United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 12

SEQ ID NO: 493867 - RNA, 22 nt, Human
uaacagagauagaaauguaaag

SEQ ID NO: 493868 - RNA, 22 nt, Human
cagggcugcuggccgugcccuc

SEQ ID NO: 493869 - RNA, 22 nt, Human
ccagcaucagcacccaaggagc

SEQ ID NO: 493870 - RNA, 22 nt, Human
gaagcuccguacuaugacuuuu

SEQ ID NO: 493871 - RNA, 19 nt, Human
ccucccacggauuccuucc

SEQ ID NO: 493872 - RNA, 22 nt, Human
gggcagguuauuggaguaggga

SEQ ID NO: 493873 - RNA, 22 nt, Human
agguauuauuagcaucucuauu

SEQ ID NO: 493874 - RNA, 22 nt, Human
uaggaaauuuuacuggucuggg

SEQ ID NO: 493875 - RNA, 20 nt, Human
uucauucauuccacaacuuc

SEQ ID NO: 493876 - RNA, 22 nt, Human
aaaauggcuuaauaggcaauaa

SEQ ID NO: 493877 - RNA, 22 nt, Human
gagccuggagcuggaacgaagc

SEQ ID NO: 493878 - RNA, 22 nt, Human
gugccugggacuugcuccggau

SEQ ID NO: 493879 - RNA, 22 nt, Human
ucugaggccuugggacagaagu

SEQ ID NO: 493880 - RNA, 22 nt, Human
ucacaugcucaccuaagccaca

SEQ ID NO: 493881 - RNA, 22 nt, Human
uucuuacagaguuuacagagcc

SEQ ID NO: 493882 - RNA, 22 nt, Human
aucucugguccaaauguuaccu

SEQ ID NO: 493883 - RNA, 22 nt, Human
aacagcuuugagcaguucugua

SEQ ID NO: 493884 - RNA, 22 nt, Human
uucugcagcaugaggcuggagc

SEQ ID NO: 493885 - RNA, 22 nt, Human
uagaauaaguugaugauauaug

SEQ ID NO: 493886 - RNA, 22 nt, Human
uuaaaugaggcugauguagauu

SEQ ID NO: 493887 - RNA, 22 nt, Human
agcuuuaugcuuccuacaagcu

SEQ ID NO: 493888 - RNA, 22 nt, Human
cagcuuccaucuccacugcccu

SEQ ID NO: 493889 - RNA, 22 nt, Human
uuaacaugucuugacuucaucu

SEQ ID NO: 493890 - RNA, 22 nt, Human
ucaagagaaggggaaauagacu

SEQ ID NO: 493891 - RNA, 22 nt, Human
auaugagaauuggaaaauauca

SEQ ID NO: 493892 - RNA, 22 nt, Human
cauugcaccacauugcaucccu

SEQ ID NO: 493893 - RNA, 22 nt, Human
gagaagggggcucgaguguccu

SEQ ID NO: 493894 - RNA, 22 nt, Human
auaacagagagcuacugaacug

SEQ ID NO: 493895 - RNA, 22 nt, Human
gguccccagcaguggcugcuuc

SEQ ID NO: 493896 - RNA, 22 nt, Human
uuugcaaauauguguuucuauu

SEQ ID NO: 493897 - RNA, 22 nt, Human
uguauuaacauuaauaaaaugg

SEQ ID NO: 493898 - RNA, 22 nt, Human
acucuggcagcagaaccagugu

SEQ ID NO: 493899 - RNA, 22 nt, Human
ucuuaacaagcuccucagugcu

SEQ ID NO: 493900 - RNA, 22 nt, Human
gcccuuccuuagacagcaggau

SEQ ID NO: 493901 - RNA, 23 nt, Human
aggaagaggcaauuucucuuaga

SEQ ID NO: 493902 - RNA, 22 nt, Human
guuuccugcgugugccacucau

SEQ ID NO: 493903 - RNA, 22 nt, Human
cugggcuagaaggaccaggaug

SEQ ID NO: 493904 - RNA, 22 nt, Human
ggaaagcuuuguacuugaaaac

SEQ ID NO: 493905 - RNA, 22 nt, Human
uaugcuuucauucauaugugag

SEQ ID NO: 493906 - RNA, 22 nt, Human
gaagccccaaacccucgccauc

SEQ ID NO: 493907 - RNA, 22 nt, Human
auuugugaauuaagcaugucaa

SEQ ID NO: 493908 - RNA, 22 nt, Human
aaauuagaucaguggauuuucu

SEQ ID NO: 493909 - RNA, 22 nt, Human
uggcccugacugauguggaggg

SEQ ID NO: 493910 - RNA, 22 nt, Human
cuucuuuccuuccuccaguggc

SEQ ID NO: 493911 - RNA, 22 nt, Human
aaauguguuuagaugguuuauu

SEQ ID NO: 493912 - RNA, 22 nt, Human
aaacaugagcaucucuucaagc

SEQ ID NO: 493913 - RNA, 22 nt, Human
gugccagggggcacugaacaga

SEQ ID NO: 493914 - RNA, 19 nt, Human
ucucuggggacacuuucac

SEQ ID NO: 493915 - RNA, 18 nt, Human
gucuggaggucaggagcu

SEQ ID NO: 493916 - RNA, 23 nt, Human
auccacauuacaguaucauacaa

SEQ ID NO: 493917 - RNA, 22 nt, Human
ugaaaugacagucuuaagcucu

SEQ ID NO: 493918 - RNA, 22 nt, Human
aagagcaucgguggagccccca

SEQ ID NO: 493919 - RNA, 22 nt, Human
ggccugucucacccccgggugc

SEQ ID NO: 493920 - RNA, 22 nt, Human
uccaaguugauguuucuuaaau

SEQ ID NO: 493921 - RNA, 18 nt, Human
auccugggccagucuuuc

SEQ ID NO: 493922 - RNA, 22 nt, Human
cuucaggaaaaucucuaaggau

SEQ ID NO: 493923 - RNA, 22 nt, Human
agucccagugagaugaaccagg

SEQ ID NO: 493924 - RNA, 20 nt, Human
cuuuggcaaugagaacaggg

SEQ ID NO: 493925 - RNA, 22 nt, Human
cccacucuggcucccuucuagu

SEQ ID NO: 493926 - RNA, 22 nt, Human
agcugugggauuugggugugcc

SEQ ID NO: 493927 - RNA, 22 nt, Human
cuuggggcugucacucuggcau

SEQ ID NO: 493928 - RNA, 20 nt, Human
accauaauguuaauuacaaa

SEQ ID NO: 493929 - RNA, 22 nt, Human
cuucuucccagcuucccucacc

SEQ ID NO: 493930 - RNA, 22 nt, Human
caaagguaguauauauauuguu

SEQ ID NO: 493931 - RNA, 22 nt, Human
cucuggcuggcugggccucagu

SEQ ID NO: 493932 - RNA, 22 nt, Human
cagaggcugccagccaugugca

SEQ ID NO: 493933 - RNA, 22 nt, Human
aggcucugugauccacaaugag

SEQ ID NO: 493934 - RNA, 22 nt, Human
gcccuggaaucucuccauggga

SEQ ID NO: 493935 - RNA, 22 nt, Human
accagcagaguugaggaggaca

SEQ ID NO: 493936 - RNA, 22 nt, Human
acagaugaguuagaauaggcag

SEQ ID NO: 493937 - RNA, 22 nt, Human
ucagggcauucaagaggccugg

SEQ ID NO: 493938 - RNA, 22 nt, Human
guggcaggucccauuggagcag

SEQ ID NO: 493939 - RNA, 22 nt, Human
ucuccuuuaagauuuccucagg

SEQ ID NO: 493940 - RNA, 22 nt, Human
caguauuuguuacagcauuagc

SEQ ID NO: 493941 - RNA, 22 nt, Human
cagaaacuauguaagaaaguga

SEQ ID NO: 493942 - RNA, 19 nt, Human
uguugaagauuauuugugg

SEQ ID NO: 493943 - RNA, 20 nt, Human
ucaggcuccgcauuaacuua

SEQ ID NO: 493944 - RNA, 22 nt, Human
ucauaaagauacuaagugaguu

SEQ ID NO: 493945 - RNA, 22 nt, Human
cccacccugggcuacacaucca

SEQ ID NO: 493946 - RNA, 19 nt, Human
ugcuucuggggcuucucca

SEQ ID NO: 493947 - RNA, 22 nt, Human
cagagggcucggcggccgcucc

SEQ ID NO: 493948 - RNA, 22 nt, Human
uggccucugugggagcugagca

SEQ ID NO: 493949 - RNA, 22 nt, Human
ugaaugaugaggggagaauaau

SEQ ID NO: 493950 - RNA, 22 nt, Human
uccuggcuccagcagcucuucc

SEQ ID NO: 493951 - RNA, 22 nt, Human
gcuggccagggcugcucgcgga

SEQ ID NO: 493952 - RNA, 22 nt, Human
cugguacaaaaugcugauauca

SEQ ID NO: 493953 - RNA, 22 nt, Human
ccccaggcagggccuaacagag

SEQ ID NO: 493954 - RNA, 22 nt, Human
aggcagcagggccacuggcuga

SEQ ID NO: 493955 - RNA, 17 nt, Human
ggcaggugcggggccgc

SEQ ID NO: 493956 - RNA, 22 nt, Human
gucugagacugggcacauaccu

SEQ ID NO: 493957 - RNA, 22 nt, Human
augauugaccaucugcugggcu

SEQ ID NO: 493958 - RNA, 22 nt, Human
gaagacaucauggagaggauag

SEQ ID NO: 493959 - RNA, 22 nt, Human
uuuagcuuuaccucauagauuu

SEQ ID NO: 493960 - RNA, 22 nt, Human
ggagaggguagggguccugccc

SEQ ID NO: 493961 - RNA, 22 nt, Human
cagguccuuuaguguccagaac

SEQ ID NO: 493962 - RNA, 18 nt, Human
agggaucaucacugcagc

SEQ ID NO: 493963 - RNA, 22 nt, Human
ugggccuggacaaggccacuag

SEQ ID NO: 493964 - RNA, 21 nt, Human
acacaaaccuccucagccugg

SEQ ID NO: 493965 - RNA, 22 nt, Human
guagccauuggcaaugaagccu

SEQ ID NO: 493966 - RNA, 22 nt, Human
uuugacagacauuuacuacauu

SEQ ID NO: 493967 - RNA, 22 nt, Human
ucuaggagcuuaaaggaggcca

SEQ ID NO: 493968 - RNA, 19 nt, Human
gcuccugggccucacucau

SEQ ID NO: 493969 - RNA, 22 nt, Human
gggaagggagggaccucagucu

SEQ ID NO: 493970 - RNA, 22 nt, Human
gccuggaguggacuuggccccu

SEQ ID NO: 493971 - RNA, 22 nt, Human
gaaggauuugagauuauccuag

SEQ ID NO: 493972 - RNA, 19 nt, Human
gcuguacaguaaggagaca

SEQ ID NO: 493973 - RNA, 22 nt, Human
aaugcaccuaccuugauucugc

SEQ ID NO: 493974 - RNA, 22 nt, Human
cuucauguucugccuguggaag

SEQ ID NO: 493975 - RNA, 22 nt, Human
uucuucugacacugaugcugua

SEQ ID NO: 493976 - RNA, 22 nt, Human
cuugaaucuggcuuugccacuu

SEQ ID NO: 493977 - RNA, 21 nt, Human
uuucugucucugccacuaguu

SEQ ID NO: 493978 - RNA, 22 nt, Human
cugcccucccaguugguccgug

SEQ ID NO: 493979 - RNA, 22 nt, Human
cuuuccaaugcauuuccaaugu

SEQ ID NO: 493980 - RNA, 22 nt, Human
aagagguaaccauagcaaccac

SEQ ID NO: 493981 - RNA, 22 nt, Human
uacaaaaggaagagggaucuua

SEQ ID NO: 493982 - RNA, 22 nt, Human
augaaugagugcuagguuuguc

SEQ ID NO: 493983 - RNA, 22 nt, Human
auguuaaaugguuuauuauuaa

SEQ ID NO: 493984 - RNA, 22 nt, Human
uccuuggcuuucuggagcuucu

SEQ ID NO: 493985 - RNA, 22 nt, Human
gaagcagcaaguauaggacagg

SEQ ID NO: 493986 - RNA, 22 nt, Human
uaaauguguuagucaugguuuu

SEQ ID NO: 493987 - RNA, 22 nt, Human
guauagaaacccagaaagauag

SEQ ID NO: 493988 - RNA, 22 nt, Human
cuggguguagauggaaguuugg

SEQ ID NO: 493989 - RNA, 22 nt, Human
uguccuggaaaaauggagaguu

SEQ ID NO: 493990 - RNA, 22 nt, Human
uucccucuccuacucaggaaag

SEQ ID NO: 493991 - RNA, 22 nt, Human
agccaaggagugcagguggcuu

SEQ ID NO: 493992 - RNA, 19 nt, Human
gcccuccucacugagcucu

SEQ ID NO: 493993 - RNA, 22 nt, Human
ggcgccagcccaggccgucgug

SEQ ID NO: 493994 - RNA, 18 nt, Human
gcugcugguggagggagc

SEQ ID NO: 493995 - RNA, 22 nt, Human
uuuauguaguuacggacuauca

SEQ ID NO: 493996 - RNA, 22 nt, Human
aaggagaaggguaaucaacaca

SEQ ID NO: 493997 - RNA, 22 nt, Human
ccuccugggccuugcucuguga

SEQ ID NO: 493998 - RNA, 22 nt, Human
ugaucccaaucuuuccugcucc

SEQ ID NO: 493999 - RNA, 22 nt, Human
uuucuuguaagauguuuauuaa

SEQ ID NO: 494000 - RNA, 22 nt, Human
guguggcuguuuagugacuuuc

SEQ ID NO: 494001 - RNA, 22 nt, Human
caggacugauguuccuccagcc

SEQ ID NO: 494002 - RNA, 21 nt, Human
gaaaagcaagggaguagaaca

SEQ ID NO: 494003 - RNA, 22 nt, Human
cccaggcugaugggaugggcca

SEQ ID NO: 494004 - RNA, 22 nt, Human
acuccagggcuccaucccuugu

SEQ ID NO: 494005 - RNA, 22 nt, Human
uguggcugccacccugaagccg

SEQ ID NO: 494006 - RNA, 22 nt, Human
ucacugggagaugugggaaggg

SEQ ID NO: 494007 - RNA, 22 nt, Human
ugggcugcuuccucagcugaga

SEQ ID NO: 494008 - RNA, 22 nt, Human
aaauuuaagaagugugugcgug

SEQ ID NO: 494009 - RNA, 22 nt, Human
ccagcccugccucucagggccc

SEQ ID NO: 494010 - RNA, 22 nt, Human
uguuucaggaccuaucuuuuag

SEQ ID NO: 494011 - RNA, 22 nt, Human
cagcuggcaaguggagcagggu

SEQ ID NO: 494012 - RNA, 22 nt, Human
uuucauugcagagucugugugc

SEQ ID NO: 494013 - RNA, 22 nt, Human
aguuuauguagaauuggcaaua

SEQ ID NO: 494014 - RNA, 20 nt, Human
acuguucaagggccuggugg

SEQ ID NO: 494015 - RNA, 22 nt, Human
cugauauucauuauggagcucc

SEQ ID NO: 494016 - RNA, 22 nt, Human
aaaguuuggauccagcaaaaga

SEQ ID NO: 494017 - RNA, 22 nt, Human
aacuuucugaaaagcuugauca

SEQ ID NO: 494018 - RNA, 22 nt, Human
gcacagggcaacaggucuguua

SEQ ID NO: 494019 - RNA, 22 nt, Human
ucagaacaauugggaaccauua

SEQ ID NO: 494020 - RNA, 20 nt, Human
uggagcugugguaaggagca

SEQ ID NO: 494021 - RNA, 22 nt, Human
ccugagcuggaagagcuugugc

SEQ ID NO: 494022 - RNA, 22 nt, Human
uuucagagguaugcugcuuauc

SEQ ID NO: 494023 - RNA, 22 nt, Human
cuggcagcgcagcaugaagucg

SEQ ID NO: 494024 - RNA, 17 nt, Human
gucaacaggauuucuuu

SEQ ID NO: 494025 - RNA, 22 nt, Human
ccucuggggucuagcaauagca

SEQ ID NO: 494026 - RNA, 20 nt, Human
ccuaggcaugcugagucucc

SEQ ID NO: 494027 - RNA, 22 nt, Human
aucagagugggucuggcaugag

SEQ ID NO: 494028 - RNA, 22 nt, Human
gggagggccaggcucacccagg

SEQ ID NO: 494029 - RNA, 22 nt, Human
ucuguugcaaugugcaugguga

SEQ ID NO: 494030 - RNA, 22 nt, Human
uguagauuuuggagucuacaag

SEQ ID NO: 494031 - RNA, 22 nt, Human
gagcacugagcuggaauuggag

SEQ ID NO: 494032 - RNA, 22 nt, Human
ugcauuguuugauaggugaauu

SEQ ID NO: 494033 - RNA, 22 nt, Human
ccaguguucauaauuuuacacu

SEQ ID NO: 494034 - RNA, 22 nt, Human
aaauauguauggaguucaugaa

SEQ ID NO: 494035 - RNA, 22 nt, Human
aaccccgcucaggcugggugag

SEQ ID NO: 494036 - RNA, 22 nt, Human
ucacugcaaucucugccuucca

SEQ ID NO: 494037 - RNA, 22 nt, Human
agauuucacaugcugcucuauu

SEQ ID NO: 494038 - RNA, 22 nt, Human
aggagucacucagggcuucauc

SEQ ID NO: 494039 - RNA, 22 nt, Human
cccucugcucaggugcauaggc

SEQ ID NO: 494040 - RNA, 22 nt, Human
ggaaggcagugaaggggcugau

SEQ ID NO: 494041 - RNA, 22 nt, Human
ugggcagacauugaguuuguuc

SEQ ID NO: 494042 - RNA, 22 nt, Human
gggacugggagauccuccuggc

SEQ ID NO: 494043 - RNA, 22 nt, Human
cuggagccgcauggagcaggga

SEQ ID NO: 494044 - RNA, 22 nt, Human
acauucugaaaaacaguguuuu

SEQ ID NO: 494045 - RNA, 22 nt, Human
gggcacaggaauuugggaugug

SEQ ID NO: 494046 - RNA, 22 nt, Human
ggugggggagacuuggucaaga

SEQ ID NO: 494047 - RNA, 22 nt, Human
cucuucaguaaaugacacuguu

SEQ ID NO: 494048 - RNA, 22 nt, Human
cauuuguuaauuacuauuaucu

SEQ ID NO: 494049 - RNA, 21 nt, Human
ucccagggccaggugccauca

SEQ ID NO: 494050 - RNA, 22 nt, Human
uucucuggauguuucucaguca

SEQ ID NO: 494051 - RNA, 22 nt, Human
gugcccugaucgcuaggcuccc

SEQ ID NO: 494052 - RNA, 22 nt, Human
caaaagauacuugcaucuaacu

SEQ ID NO: 494053 - RNA, 22 nt, Human
auucagcacaucuuuguacagc

SEQ ID NO: 494054 - RNA, 22 nt, Human
uuugcauuacuugacuuuaguu

SEQ ID NO: 494055 - RNA, 20 nt, Human
ugcagcuucaccugugucau

SEQ ID NO: 494056 - RNA, 22 nt, Human
cccaggcacagauuaucccaau

SEQ ID NO: 494057 - RNA, 19 nt, Human
ggccuugcucuguggcagc

SEQ ID NO: 494058 - RNA, 22 nt, Human
ggucuggcaggugaggacucag

SEQ ID NO: 494059 - RNA, 22 nt, Human
gugcccaggcccaaggcaccac

SEQ ID NO: 494060 - RNA, 22 nt, Human
ggcucuucugguugucacauuu

SEQ ID NO: 494061 - RNA, 22 nt, Human
gggaccuggggacuccuuguuc

SEQ ID NO: 494062 - RNA, 22 nt, Human
ucagugcacagagauuuuuguu

SEQ ID NO: 494063 - RNA, 22 nt, Human
ggcagccauacucagaccuggg

SEQ ID NO: 494064 - RNA, 22 nt, Human
aggcacugcuucuaaguaggaa

SEQ ID NO: 494065 - RNA, 22 nt, Human
guccacagagggcugggcaggc

SEQ ID NO: 494066 - RNA, 22 nt, Human
aggcauggauggauccagggcu

SEQ ID NO: 494067 - RNA, 22 nt, Human
agcagaugaaucccagauaaag

SEQ ID NO: 494068 - RNA, 22 nt, Human
agagccugcagcugugaagaaa

SEQ ID NO: 494069 - RNA, 22 nt, Human
aaaggccacuugaaggauuuuu

SEQ ID NO: 494070 - RNA, 22 nt, Human
ccccuccuggccacacugucag

SEQ ID NO: 494071 - RNA, 20 nt, Human
acuuucucgguuucucaccu

SEQ ID NO: 494072 - RNA, 22 nt, Human
uggagaauuaggccaaaucucc

SEQ ID NO: 494073 - RNA, 22 nt, Human
cuuccagguccuucuugagaag

SEQ ID NO: 494074 - RNA, 23 nt, Human
uugcacaguguauacacauauuu

SEQ ID NO: 494075 - RNA, 23 nt, Human
uguuccagauacgccuuuuccuc

SEQ ID NO: 494076 - RNA, 22 nt, Human
cagggccaguucucgcagcagu

SEQ ID NO: 494077 - RNA, 22 nt, Human
agugauggagcuuccucugcua

SEQ ID NO: 494078 - RNA, 22 nt, Human
agaugaaagauuuuuauagaga

SEQ ID NO: 494079 - RNA, 22 nt, Human
agaacuuaggaacaacagcuua

SEQ ID NO: 494080 - RNA, 22 nt, Human
aaaauagauucuaggaugucuu

SEQ ID NO: 494081 - RNA, 22 nt, Human
cugggccugucagggcuuuuug

SEQ ID NO: 494082 - RNA, 19 nt, Human
gugggccaggcagaaggcu

SEQ ID NO: 494083 - RNA, 22 nt, Human
guggcauugacauguaaacagu

SEQ ID NO: 494084 - RNA, 22 nt, Human
cucucuggaagggggagcugau

SEQ ID NO: 494085 - RNA, 22 nt, Human
gaccugagauuuugaggcucau

SEQ ID NO: 494086 - RNA, 22 nt, Human
gacuguggucuguucuccaggu

SEQ ID NO: 494087 - RNA, 22 nt, Human
ucaggcacugcuuucugauaug

SEQ ID NO: 494088 - RNA, 22 nt, Human
cagcucuggcagagcccaaccc

SEQ ID NO: 494089 - RNA, 22 nt, Human
gauggcacacagacauccccgc

SEQ ID NO: 494090 - RNA, 22 nt, Human
caaugauaauggcuguauuuau

SEQ ID NO: 494091 - RNA, 22 nt, Human
guggagccaggggcuguaggua

SEQ ID NO: 494092 - RNA, 22 nt, Human
uggagaauucuauguugagggg

SEQ ID NO: 494093 - RNA, 22 nt, Human
ggaucuucagccagcaggugcc

SEQ ID NO: 494094 - RNA, 22 nt, Human
cugggcacaggggagcagaguc

SEQ ID NO: 494095 - RNA, 22 nt, Human
acagaaugcguagugcauguug

SEQ ID NO: 494096 - RNA, 22 nt, Human
ugggccugaaggagcugcgccc

SEQ ID NO: 494097 - RNA, 22 nt, Human
gcucugugccacaugcaguguu

SEQ ID NO: 494098 - RNA, 22 nt, Human
aaagccuucuucggucugugau

SEQ ID NO: 494099 - RNA, 22 nt, Human
acaagaauuuacauguagugga

SEQ ID NO: 494100 - RNA, 22 nt, Human
agucugugaaaagauaggaagu

SEQ ID NO: 494101 - RNA, 22 nt, Human
cuggcagcccaaccuagagucu

SEQ ID NO: 494102 - RNA, 22 nt, Human
cagggcuucgcuccuggugcac

SEQ ID NO: 494103 - RNA, 22 nt, Human
aacuagucagugauucucagaa

SEQ ID NO: 494104 - RNA, 20 nt, Human
gcugucugacaguucccaga

SEQ ID NO: 494105 - RNA, 22 nt, Human
aagugugggaaguagguggcga

SEQ ID NO: 494106 - RNA, 22 nt, Human
aggucucaagagaaaaguggug

SEQ ID NO: 494107 - RNA, 22 nt, Human
gagagggccgggggccagcucc

SEQ ID NO: 494108 - RNA, 22 nt, Human
ugagcccaggaguaugaggcug

SEQ ID NO: 494109 - RNA, 22 nt, Human
aauguguuuuaugagagaauau

SEQ ID NO: 494110 - RNA, 22 nt, Human
agaggaaucugucuagacacaa

SEQ ID NO: 494111 - RNA, 22 nt, Human
gaaagugccucaguccucuuau

SEQ ID NO: 494112 - RNA, 22 nt, Human
gggaccuggacaugugugugcu

SEQ ID NO: 494113 - RNA, 22 nt, Human
aggcagguuuacucuuauuugg

SEQ ID NO: 494114 - RNA, 22 nt, Human
uaggaaaugcugucuuauugua

SEQ ID NO: 494115 - RNA, 22 nt, Human
auuuaauuuacauuugacagag

SEQ ID NO: 494116 - RNA, 20 nt, Human
gcuuccaccugaagcgcacc

SEQ ID NO: 494117 - RNA, 21 nt, Human
ugacugaggcuucuucacaca

SEQ ID NO: 494118 - RNA, 22 nt, Human
auggacaggaacucccuuggca

SEQ ID NO: 494119 - RNA, 22 nt, Human
ucacauucucagcaucuauaca

SEQ ID NO: 494120 - RNA, 22 nt, Human
gggaaggcaggauucucuggug

SEQ ID NO: 494121 - RNA, 22 nt, Human
cugccuggccugaucuccacgc

SEQ ID NO: 494122 - RNA, 22 nt, Human
ucaggguugcugugaucagucc

SEQ ID NO: 494123 - RNA, 22 nt, Human
cucuuuguggaacggcaguguc

SEQ ID NO: 494124 - RNA, 22 nt, Human
cauugaaaaacguugacugagu

SEQ ID NO: 494125 - RNA, 22 nt, Human
gaggcaccagacauggccucau

SEQ ID NO: 494126 - RNA, 23 nt, Human
aggucuggacccuuggccccugc

SEQ ID NO: 494127 - RNA, 22 nt, Human
uauuaggguaaauuugacaugc

SEQ ID NO: 494128 - RNA, 22 nt, Human
cucagcugcagccuggcuggca

SEQ ID NO: 494129 - RNA, 22 nt, Human
cagcagcacucugcgggucccc

SEQ ID NO: 494130 - RNA, 22 nt, Human
cuucuuugaaaaaggcagucag

SEQ ID NO: 494131 - RNA, 22 nt, Human
ggacacagauaaucacacagau

SEQ ID NO: 494132 - RNA, 22 nt, Human
cccccaaaguuugcacggauaa

SEQ ID NO: 494133 - RNA, 22 nt, Human
ccagguccuguuuucaccacag

SEQ ID NO: 494134 - RNA, 22 nt, Human
gagggcuccacacgggcccagc

SEQ ID NO: 494135 - RNA, 22 nt, Human
uguauacauuuaacuagauaga

SEQ ID NO: 494136 - RNA, 22 nt, Human
ucagggacgugagcucagaguc

SEQ ID NO: 494137 - RNA, 22 nt, Human
gggacagacccaugggccaggu

SEQ ID NO: 494138 - RNA, 22 nt, Human
uuuacaagucuguugaucccaa

SEQ ID NO: 494139 - RNA, 22 nt, Human
ugcauuguugaauauuucauag

SEQ ID NO: 494140 - RNA, 22 nt, Human
ugaguaauaaacugucuugcuc

SEQ ID NO: 494141 - RNA, 22 nt, Human
ugcagccaggaaauauuugcug

SEQ ID NO: 494142 - RNA, 22 nt, Human
aggcucugugacaaucaagcug

SEQ ID NO: 494143 - RNA, 22 nt, Human
gcagaggccaggccaccagcaa

SEQ ID NO: 494144 - RNA, 22 nt, Human
caaugauucugcaacugugugc

SEQ ID NO: 494145 - RNA, 19 nt, Human
uguagcaguuuaaaacaac

SEQ ID NO: 494146 - RNA, 22 nt, Human
uuuauuuauccuucuggauugc

SEQ ID NO: 494147 - RNA, 22 nt, Human
guguccugggcugguagagcug

SEQ ID NO: 494148 - RNA, 22 nt, Human
ugcuagugugugagauguucaa

SEQ ID NO: 494149 - RNA, 19 nt, Human
aagcaauguugugaaucua

SEQ ID NO: 494150 - RNA, 22 nt, Human
uuagccauuuuauacaagugua

SEQ ID NO: 494151 - RNA, 21 nt, Human
ugagaaguaugucuucagcca

SEQ ID NO: 494152 - RNA, 22 nt, Human
ugagucuguauguccagauuua

SEQ ID NO: 494153 - RNA, 22 nt, Human
gcucugugggugaguagaaucu

SEQ ID NO: 494154 - RNA, 23 nt, Human
cuucagcagaaacauaaauucuc

SEQ ID NO: 494155 - RNA, 22 nt, Human
ucccaggaggugcuuccuagga

SEQ ID NO: 494156 - RNA, 22 nt, Human
caguagacacauuaauauggaa

SEQ ID NO: 494157 - RNA, 22 nt, Human
ggugaggggagagugaaagaaa

SEQ ID NO: 494158 - RNA, 22 nt, Human
agcugacugaugaagaggccuu

SEQ ID NO: 494159 - RNA, 22 nt, Human
ggagagcugguagcuggcucca

SEQ ID NO: 494160 - RNA, 22 nt, Human
gcucaguguucaucuguaugca

SEQ ID NO: 494161 - RNA, 22 nt, Human
uaguaaguagcuaauauuuacu

SEQ ID NO: 494162 - RNA, 22 nt, Human
agacaaagacagcaucucaggu

SEQ ID NO: 494163 - RNA, 22 nt, Human
aaagccuuggucaucugguucc

SEQ ID NO: 494164 - RNA, 22 nt, Human
guccucugacucagccuuggga

SEQ ID NO: 494165 - RNA, 22 nt, Human
ggguggaggagaacaggcccca

SEQ ID NO: 494166 - RNA, 22 nt, Human
ugccugucuuggaguccuggcc

SEQ ID NO: 494167 - RNA, 22 nt, Human
ccagagugacgugaagugugaa

SEQ ID NO: 494168 - RNA, 22 nt, Human
auucuuggagcagucaaagaag

SEQ ID NO: 494169 - RNA, 22 nt, Human
ccuggcagaauauuaaagugca

SEQ ID NO: 494170 - RNA, 22 nt, Human
agaggccacuuugccugugaug

SEQ ID NO: 494171 - RNA, 22 nt, Human
ccuggguuaguaucuguuucca

SEQ ID NO: 494172 - RNA, 22 nt, Human
ucaauuaugccauugcaauauu

SEQ ID NO: 494173 - RNA, 22 nt, Human
cacagaauuaagggagaaauau

SEQ ID NO: 494174 - RNA, 22 nt, Human
uucuuuuuggauagcugaugaa

SEQ ID NO: 494175 - RNA, 18 nt, Human
uguagagccagguuugcc

SEQ ID NO: 494176 - RNA, 22 nt, Human
ucuacugugguccuuguaacca

SEQ ID NO: 494177 - RNA, 22 nt, Human
gcucacuggccugaagaggacg

SEQ ID NO: 494178 - RNA, 22 nt, Human
ucaggcucccugcugggcucug

SEQ ID NO: 494179 - RNA, 22 nt, Human
augggaggaucacuugaggcca

SEQ ID NO: 494180 - RNA, 22 nt, Human
gagggcaggggucuugcacggu

SEQ ID NO: 494181 - RNA, 22 nt, Human
cccaggacuaaugagcucuacg

SEQ ID NO: 494182 - RNA, 16 nt, Human
uggaggcaucuggccc

SEQ ID NO: 494183 - RNA, 22 nt, Human
ucucugggagccaggaugacac

SEQ ID NO: 494184 - RNA, 20 nt, Human
cacagagucuugcagcguuc

SEQ ID NO: 494185 - RNA, 22 nt, Human
gcucagaggcacgaccucuugg

SEQ ID NO: 494186 - RNA, 22 nt, Human
uuccuggggggauagauuucac

SEQ ID NO: 494187 - RNA, 22 nt, Human
ggcagauggaagaggcuggguc

SEQ ID NO: 494188 - RNA, 22 nt, Human
gggaaacuuucacaauguccag

SEQ ID NO: 494189 - RNA, 22 nt, Human
cuggcccagagcucuggccuuu

SEQ ID NO: 494190 - RNA, 22 nt, Human
cugaggccucuguucaccagaa

SEQ ID NO: 494191 - RNA, 22 nt, Human
uucacaauaggagcaugcaaau

SEQ ID NO: 494192 - RNA, 22 nt, Human
gugcucuguguauuaggauguc

SEQ ID NO: 494193 - RNA, 22 nt, Human
ccugggcauucuuugaguucuc

SEQ ID NO: 494194 - RNA, 19 nt, Human
acagaagcauagaaaagga

SEQ ID NO: 494195 - RNA, 22 nt, Human
aaaguagauuucucauggcgaa

SEQ ID NO: 494196 - RNA, 22 nt, Human
gguugguaacucccugugcagu

SEQ ID NO: 494197 - RNA, 22 nt, Human
cagaccccgaguuugcagaguu

SEQ ID NO: 494198 - RNA, 22 nt, Human
gugugcauguggaagcauguau

SEQ ID NO: 494199 - RNA, 22 nt, Human
ggcaggcuccagagcccucucc

SEQ ID NO: 494200 - RNA, 22 nt, Human
aggagaggguggcauuaaguuu

SEQ ID NO: 494201 - RNA, 22 nt, Human
uguaggauuuucaccagaccuu

SEQ ID NO: 494202 - RNA, 22 nt, Human
uuuaauguagcgugaaaugauu

SEQ ID NO: 494203 - RNA, 22 nt, Human
caagaugaaacuacagggagga

SEQ ID NO: 494204 - RNA, 22 nt, Human
ccuggcucugguucccucagcu

SEQ ID NO: 494205 - RNA, 22 nt, Human
gcaaacauaauaugaagacacu

SEQ ID NO: 494206 - RNA, 22 nt, Human
aaacucuuuccacgauuacuuu

SEQ ID NO: 494207 - RNA, 22 nt, Human
cagagcuucugacagcugcugc

SEQ ID NO: 494208 - RNA, 22 nt, Human
ccaggaucuggguccaugggac

SEQ ID NO: 494209 - RNA, 22 nt, Human
aggacaugaagaaagggcaagg

SEQ ID NO: 494210 - RNA, 22 nt, Human
ggcucuggggggaagucuguug

SEQ ID NO: 494211 - RNA, 22 nt, Human
gaugagaaggcucagauccaaa

SEQ ID NO: 494212 - RNA, 22 nt, Human
ugauuucauaguauauacauga

SEQ ID NO: 494213 - RNA, 21 nt, Human
aguucauacugaguaacaaaa

SEQ ID NO: 494214 - RNA, 23 nt, Human
uguggcugagaaauugacaacuu

SEQ ID NO: 494215 - RNA, 22 nt, Human
ucagugcacaaugacgguggcu

SEQ ID NO: 494216 - RNA, 23 nt, Human
ucagagagcuguugagagcugcc

SEQ ID NO: 494217 - RNA, 19 nt, Human
cucucacucgccacauccu

SEQ ID NO: 494218 - RNA, 22 nt, Human
uggcacagacagcacagcaaug

SEQ ID NO: 494219 - RNA, 22 nt, Human
ucaaaucaccaaacucacuggc

SEQ ID NO: 494220 - RNA, 22 nt, Human
auucuacacaaagcaagaagac

SEQ ID NO: 494221 - RNA, 21 nt, Human
acauacauaccuuaccaccuu

SEQ ID NO: 494222 - RNA, 20 nt, Human
gagauuuccaaucaugccca

SEQ ID NO: 494223 - RNA, 22 nt, Human
ccagggucuuggagaggagugc

SEQ ID NO: 494224 - RNA, 17 nt, Human
uuccccugaccaagccu

SEQ ID NO: 494225 - RNA, 18 nt, Human
cuacauucauaggaaagg

SEQ ID NO: 494226 - RNA, 22 nt, Human
ugugugccagauacaagcacug

SEQ ID NO: 494227 - RNA, 22 nt, Human
augggaggguggaaaggcucug

SEQ ID NO: 494228 - RNA, 22 nt, Human
uuuugccugagauccgagucug

SEQ ID NO: 494229 - RNA, 17 nt, Human
cucugggcagccugggg

SEQ ID NO: 494230 - RNA, 17 nt, Human
uguuaauuccaaugaua

SEQ ID NO: 494231 - RNA, 22 nt, Human
ucaguuuugaaaacauugaaug

SEQ ID NO: 494232 - RNA, 22 nt, Human
aguuuucucacaucaaaaauga

SEQ ID NO: 494233 - RNA, 22 nt, Human
acagaauuaaaguguuugugga

SEQ ID NO: 494234 - RNA, 19 nt, Human
acagugcaugggaccuggu

SEQ ID NO: 494235 - RNA, 23 nt, Human
uucuuuguggauaaucuccagug

SEQ ID NO: 494236 - RNA, 20 nt, Human
ugcagaagaacguucugguu

SEQ ID NO: 494237 - RNA, 20 nt, Human
caugccugcugguaucuggc

SEQ ID NO: 494238 - RNA, 22 nt, Human
ccacugucagaggggcugugcc

SEQ ID NO: 494239 - RNA, 22 nt, Human
guguaugagccuccagcugggc

SEQ ID NO: 494240 - RNA, 22 nt, Human
uauucacauguacauaugcuca

SEQ ID NO: 494241 - RNA, 21 nt, Human
uaaggccaagucuauuucugu

SEQ ID NO: 494242 - RNA, 22 nt, Human
aagauguuuagguaaaaaguuu

SEQ ID NO: 494243 - RNA, 22 nt, Human
uccuuuuugguccaaggugacc

SEQ ID NO: 494244 - RNA, 22 nt, Human
ucugcauauuguuaauggaaug

SEQ ID NO: 494245 - RNA, 22 nt, Human
ggauacagcggcuucugcgcga

SEQ ID NO: 494246 - RNA, 22 nt, Human
uucaggaucauuuguuuuaucu

SEQ ID NO: 494247 - RNA, 22 nt, Human
cccuggaggaaaaucugaggcu

SEQ ID NO: 494248 - RNA, 22 nt, Human
gcugagguaggagguugcagug

SEQ ID NO: 494249 - RNA, 22 nt, Human
aagcuuuaugaucucucagcua

SEQ ID NO: 494250 - RNA, 22 nt, Human
cugacucagcagcugaugaucc

SEQ ID NO: 494251 - RNA, 22 nt, Human
gcugggagcaaguacucaucuu

SEQ ID NO: 494252 - RNA, 22 nt, Human
auucagucaaaccacuggucau

SEQ ID NO: 494253 - RNA, 22 nt, Human
aacuuucaggcaaugaauauuu

SEQ ID NO: 494254 - RNA, 22 nt, Human
gaggcaggcagauugcuugagg

SEQ ID NO: 494255 - RNA, 18 nt, Human
cuguucuagaacuccugu

SEQ ID NO: 494256 - RNA, 21 nt, Human
uggcccuggccacggcugcca

SEQ ID NO: 494257 - RNA, 22 nt, Human
gggcuuuaugagauugagaucu

SEQ ID NO: 494258 - RNA, 22 nt, Human
uagggcagagcuuguacacgau

SEQ ID NO: 494259 - RNA, 22 nt, Human
guccagcugaucuugacccagc

SEQ ID NO: 494260 - RNA, 22 nt, Human
ugggcuccguugccuggggcag

SEQ ID NO: 494261 - RNA, 22 nt, Human
cacaguguaguuaaugugacau

SEQ ID NO: 494262 - RNA, 22 nt, Human
aggugcagcugacaccaugugg

SEQ ID NO: 494263 - RNA, 22 nt, Human
gcagaacauuucacaguaucuu

SEQ ID NO: 494264 - RNA, 22 nt, Human
gagcaacaguuuaugguuuuuc

SEQ ID NO: 494265 - RNA, 22 nt, Human
uguggcugugccgucacacgug

SEQ ID NO: 494266 - RNA, 22 nt, Human
agaaaucuuggagucuguggua

SEQ ID NO: 494267 - RNA, 22 nt, Human
uggcucagcgguggcagcagac

SEQ ID NO: 494268 - RNA, 22 nt, Human
ccugcccagcuucaccucaggc

SEQ ID NO: 494269 - RNA, 22 nt, Human
auguacaaucuaucacaagaag

SEQ ID NO: 494270 - RNA, 22 nt, Human
uaucuacuccucuuucagaugc

SEQ ID NO: 494271 - RNA, 23 nt, Human
ugggcuucugagaaagcaccuaa

SEQ ID NO: 494272 - RNA, 22 nt, Human
uauaucuuauaugugcagguac

SEQ ID NO: 494273 - RNA, 22 nt, Human
gugggcuggacccuccugcucc

SEQ ID NO: 494274 - RNA, 22 nt, Human
aaggcacuuaacgugggaggau

SEQ ID NO: 494275 - RNA, 22 nt, Human
aggacugggugcagagggcauc

SEQ ID NO: 494276 - RNA, 22 nt, Human
aaaguuugagugauuugacaca

SEQ ID NO: 494277 - RNA, 20 nt, Human
cagcaggaaaagugccucag

SEQ ID NO: 494278 - RNA, 22 nt, Human
guguccugggcauuaggcuuag

SEQ ID NO: 494279 - RNA, 22 nt, Human
ucauaauacaaagaguucugca

SEQ ID NO: 494280 - RNA, 22 nt, Human
ucaagcggacugagauacucug

SEQ ID NO: 494281 - RNA, 22 nt, Human
uguaguaagugcgcaauaaaua

SEQ ID NO: 494282 - RNA, 22 nt, Human
cugggcuccuaaccauccaggu

SEQ ID NO: 494283 - RNA, 15 nt, Human
cuguggcuaaccuaa

SEQ ID NO: 494284 - RNA, 22 nt, Human
uuuuggucagguuggucucgaa

SEQ ID NO: 494285 - RNA, 22 nt, Human
uuucagaucauuuuuuaaguac

SEQ ID NO: 494286 - RNA, 22 nt, Human
ucagccagguaauguggagaug

SEQ ID NO: 494287 - RNA, 22 nt, Human
uuucauguuuauggaaaaugag

SEQ ID NO: 494288 - RNA, 22 nt, Human
uugugcauuucucugagugugu

SEQ ID NO: 494289 - RNA, 22 nt, Human
agauuugcggcuuuacuuugca

SEQ ID NO: 494290 - RNA, 22 nt, Human
ucugucacccgagcaggcgaga

SEQ ID NO: 494291 - RNA, 22 nt, Human
uaggcugacuuguuucauaaag

SEQ ID NO: 494292 - RNA, 17 nt, Human
ggccagaggcggggcug

SEQ ID NO: 494293 - RNA, 22 nt, Human
ugagcugucugaauggugagga

SEQ ID NO: 494294 - RNA, 21 nt, Human
cacacagugaucuauccacau

SEQ ID NO: 494295 - RNA, 22 nt, Human
uucauagugauuguucagauag

SEQ ID NO: 494296 - RNA, 22 nt, Human
ucauuguuucugcuuuucauga

SEQ ID NO: 494297 - RNA, 22 nt, Human
gaaaccuuugccgauggggucc

SEQ ID NO: 494298 - RNA, 22 nt, Human
ggcugccucaaagcucaagcuc

SEQ ID NO: 494299 - RNA, 22 nt, Human
ggaggggcagccauggaacucc

SEQ ID NO: 494300 - RNA, 22 nt, Human
caggcugcagugcaguggcuau

SEQ ID NO: 494301 - RNA, 22 nt, Human
ccagcccugccagagagagcug

SEQ ID NO: 494302 - RNA, 22 nt, Human
acugcacuucacccugggugac

SEQ ID NO: 494303 - RNA, 20 nt, Human
ucagugauuaucucugagug

SEQ ID NO: 494304 - RNA, 22 nt, Human
auggaaauguaacuucugauuc

SEQ ID NO: 494305 - RNA, 22 nt, Human
uuucaguguaagguuuccagga

SEQ ID NO: 494306 - RNA, 22 nt, Human
gccaggcucuugguuauguuuu

SEQ ID NO: 494307 - RNA, 22 nt, Human
gaaucauuuauuuuugacagca

SEQ ID NO: 494308 - RNA, 22 nt, Human
acauguuagaaaugcagaaucu

SEQ ID NO: 494309 - RNA, 17 nt, Human
ucagagggaugagcagg

SEQ ID NO: 494310 - RNA, 22 nt, Human
auacuaagcucauuacauuuug

SEQ ID NO: 494311 - RNA, 22 nt, Human
ucccuggaacagagagacaacg

SEQ ID NO: 494312 - RNA, 22 nt, Human
gcaagaccuaucuaguugcugu

SEQ ID NO: 494313 - RNA, 22 nt, Human
cagcugcccugccuugcccuua

SEQ ID NO: 494314 - RNA, 22 nt, Human
ggacuggguaggagcccagggc

SEQ ID NO: 494315 - RNA, 22 nt, Human
uggcuucaagucuagguucuac

SEQ ID NO: 494316 - RNA, 22 nt, Human
acaguguuucacuuaaccguuu

SEQ ID NO: 494317 - RNA, 22 nt, Human
agugccaaacaguacauaacau

SEQ ID NO: 494318 - RNA, 22 nt, Human
ucuuggagaauggcagagaagc

SEQ ID NO: 494319 - RNA, 22 nt, Human
guggccuggauagacuccaucu

SEQ ID NO: 494320 - RNA, 22 nt, Human
ucccagccuggacccugccagu

SEQ ID NO: 494321 - RNA, 21 nt, Human
uagggggcagugggaugcuua

SEQ ID NO: 494322 - RNA, 23 nt, Human
acaaaguaauuccugcuuccaaa

SEQ ID NO: 494323 - RNA, 19 nt, Human
uccucagugacaaccucag

SEQ ID NO: 494324 - RNA, 22 nt, Human
gagggcucugaaaggaggucac

SEQ ID NO: 494325 - RNA, 22 nt, Human
cagaagcaaaugccuugcugag

SEQ ID NO: 494326 - RNA, 22 nt, Human
cccuggugguacggcacuggca

SEQ ID NO: 494327 - RNA, 22 nt, Human
cauugcacuccacccuaggcaa

SEQ ID NO: 494328 - RNA, 22 nt, Human
ugucucugcugcaccuucuggg

SEQ ID NO: 494329 - RNA, 22 nt, Human
cauggccugccuccuccuggug

SEQ ID NO: 494330 - RNA, 22 nt, Human
uguucaaaugaucuucuuaaau

SEQ ID NO: 494331 - RNA, 22 nt, Human
agugagaguauuaaugugaacu

SEQ ID NO: 494332 - RNA, 22 nt, Human
ucugggagagcugcugucagag

SEQ ID NO: 494333 - RNA, 22 nt, Human
aggcccaguagugcugccuuua

SEQ ID NO: 494334 - RNA, 22 nt, Human
accuggcuuguuucuaccuccu

SEQ ID NO: 494335 - RNA, 22 nt, Human
uauauaauuuucugccauaucc

SEQ ID NO: 494336 - RNA, 22 nt, Human
agguccuggucuugagucuuaa

SEQ ID NO: 494337 - RNA, 22 nt, Human
aaggagaaaugguagaugugca

SEQ ID NO: 494338 - RNA, 23 nt, Human
ccuggguuucagagcugcuuuuc

SEQ ID NO: 494339 - RNA, 22 nt, Human
cugggauccacgggcucccaag

SEQ ID NO: 494340 - RNA, 22 nt, Human
gcugcaggaugaggcucugcuc

SEQ ID NO: 494341 - RNA, 22 nt, Human
cugagcagaagggugcacgugc

SEQ ID NO: 494342 - RNA, 22 nt, Human
cagccugcccuggaagcccagc

SEQ ID NO: 494343 - RNA, 22 nt, Human
gcaguguuuacauauuagaaac

SEQ ID NO: 494344 - RNA, 22 nt, Human
aaguuagagauuccaucaugcu

SEQ ID NO: 494345 - RNA, 18 nt, Human
accuggcugugugagcug

SEQ ID NO: 494346 - RNA, 22 nt, Human
uggcagguuaugcgggccacau

SEQ ID NO: 494347 - RNA, 22 nt, Human
agugggugggugucugacaguu

SEQ ID NO: 494348 - RNA, 22 nt, Human
ucagccaguauuugagugcuca

SEQ ID NO: 494349 - RNA, 22 nt, Human
ggguacuuaauauuuacggggu

SEQ ID NO: 494350 - RNA, 18 nt, Human
ucuaggagaguaccuacc

SEQ ID NO: 494351 - RNA, 22 nt, Human
cuuagccagcuaacuuaagcac

SEQ ID NO: 494352 - RNA, 22 nt, Human
cagcucugccucuggggcugag

SEQ ID NO: 494353 - RNA, 22 nt, Human
ucuccgaucacagguuuucaau

SEQ ID NO: 494354 - RNA, 22 nt, Human
accuggcaugaagcaugccuua

SEQ ID NO: 494355 - RNA, 22 nt, Human
uccaguggaacagauguugccu

SEQ ID NO: 494356 - RNA, 22 nt, Human
ugcaggcuccacguuguugucc

SEQ ID NO: 494357 - RNA, 22 nt, Human
ugugucagagguagagauggca

SEQ ID NO: 494358 - RNA, 22 nt, Human
uugaaggacaucuuguuucuag

SEQ ID NO: 494359 - RNA, 17 nt, Human
ugaggccugcaucagug

SEQ ID NO: 494360 - RNA, 22 nt, Human
cccauucuucaugguuuccugu

SEQ ID NO: 494361 - RNA, 22 nt, Human
cagcugggugaucuugggcagg

SEQ ID NO: 494362 - RNA, 22 nt, Human
aguggcagagucaggguuugga

SEQ ID NO: 494363 - RNA, 22 nt, Human
auuaauuuuaccuuuguaaaca

SEQ ID NO: 494364 - RNA, 22 nt, Human
augcuccuuggcuucaaagcca

SEQ ID NO: 494365 - RNA, 22 nt, Human
aagcugccagauucagucugcu

SEQ ID NO: 494366 - RNA, 22 nt, Human
gagggcuccucacauucucuau

SEQ ID NO: 494367 - RNA, 22 nt, Human
aagccaggcugcacuugcuggg

SEQ ID NO: 494368 - RNA, 21 nt, Human
ggcuggacaucccaggagacu

SEQ ID NO: 494369 - RNA, 22 nt, Human
ccagagaguaggaggcauuauu

SEQ ID NO: 494370 - RNA, 22 nt, Human
aauuagggaaaauuuacuugua

SEQ ID NO: 494371 - RNA, 22 nt, Human
ugcauuaagaauuucugaggau

SEQ ID NO: 494372 - RNA, 22 nt, Human
ggagcugcacgcucugaagccu

SEQ ID NO: 494373 - RNA, 22 nt, Human
guuuauuauucaacuucauguu

SEQ ID NO: 494374 - RNA, 22 nt, Human
uugacaagaaucguugccuugg

SEQ ID NO: 494375 - RNA, 22 nt, Human
acuguacacgugucauuuacag

SEQ ID NO: 494376 - RNA, 22 nt, Human
augcaaauuaacauauaguaga

SEQ ID NO: 494377 - RNA, 20 nt, Human
uuccuguauacaaagaguuc

SEQ ID NO: 494378 - RNA, 22 nt, Human
ucccagaggacuguuggugcua

SEQ ID NO: 494379 - RNA, 22 nt, Human
gggucuccauguuaacaucacu

SEQ ID NO: 494380 - RNA, 22 nt, Human
ccaggcugcuguugguguccgc

SEQ ID NO: 494381 - RNA, 22 nt, Human
uccagugguaguaaagaggucu

SEQ ID NO: 494382 - RNA, 22 nt, Human
cugagcaccuguuauagguuag

SEQ ID NO: 494383 - RNA, 22 nt, Human
aguaugaauugcuuugccugua

SEQ ID NO: 494384 - RNA, 22 nt, Human
guacagucuucuuaaugcuuuu

SEQ ID NO: 494385 - RNA, 22 nt, Human
agaaggcuggcccuggguggcc

SEQ ID NO: 494386 - RNA, 22 nt, Human
ccucugaguccucccugguugc

SEQ ID NO: 494387 - RNA, 22 nt, Human
ggcauagcggcucagcguccag

SEQ ID NO: 494388 - RNA, 22 nt, Human
cccugaggcacaggccacguau

SEQ ID NO: 494389 - RNA, 21 nt, Human
guguggauaugugacaggugg

SEQ ID NO: 494390 - RNA, 17 nt, Human
gcuggcugacccaugcc

SEQ ID NO: 494391 - RNA, 22 nt, Human
ucacugucugaaagaaauggcc

SEQ ID NO: 494392 - RNA, 22 nt, Human
uaggguccugccuacagagaca

SEQ ID NO: 494393 - RNA, 22 nt, Human
ucagggaccccucugaguggag

SEQ ID NO: 494394 - RNA, 22 nt, Human
aacaguaagagauguuuuaucu

SEQ ID NO: 494395 - RNA, 22 nt, Human
ugugcacauucuaggacuagua

SEQ ID NO: 494396 - RNA, 22 nt, Human
agcagccagagaaugaugcagu

SEQ ID NO: 494397 - RNA, 22 nt, Human
cuguacaaguccuucaucaggg

SEQ ID NO: 494398 - RNA, 22 nt, Human
cugcagccuccugggguacaug

SEQ ID NO: 494399 - RNA, 22 nt, Human
ccaaggagcugcaggcacuugu

SEQ ID NO: 494400 - RNA, 22 nt, Human
uaggagagcugaacuauugucu

SEQ ID NO: 494401 - RNA, 20 nt, Human
acagaaagagagaaugucag

SEQ ID NO: 494402 - RNA, 23 nt, Human
cagaaagcccuuuccccacagua

SEQ ID NO: 494403 - RNA, 19 nt, Human
agacaugagacacaggaug

SEQ ID NO: 494404 - RNA, 22 nt, Human
aggagccaagauggggcaagua

SEQ ID NO: 494405 - RNA, 22 nt, Human
uacccaggggcugagcagaggu

SEQ ID NO: 494406 - RNA, 22 nt, Human
uggcccgaccucugcucaugca

SEQ ID NO: 494407 - RNA, 22 nt, Human
ucagagaguuacacaaauuguu

SEQ ID NO: 494408 - RNA, 22 nt, Human
acacuuuacagcuuccuuugca

SEQ ID NO: 494409 - RNA, 22 nt, Human
cagugcagguuuagggcugggg

SEQ ID NO: 494410 - RNA, 22 nt, Human
uuucuuuguuguuaucacauca

SEQ ID NO: 494411 - RNA, 22 nt, Human
agagccccucgguggagggguc

SEQ ID NO: 494412 - RNA, 19 nt, Human
aggagaaguagcagaaauu

SEQ ID NO: 494413 - RNA, 22 nt, Human
guuucuguaagacugaauugac

SEQ ID NO: 494414 - RNA, 22 nt, Human
uugagaagaauguguugaguuu

SEQ ID NO: 494415 - RNA, 22 nt, Human
gaaggccugugguagugagacg

SEQ ID NO: 494416 - RNA, 22 nt, Human
uggacuccagugucuguguucu

SEQ ID NO: 494417 - RNA, 22 nt, Human
ggcagggaagcuggcaucacgg

SEQ ID NO: 494418 - RNA, 22 nt, Human
caguacuuuucuggcuuucuac

SEQ ID NO: 494419 - RNA, 23 nt, Human
ugcaggggaggcuuaaagcaggu

SEQ ID NO: 494420 - RNA, 22 nt, Human
uuccaggaggcauucuuaguuu

SEQ ID NO: 494421 - RNA, 22 nt, Human
ugugaagguaagguuugcuuga

SEQ ID NO: 494422 - RNA, 22 nt, Human
aguggcugauguaggcaguggg

SEQ ID NO: 494423 - RNA, 22 nt, Human
ugcucuguaacaaauugacaug

SEQ ID NO: 494424 - RNA, 22 nt, Human
caacagaagguguacuacugaa

SEQ ID NO: 494425 - RNA, 22 nt, Human
ggggcccagcaccccuccucgc

SEQ ID NO: 494426 - RNA, 22 nt, Human
ucuuuauuuuaugcuugugcaa

SEQ ID NO: 494427 - RNA, 22 nt, Human
aaugaugggaaggagaaaagca

SEQ ID NO: 494428 - RNA, 22 nt, Human
caggccucaugguguguccuuc

SEQ ID NO: 494429 - RNA, 22 nt, Human
aaaaaucacuuuuauaggcagc

SEQ ID NO: 494430 - RNA, 21 nt, Human
uggaaagauucaaagaccagg

SEQ ID NO: 494431 - RNA, 22 nt, Human
uaacucugcuuguucucugagu

SEQ ID NO: 494432 - RNA, 22 nt, Human
ucaguguucagggaccaggucc

SEQ ID NO: 494433 - RNA, 22 nt, Human
agaguuggccaaaaggggcauu

SEQ ID NO: 494434 - RNA, 22 nt, Human
cucaggcaaggcccgcauucuc

SEQ ID NO: 494435 - RNA, 22 nt, Human
uaggacaggaucaugaugcugg

SEQ ID NO: 494436 - RNA, 22 nt, Human
ucaauucugguccucaggaacu

SEQ ID NO: 494437 - RNA, 22 nt, Human
cagcaggcccaggugcugguga

SEQ ID NO: 494438 - RNA, 22 nt, Human
ugaagcaggaaccagcagcauu

SEQ ID NO: 494439 - RNA, 22 nt, Human
agcagccaggaaucugcagagc

SEQ ID NO: 494440 - RNA, 17 nt, Human
ucgguuugccaggcuuc

SEQ ID NO: 494441 - RNA, 22 nt, Human
uggcggggcagcucuggcuucu

SEQ ID NO: 494442 - RNA, 22 nt, Human
ccugucugagccagggugggca

SEQ ID NO: 494443 - RNA, 22 nt, Human
acuguccauucacucauauuca

SEQ ID NO: 494444 - RNA, 22 nt, Human
gccuucugaucgcuggacugac

SEQ ID NO: 494445 - RNA, 22 nt, Human
acacaugugauucuaagacagc

SEQ ID NO: 494446 - RNA, 22 nt, Human
ugggagagucuaaaaccgaggu

SEQ ID NO: 494447 - RNA, 22 nt, Human
auaugaagaauuccaauuugga

SEQ ID NO: 494448 - RNA, 22 nt, Human
cagcaucaccgccauuucugau

SEQ ID NO: 494449 - RNA, 22 nt, Human
ugggcugaaaugcuguggacua

SEQ ID NO: 494450 - RNA, 22 nt, Human
cagcugcuguucaguuuuguuu

SEQ ID NO: 494451 - RNA, 22 nt, Human
uucucucaguuaaacuuuguga

SEQ ID NO: 494452 - RNA, 22 nt, Human
ggacuggccggcgcugaggccc

SEQ ID NO: 494453 - RNA, 22 nt, Human
cugcagagcuaggcugagugaa

SEQ ID NO: 494454 - RNA, 16 nt, Human
ugguggggaggacagc

SEQ ID NO: 494455 - RNA, 22 nt, Human
ccagugcacagccaggcaggug

SEQ ID NO: 494456 - RNA, 22 nt, Human
aaauaugagggugaugcccaga

SEQ ID NO: 494457 - RNA, 22 nt, Human
ucuggccccuggucucuggugu

SEQ ID NO: 494458 - RNA, 22 nt, Human
caaauaucuuuggcaaagagaa

SEQ ID NO: 494459 - RNA, 23 nt, Human
agcauaaaccucuguggcuuuag

SEQ ID NO: 494460 - RNA, 22 nt, Human
gcuggcugggucccugagaggc

SEQ ID NO: 494461 - RNA, 22 nt, Human
uuucaucucucuaaaagacagu

SEQ ID NO: 494462 - RNA, 22 nt, Human
ugggucuguagggcuguccaau

SEQ ID NO: 494463 - RNA, 23 nt, Human
aucaaacuggugagaaugucagu

SEQ ID NO: 494464 - RNA, 22 nt, Human
aaucuucauaaaaaucuaguag

SEQ ID NO: 494465 - RNA, 22 nt, Human
agggccugcucuaucacucuca

SEQ ID NO: 494466 - RNA, 19 nt, Human
ucaugcaguggggggugug

SEQ ID NO: 494467 - RNA, 22 nt, Human
cauuugaaauucuuagaacaaa

SEQ ID NO: 494468 - RNA, 22 nt, Human
cagcccuuguuucuaaagcugc

SEQ ID NO: 494469 - RNA, 21 nt, Human
ugaaaucugaugggacaaaug

SEQ ID NO: 494470 - RNA, 22 nt, Human
aagauguuaggguggaagggau

SEQ ID NO: 494471 - RNA, 22 nt, Human
uggcucucagcucccagcagcc

SEQ ID NO: 494472 - RNA, 22 nt, Human
caaauacuacgauucuugcagu

SEQ ID NO: 494473 - RNA, 22 nt, Human
uuucuuuugaauaguguguggu

SEQ ID NO: 494474 - RNA, 22 nt, Human
ugaggauggcagugugcucagc

SEQ ID NO: 494475 - RNA, 22 nt, Human
gaaacagcuuuaagugauacug

SEQ ID NO: 494476 - RNA, 22 nt, Human
caauacugaguuuacauucauc

SEQ ID NO: 494477 - RNA, 22 nt, Human
ugaggcagggagaguggauaug

SEQ ID NO: 494478 - RNA, 22 nt, Human
ucucagugcagagaggcuaucu

SEQ ID NO: 494479 - RNA, 22 nt, Human
ucaggcccagagucacggaucc

SEQ ID NO: 494480 - RNA, 22 nt, Human
ggcagguggcacugcugcuccc

SEQ ID NO: 494481 - RNA, 22 nt, Human
ugaagacacauacaagggaaug

SEQ ID NO: 494482 - RNA, 22 nt, Human
gcucuguguucccuccaggcuc

SEQ ID NO: 494483 - RNA, 22 nt, Human
cugcagagcagccaguccccca

SEQ ID NO: 494484 - RNA, 22 nt, Human
uggagcagcaucacuuugagcu

SEQ ID NO: 494485 - RNA, 20 nt, Human
uccuugaaagugggguauau

SEQ ID NO: 494486 - RNA, 22 nt, Human
cuggcugcaggaaggagugggc

SEQ ID NO: 494487 - RNA, 22 nt, Human
uuguacaaguauuaugugaaca

SEQ ID NO: 494488 - RNA, 22 nt, Human
ccagcaggcagucauauccuuu

SEQ ID NO: 494489 - RNA, 22 nt, Human
uuuaagagcuaguaugucauuu

SEQ ID NO: 494490 - RNA, 22 nt, Human
uuuccucuuauacaguguuuau

SEQ ID NO: 494491 - RNA, 20 nt, Human
ugcagagcuggcuggcuccu

SEQ ID NO: 494492 - RNA, 22 nt, Human
uauauucaaugauuaguaucag

SEQ ID NO: 494493 - RNA, 22 nt, Human
aggcagguuggggaaaagcacu

SEQ ID NO: 494494 - RNA, 22 nt, Human
agagauggagagcacuggggcu

SEQ ID NO: 494495 - RNA, 22 nt, Human
ugcaggugucucugucuagcgu

SEQ ID NO: 494496 - RNA, 22 nt, Human
acauuucucagggaguuuugcu

SEQ ID NO: 494497 - RNA, 22 nt, Human
gagcugccggcccacaguacua

SEQ ID NO: 494498 - RNA, 22 nt, Human
caagcagagacuagauagcugu

SEQ ID NO: 494499 - RNA, 22 nt, Human
caguucuggaggcuccacaucu

SEQ ID NO: 494500 - RNA, 23 nt, Human
ucucugcauguccugagcacauc

SEQ ID NO: 494501 - RNA, 22 nt, Human
cagggcaguuuuacuucucucu

SEQ ID NO: 494502 - RNA, 22 nt, Human
uucaggaaucaaccaagucauu

SEQ ID NO: 494503 - RNA, 22 nt, Human
uccuucaggccucauucucaua

SEQ ID NO: 494504 - RNA, 22 nt, Human
caggcugacaacugagcauuuu

SEQ ID NO: 494505 - RNA, 22 nt, Human
gcuccuggcuucacugacauca

SEQ ID NO: 494506 - RNA, 22 nt, Human
ucuggcucccagccugcucuca

SEQ ID NO: 494507 - RNA, 22 nt, Human
aaugagaagccuagguguacug

SEQ ID NO: 494508 - RNA, 22 nt, Human
ugccccucuccugugauccaag

SEQ ID NO: 494509 - RNA, 22 nt, Human
ucccugggcacaaucugcuggc

SEQ ID NO: 494510 - RNA, 22 nt, Human
ggaggaggcaaguaccagaugc

SEQ ID NO: 494511 - RNA, 22 nt, Human
aagaauguggguggauaugaug

SEQ ID NO: 494512 - RNA, 22 nt, Human
auuacaagggucugacuggagg

SEQ ID NO: 494513 - RNA, 22 nt, Human
acuguucacccagcacuagcag

SEQ ID NO: 494514 - RNA, 22 nt, Human
ucucauugguauauacaugugu

SEQ ID NO: 494515 - RNA, 22 nt, Human
cugcugggucuaugcaagugga

SEQ ID NO: 494516 - RNA, 22 nt, Human
cuguccuguagcuccaucaguc

SEQ ID NO: 494517 - RNA, 22 nt, Human
cugcaagauuggaagaugcaau

SEQ ID NO: 494518 - RNA, 22 nt, Human
agaaaucaugacuaagagcagu

SEQ ID NO: 494519 - RNA, 22 nt, Human
uuucauuucauagaauuguguu

SEQ ID NO: 494520 - RNA, 21 nt, Human
ucacaugcccauuacuggagc

SEQ ID NO: 494521 - RNA, 22 nt, Human
gaagcagcuagcccacuaguca

SEQ ID NO: 494522 - RNA, 22 nt, Human
aaagucacuuccuucugucagc

SEQ ID NO: 494523 - RNA, 22 nt, Human
ugcuucuggcagauugagugag

SEQ ID NO: 494524 - RNA, 22 nt, Human
cagaagaaaguggggagacaag

SEQ ID NO: 494525 - RNA, 22 nt, Human
agguucaggcugcacaccugag

SEQ ID NO: 494526 - RNA, 22 nt, Human
ugcauacauaaagugcuaucau

SEQ ID NO: 494527 - RNA, 18 nt, Human
gguggccuugacuucucu

SEQ ID NO: 494528 - RNA, 22 nt, Human
uagauacaggcucucugagccu

SEQ ID NO: 494529 - RNA, 22 nt, Human
gcacggcuaauuuuuguauuuu

SEQ ID NO: 494530 - RNA, 22 nt, Human
uugaaaguuaucuagauucuga

SEQ ID NO: 494531 - RNA, 22 nt, Human
caggaggcuccuagggcucugu

SEQ ID NO: 494532 - RNA, 23 nt, Human
gccucagagaaacagcugcacac

SEQ ID NO: 494533 - RNA, 22 nt, Human
uccugggguuuuggccgcagcu

SEQ ID NO: 494534 - RNA, 22 nt, Human
ucccagaguauuagcaauugcu

SEQ ID NO: 494535 - RNA, 22 nt, Human
agcaccuggagggcugggaccu

SEQ ID NO: 494536 - RNA, 22 nt, Human
ugggcugccggcaggcucugcc

SEQ ID NO: 494537 - RNA, 22 nt, Human
uuauuccaguaaucucuguaau

SEQ ID NO: 494538 - RNA, 23 nt, Human
uguaaaaugggguaguguuacca

SEQ ID NO: 494539 - RNA, 22 nt, Human
agggcuggcuccguuaccuuga

SEQ ID NO: 494540 - RNA, 22 nt, Human
uucacaaaacacuauuuucugg

SEQ ID NO: 494541 - RNA, 22 nt, Human
ugugcaaaguguacaaauuaau

SEQ ID NO: 494542 - RNA, 22 nt, Human
uccucugccaaagggaguugcc

SEQ ID NO: 494543 - RNA, 22 nt, Human
ggcaggacucucaggaccaagc

SEQ ID NO: 494544 - RNA, 22 nt, Human
cugcuucuccaaaguaggacuu

SEQ ID NO: 494545 - RNA, 22 nt, Human
aggaguuauggcagaaucaaau

SEQ ID NO: 494546 - RNA, 20 nt, Human
accccagccccucuaucuga

SEQ ID NO: 494547 - RNA, 22 nt, Human
auagacauauggcuuuguuucu

SEQ ID NO: 494548 - RNA, 22 nt, Human
gugaaguuuuaguauauguaga

SEQ ID NO: 494549 - RNA, 22 nt, Human
ucugugcuuucccugccuucuu

SEQ ID NO: 494550 - RNA, 22 nt, Human
gugcccagcuccaccucacaga

SEQ ID NO: 494551 - RNA, 22 nt, Human
aaaaauagcuucucuugucccu

SEQ ID NO: 494552 - RNA, 22 nt, Human
auggggugagacuaggauuaaa

SEQ ID NO: 494553 - RNA, 22 nt, Human
uugcaaaugaccauugccacau

SEQ ID NO: 494554 - RNA, 18 nt, Human
gcucaguguguuaacacu

SEQ ID NO: 494555 - RNA, 22 nt, Human
gcucugcugggugggcaguuau

SEQ ID NO: 494556 - RNA, 22 nt, Human
uggaguuccuuugaaaggcucu

SEQ ID NO: 494557 - RNA, 22 nt, Human
ugguccuggggugcaggcugac

SEQ ID NO: 494558 - RNA, 22 nt, Human
uuggagguuugaaaauaugugu

SEQ ID NO: 494559 - RNA, 22 nt, Human
uggcucagaacuacuucuaguu

SEQ ID NO: 494560 - RNA, 22 nt, Human
acaggggaauuuacugucauua

SEQ ID NO: 494561 - RNA, 22 nt, Human
uguggcucuccuccugcugccc

SEQ ID NO: 494562 - RNA, 22 nt, Human
gugugccagacaugaugcuaug

SEQ ID NO: 494563 - RNA, 22 nt, Human
uggcuuccgccgcgggccucgg

SEQ ID NO: 494564 - RNA, 22 nt, Human
uggcuucugagucuccugacau

SEQ ID NO: 494565 - RNA, 22 nt, Human
uuucacaucagagguagauuag

SEQ ID NO: 494566 - RNA, 22 nt, Human
augagacaugacuucaggccuu

SEQ ID NO: 494567 - RNA, 22 nt, Human
uuuccucugggcccugccaccc

SEQ ID NO: 494568 - RNA, 22 nt, Human
acagcuccuaacaaaggcucuc

SEQ ID NO: 494569 - RNA, 22 nt, Human
guaaucucagcuacuugggagg

SEQ ID NO: 494570 - RNA, 22 nt, Human
caggucgccagcaggaacguca

SEQ ID NO: 494571 - RNA, 22 nt, Human
accacccccuuggguguggaag

SEQ ID NO: 494572 - RNA, 22 nt, Human
cauaagaaauaaugaugaugac

SEQ ID NO: 494573 - RNA, 22 nt, Human
ccaggcagagugcuccagaaag

SEQ ID NO: 494574 - RNA, 22 nt, Human
agugaggggcagcugagugggc

SEQ ID NO: 494575 - RNA, 22 nt, Human
caguggccuuuccugcugcuca

SEQ ID NO: 494576 - RNA, 22 nt, Human
cagucccaugagcccagaacau

SEQ ID NO: 494577 - RNA, 22 nt, Human
ucucugaaggggagcuguuuaa

SEQ ID NO: 494578 - RNA, 22 nt, Human
uacagcuuaaaaaagccaacuu

SEQ ID NO: 494579 - RNA, 20 nt, Human
ucugcucagcccucaguggc

SEQ ID NO: 494580 - RNA, 22 nt, Human
aaagcacauaguagaaggauuu

SEQ ID NO: 494581 - RNA, 22 nt, Human
aaucauaauuguauacauucau

SEQ ID NO: 494582 - RNA, 22 nt, Human
gguggcagagacauaggacaua

SEQ ID NO: 494583 - RNA, 22 nt, Human
aacccaggguggagguugcagu

SEQ ID NO: 494584 - RNA, 22 nt, Human
caguccaggccuggaggagcca

SEQ ID NO: 494585 - RNA, 22 nt, Human
ggacaaagcucugcugccuccc

SEQ ID NO: 494586 - RNA, 19 nt, Human
gcagauccaaaagucacau

SEQ ID NO: 494587 - RNA, 22 nt, Human
ugcauaaacuucucugguguga

SEQ ID NO: 494588 - RNA, 22 nt, Human
cugcccuggaaaacguaucuua

SEQ ID NO: 494589 - RNA, 22 nt, Human
agggcugccugcucugcauuga

SEQ ID NO: 494590 - RNA, 22 nt, Human
gggagggaaggaggcgccgugu

SEQ ID NO: 494591 - RNA, 22 nt, Human
ucauacaucuuguauaucuauc

SEQ ID NO: 494592 - RNA, 22 nt, Human
agagcugggugaagugccauca

SEQ ID NO: 494593 - RNA, 22 nt, Human
ugcaucagaguuugcugcugcu

SEQ ID NO: 494594 - RNA, 22 nt, Human
ucucagagggaaaggccaauuu

SEQ ID NO: 494595 - RNA, 22 nt, Human
uaaagugcugggauuauaggcc

SEQ ID NO: 494596 - RNA, 22 nt, Human
gcaggaugggagcuucacucug

SEQ ID NO: 494597 - RNA, 22 nt, Human
gcacagccacugagugagaacc

SEQ ID NO: 494598 - RNA, 22 nt, Human
gcacacaugcaugcacaggagu

SEQ ID NO: 494599 - RNA, 22 nt, Human
acauugaucagccucccaugca

SEQ ID NO: 494600 - RNA, 22 nt, Human
gcucucugguuccagucaggaa

SEQ ID NO: 494601 - RNA, 22 nt, Human
gugugccaggaacuggcugcug

SEQ ID NO: 494602 - RNA, 22 nt, Human
agcucugacauugauucucagc

SEQ ID NO: 494603 - RNA, 20 nt, Human
uucuggaggcuacaagucug

SEQ ID NO: 494604 - RNA, 22 nt, Human
uucuuucccaguagaugugaaa

SEQ ID NO: 494605 - RNA, 22 nt, Human
uacuuuuuaugauaagaacuga

SEQ ID NO: 494606 - RNA, 22 nt, Human
agcagcucagaggcaccagggc

SEQ ID NO: 494607 - RNA, 22 nt, Human
uucuuaaaacuuauggacaggu

SEQ ID NO: 494608 - RNA, 22 nt, Human
cacaguccugccagagggccuu

SEQ ID NO: 494609 - RNA, 22 nt, Human
ugcauuguugaccaguugugca

SEQ ID NO: 494610 - RNA, 22 nt, Human
uugaaugaggaagagcacuggc

SEQ ID NO: 494611 - RNA, 20 nt, Human
aguguacagacacuagaaau

SEQ ID NO: 494612 - RNA, 22 nt, Human
uuuguauaagaacauucuagca

SEQ ID NO: 494613 - RNA, 22 nt, Human
gcucuggcucaaaccaccggcu

SEQ ID NO: 494614 - RNA, 22 nt, Human
ucaaaguccuugcuuuuucugu

SEQ ID NO: 494615 - RNA, 22 nt, Human
cuuauuuguacuaauaaaucug

SEQ ID NO: 494616 - RNA, 22 nt, Human
uggcuuccagagcugcuccacc

SEQ ID NO: 494617 - RNA, 22 nt, Human
gcaaauacauguugagcaccua

SEQ ID NO: 494618 - RNA, 22 nt, Human
cacuguacuggguugaaggacg

SEQ ID NO: 494619 - RNA, 22 nt, Human
ccuaggcccauuaauuccccuu

SEQ ID NO: 494620 - RNA, 23 nt, Human
uaugagaauuaagugcgagugcc

SEQ ID NO: 494621 - RNA, 22 nt, Human
uacagagaugccgaagagugaa

SEQ ID NO: 494622 - RNA, 22 nt, Human
ccucucccacguggcagaggcu

SEQ ID NO: 494623 - RNA, 22 nt, Human
agcuucagguggucuuguuucu

SEQ ID NO: 494624 - RNA, 22 nt, Human
ccagccacugggccacugccag

SEQ ID NO: 494625 - RNA, 22 nt, Human
ucugucuuagcaucuuugcuca

SEQ ID NO: 494626 - RNA, 22 nt, Human
ucugucacuauuggccagaaca

SEQ ID NO: 494627 - RNA, 22 nt, Human
ugcauuucagaagaaaauucgg

SEQ ID NO: 494628 - RNA, 22 nt, Human
uagagguauuuuugauggucau

SEQ ID NO: 494629 - RNA, 22 nt, Human
agaaguuaccacauacuucucu

SEQ ID NO: 494630 - RNA, 22 nt, Human
agagccuguuuugugggagaug

SEQ ID NO: 494631 - RNA, 21 nt, Human
gcagccagacgggauucaguu

SEQ ID NO: 494632 - RNA, 22 nt, Human
agccugccuugggcugcuugag

SEQ ID NO: 494633 - RNA, 22 nt, Human
uucacaauagcuggcaucaucu

SEQ ID NO: 494634 - RNA, 22 nt, Human
uagcagcacagaaagccuggag

SEQ ID NO: 494635 - RNA, 22 nt, Human
cauguguggagggcaugcaugg

SEQ ID NO: 494636 - RNA, 22 nt, Human
aacaaccaaaaagaugaaugua

SEQ ID NO: 494637 - RNA, 22 nt, Human
cccacacacuggcugcugccaa

SEQ ID NO: 494638 - RNA, 22 nt, Human
agauuuccaucuuuuucaugug

SEQ ID NO: 494639 - RNA, 22 nt, Human
gaaugcacacgugugugcaugc

SEQ ID NO: 494640 - RNA, 22 nt, Human
agacugggccauuuccccagcu

SEQ ID NO: 494641 - RNA, 22 nt, Human
aaaaugaggaacggaucauggc

SEQ ID NO: 494642 - RNA, 22 nt, Human
aaucuuuuucacaagaaagcac

SEQ ID NO: 494643 - RNA, 22 nt, Human
uccucuggcucuuucccuagga

SEQ ID NO: 494644 - RNA, 22 nt, Human
acaguguccuuguggucccugu

SEQ ID NO: 494645 - RNA, 22 nt, Human
agaggcuccuucacucuggcac

SEQ ID NO: 494646 - RNA, 22 nt, Human
aggcucuggcaacagcuggugu

SEQ ID NO: 494647 - RNA, 20 nt, Human
uauuuacaacuuagagccuc

SEQ ID NO: 494648 - RNA, 22 nt, Human
ucauuuaauagcuuuugucuuu

SEQ ID NO: 494649 - RNA, 22 nt, Human
cccaggcagggacgugcucugg

SEQ ID NO: 494650 - RNA, 22 nt, Human
gagugggggguccgucucagug

SEQ ID NO: 494651 - RNA, 22 nt, Human
ccuguucaaugcccuggcuuca

SEQ ID NO: 494652 - RNA, 21 nt, Human
uguccuggucacugcucuccc

SEQ ID NO: 494653 - RNA, 22 nt, Human
aggaccuguguuuuccuugaau

SEQ ID NO: 494654 - RNA, 22 nt, Human
aggcuccauaccaucuccggag

SEQ ID NO: 494655 - RNA, 22 nt, Human
acugggccagaucagagcaacu

SEQ ID NO: 494656 - RNA, 22 nt, Human
gcagagccccauugcuggcggg

SEQ ID NO: 494657 - RNA, 22 nt, Human
gccuuccugcagcucugagcgu

SEQ ID NO: 494658 - RNA, 22 nt, Human
gccuguuuggcugcugacauug

SEQ ID NO: 494659 - RNA, 22 nt, Human
cagagcagacguugagauuaag

SEQ ID NO: 494660 - RNA, 22 nt, Human
ucuuuuuauauugacaaaaggu

SEQ ID NO: 494661 - RNA, 22 nt, Human
uauuuguauguguguacauaua

SEQ ID NO: 494662 - RNA, 22 nt, Human
ucagaguggugguuuugccuuc

SEQ ID NO: 494663 - RNA, 22 nt, Human
cagugggugaugaguccugggg

SEQ ID NO: 494664 - RNA, 22 nt, Human
guggcugcucgggcuccggccc

SEQ ID NO: 494665 - RNA, 17 nt, Human
agcugccuugcuugagc

SEQ ID NO: 494666 - RNA, 23 nt, Human
uggcagcagaucuuaaagugacc

SEQ ID NO: 494667 - RNA, 22 nt, Human
aggaagcugggguguucuucau

SEQ ID NO: 494668 - RNA, 22 nt, Human
gagcuucacgggggacagcauu

SEQ ID NO: 494669 - RNA, 22 nt, Human
ugcacagggagggggccagcuc

SEQ ID NO: 494670 - RNA, 22 nt, Human
cugguggagggacaggcuuagc

SEQ ID NO: 494671 - RNA, 22 nt, Human
aagggaaacuuucacaaugucc

SEQ ID NO: 494672 - RNA, 22 nt, Human
aagagcauggaauggagaucca

SEQ ID NO: 494673 - RNA, 22 nt, Human
acauuaacacuggugcuggugu

SEQ ID NO: 494674 - RNA, 22 nt, Human
gugagagcugcuccagaucucu

SEQ ID NO: 494675 - RNA, 22 nt, Human
cagcccuggugagguuggcuau

SEQ ID NO: 494676 - RNA, 22 nt, Human
gcugucuguggugucagcugac

SEQ ID NO: 494677 - RNA, 22 nt, Human
gcagguagugaucgagggugac

SEQ ID NO: 494678 - RNA, 22 nt, Human
agccacagugcaagagagaaaa

SEQ ID NO: 494679 - RNA, 22 nt, Human
ggcugccugcucaggugcggcg

SEQ ID NO: 494680 - RNA, 22 nt, Human
ucagugcagaauagugaugcau

SEQ ID NO: 494681 - RNA, 22 nt, Human
uaaagacauaggaucagggaga

SEQ ID NO: 494682 - RNA, 22 nt, Human
guauuuucaagagcaguaguau

SEQ ID NO: 494683 - RNA, 22 nt, Human
agcaaucagcuucuuuguguuu

SEQ ID NO: 494684 - RNA, 22 nt, Human
gcuguuccugcuuagaggucgg

SEQ ID NO: 494685 - RNA, 18 nt, Human
gccaggcaggguggggaa

SEQ ID NO: 494686 - RNA, 22 nt, Human
ccaggagcgcgugaacaggcug

SEQ ID NO: 494687 - RNA, 22 nt, Human
cuuguuuugaaagcaguggcca

SEQ ID NO: 494688 - RNA, 22 nt, Human
uuagaaaauuugcuucuuugga

SEQ ID NO: 494689 - RNA, 22 nt, Human
ugaagcagcaaaugaugggaga

SEQ ID NO: 494690 - RNA, 22 nt, Human
ggggcuggcucacuaagagacu

SEQ ID NO: 494691 - RNA, 22 nt, Human
cugcagcuguagaggacagugg

SEQ ID NO: 494692 - RNA, 22 nt, Human
acagaagagcacauuuaguaug

SEQ ID NO: 494693 - RNA, 22 nt, Human
gauuuguuucaaguuagcaucu

SEQ ID NO: 494694 - RNA, 22 nt, Human
guccuugcuugagacaggcagu

SEQ ID NO: 494695 - RNA, 20 nt, Human
caaagacaugcuaggggugg

SEQ ID NO: 494696 - RNA, 22 nt, Human
agcuaggaaauugaggcugaga

SEQ ID NO: 494697 - RNA, 22 nt, Human
uucuuguaauuuggagaaauga

SEQ ID NO: 494698 - RNA, 22 nt, Human
gccucucuccuuggcuugcagu

SEQ ID NO: 494699 - RNA, 22 nt, Human
cugugucucuccuuacaagacu

SEQ ID NO: 494700 - RNA, 22 nt, Human
gacacagagggcaccagauaug

SEQ ID NO: 494701 - RNA, 22 nt, Human
gaggcccaggucaagcagccac

SEQ ID NO: 494702 - RNA, 22 nt, Human
ucacaucucccuggaggacaca

SEQ ID NO: 494703 - RNA, 22 nt, Human
agaggccuccgaaaggugggcu

SEQ ID NO: 494704 - RNA, 20 nt, Human
ugggagcuggugaggucuca

SEQ ID NO: 494705 - RNA, 22 nt, Human
uauuuaaaaagaggccagcugg

SEQ ID NO: 494706 - RNA, 22 nt, Human
aaagucaaaaugcucuccuguc

SEQ ID NO: 494707 - RNA, 22 nt, Human
ucaugcccagagcaguaaauua

SEQ ID NO: 494708 - RNA, 22 nt, Human
gcucccugcacucugcagcccu

SEQ ID NO: 494709 - RNA, 22 nt, Human
ccagguggaggugugagguccu

SEQ ID NO: 494710 - RNA, 22 nt, Human
gaaagaggaaggagauguauua

SEQ ID NO: 494711 - RNA, 22 nt, Human
cucugguguccuuuagaauuua

SEQ ID NO: 494712 - RNA, 22 nt, Human
gcucugagccgggggccugucc

SEQ ID NO: 494713 - RNA, 19 nt, Human
uccagacuguccaggcuau

SEQ ID NO: 494714 - RNA, 22 nt, Human
cugggcugcaguuccugguccu

SEQ ID NO: 494715 - RNA, 22 nt, Human
ugauuacaaaagauuguuugaa

SEQ ID NO: 494716 - RNA, 20 nt, Human
cagcuuuagaucuuugauua

SEQ ID NO: 494717 - RNA, 21 nt, Human
gccuggcagguggaagggcuc

SEQ ID NO: 494718 - RNA, 22 nt, Human
uauauaugagcaugugaggaca

SEQ ID NO: 494719 - RNA, 22 nt, Human
ccuggcugagggaccucgggua

SEQ ID NO: 494720 - RNA, 22 nt, Human
gaauuuacaaguugaauaacaa

SEQ ID NO: 494721 - RNA, 22 nt, Human
ccacagaguugaugcaauaaga

SEQ ID NO: 494722 - RNA, 20 nt, Human
agcccuguuuccuggagaga

SEQ ID NO: 494723 - RNA, 22 nt, Human
gaaagugcagucagacaaggca

SEQ ID NO: 494724 - RNA, 22 nt, Human
gauauuuuuaguauuucugccu

SEQ ID NO: 494725 - RNA, 22 nt, Human
gccagcucagaugcaggaagga

SEQ ID NO: 494726 - RNA, 22 nt, Human
agaaggguagggacuuauccaa

SEQ ID NO: 494727 - RNA, 22 nt, Human
aaguuucauguggagguagacu

SEQ ID NO: 494728 - RNA, 22 nt, Human
ucuccuuugaaaguuaggacug

SEQ ID NO: 494729 - RNA, 22 nt, Human
ugaaggaagaauaggcaguguu

SEQ ID NO: 494730 - RNA, 23 nt, Human
uugauacagaagaaucaguuugu

SEQ ID NO: 494731 - RNA, 22 nt, Human
uucuccgcuaaguucucugcag

SEQ ID NO: 494732 - RNA, 22 nt, Human
gcaccaggcuuagagccccagg

SEQ ID NO: 494733 - RNA, 22 nt, Human
ccugcugugaaacuggcauaug

SEQ ID NO: 494734 - RNA, 22 nt, Human
uuugaaagccuggcuuuucucu

SEQ ID NO: 494735 - RNA, 22 nt, Human
ucugucugaggaguuuuugacc

SEQ ID NO: 494736 - RNA, 22 nt, Human
caugggaggucugcaaggugcu

SEQ ID NO: 494737 - RNA, 22 nt, Human
ggcaaaaacagcaaugacuuuu

SEQ ID NO: 494738 - RNA, 22 nt, Human
agaagccauguuuaguaggaug

SEQ ID NO: 494739 - RNA, 22 nt, Human
ugggggagcgacagacauaauu

SEQ ID NO: 494740 - RNA, 19 nt, Human
auuguacauugaguuuggc

SEQ ID NO: 494741 - RNA, 22 nt, Human
augaagucugcacaugcaugug

SEQ ID NO: 494742 - RNA, 22 nt, Human
uaugagaaaggagaaugacuuu

SEQ ID NO: 494743 - RNA, 22 nt, Human
acugugugggccgcucacuggg

SEQ ID NO: 494744 - RNA, 22 nt, Human
ugugaaagucaaauuaauugaa

SEQ ID NO: 494745 - RNA, 22 nt, Human
ugccuguccugaggaugagggu

SEQ ID NO: 494746 - RNA, 22 nt, Human
aaggcaguagguguuucaaacu

SEQ ID NO: 494747 - RNA, 22 nt, Human
ccagcuccaggacugggagcug

SEQ ID NO: 494748 - RNA, 21 nt, Human
accugccacauugcagacuug

SEQ ID NO: 494749 - RNA, 21 nt, Human
ugcuugggggcuucaggagcu

SEQ ID NO: 494750 - RNA, 22 nt, Human
gggcuggcucugucuagaaagg

SEQ ID NO: 494751 - RNA, 22 nt, Human
ccuggcucagaccccaguucug

SEQ ID NO: 494752 - RNA, 22 nt, Human
ccuuuaaagacugcauaacuuc

SEQ ID NO: 494753 - RNA, 22 nt, Human
aucuaaagugucauaaguagcu

SEQ ID NO: 494754 - RNA, 22 nt, Human
ugagccugguugcagugucugg

SEQ ID NO: 494755 - RNA, 22 nt, Human
ccaguguucaauacauauuugu

SEQ ID NO: 494756 - RNA, 22 nt, Human
gccaggugcauggcugagucuc

SEQ ID NO: 494757 - RNA, 22 nt, Human
ugcagaagugagucaugaggaa

SEQ ID NO: 494758 - RNA, 22 nt, Human
cagaggaagcagacacaucuug

SEQ ID NO: 494759 - RNA, 22 nt, Human
auuccuugcacaucagauaguu

SEQ ID NO: 494760 - RNA, 22 nt, Human
uccucacaagcaagcacaggua

SEQ ID NO: 494761 - RNA, 22 nt, Human
uaacagaaauagaaaugagagu

SEQ ID NO: 494762 - RNA, 22 nt, Human
cugugccuuuguagcugugccu

SEQ ID NO: 494763 - RNA, 22 nt, Human
cagucccuaguggagcucacag

SEQ ID NO: 494764 - RNA, 22 nt, Human
auguguacaaccaagcacuaaa

SEQ ID NO: 494765 - RNA, 22 nt, Human
ugcaggucuccauuggcagacu

SEQ ID NO: 494766 - RNA, 19 nt, Human
gcaugcuugguggcuucug

SEQ ID NO: 494767 - RNA, 22 nt, Human
ccugggucacucaggcaggcgg

SEQ ID NO: 494768 - RNA, 22 nt, Human
ugcagcauugcaaagcagucuu

SEQ ID NO: 494769 - RNA, 16 nt, Human
gggagggaguuggugg

SEQ ID NO: 494770 - RNA, 22 nt, Human
guaagccuggaauuuuugacuu

SEQ ID NO: 494771 - RNA, 17 nt, Human
agguucagguuacauuc

SEQ ID NO: 494772 - RNA, 22 nt, Human
uggggagugaugccucggauaa

SEQ ID NO: 494773 - RNA, 22 nt, Human
auuuauuaugggauuuggcaca

SEQ ID NO: 494774 - RNA, 22 nt, Human
ucaggaaggagcuggccugcca

SEQ ID NO: 494775 - RNA, 22 nt, Human
ugaagcagauggucuggucauu

SEQ ID NO: 494776 - RNA, 22 nt, Human
cuucuggguugcaggucuuggc

SEQ ID NO: 494777 - RNA, 22 nt, Human
acugucuguccugcucuccgug

SEQ ID NO: 494778 - RNA, 21 nt, Human
agcagccauggaugguaugua

SEQ ID NO: 494779 - RNA, 22 nt, Human
cagaaauacccagcauuuggag

SEQ ID NO: 494780 - RNA, 22 nt, Human
uuuauguaaguggaaugaugcc

SEQ ID NO: 494781 - RNA, 22 nt, Human
uauaaaugccaggacuuuagau

SEQ ID NO: 494782 - RNA, 22 nt, Human
ccacucugauuuuggcuccacu

SEQ ID NO: 494783 - RNA, 22 nt, Human
cucagggacguuagaggacagg

SEQ ID NO: 494784 - RNA, 22 nt, Human
aaugggagagaacacaaagucc

SEQ ID NO: 494785 - RNA, 22 nt, Human
uagaaagugaagguuaauuaau

SEQ ID NO: 494786 - RNA, 22 nt, Human
cuuuauguucaguacaaugcuu

SEQ ID NO: 494787 - RNA, 22 nt, Human
ugggccucggggaagcccgugu

SEQ ID NO: 494788 - RNA, 19 nt, Human
uggcuuccaucucucucau

SEQ ID NO: 494789 - RNA, 22 nt, Human
agccagggacgcugcaggcuac

SEQ ID NO: 494790 - RNA, 22 nt, Human
ugagucuuuucauuguguggau

SEQ ID NO: 494791 - RNA, 22 nt, Human
ccacuguagagauuugaaugcc

SEQ ID NO: 494792 - RNA, 22 nt, Human
aaaagauuguuagggagaaugu

SEQ ID NO: 494793 - RNA, 22 nt, Human
uuuuaauacugcuauuguagga

SEQ ID NO: 494794 - RNA, 22 nt, Human
aagggagacaguugugugagga

SEQ ID NO: 494795 - RNA, 22 nt, Human
gcuggccugcgagggcaggcug

SEQ ID NO: 494796 - RNA, 21 nt, Human
cagacccucuagaggccaccu

SEQ ID NO: 494797 - RNA, 22 nt, Human
agcucccaggcagucaugagga

SEQ ID NO: 494798 - RNA, 22 nt, Human
agaagagccuggggaccauggc

SEQ ID NO: 494799 - RNA, 22 nt, Human
cggggcuguagcacagcugagc

SEQ ID NO: 494800 - RNA, 22 nt, Human
ucuguuccauguuuuguuccau

SEQ ID NO: 494801 - RNA, 22 nt, Human
aucacuguguauguauaugcag

SEQ ID NO: 494802 - RNA, 22 nt, Human
gugggccagcuuuucuccuggg

SEQ ID NO: 494803 - RNA, 22 nt, Human
ugcacacauucuauggggcuga

SEQ ID NO: 494804 - RNA, 22 nt, Human
uuucuucucgacaccuuauccc

SEQ ID NO: 494805 - RNA, 20 nt, Human
cuguaucagguuacaaagua

SEQ ID NO: 494806 - RNA, 22 nt, Human
ucacaguaaaagcauggaagag

SEQ ID NO: 494807 - RNA, 22 nt, Human
aauaaguugccuguugaaucau

SEQ ID NO: 494808 - RNA, 22 nt, Human
ugugggcaggcccgggucugag

SEQ ID NO: 494809 - RNA, 22 nt, Human
guuucauauaccaagcacuuga

SEQ ID NO: 494810 - RNA, 22 nt, Human
cagauagcaaauggguaagcua

SEQ ID NO: 494811 - RNA, 22 nt, Human
cucagagcccaggguacacccg

SEQ ID NO: 494812 - RNA, 22 nt, Human
agcaaaauaagguaauuuauug

SEQ ID NO: 494813 - RNA, 22 nt, Human
aagacauuuauuugaaucaauu

SEQ ID NO: 494814 - RNA, 21 nt, Human
ccuucucuugcuucagcuuca

SEQ ID NO: 494815 - RNA, 22 nt, Human
agcuuguuaaggaugcauauua

SEQ ID NO: 494816 - RNA, 22 nt, Human
gggcaugagagggcagcuggca

SEQ ID NO: 494817 - RNA, 22 nt, Human
gugucaauaaauagcggugugg

SEQ ID NO: 494818 - RNA, 21 nt, Human
aucacauuggcuguuauuauu

SEQ ID NO: 494819 - RNA, 22 nt, Human
aagugagauuauauguacggga

SEQ ID NO: 494820 - RNA, 22 nt, Human
gucaggauuauuuuauuaaaag

SEQ ID NO: 494821 - RNA, 22 nt, Human
acaggcaggcgggacagcccga

SEQ ID NO: 494822 - RNA, 22 nt, Human
uuucagagucagcuccucucua

SEQ ID NO: 494823 - RNA, 22 nt, Human
aaaugauugucaaaguucuguu

SEQ ID NO: 494824 - RNA, 20 nt, Human
ggcagcucacuacuuucugu

SEQ ID NO: 494825 - RNA, 22 nt, Human
aaaaugaauaaguuaacccagg

SEQ ID NO: 494826 - RNA, 22 nt, Human
agaaaugcucuuccugaccaga

SEQ ID NO: 494827 - RNA, 22 nt, Human
cccagcaucuccaggcauggcc

SEQ ID NO: 494828 - RNA, 20 nt, Human
gccagcugcccuuccacccu

SEQ ID NO: 494829 - RNA, 22 nt, Human
aaaggccagguuggcugguauu

SEQ ID NO: 494830 - RNA, 22 nt, Human
cauaauuaggcaguugaucauu

SEQ ID NO: 494831 - RNA, 22 nt, Human
cugugggccuagucuggccuag

SEQ ID NO: 494832 - RNA, 22 nt, Human
agcaaggcagucagcuggcugg

SEQ ID NO: 494833 - RNA, 22 nt, Human
ugcccugguagacacagacugu

SEQ ID NO: 494834 - RNA, 22 nt, Human
acugaaggaaacuuuuguguuu

SEQ ID NO: 494835 - RNA, 22 nt, Human
acauuucuucccuuuagcagaa

SEQ ID NO: 494836 - RNA, 22 nt, Human
uauuucagacacugaucuugca

SEQ ID NO: 494837 - RNA, 22 nt, Human
aaaaaaucagaucuuugguuaa

SEQ ID NO: 494838 - RNA, 22 nt, Human
auauuaauuauuuacacaugag

SEQ ID NO: 494839 - RNA, 22 nt, Human
ggcuucauggaggaggugaguc

SEQ ID NO: 494840 - RNA, 20 nt, Human
ccaagagcaugcaugaggaa

SEQ ID NO: 494841 - RNA, 22 nt, Human
aguggaccagaagacugaagcu

SEQ ID NO: 494842 - RNA, 22 nt, Human
aggaagaggguggcagauaauc

SEQ ID NO: 494843 - RNA, 22 nt, Human
gaggagggccuggugucccuuc

SEQ ID NO: 494844 - RNA, 22 nt, Human
uugucccaggacuugcauagau

SEQ ID NO: 494845 - RNA, 22 nt, Human
acuguucaaguuuuaugcugga

SEQ ID NO: 494846 - RNA, 22 nt, Human
acaguguuauuucugaguaaug

SEQ ID NO: 494847 - RNA, 22 nt, Human
ucccagagaaagucaaggucuu

SEQ ID NO: 494848 - RNA, 22 nt, Human
agucauuaagacaacuggagua

SEQ ID NO: 494849 - RNA, 22 nt, Human
ggccucuguucugcauuccucc

SEQ ID NO: 494850 - RNA, 22 nt, Human
aagcaauguguuaaugaaugag

SEQ ID NO: 494851 - RNA, 22 nt, Human
guucacacuuuugauaugugaa

SEQ ID NO: 494852 - RNA, 22 nt, Human
gugccugggguugagcuaugaa

SEQ ID NO: 494853 - RNA, 22 nt, Human
gcuccaguggacugggggaggc

SEQ ID NO: 494854 - RNA, 22 nt, Human
cuggccagccugucgaugcccu

SEQ ID NO: 494855 - RNA, 22 nt, Human
cucaggauccaucuccugcccu

SEQ ID NO: 494856 - RNA, 20 nt, Human
ugggauuguuuuuuagcuuc

SEQ ID NO: 494857 - RNA, 22 nt, Human
gucuggcuguccagcuuaucua

SEQ ID NO: 494858 - RNA, 20 nt, Human
uuucuguaaggcauuaaucu

SEQ ID NO: 494859 - RNA, 22 nt, Human
aggggcucaguuacuuuggcag

SEQ ID NO: 494860 - RNA, 22 nt, Human
aggccuggcuuugguuugcuga

SEQ ID NO: 494861 - RNA, 22 nt, Human
acagugugaugggccugccuga

SEQ ID NO: 494862 - RNA, 22 nt, Human
ugcauuccuuugucuguuaaag

SEQ ID NO: 494863 - RNA, 22 nt, Human
gcagcugggacacugaggccag

SEQ ID NO: 494864 - RNA, 22 nt, Human
ucugcuguugagcacaagugaa

SEQ ID NO: 494865 - RNA, 22 nt, Human
gcugcccugugguccagcaggu

SEQ ID NO: 494866 - RNA, 22 nt, Human
cagggcuguuagcugcugcucu

SEQ ID NO: 494867 - RNA, 22 nt, Human
uccugagagcagaguccaggug

SEQ ID NO: 494868 - RNA, 22 nt, Human
uuuuagaaauacugauuuagug

SEQ ID NO: 494869 - RNA, 22 nt, Human
ggagaagggcaugguaguuuua

SEQ ID NO: 494870 - RNA, 22 nt, Human
ugauugaauucaaaugcaaucu

SEQ ID NO: 494871 - RNA, 23 nt, Human
cccaggcuacaaauuaugcucug

SEQ ID NO: 494872 - RNA, 22 nt, Human
ggcucagguuuccuucccagcu

SEQ ID NO: 494873 - RNA, 22 nt, Human
uagauuucucauucauagauug

SEQ ID NO: 494874 - RNA, 22 nt, Human
gcagacaggcccaguggaggga

SEQ ID NO: 494875 - RNA, 22 nt, Human
cauacauugcucauucaguauc

SEQ ID NO: 494876 - RNA, 22 nt, Human
ucagugcuugccucuggaggag

SEQ ID NO: 494877 - RNA, 22 nt, Human
gagagaagaaagccaugguccu

SEQ ID NO: 494878 - RNA, 22 nt, Human
ugccaggcagugucagauugag

SEQ ID NO: 494879 - RNA, 22 nt, Human
auuuuucucucacacuuaccag

SEQ ID NO: 494880 - RNA, 22 nt, Human
aaaucagaaaauauggagagga

SEQ ID NO: 494881 - RNA, 22 nt, Human
gcuaggaggaagaaugugaauu

SEQ ID NO: 494882 - RNA, 22 nt, Human
uccuggccaggaugaccuaaca

SEQ ID NO: 494883 - RNA, 22 nt, Human
ggcggggccucgcgaacggccu

SEQ ID NO: 494884 - RNA, 22 nt, Human
agucucuuaaugggcagaaagu

SEQ ID NO: 494885 - RNA, 22 nt, Human
gcucuggguagccacugccugg

SEQ ID NO: 494886 - RNA, 22 nt, Human
uguggggaucuucuagcuuuuc

SEQ ID NO: 494887 - RNA, 22 nt, Human
cugaggcacccaucuucuccug

SEQ ID NO: 494888 - RNA, 22 nt, Human
cuuuggcaugguccucacuaua

SEQ ID NO: 494889 - RNA, 22 nt, Human
cugaggcugaagagggccuacg

SEQ ID NO: 494890 - RNA, 22 nt, Human
guauuagggccaaaggcaggaa

SEQ ID NO: 494891 - RNA, 20 nt, Human
cugugcuuuggaaccuggaa

SEQ ID NO: 494892 - RNA, 22 nt, Human
aggcugccucgugagcucgcug

SEQ ID NO: 494893 - RNA, 22 nt, Human
acaguuugcccugacauucucc

SEQ ID NO: 494894 - RNA, 22 nt, Human
ccugauggagcccugcugcaug

SEQ ID NO: 494895 - RNA, 22 nt, Human
uguguacacacagauauauaca

SEQ ID NO: 494896 - RNA, 22 nt, Human
gcaguggauccaaugguaucuu

SEQ ID NO: 494897 - RNA, 22 nt, Human
uggggcaguggcuuuucacccu

SEQ ID NO: 494898 - RNA, 22 nt, Human
ccugagagcgaguggccucaug

SEQ ID NO: 494899 - RNA, 22 nt, Human
ugccaggccucaggagucucca

SEQ ID NO: 494900 - RNA, 22 nt, Human
ccagggcuggugggagaugcug

SEQ ID NO: 494901 - RNA, 22 nt, Human
aggccccaaagcagugcaagua

SEQ ID NO: 494902 - RNA, 22 nt, Human
ugggacugcucuugcugggguc

SEQ ID NO: 494903 - RNA, 22 nt, Human
cucucuggaccucaacuauuuu

SEQ ID NO: 494904 - RNA, 22 nt, Human
ucagguccuuacugugcucccu

SEQ ID NO: 494905 - RNA, 22 nt, Human
agaggcugagaaacccucuucu

SEQ ID NO: 494906 - RNA, 22 nt, Human
caaagguaaagaucugcugugg

SEQ ID NO: 494907 - RNA, 22 nt, Human
acagccaggaauucuggagaag

SEQ ID NO: 494908 - RNA, 22 nt, Human
cugcucugacccuuucaccuuc

SEQ ID NO: 494909 - RNA, 22 nt, Human
aaaauacuguggaguguugaaa

SEQ ID NO: 494910 - RNA, 22 nt, Human
agcugcucaggagagccagguc

SEQ ID NO: 494911 - RNA, 22 nt, Human
agcagcaauggaaagcaacaca

SEQ ID NO: 494912 - RNA, 20 nt, Human
gccagaggccggcaggggcu

SEQ ID NO: 494913 - RNA, 18 nt, Human
ccuguguguguugcaggc

SEQ ID NO: 494914 - RNA, 23 nt, Human
ggccacuuugugucaguaugugc

SEQ ID NO: 494915 - RNA, 22 nt, Human
uccugggcugugugccacucug

SEQ ID NO: 494916 - RNA, 22 nt, Human
gcacagaacccuaucuuucgga

SEQ ID NO: 494917 - RNA, 22 nt, Human
uccucaguggggcauucauuau

SEQ ID NO: 494918 - RNA, 23 nt, Human
ugaugggaaggaacgacuaccac

SEQ ID NO: 494919 - RNA, 22 nt, Human
cuguggcucuccaauggaggga

SEQ ID NO: 494920 - RNA, 22 nt, Human
caagaaaugggauuugacugcc

SEQ ID NO: 494921 - RNA, 23 nt, Human
auaauaacgucugucuugucucu

SEQ ID NO: 494922 - RNA, 22 nt, Human
aacauacagugagcaguggacu

SEQ ID NO: 494923 - RNA, 22 nt, Human
aaaugcacaaaguaaguguaau

SEQ ID NO: 494924 - RNA, 22 nt, Human
accagagaaaacacagcaggcu

SEQ ID NO: 494925 - RNA, 22 nt, Human
cauaguaaauaaugcagaugau

SEQ ID NO: 494926 - RNA, 22 nt, Human
uugagaagguggucauuugcaa

SEQ ID NO: 494927 - RNA, 22 nt, Human
ggcagucagugugguucauaaa

SEQ ID NO: 494928 - RNA, 22 nt, Human
auuuagaaccccuuccaaccug

SEQ ID NO: 494929 - RNA, 22 nt, Human
ccucagucugucugaucugcca

SEQ ID NO: 494930 - RNA, 22 nt, Human
ugaggugaccgcagaugggaag

SEQ ID NO: 494931 - RNA, 22 nt, Human
uggcaggcaaguucagcuccac

SEQ ID NO: 494932 - RNA, 22 nt, Human
aggcuccaccagucaggugcau

SEQ ID NO: 494933 - RNA, 22 nt, Human
gaugaaaugcugagccugaguu

SEQ ID NO: 494934 - RNA, 22 nt, Human
uuucagagaauuagaagcugau

SEQ ID NO: 494935 - RNA, 22 nt, Human
ugggggcugugcacaggcucac

SEQ ID NO: 494936 - RNA, 18 nt, Human
ccucuggguuuuguuccc

SEQ ID NO: 494937 - RNA, 22 nt, Human
ccagggaggguccuguggcuuc

SEQ ID NO: 494938 - RNA, 20 nt, Human
aggaaagccugugugagucu

SEQ ID NO: 494939 - RNA, 22 nt, Human
ccagcucuagccccauguggcu

SEQ ID NO: 494940 - RNA, 22 nt, Human
uuuuuugucuugaagaaauggu

SEQ ID NO: 494941 - RNA, 22 nt, Human
cuauuagguuggugcaaaagua

SEQ ID NO: 494942 - RNA, 22 nt, Human
uucauuugggaugagucagaag

SEQ ID NO: 494943 - RNA, 19 nt, Human
uggccaccucugcuguucu

SEQ ID NO: 494944 - RNA, 22 nt, Human
acuggagcccguggaggcgcag

SEQ ID NO: 494945 - RNA, 22 nt, Human
aauugugcuaugauuaugaaag

SEQ ID NO: 494946 - RNA, 22 nt, Human
ucugcagaaggaaucagcugag

SEQ ID NO: 494947 - RNA, 22 nt, Human
uucccucuccaggagcccugag

SEQ ID NO: 494948 - RNA, 22 nt, Human
ugcaagggcuuagggggcugug

SEQ ID NO: 494949 - RNA, 22 nt, Human
cuggaucuucagagaucaccag

SEQ ID NO: 494950 - RNA, 22 nt, Human
uucaggaugaaagugugcaaca

SEQ ID NO: 494951 - RNA, 18 nt, Human
ccauuucaugauuauuac

SEQ ID NO: 494952 - RNA, 22 nt, Human
agcaggggcuccuccacagcca

SEQ ID NO: 494953 - RNA, 18 nt, Human
cuccugggcugcagaugc

SEQ ID NO: 494954 - RNA, 19 nt, Human
cuuugcuuguuucuguguc

SEQ ID NO: 494955 - RNA, 22 nt, Human
cuccucugucuaccacgagggu

SEQ ID NO: 494956 - RNA, 22 nt, Human
agaaaguucugugaguuguuca

SEQ ID NO: 494957 - RNA, 22 nt, Human
gaauacaagccaggcacaaggc

SEQ ID NO: 494958 - RNA, 22 nt, Human
auuucaaguguugagcucauaa

SEQ ID NO: 494959 - RNA, 22 nt, Human
ugagggaguuggguguauagga

SEQ ID NO: 494960 - RNA, 19 nt, Human
cagaggcaccagguauaga

SEQ ID NO: 494961 - RNA, 22 nt, Human
agagggggugucagcacugcag

SEQ ID NO: 494962 - RNA, 22 nt, Human
gguggcugaagcagucuucggg

SEQ ID NO: 494963 - RNA, 22 nt, Human
cacacagacagcucucugaaga

SEQ ID NO: 494964 - RNA, 22 nt, Human
agcugcucugauaaaccuacuu

SEQ ID NO: 494965 - RNA, 22 nt, Human
acagcauucccuuuggcugcuu

SEQ ID NO: 494966 - RNA, 22 nt, Human
uguaugaagacuucuucugugu

SEQ ID NO: 494967 - RNA, 22 nt, Human
cugggccuggacgggcagaucu

SEQ ID NO: 494968 - RNA, 22 nt, Human
cuggagcucagcccagguucca

SEQ ID NO: 494969 - RNA, 22 nt, Human
cucaccccuguaauuccagcac

SEQ ID NO: 494970 - RNA, 22 nt, Human
uccccacagcagaagaucugag

SEQ ID NO: 494971 - RNA, 22 nt, Human
uguuuauucauggcuaaugaaa

SEQ ID NO: 494972 - RNA, 22 nt, Human
cagcuauuuugccuaucauggu

SEQ ID NO: 494973 - RNA, 22 nt, Human
aggucauuaaaguuaaaugagg

SEQ ID NO: 494974 - RNA, 22 nt, Human
agaagcaggccucacagaucug

SEQ ID NO: 494975 - RNA, 22 nt, Human
ggcaggugcgcauguugcauua

SEQ ID NO: 494976 - RNA, 22 nt, Human
aagguccuuuugcagugugauc

SEQ ID NO: 494977 - RNA, 22 nt, Human
uuuuaucaaucauuaagacauu

SEQ ID NO: 494978 - RNA, 22 nt, Human
cuguauaacaucuuuuguuucc

SEQ ID NO: 494979 - RNA, 22 nt, Human
cuuggcagagggcugggcucag

SEQ ID NO: 494980 - RNA, 22 nt, Human
ugagccccggaguuucaggcug

SEQ ID NO: 494981 - RNA, 22 nt, Human
uuucagaaagcaucaucaaagu

SEQ ID NO: 494982 - RNA, 22 nt, Human
uccugcagucugcacucugccu

SEQ ID NO: 494983 - RNA, 22 nt, Human
gagagguaauuugaagugcaaa

SEQ ID NO: 494984 - RNA, 22 nt, Human
uccuccuccucacagucaccug

SEQ ID NO: 494985 - RNA, 22 nt, Human
caggcauggugagaacucagcc

SEQ ID NO: 494986 - RNA, 22 nt, Human
auaaagauuucuuuuucucuac

SEQ ID NO: 494987 - RNA, 22 nt, Human
gucuggcuuugcucagaugcug

SEQ ID NO: 494988 - RNA, 22 nt, Human
ucccagcuacucuagaggcuga

SEQ ID NO: 494989 - RNA, 22 nt, Human
gcuggggaggcagcagagaaca

SEQ ID NO: 494990 - RNA, 22 nt, Human
aaaggucaaaaucgugacauug

SEQ ID NO: 494991 - RNA, 22 nt, Human
gggggcuguccugugcauugua

SEQ ID NO: 494992 - RNA, 21 nt, Human
gagacagcccagugccagggc

SEQ ID NO: 494993 - RNA, 22 nt, Human
auuuuguuauagaacucuguga

SEQ ID NO: 494994 - RNA, 22 nt, Human
acacagguacacauauguaccu

SEQ ID NO: 494995 - RNA, 22 nt, Human
cugagcagcacagggcgccagg

SEQ ID NO: 494996 - RNA, 22 nt, Human
ugcccuggagucaguggcuauu

SEQ ID NO: 494997 - RNA, 22 nt, Human
ggcuggcuugccaagcucaggg

SEQ ID NO: 494998 - RNA, 22 nt, Human
cagguccaacuauuuaucugug

SEQ ID NO: 494999 - RNA, 22 nt, Human
gaaucucauucuaacuaguagg

SEQ ID NO: 495000 - RNA, 22 nt, Human
acuguguggaaauuugugaggg

SEQ ID NO: 495001 - RNA, 22 nt, Human
ccuggggaccugccucagcccu

SEQ ID NO: 495002 - RNA, 22 nt, Human
agcagagucugugugcacuuua

SEQ ID NO: 495003 - RNA, 22 nt, Human
cuggguggaaagugcugagaau

SEQ ID NO: 495004 - RNA, 22 nt, Human
gacacagaugaucaggugugga

SEQ ID NO: 495005 - RNA, 22 nt, Human
cacagagcugaaccugggucau

SEQ ID NO: 495006 - RNA, 22 nt, Human
gcaggcaggagcccaacugccu

SEQ ID NO: 495007 - RNA, 22 nt, Human
ucuguaggacagagaaaugggg

SEQ ID NO: 495008 - RNA, 22 nt, Human
gccucugcugcaagccugguug

SEQ ID NO: 495009 - RNA, 22 nt, Human
uggagugaaguaaagaggacaa

SEQ ID NO: 495010 - RNA, 22 nt, Human
ggaaagagggacccagcuuggu

SEQ ID NO: 495011 - RNA, 22 nt, Human
gucaggaagcaagguugggcau

SEQ ID NO: 495012 - RNA, 22 nt, Human
gcugccugauuuacauagugaa

SEQ ID NO: 495013 - RNA, 22 nt, Human
uggauuugcuaccuucugauau

SEQ ID NO: 495014 - RNA, 21 nt, Human
ucaguaaaccuaaagauugua

SEQ ID NO: 495015 - RNA, 22 nt, Human
ccugucucuuucaaucugagag

SEQ ID NO: 495016 - RNA, 22 nt, Human
ggccugcuuuccgagccugcag

SEQ ID NO: 495017 - RNA, 21 nt, Human
accucaagcaacaaccaaggu

SEQ ID NO: 495018 - RNA, 22 nt, Human
ggcucccuggcccuggggacac

SEQ ID NO: 495019 - RNA, 22 nt, Human
gucucagaguccuacuuauucc

SEQ ID NO: 495020 - RNA, 22 nt, Human
aacagaauugcugcugccaaug

SEQ ID NO: 495021 - RNA, 22 nt, Human
ccaugggaauugggagguccca

SEQ ID NO: 495022 - RNA, 22 nt, Human
agagugaaaagcuagagcagua

SEQ ID NO: 495023 - RNA, 22 nt, Human
cagaggccaccuguggccacug

SEQ ID NO: 495024 - RNA, 22 nt, Human
agccagccaguucacuaggaaa

SEQ ID NO: 495025 - RNA, 22 nt, Human
gaaauacaaagccagccauuuu

SEQ ID NO: 495026 - RNA, 22 nt, Human
auugacaagcaguaugucuuag

SEQ ID NO: 495027 - RNA, 22 nt, Human
agugucaacucggaauaaggau

SEQ ID NO: 495028 - RNA, 22 nt, Human
uagacacaagagaaggguauaa

SEQ ID NO: 495029 - RNA, 22 nt, Human
gggcggcgucggcgaggccauc

SEQ ID NO: 495030 - RNA, 22 nt, Human
augaaggcuguguagauggaug

SEQ ID NO: 495031 - RNA, 22 nt, Human
ggccucaguuucuccauggguu

SEQ ID NO: 495032 - RNA, 22 nt, Human
aagacacacacauaugcugagu

SEQ ID NO: 495033 - RNA, 22 nt, Human
aggcuacagauacagaggcuac

SEQ ID NO: 495034 - RNA, 22 nt, Human
ugucagcaguaucucuaucuca

SEQ ID NO: 495035 - RNA, 22 nt, Human
gugucccaauguucaggacggc

SEQ ID NO: 495036 - RNA, 21 nt, Human
guggcucugccaggacugaaa

SEQ ID NO: 495037 - RNA, 22 nt, Human
cauuugaaugagauugcuguaa

SEQ ID NO: 495038 - RNA, 19 nt, Human
ugcuggaggguagugaguc

SEQ ID NO: 495039 - RNA, 22 nt, Human
gacuguggcaggcucagcacug

SEQ ID NO: 495040 - RNA, 22 nt, Human
acagcagcuggguucccaccau

SEQ ID NO: 495041 - RNA, 22 nt, Human
ggcagugagaggucuccugguc

SEQ ID NO: 495042 - RNA, 18 nt, Human
uuuccuuguaugaacaua

SEQ ID NO: 495043 - RNA, 22 nt, Human
ucucugggcuaaaaucaaggug

SEQ ID NO: 495044 - RNA, 22 nt, Human
gcaguccaaaguggcucucacc

SEQ ID NO: 495045 - RNA, 22 nt, Human
uaaaaguauacuuucaaaggag

SEQ ID NO: 495046 - RNA, 22 nt, Human
gcagccugaugaucuggguugu

SEQ ID NO: 495047 - RNA, 22 nt, Human
guagcuucaaguacucucccug

SEQ ID NO: 495048 - RNA, 22 nt, Human
agcagcuggggccugugacgau

SEQ ID NO: 495049 - RNA, 22 nt, Human
agguuucuggauuuauuauggc

SEQ ID NO: 495050 - RNA, 22 nt, Human
aaugggaaagagacuagaugcu

SEQ ID NO: 495051 - RNA, 21 nt, Human
gggcuggacaugguggcucau

SEQ ID NO: 495052 - RNA, 22 nt, Human
uccaggagguaugaguggcccc

SEQ ID NO: 495053 - RNA, 22 nt, Human
cauucauuuaugaaauaucuau

SEQ ID NO: 495054 - RNA, 22 nt, Human
acauugaagcugugaaaucaaa

SEQ ID NO: 495055 - RNA, 22 nt, Human
aacuacauagaaauuaguauuu

SEQ ID NO: 495056 - RNA, 22 nt, Human
caguuaccagaucgcaggaggu

SEQ ID NO: 495057 - RNA, 22 nt, Human
ccagguggaaggucugugcucu

SEQ ID NO: 495058 - RNA, 20 nt, Human
guauuaggagguaaauguaa

SEQ ID NO: 495059 - RNA, 18 nt, Human
aggcuucuuggcucaguc

SEQ ID NO: 495060 - RNA, 22 nt, Human
ugagcuggcacuuuuccuggga

SEQ ID NO: 495061 - RNA, 22 nt, Human
ggggucccugcaccagcauguc

SEQ ID NO: 495062 - RNA, 22 nt, Human
auguggcugccaccugccugaa

SEQ ID NO: 495063 - RNA, 20 nt, Human
cuggcccaggaugauggcgc

SEQ ID NO: 495064 - RNA, 22 nt, Human
agaaauguauagugaauuuuuc

SEQ ID NO: 495065 - RNA, 22 nt, Human
agccccacacucucucugagaa

SEQ ID NO: 495066 - RNA, 22 nt, Human
cuggaaggugacugucuugaau

SEQ ID NO: 495067 - RNA, 22 nt, Human
aggcugcuucagcugcagggag

SEQ ID NO: 495068 - RNA, 22 nt, Human
ucuggccccgcaugcacuuuau

SEQ ID NO: 495069 - RNA, 22 nt, Human
uggaguucucaggugagggcuu

SEQ ID NO: 495070 - RNA, 22 nt, Human
ggcaguagccagggacuggcag

SEQ ID NO: 495071 - RNA, 22 nt, Human
ucugaggcauacccaggccccc

SEQ ID NO: 495072 - RNA, 22 nt, Human
cacuggcaugugaggcgguggc

SEQ ID NO: 495073 - RNA, 22 nt, Human
gaguguuccagaaacuggcccu

SEQ ID NO: 495074 - RNA, 22 nt, Human
aaggccugaacaugaggagaug

SEQ ID NO: 495075 - RNA, 22 nt, Human
gcucucugucguuaugcuucau

SEQ ID NO: 495076 - RNA, 22 nt, Human
ucccagccacagguguagcccu

SEQ ID NO: 495077 - RNA, 22 nt, Human
ugccugugcccuucuuggcauu

SEQ ID NO: 495078 - RNA, 22 nt, Human
ugaggcagugauguuuaagcac

SEQ ID NO: 495079 - RNA, 22 nt, Human
gcuucuggaggagcugggcuga

SEQ ID NO: 495080 - RNA, 22 nt, Human
aagugcuuuacaaaugucuguu

SEQ ID NO: 495081 - RNA, 15 nt, Human
cacacagacagcuug

SEQ ID NO: 495082 - RNA, 22 nt, Human
caggaugagguagaggcagaua

SEQ ID NO: 495083 - RNA, 22 nt, Human
uucugagcugcaacacuaacau

SEQ ID NO: 495084 - RNA, 22 nt, Human
gucacuuuauuaauuuugguga

SEQ ID NO: 495085 - RNA, 22 nt, Human
aagcagcuucccuggcuccugg

SEQ ID NO: 495086 - RNA, 22 nt, Human
ugagguucaguucuuggccaca

SEQ ID NO: 495087 - RNA, 23 nt, Human
ugggccuggccucccaguccagc

SEQ ID NO: 495088 - RNA, 22 nt, Human
auagacuugguuaguaaauuug

SEQ ID NO: 495089 - RNA, 22 nt, Human
ggcugaggcucaugccaucuug

SEQ ID NO: 495090 - RNA, 22 nt, Human
caggggcucugagauugucuaa

SEQ ID NO: 495091 - RNA, 22 nt, Human
cauggcccucuucuggagcaau

SEQ ID NO: 495092 - RNA, 22 nt, Human
ucaguguuuaccguauguuguu

SEQ ID NO: 495093 - RNA, 19 nt, Human
uggagguccaggaguaggg

SEQ ID NO: 495094 - RNA, 22 nt, Human
uuugaaaggguuaugagacuga

SEQ ID NO: 495095 - RNA, 22 nt, Human
cagcccuggcccaggugccuua

SEQ ID NO: 495096 - RNA, 22 nt, Human
gcuggaaggcuaggcucaguug

SEQ ID NO: 495097 - RNA, 22 nt, Human
uaccagccucaguugugagccc

SEQ ID NO: 495098 - RNA, 22 nt, Human
uuugaauaaacgguuaauguuc

SEQ ID NO: 495099 - RNA, 19 nt, Human
agguggucuaggcuggaga

SEQ ID NO: 495100 - RNA, 22 nt, Human
uaaaguuuggcagacaauaaca

SEQ ID NO: 495101 - RNA, 22 nt, Human
uccucaguauuguggagcagau

SEQ ID NO: 495102 - RNA, 22 nt, Human
cuguguccugcgucaagccaau

SEQ ID NO: 495103 - RNA, 22 nt, Human
aaaggucagcugccaucguucu

SEQ ID NO: 495104 - RNA, 22 nt, Human
cagaagcacauguuuacaugua

SEQ ID NO: 495105 - RNA, 22 nt, Human
ugcucuggcuggagcaaugacu

SEQ ID NO: 495106 - RNA, 22 nt, Human
gcuggagaguaguaagcaguua

SEQ ID NO: 495107 - RNA, 22 nt, Human
uugcuuccucuaguuucuugaa

SEQ ID NO: 495108 - RNA, 22 nt, Human
gccaggcugguuauuuaaugag

SEQ ID NO: 495109 - RNA, 22 nt, Human
uuaggaaauuaugguuucagau

SEQ ID NO: 495110 - RNA, 22 nt, Human
caggcacugugcuagauccuug

SEQ ID NO: 495111 - RNA, 22 nt, Human
uugucugaaucuggagcucucu

SEQ ID NO: 495112 - RNA, 22 nt, Human
uguguucuuaaaagcagugaua

SEQ ID NO: 495113 - RNA, 22 nt, Human
uguccacaucacucacuuguca

SEQ ID NO: 495114 - RNA, 22 nt, Human
uccucaggucaaagcaggagaa

SEQ ID NO: 495115 - RNA, 22 nt, Human
ggccaccugggaucucauccug

SEQ ID NO: 495116 - RNA, 17 nt, Human
ccagagaguaguuagga

SEQ ID NO: 495117 - RNA, 22 nt, Human
acagaugaauuuuaauuguguu

SEQ ID NO: 495118 - RNA, 22 nt, Human
caguaugucuacuggacaaagu

SEQ ID NO: 495119 - RNA, 22 nt, Human
gccuggcaggggccugggagug

SEQ ID NO: 495120 - RNA, 22 nt, Human
acugggcucauaaugucauaga

SEQ ID NO: 495121 - RNA, 22 nt, Human
ucugagaguacgggcugcgcgc

SEQ ID NO: 495122 - RNA, 22 nt, Human
gcagaggcuguagggaagguug

SEQ ID NO: 495123 - RNA, 22 nt, Human
augauauuuuaguaaagugaua

SEQ ID NO: 495124 - RNA, 22 nt, Human
aagauguucuauuuucacuuuu

SEQ ID NO: 495125 - RNA, 22 nt, Human
acuguuuucuuagcucccugcu

SEQ ID NO: 495126 - RNA, 22 nt, Human
cugugucggacgugggcagcag

SEQ ID NO: 495127 - RNA, 21 nt, Human
uaaagaagaugaaugugauca

SEQ ID NO: 495128 - RNA, 22 nt, Human
acacacuguaaggacuaucacu

SEQ ID NO: 495129 - RNA, 22 nt, Human
cucacugucuguacuagcugau

SEQ ID NO: 495130 - RNA, 22 nt, Human
ucugugugugccuguuaauauu

SEQ ID NO: 495131 - RNA, 22 nt, Human
gcuggaggcaguucagacacca

SEQ ID NO: 495132 - RNA, 23 nt, Human
aggagccaggugcagcccuugug

SEQ ID NO: 495133 - RNA, 22 nt, Human
agcucccugagaugccacagca

SEQ ID NO: 495134 - RNA, 22 nt, Human
guguuaaccagcuaaacuuugc

SEQ ID NO: 495135 - RNA, 22 nt, Human
cugagcacagaaauaagauauu

SEQ ID NO: 495136 - RNA, 22 nt, Human
cagcaguggccaucuguguggu

SEQ ID NO: 495137 - RNA, 22 nt, Human
cucagcagcagggaagagguca

SEQ ID NO: 495138 - RNA, 22 nt, Human
ucacuuaaaaauucuaguuaug

SEQ ID NO: 495139 - RNA, 22 nt, Human
ggcaggagggcggacaaugacc

SEQ ID NO: 495140 - RNA, 20 nt, Human
ccagucccugagcaccaggg

SEQ ID NO: 495141 - RNA, 22 nt, Human
uuuaaauucugucugccgcuua

SEQ ID NO: 495142 - RNA, 22 nt, Human
ugcugaaugugcucccuuuuaa

SEQ ID NO: 495143 - RNA, 22 nt, Human
gcagggacagggcagggccuuu

SEQ ID NO: 495144 - RNA, 22 nt, Human
ccucccguauauguccugggcu

SEQ ID NO: 495145 - RNA, 22 nt, Human
uaggaaauauuugaacauagga

SEQ ID NO: 495146 - RNA, 22 nt, Human
uugaagcaaggcgaaucuugug

SEQ ID NO: 495147 - RNA, 22 nt, Human
cagcuuuggcccagucgggagg

SEQ ID NO: 495148 - RNA, 22 nt, Human
ucacuggggccuuuggucagga

SEQ ID NO: 495149 - RNA, 22 nt, Human
aucuggcuuacgaagcacuggu

SEQ ID NO: 495150 - RNA, 22 nt, Human
aauuagggagccaucauaaggu

SEQ ID NO: 495151 - RNA, 21 nt, Human
ucauuugugaucugauuucca

SEQ ID NO: 495152 - RNA, 22 nt, Human
aaauccuaaggagaauaugauu

SEQ ID NO: 495153 - RNA, 22 nt, Human
ugcaggugcugugucaagagag

SEQ ID NO: 495154 - RNA, 22 nt, Human
auauucuugugauuauaaagua

SEQ ID NO: 495155 - RNA, 22 nt, Human
ucagaagcauguggggagccug

SEQ ID NO: 495156 - RNA, 22 nt, Human
cauguacaguuuuucuguccug

SEQ ID NO: 495157 - RNA, 22 nt, Human
uggcuucugggacuugugagca

SEQ ID NO: 495158 - RNA, 22 nt, Human
cugcuuugaaaauaaacuuguc

SEQ ID NO: 495159 - RNA, 22 nt, Human
ccggcucggcgaccaggcugaa

SEQ ID NO: 495160 - RNA, 22 nt, Human
ucagagccaaucauggugcauu

SEQ ID NO: 495161 - RNA, 22 nt, Human
gccccuugucuccaggccccaa

SEQ ID NO: 495162 - RNA, 22 nt, Human
caaagcuauaaauucagacaga

SEQ ID NO: 495163 - RNA, 22 nt, Human
gaggcucagagagguccacaua

SEQ ID NO: 495164 - RNA, 22 nt, Human
ccagggugcucuguggcgucgc

SEQ ID NO: 495165 - RNA, 22 nt, Human
aagacugugucuauggcuacuc

SEQ ID NO: 495166 - RNA, 22 nt, Human
uuugcauugcauacaaggaacu

SEQ ID NO: 495167 - RNA, 22 nt, Human
cuuccccaaguagagaggggag

SEQ ID NO: 495168 - RNA, 22 nt, Human
gaauuguacgcuuuacauaggu

SEQ ID NO: 495169 - RNA, 22 nt, Human
caaguccucgcuucuagcugug

SEQ ID NO: 495170 - RNA, 22 nt, Human
ggacucuguuuuccugaucacu

SEQ ID NO: 495171 - RNA, 22 nt, Human
ucccccuccaauugccauguua

SEQ ID NO: 495172 - RNA, 22 nt, Human
ccugccugaaggucagccaccc

SEQ ID NO: 495173 - RNA, 22 nt, Human
gcugaaugaauguauuuuaaaa

SEQ ID NO: 495174 - RNA, 22 nt, Human
uuaaagcaccuccuuggaugug

SEQ ID NO: 495175 - RNA, 22 nt, Human
cuuccugcauugugccagaguu

SEQ ID NO: 495176 - RNA, 22 nt, Human
acaaguaggugcacuucaauag

SEQ ID NO: 495177 - RNA, 22 nt, Human
ggcagagugcucugggcagggg

SEQ ID NO: 495178 - RNA, 22 nt, Human
ccucuucuaggacguccuugug

SEQ ID NO: 495179 - RNA, 19 nt, Human
gacuuuggaaaugcuguuu

SEQ ID NO: 495180 - RNA, 23 nt, Human
uccaggagaauuccagggcccgg

SEQ ID NO: 495181 - RNA, 22 nt, Human
gcucuggggcccagggaucaca

SEQ ID NO: 495182 - RNA, 22 nt, Human
uagagaauggccuugaaguagu

SEQ ID NO: 495183 - RNA, 22 nt, Human
cauuugcagagggugacacucu

SEQ ID NO: 495184 - RNA, 22 nt, Human
ccuugcucaagcuagugacggg

SEQ ID NO: 495185 - RNA, 22 nt, Human
aaagcagagaucauggcuugua

SEQ ID NO: 495186 - RNA, 22 nt, Human
agaaucaacugaaaauugguga

SEQ ID NO: 495187 - RNA, 22 nt, Human
cagauggaacacagaaaggaga

SEQ ID NO: 495188 - RNA, 22 nt, Human
uguggcugaucaaagcgcucag

SEQ ID NO: 495189 - RNA, 22 nt, Human
uacaaaguagaaauucaguaaa

SEQ ID NO: 495190 - RNA, 22 nt, Human
gcugagguggcugccuuaguaa

SEQ ID NO: 495191 - RNA, 22 nt, Human
ggaucugggguagagcaguggg

SEQ ID NO: 495192 - RNA, 22 nt, Human
gccuccugaaaggaagagcucc

SEQ ID NO: 495193 - RNA, 22 nt, Human
uggggccugagguggagcugca

SEQ ID NO: 495194 - RNA, 22 nt, Human
gagccaaggguugccauggaga

SEQ ID NO: 495195 - RNA, 22 nt, Human
ccagggugugggcgucggcacg

SEQ ID NO: 495196 - RNA, 22 nt, Human
acccaggagguggaggcugcag

SEQ ID NO: 495197 - RNA, 22 nt, Human
guccuggggauuauagaguguu

SEQ ID NO: 495198 - RNA, 19 nt, Human
cucugccucccuccugggu

SEQ ID NO: 495199 - RNA, 22 nt, Human
uuuuggaugagcccagauuucu

SEQ ID NO: 495200 - RNA, 22 nt, Human
auucuacaacccaauaauaauu

SEQ ID NO: 495201 - RNA, 22 nt, Human
augcaguaaauguucuaguuug

SEQ ID NO: 495202 - RNA, 22 nt, Human
uccauguggccagacacuggca

SEQ ID NO: 495203 - RNA, 22 nt, Human
aaguucaaucagaugaaaaagc

SEQ ID NO: 495204 - RNA, 22 nt, Human
agcagcacgaguccacaaaucc

SEQ ID NO: 495205 - RNA, 22 nt, Human
uacacacaugcauuugccuuau

SEQ ID NO: 495206 - RNA, 22 nt, Human
uggcaaggcugugggggcagag

SEQ ID NO: 495207 - RNA, 22 nt, Human
agccccuugcacuuccccacgc

SEQ ID NO: 495208 - RNA, 22 nt, Human
cagggcucaccacugggauccu

SEQ ID NO: 495209 - RNA, 22 nt, Human
agcuccaggauaagacaggugc

SEQ ID NO: 495210 - RNA, 22 nt, Human
ugggaggcuuccagaccuugcu

SEQ ID NO: 495211 - RNA, 22 nt, Human
gagagcugucagcguagcaccg

SEQ ID NO: 495212 - RNA, 22 nt, Human
uacauucccccaauuaccaaug

SEQ ID NO: 495213 - RNA, 22 nt, Human
cagaggcgaggcagcugaaccu

SEQ ID NO: 495214 - RNA, 22 nt, Human
aggacuucuccgauaagucaga

SEQ ID NO: 495215 - RNA, 22 nt, Human
uggaaggcuuggaauacuucca

SEQ ID NO: 495216 - RNA, 22 nt, Human
uauuucuguaugcauaaaagga

SEQ ID NO: 495217 - RNA, 22 nt, Human
uguggccuccuguuccugggua

SEQ ID NO: 495218 - RNA, 22 nt, Human
aggggagaauuucaacucaggu

SEQ ID NO: 495219 - RNA, 22 nt, Human
acauuuaaauaccuauguuucu

SEQ ID NO: 495220 - RNA, 22 nt, Human
ucaauauucuucuuuaguagga

SEQ ID NO: 495221 - RNA, 22 nt, Human
ggagccugagcggcccagggcc

SEQ ID NO: 495222 - RNA, 22 nt, Human
uguuccaauaaggaguugaaau

SEQ ID NO: 495223 - RNA, 22 nt, Human
uggagaauggaauguugugcag

SEQ ID NO: 495224 - RNA, 22 nt, Human
accaagcucucuucccggcucu

SEQ ID NO: 495225 - RNA, 22 nt, Human
caaaugcaugagaaauaagagg

SEQ ID NO: 495226 - RNA, 22 nt, Human
cccuggaguccggagcucaccu

SEQ ID NO: 495227 - RNA, 22 nt, Human
ugcugaggagguggcugugcuu

SEQ ID NO: 495228 - RNA, 21 nt, Human
cucuggaguuugaaggcuggg

SEQ ID NO: 495229 - RNA, 22 nt, Human
auggacagugugucuguuucca

SEQ ID NO: 495230 - RNA, 22 nt, Human
ucccuggcagcuaagggugguc

SEQ ID NO: 495231 - RNA, 22 nt, Human
gagccaggggucagcuccgagg

SEQ ID NO: 495232 - RNA, 19 nt, Human
ucucugcuucucuuggcau

SEQ ID NO: 495233 - RNA, 23 nt, Human
auaugucaugcaccagcacuuua

SEQ ID NO: 495234 - RNA, 22 nt, Human
caagaacauugugaucacuuca

SEQ ID NO: 495235 - RNA, 22 nt, Human
agcagcugucccuuaacaucag

SEQ ID NO: 495236 - RNA, 22 nt, Human
gggcugacaguuuccccugaaa

SEQ ID NO: 495237 - RNA, 21 nt, Human
ggagucuguggaugcuguuuc

SEQ ID NO: 495238 - RNA, 22 nt, Human
gcagcauccuuggccuccaccc

SEQ ID NO: 495239 - RNA, 22 nt, Human
gcagacagcauguugggcuauu

SEQ ID NO: 495240 - RNA, 22 nt, Human
cagaaaugacaaaguaagagga

SEQ ID NO: 495241 - RNA, 22 nt, Human
cugcccugaccugccucagagu

SEQ ID NO: 495242 - RNA, 23 nt, Human
agcuuuggugaugugacagauaa

SEQ ID NO: 495243 - RNA, 22 nt, Human
agcagcauguugggaugugaaa

SEQ ID NO: 495244 - RNA, 22 nt, Human
cuuuauuccuacaagauuuucu

SEQ ID NO: 495245 - RNA, 22 nt, Human
ccugggcuuccacgagcagagg

SEQ ID NO: 495246 - RNA, 22 nt, Human
gugugcaugcauagacaccaca

SEQ ID NO: 495247 - RNA, 22 nt, Human
uucaauagaaaugacauucuuu

SEQ ID NO: 495248 - RNA, 22 nt, Human
uaggccaugcagcaaagaggcu

SEQ ID NO: 495249 - RNA, 22 nt, Human
uguauuagagcaguagaauuau

SEQ ID NO: 495250 - RNA, 22 nt, Human
acagccagggucucaggaggcg

SEQ ID NO: 495251 - RNA, 22 nt, Human
uuuaaaaucagaugggaguugg

SEQ ID NO: 495252 - RNA, 22 nt, Human
gugucaugggguuuguuauaca

SEQ ID NO: 495253 - RNA, 22 nt, Human
acuuaaaaacagauccagcagg

SEQ ID NO: 495254 - RNA, 22 nt, Human
gcugucacauuuggagcacugg

SEQ ID NO: 495255 - RNA, 22 nt, Human
gaggaaggcuaaggggcuuaga

SEQ ID NO: 495256 - RNA, 22 nt, Human
gguggcagucuuaagagaucuu

SEQ ID NO: 495257 - RNA, 22 nt, Human
gcugccugggcaggaggcgcug

SEQ ID NO: 495258 - RNA, 22 nt, Human
aggccucagugaucaucaucag

SEQ ID NO: 495259 - RNA, 19 nt, Human
uggcuuccugacucucauc

SEQ ID NO: 495260 - RNA, 22 nt, Human
agaggcucuaauaccagcaugg

SEQ ID NO: 495261 - RNA, 19 nt, Human
gggcccagcauggaggguu

SEQ ID NO: 495262 - RNA, 22 nt, Human
cugggucucuuaccaugugacu

SEQ ID NO: 495263 - RNA, 22 nt, Human
ugagcagaguuguuucuccuga

SEQ ID NO: 495264 - RNA, 22 nt, Human
aaagauguuaugaaauaacuau

SEQ ID NO: 495265 - RNA, 22 nt, Human
auaugugugaugcauggacuaa

SEQ ID NO: 495266 - RNA, 22 nt, Human
cucugugccucaguuuucuucu

SEQ ID NO: 495267 - RNA, 22 nt, Human
ucugugugguaguuucagugaa

SEQ ID NO: 495268 - RNA, 22 nt, Human
cagagaccccgcugcccuucug

SEQ ID NO: 495269 - RNA, 22 nt, Human
ugccuggaugugcuggccucac

SEQ ID NO: 495270 - RNA, 21 nt, Human
gcucaggcucuugacagagca

SEQ ID NO: 495271 - RNA, 22 nt, Human
auaacagacuuagaguuacaag

SEQ ID NO: 495272 - RNA, 22 nt, Human
ugggccaccugcucuguuucua

SEQ ID NO: 495273 - RNA, 22 nt, Human
cauuuguaguuaaaaaugucuc

SEQ ID NO: 495274 - RNA, 22 nt, Human
acagguggggaggcugagguuc

SEQ ID NO: 495275 - RNA, 22 nt, Human
uuagagccaguuacaaggucaa

SEQ ID NO: 495276 - RNA, 22 nt, Human
guacauguugguuguuuccagu

SEQ ID NO: 495277 - RNA, 22 nt, Human
caaaaguaauugugguuuuugc

SEQ ID NO: 495278 - RNA, 22 nt, Human
gcucagugcagccuuucuguau

SEQ ID NO: 495279 - RNA, 22 nt, Human
auacuguuuugugacuuaucuu

SEQ ID NO: 495280 - RNA, 22 nt, Human
auggagggaaaaguggagagcc

SEQ ID NO: 495281 - RNA, 22 nt, Human
agcagcucuggcacuguagcau

SEQ ID NO: 495282 - RNA, 22 nt, Human
ccuggagcacauggcaggaggc

SEQ ID NO: 495283 - RNA, 22 nt, Human
cuguaugaaauuaaguaaacag

SEQ ID NO: 495284 - RNA, 22 nt, Human
ccaccuccaccuauugccagcc

SEQ ID NO: 495285 - RNA, 22 nt, Human
gcaggagugacauggaugugga

SEQ ID NO: 495286 - RNA, 22 nt, Human
cucagcacuuuggaaggcugau

SEQ ID NO: 495287 - RNA, 22 nt, Human
caggaggagcauuagcgucuca

SEQ ID NO: 495288 - RNA, 22 nt, Human
cuccccagguucaggagguggg

SEQ ID NO: 495289 - RNA, 22 nt, Human
cuggaucuugcugcauugagaa

SEQ ID NO: 495290 - RNA, 22 nt, Human
guccuggaauccuagaacagug

SEQ ID NO: 495291 - RNA, 22 nt, Human
cagggcucccugcagccucugu

SEQ ID NO: 495292 - RNA, 19 nt, Human
cagaggccagaagcacagg

SEQ ID NO: 495293 - RNA, 22 nt, Human
cuuauguaugcuacuuuguggu

SEQ ID NO: 495294 - RNA, 21 nt, Human
ucagggcagugggagguuccu

SEQ ID NO: 495295 - RNA, 22 nt, Human
uagcacuauuuuucacuauccu

SEQ ID NO: 495296 - RNA, 22 nt, Human
aaugagcuagaccugcuuccuc

SEQ ID NO: 495297 - RNA, 22 nt, Human
gacagccaucagcacacgcugc

SEQ ID NO: 495298 - RNA, 22 nt, Human
cugggccugguguggcaccugc

SEQ ID NO: 495299 - RNA, 22 nt, Human
gaaacuuuuaaaccucaugagu

SEQ ID NO: 495300 - RNA, 22 nt, Human
aauuuacaguugcugaugguac

SEQ ID NO: 495301 - RNA, 22 nt, Human
gcugccuuuuaaagccucgcuu

SEQ ID NO: 495302 - RNA, 20 nt, Human
aacauugaaagucuagaaga

SEQ ID NO: 495303 - RNA, 22 nt, Human
uaauucagggccagaaucccca

SEQ ID NO: 495304 - RNA, 23 nt, Human
ccucagcauggcaggagcccagc

SEQ ID NO: 495305 - RNA, 22 nt, Human
ugucucaggcccaagccaguaa

SEQ ID NO: 495306 - RNA, 22 nt, Human
aucaggauuauuaaaucuggau

SEQ ID NO: 495307 - RNA, 22 nt, Human
uagcuuaaggaguaccagauca

SEQ ID NO: 495308 - RNA, 22 nt, Human
accauguuggccaagcuggucu

SEQ ID NO: 495309 - RNA, 22 nt, Human
cauuagggccaccauaacaaaa

SEQ ID NO: 495310 - RNA, 22 nt, Human
aaacaacuucugcacuaugggu

SEQ ID NO: 495311 - RNA, 22 nt, Human
guauuuuuaguagagucggggu

SEQ ID NO: 495312 - RNA, 22 nt, Human
ugagagggcccagagcacacca

SEQ ID NO: 495313 - RNA, 22 nt, Human
ccuggggaaaagcaggcauuua

SEQ ID NO: 495314 - RNA, 22 nt, Human
auuuuuuagaaccuggccugau

SEQ ID NO: 495315 - RNA, 22 nt, Human
ccucagugagaugcucagcgaa

SEQ ID NO: 495316 - RNA, 22 nt, Human
uacaugcaugucacagaaugaa

SEQ ID NO: 495317 - RNA, 22 nt, Human
acauucugugagucauguuuua

SEQ ID NO: 495318 - RNA, 22 nt, Human
uaggaaggaggccaucuuggcg

SEQ ID NO: 495319 - RNA, 22 nt, Human
ugacuggauugucauuacgacg

SEQ ID NO: 495320 - RNA, 19 nt, Human
cugggccagaaucagcuca

SEQ ID NO: 495321 - RNA, 21 nt, Human
ucuguacuuugcuuccaugcu

SEQ ID NO: 495322 - RNA, 22 nt, Human
gguugccggggcaggacuggaa

SEQ ID NO: 495323 - RNA, 22 nt, Human
ccuggaagauucaccacuacca

SEQ ID NO: 495324 - RNA, 22 nt, Human
aauuugauucccugcaccuguu

SEQ ID NO: 495325 - RNA, 21 nt, Human
aucuuuauuacgcagagaaga

SEQ ID NO: 495326 - RNA, 22 nt, Human
uuaaacauuuauggaggcagca

SEQ ID NO: 495327 - RNA, 22 nt, Human
cacuucaauuaacuucagcauu

SEQ ID NO: 495328 - RNA, 22 nt, Human
cuucuuaacuguauauacuaug

SEQ ID NO: 495329 - RNA, 22 nt, Human
gcuggcuggcgggugcguccuc

SEQ ID NO: 495330 - RNA, 22 nt, Human
agcuuccugaugcaagagggcu

SEQ ID NO: 495331 - RNA, 22 nt, Human
ucucccacagucucccauggcu

SEQ ID NO: 495332 - RNA, 22 nt, Human
gcuucucuggccugcagggcau

SEQ ID NO: 495333 - RNA, 22 nt, Human
gggcuggcgggaaaggcaauuc

SEQ ID NO: 495334 - RNA, 22 nt, Human
aagauucacagagugaaugaaa

SEQ ID NO: 495335 - RNA, 21 nt, Human
ucucccaaggagguccugagg

SEQ ID NO: 495336 - RNA, 22 nt, Human
acagggucauuuuaugaucugu

SEQ ID NO: 495337 - RNA, 22 nt, Human
gaggcaugcagagcuggagcag

SEQ ID NO: 495338 - RNA, 22 nt, Human
ugaggcagauauuuauuggguu

SEQ ID NO: 495339 - RNA, 22 nt, Human
ucugggcagccucaggccaggg

SEQ ID NO: 495340 - RNA, 22 nt, Human
cagcuucuuagucuuuccuugu

SEQ ID NO: 495341 - RNA, 22 nt, Human
ggcuccagaugucuccuggcaa

SEQ ID NO: 495342 - RNA, 22 nt, Human
gcaaagucugcaucuggaucag

SEQ ID NO: 495343 - RNA, 22 nt, Human
acauuucugcauguaggguaau

SEQ ID NO: 495344 - RNA, 22 nt, Human
uuccauuuauucuuguccagau

SEQ ID NO: 495345 - RNA, 22 nt, Human
gcacagcaauuucuauaagcuc

SEQ ID NO: 495346 - RNA, 22 nt, Human
uggaaggcaggaccugccuugg

SEQ ID NO: 495347 - RNA, 22 nt, Human
ugcaggcuauccuuugcugcaa

SEQ ID NO: 495348 - RNA, 22 nt, Human
augcuuuagugucaaguuuggg

SEQ ID NO: 495349 - RNA, 22 nt, Human
auucuuuuaagccccagggauu

SEQ ID NO: 495350 - RNA, 22 nt, Human
cagcugaacauguagagcaucu

SEQ ID NO: 495351 - RNA, 22 nt, Human
guaagggauuugaacauagguu

SEQ ID NO: 495352 - RNA, 22 nt, Human
cagaggcacagugcgggccacu

SEQ ID NO: 495353 - RNA, 22 nt, Human
uucacauuggugauauguuucu

SEQ ID NO: 495354 - RNA, 22 nt, Human
cugccagcacugccuccugagg

SEQ ID NO: 495355 - RNA, 22 nt, Human
ggagcuguguuauccauuccca

SEQ ID NO: 495356 - RNA, 22 nt, Human
caguacuuugaagauauuuuag

SEQ ID NO: 495357 - RNA, 22 nt, Human
ccugggagagucuguggucucc

SEQ ID NO: 495358 - RNA, 22 nt, Human
aaugugaacuuugucauguaac

SEQ ID NO: 495359 - RNA, 22 nt, Human
uguauuuucugaagauaaucaa

SEQ ID NO: 495360 - RNA, 22 nt, Human
cugcugugcagacagacucucu

SEQ ID NO: 495361 - RNA, 22 nt, Human
ccugcagguuucccccggacgg

SEQ ID NO: 495362 - RNA, 22 nt, Human
uaugcacauauaaccugcacug

SEQ ID NO: 495363 - RNA, 22 nt, Human
aauaucaguauauuguaucagu

SEQ ID NO: 495364 - RNA, 22 nt, Human
uuugcauuuauaaguuggugga

SEQ ID NO: 495365 - RNA, 19 nt, Human
agcaggcagguggcccagg

SEQ ID NO: 495366 - RNA, 22 nt, Human
gccuggagaauuaaaaggaagg

SEQ ID NO: 495367 - RNA, 22 nt, Human
ucagucuucccuccagugcaac

SEQ ID NO: 495368 - RNA, 22 nt, Human
aacagcauaccaauguacauau

SEQ ID NO: 495369 - RNA, 22 nt, Human
ccaaaguccauaguuuacuuua

SEQ ID NO: 495370 - RNA, 22 nt, Human
aacaaaugauaccaguucucaa

SEQ ID NO: 495371 - RNA, 22 nt, Human
cucccugugucuucacuuggcc

SEQ ID NO: 495372 - RNA, 22 nt, Human
uucagggacuuagugucaguuu

SEQ ID NO: 495373 - RNA, 22 nt, Human
ggagcugcuuugaucugaagaa

SEQ ID NO: 495374 - RNA, 22 nt, Human
cuuuuggccucaaaggaaagaa

SEQ ID NO: 495375 - RNA, 22 nt, Human
gaagagcuuagacagaaucaaa

SEQ ID NO: 495376 - RNA, 22 nt, Human
gcagccaccucccauggcgggg

SEQ ID NO: 495377 - RNA, 18 nt, Human
cucaggccuuucccugug

SEQ ID NO: 495378 - RNA, 22 nt, Human
cuggcucauccagguguugcuc

SEQ ID NO: 495379 - RNA, 22 nt, Human
gggcugcugccaaucacagccu

SEQ ID NO: 495380 - RNA, 17 nt, Human
cucugcagugcauggcu

SEQ ID NO: 495381 - RNA, 22 nt, Human
cuccugggcuucgaaggcuccc

SEQ ID NO: 495382 - RNA, 22 nt, Human
agagaaggucacuaaggaccca

SEQ ID NO: 495383 - RNA, 22 nt, Human
cagagcuguccaaacccugaca

SEQ ID NO: 495384 - RNA, 22 nt, Human
aggucaaggcugcagugagcug

SEQ ID NO: 495385 - RNA, 22 nt, Human
ccaggccuccugugaguggacc

SEQ ID NO: 495386 - RNA, 22 nt, Human
ugguccaggcacccuucuagag

SEQ ID NO: 495387 - RNA, 19 nt, Human
gagcagcuuccuaucuggu

SEQ ID NO: 495388 - RNA, 20 nt, Human
ucagugauuuugaagaggaa

SEQ ID NO: 495389 - RNA, 22 nt, Human
ugucugaaggcagguggagaac

SEQ ID NO: 495390 - RNA, 22 nt, Human
uggagagcacaguuccugcuuc

SEQ ID NO: 495391 - RNA, 22 nt, Human
cagccugcuagggcaaugccuu

SEQ ID NO: 495392 - RNA, 22 nt, Human
gagucuggcccugaugcaucau

SEQ ID NO: 495393 - RNA, 22 nt, Human
ugcacuagccacauuucaaaug

SEQ ID NO: 495394 - RNA, 22 nt, Human
agcuuuagagagccaagacuca

SEQ ID NO: 495395 - RNA, 19 nt, Human
augauacaggugaaaauug

SEQ ID NO: 495396 - RNA, 22 nt, Human
ccaggucccuggaauuuaugag

SEQ ID NO: 495397 - RNA, 22 nt, Human
cuuagcagaauuccaagcuuga

SEQ ID NO: 495398 - RNA, 22 nt, Human
cagcugaguguuggcauguuca

SEQ ID NO: 495399 - RNA, 18 nt, Human
ggcaggcucucuggguca

SEQ ID NO: 495400 - RNA, 22 nt, Human
ucagaaauuuucucaguaguuc

SEQ ID NO: 495401 - RNA, 22 nt, Human
agccucucuuuauucccagcua

SEQ ID NO: 495402 - RNA, 22 nt, Human
cagcauggcuugaguguuuccu

SEQ ID NO: 495403 - RNA, 22 nt, Human
aucaaauacaaagggcauaagg

SEQ ID NO: 495404 - RNA, 21 nt, Human
agcagcaucagccucaccuga

SEQ ID NO: 495405 - RNA, 19 nt, Human
uucccagagccaugaguga

SEQ ID NO: 495406 - RNA, 22 nt, Human
gucccugguuugcccaggacca

SEQ ID NO: 495407 - RNA, 20 nt, Human
ccuguucacugcgcaguuuc

SEQ ID NO: 495408 - RNA, 22 nt, Human
acauuucuauagugcaucuguu

SEQ ID NO: 495409 - RNA, 22 nt, Human
uccaucauggcagcagcaguga

SEQ ID NO: 495410 - RNA, 22 nt, Human
aucagcaagauguaauuucuau

SEQ ID NO: 495411 - RNA, 22 nt, Human
gcugcccaggguggagccggcu

SEQ ID NO: 495412 - RNA, 22 nt, Human
gggaucugggacaacagguggu

SEQ ID NO: 495413 - RNA, 19 nt, Human
uguggucucuguucucagg

SEQ ID NO: 495414 - RNA, 21 nt, Human
gccauuguuuucuaccuggag

SEQ ID NO: 495415 - RNA, 22 nt, Human
acuugaaaagcucagcaguagu

SEQ ID NO: 495416 - RNA, 22 nt, Human
ggccugcugacccaaguccugu

SEQ ID NO: 495417 - RNA, 22 nt, Human
gcagagcccuggggguauggug

SEQ ID NO: 495418 - RNA, 22 nt, Human
aguacagaccugucucuuccug

SEQ ID NO: 495419 - RNA, 22 nt, Human
augaagcuaaacccugcagcca

SEQ ID NO: 495420 - RNA, 22 nt, Human
gcugggcuccaggccaggguga

SEQ ID NO: 495421 - RNA, 22 nt, Human
guuccuuguaauuuguuaagga

SEQ ID NO: 495422 - RNA, 20 nt, Human
aggaggggauagaaucaaag

SEQ ID NO: 495423 - RNA, 22 nt, Human
gguggccauaggaccagccugg

SEQ ID NO: 495424 - RNA, 22 nt, Human
ucaggagcagcaugggugagag

SEQ ID NO: 495425 - RNA, 22 nt, Human
agaaggguucaggaauauguua

SEQ ID NO: 495426 - RNA, 22 nt, Human
ggcagaguggagugcggccucc

SEQ ID NO: 495427 - RNA, 22 nt, Human
uuagcauucugccuccuauauc

SEQ ID NO: 495428 - RNA, 22 nt, Human
guccagggaaauagcgacaggg

SEQ ID NO: 495429 - RNA, 22 nt, Human
ucagaggccugaaagaauuugg

SEQ ID NO: 495430 - RNA, 22 nt, Human
uuccagagaaaagguuuauuuc

SEQ ID NO: 495431 - RNA, 22 nt, Human
agaggagugggaagcagugcaa

SEQ ID NO: 495432 - RNA, 22 nt, Human
ccaaaccauccaucuccaggcu

SEQ ID NO: 495433 - RNA, 22 nt, Human
cagaggcucuuccucacugccc

SEQ ID NO: 495434 - RNA, 22 nt, Human
acagagagaaacaaucagcagc

SEQ ID NO: 495435 - RNA, 22 nt, Human
gaggcacagaguaggugcacac

SEQ ID NO: 495436 - RNA, 22 nt, Human
gccugggaacucugaucuccug

SEQ ID NO: 495437 - RNA, 22 nt, Human
gcugaaguugccuauuuuaaua

SEQ ID NO: 495438 - RNA, 22 nt, Human
uuucaucugugcugccaagacu

SEQ ID NO: 495439 - RNA, 22 nt, Human
ggcucugcagugacuugagggg

SEQ ID NO: 495440 - RNA, 22 nt, Human
gggcuggcaucaguugccgaga

SEQ ID NO: 495441 - RNA, 22 nt, Human
augaaaugagucaaugcgacua

SEQ ID NO: 495442 - RNA, 22 nt, Human
uggcccugcuggccaaaggcua

SEQ ID NO: 495443 - RNA, 22 nt, Human
uuuguugaguuacagagaugaa

SEQ ID NO: 495444 - RNA, 22 nt, Human
ccacacagucaguuuccaagaa

SEQ ID NO: 495445 - RNA, 22 nt, Human
aaauagacaggcuuaaauagga

SEQ ID NO: 495446 - RNA, 22 nt, Human
uagauaaauuagaaaguuuacu

SEQ ID NO: 495447 - RNA, 22 nt, Human
uagcagcuaccuggcuaagagu

SEQ ID NO: 495448 - RNA, 22 nt, Human
cagcagcuacuuggagcagcag

SEQ ID NO: 495449 - RNA, 22 nt, Human
aggaccugccaggugcaaagca

SEQ ID NO: 495450 - RNA, 22 nt, Human
caccagcagaagacugagggug

SEQ ID NO: 495451 - RNA, 22 nt, Human
aaagacuuggcuuaugauuugc

SEQ ID NO: 495452 - RNA, 22 nt, Human
auguacaggauggugcucaucu

SEQ ID NO: 495453 - RNA, 22 nt, Human
uuguuacagcagugauuucaga

SEQ ID NO: 495454 - RNA, 19 nt, Human
ugcauaaauuauauacuuu

SEQ ID NO: 495455 - RNA, 22 nt, Human
ucagccugcuccaagugcugcc

SEQ ID NO: 495456 - RNA, 22 nt, Human
cccaggcugugcaaacuucaaa

SEQ ID NO: 495457 - RNA, 20 nt, Human
auaauuuacccugcaccacu

SEQ ID NO: 495458 - RNA, 22 nt, Human
acuuggagagcauugcugggga

SEQ ID NO: 495459 - RNA, 22 nt, Human
ugcauuaugcuacccagaagcu

SEQ ID NO: 495460 - RNA, 22 nt, Human
gcagagccugugucugagcaaa

SEQ ID NO: 495461 - RNA, 22 nt, Human
uacagcacugugcauagugguu

SEQ ID NO: 495462 - RNA, 22 nt, Human
uuugcaaaugcucugcagagcu

SEQ ID NO: 495463 - RNA, 22 nt, Human
cccagggcuuuucucacuagac

SEQ ID NO: 495464 - RNA, 22 nt, Human
aggugcaguguuuaaaaguagc

SEQ ID NO: 495465 - RNA, 22 nt, Human
ccacagaaccucagcuuugagc

SEQ ID NO: 495466 - RNA, 22 nt, Human
cuggaggagcauggacuggagu

SEQ ID NO: 495467 - RNA, 22 nt, Human
gcagcuuucuuuuugcaugucu

SEQ ID NO: 495468 - RNA, 22 nt, Human
ccugccuggagcugagugugga

SEQ ID NO: 495469 - RNA, 22 nt, Human
gaaggaaaaauacucuguaagg

SEQ ID NO: 495470 - RNA, 23 nt, Human
uugaaagguagcuggcagcuaga

SEQ ID NO: 495471 - RNA, 22 nt, Human
acacauacauggggaagaugag

SEQ ID NO: 495472 - RNA, 21 nt, Human
auggccacuauggugcagcag

SEQ ID NO: 495473 - RNA, 22 nt, Human
gcccucucuucugcagccucca

SEQ ID NO: 495474 - RNA, 22 nt, Human
ggcagggucuggacugaaagcu

SEQ ID NO: 495475 - RNA, 22 nt, Human
ugaaaugagauaauuuaagugc

SEQ ID NO: 495476 - RNA, 22 nt, Human
uauguacagggauagaacuuga

SEQ ID NO: 495477 - RNA, 22 nt, Human
augcccuggacuucuaguauuc

SEQ ID NO: 495478 - RNA, 22 nt, Human
uuucuacagguugauggguuug

SEQ ID NO: 495479 - RNA, 22 nt, Human
accaggcagagcugggccuuaa

SEQ ID NO: 495480 - RNA, 22 nt, Human
uuauuuugccacaggugaccuu

SEQ ID NO: 495481 - RNA, 22 nt, Human
agccuccaucucccaucuguga

SEQ ID NO: 495482 - RNA, 22 nt, Human
ugagcuggcaggggcucaggga

SEQ ID NO: 495483 - RNA, 22 nt, Human
ccagguguuuggccugcaugau

SEQ ID NO: 495484 - RNA, 22 nt, Human
gaaguagaaagccucguaaaua

SEQ ID NO: 495485 - RNA, 22 nt, Human
uuacagcagugggaaggaguca

SEQ ID NO: 495486 - RNA, 21 nt, Human
acagcagacaggcuuaggacc

SEQ ID NO: 495487 - RNA, 22 nt, Human
ugguccagaagauauucaacca

SEQ ID NO: 495488 - RNA, 22 nt, Human
uucaggauccccaccgcguuua

SEQ ID NO: 495489 - RNA, 22 nt, Human
acagaguaucuaucaggaguau

SEQ ID NO: 495490 - RNA, 22 nt, Human
aauuucaaacuaauaggaacca

SEQ ID NO: 495491 - RNA, 22 nt, Human
gcaggucuggcauagagccugc

SEQ ID NO: 495492 - RNA, 22 nt, Human
aggcaggcccucuggaaaggua

SEQ ID NO: 495493 - RNA, 22 nt, Human
uguggcugcagacacuggagcc

SEQ ID NO: 495494 - RNA, 22 nt, Human
agaaaaaucuuggcgcuugucu

SEQ ID NO: 495495 - RNA, 22 nt, Human
uccuuagccggagcagcucauc

SEQ ID NO: 495496 - RNA, 18 nt, Human
aggucugaggaagagccu

SEQ ID NO: 495497 - RNA, 22 nt, Human
aagcuggagaguuaggugaaua

SEQ ID NO: 495498 - RNA, 22 nt, Human
gcagcguggggacaggagcuca

SEQ ID NO: 495499 - RNA, 22 nt, Human
aucuugugcugacaaaacacau

SEQ ID NO: 495500 - RNA, 22 nt, Human
cugggcucagcaggccaaggcc

SEQ ID NO: 495501 - RNA, 22 nt, Human
uggagcaggugggaugucguga

SEQ ID NO: 495502 - RNA, 22 nt, Human
acugggccaggugugggugagu

SEQ ID NO: 495503 - RNA, 19 nt, Human
aguggcugggcagaagcaa

SEQ ID NO: 495504 - RNA, 22 nt, Human
acagcuuuguguuaaugggaag

SEQ ID NO: 495505 - RNA, 22 nt, Human
gcccucagaguuccccacagug

SEQ ID NO: 495506 - RNA, 19 nt, Human
cugaggcccauguaccaug

SEQ ID NO: 495507 - RNA, 22 nt, Human
uuguuacaucuuauguaagugg

SEQ ID NO: 495508 - RNA, 22 nt, Human
cagcuccugcagcugcugccgu

SEQ ID NO: 495509 - RNA, 22 nt, Human
cccagugucugggccugcaggg

SEQ ID NO: 495510 - RNA, 22 nt, Human
ccaggcagcaaauuuucugaau

SEQ ID NO: 495511 - RNA, 22 nt, Human
ucagcaguggcucucaugcagu

SEQ ID NO: 495512 - RNA, 22 nt, Human
ugauacauaaaccaucauuuug

SEQ ID NO: 495513 - RNA, 22 nt, Human
ccagugugaaccucaccacccu

SEQ ID NO: 495514 - RNA, 22 nt, Human
gagcugugacacgcagcccagg

SEQ ID NO: 495515 - RNA, 22 nt, Human
aucuggcuccuacacuugaaga

SEQ ID NO: 495516 - RNA, 19 nt, Human
cucucagccugucuccuug

SEQ ID NO: 495517 - RNA, 22 nt, Human
ugcaggcucaucucaagaguag

SEQ ID NO: 495518 - RNA, 19 nt, Human
aggcagcauucuggggcuu

SEQ ID NO: 495519 - RNA, 21 nt, Human
uuucuaaggaggaagaaaaga

SEQ ID NO: 495520 - RNA, 22 nt, Human
gaggaaaaugcaacaggaaugc

SEQ ID NO: 495521 - RNA, 23 nt, Human
auuugagaaaguauuuuuaagac

SEQ ID NO: 495522 - RNA, 22 nt, Human
accagggcagccgagguguguc

SEQ ID NO: 495523 - RNA, 22 nt, Human
auaucacaguaguuguuuaguu

SEQ ID NO: 495524 - RNA, 22 nt, Human
acucucagaggguggcagcaau

SEQ ID NO: 495525 - RNA, 22 nt, Human
uguccagguggccucugcugcu

SEQ ID NO: 495526 - RNA, 22 nt, Human
cucugaggcuccaugcaggcuu

SEQ ID NO: 495527 - RNA, 22 nt, Human
aagggcucugugugccucccca

SEQ ID NO: 495528 - RNA, 22 nt, Human
caggaaauugcaacagucugag

SEQ ID NO: 495529 - RNA, 22 nt, Human
uggacaacauagugagaccuca

SEQ ID NO: 495530 - RNA, 22 nt, Human
agaauuuuugauuaucuacucg

SEQ ID NO: 495531 - RNA, 22 nt, Human
uccugccucuccaugcuaacua

SEQ ID NO: 495532 - RNA, 22 nt, Human
aaaaccaggcguuuccuauuau

SEQ ID NO: 495533 - RNA, 22 nt, Human
ccucugggccagccuggacccu

SEQ ID NO: 495534 - RNA, 20 nt, Human
gcugggcuaccacuggcccu

SEQ ID NO: 495535 - RNA, 22 nt, Human
caaaaguaccuugugugcuuug

SEQ ID NO: 495536 - RNA, 22 nt, Human
cugcagcuccccugagaucaag

SEQ ID NO: 495537 - RNA, 23 nt, Human
cuacaagagcaagcauggacaag

SEQ ID NO: 495538 - RNA, 22 nt, Human
gcaugcugcaccagagccucuc

SEQ ID NO: 495539 - RNA, 22 nt, Human
ucagagcuuaucucuugcugga

SEQ ID NO: 495540 - RNA, 22 nt, Human
aggcuaggcugaugccucuucc

SEQ ID NO: 495541 - RNA, 21 nt, Human
gcaggguccuuuccauuccua

SEQ ID NO: 495542 - RNA, 22 nt, Human
ggccucucauguccugggcuuc

SEQ ID NO: 495543 - RNA, 22 nt, Human
aguuacuuucugaucagugugu

SEQ ID NO: 495544 - RNA, 22 nt, Human
cuggagcuuauugggagcagaa

SEQ ID NO: 495545 - RNA, 22 nt, Human
acccucaugaagcuggccugga

SEQ ID NO: 495546 - RNA, 18 nt, Human
uccagagguguuggagcc

SEQ ID NO: 495547 - RNA, 22 nt, Human
guggcagggugcucaucaugca

SEQ ID NO: 495548 - RNA, 22 nt, Human
gccaggcauuuguuaggugcug

SEQ ID NO: 495549 - RNA, 22 nt, Human
gaggcagaggaagguggucucu

SEQ ID NO: 495550 - RNA, 22 nt, Human
gcugucaggccaugugggccuu

SEQ ID NO: 495551 - RNA, 22 nt, Human
uacaggcccauagucccugcuu

SEQ ID NO: 495552 - RNA, 22 nt, Human
aggcagcugaccacaguaugau

SEQ ID NO: 495553 - RNA, 22 nt, Human
augcuuggaugcugccauggga

SEQ ID NO: 495554 - RNA, 19 nt, Human
ugcagcucagggcaggggc

SEQ ID NO: 495555 - RNA, 22 nt, Human
cacugcagcaccaugcagggcu

SEQ ID NO: 495556 - RNA, 22 nt, Human
agagccaguuacaacuguggag

SEQ ID NO: 495557 - RNA, 22 nt, Human
uaaagcauguguuagaagugca

SEQ ID NO: 495558 - RNA, 22 nt, Human
ggaccugccagaacucaggcua

SEQ ID NO: 495559 - RNA, 22 nt, Human
gcugcucugcuguguaagcagg

SEQ ID NO: 495560 - RNA, 22 nt, Human
gccaggucuggguagcagagga

SEQ ID NO: 495561 - RNA, 22 nt, Human
ucaaucacguguuccauguucu

SEQ ID NO: 495562 - RNA, 22 nt, Human
acuguguccuauuuccuugaca

SEQ ID NO: 495563 - RNA, 22 nt, Human
aaauauaauuucugccucaaua

SEQ ID NO: 495564 - RNA, 22 nt, Human
aggccagaaauuuggaguaugu

SEQ ID NO: 495565 - RNA, 22 nt, Human
gggcuggugaggcugcccugca

SEQ ID NO: 495566 - RNA, 22 nt, Human
guugaaaguagaugcuauuugg

SEQ ID NO: 495567 - RNA, 22 nt, Human
augucuuucgcaucaguagcua

SEQ ID NO: 495568 - RNA, 22 nt, Human
aagauguuaaaucuguagaauu

SEQ ID NO: 495569 - RNA, 22 nt, Human
uuacaaagaaaauuaggcauuu

SEQ ID NO: 495570 - RNA, 22 nt, Human
cagggaggaugggcuguuuugc

SEQ ID NO: 495571 - RNA, 22 nt, Human
uuuacaaguuuacagaaugaug

SEQ ID NO: 495572 - RNA, 22 nt, Human
acacagaugcauuacacaucua

SEQ ID NO: 495573 - RNA, 22 nt, Human
uguguucaguaugacauucaca

SEQ ID NO: 495574 - RNA, 22 nt, Human
ccuggggccccgagccagaagc

SEQ ID NO: 495575 - RNA, 22 nt, Human
ccucccugggugacgggcuccu

SEQ ID NO: 495576 - RNA, 22 nt, Human
auuagggaaggauuuggccuga

SEQ ID NO: 495577 - RNA, 22 nt, Human
uggguagaggaauugggcuacc

SEQ ID NO: 495578 - RNA, 22 nt, Human
ugcagggaaagggcacugggcu

SEQ ID NO: 495579 - RNA, 22 nt, Human
ucaguuucacagucugugcaga

SEQ ID NO: 495580 - RNA, 17 nt, Human
gagcagggaugcgguuc

SEQ ID NO: 495581 - RNA, 22 nt, Human
ccugggucccaucccagaguga

SEQ ID NO: 495582 - RNA, 22 nt, Human
guuaauuugcagcuuucgagcu

SEQ ID NO: 495583 - RNA, 22 nt, Human
gcugggaggcagcaccuuuagc

SEQ ID NO: 495584 - RNA, 22 nt, Human
augagcuucccagacaggaugg

SEQ ID NO: 495585 - RNA, 22 nt, Human
ugcuuaaacccugaucaugugu

SEQ ID NO: 495586 - RNA, 22 nt, Human
ggcauggcuggguucuggugag

SEQ ID NO: 495587 - RNA, 22 nt, Human
ggccagagagcagccaggauuc

SEQ ID NO: 495588 - RNA, 20 nt, Human
cugggccauccuuuuacaau

SEQ ID NO: 495589 - RNA, 22 nt, Human
acuaaaguccuguuguagcaua

SEQ ID NO: 495590 - RNA, 22 nt, Human
cagagguagaaggcaugcagug

SEQ ID NO: 495591 - RNA, 22 nt, Human
cagcugaguuuccaagucugcc

SEQ ID NO: 495592 - RNA, 22 nt, Human
agcaguggcuggauggugugcu

SEQ ID NO: 495593 - RNA, 22 nt, Human
gaguuaaaggcaguugaggaaa

SEQ ID NO: 495594 - RNA, 22 nt, Human
aaggaaagauucucucucuaga

SEQ ID NO: 495595 - RNA, 22 nt, Human
gcugcuuccuuuccugcugacc

SEQ ID NO: 495596 - RNA, 22 nt, Human
aaacuucauggauaauauaaag

SEQ ID NO: 495597 - RNA, 21 nt, Human
auuuucauuuccaggggagga

SEQ ID NO: 495598 - RNA, 18 nt, Human
cagaaguccuucaaggcc

SEQ ID NO: 495599 - RNA, 22 nt, Human
ggggcuguugaaguuaguugag

SEQ ID NO: 495600 - RNA, 23 nt, Human
agggcuccuuguugauuagcauu

SEQ ID NO: 495601 - RNA, 21 nt, Human
cgggcuggccgggcccucacc

SEQ ID NO: 495602 - RNA, 22 nt, Human
gaauauuuguaauuacuguuga

SEQ ID NO: 495603 - RNA, 22 nt, Human
cagauguaguagcuuuauugca

SEQ ID NO: 495604 - RNA, 22 nt, Human
cugccaaggcuggggaggacaa

SEQ ID NO: 495605 - RNA, 22 nt, Human
gggcagggguagcauuccaagu

SEQ ID NO: 495606 - RNA, 22 nt, Human
gggcugcuguagagaacauguu

SEQ ID NO: 495607 - RNA, 22 nt, Human
agucacaugcauuuucuucaau

SEQ ID NO: 495608 - RNA, 22 nt, Human
aaacagauaaugcuauaaaugg

SEQ ID NO: 495609 - RNA, 22 nt, Human
acacaucucaggggacacucuc

SEQ ID NO: 495610 - RNA, 22 nt, Human
auccuggguaaguuccuuuuaa

SEQ ID NO: 495611 - RNA, 22 nt, Human
aggaaggagggcagauauuaag

SEQ ID NO: 495612 - RNA, 22 nt, Human
ggcuccugggaugggacugagc

SEQ ID NO: 495613 - RNA, 15 nt, Human
ccaggcucugcacuc

SEQ ID NO: 495614 - RNA, 22 nt, Human
aaacagcugcacugcugauguc

SEQ ID NO: 495615 - RNA, 22 nt, Human
auuugucuuugagugcccugcu

SEQ ID NO: 495616 - RNA, 22 nt, Human
aguggcugcuaugaucaggaca

SEQ ID NO: 495617 - RNA, 22 nt, Human
gucaccagucccagcuccugaa

SEQ ID NO: 495618 - RNA, 22 nt, Human
cugggaaguagaaucagaugag

SEQ ID NO: 495619 - RNA, 22 nt, Human
auugauaucaguuugcugauug

SEQ ID NO: 495620 - RNA, 22 nt, Human
cauguguuaaucuuucugcaaa

SEQ ID NO: 495621 - RNA, 22 nt, Human
acagccauagaugcuuauguaa

SEQ ID NO: 495622 - RNA, 20 nt, Human
cucucccagcacagcuuccu

SEQ ID NO: 495623 - RNA, 22 nt, Human
ucugagggugggagaaggagcu

SEQ ID NO: 495624 - RNA, 22 nt, Human
guaugcaucgacucaagucuga

SEQ ID NO: 495625 - RNA, 22 nt, Human
accaaggagaaggugcaagcuu

SEQ ID NO: 495626 - RNA, 22 nt, Human
aagagggcugcaaucuuauugc

SEQ ID NO: 495627 - RNA, 22 nt, Human
caggagcucuuaaggaugugau

SEQ ID NO: 495628 - RNA, 22 nt, Human
acagcucugagauauuacuauu

SEQ ID NO: 495629 - RNA, 22 nt, Human
agagcaucuaacacauaagccu

SEQ ID NO: 495630 - RNA, 22 nt, Human
ugggccacugcugcggaaggcg

SEQ ID NO: 495631 - RNA, 22 nt, Human
gucccugcaucaccacgggacu

SEQ ID NO: 495632 - RNA, 22 nt, Human
ugaagacucagaagcuaagaua

SEQ ID NO: 495633 - RNA, 22 nt, Human
cuccaggccauggcugcggagg

SEQ ID NO: 495634 - RNA, 22 nt, Human
agagccaggcggcugggcaccu

SEQ ID NO: 495635 - RNA, 22 nt, Human
uggagggauacaaagaugaaaa

SEQ ID NO: 495636 - RNA, 17 nt, Human
ucagcauacacagagaa

SEQ ID NO: 495637 - RNA, 22 nt, Human
uacauguaagacaugagacucu

SEQ ID NO: 495638 - RNA, 22 nt, Human
gcagugugaccgagcuugcuuc

SEQ ID NO: 495639 - RNA, 18 nt, Human
ggacaucaucaggugcuu

SEQ ID NO: 495640 - RNA, 20 nt, Human
ucauuguguugccaauuccc

SEQ ID NO: 495641 - RNA, 22 nt, Human
aggcuuuggggcauucuguguu

SEQ ID NO: 495642 - RNA, 22 nt, Human
gcaggaguguauuugcauguaa

SEQ ID NO: 495643 - RNA, 22 nt, Human
uuuaauuuguauuucuagaggg

SEQ ID NO: 495644 - RNA, 22 nt, Human
agucacuguucugucaugucaa

SEQ ID NO: 495645 - RNA, 19 nt, Human
aaugacugaguacauuguc

SEQ ID NO: 495646 - RNA, 22 nt, Human
uuggcuuccaggaucucagcag

SEQ ID NO: 495647 - RNA, 22 nt, Human
ccuguguggaaaccgcaugacg

SEQ ID NO: 495648 - RNA, 20 nt, Human
cucaggauacugcaaaguug

SEQ ID NO: 495649 - RNA, 22 nt, Human
uggcugccuagugucugagcag

SEQ ID NO: 495650 - RNA, 22 nt, Human
aagugagugaaaaugcagaaua

SEQ ID NO: 495651 - RNA, 22 nt, Human
cacagauaccuagugaaacaua

SEQ ID NO: 495652 - RNA, 22 nt, Human
uggcuuucucccccagcuucuc

SEQ ID NO: 495653 - RNA, 22 nt, Human
cugggccuccucugcccaagcu

SEQ ID NO: 495654 - RNA, 21 nt, Human
uagcuuuaauauucccacauu

SEQ ID NO: 495655 - RNA, 22 nt, Human
gcagcugagagaagaacagggc

SEQ ID NO: 495656 - RNA, 22 nt, Human
acucugggaauccucaccuucc

SEQ ID NO: 495657 - RNA, 22 nt, Human
ugccacagaggugaagcccacu

SEQ ID NO: 495658 - RNA, 22 nt, Human
ccaggaagguaugggaagaaaa

SEQ ID NO: 495659 - RNA, 22 nt, Human
cagcucuggggcagagugacua

SEQ ID NO: 495660 - RNA, 22 nt, Human
uccuucagccaugggcucucca

SEQ ID NO: 495661 - RNA, 22 nt, Human
uucaggauucucucccauuuac

SEQ ID NO: 495662 - RNA, 22 nt, Human
aaguucaaggugauaguggcag

SEQ ID NO: 495663 - RNA, 22 nt, Human
ggucccugguucccucugagcu

SEQ ID NO: 495664 - RNA, 22 nt, Human
cagcucuguugcccuggaaacg

SEQ ID NO: 495665 - RNA, 22 nt, Human
accuuuuuucagaacucuaaag

SEQ ID NO: 495666 - RNA, 22 nt, Human
cagggcuucgauggauggaugg

SEQ ID NO: 495667 - RNA, 22 nt, Human
ccuggccaguuuccaggcccug

SEQ ID NO: 495668 - RNA, 22 nt, Human
gcacagaaccagacaugaggca

SEQ ID NO: 495669 - RNA, 22 nt, Human
ggcugcccucgucuacugccca

SEQ ID NO: 495670 - RNA, 22 nt, Human
acaguguuuuagaaaagcuuga

SEQ ID NO: 495671 - RNA, 22 nt, Human
aggcagagcugauguucuguga

SEQ ID NO: 495672 - RNA, 22 nt, Human
cacagcuucccgugcauggaga

SEQ ID NO: 495673 - RNA, 22 nt, Human
ucucuggccgagagucccuggg

SEQ ID NO: 495674 - RNA, 22 nt, Human
auuucuguauccugcugucaga

SEQ ID NO: 495675 - RNA, 22 nt, Human
uccugcagagccgcccucaggu

SEQ ID NO: 495676 - RNA, 22 nt, Human
cauuugcucugugucaguggca

SEQ ID NO: 495677 - RNA, 22 nt, Human
uccagacccaugacccugggga

SEQ ID NO: 495678 - RNA, 22 nt, Human
aguuuacauaaaaaggcagagg

SEQ ID NO: 495679 - RNA, 22 nt, Human
agccuccaucccaugcacaaag

SEQ ID NO: 495680 - RNA, 22 nt, Human
aaaugcagaucccugaaucuca

SEQ ID NO: 495681 - RNA, 22 nt, Human
ccaucagcuccaguaucuucug

SEQ ID NO: 495682 - RNA, 22 nt, Human
uuguccugaggacuguuaucag

SEQ ID NO: 495683 - RNA, 22 nt, Human
ggaagaagggucauuggcagcc

SEQ ID NO: 495684 - RNA, 22 nt, Human
cugggccaugggccagcgaggc

SEQ ID NO: 495685 - RNA, 22 nt, Human
uaccugcacagccagccaugug

SEQ ID NO: 495686 - RNA, 22 nt, Human
ccugggcucaccaugccuugga

SEQ ID NO: 495687 - RNA, 22 nt, Human
cuguggcuggcucaucauaggu

SEQ ID NO: 495688 - RNA, 20 nt, Human
acaguguuaguuaucaucuc

SEQ ID NO: 495689 - RNA, 22 nt, Human
cccccagccagcagugcucagc

SEQ ID NO: 495690 - RNA, 22 nt, Human
aucacauugccagugauuaccc

SEQ ID NO: 495691 - RNA, 19 nt, Human
uugaaauuguuugauaugg

SEQ ID NO: 495692 - RNA, 22 nt, Human
gagagugagauccuccugggga

SEQ ID NO: 495693 - RNA, 18 nt, Human
ugggcugccuggccucug

SEQ ID NO: 495694 - RNA, 22 nt, Human
uaguacaguuuuggcacaugga

SEQ ID NO: 495695 - RNA, 22 nt, Human
ccugggcugcaugauggcauuu

SEQ ID NO: 495696 - RNA, 22 nt, Human
cuccccaagccuuggcuucucc

SEQ ID NO: 495697 - RNA, 22 nt, Human
guuauauauaguauuucucuga

SEQ ID NO: 495698 - RNA, 22 nt, Human
ggggcuguuuuuggaauggcug

SEQ ID NO: 495699 - RNA, 22 nt, Human
uccaggagguagugcuuaauuu

SEQ ID NO: 495700 - RNA, 22 nt, Human
uccuggcucuucugaguuuucu

SEQ ID NO: 495701 - RNA, 22 nt, Human
caauuucuggaacuaauucuga

SEQ ID NO: 495702 - RNA, 22 nt, Human
auuuguuuaucgucgauuguag

SEQ ID NO: 495703 - RNA, 22 nt, Human
cagcucuguugccaaagugggc

SEQ ID NO: 495704 - RNA, 22 nt, Human
acuugcauuauauuuaucacaa

SEQ ID NO: 495705 - RNA, 22 nt, Human
cagggcagagggaaacuccuuu

SEQ ID NO: 495706 - RNA, 21 nt, Human
cucugcagugcccaccuugcc

SEQ ID NO: 495707 - RNA, 22 nt, Human
acucuggguccugccauucacu

SEQ ID NO: 495708 - RNA, 21 nt, Human
agagaagaggacuuucucaca

SEQ ID NO: 495709 - RNA, 22 nt, Human
ucacagccuggacaguugccug

SEQ ID NO: 495710 - RNA, 22 nt, Human
uuuaaagugcugcuccuauccu

SEQ ID NO: 495711 - RNA, 22 nt, Human
aggaggcugggcacaguggccu

SEQ ID NO: 495712 - RNA, 22 nt, Human
auggcugccccaaauuguugcu

SEQ ID NO: 495713 - RNA, 19 nt, Human
uaaaaugucuguggucagu

SEQ ID NO: 495714 - RNA, 22 nt, Human
auuauauugaguauaaccagag

SEQ ID NO: 495715 - RNA, 22 nt, Human
cugcccugucuuuuucugauga

SEQ ID NO: 495716 - RNA, 22 nt, Human
cugucaucacaguugagcagcc

SEQ ID NO: 495717 - RNA, 22 nt, Human
cagucccagacccagaaggugg

SEQ ID NO: 495718 - RNA, 22 nt, Human
guuagggagucagguggcucuu

SEQ ID NO: 495719 - RNA, 22 nt, Human
cuuuggaggucauagccaagag

SEQ ID NO: 495720 - RNA, 22 nt, Human
cagggcuccaugcagggacucc

SEQ ID NO: 495721 - RNA, 22 nt, Human
cgcaggcugcagccaagaagag

SEQ ID NO: 495722 - RNA, 22 nt, Human
cuggcagguggauggggacucc

SEQ ID NO: 495723 - RNA, 22 nt, Human
aagcugcagacccccugucuca

SEQ ID NO: 495724 - RNA, 22 nt, Human
uauuucccagggagcaacaagc

SEQ ID NO: 495725 - RNA, 22 nt, Human
acaaagguggaccauguggcuu

SEQ ID NO: 495726 - RNA, 22 nt, Human
ucagcuuucuauguugcuaaac

SEQ ID NO: 495727 - RNA, 22 nt, Human
ugaagcaggcauugacugauga

SEQ ID NO: 495728 - RNA, 22 nt, Human
uggcccugugugcaggcugcac

SEQ ID NO: 495729 - RNA, 22 nt, Human
aacuuuaaggcuauaaauuaug

SEQ ID NO: 495730 - RNA, 22 nt, Human
uguguacucaauugagccauuu

SEQ ID NO: 495731 - RNA, 22 nt, Human
gggcugaugaugagcagaggug

SEQ ID NO: 495732 - RNA, 22 nt, Human
gcuggcagucccaucagcuggg

SEQ ID NO: 495733 - RNA, 22 nt, Human
ggcugcggccgcgggucugugc

SEQ ID NO: 495734 - RNA, 22 nt, Human
ugcaggugcuccgggggugccc

SEQ ID NO: 495735 - RNA, 20 nt, Human
cagggcucugggccuggccu

SEQ ID NO: 495736 - RNA, 22 nt, Human
caggagcccagaguccucagcu

SEQ ID NO: 495737 - RNA, 22 nt, Human
agcagagcccuuccauggccuu

SEQ ID NO: 495738 - RNA, 22 nt, Human
ccaggcugugcuuuucauaaau

SEQ ID NO: 495739 - RNA, 22 nt, Human
gagcugagccuggguggaccgc

SEQ ID NO: 495740 - RNA, 22 nt, Human
ggccugcacagagguggcucua

SEQ ID NO: 495741 - RNA, 22 nt, Human
ccaggcugagcaugauuggagc

SEQ ID NO: 495742 - RNA, 22 nt, Human
uggcccaggcgaggugggcaga

SEQ ID NO: 495743 - RNA, 22 nt, Human
ugcagaggagcuggaaggcugg

SEQ ID NO: 495744 - RNA, 22 nt, Human
acagucuuuaauuucuuugugg

SEQ ID NO: 495745 - RNA, 22 nt, Human
ucuguggcacgauugcacugca

SEQ ID NO: 495746 - RNA, 22 nt, Human
ugcagccaccaccucugcugaa

SEQ ID NO: 495747 - RNA, 22 nt, Human
acuuuagauauuccucuguaca

SEQ ID NO: 495748 - RNA, 22 nt, Human
gcugcccacaaccccgugucua

SEQ ID NO: 495749 - RNA, 22 nt, Human
ucauccaguaccauggaaggca

SEQ ID NO: 495750 - RNA, 22 nt, Human
aaauguguuucgaaaacuggug

SEQ ID NO: 495751 - RNA, 22 nt, Human
aacaugaaacccaaacagaaua

SEQ ID NO: 495752 - RNA, 22 nt, Human
acacuguaaauugagugcguga

SEQ ID NO: 495753 - RNA, 22 nt, Human
agcugcuaugacaacaccagcc

SEQ ID NO: 495754 - RNA, 22 nt, Human
aaucaagaguuguguaauauuu

SEQ ID NO: 495755 - RNA, 22 nt, Human
cuggcucaggguggucuggguc

SEQ ID NO: 495756 - RNA, 22 nt, Human
cugggucuuuuucuuccauuga

SEQ ID NO: 495757 - RNA, 22 nt, Human
cuggugccuccucccugugcuu

SEQ ID NO: 495758 - RNA, 22 nt, Human
uagaaauaaaucugcagcuggg

SEQ ID NO: 495759 - RNA, 22 nt, Human
cacaggaauauaaguuugaguu

SEQ ID NO: 495760 - RNA, 22 nt, Human
ugguggcagcaggagggccccu

SEQ ID NO: 495761 - RNA, 22 nt, Human
aggcacaguuucauccccgggc

SEQ ID NO: 495762 - RNA, 22 nt, Human
ugggccacggggguggagagcu

SEQ ID NO: 495763 - RNA, 22 nt, Human
uuacuuuaucuccuagauucca

SEQ ID NO: 495764 - RNA, 22 nt, Human
gccuggcaggccuguuggggcu

SEQ ID NO: 495765 - RNA, 23 nt, Human
acagacaacacugaugagagaaa

SEQ ID NO: 495766 - RNA, 22 nt, Human
gagggaggugauacugaacgua

SEQ ID NO: 495767 - RNA, 18 nt, Human
auacaagaucaaguguuc

SEQ ID NO: 495768 - RNA, 22 nt, Human
uuuuaauucaaagugaauagug

SEQ ID NO: 495769 - RNA, 19 nt, Human
aagcagcccuggcaagagc

SEQ ID NO: 495770 - RNA, 22 nt, Human
acuguacaaccucugccccugu

SEQ ID NO: 495771 - RNA, 22 nt, Human
gaacuccagaugacucaggaac

SEQ ID NO: 495772 - RNA, 22 nt, Human
ugggcucugguuuccuggcugg

SEQ ID NO: 495773 - RNA, 22 nt, Human
cagguacacaggacaaaguacu

SEQ ID NO: 495774 - RNA, 22 nt, Human
gagugguaggcaguguuaggaa

SEQ ID NO: 495775 - RNA, 22 nt, Human
ugcaggcccaguguagaggcuc

SEQ ID NO: 495776 - RNA, 22 nt, Human
cugugcuucgcaacuccaaggu

SEQ ID NO: 495777 - RNA, 22 nt, Human
uccaggucccagacugggcagc

SEQ ID NO: 495778 - RNA, 20 nt, Human
ugguccucacaugccaucuu

SEQ ID NO: 495779 - RNA, 22 nt, Human
ucaggaaagaagaugcucagug

SEQ ID NO: 495780 - RNA, 22 nt, Human
gccugagaaggauaggaagcga

SEQ ID NO: 495781 - RNA, 22 nt, Human
uccuaggaaguggaggcaccug

SEQ ID NO: 495782 - RNA, 22 nt, Human
ucugccagaaguucugagagua

SEQ ID NO: 495783 - RNA, 22 nt, Human
ugauuacauugguaauguuuau

SEQ ID NO: 495784 - RNA, 22 nt, Human
ucagugcauuguucauuguagg

SEQ ID NO: 495785 - RNA, 22 nt, Human
cuggguggcagagccugcagug

SEQ ID NO: 495786 - RNA, 22 nt, Human
aggagcugcaaauauuaguaau

SEQ ID NO: 495787 - RNA, 22 nt, Human
agauguggauccuaggguagaa

SEQ ID NO: 495788 - RNA, 22 nt, Human
uggaaauggaucugaugagucu

SEQ ID NO: 495789 - RNA, 22 nt, Human
gaggcauggccugaggcuagga

SEQ ID NO: 495790 - RNA, 22 nt, Human
agaccaugaccugccacuaagc

SEQ ID NO: 495791 - RNA, 22 nt, Human
cuucccugauaagagccucaga

SEQ ID NO: 495792 - RNA, 22 nt, Human
auauauuugagaauauucauga

SEQ ID NO: 495793 - RNA, 22 nt, Human
uuaugcaacaggugagcagaca

SEQ ID NO: 495794 - RNA, 22 nt, Human
ugcuuuauguggcugauacuca

SEQ ID NO: 495795 - RNA, 22 nt, Human
cuucagcaacuuuggaauguuu

SEQ ID NO: 495796 - RNA, 22 nt, Human
uucaacaucaagaaugcaugga

SEQ ID NO: 495797 - RNA, 22 nt, Human
gugcccuguugcacacuugagg

SEQ ID NO: 495798 - RNA, 22 nt, Human
ccagcccugauuagagaauguc

SEQ ID NO: 495799 - RNA, 22 nt, Human
agcauuaagccuggcucagagg

SEQ ID NO: 495800 - RNA, 22 nt, Human
ucacagaaaucuguuuuuucua

SEQ ID NO: 495801 - RNA, 22 nt, Human
gucauucaacugcacauuaggu

SEQ ID NO: 495802 - RNA, 22 nt, Human
uggcagcauguuauguaaggaa

SEQ ID NO: 495803 - RNA, 22 nt, Human
agugcauauaugaagaguauga

SEQ ID NO: 495804 - RNA, 22 nt, Human
gaugaggcagcucagggggaaa

SEQ ID NO: 495805 - RNA, 23 nt, Human
uggcagugaucaaaagcuuacau

SEQ ID NO: 495806 - RNA, 22 nt, Human
uaaaauagcaugugcagugaaa

SEQ ID NO: 495807 - RNA, 22 nt, Human
uucaagguaugguagcugguca

SEQ ID NO: 495808 - RNA, 22 nt, Human
guaaauauucccucgguuccua

SEQ ID NO: 495809 - RNA, 19 nt, Human
gggcagaauggcaucucag

SEQ ID NO: 495810 - RNA, 22 nt, Human
ggcacagcugaugcagacacac

SEQ ID NO: 495811 - RNA, 22 nt, Human
ccuuggaggacugcugcuucuu

SEQ ID NO: 495812 - RNA, 22 nt, Human
ccugagccuggcucaugcacuc

SEQ ID NO: 495813 - RNA, 22 nt, Human
cagaggaagcuggguguggagu

SEQ ID NO: 495814 - RNA, 22 nt, Human
uuuucauuguuccucgagcauu

SEQ ID NO: 495815 - RNA, 21 nt, Human
uacacaaagcgugguccagag

SEQ ID NO: 495816 - RNA, 22 nt, Human
aagcugccauagaacgagaggu

SEQ ID NO: 495817 - RNA, 22 nt, Human
gcagcagguccgcaucaucauc

SEQ ID NO: 495818 - RNA, 22 nt, Human
uucucuggacuauuugcacucc

SEQ ID NO: 495819 - RNA, 22 nt, Human
gaugccugcauuucaggagagu

SEQ ID NO: 495820 - RNA, 18 nt, Human
uucuuuaauucaguuuga

SEQ ID NO: 495821 - RNA, 22 nt, Human
cuggccacugguggucauaggc

SEQ ID NO: 495822 - RNA, 22 nt, Human
agguggggaggagugucucuuu

SEQ ID NO: 495823 - RNA, 22 nt, Human
ggacagagcccugguggccuaa

SEQ ID NO: 495824 - RNA, 22 nt, Human
ugccagggugucaggagagcua

SEQ ID NO: 495825 - RNA, 21 nt, Human
uccucccugagcuguggggga

SEQ ID NO: 495826 - RNA, 22 nt, Human
gcccacacagcagauccuuugg

SEQ ID NO: 495827 - RNA, 22 nt, Human
ggcaugggguguauguggcacg

SEQ ID NO: 495828 - RNA, 22 nt, Human
ucccugggccuaucuuagcucc

SEQ ID NO: 495829 - RNA, 22 nt, Human
cuccagugucucagagcagaug

SEQ ID NO: 495830 - RNA, 22 nt, Human
agagcagagggcucugggacaa

SEQ ID NO: 495831 - RNA, 22 nt, Human
ggcuggguuauuuauggccaag

SEQ ID NO: 495832 - RNA, 22 nt, Human
cagacacaccaggcccauucug

SEQ ID NO: 495833 - RNA, 22 nt, Human
gggggugaggacaggagcacug

SEQ ID NO: 495834 - RNA, 20 nt, Human
ggcugcaggacucauuggcu

SEQ ID NO: 495835 - RNA, 22 nt, Human
uccuugaauggacauuacacug

SEQ ID NO: 495836 - RNA, 20 nt, Human
ccagguggugccuggagagg

SEQ ID NO: 495837 - RNA, 22 nt, Human
uagcugccauugcuccaggaag

SEQ ID NO: 495838 - RNA, 22 nt, Human
auucuaagcacgcugaagucuu

SEQ ID NO: 495839 - RNA, 22 nt, Human
aggcacugauucuguuuuccau

SEQ ID NO: 495840 - RNA, 22 nt, Human
gcaguguuauguuuucuauaau

SEQ ID NO: 495841 - RNA, 22 nt, Human
auugauaaauugcaauggggcu

SEQ ID NO: 495842 - RNA, 20 nt, Human
cugccuggaggccucuaccu

SEQ ID NO: 495843 - RNA, 22 nt, Human
gccucugcucucagguagccuc

SEQ ID NO: 495844 - RNA, 22 nt, Human
auauucaucguguagaaauacu

SEQ ID NO: 495845 - RNA, 22 nt, Human
cuggcaggcagacuucugcaag

SEQ ID NO: 495846 - RNA, 22 nt, Human
ucaguguuggagauaauugcac

SEQ ID NO: 495847 - RNA, 22 nt, Human
uuccagauguuuaaguucugcu

SEQ ID NO: 495848 - RNA, 22 nt, Human
uuucuaaaggguagauuuggcc

SEQ ID NO: 495849 - RNA, 22 nt, Human
ucaguguuaaucagugguaccu

SEQ ID NO: 495850 - RNA, 22 nt, Human
uagaaaucagcaggcauaugua

SEQ ID NO: 495851 - RNA, 22 nt, Human
gcuuuauguaaguccaaaggca

SEQ ID NO: 495852 - RNA, 22 nt, Human
ugggcacaggggaauggaugaa

SEQ ID NO: 495853 - RNA, 17 nt, Human
ggaaggucaaggggagg

SEQ ID NO: 495854 - RNA, 22 nt, Human
gcagauggcugagccugcagau

SEQ ID NO: 495855 - RNA, 22 nt, Human
aaacaugagcauuucuguuuaa

SEQ ID NO: 495856 - RNA, 22 nt, Human
ccugugugaagguuaggcaggu

SEQ ID NO: 495857 - RNA, 22 nt, Human
ggagaggagauuguggcauuuu

SEQ ID NO: 495858 - RNA, 22 nt, Human
caggcugaggcaguaggguuug

SEQ ID NO: 495859 - RNA, 22 nt, Human
ugggaaaguguugaggugucuu

SEQ ID NO: 495860 - RNA, 22 nt, Human
cagcagcaucaggucugugguu

SEQ ID NO: 495861 - RNA, 22 nt, Human
ugcaggugguuuggacacugcu

SEQ ID NO: 495862 - RNA, 22 nt, Human
agccuucacugggaccuuggau

SEQ ID NO: 495863 - RNA, 19 nt, Human
uccuggggaggggcauggc

SEQ ID NO: 495864 - RNA, 22 nt, Human
uugaaucuauguauucagugua

SEQ ID NO: 495865 - RNA, 22 nt, Human
uacauugcuagaaauguauuuu

SEQ ID NO: 495866 - RNA, 18 nt, Human
gagguccugcucuagccc

SEQ ID NO: 495867 - RNA, 17 nt, Human
uggcucugaggcugaau

SEQ ID NO: 495868 - RNA, 22 nt, Human
ugccucugugugcaggugagca

SEQ ID NO: 495869 - RNA, 22 nt, Human
ggcacugaauuucuuggcaucu

SEQ ID NO: 495870 - RNA, 22 nt, Human
uggguucuuucacuucucaguu

SEQ ID NO: 495871 - RNA, 22 nt, Human
acagauuuggcccagccaaugc

SEQ ID NO: 495872 - RNA, 22 nt, Human
ucucaguggacgugucugucuu

SEQ ID NO: 495873 - RNA, 22 nt, Human
gggagacccccaaugccagguc

SEQ ID NO: 495874 - RNA, 22 nt, Human
ugaucugguccuacugugggca

SEQ ID NO: 495875 - RNA, 22 nt, Human
ccaaggaggccccaggucagcu

SEQ ID NO: 495876 - RNA, 22 nt, Human
cugcaggcugagcgccugccgg

SEQ ID NO: 495877 - RNA, 22 nt, Human
gccuggagacaaggacaaaggg

SEQ ID NO: 495878 - RNA, 22 nt, Human
ucugaggcuucagacuguacug

SEQ ID NO: 495879 - RNA, 22 nt, Human
ugcuuuauucaggguuuacccc

SEQ ID NO: 495880 - RNA, 19 nt, Human
ggucacagggguuacaagg

SEQ ID NO: 495881 - RNA, 22 nt, Human
ggggcagagcauagcuccaauu

SEQ ID NO: 495882 - RNA, 22 nt, Human
auuugugaucgugcgugaugaa

SEQ ID NO: 495883 - RNA, 22 nt, Human
gccaggaaugcauaaaugaccu

SEQ ID NO: 495884 - RNA, 22 nt, Human
ggcacugggcaccggcugaggg

SEQ ID NO: 495885 - RNA, 22 nt, Human
ugggcagagaucuggaucaaac

SEQ ID NO: 495886 - RNA, 20 nt, Human
cugccaugauugauagagug

SEQ ID NO: 495887 - RNA, 22 nt, Human
agucagugacuuuugcugagag

SEQ ID NO: 495888 - RNA, 22 nt, Human
cucccagguuccgacgccucuu

SEQ ID NO: 495889 - RNA, 22 nt, Human
ugcuggaggggccugaccagga

SEQ ID NO: 495890 - RNA, 22 nt, Human
agccauugaauuuagugccuuu

SEQ ID NO: 495891 - RNA, 22 nt, Human
aaggcaggaugggaaaagauuu

SEQ ID NO: 495892 - RNA, 22 nt, Human
uaaaaggagguugaagcuguca

SEQ ID NO: 495893 - RNA, 22 nt, Human
agugccuggaccccaugacaua

SEQ ID NO: 495894 - RNA, 22 nt, Human
gacauucacagguaaacauucc

SEQ ID NO: 495895 - RNA, 22 nt, Human
uucucuggcgguguguuuuccu

SEQ ID NO: 495896 - RNA, 22 nt, Human
auacuuuggucacuauuauugg

SEQ ID NO: 495897 - RNA, 22 nt, Human
uagcugccuaugugauaagaga

SEQ ID NO: 495898 - RNA, 22 nt, Human
cugguuaaaugaaaaaguauua

SEQ ID NO: 495899 - RNA, 22 nt, Human
agaaaugcauuagcacauauag

SEQ ID NO: 495900 - RNA, 17 nt, Human
caguggucugagguaug

SEQ ID NO: 495901 - RNA, 22 nt, Human
uuguaugaguaugguguauagg

SEQ ID NO: 495902 - RNA, 22 nt, Human
gaagagcuaaaggcacaggcuu

SEQ ID NO: 495903 - RNA, 22 nt, Human
ucagcauuucagaaguggcaua

SEQ ID NO: 495904 - RNA, 22 nt, Human
ccugaggucacaacuugcuuau

SEQ ID NO: 495905 - RNA, 22 nt, Human
gcagagcucaagguguucagcu

SEQ ID NO: 495906 - RNA, 21 nt, Human
cauuagggcagaagcaggaag

SEQ ID NO: 495907 - RNA, 22 nt, Human
gcaguggcuaggagucuggcgu

SEQ ID NO: 495908 - RNA, 22 nt, Human
cauuuguagcuauuuacuguau

SEQ ID NO: 495909 - RNA, 21 nt, Human
agcauucaaaagaugccauaa

SEQ ID NO: 495910 - RNA, 22 nt, Human
acuaaaguguuggagaaugagg

SEQ ID NO: 495911 - RNA, 22 nt, Human
gcagcuccuuuaggcugcaaag

SEQ ID NO: 495912 - RNA, 22 nt, Human
uucagcaccacuuccagagaag

SEQ ID NO: 495913 - RNA, 22 nt, Human
ggcuucucgugccgaagcaaga

SEQ ID NO: 495914 - RNA, 22 nt, Human
cauuuguuaaccaguguggauu

SEQ ID NO: 495915 - RNA, 22 nt, Human
auuucucagcacuuccuaucuc

SEQ ID NO: 495916 - RNA, 22 nt, Human
caggaaugacccaacaguuuca

SEQ ID NO: 495917 - RNA, 20 nt, Human
cugcacugaacaugucugag

SEQ ID NO: 495918 - RNA, 22 nt, Human
agagaacacgugcaucugcaau

SEQ ID NO: 495919 - RNA, 22 nt, Human
aagcuuuagagaugaguuccuu

SEQ ID NO: 495920 - RNA, 22 nt, Human
cuguggcuaggauuauuccuga

SEQ ID NO: 495921 - RNA, 19 nt, Human
ggaaacaggggccagagga

SEQ ID NO: 495922 - RNA, 22 nt, Human
ugggcuccaauuuguccuuuca

SEQ ID NO: 495923 - RNA, 22 nt, Human
cucaggaugucggugacuauug

SEQ ID NO: 495924 - RNA, 22 nt, Human
guuucuaaauguucugaguuuu

SEQ ID NO: 495925 - RNA, 22 nt, Human
ggaaacuaaagagguguuuuug

SEQ ID NO: 495926 - RNA, 22 nt, Human
cacuggcugagcuucucuaggg

SEQ ID NO: 495927 - RNA, 22 nt, Human
gugauuucaaauauagagugag

SEQ ID NO: 495928 - RNA, 22 nt, Human
gagugagggcagcaggggcugc

SEQ ID NO: 495929 - RNA, 22 nt, Human
ggcagcugcaaaucugcucugu

SEQ ID NO: 495930 - RNA, 22 nt, Human
auguccagaguaaagcacauuc

SEQ ID NO: 495931 - RNA, 22 nt, Human
uagugcaauuccccauacuaac

SEQ ID NO: 495932 - RNA, 22 nt, Human
agaaggccaauagggugcacug

SEQ ID NO: 495933 - RNA, 16 nt, Human
ccucugggccugcaag

SEQ ID NO: 495934 - RNA, 22 nt, Human
ucaugucaguuucuucuauaaa

SEQ ID NO: 495935 - RNA, 22 nt, Human
agagaagauucuuauaugucuu

SEQ ID NO: 495936 - RNA, 22 nt, Human
uuccuaauggcaaaacauguuu

SEQ ID NO: 495937 - RNA, 22 nt, Human
cccaggcacacugaagugacau

SEQ ID NO: 495938 - RNA, 22 nt, Human
aguuuguaaacuugagcuagcc

SEQ ID NO: 495939 - RNA, 22 nt, Human
cugcugcauuccucuuuaugag

SEQ ID NO: 495940 - RNA, 22 nt, Human
ccacacugaaccucagugucuu

SEQ ID NO: 495941 - RNA, 20 nt, Human
cauuuguuagcuuucuacug

SEQ ID NO: 495942 - RNA, 22 nt, Human
uguacauagaucuugaaaauua

SEQ ID NO: 495943 - RNA, 20 nt, Human
cccugcagccaugggagugg

SEQ ID NO: 495944 - RNA, 21 nt, Human
cagcccagagcaguggggcca

SEQ ID NO: 495945 - RNA, 22 nt, Human
ccucaggguggcaucagaucuu

SEQ ID NO: 495946 - RNA, 22 nt, Human
cugccacuuucacccagugcuc

SEQ ID NO: 495947 - RNA, 22 nt, Human
aggcacagagaaugcccuccau

SEQ ID NO: 495948 - RNA, 18 nt, Human
aagccagagaccacugcc

SEQ ID NO: 495949 - RNA, 22 nt, Human
uauguuuuucaagugcacacua

SEQ ID NO: 495950 - RNA, 22 nt, Human
gaggcuucuguaacccuguccu

SEQ ID NO: 495951 - RNA, 22 nt, Human
aagcagaguccccuucccaugg

SEQ ID NO: 495952 - RNA, 22 nt, Human
uggguccuucaaagcugggucu

SEQ ID NO: 495953 - RNA, 22 nt, Human
uggaggugagugugguacagca

SEQ ID NO: 495954 - RNA, 22 nt, Human
gggccacauugaagggugggua

SEQ ID NO: 495955 - RNA, 22 nt, Human
uuucugcacauuucuaaaguug

SEQ ID NO: 495956 - RNA, 22 nt, Human
cagcccuggaacagcugacuca

SEQ ID NO: 495957 - RNA, 21 nt, Human
uuuuuucuugcgugaggccug

SEQ ID NO: 495958 - RNA, 22 nt, Human
ucccugaaacaucucuguggau

SEQ ID NO: 495959 - RNA, 22 nt, Human
augucuuugccauaguucauau

SEQ ID NO: 495960 - RNA, 20 nt, Human
uggucuggagccagugagga

SEQ ID NO: 495961 - RNA, 22 nt, Human
uuaguaauguguuaauaugaau

SEQ ID NO: 495962 - RNA, 22 nt, Human
ggcacacaaaggcagcauuuga

SEQ ID NO: 495963 - RNA, 22 nt, Human
auauuccauugguuucccuucu

SEQ ID NO: 495964 - RNA, 21 nt, Human
ugagagccuccaaccggcuac

SEQ ID NO: 495965 - RNA, 22 nt, Human
gugaaggaggggccacagauau

SEQ ID NO: 495966 - RNA, 22 nt, Human
gaagagcuuaguuguccuagaa

SEQ ID NO: 495967 - RNA, 22 nt, Human
agauguggccuuugggagauua

SEQ ID NO: 495968 - RNA, 22 nt, Human
uuugaaaggaaguuaauacuuu

SEQ ID NO: 495969 - RNA, 22 nt, Human
agccucugcacgggcacgggug

SEQ ID NO: 495970 - RNA, 22 nt, Human
agggcacaucugcugggaaugg

SEQ ID NO: 495971 - RNA, 22 nt, Human
ggcaggcuuugagaaagagcau

SEQ ID NO: 495972 - RNA, 22 nt, Human
aaacaugcuggauuuagaauau

SEQ ID NO: 495973 - RNA, 20 nt, Human
ggcagcaggaguuuccucuu

SEQ ID NO: 495974 - RNA, 22 nt, Human
aaucuguucuacucuauucaga

SEQ ID NO: 495975 - RNA, 22 nt, Human
cucaagacugaucgcaguggaa

SEQ ID NO: 495976 - RNA, 22 nt, Human
ugggacagugugccuugcuccu

SEQ ID NO: 495977 - RNA, 22 nt, Human
ucucucagcuuugagaccugcu

SEQ ID NO: 495978 - RNA, 22 nt, Human
agagccugcaucaggcuugggg

SEQ ID NO: 495979 - RNA, 22 nt, Human
auugaaagauauacuguucuca

SEQ ID NO: 495980 - RNA, 17 nt, Human
aguggcaggcagauggg

SEQ ID NO: 495981 - RNA, 22 nt, Human
cacagggccacuuucccaguaa

SEQ ID NO: 495982 - RNA, 22 nt, Human
uggcuggcaguaggcuaguggc

SEQ ID NO: 495983 - RNA, 18 nt, Human
ccuggcuuccaucuuggu

SEQ ID NO: 495984 - RNA, 22 nt, Human
cuccugggucauugccagcaaa

SEQ ID NO: 495985 - RNA, 22 nt, Human
gccaggcaggugucggagcccu

SEQ ID NO: 495986 - RNA, 22 nt, Human
uccauucauucauugaugaaca

SEQ ID NO: 495987 - RNA, 18 nt, Human
uugaggaguucacugucu

SEQ ID NO: 495988 - RNA, 22 nt, Human
ugccucugggugaccaaggagc

SEQ ID NO: 495989 - RNA, 22 nt, Human
cugcaggagcaaagccucugcu

SEQ ID NO: 495990 - RNA, 22 nt, Human
cccaguccuaaagcagacgcca

SEQ ID NO: 495991 - RNA, 22 nt, Human
cguaugaaauuuuugacauuug

SEQ ID NO: 495992 - RNA, 21 nt, Human
uucuccccagcgaauccucgg

SEQ ID NO: 495993 - RNA, 22 nt, Human
uuauugcaaaggaagagcuuga

SEQ ID NO: 495994 - RNA, 22 nt, Human
gcacccaggcuugggcagcaac

SEQ ID NO: 495995 - RNA, 22 nt, Human
acauuucucaucuaguagagua

SEQ ID NO: 495996 - RNA, 22 nt, Human
cagggacagccuugggguggcg

SEQ ID NO: 495997 - RNA, 22 nt, Human
ugucucugaggugagggucagc

SEQ ID NO: 495998 - RNA, 22 nt, Human
agaaaucuuuccugaaguguuu

SEQ ID NO: 495999 - RNA, 22 nt, Human
uuggcuucuggcagucuggacg

SEQ ID NO: 496000 - RNA, 22 nt, Human
uuacaguuuaguccaagccaga

SEQ ID NO: 496001 - RNA, 22 nt, Human
ggaagaaagcacacaaacuuga

SEQ ID NO: 496002 - RNA, 23 nt, Human
ugcauuauccucucugaagacca

SEQ ID NO: 496003 - RNA, 22 nt, Human
uacaaaugaccauagccacuua

SEQ ID NO: 496004 - RNA, 22 nt, Human
cuccucacuuuccagacugggc

SEQ ID NO: 496005 - RNA, 19 nt, Human
uugcauuguaguuggacug

SEQ ID NO: 496006 - RNA, 22 nt, Human
augugcaugcacuuacaugugu

SEQ ID NO: 496007 - RNA, 22 nt, Human
ccagauucauagaaacucauag

SEQ ID NO: 496008 - RNA, 22 nt, Human
ugggcuucugauguugagugcu

SEQ ID NO: 496009 - RNA, 22 nt, Human
agagcuggacgucugagcccua

SEQ ID NO: 496010 - RNA, 22 nt, Human
gccacagacagagagucuagug

SEQ ID NO: 496011 - RNA, 22 nt, Human
uggcucugucacugugagcuau

SEQ ID NO: 496012 - RNA, 22 nt, Human
auguuauuaaaguacagauucu

SEQ ID NO: 496013 - RNA, 22 nt, Human
cacacauuaauaucaaaggcuc

SEQ ID NO: 496014 - RNA, 22 nt, Human
aggagagaauguuccaggcuug

SEQ ID NO: 496015 - RNA, 22 nt, Human
aacagcuuugugcucagauuug

SEQ ID NO: 496016 - RNA, 22 nt, Human
augugaggcagcacggagauua

SEQ ID NO: 496017 - RNA, 22 nt, Human
ccccuucucugcaagccugcuc

SEQ ID NO: 496018 - RNA, 22 nt, Human
gaggcucugugaugugccaggc

SEQ ID NO: 496019 - RNA, 22 nt, Human
ucuuagaaaugaaguucuuucu

SEQ ID NO: 496020 - RNA, 22 nt, Human
gaagccaagugcaaaugccuua

SEQ ID NO: 496021 - RNA, 22 nt, Human
aaguucaagaucaagguuccag

SEQ ID NO: 496022 - RNA, 22 nt, Human
aaugcacauguuguaauaaaua

SEQ ID NO: 496023 - RNA, 22 nt, Human
gggcugugaggugagaacuuac

SEQ ID NO: 496024 - RNA, 20 nt, Human
uguugauuggugucaucuca

SEQ ID NO: 496025 - RNA, 22 nt, Human
acuccugguuuguguccuggcu

SEQ ID NO: 496026 - RNA, 23 nt, Human
gccagccuugcucuccugcagcc

SEQ ID NO: 496027 - RNA, 20 nt, Human
agguccugggacuggcagag

SEQ ID NO: 496028 - RNA, 22 nt, Human
agagacugcaaaucauaagaau

SEQ ID NO: 496029 - RNA, 22 nt, Human
gcuuggccagcagccgggaugc

SEQ ID NO: 496030 - RNA, 22 nt, Human
ucaguguuuuuaaagcaauaua

SEQ ID NO: 496031 - RNA, 22 nt, Human
uguaugaaagaacaagggcuua

SEQ ID NO: 496032 - RNA, 22 nt, Human
ucaccaggcuggaaugcagugg

SEQ ID NO: 496033 - RNA, 22 nt, Human
auacuguaucacuugugaguga

SEQ ID NO: 496034 - RNA, 22 nt, Human
uuucagagaacugaguccuugc

SEQ ID NO: 496035 - RNA, 22 nt, Human
gaagauuucuuuaugaaagaug

SEQ ID NO: 496036 - RNA, 17 nt, Human
uauguaguacuuauaaa

SEQ ID NO: 496037 - RNA, 22 nt, Human
aacaaaugaccugauuucuucc

SEQ ID NO: 496038 - RNA, 22 nt, Human
uugugugacuccuagaguagag

SEQ ID NO: 496039 - RNA, 22 nt, Human
aaaaagacuagucgagugcagu

SEQ ID NO: 496040 - RNA, 22 nt, Human
aucaaaguuucccagaaguugu

SEQ ID NO: 496041 - RNA, 22 nt, Human
cccagggaaugacucuggccuu

SEQ ID NO: 496042 - RNA, 22 nt, Human
aacuuuggccacaaguacccug

SEQ ID NO: 496043 - RNA, 22 nt, Human
uguuuacuagccaacauggaga

SEQ ID NO: 496044 - RNA, 22 nt, Human
gcagggucugaggccacagagg

SEQ ID NO: 496045 - RNA, 22 nt, Human
cagcaguaacucccgugcagca

SEQ ID NO: 496046 - RNA, 22 nt, Human
ccugccugcguccucugagggc

SEQ ID NO: 496047 - RNA, 22 nt, Human
uuucacaugguacugccuguuu

SEQ ID NO: 496048 - RNA, 22 nt, Human
caucacuguccucagcauucca

SEQ ID NO: 496049 - RNA, 22 nt, Human
uuggaaagcaagcuggacauac

SEQ ID NO: 496050 - RNA, 22 nt, Human
accuguuuguguuuggacugca

SEQ ID NO: 496051 - RNA, 22 nt, Human
gccaaagcccaggagacagcca

SEQ ID NO: 496052 - RNA, 22 nt, Human
ugucagcaggacauuaaaagcu

SEQ ID NO: 496053 - RNA, 22 nt, Human
cccuguuuauuuuuggagagaa

SEQ ID NO: 496054 - RNA, 20 nt, Human
guggcaggcagugaaggagc

SEQ ID NO: 496055 - RNA, 22 nt, Human
ugcauugcaguuaacucaguau

SEQ ID NO: 496056 - RNA, 22 nt, Human
gcaggcugaguugggaaaccaa

SEQ ID NO: 496057 - RNA, 22 nt, Human
cacagauagaccuuaugagauu

SEQ ID NO: 496058 - RNA, 22 nt, Human
uacagaagcuuuugaaaagaug

SEQ ID NO: 496059 - RNA, 18 nt, Human
ucaguccuccauagagcu

SEQ ID NO: 496060 - RNA, 22 nt, Human
gagguccauuuucacauaugau

SEQ ID NO: 496061 - RNA, 22 nt, Human
gggaucuugaaacagcuggauu

SEQ ID NO: 496062 - RNA, 22 nt, Human
gugccugggcaugagcuuguug

SEQ ID NO: 496063 - RNA, 20 nt, Human
cugcccugcccuggguccug

SEQ ID NO: 496064 - RNA, 22 nt, Human
cuccugggaaaugaaggggcag

SEQ ID NO: 496065 - RNA, 22 nt, Human
acagagcaguucuggagcuggc

SEQ ID NO: 496066 - RNA, 22 nt, Human
gcacagggcugccaggcggcuu

SEQ ID NO: 496067 - RNA, 22 nt, Human
auucuagaugcuguaaguagca

SEQ ID NO: 496068 - RNA, 22 nt, Human
acauuucucuugaugucucuau

SEQ ID NO: 496069 - RNA, 19 nt, Human
ggccuggauuuagggcucc

SEQ ID NO: 496070 - RNA, 22 nt, Human
uuuauucuagcucagaauaguu

SEQ ID NO: 496071 - RNA, 22 nt, Human
aaagguaguacuucuagaaggg

SEQ ID NO: 496072 - RNA, 22 nt, Human
uuugugaauagguuggcuucca

SEQ ID NO: 496073 - RNA, 22 nt, Human
cauugcacaucugagaagagau

SEQ ID NO: 496074 - RNA, 22 nt, Human
aaaugaccagaauacaggcuuc

SEQ ID NO: 496075 - RNA, 22 nt, Human
aggacuuagaacauuauguacu

SEQ ID NO: 496076 - RNA, 22 nt, Human
uccuggaggacagaggcaucuc

SEQ ID NO: 496077 - RNA, 19 nt, Human
agagucugugcucuuccua

SEQ ID NO: 496078 - RNA, 20 nt, Human
gcugccuuguccugcuuggu

SEQ ID NO: 496079 - RNA, 22 nt, Human
gcugucugccgcaggcugccac

SEQ ID NO: 496080 - RNA, 22 nt, Human
cugccagcucaaagcgcagcua

SEQ ID NO: 496081 - RNA, 22 nt, Human
aaaugucugucucaugaggaaa

SEQ ID NO: 496082 - RNA, 22 nt, Human
cuccuggcuaugacuacauuuc

SEQ ID NO: 496083 - RNA, 22 nt, Human
augugagggaaaucagucagaa

SEQ ID NO: 496084 - RNA, 20 nt, Human
cugcaggguuagaggcucca

SEQ ID NO: 496085 - RNA, 22 nt, Human
auuuuuccaugauacuuaucug

SEQ ID NO: 496086 - RNA, 22 nt, Human
uuugucagucaugucugcuuuu

SEQ ID NO: 496087 - RNA, 22 nt, Human
cuguucagaaaaaaucuucaug

SEQ ID NO: 496088 - RNA, 22 nt, Human
acagauuuuaaaugacacuccc

SEQ ID NO: 496089 - RNA, 22 nt, Human
cuuggccucuucucaggguggg

SEQ ID NO: 496090 - RNA, 22 nt, Human
acuguacuuuucuuggcuagau

SEQ ID NO: 496091 - RNA, 22 nt, Human
ccagcagguguagggcucaugg

SEQ ID NO: 496092 - RNA, 20 nt, Human
auguagaugaaagcaaaggc

SEQ ID NO: 496093 - RNA, 22 nt, Human
ugcaguuuugccaggcaaugga

SEQ ID NO: 496094 - RNA, 22 nt, Human
cugacaggguagacagagggca

SEQ ID NO: 496095 - RNA, 22 nt, Human
agguccaucguggaugaacugc

SEQ ID NO: 496096 - RNA, 22 nt, Human
ugcugaauaagacguggcuugu

SEQ ID NO: 496097 - RNA, 22 nt, Human
agggcagaaauauugauacugu

SEQ ID NO: 496098 - RNA, 22 nt, Human
accuguuuucagaaaaugcaga

SEQ ID NO: 496099 - RNA, 23 nt, Human
uucauuugucuacuucacuuguu

SEQ ID NO: 496100 - RNA, 22 nt, Human
uggaaagaugaagauguuuaag

SEQ ID NO: 496101 - RNA, 22 nt, Human
ucugggagcagcucagcagauu

SEQ ID NO: 496102 - RNA, 22 nt, Human
guccuucauuuccugaucucua

SEQ ID NO: 496103 - RNA, 19 nt, Human
acaagggcaggcaagguga

SEQ ID NO: 496104 - RNA, 22 nt, Human
uagaauugggccuaacuuccau

SEQ ID NO: 496105 - RNA, 22 nt, Human
ucuucaaacugaaaauuuagaa

SEQ ID NO: 496106 - RNA, 22 nt, Human
uucacagaugccugaugugugg

SEQ ID NO: 496107 - RNA, 22 nt, Human
caggccucaggggcucaggcug

SEQ ID NO: 496108 - RNA, 22 nt, Human
uguccuggugcuucuugggauu

SEQ ID NO: 496109 - RNA, 22 nt, Human
caggcucccgcuccacugggca

SEQ ID NO: 496110 - RNA, 22 nt, Human
augguuuguguggcccagauga

SEQ ID NO: 496111 - RNA, 22 nt, Human
ggcaggcaacggaccacuaguc

SEQ ID NO: 496112 - RNA, 22 nt, Human
cugcuggagguuggagcaugca

SEQ ID NO: 496113 - RNA, 22 nt, Human
ucugaagagucuugcaagaaag

SEQ ID NO: 496114 - RNA, 22 nt, Human
acugcuuuucagagucugccug

SEQ ID NO: 496115 - RNA, 22 nt, Human
gggaucagcaagccacugcacc

SEQ ID NO: 496116 - RNA, 19 nt, Human
ccagcccacagugacuuuc

SEQ ID NO: 496117 - RNA, 22 nt, Human
uccagggguaccggccaggcag

SEQ ID NO: 496118 - RNA, 22 nt, Human
ccugggucaccaggcccaggca

SEQ ID NO: 496119 - RNA, 22 nt, Human
uacagcauuaacaggcuguuua

SEQ ID NO: 496120 - RNA, 22 nt, Human
gugcacagaaacauacaaugug

SEQ ID NO: 496121 - RNA, 22 nt, Human
ccagucugcugugguaggaaga

SEQ ID NO: 496122 - RNA, 22 nt, Human
cugcuuugauuagaagaguaca

SEQ ID NO: 496123 - RNA, 22 nt, Human
augcacccagugucuggacuau

SEQ ID NO: 496124 - RNA, 22 nt, Human
ggagccagagggaugcaguuga

SEQ ID NO: 496125 - RNA, 22 nt, Human
ucagggcauacucuucaagguc

SEQ ID NO: 496126 - RNA, 22 nt, Human
aaauuagauaugugugagacuc

SEQ ID NO: 496127 - RNA, 22 nt, Human
gaggaaccaaaucagcuugcac

SEQ ID NO: 496128 - RNA, 22 nt, Human
uuugucuuauccaaucucucag

SEQ ID NO: 496129 - RNA, 22 nt, Human
gagcaggccagcaauggaaggg

SEQ ID NO: 496130 - RNA, 22 nt, Human
agaaguuaauuccugaaauucu

SEQ ID NO: 496131 - RNA, 21 nt, Human
gcucagaguauugcacuguuu

SEQ ID NO: 496132 - RNA, 22 nt, Human
ugcauaucuucaaugcuguugc

SEQ ID NO: 496133 - RNA, 22 nt, Human
ccucaaagcgguaugcagacgg

SEQ ID NO: 496134 - RNA, 22 nt, Human
gaaaugcagauucugauucugu

SEQ ID NO: 496135 - RNA, 22 nt, Human
ggaggccaugaggcucuaggug

SEQ ID NO: 496136 - RNA, 23 nt, Human
aaggucacagaacuuagcaagcc

SEQ ID NO: 496137 - RNA, 20 nt, Human
ggcagagcuaugucuguugc

SEQ ID NO: 496138 - RNA, 22 nt, Human
caagggcuucaaguggccaaga

SEQ ID NO: 496139 - RNA, 22 nt, Human
acuguucauuuggauuucucug

SEQ ID NO: 496140 - RNA, 22 nt, Human
cuggagcagguuuaggaguccc

SEQ ID NO: 496141 - RNA, 22 nt, Human
ucuuuccuagaggcugaugagu

SEQ ID NO: 496142 - RNA, 22 nt, Human
cauggccaggccaagagaguac

SEQ ID NO: 496143 - RNA, 22 nt, Human
aacaaauggaacacaaaucuuu

SEQ ID NO: 496144 - RNA, 22 nt, Human
uuuccucugcugccauugcccc

SEQ ID NO: 496145 - RNA, 22 nt, Human
auucagugugagguuuucaagu

SEQ ID NO: 496146 - RNA, 22 nt, Human
guguuuuauuggugcagucaga

SEQ ID NO: 496147 - RNA, 22 nt, Human
uuggguuuugauacaugucuaa

SEQ ID NO: 496148 - RNA, 22 nt, Human
auuguugaggagacucuucaau

SEQ ID NO: 496149 - RNA, 22 nt, Human
aaaguguugaagaaaauguuca

SEQ ID NO: 496150 - RNA, 20 nt, Human
aggguucccuuguucagcag

SEQ ID NO: 496151 - RNA, 22 nt, Human
gaaaacauccagagauagaccu

SEQ ID NO: 496152 - RNA, 22 nt, Human
aagcagcuuuugaagagugagg

SEQ ID NO: 496153 - RNA, 22 nt, Human
acagcaguggugcacugagcca

SEQ ID NO: 496154 - RNA, 22 nt, Human
ucugugacugauggaggcuuuu

SEQ ID NO: 496155 - RNA, 22 nt, Human
aagcuucagugugagcauguaa

SEQ ID NO: 496156 - RNA, 22 nt, Human
uuacaaagagugccagagugug

SEQ ID NO: 496157 - RNA, 22 nt, Human
gccccacagccugcggucucag

SEQ ID NO: 496158 - RNA, 22 nt, Human
ugccaggcacgugagaguggcc

SEQ ID NO: 496159 - RNA, 22 nt, Human
agcuaggacagguagagauggg

SEQ ID NO: 496160 - RNA, 21 nt, Human
aaggucuguaaagugacagga

SEQ ID NO: 496161 - RNA, 18 nt, Human
ggcugagguugacuagaa

SEQ ID NO: 496162 - RNA, 22 nt, Human
ggccccucuuguggcacauacg

SEQ ID NO: 496163 - RNA, 22 nt, Human
ucugggcccuaaaccagcucua

SEQ ID NO: 496164 - RNA, 22 nt, Human
agggcagagagaugaaugggau

SEQ ID NO: 496165 - RNA, 22 nt, Human
auuacaguaacagcuacaaugc

SEQ ID NO: 496166 - RNA, 22 nt, Human
auggggcugggauucuccucgg

SEQ ID NO: 496167 - RNA, 22 nt, Human
ccucuggccacaugggacauag

SEQ ID NO: 496168 - RNA, 22 nt, Human
uggagccagcccaggccccucu

SEQ ID NO: 496169 - RNA, 22 nt, Human
ugaggcagaaaauagcaguuca

SEQ ID NO: 496170 - RNA, 22 nt, Human
uucaggaggugagcaagaaggg

SEQ ID NO: 496171 - RNA, 22 nt, Human
agcauuuaguuaguaaauguuu

SEQ ID NO: 496172 - RNA, 22 nt, Human
uggaaacuaagacuagagagac

SEQ ID NO: 496173 - RNA, 22 nt, Human
uccucagacacccugcuggcuu

SEQ ID NO: 496174 - RNA, 22 nt, Human
agagacagaggcaauauagcuu

SEQ ID NO: 496175 - RNA, 22 nt, Human
uggcucagcauucacuggucuu

SEQ ID NO: 496176 - RNA, 22 nt, Human
gggggcaguaaccucaaagugu

SEQ ID NO: 496177 - RNA, 22 nt, Human
cuggccucagagggucauggug

SEQ ID NO: 496178 - RNA, 22 nt, Human
aauauuucuguagcuauguucu

SEQ ID NO: 496179 - RNA, 22 nt, Human
ucucugggugauggcagggcac

SEQ ID NO: 496180 - RNA, 22 nt, Human
agauuuguccugcuuucuaccu

SEQ ID NO: 496181 - RNA, 22 nt, Human
uguagcauguaaauugguuauu

SEQ ID NO: 496182 - RNA, 22 nt, Human
gaagcagccacggggagacaga

SEQ ID NO: 496183 - RNA, 22 nt, Human
uuugcuauuuuucugugcagcu

SEQ ID NO: 496184 - RNA, 22 nt, Human
ucgugucagaucagagguuccu

SEQ ID NO: 496185 - RNA, 22 nt, Human
guucccauacaguaucagugcu

SEQ ID NO: 496186 - RNA, 22 nt, Human
agauuucccucuuguauuugca

SEQ ID NO: 496187 - RNA, 22 nt, Human
cucaccaggaacagcugcggag

SEQ ID NO: 496188 - RNA, 22 nt, Human
ugaguccaagagccagugggaa

SEQ ID NO: 496189 - RNA, 22 nt, Human
cagcccugagaaggaggaucuc

SEQ ID NO: 496190 - RNA, 22 nt, Human
uaugcauacaaugagauauucc

SEQ ID NO: 496191 - RNA, 22 nt, Human
ucauuguugcguuaaugucuuc

SEQ ID NO: 496192 - RNA, 22 nt, Human
cagagcagugaggaguugugua

SEQ ID NO: 496193 - RNA, 22 nt, Human
ggccugagcuugggcagcguau

SEQ ID NO: 496194 - RNA, 22 nt, Human
uccuggcuaacacggugacacc

SEQ ID NO: 496195 - RNA, 22 nt, Human
aacuguaaagguugagugguaa

SEQ ID NO: 496196 - RNA, 22 nt, Human
gcacaggaggccgaugcucaug

SEQ ID NO: 496197 - RNA, 22 nt, Human
ugaaggccagggauuugcagcc

SEQ ID NO: 496198 - RNA, 22 nt, Human
ugucugaauuuuggaaucaagu

SEQ ID NO: 496199 - RNA, 22 nt, Human
aacaguguuuuucuucagcacu

SEQ ID NO: 496200 - RNA, 22 nt, Human
uacagaaagaccucucgggaaa

SEQ ID NO: 496201 - RNA, 22 nt, Human
agucuguggauggacuggcaga

SEQ ID NO: 496202 - RNA, 22 nt, Human
agcuccugaaaagcgcuugcuu

SEQ ID NO: 496203 - RNA, 22 nt, Human
agccagggcucuccuucgcgug

SEQ ID NO: 496204 - RNA, 22 nt, Human
auccuguggggcggcugcaggg

SEQ ID NO: 496205 - RNA, 22 nt, Human
guccucugagggggcugcacgc

SEQ ID NO: 496206 - RNA, 22 nt, Human
cauuuguaauacugacuugcag

SEQ ID NO: 496207 - RNA, 22 nt, Human
gcagggguagugucuuccugag

SEQ ID NO: 496208 - RNA, 22 nt, Human
ucugggagagcacguggcugac

SEQ ID NO: 496209 - RNA, 22 nt, Human
uuguccugcaaccucacauggc

SEQ ID NO: 496210 - RNA, 22 nt, Human
cugucucuguugccuguaggug

SEQ ID NO: 496211 - RNA, 22 nt, Human
ucauugucagcucuugacuucu

SEQ ID NO: 496212 - RNA, 22 nt, Human
auugacaaucuacuauguucug

SEQ ID NO: 496213 - RNA, 22 nt, Human
aggacuggcccugaggggaggc

SEQ ID NO: 496214 - RNA, 22 nt, Human
aguggcuguuuauaggugggua

SEQ ID NO: 496215 - RNA, 22 nt, Human
gcugccucuguagcuuuggacc

SEQ ID NO: 496216 - RNA, 22 nt, Human
gcccucucggcauagcaggggc

SEQ ID NO: 496217 - RNA, 22 nt, Human
gaaacccaaacuaagacaguag

SEQ ID NO: 496218 - RNA, 22 nt, Human
cuggagaaguacugagacauuu

SEQ ID NO: 496219 - RNA, 23 nt, Human
cuguggcugaguccuguuggagu

SEQ ID NO: 496220 - RNA, 22 nt, Human
aagagcuggaguuugcagcccu

SEQ ID NO: 496221 - RNA, 22 nt, Human
cugugccaggcccagcugacuu

SEQ ID NO: 496222 - RNA, 22 nt, Human
cgcugggggaacagcgagggug

SEQ ID NO: 496223 - RNA, 22 nt, Human
ucuccugcucagaacagccuca

SEQ ID NO: 496224 - RNA, 21 nt, Human
aguccaggaggaggccagguu

SEQ ID NO: 496225 - RNA, 22 nt, Human
uguuuuaaucucccauugcucu

SEQ ID NO: 496226 - RNA, 22 nt, Human
gacccugaggauucccugcuga

SEQ ID NO: 496227 - RNA, 22 nt, Human
guuugucuuaauuaggcaucga

SEQ ID NO: 496228 - RNA, 22 nt, Human
accaucuuaguggccagcucuc

SEQ ID NO: 496229 - RNA, 22 nt, Human
gcugggagugggcaagaugaga

SEQ ID NO: 496230 - RNA, 21 nt, Human
ggccucagccaccuggcucug

SEQ ID NO: 496231 - RNA, 22 nt, Human
gcccuuagucagcacuuucacu

SEQ ID NO: 496232 - RNA, 22 nt, Human
uugauuucuuacucuuccaagg

SEQ ID NO: 496233 - RNA, 22 nt, Human
uucccuggggaaggugaccuuu

SEQ ID NO: 496234 - RNA, 22 nt, Human
augauucagcaauuuuauaucu

SEQ ID NO: 496235 - RNA, 22 nt, Human
ugagguggcuagggaggcacuc

SEQ ID NO: 496236 - RNA, 22 nt, Human
cugcugcugcuaucuacccagg

SEQ ID NO: 496237 - RNA, 22 nt, Human
agagccaggccaggccggggca

SEQ ID NO: 496238 - RNA, 23 nt, Human
ugcuguccaacagacuggccaug

SEQ ID NO: 496239 - RNA, 22 nt, Human
ugcagagguguugcugagauaa

SEQ ID NO: 496240 - RNA, 22 nt, Human
uguaaugauguacuuagaagga

SEQ ID NO: 496241 - RNA, 22 nt, Human
cacagcagaaaguguaggagga

SEQ ID NO: 496242 - RNA, 22 nt, Human
acacagaguuugacacauggga

SEQ ID NO: 496243 - RNA, 22 nt, Human
aagggcagccugacucacgguc

SEQ ID NO: 496244 - RNA, 22 nt, Human
gccuccuggauuuuagugccau

SEQ ID NO: 496245 - RNA, 22 nt, Human
caggcccauaaugcaaauauuu

SEQ ID NO: 496246 - RNA, 23 nt, Human
uguuuuucauucacaugggcugu

SEQ ID NO: 496247 - RNA, 22 nt, Human
gauuuauuuuuaaucagcaggg

SEQ ID NO: 496248 - RNA, 22 nt, Human
aggaucaaaugaaauauuuuga

SEQ ID NO: 496249 - RNA, 22 nt, Human
ucagcuuuuuacaugugaaaua

SEQ ID NO: 496250 - RNA, 22 nt, Human
agcgggugcugugucagcccuc

SEQ ID NO: 496251 - RNA, 22 nt, Human
uucuugauuagucucaugccaa

SEQ ID NO: 496252 - RNA, 22 nt, Human
gaaagagaaccugggccuagau

SEQ ID NO: 496253 - RNA, 22 nt, Human
caaguuuucuggguucagagca

SEQ ID NO: 496254 - RNA, 22 nt, Human
ggagauaauccagggagggacu

SEQ ID NO: 496255 - RNA, 22 nt, Human
uuugucuuaaaucuuguuacug

SEQ ID NO: 496256 - RNA, 22 nt, Human
caugccaguuuugagaugcacc

SEQ ID NO: 496257 - RNA, 22 nt, Human
aaggcuggguuugggaugugau

SEQ ID NO: 496258 - RNA, 22 nt, Human
aguggcuguaggcuaugagaga

SEQ ID NO: 496259 - RNA, 22 nt, Human
uggaggaaguggcuggccagaa

SEQ ID NO: 496260 - RNA, 22 nt, Human
cccaugcugaguggccugagau

SEQ ID NO: 496261 - RNA, 22 nt, Human
aaacucuggauuggaguccagc

SEQ ID NO: 496262 - RNA, 22 nt, Human
ugcugggcuugaaagcugcuaa

SEQ ID NO: 496263 - RNA, 22 nt, Human
uguacauacauagauauacaca

SEQ ID NO: 496264 - RNA, 22 nt, Human
ugcccuggggagcccagccagg

SEQ ID NO: 496265 - RNA, 22 nt, Human
agggcacaggcuccggguccag

SEQ ID NO: 496266 - RNA, 22 nt, Human
ucuauucauucaauuuagcucu

SEQ ID NO: 496267 - RNA, 20 nt, Human
aaggcacuaugucugcuagc

SEQ ID NO: 496268 - RNA, 22 nt, Human
ggcuccuucaaagcaccuggcu

SEQ ID NO: 496269 - RNA, 16 nt, Human
aaggagggaagagaau

SEQ ID NO: 496270 - RNA, 22 nt, Human
agauauauuuccugcccaaggc

SEQ ID NO: 496271 - RNA, 23 nt, Human
ucucaggacacacaugucuauca

SEQ ID NO: 496272 - RNA, 22 nt, Human
guuuauuaacugucaagugauu

SEQ ID NO: 496273 - RNA, 22 nt, Human
acaauagacaaagugaauggcu

SEQ ID NO: 496274 - RNA, 22 nt, Human
ucucuggaagcgcagaucuguu

SEQ ID NO: 496275 - RNA, 22 nt, Human
ucacaagauacaguuagaagca

SEQ ID NO: 496276 - RNA, 22 nt, Human
gaggguuggugcaaaugggaug

SEQ ID NO: 496277 - RNA, 19 nt, Human
uccccagcaccucugaguc

SEQ ID NO: 496278 - RNA, 22 nt, Human
ggagaagguggcucagcaaagg

SEQ ID NO: 496279 - RNA, 22 nt, Human
uuucuaguucucugccaaaaaa

SEQ ID NO: 496280 - RNA, 22 nt, Human
gcagccacagaggagggaugca

SEQ ID NO: 496281 - RNA, 22 nt, Human
agaucugguuggaguccugaca

SEQ ID NO: 496282 - RNA, 22 nt, Human
auaaaguggagguaguauucau

SEQ ID NO: 496283 - RNA, 22 nt, Human
cagggcaguuugugccuaugag

SEQ ID NO: 496284 - RNA, 22 nt, Human
uggcucugagacacaggcucuc

SEQ ID NO: 496285 - RNA, 21 nt, Human
uuacuuuugcagcaaccuaau

SEQ ID NO: 496286 - RNA, 22 nt, Human
acacaagauuguguauugaauu

SEQ ID NO: 496287 - RNA, 22 nt, Human
aaaguuuccugcuaagugcuau

SEQ ID NO: 496288 - RNA, 22 nt, Human
uuccaggaagauucaacaaaag

SEQ ID NO: 496289 - RNA, 19 nt, Human
uuaugaaggcuggggggag

SEQ ID NO: 496290 - RNA, 22 nt, Human
uguagaaagaauauguuucaua

SEQ ID NO: 496291 - RNA, 22 nt, Human
cggagaggaccugcaacucgcu

SEQ ID NO: 496292 - RNA, 20 nt, Human
aauguauauuuuaugccagg

SEQ ID NO: 496293 - RNA, 23 nt, Human
ucaguuuuggcuguucaguguug

SEQ ID NO: 496294 - RNA, 22 nt, Human
cccagcucaagcagagagcuaa

SEQ ID NO: 496295 - RNA, 20 nt, Human
agcaggaaugaugcuuucau

SEQ ID NO: 496296 - RNA, 22 nt, Human
caggcugggaacgccacccgcu

SEQ ID NO: 496297 - RNA, 22 nt, Human
agacagcugccuccaccacagc

SEQ ID NO: 496298 - RNA, 22 nt, Human
gccagcuggagacuggcagggg

SEQ ID NO: 496299 - RNA, 22 nt, Human
gcucugggugaauggcagauug

SEQ ID NO: 496300 - RNA, 22 nt, Human
cagaugaauaaaugaugaggua

SEQ ID NO: 496301 - RNA, 20 nt, Human
gcuuuuucuaauagcagucc

SEQ ID NO: 496302 - RNA, 22 nt, Human
guugaaaguggagaaccugguu

SEQ ID NO: 496303 - RNA, 22 nt, Human
aagaugauaggacuugcuuaag

SEQ ID NO: 496304 - RNA, 22 nt, Human
uccccagucccggcggugggug

SEQ ID NO: 496305 - RNA, 22 nt, Human
gcaggagccacuucagggaugc

SEQ ID NO: 496306 - RNA, 22 nt, Human
acaggugaccugcucauaugaa

SEQ ID NO: 496307 - RNA, 22 nt, Human
auuauuucucacucacauaaua

SEQ ID NO: 496308 - RNA, 22 nt, Human
ugguccugaucaccgcugggca

SEQ ID NO: 496309 - RNA, 22 nt, Human
gagcuuccauggacgccaucug

SEQ ID NO: 496310 - RNA, 22 nt, Human
uuuccuuccaaaugcccgggag

SEQ ID NO: 496311 - RNA, 22 nt, Human
gcuuccuuauuguugccauagu

SEQ ID NO: 496312 - RNA, 22 nt, Human
ucaguccucacuugguucuaag

SEQ ID NO: 496313 - RNA, 22 nt, Human
ccucuguacaggucagcaucua

SEQ ID NO: 496314 - RNA, 22 nt, Human
ccaggagccacucaggcccaca

SEQ ID NO: 496315 - RNA, 22 nt, Human
cagaaguaagauuacugugagu

SEQ ID NO: 496316 - RNA, 22 nt, Human
uuccaaguguugagauuagagg

SEQ ID NO: 496317 - RNA, 22 nt, Human
cuauacaucccaauuucagaga

SEQ ID NO: 496318 - RNA, 22 nt, Human
ugguccuugcuauagagugaua

SEQ ID NO: 496319 - RNA, 22 nt, Human
caggaugggugucggccagcac

SEQ ID NO: 496320 - RNA, 22 nt, Human
caugcuggguaaagguggugaa

SEQ ID NO: 496321 - RNA, 22 nt, Human
ggaaaguggugguggaaagagg

SEQ ID NO: 496322 - RNA, 18 nt, Human
uaggaagcuuaauguuuu

SEQ ID NO: 496323 - RNA, 22 nt, Human
cuuggcaguuucggaaggauga

SEQ ID NO: 496324 - RNA, 23 nt, Human
ugagcccaggaggucaaggcugc

SEQ ID NO: 496325 - RNA, 22 nt, Human
cugccugugcaugcagucagaa

SEQ ID NO: 496326 - RNA, 22 nt, Human
agagccaggaucuguuuugggg

SEQ ID NO: 496327 - RNA, 22 nt, Human
ucuuucucucuaaucaagcaca

SEQ ID NO: 496328 - RNA, 22 nt, Human
cauugugcagggauaaugcagc

SEQ ID NO: 496329 - RNA, 21 nt, Human
caggucuggugaacacucuca

SEQ ID NO: 496330 - RNA, 17 nt, Human
gaaaggaggcaacacug

SEQ ID NO: 496331 - RNA, 22 nt, Human
cagcuucccuuggcugagcaga

SEQ ID NO: 496332 - RNA, 22 nt, Human
ugaacacacacaucuuaauaau

SEQ ID NO: 496333 - RNA, 22 nt, Human
aagcagaacugggaaguagugg

SEQ ID NO: 496334 - RNA, 22 nt, Human
ccugcagaccacacucaguccu

SEQ ID NO: 496335 - RNA, 22 nt, Human
ugcccaagcagaggagugauuc

SEQ ID NO: 496336 - RNA, 22 nt, Human
ucuaauaaauaaaugcucuagg

SEQ ID NO: 496337 - RNA, 22 nt, Human
aacaggaauugcaggcagaucu

SEQ ID NO: 496338 - RNA, 22 nt, Human
gcacuucuauuuuuuucagugg

SEQ ID NO: 496339 - RNA, 22 nt, Human
cugcugagcaucagggcugccc

SEQ ID NO: 496340 - RNA, 22 nt, Human
ucucugauguauaucagagaac

SEQ ID NO: 496341 - RNA, 22 nt, Human
ccaagggcugcugaggugucca

SEQ ID NO: 496342 - RNA, 22 nt, Human
gaaaauguuuccuguuauuugc

SEQ ID NO: 496343 - RNA, 22 nt, Human
auauucuuccaaaacaucauuu

SEQ ID NO: 496344 - RNA, 22 nt, Human
aggcccaguuauccuacuuguu

SEQ ID NO: 496345 - RNA, 22 nt, Human
aggcuccacccuacagagcucc

SEQ ID NO: 496346 - RNA, 22 nt, Human
aauuccagcuaggaaaagcuuc

SEQ ID NO: 496347 - RNA, 18 nt, Human
cugagggcaacagaggcu

SEQ ID NO: 496348 - RNA, 22 nt, Human
uuuuuacagucauggucacuca

SEQ ID NO: 496349 - RNA, 20 nt, Human
uccaguuuuggagacauucu

SEQ ID NO: 496350 - RNA, 22 nt, Human
uugaagguuuaacugagaggca

SEQ ID NO: 496351 - RNA, 22 nt, Human
uagggaggcuacuucuuguagg

SEQ ID NO: 496352 - RNA, 22 nt, Human
cugaggcuggggaagggaagug

SEQ ID NO: 496353 - RNA, 22 nt, Human
augggcuggccuuucccgcucu

SEQ ID NO: 496354 - RNA, 22 nt, Human
agcugagcuaguaguuccagug

SEQ ID NO: 496355 - RNA, 20 nt, Human
caguccaaucagaggccacc

SEQ ID NO: 496356 - RNA, 22 nt, Human
gugcugggugcugcagacaggu

SEQ ID NO: 496357 - RNA, 18 nt, Human
acagaggcagacauguau

SEQ ID NO: 496358 - RNA, 22 nt, Human
acuuucucccacccacccgucu

SEQ ID NO: 496359 - RNA, 22 nt, Human
caauugaacagaugaguuaaau

SEQ ID NO: 496360 - RNA, 22 nt, Human
gcacuagucuaggugcuaagau

SEQ ID NO: 496361 - RNA, 22 nt, Human
aaguucuuggaggaugaagagu

SEQ ID NO: 496362 - RNA, 22 nt, Human
gucaagaugagaauucuuuuua

SEQ ID NO: 496363 - RNA, 22 nt, Human
auuucauugaaguuaauucuuc

SEQ ID NO: 496364 - RNA, 22 nt, Human
aauuuguuacacagcaauauaa

SEQ ID NO: 496365 - RNA, 22 nt, Human
aagauuucugcuccugagagaa

SEQ ID NO: 496366 - RNA, 22 nt, Human
uuaaaaccaucagcuguaagau

SEQ ID NO: 496367 - RNA, 22 nt, Human
cucaggaggccauucucaaggu

SEQ ID NO: 496368 - RNA, 22 nt, Human
ggaugcugggagacagcaggca

SEQ ID NO: 496369 - RNA, 22 nt, Human
cguccgcaaugcaagccuuuua

SEQ ID NO: 496370 - RNA, 22 nt, Human
cuggucaccuccuucccagcua

SEQ ID NO: 496371 - RNA, 22 nt, Human
agaggcagcagucauacuacag

SEQ ID NO: 496372 - RNA, 22 nt, Human
aggcugggcaccguuuugaucc

SEQ ID NO: 496373 - RNA, 22 nt, Human
cuucacagccaacaugggcaca

SEQ ID NO: 496374 - RNA, 22 nt, Human
uucugaaggucagcagcuuggu

SEQ ID NO: 496375 - RNA, 22 nt, Human
cagguggguguaugaaugcaaa

SEQ ID NO: 496376 - RNA, 22 nt, Human
ugggcugcccaagguggccaug

SEQ ID NO: 496377 - RNA, 22 nt, Human
uuugaaaggugucgagaugugu

SEQ ID NO: 496378 - RNA, 22 nt, Human
ucucuggcuuagguugagugca

SEQ ID NO: 496379 - RNA, 22 nt, Human
aguaucauguuggaauuaauca

SEQ ID NO: 496380 - RNA, 22 nt, Human
agucccagcucagaaccacuag

SEQ ID NO: 496381 - RNA, 22 nt, Human
cagggcccaagacacaaugagg

SEQ ID NO: 496382 - RNA, 20 nt, Human
cacagcuugccuuuuaugac

SEQ ID NO: 496383 - RNA, 22 nt, Human
ccacucugcugugcuccaugau

SEQ ID NO: 496384 - RNA, 22 nt, Human
agcagggggcauccuugcccuu

SEQ ID NO: 496385 - RNA, 22 nt, Human
gaugcaggugugccacagagcu

SEQ ID NO: 496386 - RNA, 22 nt, Human
cuccaguggcaaguccgggcgg

SEQ ID NO: 496387 - RNA, 22 nt, Human
uuugcauugccucugacuuaug

SEQ ID NO: 496388 - RNA, 22 nt, Human
uaaagcaauuugagcaaguucu

SEQ ID NO: 496389 - RNA, 22 nt, Human
guagcccaccuggggagggcga

SEQ ID NO: 496390 - RNA, 22 nt, Human
aaacucugccauuuuuggccug

SEQ ID NO: 496391 - RNA, 22 nt, Human
agggggaggcugugcugcgucu

SEQ ID NO: 496392 - RNA, 22 nt, Human
guuauuaguaagacucgcacau

SEQ ID NO: 496393 - RNA, 22 nt, Human
ucucuggaauuuugagagugac

SEQ ID NO: 496394 - RNA, 22 nt, Human
aaccagaggcagcaguaccuga

SEQ ID NO: 496395 - RNA, 18 nt, Human
uuggaccugugucagggc

SEQ ID NO: 496396 - RNA, 22 nt, Human
gaguucaguguuucuaguagug

SEQ ID NO: 496397 - RNA, 22 nt, Human
ccccuuccacagugcuuccuaa

SEQ ID NO: 496398 - RNA, 22 nt, Human
uccugagauucugcauuucuaa

SEQ ID NO: 496399 - RNA, 22 nt, Human
gccugagagucugcauuucuaa

SEQ ID NO: 496400 - RNA, 20 nt, Human
ugcucaggauggagaggugu

SEQ ID NO: 496401 - RNA, 22 nt, Human
gcuggagguagggagguccugu

SEQ ID NO: 496402 - RNA, 16 nt, Human
agaggccuugaggaag

SEQ ID NO: 496403 - RNA, 18 nt, Human
gguccugggccuggcuca

SEQ ID NO: 496404 - RNA, 22 nt, Human
agagugaaguuuuugaaaguga

SEQ ID NO: 496405 - RNA, 22 nt, Human
gccagcagguggagagaucaag

SEQ ID NO: 496406 - RNA, 22 nt, Human
caggaaccuaaagagacauuac

SEQ ID NO: 496407 - RNA, 22 nt, Human
ccugcccuagagaugacacaau

SEQ ID NO: 496408 - RNA, 22 nt, Human
agguucagucuuuggaccccuc

SEQ ID NO: 496409 - RNA, 22 nt, Human
agcuucuuaaguuccugcagca

SEQ ID NO: 496410 - RNA, 22 nt, Human
uccaggcauuggagagauaaug

SEQ ID NO: 496411 - RNA, 22 nt, Human
aaaaguauggugguccuuuuua

SEQ ID NO: 496412 - RNA, 22 nt, Human
ccucuccaguuuuaacgugacc

SEQ ID NO: 496413 - RNA, 22 nt, Human
gcugcccagcaggccccagggg

SEQ ID NO: 496414 - RNA, 22 nt, Human
ugugccuggcauucugggcuuc

SEQ ID NO: 496415 - RNA, 18 nt, Human
cacaggcucccagugagg

SEQ ID NO: 496416 - RNA, 22 nt, Human
cucaggccauucuuccagcugc

SEQ ID NO: 496417 - RNA, 22 nt, Human
agggagaacaguugcagcagac

SEQ ID NO: 496418 - RNA, 22 nt, Human
uguggcugucuguucuccuagg

SEQ ID NO: 496419 - RNA, 22 nt, Human
augaaugaagaacaucugugcc

SEQ ID NO: 496420 - RNA, 22 nt, Human
auuuagugaaacccauaaagca

SEQ ID NO: 496421 - RNA, 22 nt, Human
aggagcccugcgggaggcagag

SEQ ID NO: 496422 - RNA, 22 nt, Human
cuggggcaucugacagauaaau

SEQ ID NO: 496423 - RNA, 22 nt, Human
uuuaauuagcaagccagagagc

SEQ ID NO: 496424 - RNA, 20 nt, Human
cagcaguggaugagaguuuu

SEQ ID NO: 496425 - RNA, 22 nt, Human
ugguucauaauuugcacuacug

SEQ ID NO: 496426 - RNA, 19 nt, Human
gggagagccaggcucaccc

SEQ ID NO: 496427 - RNA, 22 nt, Human
gguagcagggcugugagucaga

SEQ ID NO: 496428 - RNA, 22 nt, Human
cucccagagaccaagcugagaa

SEQ ID NO: 496429 - RNA, 22 nt, Human
auaacagaguugggaagugaaa

SEQ ID NO: 496430 - RNA, 19 nt, Human
gucacauuugucucccagg

SEQ ID NO: 496431 - RNA, 19 nt, Human
uuugaaaggauuguuauuu

SEQ ID NO: 496432 - RNA, 22 nt, Human
uuagaaagcuuuccauagucaa

SEQ ID NO: 496433 - RNA, 22 nt, Human
gaagcagcaaaucugcaguauc

SEQ ID NO: 496434 - RNA, 22 nt, Human
uuugugcagugguuaagaccau

SEQ ID NO: 496435 - RNA, 22 nt, Human
gaggcaaggccgcacgucucag

SEQ ID NO: 496436 - RNA, 22 nt, Human
aggagaaggaagugcaucacua

SEQ ID NO: 496437 - RNA, 22 nt, Human
ggcugccucuggaagcuggaga

SEQ ID NO: 496438 - RNA, 22 nt, Human
cauuuguaucugggcugcugug

SEQ ID NO: 496439 - RNA, 22 nt, Human
aguguguaagggaucaaagagu

SEQ ID NO: 496440 - RNA, 22 nt, Human
guggcccaggcacccugaugac

SEQ ID NO: 496441 - RNA, 22 nt, Human
ugcagcucauauuagagagaag

SEQ ID NO: 496442 - RNA, 22 nt, Human
uuuggaaaguguacaaauuuga

SEQ ID NO: 496443 - RNA, 22 nt, Human
ugcaggcuauaucuuauuugac

SEQ ID NO: 496444 - RNA, 22 nt, Human
cugccagcucgccacaaugaca

SEQ ID NO: 496445 - RNA, 22 nt, Human
cucacugacgaggaagcugaga

SEQ ID NO: 496446 - RNA, 22 nt, Human
aauguguucacaggaaauacag

SEQ ID NO: 496447 - RNA, 19 nt, Human
aaaguucugacuguagagc

SEQ ID NO: 496448 - RNA, 22 nt, Human
aaaggcaggcuuucacaucuca

SEQ ID NO: 496449 - RNA, 21 nt, Human
uccuccuccacuaggcuagcc

SEQ ID NO: 496450 - RNA, 22 nt, Human
uugcaauugcuauggagagcgu

SEQ ID NO: 496451 - RNA, 22 nt, Human
cuuacagugaucaacacaaaga

SEQ ID NO: 496452 - RNA, 22 nt, Human
agccauccucccaccucagccu

SEQ ID NO: 496453 - RNA, 22 nt, Human
ugcuucugaaguggaugggugc

SEQ ID NO: 496454 - RNA, 22 nt, Human
gcauggccauggcacuauggac

SEQ ID NO: 496455 - RNA, 22 nt, Human
acccacacaucucuaauucagu

SEQ ID NO: 496456 - RNA, 22 nt, Human
uuucuauucuggaucuguggca

SEQ ID NO: 496457 - RNA, 22 nt, Human
gccugccuuugugaggaagcgg

SEQ ID NO: 496458 - RNA, 22 nt, Human
uaaagugcgacccaguccccag

SEQ ID NO: 496459 - RNA, 22 nt, Human
cgaggcagacaaaaguuggaag

SEQ ID NO: 496460 - RNA, 22 nt, Human
cugcuuugaggggcucuguaua

SEQ ID NO: 496461 - RNA, 22 nt, Human
acauuucuuccuaauuaucccu

SEQ ID NO: 496462 - RNA, 21 nt, Human
gcucuggccuacuguucccuc

SEQ ID NO: 496463 - RNA, 22 nt, Human
cuccuuccccuacucagcaucc

SEQ ID NO: 496464 - RNA, 22 nt, Human
ucccagaagugaaauuucuaga

SEQ ID NO: 496465 - RNA, 22 nt, Human
cagugcagaggccagggaggau

SEQ ID NO: 496466 - RNA, 22 nt, Human
ucaaggaaugacuauaugagga

SEQ ID NO: 496467 - RNA, 22 nt, Human
augucuuucuuauggucuguug

SEQ ID NO: 496468 - RNA, 22 nt, Human
agggggcaucagguccuggcuc

SEQ ID NO: 496469 - RNA, 22 nt, Human
agggcugguauguccaugaaag

SEQ ID NO: 496470 - RNA, 22 nt, Human
auuuugaaaagcauuugaguaa

SEQ ID NO: 496471 - RNA, 22 nt, Human
ucugucaggagauuggcagcug

SEQ ID NO: 496472 - RNA, 22 nt, Human
ucacacaugcuaagccagagau

SEQ ID NO: 496473 - RNA, 22 nt, Human
aaguuguauauaccgcuuuaag

SEQ ID NO: 496474 - RNA, 22 nt, Human
uggcagcagggaggccaguguu

SEQ ID NO: 496475 - RNA, 22 nt, Human
accugcagcuaaagauguaggg

SEQ ID NO: 496476 - RNA, 22 nt, Human
ccaaauagucuuucauugaauu

SEQ ID NO: 496477 - RNA, 22 nt, Human
ucugccugccagucugguccuc

SEQ ID NO: 496478 - RNA, 22 nt, Human
uuuuuccuuggaugugucucuc

SEQ ID NO: 496479 - RNA, 22 nt, Human
cagggcuuugugugccugggga

SEQ ID NO: 496480 - RNA, 21 nt, Human
guucaaauggguagauucaca

SEQ ID NO: 496481 - RNA, 22 nt, Human
aacaacuugcguucagagaugu

SEQ ID NO: 496482 - RNA, 18 nt, Human
agcagaauucuaggguuc

SEQ ID NO: 496483 - RNA, 20 nt, Human
cagcucugggaaagaggcca

SEQ ID NO: 496484 - RNA, 22 nt, Human
ugccugucuuaauaucuggaaa

SEQ ID NO: 496485 - RNA, 22 nt, Human
ggggaugguggcauuuguaaaa

SEQ ID NO: 496486 - RNA, 22 nt, Human
augugcagcuuuucuagagaag

SEQ ID NO: 496487 - RNA, 22 nt, Human
uaguccugaccuugccaccagc

SEQ ID NO: 496488 - RNA, 21 nt, Human
ccucuggcuugugcugugccc

SEQ ID NO: 496489 - RNA, 22 nt, Human
aucugccugagucuagguuuuc

SEQ ID NO: 496490 - RNA, 22 nt, Human
aggaaacuaacuuaucuuuaua

SEQ ID NO: 496491 - RNA, 22 nt, Human
guuccugacuguggaguuuggu

SEQ ID NO: 496492 - RNA, 22 nt, Human
ucaguguucuuauuuaauuagg

SEQ ID NO: 496493 - RNA, 22 nt, Human
agcucugggggaaagucugcuc

SEQ ID NO: 496494 - RNA, 22 nt, Human
ggauccagaggugaagauggga

SEQ ID NO: 496495 - RNA, 23 nt, Human
agccccucauaucugcuuucucu

SEQ ID NO: 496496 - RNA, 22 nt, Human
auauuuuccgaacuugagguag

SEQ ID NO: 496497 - RNA, 22 nt, Human
gggguggccaaggacucugacc

SEQ ID NO: 496498 - RNA, 18 nt, Human
ucaugagguagaggcugg

SEQ ID NO: 496499 - RNA, 22 nt, Human
caaguccucaaagggcucugcu

SEQ ID NO: 496500 - RNA, 22 nt, Human
acauuucuggaguuucucaaca

SEQ ID NO: 496501 - RNA, 22 nt, Human
ucucagaguuuagagcugagcc

SEQ ID NO: 496502 - RNA, 22 nt, Human
gagcuuugcuggaagccugggg

SEQ ID NO: 496503 - RNA, 19 nt, Human
accaggcuuauggucagug

SEQ ID NO: 496504 - RNA, 20 nt, Human
cugcccagccacugagggau

SEQ ID NO: 496505 - RNA, 22 nt, Human
cugcaugaagucuuuuuuauag

SEQ ID NO: 496506 - RNA, 22 nt, Human
gcugugcagucuuuggugugcc

SEQ ID NO: 496507 - RNA, 22 nt, Human
uaagccugcaugaaccaugaga

SEQ ID NO: 496508 - RNA, 20 nt, Human
uggaccacccuccucuuugc

SEQ ID NO: 496509 - RNA, 22 nt, Human
agggucugacaaugugacuuag

SEQ ID NO: 496510 - RNA, 21 nt, Human
cccuguguuccacagcagaca

SEQ ID NO: 496511 - RNA, 22 nt, Human
uguccauggagaagcucagggc

SEQ ID NO: 496512 - RNA, 22 nt, Human
cagcaaagguagaagcacagga

SEQ ID NO: 496513 - RNA, 22 nt, Human
uggaccugaagaauaggaagua

SEQ ID NO: 496514 - RNA, 22 nt, Human
cagugagguggauggauggccu

SEQ ID NO: 496515 - RNA, 22 nt, Human
ucagaggaaagggaacauaguc

SEQ ID NO: 496516 - RNA, 23 nt, Human
acuuuagauaaauuaugugcaca

SEQ ID NO: 496517 - RNA, 22 nt, Human
aaugaacaucaaaugccuacca

SEQ ID NO: 496518 - RNA, 22 nt, Human
cuaggccacagggcaaaaagga

SEQ ID NO: 496519 - RNA, 22 nt, Human
uuuuagaaguucaugugggauu

SEQ ID NO: 496520 - RNA, 19 nt, Human
uagcccagagccuggcuac

SEQ ID NO: 496521 - RNA, 22 nt, Human
agagacaggauaucugcucaug

SEQ ID NO: 496522 - RNA, 22 nt, Human
uuggaagguucuggucaugguu

SEQ ID NO: 496523 - RNA, 22 nt, Human
caagaugccccugguagggauc

SEQ ID NO: 496524 - RNA, 22 nt, Human
acccagagucauguuuauuccc

SEQ ID NO: 496525 - RNA, 22 nt, Human
ucuagggaacaugggucaagcu

SEQ ID NO: 496526 - RNA, 22 nt, Human
ucugaaggugcuagagaaagcu

SEQ ID NO: 496527 - RNA, 22 nt, Human
ugcuuuauggagcccaucucau

SEQ ID NO: 496528 - RNA, 22 nt, Human
aagggcagcugacagaugcuua

SEQ ID NO: 496529 - RNA, 22 nt, Human
ugaaugaugcaguauaaugaua

SEQ ID NO: 496530 - RNA, 19 nt, Human
gcauuucucuuuacagcca

SEQ ID NO: 496531 - RNA, 22 nt, Human
uccuggcuguuagagaggcaag

SEQ ID NO: 496532 - RNA, 22 nt, Human
caagacuucaccgcucugugcu

SEQ ID NO: 496533 - RNA, 22 nt, Human
ccagcuggaagagugcagaacu

SEQ ID NO: 496534 - RNA, 22 nt, Human
gaugaagaggcacugacauauu

SEQ ID NO: 496535 - RNA, 22 nt, Human
ugcugaaauuagaacauugagg

SEQ ID NO: 496536 - RNA, 22 nt, Human
ggaagagccuggggugucaggc

SEQ ID NO: 496537 - RNA, 22 nt, Human
uggggagcacgguagggaaaug

SEQ ID NO: 496538 - RNA, 22 nt, Human
cuccagggcagcauggcagugg

SEQ ID NO: 496539 - RNA, 22 nt, Human
cccagggcccuggacagcuaca

SEQ ID NO: 496540 - RNA, 22 nt, Human
cuuuggaaaaauaccuggcaua

SEQ ID NO: 496541 - RNA, 22 nt, Human
uucucagggucuggauggccug

SEQ ID NO: 496542 - RNA, 22 nt, Human
gaggaggcuggcgccgccugcc

SEQ ID NO: 496543 - RNA, 22 nt, Human
cccuggguucuggcugggcugc

SEQ ID NO: 496544 - RNA, 22 nt, Human
agaucaaagccaugagagauuu

SEQ ID NO: 496545 - RNA, 22 nt, Human
auuagagguacaaaccuucacu

SEQ ID NO: 496546 - RNA, 22 nt, Human
uuucacaaguaaaguccuaagu

SEQ ID NO: 496547 - RNA, 22 nt, Human
uggaaacucuaccucucuaaga

SEQ ID NO: 496548 - RNA, 22 nt, Human
uacauucaacaugucacuaugu

SEQ ID NO: 496549 - RNA, 22 nt, Human
gacaggguacgggcuaggcaca

SEQ ID NO: 496550 - RNA, 22 nt, Human
gugcagguguuuuggcugccag

SEQ ID NO: 496551 - RNA, 22 nt, Human
ugaguucugacugugaugccag

SEQ ID NO: 496552 - RNA, 22 nt, Human
ucuggagccacaaaccucagcu

SEQ ID NO: 496553 - RNA, 22 nt, Human
aaggcaguuugggccaccaucu

SEQ ID NO: 496554 - RNA, 22 nt, Human
gauuucaaaaguagauccauca

SEQ ID NO: 496555 - RNA, 22 nt, Human
gguuggggcgagcuggaggccc

SEQ ID NO: 496556 - RNA, 23 nt, Human
uccagccucuugcucucacaugc

SEQ ID NO: 496557 - RNA, 22 nt, Human
cagcagcaguggcugcagaaca

SEQ ID NO: 496558 - RNA, 21 nt, Human
agaugaggauacugaggccua

SEQ ID NO: 496559 - RNA, 22 nt, Human
uugaaguugcacauuauaauuu

SEQ ID NO: 496560 - RNA, 22 nt, Human
auccccaggggcauucaagcuu

SEQ ID NO: 496561 - RNA, 17 nt, Human
ucauuuguugugacuag

SEQ ID NO: 496562 - RNA, 22 nt, Human
ccucauggccuugagcugaggg

SEQ ID NO: 496563 - RNA, 22 nt, Human
aguugugagaaacagaaugagc

SEQ ID NO: 496564 - RNA, 21 nt, Human
uuagaaagcucacuacaguua

SEQ ID NO: 496565 - RNA, 22 nt, Human
cauugcacgggcgucugucugu

SEQ ID NO: 496566 - RNA, 22 nt, Human
aggcuccuuguucaucauccau

SEQ ID NO: 496567 - RNA, 22 nt, Human
cccuccagcucaaagcaaccgg

SEQ ID NO: 496568 - RNA, 22 nt, Human
ggagccuguuaguugagugcuc

SEQ ID NO: 496569 - RNA, 22 nt, Human
agcagcucccuccucagccacc

SEQ ID NO: 496570 - RNA, 22 nt, Human
aaggaggcacccugagccugcc

SEQ ID NO: 496571 - RNA, 22 nt, Human
uaagugcaauguuuuacuuaaa

SEQ ID NO: 496572 - RNA, 22 nt, Human
ggccaccuccgugaaggaauga

SEQ ID NO: 496573 - RNA, 22 nt, Human
cugagccagggccacacaugga

SEQ ID NO: 496574 - RNA, 22 nt, Human
uucagagaguccaguaugcagu

SEQ ID NO: 496575 - RNA, 22 nt, Human
cagcugccaugacauguccugc

SEQ ID NO: 496576 - RNA, 22 nt, Human
agcugcugagccaggcugaugu

SEQ ID NO: 496577 - RNA, 22 nt, Human
gccagcuguucagacauucuuu

SEQ ID NO: 496578 - RNA, 22 nt, Human
agcugugggccugggagagcug

SEQ ID NO: 496579 - RNA, 22 nt, Human
ggaaggaucuggcugaaaucca

SEQ ID NO: 496580 - RNA, 22 nt, Human
cugucucugucuuaacucccag

SEQ ID NO: 496581 - RNA, 22 nt, Human
caauuucuaacauuccauggau

SEQ ID NO: 496582 - RNA, 16 nt, Human
uaaacagcagacaguu

SEQ ID NO: 496583 - RNA, 22 nt, Human
ugagcuucaaaguuggaucuga

SEQ ID NO: 496584 - RNA, 22 nt, Human
ggggaccuuuccauuucugaga

SEQ ID NO: 496585 - RNA, 17 nt, Human
uguagcuucuccuucuc

SEQ ID NO: 496586 - RNA, 22 nt, Human
ggacaaaggucuggggaaccug

SEQ ID NO: 496587 - RNA, 22 nt, Human
guuauguauugggaaauccaag

SEQ ID NO: 496588 - RNA, 19 nt, Human
ucucacaucagcuccuagc

SEQ ID NO: 496589 - RNA, 22 nt, Human
gaagaacaccugcugcccagug

SEQ ID NO: 496590 - RNA, 22 nt, Human
ccagaucuaaguccaaaguacu

SEQ ID NO: 496591 - RNA, 22 nt, Human
guggcucuugcauggggucucu

SEQ ID NO: 496592 - RNA, 22 nt, Human
cagcagagcugugugggaaggg

SEQ ID NO: 496593 - RNA, 22 nt, Human
ugccagggucagcugcagcucu

SEQ ID NO: 496594 - RNA, 22 nt, Human
aaccaggacaauuugaauagaa

SEQ ID NO: 496595 - RNA, 22 nt, Human
cucucuggucccagauuccaga

SEQ ID NO: 496596 - RNA, 22 nt, Human
agcugaaggcuagaacagcugg

SEQ ID NO: 496597 - RNA, 22 nt, Human
agagcuguagcuuccuagagcc

SEQ ID NO: 496598 - RNA, 22 nt, Human
ggcacugacacuagcauggcac

SEQ ID NO: 496599 - RNA, 20 nt, Human
cauauauaccuagaagugga

SEQ ID NO: 496600 - RNA, 22 nt, Human
gggauggggagcuggaaagggg

SEQ ID NO: 496601 - RNA, 22 nt, Human
cagcaggacauggaggaguaaa

SEQ ID NO: 496602 - RNA, 22 nt, Human
cugcuggccuagcccauccucu

SEQ ID NO: 496603 - RNA, 22 nt, Human
uaugugcaguuugcucuuaaca

SEQ ID NO: 496604 - RNA, 22 nt, Human
aaucauaauucaaauaagcuua

SEQ ID NO: 496605 - RNA, 19 nt, Human
cagcugcaccgugaccauc

SEQ ID NO: 496606 - RNA, 22 nt, Human
guuauugcaguauagaggucua

SEQ ID NO: 496607 - RNA, 22 nt, Human
uggccugguaccacauagauuu

SEQ ID NO: 496608 - RNA, 22 nt, Human
cagguggcuuauuagggucagu

SEQ ID NO: 496609 - RNA, 22 nt, Human
ugccaccuggacaaccuuaugc

SEQ ID NO: 496610 - RNA, 23 nt, Human
uuucauaugguguggaugaagaa

SEQ ID NO: 496611 - RNA, 22 nt, Human
ccagagucuuuauauuccugaa

SEQ ID NO: 496612 - RNA, 21 nt, Human
guuuucaugauagagucugua

SEQ ID NO: 496613 - RNA, 22 nt, Human
uaaaaguaggaaugaaacgcau

SEQ ID NO: 496614 - RNA, 22 nt, Human
gaguuuaaagcauacauauuuu

SEQ ID NO: 496615 - RNA, 22 nt, Human
gccuggaggggacagucucugg

SEQ ID NO: 496616 - RNA, 22 nt, Human
uaaguuuggggaaaauguuaag

SEQ ID NO: 496617 - RNA, 22 nt, Human
aaaguagaacauuuucuuaucu

SEQ ID NO: 496618 - RNA, 22 nt, Human
ugucuguaagguguuuauguua

SEQ ID NO: 496619 - RNA, 22 nt, Human
acaaugucucauauucguguuc

SEQ ID NO: 496620 - RNA, 22 nt, Human
cccugccuucuuggccuuuaaa

SEQ ID NO: 496621 - RNA, 22 nt, Human
auucaaguacaguuuucuucuu

SEQ ID NO: 496622 - RNA, 22 nt, Human
acaaacagaguugaaaaauagg

SEQ ID NO: 496623 - RNA, 22 nt, Human
uggcccugacuuggaggccuga

SEQ ID NO: 496624 - RNA, 22 nt, Human
caguuucuauggcugggcucug

SEQ ID NO: 496625 - RNA, 22 nt, Human
ccugggagccgacugacugugc

SEQ ID NO: 496626 - RNA, 22 nt, Human
gccugucucuuggaacuuggua

SEQ ID NO: 496627 - RNA, 22 nt, Human
uccagguccuacuggcccauag

SEQ ID NO: 496628 - RNA, 22 nt, Human
ggcagggaguggagacucccua

SEQ ID NO: 496629 - RNA, 22 nt, Human
uuaaagaguaaucauaggucaa

SEQ ID NO: 496630 - RNA, 22 nt, Human
guuugcauggaagacagugagu

SEQ ID NO: 496631 - RNA, 22 nt, Human
agggcagagaucugagugggca

SEQ ID NO: 496632 - RNA, 22 nt, Human
gcugucacucuccggccuuccc

SEQ ID NO: 496633 - RNA, 22 nt, Human
agggcuccaaggaaguguagcu

SEQ ID NO: 496634 - RNA, 22 nt, Human
aauggcagaggcaaagauggua

SEQ ID NO: 496635 - RNA, 22 nt, Human
aaagcugcuuuaaacaucuaug

SEQ ID NO: 496636 - RNA, 22 nt, Human
acucuuugucuguugccgcuua

SEQ ID NO: 496637 - RNA, 22 nt, Human
ucugggcagccaugugccuggc

SEQ ID NO: 496638 - RNA, 23 nt, Human
aaauaggaguaucuggaucauga

SEQ ID NO: 496639 - RNA, 22 nt, Human
agucccagcucugccacuuacu

SEQ ID NO: 496640 - RNA, 22 nt, Human
gagggcugauaaaugcgcaugg

SEQ ID NO: 496641 - RNA, 21 nt, Human
ccugagccuguuuauccagaa

SEQ ID NO: 496642 - RNA, 22 nt, Human
uucagcagugcagacacccagu

SEQ ID NO: 496643 - RNA, 21 nt, Human
ggugggcacaggagagcagag

SEQ ID NO: 496644 - RNA, 22 nt, Human
ccccagccuuccaugggaauug

SEQ ID NO: 496645 - RNA, 22 nt, Human
ggaggggagucucccaaagccg

SEQ ID NO: 496646 - RNA, 18 nt, Human
cugugggcuggugcauga

SEQ ID NO: 496647 - RNA, 22 nt, Human
uaggagccugcucugcagggac

SEQ ID NO: 496648 - RNA, 22 nt, Human
agcugggccugagcuggaagcu

SEQ ID NO: 496649 - RNA, 22 nt, Human
aggcagcaauugaaaucauugu

SEQ ID NO: 496650 - RNA, 22 nt, Human
cuggcucacuagcccugcccug

SEQ ID NO: 496651 - RNA, 19 nt, Human
gugucugccuuugugccac

SEQ ID NO: 496652 - RNA, 19 nt, Human
gcaggguguugacuguccc

SEQ ID NO: 496653 - RNA, 23 nt, Human
ggagccuggcauaugagacgcau

SEQ ID NO: 496654 - RNA, 21 nt, Human
uucucuccauaugcccagccc

SEQ ID NO: 496655 - RNA, 22 nt, Human
cugagcaguagagggucucuuu

SEQ ID NO: 496656 - RNA, 22 nt, Human
cacagaaguuucauagucucga

SEQ ID NO: 496657 - RNA, 22 nt, Human
agguccagagguugaacggugg

SEQ ID NO: 496658 - RNA, 22 nt, Human
ugaagccagggacugacacuuc

SEQ ID NO: 496659 - RNA, 22 nt, Human
aaacagauugaaauucguagua

SEQ ID NO: 496660 - RNA, 22 nt, Human
aagcagcauucagugaaaugug

SEQ ID NO: 496661 - RNA, 22 nt, Human
uccugggagcccuugcuccacc

SEQ ID NO: 496662 - RNA, 22 nt, Human
guaaauuauuucaagaucaucu

SEQ ID NO: 496663 - RNA, 22 nt, Human
aggccagcuguuacuagagcca

SEQ ID NO: 496664 - RNA, 22 nt, Human
ggcaaaguuuucaucucauaac

SEQ ID NO: 496665 - RNA, 21 nt, Human
caggaaagaaaacguacauau

SEQ ID NO: 496666 - RNA, 22 nt, Human
gccuucagcggccgcucgcugc

SEQ ID NO: 496667 - RNA, 22 nt, Human
ugucuuuuauaacugacauaua

SEQ ID NO: 496668 - RNA, 22 nt, Human
guuucauuuacaucuguaggua

SEQ ID NO: 496669 - RNA, 22 nt, Human
augaauugaggaaaacagucgu

SEQ ID NO: 496670 - RNA, 22 nt, Human
ucuccuucgaggcccagcuccc

SEQ ID NO: 496671 - RNA, 22 nt, Human
uggccuggugcucaggcaguag

SEQ ID NO: 496672 - RNA, 22 nt, Human
uacaggaggauuaucaaaggau

SEQ ID NO: 496673 - RNA, 22 nt, Human
cuucacagcaugagcuuuggag

SEQ ID NO: 496674 - RNA, 22 nt, Human
uccugggcagcgggacgcucag

SEQ ID NO: 496675 - RNA, 22 nt, Human
ucuggggugugaccugagcaug

SEQ ID NO: 496676 - RNA, 22 nt, Human
ucccuggcuguguucaggugcg

SEQ ID NO: 496677 - RNA, 22 nt, Human
uccuguggaagacaguguuggg

SEQ ID NO: 496678 - RNA, 22 nt, Human
gaaggucaccuccccucucugg

SEQ ID NO: 496679 - RNA, 22 nt, Human
ugccaggcgugguggugcgcac

SEQ ID NO: 496680 - RNA, 23 nt, Human
acacaaggguaacugccagccau

SEQ ID NO: 496681 - RNA, 22 nt, Human
aagaauugguuuccucugucau

SEQ ID NO: 496682 - RNA, 22 nt, Human
gggcccacuggcugucugaccc

SEQ ID NO: 496683 - RNA, 22 nt, Human
ugcagcugcuggcccaggugcu

SEQ ID NO: 496684 - RNA, 16 nt, Human
uggcugagagaggguu

SEQ ID NO: 496685 - RNA, 22 nt, Human
agggcuggaggguacuaguuua

SEQ ID NO: 496686 - RNA, 19 nt, Human
cagaccuguccagccugug

SEQ ID NO: 496687 - RNA, 22 nt, Human
uaucuguuccaggcacucagcu

SEQ ID NO: 496688 - RNA, 22 nt, Human
gguggcugcuuccucaagagga

SEQ ID NO: 496689 - RNA, 22 nt, Human
acuuccuguuaugugugccucu

SEQ ID NO: 496690 - RNA, 22 nt, Human
uccaggcauagaaggcacgcac

SEQ ID NO: 496691 - RNA, 22 nt, Human
uguggaauuucuuucagguaug

SEQ ID NO: 496692 - RNA, 22 nt, Human
ugcuucaaguugaaauauucuu

SEQ ID NO: 496693 - RNA, 22 nt, Human
aggucucugaguacugcuggac

SEQ ID NO: 496694 - RNA, 20 nt, Human
ggcaggacccgguagggagc

SEQ ID NO: 496695 - RNA, 22 nt, Human
caggccugugaguugaggcccc

SEQ ID NO: 496696 - RNA, 22 nt, Human
agggggcucagcaggcucugga

SEQ ID NO: 496697 - RNA, 22 nt, Human
gcaggcagaucaccugucagga

SEQ ID NO: 496698 - RNA, 19 nt, Human
acaaagcugugagcagcuu

SEQ ID NO: 496699 - RNA, 22 nt, Human
gauacaaauucaugucugaauu

SEQ ID NO: 496700 - RNA, 22 nt, Human
uuccagauuucuacacaagacc

SEQ ID NO: 496701 - RNA, 22 nt, Human
ucugucuccugccagugccucu

SEQ ID NO: 496702 - RNA, 22 nt, Human
auuagcuuccuauaguaagggg

SEQ ID NO: 496703 - RNA, 21 nt, Human
aguaguuuagcacaggguuug

SEQ ID NO: 496704 - RNA, 22 nt, Human
caaggugaacuugcuguacagc

SEQ ID NO: 496705 - RNA, 22 nt, Human
ugagcuggaaucuucuugacug

SEQ ID NO: 496706 - RNA, 17 nt, Human
acacagggagagggagc

SEQ ID NO: 496707 - RNA, 22 nt, Human
ucagagaguuuucacuagggug

SEQ ID NO: 496708 - RNA, 22 nt, Human
uagguucagugucuuguucugc

SEQ ID NO: 496709 - RNA, 22 nt, Human
agcucccagagcucgagaguaa

SEQ ID NO: 496710 - RNA, 22 nt, Human
auuucuguugcuuauaaauuac

SEQ ID NO: 496711 - RNA, 22 nt, Human
cccuggcugcuaccagguagcu

SEQ ID NO: 496712 - RNA, 22 nt, Human
ugcagaggagucagccugggca

SEQ ID NO: 496713 - RNA, 22 nt, Human
uggagcagggcaucacugugcg

SEQ ID NO: 496714 - RNA, 22 nt, Human
ggcacagaguuggcagagcugc

SEQ ID NO: 496715 - RNA, 22 nt, Human
acagagucugacagguaggcgc

SEQ ID NO: 496716 - RNA, 22 nt, Human
gugaaaucugaggcccaugaug

SEQ ID NO: 496717 - RNA, 22 nt, Human
acagaaggcggggacaaggcgg

SEQ ID NO: 496718 - RNA, 22 nt, Human
gccuggggucucugacucacag

SEQ ID NO: 496719 - RNA, 22 nt, Human
ugaugggaaaaugaggccuggg

SEQ ID NO: 496720 - RNA, 22 nt, Human
agccuccaaaugucaggucccg

SEQ ID NO: 496721 - RNA, 19 nt, Human
aaacucugaaggccacugg

SEQ ID NO: 496722 - RNA, 22 nt, Human
agcagggcucuguggagggugg

SEQ ID NO: 496723 - RNA, 22 nt, Human
cccugcagagggaugggggcag

SEQ ID NO: 496724 - RNA, 22 nt, Human
aggccaggccuuucuccauucc

SEQ ID NO: 496725 - RNA, 22 nt, Human
uguguuuuaucuauuguaucuu

SEQ ID NO: 496726 - RNA, 22 nt, Human
uuuugagauggagucuugcucu

SEQ ID NO: 496727 - RNA, 22 nt, Human
uagcauuagucagauauguuuu

SEQ ID NO: 496728 - RNA, 22 nt, Human
acuggaagccaguugacaauca

SEQ ID NO: 496729 - RNA, 22 nt, Human
ggccucagaccggagcuggcca

SEQ ID NO: 496730 - RNA, 22 nt, Human
ucauuucuaucuaugcagcuuc

SEQ ID NO: 496731 - RNA, 22 nt, Human
ucucaggaaauaggauuugagu

SEQ ID NO: 496732 - RNA, 22 nt, Human
acaucuuuuuggaaacggcuga

SEQ ID NO: 496733 - RNA, 22 nt, Human
gcuggagucuggaggugugcca

SEQ ID NO: 496734 - RNA, 22 nt, Human
gccuuccuuuuaccaccagcca

SEQ ID NO: 496735 - RNA, 23 nt, Human
guuuuacaggugagaaaauggag

SEQ ID NO: 496736 - RNA, 22 nt, Human
aggcagagaaaaaccagauaug

SEQ ID NO: 496737 - RNA, 23 nt, Human
aaaguuugaagcaacaguaguug

SEQ ID NO: 496738 - RNA, 22 nt, Human
uucuaugccauguucagcuacu

SEQ ID NO: 496739 - RNA, 22 nt, Human
guuucugagcacuuuuauugca

SEQ ID NO: 496740 - RNA, 22 nt, Human
ucuggcccugcugcugugagca

SEQ ID NO: 496741 - RNA, 22 nt, Human
ggacuccucuagaaguugaggc

SEQ ID NO: 496742 - RNA, 22 nt, Human
gugccuggggguaauguaggau

SEQ ID NO: 496743 - RNA, 22 nt, Human
ucuuggaaucuccauagaguga

SEQ ID NO: 496744 - RNA, 22 nt, Human
gcugucaccaaagcaggcacug

SEQ ID NO: 496745 - RNA, 22 nt, Human
ccagcccugaacccugcugcau

SEQ ID NO: 496746 - RNA, 22 nt, Human
ggcucuggucagugaggggccu

SEQ ID NO: 496747 - RNA, 22 nt, Human
ucuuggcuccucacagcaucag

SEQ ID NO: 496748 - RNA, 22 nt, Human
acugggcuuauuucuugugaac

SEQ ID NO: 496749 - RNA, 22 nt, Human
acacagugguguuuacaaaauu

SEQ ID NO: 496750 - RNA, 19 nt, Human
cucagcuguagcucaugug

SEQ ID NO: 496751 - RNA, 22 nt, Human
ccaguugguuucaaugggacag

SEQ ID NO: 496752 - RNA, 22 nt, Human
uccugggcgguuaugugaucug

SEQ ID NO: 496753 - RNA, 22 nt, Human
agcucccagcuccuuugagaga

SEQ ID NO: 496754 - RNA, 22 nt, Human
aggagcuggaguccaggcaagu

SEQ ID NO: 496755 - RNA, 22 nt, Human
aggaaacugggccucagguuag

SEQ ID NO: 496756 - RNA, 22 nt, Human
cugggcucuaagggagcaccgu

SEQ ID NO: 496757 - RNA, 22 nt, Human
acagugcagggcgggaagaagg

SEQ ID NO: 496758 - RNA, 22 nt, Human
ucagcuuuccuugcuuuagauu

SEQ ID NO: 496759 - RNA, 22 nt, Human
ucauugcauuuauucacuggca

SEQ ID NO: 496760 - RNA, 22 nt, Human
ucacauuuuuuacuggacuuaa

SEQ ID NO: 496761 - RNA, 17 nt, Human
gagauggguggaucacc

SEQ ID NO: 496762 - RNA, 22 nt, Human
uguguguauaugcauuuaucua

SEQ ID NO: 496763 - RNA, 22 nt, Human
gguagcacauugcauuaggaga

SEQ ID NO: 496764 - RNA, 22 nt, Human
ucugcaggcuuggaguggcagc

SEQ ID NO: 496765 - RNA, 22 nt, Human
augcugcacaagccacauguag

SEQ ID NO: 496766 - RNA, 22 nt, Human
caggaggcccaaagggcgcaga

SEQ ID NO: 496767 - RNA, 22 nt, Human
uacagaaaaacuggcauugaag

SEQ ID NO: 496768 - RNA, 22 nt, Human
acuuggcaaguaucuauaaagu

SEQ ID NO: 496769 - RNA, 22 nt, Human
ugaaaucaugaacaagguaggu

SEQ ID NO: 496770 - RNA, 22 nt, Human
uugucuguccaggcaccccaag

SEQ ID NO: 496771 - RNA, 22 nt, Human
cuggagggauguaggguguauu

SEQ ID NO: 496772 - RNA, 21 nt, Human
accuucaagccagaggugguc

SEQ ID NO: 496773 - RNA, 22 nt, Human
cagagucauaucagagaauaug

SEQ ID NO: 496774 - RNA, 22 nt, Human
uuaacagagugccuggcaugua

SEQ ID NO: 496775 - RNA, 22 nt, Human
gaaggcaggcuucugauuaggu

SEQ ID NO: 496776 - RNA, 22 nt, Human
caggccugagacaucugagaua

SEQ ID NO: 496777 - RNA, 19 nt, Human
agugaaauggaguauucaa

SEQ ID NO: 496778 - RNA, 22 nt, Human
gaugcagggcuggcaggagcuu

SEQ ID NO: 496779 - RNA, 17 nt, Human
accaggcaacacgccca

SEQ ID NO: 496780 - RNA, 22 nt, Human
ugaaagaagugucacauugcca

SEQ ID NO: 496781 - RNA, 22 nt, Human
uaguacuuaucucugucauugu

SEQ ID NO: 496782 - RNA, 22 nt, Human
aagagcugugggugguaguccu

SEQ ID NO: 496783 - RNA, 22 nt, Human
ggccucagagaaggcugugcgg

SEQ ID NO: 496784 - RNA, 22 nt, Human
ucccagcagagccagcaagccg

SEQ ID NO: 496785 - RNA, 20 nt, Human
uccaggcagacagcuauggg

SEQ ID NO: 496786 - RNA, 22 nt, Human
aacacuguacuggaagauggac

SEQ ID NO: 496787 - RNA, 22 nt, Human
aaacucuggggguggagcccag

SEQ ID NO: 496788 - RNA, 22 nt, Human
gccguuagauaauaacaagcau

SEQ ID NO: 496789 - RNA, 19 nt, Human
caggaugaucccaugacac

SEQ ID NO: 496790 - RNA, 20 nt, Human
aagagcauaguacaggaaga

SEQ ID NO: 496791 - RNA, 22 nt, Human
gcaguguuaccucuucaguggg

SEQ ID NO: 496792 - RNA, 22 nt, Human
cuuuccuuaauaagcagguaua

SEQ ID NO: 496793 - RNA, 22 nt, Human
agcagcuuacauguggccuauc

SEQ ID NO: 496794 - RNA, 22 nt, Human
auguguguauauauagucauuu

SEQ ID NO: 496795 - RNA, 22 nt, Human
uagagucuaguguauacaaagu

SEQ ID NO: 496796 - RNA, 22 nt, Human
uugguuuaggaacuggcuugga

SEQ ID NO: 496797 - RNA, 22 nt, Human
gucuucuguaagaugagguccc

SEQ ID NO: 496798 - RNA, 22 nt, Human
gaggagaggccaucguuguuau

SEQ ID NO: 496799 - RNA, 22 nt, Human
uucugaggcacuggcucuccca

SEQ ID NO: 496800 - RNA, 22 nt, Human
uuuauucugugcuacaugaaga

SEQ ID NO: 496801 - RNA, 19 nt, Human
gcacugaagaguuggucac

SEQ ID NO: 496802 - RNA, 22 nt, Human
aacuguaaugaauuguucauga

SEQ ID NO: 496803 - RNA, 22 nt, Human
ccuggagcgcgggucaagcugg

SEQ ID NO: 496804 - RNA, 22 nt, Human
cuguggauuuaggcagagcuga

SEQ ID NO: 496805 - RNA, 22 nt, Human
ugggccuggcccuguggaggag

SEQ ID NO: 496806 - RNA, 22 nt, Human
ugcagggagggcccagcaaucu

SEQ ID NO: 496807 - RNA, 22 nt, Human
gccagaggggcucgaaggcgcg

SEQ ID NO: 496808 - RNA, 22 nt, Human
cuuaggaacgcucugccuagug

SEQ ID NO: 496809 - RNA, 22 nt, Human
aaauguguuucuuugugaaugg

SEQ ID NO: 496810 - RNA, 22 nt, Human
agagcuggcagcagcuucuccu

SEQ ID NO: 496811 - RNA, 22 nt, Human
gcagggcagcucacugugguuc

SEQ ID NO: 496812 - RNA, 21 nt, Human
ugcaggcuacuucugacucua

SEQ ID NO: 496813 - RNA, 22 nt, Human
cagaagagaugaaauaguauua

SEQ ID NO: 496814 - RNA, 20 nt, Human
cucuuuguuggcaaacucuu

SEQ ID NO: 496815 - RNA, 22 nt, Human
agcaaacagugugcuaagaaau

SEQ ID NO: 496816 - RNA, 22 nt, Human
gcaggcugugguauguugggca

SEQ ID NO: 496817 - RNA, 22 nt, Human
uccaggcauguugggaagauga

SEQ ID NO: 496818 - RNA, 22 nt, Human
gcucccaggaagagaagggcca

SEQ ID NO: 496819 - RNA, 22 nt, Human
aaaugcuugcaacaucccaggu

SEQ ID NO: 496820 - RNA, 20 nt, Human
accaggagauggaggcaggg

SEQ ID NO: 496821 - RNA, 22 nt, Human
gcaggagccaggccgagcuggu

SEQ ID NO: 496822 - RNA, 22 nt, Human
cuccucuucugaguaccaggga

SEQ ID NO: 496823 - RNA, 22 nt, Human
augaacaaugacuacauauuga

SEQ ID NO: 496824 - RNA, 20 nt, Human
ccugucugcaauggagguca

SEQ ID NO: 496825 - RNA, 22 nt, Human
uguugugacccagaccaagaag

SEQ ID NO: 496826 - RNA, 20 nt, Human
uuucauugucagaaucuuau

SEQ ID NO: 496827 - RNA, 22 nt, Human
ucugggccggagccgacggcag

SEQ ID NO: 496828 - RNA, 22 nt, Human
ugcuuucaaaggcuuucuagau

SEQ ID NO: 496829 - RNA, 22 nt, Human
uggggaccagauuagaccaugg

SEQ ID NO: 496830 - RNA, 22 nt, Human
ggcacagcaccuuuucacauug

SEQ ID NO: 496831 - RNA, 22 nt, Human
uucaagauggcugcaaauacuu

SEQ ID NO: 496832 - RNA, 22 nt, Human
ucacagaagguggccauagcug

SEQ ID NO: 496833 - RNA, 22 nt, Human
agcugcucccuauccuuuccuu

SEQ ID NO: 496834 - RNA, 22 nt, Human
agguggguaucaugagagauua

SEQ ID NO: 496835 - RNA, 20 nt, Human
ggccggggagcucuccaggg

SEQ ID NO: 496836 - RNA, 22 nt, Human
cugggagaugacucagagcagg

SEQ ID NO: 496837 - RNA, 22 nt, Human
cucugguugcagcugaaguucc

SEQ ID NO: 496838 - RNA, 22 nt, Human
ugcucugucaagaaaagaugcc

SEQ ID NO: 496839 - RNA, 22 nt, Human
cagaaaauaaaguuucuacgca

SEQ ID NO: 496840 - RNA, 22 nt, Human
ccacugagaccuuuuggaggag

SEQ ID NO: 496841 - RNA, 22 nt, Human
gaaaacugugauuagaaugccu

SEQ ID NO: 496842 - RNA, 22 nt, Human
gcccccucaaagaggaagcucu

SEQ ID NO: 496843 - RNA, 22 nt, Human
gggcccuggacguggcggcaga

SEQ ID NO: 496844 - RNA, 22 nt, Human
ggcaggcuagcacugauguccu

SEQ ID NO: 496845 - RNA, 22 nt, Human
cuguaaaacacuguaguaucug

SEQ ID NO: 496846 - RNA, 22 nt, Human
ccagccugaaaugccucauccu

SEQ ID NO: 496847 - RNA, 22 nt, Human
ggugagaaagggauuccuguuc

SEQ ID NO: 496848 - RNA, 22 nt, Human
gcuuuccuggcccugucccugc

SEQ ID NO: 496849 - RNA, 22 nt, Human
aguuuaugaaacacagauuuga

SEQ ID NO: 496850 - RNA, 22 nt, Human
guuuagaacacggaaauacuga

SEQ ID NO: 496851 - RNA, 22 nt, Human
ggugaggcagguggcugcugag

SEQ ID NO: 496852 - RNA, 22 nt, Human
ugagcuguguccugggggcagu

SEQ ID NO: 496853 - RNA, 22 nt, Human
aaaacuguaucuucuugggacu

SEQ ID NO: 496854 - RNA, 22 nt, Human
ggugcagcugcagccugggagc

SEQ ID NO: 496855 - RNA, 22 nt, Human
cgugucaucugagccuugggcg

SEQ ID NO: 496856 - RNA, 20 nt, Human
uauaacaguguugggugugu

SEQ ID NO: 496857 - RNA, 16 nt, Human
gcugggagggagaggu

SEQ ID NO: 496858 - RNA, 22 nt, Human
ucucagagaggggccgggccuu

SEQ ID NO: 496859 - RNA, 22 nt, Human
cacagggcuaaaugaaggguug

SEQ ID NO: 496860 - RNA, 22 nt, Human
cugaggccuaagacaugaauga

SEQ ID NO: 496861 - RNA, 22 nt, Human
aggaccugacuggcuccugcuu

SEQ ID NO: 496862 - RNA, 20 nt, Human
uuaagaaaagcacauccugc

SEQ ID NO: 496863 - RNA, 22 nt, Human
uuagauaacaguagaauaucaa

SEQ ID NO: 496864 - RNA, 22 nt, Human
acagccaggcccagcacgcagg

SEQ ID NO: 496865 - RNA, 21 nt, Human
gcacagggacagaucaucaca

SEQ ID NO: 496866 - RNA, 22 nt, Human
caggaaaaugucaauggaaagc

SEQ ID NO: 496867 - RNA, 22 nt, Human
ucugggccugucucagagcugg

SEQ ID NO: 496868 - RNA, 22 nt, Human
agacugugagaagauggcugcg

SEQ ID NO: 496869 - RNA, 22 nt, Human
cugcccuggccacugugcccag

SEQ ID NO: 496870 - RNA, 22 nt, Human
ugucauguguucuuaaauacau

SEQ ID NO: 496871 - RNA, 22 nt, Human
gugaaugacuguuuucagcauu

SEQ ID NO: 496872 - RNA, 22 nt, Human
aaagacuaaccaguugucaaaa

SEQ ID NO: 496873 - RNA, 22 nt, Human
caaaagcaguucuaucugaguu

SEQ ID NO: 496874 - RNA, 22 nt, Human
ugaggcuggcaaggcugguauu

SEQ ID NO: 496875 - RNA, 22 nt, Human
aggaggggcauagaaauguaau

SEQ ID NO: 496876 - RNA, 22 nt, Human
agacagggagggagcgcggcug

SEQ ID NO: 496877 - RNA, 22 nt, Human
ucugaaaugcaaauuugacuga

SEQ ID NO: 496878 - RNA, 22 nt, Human
ucuucacagaugcauauacuuc

SEQ ID NO: 496879 - RNA, 22 nt, Human
ggacugggcaugggugcucugc

SEQ ID NO: 496880 - RNA, 22 nt, Human
ucucaaauauuuggagagagga

SEQ ID NO: 496881 - RNA, 22 nt, Human
caggcucccugcaggccaguga

SEQ ID NO: 496882 - RNA, 22 nt, Human
aaaauccucuaauucuagaaua

SEQ ID NO: 496883 - RNA, 22 nt, Human
gggagcaggagccugccugcca

SEQ ID NO: 496884 - RNA, 22 nt, Human
ccuggcagacagcacugaagcu

SEQ ID NO: 496885 - RNA, 22 nt, Human
uugcauuguaggauguuagaag

SEQ ID NO: 496886 - RNA, 19 nt, Human
uuucaaagggcauaagccu

SEQ ID NO: 496887 - RNA, 23 nt, Human
uuguccugccgaucucugagaau

SEQ ID NO: 496888 - RNA, 22 nt, Human
gacccggcuccaggcccagcag

SEQ ID NO: 496889 - RNA, 18 nt, Human
uguuaaaugaagauuugc

SEQ ID NO: 496890 - RNA, 22 nt, Human
cccuggaggucagaggccuggg

SEQ ID NO: 496891 - RNA, 22 nt, Human
cucuagcugaggucacugcuau

SEQ ID NO: 496892 - RNA, 22 nt, Human
ugccccucuugcuggcccuguc

SEQ ID NO: 496893 - RNA, 22 nt, Human
acuuccuggcugggugaccugg

SEQ ID NO: 496894 - RNA, 22 nt, Human
uucaauaucauuguuuagucuc

SEQ ID NO: 496895 - RNA, 22 nt, Human
aggagccauuuuccaagggcga

SEQ ID NO: 496896 - RNA, 22 nt, Human
uacaaagucagaauaacaggug

SEQ ID NO: 496897 - RNA, 22 nt, Human
caagcuuguuucuccugggggu

SEQ ID NO: 496898 - RNA, 20 nt, Human
uccugagugcaguuggcuug

SEQ ID NO: 496899 - RNA, 22 nt, Human
cuacccagcaccuaggcugccu

SEQ ID NO: 496900 - RNA, 22 nt, Human
uuuccagguaucaagcuucagg

SEQ ID NO: 496901 - RNA, 22 nt, Human
uccacagugguugaacuaguaa

SEQ ID NO: 496902 - RNA, 22 nt, Human
aggcuccagucuccucuggcag

SEQ ID NO: 496903 - RNA, 23 nt, Human
ucuguggccccuucgccccacuc

SEQ ID NO: 496904 - RNA, 22 nt, Human
uaaaugcagauuccugagccua

SEQ ID NO: 496905 - RNA, 22 nt, Human
ucuggcugucauuggaggcccc

SEQ ID NO: 496906 - RNA, 22 nt, Human
gucugucaucugagauggagug

SEQ ID NO: 496907 - RNA, 22 nt, Human
gggcuggcuaagacuuuucugu

SEQ ID NO: 496908 - RNA, 22 nt, Human
ggagcagagcucuucaucugca

SEQ ID NO: 496909 - RNA, 22 nt, Human
aaagaucagucugaagcaacau

SEQ ID NO: 496910 - RNA, 22 nt, Human
ucccagaggaaauggcagcuga

SEQ ID NO: 496911 - RNA, 22 nt, Human
ccacagaccuuggcuuccaccu

SEQ ID NO: 496912 - RNA, 22 nt, Human
cccuggaggcggagcuugcagu

SEQ ID NO: 496913 - RNA, 22 nt, Human
ugggccacgucaucucccacaa

SEQ ID NO: 496914 - RNA, 22 nt, Human
gguuccccaggcggcccuugga

SEQ ID NO: 496915 - RNA, 22 nt, Human
gcucccaggaugaggagccagg

SEQ ID NO: 496916 - RNA, 22 nt, Human
cagagacauguggccugcacgu

SEQ ID NO: 496917 - RNA, 22 nt, Human
ucaggucuauagaagaggaggg

SEQ ID NO: 496918 - RNA, 22 nt, Human
uuuguucacugagcaaugauua

SEQ ID NO: 496919 - RNA, 22 nt, Human
uuucagaauagcaaagcaagcu

SEQ ID NO: 496920 - RNA, 22 nt, Human
agaguucaguuguagccauauu

SEQ ID NO: 496921 - RNA, 22 nt, Human
uguuuacuuuccuucucacagg

SEQ ID NO: 496922 - RNA, 22 nt, Human
ucuuuuggaaaugaugugcagg

SEQ ID NO: 496923 - RNA, 22 nt, Human
uguacagauaaagacuguaaau

SEQ ID NO: 496924 - RNA, 22 nt, Human
aaucuaagccaccaguaguuuc

SEQ ID NO: 496925 - RNA, 22 nt, Human
agcauaaaggucaacguuuuag

SEQ ID NO: 496926 - RNA, 22 nt, Human
uucagagggacauucaagggaa

SEQ ID NO: 496927 - RNA, 23 nt, Human
acagggcauugcuggccucgagg

SEQ ID NO: 496928 - RNA, 22 nt, Human
uagagguagcaacaggacuaga

SEQ ID NO: 496929 - RNA, 18 nt, Human
gguggcucagucaugggg

SEQ ID NO: 496930 - RNA, 22 nt, Human
cccagcagauggcuaugugcua

SEQ ID NO: 496931 - RNA, 22 nt, Human
ucugagagguuaagcaauuuga

SEQ ID NO: 496932 - RNA, 22 nt, Human
caccagaguuguccaaaugauu

SEQ ID NO: 496933 - RNA, 23 nt, Human
cagggcugggcuugguguuaggc

SEQ ID NO: 496934 - RNA, 22 nt, Human
gcuguccucugaucucuggagg

SEQ ID NO: 496935 - RNA, 22 nt, Human
uaacagcuggcguuauaggaau

SEQ ID NO: 496936 - RNA, 22 nt, Human
ucucugaagauauuuauuauua

SEQ ID NO: 496937 - RNA, 22 nt, Human
cagcccagcagucuuagccugc

SEQ ID NO: 496938 - RNA, 19 nt, Human
ggccccucucacaggaguu

SEQ ID NO: 496939 - RNA, 22 nt, Human
uacauugugauguuucaauaca

SEQ ID NO: 496940 - RNA, 20 nt, Human
ucacagaaacaaauagagaa

SEQ ID NO: 496941 - RNA, 22 nt, Human
aacagcuuuuuuggucagcauu

SEQ ID NO: 496942 - RNA, 18 nt, Human
uguuuauuuuucucuuac

SEQ ID NO: 496943 - RNA, 22 nt, Human
cuuugugaugaggccuaagaca

SEQ ID NO: 496944 - RNA, 22 nt, Human
agguaaaauagauaguauuucu

SEQ ID NO: 496945 - RNA, 17 nt, Human
uugggagagaaagguau

SEQ ID NO: 496946 - RNA, 22 nt, Human
ucuggcucuguguccucaccca

SEQ ID NO: 496947 - RNA, 22 nt, Human
uuuguaaaaggaggaagcaugg

SEQ ID NO: 496948 - RNA, 22 nt, Human
auucaagguuggcucaggaauu

SEQ ID NO: 496949 - RNA, 22 nt, Human
aaagaugaucuacaaguucauu

SEQ ID NO: 496950 - RNA, 22 nt, Human
auuuguuccacacauauuuacu

SEQ ID NO: 496951 - RNA, 17 nt, Human
auccccagcaucuagaa

SEQ ID NO: 496952 - RNA, 22 nt, Human
gcugggagucgcgucuguggcc

SEQ ID NO: 496953 - RNA, 22 nt, Human
agguggggccaaaugcuacagu

SEQ ID NO: 496954 - RNA, 21 nt, Human
aaaugaaugugguagugcaag

SEQ ID NO: 496955 - RNA, 22 nt, Human
gggagggaagguaccuguguga

SEQ ID NO: 496956 - RNA, 22 nt, Human
gcagagugauggaaugugggug

SEQ ID NO: 496957 - RNA, 22 nt, Human
ccucacccagucaccuaggugg

SEQ ID NO: 496958 - RNA, 22 nt, Human
cagucucuugcuucauuaguug

SEQ ID NO: 496959 - RNA, 22 nt, Human
aucugccugcaguggagguggg

SEQ ID NO: 496960 - RNA, 22 nt, Human
ccaggccucaccugcccaccua

SEQ ID NO: 496961 - RNA, 22 nt, Human
agcuggagccagugugaggcuu

SEQ ID NO: 496962 - RNA, 22 nt, Human
auugaaaauauaauucuaggag

SEQ ID NO: 496963 - RNA, 22 nt, Human
aaggucugaguuuugccaggcc

SEQ ID NO: 496964 - RNA, 22 nt, Human
uccaggcaaagccuuguagacg

SEQ ID NO: 496965 - RNA, 22 nt, Human
acagaauauuguaagugccacu

SEQ ID NO: 496966 - RNA, 22 nt, Human
acagcuuuucugauagauccug

SEQ ID NO: 496967 - RNA, 22 nt, Human
uaaggcacccuucugaguagag

SEQ ID NO: 496968 - RNA, 22 nt, Human
gagcagcuggaggccuuguugg

SEQ ID NO: 496969 - RNA, 22 nt, Human
aaucagaaaauucaguggaauu

SEQ ID NO: 496970 - RNA, 22 nt, Human
gugccugccccacuccucagca

SEQ ID NO: 496971 - RNA, 22 nt, Human
gcagcuuuaaaggaggcucuga

SEQ ID NO: 496972 - RNA, 22 nt, Human
uuuaauauuucuuuccugaagc

SEQ ID NO: 496973 - RNA, 21 nt, Human
agaagggauugugguaaagau

SEQ ID NO: 496974 - RNA, 22 nt, Human
ggagaagggacagacucagcuu

SEQ ID NO: 496975 - RNA, 21 nt, Human
uggcuuuuauggagcucuggg

SEQ ID NO: 496976 - RNA, 22 nt, Human
cuggagaagcauucaaauaauu

SEQ ID NO: 496977 - RNA, 22 nt, Human
gcugccacauuuucaggacuaa

SEQ ID NO: 496978 - RNA, 22 nt, Human
ucagcucucacagaucucaacc

SEQ ID NO: 496979 - RNA, 22 nt, Human
cauugaauccuuccuucagaag

SEQ ID NO: 496980 - RNA, 22 nt, Human
ugccuggcugggcugcucaugg

SEQ ID NO: 496981 - RNA, 22 nt, Human
gucauugcaguggcaaaucaca

SEQ ID NO: 496982 - RNA, 22 nt, Human
agaggcuccaccuucucugucc

SEQ ID NO: 496983 - RNA, 22 nt, Human
ugaugguugauuauaaaucagu

SEQ ID NO: 496984 - RNA, 22 nt, Human
ugguccaguagcagggauacca

SEQ ID NO: 496985 - RNA, 22 nt, Human
ccaaauuaaaucauacagacag

SEQ ID NO: 496986 - RNA, 17 nt, Human
cagacagauauccuggg

SEQ ID NO: 496987 - RNA, 22 nt, Human
guaaacaugcuguguacucagc

SEQ ID NO: 496988 - RNA, 22 nt, Human
gccaggcaguucaaguacacca

SEQ ID NO: 496989 - RNA, 22 nt, Human
ggguaggagaggugucugugug

SEQ ID NO: 496990 - RNA, 20 nt, Human
cccuccagcaaccaggacuu

SEQ ID NO: 496991 - RNA, 22 nt, Human
ugaucaguguugguucuaucua

SEQ ID NO: 496992 - RNA, 22 nt, Human
cuguguuuugagauauuauuaa

SEQ ID NO: 496993 - RNA, 22 nt, Human
cugcucuguucccccaucaucu

SEQ ID NO: 496994 - RNA, 22 nt, Human
gcuguuggcgaggagcucagcu

SEQ ID NO: 496995 - RNA, 22 nt, Human
acuuccugcaaucguccacucc

SEQ ID NO: 496996 - RNA, 22 nt, Human
aguggcagagguugacugcagu

SEQ ID NO: 496997 - RNA, 22 nt, Human
acacaucaugccaaguuucacc

SEQ ID NO: 496998 - RNA, 22 nt, Human
uguggcugggcuaauaggcaaa

SEQ ID NO: 496999 - RNA, 22 nt, Human
agcuccugcacccagccuugag

SEQ ID NO: 497000 - RNA, 22 nt, Human
acacacagcgccuaccaugugc

SEQ ID NO: 497001 - RNA, 22 nt, Human
ccugggcucaagcgaucuuguc

SEQ ID NO: 497002 - RNA, 22 nt, Human
caucuucagguucauggucaua

SEQ ID NO: 497003 - RNA, 19 nt, Human
gugauuucuuuccacaagc

SEQ ID NO: 497004 - RNA, 19 nt, Human
uggaaacuccugauauuag

SEQ ID NO: 497005 - RNA, 22 nt, Human
gaccuccagcggcccugcagag

SEQ ID NO: 497006 - RNA, 22 nt, Human
uuacaggugggaaaacuaagcu

SEQ ID NO: 497007 - RNA, 22 nt, Human
ucauugcaagcucauuuaucug

SEQ ID NO: 497008 - RNA, 22 nt, Human
agccucugacugucagcaaggu

SEQ ID NO: 497009 - RNA, 22 nt, Human
caggccugauacacugaacucu

SEQ ID NO: 497010 - RNA, 22 nt, Human
aaaugcacagaggccagagagg

SEQ ID NO: 497011 - RNA, 22 nt, Human
ucacagcaaaagugugcagagc

SEQ ID NO: 497012 - RNA, 22 nt, Human
gcauggccuccagccaacagca

SEQ ID NO: 497013 - RNA, 22 nt, Human
cagggccucuccuccaggaacu

SEQ ID NO: 497014 - RNA, 22 nt, Human
cucaggauugugccuagggaga

SEQ ID NO: 497015 - RNA, 22 nt, Human
uuccuauuuccaugaaacacaa

SEQ ID NO: 497016 - RNA, 22 nt, Human
acuuccugcagcuucucagccc

SEQ ID NO: 497017 - RNA, 22 nt, Human
gggaaacuagaagcaggguuau

SEQ ID NO: 497018 - RNA, 20 nt, Human
gacauucauaguuauuacca

SEQ ID NO: 497019 - RNA, 22 nt, Human
cagggcugaaaucaagguguag

SEQ ID NO: 497020 - RNA, 22 nt, Human
gccucugcggggcccgagcccg

SEQ ID NO: 497021 - RNA, 22 nt, Human
cuacaggucaguaagaccuaga

SEQ ID NO: 497022 - RNA, 22 nt, Human
cccacauuuuugagucuucauc

SEQ ID NO: 497023 - RNA, 22 nt, Human
uacccaggaggaaacugaggcu

SEQ ID NO: 497024 - RNA, 22 nt, Human
ccugcagacacuuguccagcaa

SEQ ID NO: 497025 - RNA, 22 nt, Human
gcuggccauggggagugaggag

SEQ ID NO: 497026 - RNA, 22 nt, Human
agcagggaggcggugugcuggc

SEQ ID NO: 497027 - RNA, 22 nt, Human
cuggccuagcucucugcuugaa

SEQ ID NO: 497028 - RNA, 22 nt, Human
ugugugugaguccuggcuuucc

SEQ ID NO: 497029 - RNA, 22 nt, Human
gcucaggaucagccaccucuuu

SEQ ID NO: 497030 - RNA, 22 nt, Human
guuauuaaaguauuugauguua

SEQ ID NO: 497031 - RNA, 22 nt, Human
ggaggcaggaaagacagguuca

SEQ ID NO: 497032 - RNA, 22 nt, Human
ugucaugccauuuaaaauguuu

SEQ ID NO: 497033 - RNA, 22 nt, Human
guccugggccugcugaggcuga

SEQ ID NO: 497034 - RNA, 22 nt, Human
ugcugaggucaccuugcugcua

SEQ ID NO: 497035 - RNA, 22 nt, Human
cccucaccaggcuccaggcaug

SEQ ID NO: 497036 - RNA, 22 nt, Human
aaaaucugcuuccuuuuacaga

SEQ ID NO: 497037 - RNA, 22 nt, Human
ucuccugguacccuuccuagca

SEQ ID NO: 497038 - RNA, 22 nt, Human
gaaggcccugguauucuugagg

SEQ ID NO: 497039 - RNA, 22 nt, Human
aaggcucuggguuucauaggug

SEQ ID NO: 497040 - RNA, 22 nt, Human
caggaugugaggaggccauuug

SEQ ID NO: 497041 - RNA, 22 nt, Human
gaugaagucauuauccuuuugg

SEQ ID NO: 497042 - RNA, 22 nt, Human
ggccucggcccacugcugcggu

SEQ ID NO: 497043 - RNA, 22 nt, Human
gcugggagccccgagccagcgc

SEQ ID NO: 497044 - RNA, 22 nt, Human
uagccggguguugugucaugca

SEQ ID NO: 497045 - RNA, 22 nt, Human
auaauauuugcauuacugugau

SEQ ID NO: 497046 - RNA, 22 nt, Human
cugccucugguuuuggucccug

SEQ ID NO: 497047 - RNA, 22 nt, Human
uugagaagaaauaguuugcaau

SEQ ID NO: 497048 - RNA, 18 nt, Human
gggaagaggaucuggccc

SEQ ID NO: 497049 - RNA, 22 nt, Human
ucagagagcuggugggcagagg

SEQ ID NO: 497050 - RNA, 22 nt, Human
ugugccaugaggcucugauaug

SEQ ID NO: 497051 - RNA, 22 nt, Human
caggugggagccacagcguaca

SEQ ID NO: 497052 - RNA, 22 nt, Human
guugaaagaucauguggcugcc

SEQ ID NO: 497053 - RNA, 22 nt, Human
uguauacauucucuuggguuug

SEQ ID NO: 497054 - RNA, 22 nt, Human
uccaguggagugugggggugaa

SEQ ID NO: 497055 - RNA, 22 nt, Human
gccaggcagcagcgaggauggu

SEQ ID NO: 497056 - RNA, 22 nt, Human
cugggucccggcuucuauccac

SEQ ID NO: 497057 - RNA, 22 nt, Human
aagagagagugcgcucacagaa

SEQ ID NO: 497058 - RNA, 22 nt, Human
cagcagaggcacgucugugaau

SEQ ID NO: 497059 - RNA, 22 nt, Human
ucucagugaagaguauaacaaa

SEQ ID NO: 497060 - RNA, 22 nt, Human
gacugcaaccuuagacuagaaa

SEQ ID NO: 497061 - RNA, 22 nt, Human
ggacaggguaaguacuagugug

SEQ ID NO: 497062 - RNA, 23 nt, Human
aggcuuccuaucuuagagcuggg

SEQ ID NO: 497063 - RNA, 22 nt, Human
ugaguuacugccuaguaacuug

SEQ ID NO: 497064 - RNA, 22 nt, Human
uuuucuuauggugaagcacaaa

SEQ ID NO: 497065 - RNA, 22 nt, Human
ccuggggauucugacacggagu

SEQ ID NO: 497066 - RNA, 22 nt, Human
cccaggaguaagugacauuguu

SEQ ID NO: 497067 - RNA, 22 nt, Human
aagauguuagaggucaugcaga

SEQ ID NO: 497068 - RNA, 22 nt, Human
ucaguccugaugacaggcccaa

SEQ ID NO: 497069 - RNA, 20 nt, Human
acaguguuagguuuuuccuu

SEQ ID NO: 497070 - RNA, 22 nt, Human
ugcagcugugaaagggaaccaa

SEQ ID NO: 497071 - RNA, 22 nt, Human
ucugaacauccagcaaugcaca

SEQ ID NO: 497072 - RNA, 22 nt, Human
cugcccugcccaggccuugggc

SEQ ID NO: 497073 - RNA, 22 nt, Human
uccauuuuagaagaaaauccac

SEQ ID NO: 497074 - RNA, 22 nt, Human
acuuugugcccaacagaaagaa

SEQ ID NO: 497075 - RNA, 22 nt, Human
acaguguuccuuuguugugacu

SEQ ID NO: 497076 - RNA, 22 nt, Human
aaggcagguauugaugccacag

SEQ ID NO: 497077 - RNA, 22 nt, Human
uugcugaaaguggcaagaagua

SEQ ID NO: 497078 - RNA, 20 nt, Human
ucuguaggcaaguuagcagg

SEQ ID NO: 497079 - RNA, 22 nt, Human
uguccugggccggcgacugguc

SEQ ID NO: 497080 - RNA, 22 nt, Human
ggagcuggucagccuugagcau

SEQ ID NO: 497081 - RNA, 22 nt, Human
ucaaagucacaacucucuaauu

SEQ ID NO: 497082 - RNA, 22 nt, Human
cagugaaguucuacugaauggu

SEQ ID NO: 497083 - RNA, 22 nt, Human
accacugggcgggcagccugcu

SEQ ID NO: 497084 - RNA, 22 nt, Human
cugcagccacgagucacagccc

SEQ ID NO: 497085 - RNA, 22 nt, Human
gggccaggucggugaaugguca

SEQ ID NO: 497086 - RNA, 23 nt, Human
uguaaaagcauuugucagccugg

SEQ ID NO: 497087 - RNA, 22 nt, Human
aagcagccuggacuugggcugg

SEQ ID NO: 497088 - RNA, 22 nt, Human
ggcugcaggcagaggcugucug

SEQ ID NO: 497089 - RNA, 22 nt, Human
cugagagaucaagccacaggau

SEQ ID NO: 497090 - RNA, 22 nt, Human
gagccagccuucuucugagguc

SEQ ID NO: 497091 - RNA, 22 nt, Human
acauuuaaccaaacuguuuaau

SEQ ID NO: 497092 - RNA, 22 nt, Human
ugaggccaggaucccaggcucu

SEQ ID NO: 497093 - RNA, 22 nt, Human
cuuugggauuucaugagagcua

SEQ ID NO: 497094 - RNA, 21 nt, Human
ugaggcaggggugcuuuuguc

SEQ ID NO: 497095 - RNA, 18 nt, Human
gugggguguugugaggau

SEQ ID NO: 497096 - RNA, 22 nt, Human
caaagugcagaaggaacugggu

SEQ ID NO: 497097 - RNA, 22 nt, Human
uccucccugcacucagugaagu

SEQ ID NO: 497098 - RNA, 22 nt, Human
uggcucugggaaucuguugcuu

SEQ ID NO: 497099 - RNA, 22 nt, Human
uggcuucuggcuggugagaaau

SEQ ID NO: 497100 - RNA, 22 nt, Human
cgguccuggcacuugcggcucc

SEQ ID NO: 497101 - RNA, 22 nt, Human
gggaccuggcgagggucacaca

SEQ ID NO: 497102 - RNA, 22 nt, Human
ugggcucugaagucagucugcu

SEQ ID NO: 497103 - RNA, 22 nt, Human
guuccuauauagccuuaaggau

SEQ ID NO: 497104 - RNA, 22 nt, Human
ccagagcccagggucaugcagg

SEQ ID NO: 497105 - RNA, 22 nt, Human
gggcagguggagggcccagcca

SEQ ID NO: 497106 - RNA, 22 nt, Human
ucucugagggagauggccugcc

SEQ ID NO: 497107 - RNA, 22 nt, Human
gguucacacuaagcuuaagugg

SEQ ID NO: 497108 - RNA, 19 nt, Human
cucuccagcuccaguagcu

SEQ ID NO: 497109 - RNA, 22 nt, Human
cuacauuuugugauuaugaaau

SEQ ID NO: 497110 - RNA, 22 nt, Human
uaugcauauagaugcacacaca

SEQ ID NO: 497111 - RNA, 22 nt, Human
uagcaggguccaaugugaggca

SEQ ID NO: 497112 - RNA, 22 nt, Human
caaaaguucucacccagacaug

SEQ ID NO: 497113 - RNA, 22 nt, Human
uggucccuagcacagcuguccu

SEQ ID NO: 497114 - RNA, 22 nt, Human
ggcaggacugaucagugggaug

SEQ ID NO: 497115 - RNA, 22 nt, Human
uaaaugcuuucuaugaaagagg

SEQ ID NO: 497116 - RNA, 22 nt, Human
acagcauucaauaaauaauaac

SEQ ID NO: 497117 - RNA, 22 nt, Human
aaagccuugggauuugugauca

SEQ ID NO: 497118 - RNA, 21 nt, Human
agaaaaaccagcauguuuuca

SEQ ID NO: 497119 - RNA, 22 nt, Human
ggccuugggcuggcugcaguau

SEQ ID NO: 497120 - RNA, 22 nt, Human
augucaccuucgguggcacggu

SEQ ID NO: 497121 - RNA, 22 nt, Human
ugcugaauaaagauauauuuuc

SEQ ID NO: 497122 - RNA, 22 nt, Human
ugcuucugggcaaaugugugug

SEQ ID NO: 497123 - RNA, 20 nt, Human
ucugggcuucccccagcucc

SEQ ID NO: 497124 - RNA, 22 nt, Human
gucaggaugggcagccaaacua

SEQ ID NO: 497125 - RNA, 23 nt, Human
acagacauuccauaauguacacc

SEQ ID NO: 497126 - RNA, 22 nt, Human
augugacaauauuuggucuuau

SEQ ID NO: 497127 - RNA, 22 nt, Human
cuggugggaagauggaaaacau

SEQ ID NO: 497128 - RNA, 23 nt, Human
gggagaugggaaaugaaggcucu

SEQ ID NO: 497129 - RNA, 22 nt, Human
gaggcagagucacaaagagucu

SEQ ID NO: 497130 - RNA, 22 nt, Human
auggcugcagccggcccugcgc

SEQ ID NO: 497131 - RNA, 22 nt, Human
acacauuauaggcaaucaaaag

SEQ ID NO: 497132 - RNA, 22 nt, Human
gggagacacgcugcaggcauaa

SEQ ID NO: 497133 - RNA, 22 nt, Human
cccucacuucacgcucugcaga

SEQ ID NO: 497134 - RNA, 22 nt, Human
aauacagauauucagugguacu

SEQ ID NO: 497135 - RNA, 22 nt, Human
gggugggguguaucggauccua

SEQ ID NO: 497136 - RNA, 22 nt, Human
uaacaguaaaguaaguuagcuu

SEQ ID NO: 497137 - RNA, 22 nt, Human
uauaacaguuuaggugguguca

SEQ ID NO: 497138 - RNA, 22 nt, Human
aggcagcuuuaacugguaguag

SEQ ID NO: 497139 - RNA, 22 nt, Human
uuccaggacuggguguuugaag

SEQ ID NO: 497140 - RNA, 22 nt, Human
agaaaacauaggagacaggaaa

SEQ ID NO: 497141 - RNA, 22 nt, Human
ggcuuuauuuugcaugaaugcu

SEQ ID NO: 497142 - RNA, 22 nt, Human
uuauuaaaaugcggauuuggcu

SEQ ID NO: 497143 - RNA, 22 nt, Human
agugggaggcggcugacgggcg

SEQ ID NO: 497144 - RNA, 21 nt, Human
agcuggccugguuugagcucc

SEQ ID NO: 497145 - RNA, 22 nt, Human
ucagaggaaaggucagauggcu

SEQ ID NO: 497146 - RNA, 22 nt, Human
gcagaggcuccauuuuacagau

SEQ ID NO: 497147 - RNA, 22 nt, Human
ccagcagcucccucaggguccg

SEQ ID NO: 497148 - RNA, 22 nt, Human
cugggucuaaaaauucucagau

SEQ ID NO: 497149 - RNA, 22 nt, Human
gcaggucuagaagcugccucug

SEQ ID NO: 497150 - RNA, 22 nt, Human
aaauggcuuugaggguaggaca

SEQ ID NO: 497151 - RNA, 22 nt, Human
gaacagaauuaccgaagaucug

SEQ ID NO: 497152 - RNA, 22 nt, Human
cuggggcucacuccagcccugg

SEQ ID NO: 497153 - RNA, 22 nt, Human
gggaucugcuccagagggaaaa

SEQ ID NO: 497154 - RNA, 22 nt, Human
gagaggcccugaagcccacaga

SEQ ID NO: 497155 - RNA, 22 nt, Human
ugcauccuccuuuguccucuug

SEQ ID NO: 497156 - RNA, 22 nt, Human
uccugggcuuaagugauccucc

SEQ ID NO: 497157 - RNA, 22 nt, Human
guaaaauucuagcaucugaaag

SEQ ID NO: 497158 - RNA, 22 nt, Human
caggugggccgggguuuguucu

SEQ ID NO: 497159 - RNA, 22 nt, Human
ucuccagggacugaggcuggag

SEQ ID NO: 497160 - RNA, 22 nt, Human
ucagggacugcagagggaagcu

SEQ ID NO: 497161 - RNA, 22 nt, Human
gccuggcccagggcuccgcagg

SEQ ID NO: 497162 - RNA, 22 nt, Human
cguggccuuugagugagcuccc

SEQ ID NO: 497163 - RNA, 22 nt, Human
uugcagcagggugaauucacuc

SEQ ID NO: 497164 - RNA, 22 nt, Human
cagggcucaggaaaucagacgu

SEQ ID NO: 497165 - RNA, 22 nt, Human
ggaaggggccuugagcaaacug

SEQ ID NO: 497166 - RNA, 20 nt, Human
ucagccagcuaacaugggga

SEQ ID NO: 497167 - RNA, 22 nt, Human
gagcuuggggcauauggugcua

SEQ ID NO: 497168 - RNA, 20 nt, Human
gcuccccuucucugggccuc

SEQ ID NO: 497169 - RNA, 22 nt, Human
aagaaauuaaggaaugcaacga

SEQ ID NO: 497170 - RNA, 22 nt, Human
gccugcagauauauaggauggu

SEQ ID NO: 497171 - RNA, 22 nt, Human
gcagaacaacguaggaguggag

SEQ ID NO: 497172 - RNA, 22 nt, Human
ucuagaaacaugacauugaucu

SEQ ID NO: 497173 - RNA, 22 nt, Human
ucacagagagguuaagcaguug

SEQ ID NO: 497174 - RNA, 22 nt, Human
uuuaguaaguucacugcaaagc

SEQ ID NO: 497175 - RNA, 22 nt, Human
aaagacacacagugcuucaguu

SEQ ID NO: 497176 - RNA, 19 nt, Human
ccuuggaguuccaggugga

SEQ ID NO: 497177 - RNA, 22 nt, Human
cugcagggaacugaggcccaga

SEQ ID NO: 497178 - RNA, 22 nt, Human
guuccuugggaacaacgcugaa

SEQ ID NO: 497179 - RNA, 22 nt, Human
gggcugacucugcacugagcca

SEQ ID NO: 497180 - RNA, 22 nt, Human
gacaagacuauguagaaaguau

SEQ ID NO: 497181 - RNA, 22 nt, Human
uugcucugacuggagugcagug

SEQ ID NO: 497182 - RNA, 22 nt, Human
ccugccuggaucagccauccug

SEQ ID NO: 497183 - RNA, 22 nt, Human
uuguaacaaucugucauaaaug

SEQ ID NO: 497184 - RNA, 22 nt, Human
aagggccauaacuugcaguguu

SEQ ID NO: 497185 - RNA, 22 nt, Human
uaggcugagcuuguagaucgua

SEQ ID NO: 497186 - RNA, 17 nt, Human
agauggcaggaggcaga

SEQ ID NO: 497187 - RNA, 22 nt, Human
uacuacauuaauaaaacauuca

SEQ ID NO: 497188 - RNA, 22 nt, Human
aaggaggaauuucagggugaau

SEQ ID NO: 497189 - RNA, 22 nt, Human
agacagcaugagccugcugaug

SEQ ID NO: 497190 - RNA, 18 nt, Human
ggcaggagcaagaauagg

SEQ ID NO: 497191 - RNA, 22 nt, Human
ccuaggccuuacuuuccugugc

SEQ ID NO: 497192 - RNA, 22 nt, Human
ucuguggcauguugcacuugua

SEQ ID NO: 497193 - RNA, 21 nt, Human
cacugaggucagggguagggu

SEQ ID NO: 497194 - RNA, 22 nt, Human
uaugaagacaaugauagcauga

SEQ ID NO: 497195 - RNA, 22 nt, Human
gcccagcugagaagcgcggggc

SEQ ID NO: 497196 - RNA, 22 nt, Human
agagugagggggcacugagacg

SEQ ID NO: 497197 - RNA, 22 nt, Human
acagaauugauggaaaucucag

SEQ ID NO: 497198 - RNA, 22 nt, Human
uggccagguugggcuuugcagc

SEQ ID NO: 497199 - RNA, 22 nt, Human
aggaggugacagccugcaucug

SEQ ID NO: 497200 - RNA, 22 nt, Human
uggcucaggaucuaagcagaau

SEQ ID NO: 497201 - RNA, 22 nt, Human
auguaucaauuaucugucugca

SEQ ID NO: 497202 - RNA, 22 nt, Human
caguuuauagcucuagcagcuu

SEQ ID NO: 497203 - RNA, 22 nt, Human
uauacagaaccgccugaagucu

SEQ ID NO: 497204 - RNA, 22 nt, Human
aucaggauguuuggcugucaua

SEQ ID NO: 497205 - RNA, 22 nt, Human
auauuguacuaggguuacaugu

SEQ ID NO: 497206 - RNA, 22 nt, Human
aguucuggugguuuggagaucu

SEQ ID NO: 497207 - RNA, 22 nt, Human
ccucuguccuggggaguggagc

SEQ ID NO: 497208 - RNA, 22 nt, Human
ccagcuuuccugcgaguugauu

SEQ ID NO: 497209 - RNA, 22 nt, Human
acucagcuuccuacagcuagaa

SEQ ID NO: 497210 - RNA, 22 nt, Human
aauguuacgaucaacaacacau

SEQ ID NO: 497211 - RNA, 22 nt, Human
cccagccuacucugccauagca

SEQ ID NO: 497212 - RNA, 23 nt, Human
ccucccaccuauuucacuuucuu

SEQ ID NO: 497213 - RNA, 22 nt, Human
aaugccaguguguugauuccag

SEQ ID NO: 497214 - RNA, 22 nt, Human
ggcugagcucaggggcagcagg

SEQ ID NO: 497215 - RNA, 22 nt, Human
cuggcagcgguuugcagccugg

SEQ ID NO: 497216 - RNA, 22 nt, Human
gcagggccagugcagagaggaa

SEQ ID NO: 497217 - RNA, 22 nt, Human
cacugucuuuugugaagacaau

SEQ ID NO: 497218 - RNA, 22 nt, Human
uccuccuucgggacugcuugac

SEQ ID NO: 497219 - RNA, 22 nt, Human
uucugggggaauacagcuauga

SEQ ID NO: 497220 - RNA, 22 nt, Human
gcuccugucuuggggcacuggc

SEQ ID NO: 497221 - RNA, 22 nt, Human
agcuccuggcaaggucauggug

SEQ ID NO: 497222 - RNA, 22 nt, Human
ugcugaauuuacauuuuuguag

SEQ ID NO: 497223 - RNA, 22 nt, Human
agguggguccuggcucugccau

SEQ ID NO: 497224 - RNA, 22 nt, Human
uugaggagaagacuuugcuucc

SEQ ID NO: 497225 - RNA, 19 nt, Human
ccagcagguucauuucagg

SEQ ID NO: 497226 - RNA, 22 nt, Human
ucucaucuucauaucugaaaga

SEQ ID NO: 497227 - RNA, 22 nt, Human
cuggccuggucuggccucucca

SEQ ID NO: 497228 - RNA, 22 nt, Human
ucacaccuguaaucccaggccu

SEQ ID NO: 497229 - RNA, 22 nt, Human
cucugagcagaggccguggcua

SEQ ID NO: 497230 - RNA, 19 nt, Human
uuucaauggcuuagagaaa

SEQ ID NO: 497231 - RNA, 22 nt, Human
ugccuucauccauguuauagug

SEQ ID NO: 497232 - RNA, 22 nt, Human
ugaaccacaugcaaagugaaua

SEQ ID NO: 497233 - RNA, 22 nt, Human
gggucucucucggcuccacgcg

SEQ ID NO: 497234 - RNA, 19 nt, Human
auuccucaaggacagaaau

SEQ ID NO: 497235 - RNA, 22 nt, Human
ccagggcagggaccacgugucu

SEQ ID NO: 497236 - RNA, 22 nt, Human
ggugaagggccuuaggagacag

SEQ ID NO: 497237 - RNA, 22 nt, Human
uccuggcugccgucguccugcg

SEQ ID NO: 497238 - RNA, 22 nt, Human
acaguguuuaagagauggcauu

SEQ ID NO: 497239 - RNA, 22 nt, Human
uucagugugaagcuucugaaag

SEQ ID NO: 497240 - RNA, 22 nt, Human
agcugucugucuccugaggaga

SEQ ID NO: 497241 - RNA, 22 nt, Human
ucugaaaguaucuggaucuuuu

SEQ ID NO: 497242 - RNA, 22 nt, Human
agagcugggacuuggacucaau

SEQ ID NO: 497243 - RNA, 22 nt, Human
caaggcugucuccagcuuccaa

SEQ ID NO: 497244 - RNA, 22 nt, Human
ucugcuggccuuagcaggucua

SEQ ID NO: 497245 - RNA, 22 nt, Human
gggaguccaaauugguacaaua

SEQ ID NO: 497246 - RNA, 22 nt, Human
uauaauuaguaaauggcagauu

SEQ ID NO: 497247 - RNA, 22 nt, Human
agaagcaguuauuuuuugcaca

SEQ ID NO: 497248 - RNA, 22 nt, Human
acagcacuggucccgcaagccu

SEQ ID NO: 497249 - RNA, 22 nt, Human
cacaggccugucucuuucuaac

SEQ ID NO: 497250 - RNA, 22 nt, Human
gcacacagcuagauuaccauuc

SEQ ID NO: 497251 - RNA, 22 nt, Human
auuugaauggcuuaacacaacg

SEQ ID NO: 497252 - RNA, 22 nt, Human
ggaggguuagcaaaggcacaga

SEQ ID NO: 497253 - RNA, 22 nt, Human
aaacuagagcaugugaguggga

SEQ ID NO: 497254 - RNA, 22 nt, Human
uuucugcaacgagucuuugacu

SEQ ID NO: 497255 - RNA, 22 nt, Human
guccuggugccaccugcgggau

SEQ ID NO: 497256 - RNA, 22 nt, Human
caaugugguggcagaugucagu

SEQ ID NO: 497257 - RNA, 22 nt, Human
cucucugguacauagaguuugg

SEQ ID NO: 497258 - RNA, 22 nt, Human
uuaguugauagccaaaauuuau

SEQ ID NO: 497259 - RNA, 22 nt, Human
gaucauuuacuuguucuggacu

SEQ ID NO: 497260 - RNA, 22 nt, Human
uuaaaaugcagauucugauuca

SEQ ID NO: 497261 - RNA, 22 nt, Human
ggaagggaaaauucauucggcu

SEQ ID NO: 497262 - RNA, 22 nt, Human
gccagagcagaauagaguggcc

SEQ ID NO: 497263 - RNA, 22 nt, Human
cagcaggcagccauuucacugu

SEQ ID NO: 497264 - RNA, 22 nt, Human
guccucugaaagaugaaccaug

SEQ ID NO: 497265 - RNA, 21 nt, Human
aggaaguggccagauugggaa

SEQ ID NO: 497266 - RNA, 22 nt, Human
cuugcugggguaagucugugcu

SEQ ID NO: 497267 - RNA, 22 nt, Human
uaggccaguggcagguugugug

SEQ ID NO: 497268 - RNA, 22 nt, Human
gcacagaauaacacucugggcu

SEQ ID NO: 497269 - RNA, 23 nt, Human
uccaagggcuacaaacacagacc

SEQ ID NO: 497270 - RNA, 22 nt, Human
cccuuagcucaauuucuugccc

SEQ ID NO: 497271 - RNA, 22 nt, Human
aggcuuuguaccuggggucuua

SEQ ID NO: 497272 - RNA, 22 nt, Human
caaggccuucgucuccuagcuu

SEQ ID NO: 497273 - RNA, 20 nt, Human
ugaaggccagcagcauaggg

SEQ ID NO: 497274 - RNA, 22 nt, Human
ggcagcucugaugaugcucugg

SEQ ID NO: 497275 - RNA, 22 nt, Human
uuagcauuucuggaaucacaag

SEQ ID NO: 497276 - RNA, 22 nt, Human
uuccugggagcuagccacaucu

SEQ ID NO: 497277 - RNA, 22 nt, Human
ccaggagcuggagggugcagug

SEQ ID NO: 497278 - RNA, 22 nt, Human
ccucagagccuccagaaggaau

SEQ ID NO: 497279 - RNA, 22 nt, Human
uacaaugagcuguacaucucca

SEQ ID NO: 497280 - RNA, 22 nt, Human
aaaaugauauccugacuuuuau

SEQ ID NO: 497281 - RNA, 20 nt, Human
uccugguggauacugcuuaa

SEQ ID NO: 497282 - RNA, 22 nt, Human
aaaggccaagcaugagguggac

SEQ ID NO: 497283 - RNA, 22 nt, Human
gugacagaguuuuagaucucau

SEQ ID NO: 497284 - RNA, 20 nt, Human
uucuuucaucuacacguugu

SEQ ID NO: 497285 - RNA, 21 nt, Human
ugcagcugacacugguaugcc

SEQ ID NO: 497286 - RNA, 22 nt, Human
ugggcagagucauacaggagac

SEQ ID NO: 497287 - RNA, 22 nt, Human
uauucacaguugauuuacaguu

SEQ ID NO: 497288 - RNA, 22 nt, Human
ucugccuugagguccucagcuc

SEQ ID NO: 497289 - RNA, 22 nt, Human
agcuuugggcagaagaggauuc

SEQ ID NO: 497290 - RNA, 22 nt, Human
agcucccaauugacuugaacua

SEQ ID NO: 497291 - RNA, 22 nt, Human
ccucagaguaggucucagcugu

SEQ ID NO: 497292 - RNA, 22 nt, Human
ucacuggggcccacaucaacau

SEQ ID NO: 497293 - RNA, 22 nt, Human
ucagggcaggcgagcagcugcu

SEQ ID NO: 497294 - RNA, 23 nt, Human
ucuguguagccaggucuggaggg

SEQ ID NO: 497295 - RNA, 22 nt, Human
caaauguguaaggaaguguuag

SEQ ID NO: 497296 - RNA, 22 nt, Human
gaggggcagaaugugaucaggg

SEQ ID NO: 497297 - RNA, 22 nt, Human
ggcuucaccgcgggguugcagg

SEQ ID NO: 497298 - RNA, 22 nt, Human
ggcuguccuuggccaaggcacu

SEQ ID NO: 497299 - RNA, 22 nt, Human
cugguuuagcuguaagguuccc

SEQ ID NO: 497300 - RNA, 22 nt, Human
cauuugugugggaacccaucag

SEQ ID NO: 497301 - RNA, 22 nt, Human
aucauucagccuaagcaaguac

SEQ ID NO: 497302 - RNA, 22 nt, Human
uccaguggguugcugagggagg

SEQ ID NO: 497303 - RNA, 22 nt, Human
aaugucuauuugcuacaaagcc

SEQ ID NO: 497304 - RNA, 22 nt, Human
ucuguggccugccuccucauuu

SEQ ID NO: 497305 - RNA, 22 nt, Human
aauauguugagucuaucuuuau

SEQ ID NO: 497306 - RNA, 22 nt, Human
aagaaagagaucacuccuccau

SEQ ID NO: 497307 - RNA, 22 nt, Human
gaaaugcaaauucucucucgcu

SEQ ID NO: 497308 - RNA, 22 nt, Human
ugggaaggcagucacuguccua

SEQ ID NO: 497309 - RNA, 22 nt, Human
cagcaggaagguuuccccugca

SEQ ID NO: 497310 - RNA, 19 nt, Human
ccagcagcuuugauucucu

SEQ ID NO: 497311 - RNA, 22 nt, Human
ucuggccaggauggcaagacca

SEQ ID NO: 497312 - RNA, 22 nt, Human
cuggcuccuccaaggccuggag

SEQ ID NO: 497313 - RNA, 22 nt, Human
uccagggcuggguuggcucagc

SEQ ID NO: 497314 - RNA, 22 nt, Human
uuccucugaaauggcuuggaaa

SEQ ID NO: 497315 - RNA, 22 nt, Human
uuauguaccugaauuaguaaag

SEQ ID NO: 497316 - RNA, 17 nt, Human
cucacggaggaugaauc

SEQ ID NO: 497317 - RNA, 22 nt, Human
uguguuuauaguguaucuucca

SEQ ID NO: 497318 - RNA, 22 nt, Human
agguaaagacugcaaggagaau

SEQ ID NO: 497319 - RNA, 19 nt, Human
ucugaagaauuagagagca

SEQ ID NO: 497320 - RNA, 21 nt, Human
acuguucauuugaugaacugg

SEQ ID NO: 497321 - RNA, 22 nt, Human
aagaaauggcuucaucugagua

SEQ ID NO: 497322 - RNA, 22 nt, Human
gcugucagcgcccaaggagcuc

SEQ ID NO: 497323 - RNA, 22 nt, Human
agggccagcacuccuggcagga

SEQ ID NO: 497324 - RNA, 22 nt, Human
aguccuggccccaaggaaggau

SEQ ID NO: 497325 - RNA, 22 nt, Human
ucaguuuuucuauacuuuguag

SEQ ID NO: 497326 - RNA, 22 nt, Human
uaaaucccuacaucuguguuuu

SEQ ID NO: 497327 - RNA, 22 nt, Human
ggccucugaggacagccuuggc

SEQ ID NO: 497328 - RNA, 22 nt, Human
gcugccaguguggcaugaugca

SEQ ID NO: 497329 - RNA, 22 nt, Human
uguacaaugccgagacuaacuc

SEQ ID NO: 497330 - RNA, 22 nt, Human
auauggaacuauucuguguaga

SEQ ID NO: 497331 - RNA, 22 nt, Human
cacugcuuauaaauucuaggca

SEQ ID NO: 497332 - RNA, 22 nt, Human
ggucucagcccucgccagcagc

SEQ ID NO: 497333 - RNA, 22 nt, Human
aggcucugccaauuccuuccuc

SEQ ID NO: 497334 - RNA, 22 nt, Human
uguguuuugaacucaucuacug

SEQ ID NO: 497335 - RNA, 22 nt, Human
ucucuuaauuuuggaauagugu

SEQ ID NO: 497336 - RNA, 22 nt, Human
aguuauuucaguaacauaauag

SEQ ID NO: 497337 - RNA, 22 nt, Human
uagcaauguguguguauaaauu

SEQ ID NO: 497338 - RNA, 21 nt, Human
agguuccagcagccagagaau

SEQ ID NO: 497339 - RNA, 22 nt, Human
ucccagagugugggcaucaagg

SEQ ID NO: 497340 - RNA, 22 nt, Human
ccugcccuucuuuccccagcau

SEQ ID NO: 497341 - RNA, 20 nt, Human
aucaaaauccuauugagguu

SEQ ID NO: 497342 - RNA, 22 nt, Human
gaggccugaggcugccuggagc

SEQ ID NO: 497343 - RNA, 22 nt, Human
ucugggcccacucaacuucacu

SEQ ID NO: 497344 - RNA, 22 nt, Human
cagaggcaaaagagguggaggu

SEQ ID NO: 497345 - RNA, 22 nt, Human
ugcuuuauuuuaaauaugccau

SEQ ID NO: 497346 - RNA, 22 nt, Human
ugggcacuggaagccugcugug

SEQ ID NO: 497347 - RNA, 22 nt, Human
uuucuguaaguggcaaauaaug

SEQ ID NO: 497348 - RNA, 22 nt, Human
aggucuagauuuauagacagca

SEQ ID NO: 497349 - RNA, 22 nt, Human
acagauuuguucuuuugggcua

SEQ ID NO: 497350 - RNA, 22 nt, Human
aagccaagaguuaacuauuugu

SEQ ID NO: 497351 - RNA, 22 nt, Human
gaaucauuggaaccacauccaa

SEQ ID NO: 497352 - RNA, 22 nt, Human
aagugauuucugccugcauguu

SEQ ID NO: 497353 - RNA, 22 nt, Human
caguuucuguggucucuuuuca

SEQ ID NO: 497354 - RNA, 22 nt, Human
ccugacucuggccaggccagcu

SEQ ID NO: 497355 - RNA, 18 nt, Human
aguccuggagaucaccaa

SEQ ID NO: 497356 - RNA, 22 nt, Human
auuuuuccugcuggaucugcuc

SEQ ID NO: 497357 - RNA, 22 nt, Human
ugugaaagcaagucuaguucuc

SEQ ID NO: 497358 - RNA, 22 nt, Human
gggcagagaaauggacaguugg

SEQ ID NO: 497359 - RNA, 22 nt, Human
cacauggggcgcugcauuggcc

SEQ ID NO: 497360 - RNA, 22 nt, Human
aagagaugcuuuacaucggaug

SEQ ID NO: 497361 - RNA, 22 nt, Human
cagggugacaaguggcaaggag

SEQ ID NO: 497362 - RNA, 22 nt, Human
cuuauuagugucugucugaguu

SEQ ID NO: 497363 - RNA, 22 nt, Human
guggcuuggaccagucacagug

SEQ ID NO: 497364 - RNA, 22 nt, Human
gcacagagggcagugagccucu

SEQ ID NO: 497365 - RNA, 22 nt, Human
gcagagugggagcccagggcug

SEQ ID NO: 497366 - RNA, 22 nt, Human
aaaugucuaucuggcauauucc

SEQ ID NO: 497367 - RNA, 22 nt, Human
gcagcagaugcuuucauggaca

SEQ ID NO: 497368 - RNA, 22 nt, Human
cacaaaggagaaugucagcaua

SEQ ID NO: 497369 - RNA, 22 nt, Human
cuggcucccucucccugaguca

SEQ ID NO: 497370 - RNA, 22 nt, Human
uugcauuuugguuguaaauaug

SEQ ID NO: 497371 - RNA, 22 nt, Human
gccagcugguaggcaccuagcc

SEQ ID NO: 497372 - RNA, 22 nt, Human
cucagaaguucagccuagagua

SEQ ID NO: 497373 - RNA, 22 nt, Human
aacagcaugcuggguaacauug

SEQ ID NO: 497374 - RNA, 22 nt, Human
uucuccuugaaaagcugcaucu

SEQ ID NO: 497375 - RNA, 22 nt, Human
agcuccuguucugagagcagga

SEQ ID NO: 497376 - RNA, 22 nt, Human
gcagcagcucaguucugggagg

SEQ ID NO: 497377 - RNA, 22 nt, Human
uguggaaaagaauaagggagau

SEQ ID NO: 497378 - RNA, 19 nt, Human
aauuagggagucgguuaag

SEQ ID NO: 497379 - RNA, 22 nt, Human
aaagacaguggauucaaaaucc

SEQ ID NO: 497380 - RNA, 21 nt, Human
ucucugguuggaguugugcca

SEQ ID NO: 497381 - RNA, 22 nt, Human
gugucauguagaaauugaugaa

SEQ ID NO: 497382 - RNA, 22 nt, Human
ucuguucaucaucuggacacau

SEQ ID NO: 497383 - RNA, 22 nt, Human
uggcagagcccagaacugagca

SEQ ID NO: 497384 - RNA, 22 nt, Human
agacaaguucugugggucaccu

SEQ ID NO: 497385 - RNA, 22 nt, Human
guuuccuguggccacagaauaa

SEQ ID NO: 497386 - RNA, 22 nt, Human
ucauccaggaaaagauuuggaa

SEQ ID NO: 497387 - RNA, 22 nt, Human
cagucagucaauacucuuugag

SEQ ID NO: 497388 - RNA, 22 nt, Human
uuccugugugaccgagacagug

SEQ ID NO: 497389 - RNA, 22 nt, Human
ucuguucuauuggucuaugugu

SEQ ID NO: 497390 - RNA, 22 nt, Human
accuggcacuacaggcaccugu

SEQ ID NO: 497391 - RNA, 22 nt, Human
uccagucaagcuugagaauuuc

SEQ ID NO: 497392 - RNA, 18 nt, Human
uggaucuuuaugaggcug

SEQ ID NO: 497393 - RNA, 22 nt, Human
guugacagaaaaauaacauagc

SEQ ID NO: 497394 - RNA, 22 nt, Human
ccugagcugaacuaagcaguuu

SEQ ID NO: 497395 - RNA, 22 nt, Human
ugcuggccggccaggugcugag

SEQ ID NO: 497396 - RNA, 22 nt, Human
ggcugcggaucuaaggcuggga

SEQ ID NO: 497397 - RNA, 22 nt, Human
augaggagucaaggagucggag

SEQ ID NO: 497398 - RNA, 22 nt, Human
aggcccagcugggccaggaaca

SEQ ID NO: 497399 - RNA, 22 nt, Human
ucugucugacaggguaugaacu

SEQ ID NO: 497400 - RNA, 22 nt, Human
uccuggcuuagguuuccagaac

SEQ ID NO: 497401 - RNA, 22 nt, Human
uaaaugagauuuguucuuuugu

SEQ ID NO: 497402 - RNA, 22 nt, Human
gccucugccaagggggcugcgg

SEQ ID NO: 497403 - RNA, 22 nt, Human
agcaggcaggcccagcggcugg

SEQ ID NO: 497404 - RNA, 22 nt, Human
ggagaagaggagcuggaagccu

SEQ ID NO: 497405 - RNA, 22 nt, Human
uuauuagguuuacauaaagguu

SEQ ID NO: 497406 - RNA, 22 nt, Human
cauuuacacuucuaaccacaag

SEQ ID NO: 497407 - RNA, 22 nt, Human
gcagcccaauggacugagacag

SEQ ID NO: 497408 - RNA, 22 nt, Human
caaagguauaaguuaauauaca

SEQ ID NO: 497409 - RNA, 17 nt, Human
agugaaauuuacauugc

SEQ ID NO: 497410 - RNA, 22 nt, Human
uaugaguacaaggacucugucu

SEQ ID NO: 497411 - RNA, 19 nt, Human
ggcugcugguuacagaggc

SEQ ID NO: 497412 - RNA, 22 nt, Human
acauuuuuauucaucaaagcag

SEQ ID NO: 497413 - RNA, 22 nt, Human
gaaagcaaguugacugcagaau

SEQ ID NO: 497414 - RNA, 19 nt, Human
aggaauggaauuaauucug

SEQ ID NO: 497415 - RNA, 22 nt, Human
gucaggauguuuauucuccagu

SEQ ID NO: 497416 - RNA, 19 nt, Human
uuucaggagcuaugcaggg

SEQ ID NO: 497417 - RNA, 22 nt, Human
aauuaguauugcgauucauuag

SEQ ID NO: 497418 - RNA, 22 nt, Human
agcugcuguccuaggcacugua

SEQ ID NO: 497419 - RNA, 22 nt, Human
aaaugcauuuuuaauuagaccc

SEQ ID NO: 497420 - RNA, 22 nt, Human
ggucccaggaagugcggcggcg

SEQ ID NO: 497421 - RNA, 19 nt, Human
gcuggccacgccccaguug

SEQ ID NO: 497422 - RNA, 22 nt, Human
uguuucuguaugaucaauauug

SEQ ID NO: 497423 - RNA, 22 nt, Human
ucagaacaguucuuaauauugc

SEQ ID NO: 497424 - RNA, 22 nt, Human
agggcgggcucaucacaugcuc

SEQ ID NO: 497425 - RNA, 18 nt, Human
ggcagggaaaagauaggg

SEQ ID NO: 497426 - RNA, 22 nt, Human
aggcaguuguugcugagcagcu

SEQ ID NO: 497427 - RNA, 22 nt, Human
agguuuaugccuuggagcuggg

SEQ ID NO: 497428 - RNA, 22 nt, Human
uagacacaucuucauccacaau

SEQ ID NO: 497429 - RNA, 22 nt, Human
aauuuagaauucgcuagcuaau

SEQ ID NO: 497430 - RNA, 22 nt, Human
ucuuacaagaaauaagccaaug

SEQ ID NO: 497431 - RNA, 22 nt, Human
gaggaaccacucugagaagcca

SEQ ID NO: 497432 - RNA, 22 nt, Human
agagaagggccuguauguaauc

SEQ ID NO: 497433 - RNA, 22 nt, Human
ggaaacuuguuauuguauuuuc

SEQ ID NO: 497434 - RNA, 22 nt, Human
cagcccaaagccccaggcuaga

SEQ ID NO: 497435 - RNA, 22 nt, Human
ugccuggcacagagcagguggc

SEQ ID NO: 497436 - RNA, 22 nt, Human
uaggagcuaaaauauuuuauau

SEQ ID NO: 497437 - RNA, 22 nt, Human
acucaggaaaugagaggcucuc

SEQ ID NO: 497438 - RNA, 22 nt, Human
uuauacaguuuauacuuagaau

SEQ ID NO: 497439 - RNA, 22 nt, Human
cuaggaaucaccaagauucuag

SEQ ID NO: 497440 - RNA, 22 nt, Human
uccaguucuaggucacucucug

SEQ ID NO: 497441 - RNA, 22 nt, Human
agcagcucacaggauuccugaa

SEQ ID NO: 497442 - RNA, 22 nt, Human
agccuucagcaguucaggugcc

SEQ ID NO: 497443 - RNA, 22 nt, Human
agggagagguugaaaccucagu

SEQ ID NO: 497444 - RNA, 22 nt, Human
agguuucuuuaugcugcuagaa

SEQ ID NO: 497445 - RNA, 22 nt, Human
ucugcuguaaagaauuucugcc

SEQ ID NO: 497446 - RNA, 22 nt, Human
gggaugaauugagucagaaggg

SEQ ID NO: 497447 - RNA, 22 nt, Human
auuaauuuuucugacagccaca

SEQ ID NO: 497448 - RNA, 19 nt, Human
ucagugugugggagguggu

SEQ ID NO: 497449 - RNA, 22 nt, Human
uaucauuuuacugugacauuuu

SEQ ID NO: 497450 - RNA, 21 nt, Human
gggagcuggaaacugggugac

SEQ ID NO: 497451 - RNA, 22 nt, Human
uccugggacuuucaaggcuagg

SEQ ID NO: 497452 - RNA, 22 nt, Human
caaagcaggaagaauauugaaa

SEQ ID NO: 497453 - RNA, 22 nt, Human
auaugcauuuaccuggcauaua

SEQ ID NO: 497454 - RNA, 21 nt, Human
agagagaaggccauauggucc

SEQ ID NO: 497455 - RNA, 23 nt, Human
aaaguguagccagguuaagaacc

SEQ ID NO: 497456 - RNA, 20 nt, Human
aguaccuuuuguauguuacc

SEQ ID NO: 497457 - RNA, 22 nt, Human
uaacagaaaggcucaggugcuc

SEQ ID NO: 497458 - RNA, 22 nt, Human
cccagaggugaaggagguggga

SEQ ID NO: 497459 - RNA, 22 nt, Human
uggcucaguuuagcagcucagu

SEQ ID NO: 497460 - RNA, 22 nt, Human
aaaggccaccaacaugaagcau

SEQ ID NO: 497461 - RNA, 22 nt, Human
gugugcaggccacaggccaggg

SEQ ID NO: 497462 - RNA, 22 nt, Human
agggaggaguccucaaagucau

SEQ ID NO: 497463 - RNA, 22 nt, Human
auucaagguauuuaaaacauaa

SEQ ID NO: 497464 - RNA, 22 nt, Human
ucucugggguagggcccaggac

SEQ ID NO: 497465 - RNA, 22 nt, Human
cagcccugggaguuggggccga

SEQ ID NO: 497466 - RNA, 22 nt, Human
ugggggucaggaugaggccuug

SEQ ID NO: 497467 - RNA, 22 nt, Human
caguggugaagagcaggggcuc

SEQ ID NO: 497468 - RNA, 21 nt, Human
uccuggccagggcacuaggca

SEQ ID NO: 497469 - RNA, 22 nt, Human
cagcuuuaguaacccacugcuc

SEQ ID NO: 497470 - RNA, 22 nt, Human
gcagggagguuugcugaccugg

SEQ ID NO: 497471 - RNA, 22 nt, Human
agcagcugaucaaagcacuuau

SEQ ID NO: 497472 - RNA, 22 nt, Human
guuuuuccugcugacuuggguc

SEQ ID NO: 497473 - RNA, 22 nt, Human
agaggcucuaauccccuccaca

SEQ ID NO: 497474 - RNA, 22 nt, Human
auauauuuacucuccuguugca

SEQ ID NO: 497475 - RNA, 22 nt, Human
ggaagagagaucccauagaugu

SEQ ID NO: 497476 - RNA, 22 nt, Human
acagccagugacugcagacccu

SEQ ID NO: 497477 - RNA, 22 nt, Human
aaaucuuucccuuuacuaucca

SEQ ID NO: 497478 - RNA, 22 nt, Human
ugggagcagcagggagaugcgg

SEQ ID NO: 497479 - RNA, 22 nt, Human
caggauggucucgaucuccuga

SEQ ID NO: 497480 - RNA, 17 nt, Human
ggcuuccagguggcucu

SEQ ID NO: 497481 - RNA, 22 nt, Human
uacauucuauaucuguuacauc

SEQ ID NO: 497482 - RNA, 22 nt, Human
auuguaaguagaaauguuaugg

SEQ ID NO: 497483 - RNA, 22 nt, Human
aaaacaguuuuugcuaacugcu

SEQ ID NO: 497484 - RNA, 22 nt, Human
agaauauucaucuguauucuua

SEQ ID NO: 497485 - RNA, 22 nt, Human
gcaggguauaauacuuagguga

SEQ ID NO: 497486 - RNA, 23 nt, Human
aggcccugccugucccucuuuuu

SEQ ID NO: 497487 - RNA, 22 nt, Human
cccaggacucuucacugcagcc

SEQ ID NO: 497488 - RNA, 22 nt, Human
caagaacaguuugccaaauugg

SEQ ID NO: 497489 - RNA, 17 nt, Human
ggcugcugugcuggugc

SEQ ID NO: 497490 - RNA, 22 nt, Human
acucaagauagggaaaguacaa

SEQ ID NO: 497491 - RNA, 22 nt, Human
cacagcuucuccccgcugcggc

SEQ ID NO: 497492 - RNA, 22 nt, Human
auacaucuaugccuuucugaca

SEQ ID NO: 497493 - RNA, 21 nt, Human
ccuguucacagaucuguaacu

SEQ ID NO: 497494 - RNA, 22 nt, Human
auucuccagcucacuguccaua

SEQ ID NO: 497495 - RNA, 22 nt, Human
ccagguggugaaagugggcccu

SEQ ID NO: 497496 - RNA, 21 nt, Human
ucaggaaacaccucuuaagga

SEQ ID NO: 497497 - RNA, 22 nt, Human
ugcagggauuauguagggguug

SEQ ID NO: 497498 - RNA, 21 nt, Human
cagcuucugaagguguaggaa

SEQ ID NO: 497499 - RNA, 19 nt, Human
cacugugguccuucacugc

SEQ ID NO: 497500 - RNA, 22 nt, Human
uggcuaggaauccaugacucuc

SEQ ID NO: 497501 - RNA, 22 nt, Human
uguagcauuuuauguaauaagu

SEQ ID NO: 497502 - RNA, 22 nt, Human
gcugggcuucucaaugcugccu

SEQ ID NO: 497503 - RNA, 22 nt, Human
aagaggagacuucagcaacuug

SEQ ID NO: 497504 - RNA, 21 nt, Human
cagaggccucaugcucugugc

SEQ ID NO: 497505 - RNA, 22 nt, Human
ccaggcugcucacaagcugccc

SEQ ID NO: 497506 - RNA, 22 nt, Human
ccucugcugcuguugagcaccg

SEQ ID NO: 497507 - RNA, 22 nt, Human
cuccaggagcugugucuuucuu

SEQ ID NO: 497508 - RNA, 22 nt, Human
uccaagucuuccuucccaaacc

SEQ ID NO: 497509 - RNA, 22 nt, Human
ugguccugcccacgcccaucug

SEQ ID NO: 497510 - RNA, 22 nt, Human
cagagggcacaugguuuccuca

SEQ ID NO: 497511 - RNA, 22 nt, Human
uagaaaucagguuuuuagaaag

SEQ ID NO: 497512 - RNA, 23 nt, Human
acacugucucauggauagacugc

SEQ ID NO: 497513 - RNA, 22 nt, Human
uuccaagucacccuuaggguca

SEQ ID NO: 497514 - RNA, 22 nt, Human
cugggcucaccuguggcuggca

SEQ ID NO: 497515 - RNA, 22 nt, Human
aucagugcuaaagcaaaugccc

SEQ ID NO: 497516 - RNA, 22 nt, Human
gaggggcucuugggcaugaagg

SEQ ID NO: 497517 - RNA, 22 nt, Human
uguaaucauuacaguacaugga

SEQ ID NO: 497518 - RNA, 22 nt, Human
ggcuggcacugaggagagcucu

SEQ ID NO: 497519 - RNA, 22 nt, Human
acaugauucuugauaggcauug

SEQ ID NO: 497520 - RNA, 22 nt, Human
gcagggccuuagcagcggcugc

SEQ ID NO: 497521 - RNA, 19 nt, Human
cugggagguguucagagaa

SEQ ID NO: 497522 - RNA, 22 nt, Human
cauguaaaacacucagaacagu

SEQ ID NO: 497523 - RNA, 22 nt, Human
ggcaguucucagccaaggcaau

SEQ ID NO: 497524 - RNA, 22 nt, Human
ugauauuuuucacuggccucug

SEQ ID NO: 497525 - RNA, 23 nt, Human
uucugggcuguggaagccucggg

SEQ ID NO: 497526 - RNA, 22 nt, Human
agcuggcuaugcccugugaacc

SEQ ID NO: 497527 - RNA, 22 nt, Human
ugggggcuccaggcuccaggga

SEQ ID NO: 497528 - RNA, 22 nt, Human
cugggcacuuuggggagccuac

SEQ ID NO: 497529 - RNA, 22 nt, Human
ggcacagcaggagcuaugugaa

SEQ ID NO: 497530 - RNA, 22 nt, Human
cuaauuuaaugaaugagucuua

SEQ ID NO: 497531 - RNA, 22 nt, Human
caguaagucaacaaacaugggg

SEQ ID NO: 497532 - RNA, 22 nt, Human
ucugagccccuagaacugagcg

SEQ ID NO: 497533 - RNA, 17 nt, Human
cccguucucuucgcugg

SEQ ID NO: 497534 - RNA, 22 nt, Human
agcaggcauagaguagcacuca

SEQ ID NO: 497535 - RNA, 22 nt, Human
uauuagcuuuagccuuuggaug

SEQ ID NO: 497536 - RNA, 22 nt, Human
cacccaggcuggagugcagggg

SEQ ID NO: 497537 - RNA, 22 nt, Human
aggugcuuggcucgugcacaca

SEQ ID NO: 497538 - RNA, 22 nt, Human
cugaaugauaaucuuuugcugg

SEQ ID NO: 497539 - RNA, 21 nt, Human
caugaagccgguucccuguuu

SEQ ID NO: 497540 - RNA, 22 nt, Human
aaguauucauaaggacauaugu

SEQ ID NO: 497541 - RNA, 22 nt, Human
aagggaaaucauauggugcagu

SEQ ID NO: 497542 - RNA, 22 nt, Human
agacagcaugauacaugaugcu

SEQ ID NO: 497543 - RNA, 22 nt, Human
gagcuucagaauuuaacagacu

SEQ ID NO: 497544 - RNA, 22 nt, Human
ucugucacugagcucaggauuc

SEQ ID NO: 497545 - RNA, 22 nt, Human
gcucccagggaccgcagggcag

SEQ ID NO: 497546 - RNA, 22 nt, Human
augcagaaugaguucacgaucu

SEQ ID NO: 497547 - RNA, 22 nt, Human
cagcuggcagaaccugcaucca

SEQ ID NO: 497548 - RNA, 22 nt, Human
cuguacaucucugaggacagua

SEQ ID NO: 497549 - RNA, 22 nt, Human
ugucugcuacuugguucuacca

SEQ ID NO: 497550 - RNA, 20 nt, Human
ugccuggccuuucucugccc

SEQ ID NO: 497551 - RNA, 22 nt, Human
cauugcacuccagcuugggcaa

SEQ ID NO: 497552 - RNA, 22 nt, Human
agauuacagcaugggaauggga

SEQ ID NO: 497553 - RNA, 22 nt, Human
gguucucuaacuuugacuggag

SEQ ID NO: 497554 - RNA, 22 nt, Human
gcagaaggucaaagcaagaugu

SEQ ID NO: 497555 - RNA, 22 nt, Human
gggaaauugugugagaucuuug

SEQ ID NO: 497556 - RNA, 21 nt, Human
ccagaggccucucuuggccac

SEQ ID NO: 497557 - RNA, 22 nt, Human
ggucugagcuugagcccaugcu

SEQ ID NO: 497558 - RNA, 22 nt, Human
augggcugcuuggcuuccaccc

SEQ ID NO: 497559 - RNA, 22 nt, Human
aaaucaguaaauguucauuaac

SEQ ID NO: 497560 - RNA, 22 nt, Human
ucugaaugcacuuaguuaccaa

SEQ ID NO: 497561 - RNA, 22 nt, Human
ucugggcuuuguaaugggaggu

SEQ ID NO: 497562 - RNA, 22 nt, Human
ugccucugguuaucugguaccu

SEQ ID NO: 497563 - RNA, 22 nt, Human
caaauagaacucacagacaaga

SEQ ID NO: 497564 - RNA, 22 nt, Human
ggaaguagaaguaaugaaauca

SEQ ID NO: 497565 - RNA, 22 nt, Human
cuacauucaacagcagaguuuu

SEQ ID NO: 497566 - RNA, 22 nt, Human
ccagcuccauugcuuaguguaa

SEQ ID NO: 497567 - RNA, 22 nt, Human
uaggcacaagaccaugcaaagg

SEQ ID NO: 497568 - RNA, 22 nt, Human
ucacauuuguuccucugcacuu

SEQ ID NO: 497569 - RNA, 22 nt, Human
auggcagacgaggcagcagggg

SEQ ID NO: 497570 - RNA, 22 nt, Human
ugguccagacauuucugaggua

SEQ ID NO: 497571 - RNA, 22 nt, Human
guuacacaggaaaacauuagca

SEQ ID NO: 497572 - RNA, 22 nt, Human
uagaagauucuaaaguggagag

SEQ ID NO: 497573 - RNA, 22 nt, Human
uggcagucggacuucuaucuca

SEQ ID NO: 497574 - RNA, 22 nt, Human
uggagcagagaugggagcccaa

SEQ ID NO: 497575 - RNA, 22 nt, Human
uagcuuuaagacauggugaaug

SEQ ID NO: 497576 - RNA, 21 nt, Human
uucuuuccccagaggacuaaa

SEQ ID NO: 497577 - RNA, 22 nt, Human
cagucccagaagagccugggag

SEQ ID NO: 497578 - RNA, 22 nt, Human
cccugggcagucugcacuucag

SEQ ID NO: 497579 - RNA, 22 nt, Human
uuguaugaucaaaagaaaugua

SEQ ID NO: 497580 - RNA, 22 nt, Human
gagguccauacagcuauucuac

SEQ ID NO: 497581 - RNA, 22 nt, Human
ugggaccugcuccuggaaugag

SEQ ID NO: 497582 - RNA, 22 nt, Human
uuauuuuguagcucugaucuuu

SEQ ID NO: 497583 - RNA, 21 nt, Human
uccucugcagugagguggccu

SEQ ID NO: 497584 - RNA, 20 nt, Human
acuuaguguaggguuccuag

SEQ ID NO: 497585 - RNA, 22 nt, Human
ugcuucuguauuuugggcuuga

SEQ ID NO: 497586 - RNA, 20 nt, Human
cugcugugugugccucagcc

SEQ ID NO: 497587 - RNA, 22 nt, Human
uuaauuaauuaguuaagcaugu

SEQ ID NO: 497588 - RNA, 19 nt, Human
ccagguggaacugagguag

SEQ ID NO: 497589 - RNA, 22 nt, Human
gagauguuuugcugagaauggg

SEQ ID NO: 497590 - RNA, 22 nt, Human
ugaaaaugcacgcuggaaagca

SEQ ID NO: 497591 - RNA, 22 nt, Human
uuaggaaguguguccagaagcg

SEQ ID NO: 497592 - RNA, 22 nt, Human
ccuucugcucccuggccagggc

SEQ ID NO: 497593 - RNA, 22 nt, Human
cuuguucaguccugacuuccug

SEQ ID NO: 497594 - RNA, 22 nt, Human
auuucuucagguucuucuagga

SEQ ID NO: 497595 - RNA, 22 nt, Human
gagguccaacacaauggguguu

SEQ ID NO: 497596 - RNA, 22 nt, Human
gcucacugcaaccucugcuucc

SEQ ID NO: 497597 - RNA, 22 nt, Human
auaaucuuguauuuccuaaagu

SEQ ID NO: 497598 - RNA, 22 nt, Human
ugcuuccagcucucuguaaggu

SEQ ID NO: 497599 - RNA, 22 nt, Human
auguuucugaguguauauacau

SEQ ID NO: 497600 - RNA, 22 nt, Human
aaaaggauguuuucaugaaaca

SEQ ID NO: 497601 - RNA, 22 nt, Human
gcuucagcccaucccaguacau

SEQ ID NO: 497602 - RNA, 23 nt, Human
ggguccagccaauuccaaggaaa

SEQ ID NO: 497603 - RNA, 22 nt, Human
aagauuuaccacuuuauucaag

SEQ ID NO: 497604 - RNA, 22 nt, Human
gcuuccuagaucugugguacuc

SEQ ID NO: 497605 - RNA, 22 nt, Human
ucuuucaaugugaaaccaugua

SEQ ID NO: 497606 - RNA, 22 nt, Human
gcuuccuucuaccacaucaugc

SEQ ID NO: 497607 - RNA, 22 nt, Human
ugugugacccccagugaagccu

SEQ ID NO: 497608 - RNA, 22 nt, Human
cccucucugcugcauagaggaa

SEQ ID NO: 497609 - RNA, 22 nt, Human
ggucuggccucgggcaccccca

SEQ ID NO: 497610 - RNA, 22 nt, Human
cagggcaaagucuucuagaacc

SEQ ID NO: 497611 - RNA, 22 nt, Human
gugcaguggcagauccuagcuc

SEQ ID NO: 497612 - RNA, 22 nt, Human
gguggccuuucaguggaucagg

SEQ ID NO: 497613 - RNA, 22 nt, Human
caguguacuuggaauguaacag

SEQ ID NO: 497614 - RNA, 17 nt, Human
aagacagaagccaugag

SEQ ID NO: 497615 - RNA, 22 nt, Human
acugcuuuucuaagauucugug

SEQ ID NO: 497616 - RNA, 22 nt, Human
gccagccugugggggcucugug

SEQ ID NO: 497617 - RNA, 22 nt, Human
agcaggugacccaagcaggcug

SEQ ID NO: 497618 - RNA, 22 nt, Human
aucagcaaguccuguuaauucu

SEQ ID NO: 497619 - RNA, 22 nt, Human
uggagucaucuuaaucuaggca

SEQ ID NO: 497620 - RNA, 21 nt, Human
gcccagcaaggugagaaggcc

SEQ ID NO: 497621 - RNA, 22 nt, Human
ggagucaucucagcugagaggc

SEQ ID NO: 497622 - RNA, 22 nt, Human
cagucccaggguugguucagcu

SEQ ID NO: 497623 - RNA, 22 nt, Human
gugcgccagcucaaggggaggc

SEQ ID NO: 497624 - RNA, 22 nt, Human
agcuucuugggcuuuacacaaa

SEQ ID NO: 497625 - RNA, 22 nt, Human
uuuuuccuuagggguuacucac

SEQ ID NO: 497626 - RNA, 22 nt, Human
ucaaaugcacguagagaaaaua

SEQ ID NO: 497627 - RNA, 22 nt, Human
ucauagaaauaucacgucuuuu

SEQ ID NO: 497628 - RNA, 22 nt, Human
cugccuccugccgugcagcuuc

SEQ ID NO: 497629 - RNA, 20 nt, Human
caggaggcaaggucaagguc

SEQ ID NO: 497630 - RNA, 20 nt, Human
accccacagaguccauugca

SEQ ID NO: 497631 - RNA, 22 nt, Human
ccagcuuuuggggugacaauuu

SEQ ID NO: 497632 - RNA, 22 nt, Human
cuauuuaucuauuucugaauga

SEQ ID NO: 497633 - RNA, 18 nt, Human
ccugccagucuggagcag

SEQ ID NO: 497634 - RNA, 22 nt, Human
uucaguguauauuuuuugagua

SEQ ID NO: 497635 - RNA, 22 nt, Human
acuguucauuuguccuguaucu

SEQ ID NO: 497636 - RNA, 18 nt, Human
augcccuguugacuucag

SEQ ID NO: 497637 - RNA, 22 nt, Human
aguucucagcuuaguaugcugu

SEQ ID NO: 497638 - RNA, 22 nt, Human
ugaagccauaggacagaggaua

SEQ ID NO: 497639 - RNA, 22 nt, Human
uaagaacauaaauucauacggg

SEQ ID NO: 497640 - RNA, 22 nt, Human
ggaagggguuaggggucccuga

SEQ ID NO: 497641 - RNA, 22 nt, Human
uguucuugagccuuuagaccua

SEQ ID NO: 497642 - RNA, 22 nt, Human
cagcucugugcaggccugggga

SEQ ID NO: 497643 - RNA, 22 nt, Human
uguaugaagguuuaccugcugu

SEQ ID NO: 497644 - RNA, 22 nt, Human
guggcucuguaaaaugccugca

SEQ ID NO: 497645 - RNA, 22 nt, Human
cagugcagacguggagggggca

SEQ ID NO: 497646 - RNA, 22 nt, Human
ggagaagggaacugaguuuuug

SEQ ID NO: 497647 - RNA, 22 nt, Human
cacaggggcaaacuguagggga

SEQ ID NO: 497648 - RNA, 21 nt, Human
aacacauccagaguauuugac

SEQ ID NO: 497649 - RNA, 22 nt, Human
agugcagaggcugggaaaugcu

SEQ ID NO: 497650 - RNA, 20 nt, Human
ucaucagauagguuaguaca

SEQ ID NO: 497651 - RNA, 22 nt, Human
uuuacagugagagcuuagugag

SEQ ID NO: 497652 - RNA, 22 nt, Human
uuuuauaagcaagaaagggaaa

SEQ ID NO: 497653 - RNA, 22 nt, Human
aaaggaagaugccaggacucug

SEQ ID NO: 497654 - RNA, 20 nt, Human
uuucacaucugucccuuuaa

SEQ ID NO: 497655 - RNA, 22 nt, Human
acauuguauaaugauuaucaca

SEQ ID NO: 497656 - RNA, 22 nt, Human
cccagcagccagaaugaggagc

SEQ ID NO: 497657 - RNA, 22 nt, Human
ugcagcauucuuggccacuacu

SEQ ID NO: 497658 - RNA, 22 nt, Human
agaguccacccuggggucaggc

SEQ ID NO: 497659 - RNA, 22 nt, Human
acacaucagaaauaugaaugag

SEQ ID NO: 497660 - RNA, 22 nt, Human
ggcagaagaaaggcuaagucuc

SEQ ID NO: 497661 - RNA, 22 nt, Human
agagcugagaauguggcuuccu

SEQ ID NO: 497662 - RNA, 22 nt, Human
cagagcaucgcgcagagagccu

SEQ ID NO: 497663 - RNA, 22 nt, Human
uaaaaaucuuaugaauggcaag

SEQ ID NO: 497664 - RNA, 22 nt, Human
uggguccuugcuaacuucuaug

SEQ ID NO: 497665 - RNA, 22 nt, Human
ggaaggggugucgcccauggau

SEQ ID NO: 497666 - RNA, 22 nt, Human
agccaccuucuccaaggccuag

SEQ ID NO: 497667 - RNA, 22 nt, Human
gucaggggccaugggccaagga

SEQ ID NO: 497668 - RNA, 22 nt, Human
uuuccuugcacauugguuucca

SEQ ID NO: 497669 - RNA, 22 nt, Human
aguguugucaaacggcucagca

SEQ ID NO: 497670 - RNA, 22 nt, Human
augcccugcaucaagugacacu

SEQ ID NO: 497671 - RNA, 22 nt, Human
uuacuuucaaaaacuacguggg

SEQ ID NO: 497672 - RNA, 19 nt, Human
gcagagugggguggagggu

SEQ ID NO: 497673 - RNA, 22 nt, Human
aggcuccaugcaaaggcuguuu

SEQ ID NO: 497674 - RNA, 22 nt, Human
gcccagguuggagagcaguggc

SEQ ID NO: 497675 - RNA, 22 nt, Human
cagcuccccaugguuccugaag

SEQ ID NO: 497676 - RNA, 21 nt, Human
agaaauguaucauucuuuucc

SEQ ID NO: 497677 - RNA, 22 nt, Human
uguucuaagcugccaaaaugcu

SEQ ID NO: 497678 - RNA, 22 nt, Human
gggcuccaguuuggccaggaag

SEQ ID NO: 497679 - RNA, 22 nt, Human
cagcuguucggggcuggcaugu

SEQ ID NO: 497680 - RNA, 22 nt, Human
guacaguaguaaaagugaauga

SEQ ID NO: 497681 - RNA, 22 nt, Human
uacauagcaaggaaaugacaga

SEQ ID NO: 497682 - RNA, 22 nt, Human
aaagauuaagguauuguuagcu

SEQ ID NO: 497683 - RNA, 22 nt, Human
uggccuggugucugcgaggccu

SEQ ID NO: 497684 - RNA, 19 nt, Human
ggcugccuuuccuuaccag

SEQ ID NO: 497685 - RNA, 22 nt, Human
uuauucugacuaauguauaacu

SEQ ID NO: 497686 - RNA, 22 nt, Human
cagggugcugcaccaucccuca

SEQ ID NO: 497687 - RNA, 22 nt, Human
agugcauuauauguuucaaugg

SEQ ID NO: 497688 - RNA, 22 nt, Human
uuggaagggauauuggcauaug

SEQ ID NO: 497689 - RNA, 23 nt, Human
cuggcucuguagguggcauccuu

SEQ ID NO: 497690 - RNA, 22 nt, Human
gggccuguguguucaggagccu

SEQ ID NO: 497691 - RNA, 22 nt, Human
gcagcuuucuugcccuaaucuu

SEQ ID NO: 497692 - RNA, 22 nt, Human
ucauuuggagccuuccuguuuu

SEQ ID NO: 497693 - RNA, 22 nt, Human
ucagcacuauacauuuugaaua

SEQ ID NO: 497694 - RNA, 19 nt, Human
cugcugggugcugagggag

SEQ ID NO: 497695 - RNA, 22 nt, Human
ggaaagaaucaagugauccugu

SEQ ID NO: 497696 - RNA, 22 nt, Human
ggaugggcccgggacggcgcug

SEQ ID NO: 497697 - RNA, 22 nt, Human
cacugaaggcuaggauuagaug

SEQ ID NO: 497698 - RNA, 22 nt, Human
cuucucucugcauaggcauggg

SEQ ID NO: 497699 - RNA, 22 nt, Human
uuugggcugguuugccaugccc

SEQ ID NO: 497700 - RNA, 21 nt, Human
ucucuggaauuagaccauguu

SEQ ID NO: 497701 - RNA, 22 nt, Human
ucaggccugcaggcuuccugga

SEQ ID NO: 497702 - RNA, 20 nt, Human
cagaggcauuuucagacucu

SEQ ID NO: 497703 - RNA, 22 nt, Human
uggggcuggggaucuugagccu

SEQ ID NO: 497704 - RNA, 22 nt, Human
ucaggcaguagaauugcuugaa

SEQ ID NO: 497705 - RNA, 22 nt, Human
uuucacauuuaggcgugaauug

SEQ ID NO: 497706 - RNA, 23 nt, Human
augcaguauaugucaguaguuua

SEQ ID NO: 497707 - RNA, 22 nt, Human
gagaaaaugucagacuuggucg

SEQ ID NO: 497708 - RNA, 22 nt, Human
gaaacauuuguugaguacuugc

SEQ ID NO: 497709 - RNA, 22 nt, Human
uccaggcauaaugcccaguggu

SEQ ID NO: 497710 - RNA, 22 nt, Human
uggguagagacacagucugggg

SEQ ID NO: 497711 - RNA, 19 nt, Human
agggaaggauucugucauu

SEQ ID NO: 497712 - RNA, 22 nt, Human
gcugcucucagagcucaugcug

SEQ ID NO: 497713 - RNA, 22 nt, Human
uucucuuauucuggauaugcag

SEQ ID NO: 497714 - RNA, 22 nt, Human
uacaaagccugguagauaucug

SEQ ID NO: 497715 - RNA, 22 nt, Human
agagaaucugggaagauguuaa

SEQ ID NO: 497716 - RNA, 20 nt, Human
uuuuauauguaggguauaug

SEQ ID NO: 497717 - RNA, 22 nt, Human
ggggccuuuucugaauguggaa

SEQ ID NO: 497718 - RNA, 22 nt, Human
uggggcugugagacuacaggau

SEQ ID NO: 497719 - RNA, 22 nt, Human
gguucacacuuucaugauuuca

SEQ ID NO: 497720 - RNA, 22 nt, Human
ugcauuaaaaugugccucucuu

SEQ ID NO: 497721 - RNA, 22 nt, Human
uccuggaguugugcagugcaca

SEQ ID NO: 497722 - RNA, 22 nt, Human
auuuguugaauaaauuaguauu

SEQ ID NO: 497723 - RNA, 22 nt, Human
gcugggucuggaugcucaggug

SEQ ID NO: 497724 - RNA, 22 nt, Human
auugaaagaguuuucugcugca

SEQ ID NO: 497725 - RNA, 22 nt, Human
cugucuccagggcaggugcagg

SEQ ID NO: 497726 - RNA, 22 nt, Human
cccccaggcucugacacaggag

SEQ ID NO: 497727 - RNA, 22 nt, Human
ggccaugguuggggaagacaug

SEQ ID NO: 497728 - RNA, 22 nt, Human
agguuuucagcuguauccugag

SEQ ID NO: 497729 - RNA, 22 nt, Human
uucuguauauuguaaagacuca

SEQ ID NO: 497730 - RNA, 22 nt, Human
cuggcuccacucccugccugac

SEQ ID NO: 497731 - RNA, 23 nt, Human
aucuaaaguguuaaauagcuggg

SEQ ID NO: 497732 - RNA, 22 nt, Human
ccugccagauccccugagcuga

SEQ ID NO: 497733 - RNA, 22 nt, Human
agauggggcagaauggagccau

SEQ ID NO: 497734 - RNA, 22 nt, Human
auaugcauaugucaaaacuuau

SEQ ID NO: 497735 - RNA, 22 nt, Human
cuggcucuaagugucagcuccc

SEQ ID NO: 497736 - RNA, 22 nt, Human
auaaauaucacuguugucccuc

SEQ ID NO: 497737 - RNA, 22 nt, Human
aaagaauuuguacacccuacua

SEQ ID NO: 497738 - RNA, 22 nt, Human
aucaggauucaccccagagcug

SEQ ID NO: 497739 - RNA, 22 nt, Human
uuagcacuuugauucaugcaga

SEQ ID NO: 497740 - RNA, 22 nt, Human
ugggcuccucgucacucgcugu

SEQ ID NO: 497741 - RNA, 22 nt, Human
auagauuauuugcucauuacuu

SEQ ID NO: 497742 - RNA, 22 nt, Human
agcugggucuugggccaggaga

SEQ ID NO: 497743 - RNA, 22 nt, Human
gaggguccuggcuaagucugac

SEQ ID NO: 497744 - RNA, 22 nt, Human
uauaauuuuagaagagauggaa

SEQ ID NO: 497745 - RNA, 22 nt, Human
acagaguauuggaaaggcagug

SEQ ID NO: 497746 - RNA, 20 nt, Human
ugucagugccugaggcacag

SEQ ID NO: 497747 - RNA, 22 nt, Human
gcugcuggcaucuagggggugg

SEQ ID NO: 497748 - RNA, 22 nt, Human
aaccugcauguuucuaaaagca

SEQ ID NO: 497749 - RNA, 22 nt, Human
auggaaagccaguguuccauca

SEQ ID NO: 497750 - RNA, 22 nt, Human
ggcugcagauuguagucuguua

SEQ ID NO: 497751 - RNA, 22 nt, Human
cuggaagguuccucccagcucc

SEQ ID NO: 497752 - RNA, 22 nt, Human
uaacagaaguuguucauugugg

SEQ ID NO: 497753 - RNA, 22 nt, Human
aggacagguguagugggcucug

SEQ ID NO: 497754 - RNA, 22 nt, Human
aaguuauuuccucgugacugaa

SEQ ID NO: 497755 - RNA, 16 nt, Human
cuacccagugagaagg

SEQ ID NO: 497756 - RNA, 22 nt, Human
gucccucugugucccugcaguc

SEQ ID NO: 497757 - RNA, 20 nt, Human
cagagccaagagcagcaucu

SEQ ID NO: 497758 - RNA, 22 nt, Human
aucacagagcucccuuccacug

SEQ ID NO: 497759 - RNA, 22 nt, Human
agugucugcgggcagaggagcg

SEQ ID NO: 497760 - RNA, 22 nt, Human
aggcaguggcugagaccagggg

SEQ ID NO: 497761 - RNA, 22 nt, Human
cauuucugggagacaugcuaga

SEQ ID NO: 497762 - RNA, 22 nt, Human
gcuggguccaugguccucgggu

SEQ ID NO: 497763 - RNA, 20 nt, Human
uccaggagaacugggagccg

SEQ ID NO: 497764 - RNA, 22 nt, Human
ccacacagggggaugaguuauu

SEQ ID NO: 497765 - RNA, 22 nt, Human
ugcuucuggcuuaucucgugcc

SEQ ID NO: 497766 - RNA, 22 nt, Human
gcucaggagcugacagccucaa

SEQ ID NO: 497767 - RNA, 22 nt, Human
uagaaugaccuccucuuagcuu

SEQ ID NO: 497768 - RNA, 22 nt, Human
auucaauaaauaugcuacaugg

SEQ ID NO: 497769 - RNA, 22 nt, Human
cucccgugauccuggaggagag

SEQ ID NO: 497770 - RNA, 22 nt, Human
ccuacacaucucaccucacagg

SEQ ID NO: 497771 - RNA, 22 nt, Human
augugcaguugguggccaggag

SEQ ID NO: 497772 - RNA, 22 nt, Human
ggagcuggccgccuaugugcag

SEQ ID NO: 497773 - RNA, 22 nt, Human
gccaccccauagguguuaggug

SEQ ID NO: 497774 - RNA, 19 nt, Human
gcauaaaaugucaaugugu

SEQ ID NO: 497775 - RNA, 22 nt, Human
agcugcugugugcucaggcagg

SEQ ID NO: 497776 - RNA, 22 nt, Human
cccagggucccugcucucugug

SEQ ID NO: 497777 - RNA, 22 nt, Human
guggcaggggcgggcuguuccg

SEQ ID NO: 497778 - RNA, 22 nt, Human
ggcucuguggcuggccaugaug

SEQ ID NO: 497779 - RNA, 22 nt, Human
ggcugcucuucuuggcgaccuc

SEQ ID NO: 497780 - RNA, 22 nt, Human
aguaggaggcgggagcaugaag

SEQ ID NO: 497781 - RNA, 22 nt, Human
ggcaggcaggagcgugcuuggg

SEQ ID NO: 497782 - RNA, 22 nt, Human
uuaaaacugcaaauccuacuga

SEQ ID NO: 497783 - RNA, 22 nt, Human
ggcugaaguguaguggcucacu

SEQ ID NO: 497784 - RNA, 22 nt, Human
gcccucagcuccuggacacaug

SEQ ID NO: 497785 - RNA, 22 nt, Human
gauggggaugagaagugagcag

SEQ ID NO: 497786 - RNA, 22 nt, Human
cuccucacacccacugcaacca

SEQ ID NO: 497787 - RNA, 22 nt, Human
cgcuggccauagccuccugugu

SEQ ID NO: 497788 - RNA, 22 nt, Human
ugcaaaaacugcaauugcuuuu

SEQ ID NO: 497789 - RNA, 22 nt, Human
uaauuacagagguuugccaguu

SEQ ID NO: 497790 - RNA, 22 nt, Human
cugucacacugauaucaggcuu

SEQ ID NO: 497791 - RNA, 19 nt, Human
agcuguggggccuagcacc

SEQ ID NO: 497792 - RNA, 22 nt, Human
cuggccagaagcaccuuuggcg

SEQ ID NO: 497793 - RNA, 22 nt, Human
aggcaggggagcuggaagggua

SEQ ID NO: 497794 - RNA, 22 nt, Human
ucucaguguuguucugcagaug

SEQ ID NO: 497795 - RNA, 22 nt, Human
gcagggcagaaggugcugagga

SEQ ID NO: 497796 - RNA, 21 nt, Human
cagagcugaaggguguagugu

SEQ ID NO: 497797 - RNA, 22 nt, Human
guagaagugaugucauguuaua

SEQ ID NO: 497798 - RNA, 22 nt, Human
cuuuguugugccugagugcacc

SEQ ID NO: 497799 - RNA, 18 nt, Human
uaaugauaagccuugaag

SEQ ID NO: 497800 - RNA, 22 nt, Human
ucacaugcccuguauuuaccag

SEQ ID NO: 497801 - RNA, 22 nt, Human
ucccaggccauaaaacucagag

SEQ ID NO: 497802 - RNA, 22 nt, Human
auggcagagggauugaacagcu

SEQ ID NO: 497803 - RNA, 22 nt, Human
cccugcagggaggauucugaag

SEQ ID NO: 497804 - RNA, 22 nt, Human
cagagggaaaaggggaguaaua

SEQ ID NO: 497805 - RNA, 22 nt, Human
auguccagggcacacagcagug

SEQ ID NO: 497806 - RNA, 22 nt, Human
uugauacagcagccugugaucc

SEQ ID NO: 497807 - RNA, 22 nt, Human
cauggccucaaaggacugcaga

SEQ ID NO: 497808 - RNA, 20 nt, Human
ggcucugcuugugagcagcc

SEQ ID NO: 497809 - RNA, 22 nt, Human
gcuguccugggaacaggcacua

SEQ ID NO: 497810 - RNA, 19 nt, Human
ucucuucucccugguuuua

SEQ ID NO: 497811 - RNA, 22 nt, Human
cacauuauucuaaagagguacu

SEQ ID NO: 497812 - RNA, 22 nt, Human
ccacagggcucuaggcgcuucc

SEQ ID NO: 497813 - RNA, 22 nt, Human
cucagugcagcuaggcaugaga

SEQ ID NO: 497814 - RNA, 22 nt, Human
guggcugcaucggggugaccag

SEQ ID NO: 497815 - RNA, 22 nt, Human
ccugggagagccaucuguggcc

SEQ ID NO: 497816 - RNA, 22 nt, Human
agggccuguccgcucccgcccg

SEQ ID NO: 497817 - RNA, 19 nt, Human
ucucuggcuugucugccug

SEQ ID NO: 497818 - RNA, 22 nt, Human
ugaaggcauugaugaaggaauc

SEQ ID NO: 497819 - RNA, 22 nt, Human
uagagaaaagcagggaucagga

SEQ ID NO: 497820 - RNA, 22 nt, Human
aggaugggccugggauaugcuu

SEQ ID NO: 497821 - RNA, 22 nt, Human
gccaggugcaccugcccuggcc

SEQ ID NO: 497822 - RNA, 22 nt, Human
ggcagccagagggcagcuggau

SEQ ID NO: 497823 - RNA, 22 nt, Human
gaagagcuggaauccagucugg

SEQ ID NO: 497824 - RNA, 22 nt, Human
auauuuaaacaggguaccaaua

SEQ ID NO: 497825 - RNA, 22 nt, Human
caccagcuuugcccacugccca

SEQ ID NO: 497826 - RNA, 22 nt, Human
agcugcaggcccaugcucaguc

SEQ ID NO: 497827 - RNA, 22 nt, Human
accaggaggccuggagcacaaa

SEQ ID NO: 497828 - RNA, 22 nt, Human
caaaugcauagaaagaugaaac

SEQ ID NO: 497829 - RNA, 20 nt, Human
uucuuaaagaccucacuuug

SEQ ID NO: 497830 - RNA, 22 nt, Human
uagacauuuggcaugguuuuca

SEQ ID NO: 497831 - RNA, 22 nt, Human
ugugaugguucacugggcauga

SEQ ID NO: 497832 - RNA, 19 nt, Human
gguccagacuucagacuag

SEQ ID NO: 497833 - RNA, 22 nt, Human
cugcccugcuucugagggaagc

SEQ ID NO: 497834 - RNA, 22 nt, Human
ugggcaagucacuucugucuuu

SEQ ID NO: 497835 - RNA, 22 nt, Human
ggaggcagaauagagugugggu

SEQ ID NO: 497836 - RNA, 22 nt, Human
uggagcauauucuggagcuugg

SEQ ID NO: 497837 - RNA, 23 nt, Human
agagagaguuugugucagguacc

SEQ ID NO: 497838 - RNA, 22 nt, Human
aaaugguauuuacucuguauua

SEQ ID NO: 497839 - RNA, 22 nt, Human
agaugacagccaaggagaugaa

SEQ ID NO: 497840 - RNA, 22 nt, Human
uccaggcuuuggggcaggagcg

SEQ ID NO: 497841 - RNA, 22 nt, Human
uccugggugugauauucauaga

SEQ ID NO: 497842 - RNA, 22 nt, Human
caaauguguuuuuucuucuaca

SEQ ID NO: 497843 - RNA, 22 nt, Human
cagagcauugagggucugccaa

SEQ ID NO: 497844 - RNA, 22 nt, Human
cagggaugaccagagggaugug

SEQ ID NO: 497845 - RNA, 22 nt, Human
gaagaacugugacagaagcagu

SEQ ID NO: 497846 - RNA, 22 nt, Human
aacaguaaugugguguuggguu

SEQ ID NO: 497847 - RNA, 22 nt, Human
agagccaguuaagcacuuacag

SEQ ID NO: 497848 - RNA, 22 nt, Human
gccacugauuccaagucaauuu

SEQ ID NO: 497849 - RNA, 22 nt, Human
gcucccagcaauugaggcagcc

SEQ ID NO: 497850 - RNA, 22 nt, Human
uccugggcugcagggaagagca

SEQ ID NO: 497851 - RNA, 22 nt, Human
cacagggcagugcugcccacuc

SEQ ID NO: 497852 - RNA, 22 nt, Human
gaugcacagugacccugccagu

SEQ ID NO: 497853 - RNA, 22 nt, Human
cagaaguaagauuacugugaga

SEQ ID NO: 497854 - RNA, 22 nt, Human
gggcagguacuggguggugagc

SEQ ID NO: 497855 - RNA, 22 nt, Human
aaguuuaacuugaauucuuucu

SEQ ID NO: 497856 - RNA, 22 nt, Human
ggcucuggguucugcaaugcgu

SEQ ID NO: 497857 - RNA, 22 nt, Human
guuuaagaggguuucauuccca

SEQ ID NO: 497858 - RNA, 22 nt, Human
uuucacagcgucuuucucuugc

SEQ ID NO: 497859 - RNA, 22 nt, Human
cuguggcuccagugaaccaaug

SEQ ID NO: 497860 - RNA, 22 nt, Human
acacaguaccccaaggcugggc

SEQ ID NO: 497861 - RNA, 20 nt, Human
uguucacaguaguugcugcu

SEQ ID NO: 497862 - RNA, 20 nt, Human
gauuacaaaaugaaaugcau

SEQ ID NO: 497863 - RNA, 22 nt, Human
ucauugaauuucacagcuuuau

SEQ ID NO: 497864 - RNA, 22 nt, Human
acccuggggguggccagugcca

SEQ ID NO: 497865 - RNA, 22 nt, Human
ccaggucuggaaccaccagggc

SEQ ID NO: 497866 - RNA, 22 nt, Human
ccucagggucugaggagaccgu

SEQ ID NO: 497867 - RNA, 22 nt, Human
uggagggcaucuguggucaggc

SEQ ID NO: 497868 - RNA, 22 nt, Human
acuggggauuagggacucagug

SEQ ID NO: 497869 - RNA, 22 nt, Human
gggccuggugcuucugacuccu

SEQ ID NO: 497870 - RNA, 22 nt, Human
ccuuggugaucugggcuggaag

SEQ ID NO: 497871 - RNA, 22 nt, Human
ucaggucuuuugucuccuagaa

SEQ ID NO: 497872 - RNA, 22 nt, Human
uguguccauucaggcacugacc

SEQ ID NO: 497873 - RNA, 19 nt, Human
agcuccuguucagcagcuc

SEQ ID NO: 497874 - RNA, 23 nt, Human
aaggccagaauuucaauggugcc

SEQ ID NO: 497875 - RNA, 22 nt, Human
gugcccugguccccagcauaua

SEQ ID NO: 497876 - RNA, 22 nt, Human
cucaggucuuaguucugucauc

SEQ ID NO: 497877 - RNA, 22 nt, Human
auugacaacccugguaugagca

SEQ ID NO: 497878 - RNA, 22 nt, Human
acagacuguuugguucaugucu

SEQ ID NO: 497879 - RNA, 22 nt, Human
gagcccagguucugcuuccagc

SEQ ID NO: 497880 - RNA, 22 nt, Human
aaagcucuuauagcagagugug

SEQ ID NO: 497881 - RNA, 22 nt, Human
caguagucuuuuuccuccuaga

SEQ ID NO: 497882 - RNA, 22 nt, Human
ugcuugagacacauaugaauuu

SEQ ID NO: 497883 - RNA, 22 nt, Human
aagauguugcauuagaauaccu

SEQ ID NO: 497884 - RNA, 22 nt, Human
gccuguguggaugcgccggugc

SEQ ID NO: 497885 - RNA, 22 nt, Human
uggcagcuugaaugcagucuuu

SEQ ID NO: 497886 - RNA, 20 nt, Human
gaagccagaggggaaaggag

SEQ ID NO: 497887 - RNA, 22 nt, Human
aaguugagaugucauaggagac

SEQ ID NO: 497888 - RNA, 22 nt, Human
uuucuguuaggcaucauuuuaa

SEQ ID NO: 497889 - RNA, 22 nt, Human
gucaaacaaauuaacauaucca

SEQ ID NO: 497890 - RNA, 22 nt, Human
cggagaggugggggcagcaucu

SEQ ID NO: 497891 - RNA, 22 nt, Human
uuacuuuggauggucaagaaag

SEQ ID NO: 497892 - RNA, 18 nt, Human
agagcagcggcaucacac

SEQ ID NO: 497893 - RNA, 22 nt, Human
ggagcacuauaauagagauuuu

SEQ ID NO: 497894 - RNA, 22 nt, Human
acaauguuuuuguucaaagagu

SEQ ID NO: 497895 - RNA, 22 nt, Human
aucaggauggguuuggcuuagg

SEQ ID NO: 497896 - RNA, 22 nt, Human
gcagcugcuguggcaucaagcu

SEQ ID NO: 497897 - RNA, 22 nt, Human
agcgugaauuaguugguacaca

SEQ ID NO: 497898 - RNA, 22 nt, Human
uaccugcaaaguuccuuuugcc

SEQ ID NO: 497899 - RNA, 17 nt, Human
uggacccuugggccucc

SEQ ID NO: 497900 - RNA, 22 nt, Human
gcaggccuuggcaaugagccug

SEQ ID NO: 497901 - RNA, 22 nt, Human
gugcaugugucuuuauaguaga

SEQ ID NO: 497902 - RNA, 23 nt, Human
uggagcugggcucagacccuggg

SEQ ID NO: 497903 - RNA, 22 nt, Human
uaguuaggguucugcagagaca

SEQ ID NO: 497904 - RNA, 22 nt, Human
gcaaugauugcauuagaagaug

SEQ ID NO: 497905 - RNA, 22 nt, Human
agcauuuaugacuaauguaaaa

SEQ ID NO: 497906 - RNA, 22 nt, Human
aggcucugguuggcaaguaaag

SEQ ID NO: 497907 - RNA, 22 nt, Human
accuuucaaaguggcuaucacu

SEQ ID NO: 497908 - RNA, 18 nt, Human
cugccccuucucugagau

SEQ ID NO: 497909 - RNA, 22 nt, Human
uuaaaugacuuuuauuauucuc

SEQ ID NO: 497910 - RNA, 22 nt, Human
cauguguuucgagacuguugag

SEQ ID NO: 497911 - RNA, 22 nt, Human
acccugagggguauagcagaag

SEQ ID NO: 497912 - RNA, 22 nt, Human
gauuuucugagccuucaaauuu

SEQ ID NO: 497913 - RNA, 22 nt, Human
cagacacagcaauucuguguug

SEQ ID NO: 497914 - RNA, 22 nt, Human
cagccccucacagagcuguccu

SEQ ID NO: 497915 - RNA, 22 nt, Human
cagggcucugccuugagggaug

SEQ ID NO: 497916 - RNA, 22 nt, Human
gauccuguuagaaauguagacu

SEQ ID NO: 497917 - RNA, 17 nt, Human
ggcagcugccacuuuuu

SEQ ID NO: 497918 - RNA, 22 nt, Human
caguuugugcuaggcacuauuu

SEQ ID NO: 497919 - RNA, 22 nt, Human
auggaagguccuacagagcgca

SEQ ID NO: 497920 - RNA, 22 nt, Human
uggagagguugaauaacuuguc

SEQ ID NO: 497921 - RNA, 22 nt, Human
cucacugugaccucagcagaca

SEQ ID NO: 497922 - RNA, 22 nt, Human
agccucuggcccuagacugcuu

SEQ ID NO: 497923 - RNA, 22 nt, Human
aagcaucucuauguggagagug

SEQ ID NO: 497924 - RNA, 18 nt, Human
gggcuguguucaugccca

SEQ ID NO: 497925 - RNA, 22 nt, Human
ugaacagaucaauagaacugac

SEQ ID NO: 497926 - RNA, 22 nt, Human
aggcucauucuugccucugagc

SEQ ID NO: 497927 - RNA, 22 nt, Human
agacagcugcucgcagagcuau

SEQ ID NO: 497928 - RNA, 22 nt, Human
ucagggcaucaucaugaauaua

SEQ ID NO: 497929 - RNA, 22 nt, Human
gcucucagguacaaagcugugu

SEQ ID NO: 497930 - RNA, 22 nt, Human
aaacuguaagagaauaaacuac

SEQ ID NO: 497931 - RNA, 22 nt, Human
aacagugcuucauucacacauu

SEQ ID NO: 497932 - RNA, 22 nt, Human
ucaguguugaauuuuuugcaaa

SEQ ID NO: 497933 - RNA, 21 nt, Human
ugaaggagaggaccgagugcu

SEQ ID NO: 497934 - RNA, 22 nt, Human
gcugugcagccaagugccucug

SEQ ID NO: 497935 - RNA, 22 nt, Human
uaccagccuuuuaacaugggcc

SEQ ID NO: 497936 - RNA, 22 nt, Human
caggaacauuuaaccacagggu

SEQ ID NO: 497937 - RNA, 22 nt, Human
aaacauuugcaacucgguuugg

SEQ ID NO: 497938 - RNA, 22 nt, Human
aggcacugacaauucuggacug

SEQ ID NO: 497939 - RNA, 22 nt, Human
uaugaagaaguucugugaaaug

SEQ ID NO: 497940 - RNA, 22 nt, Human
gcucaguguguucaagggcuca

SEQ ID NO: 497941 - RNA, 22 nt, Human
gaagugucuccguuuuuaaagg

SEQ ID NO: 497942 - RNA, 22 nt, Human
gcccuuauaaacaaggcuucag

SEQ ID NO: 497943 - RNA, 22 nt, Human
ccagguggacggcgaguacagg

SEQ ID NO: 497944 - RNA, 22 nt, Human
cucuggagcaccgggcuaucca

SEQ ID NO: 497945 - RNA, 22 nt, Human
cugccucuugacagaucguggc

SEQ ID NO: 497946 - RNA, 19 nt, Human
caggccucuggucugcugu

SEQ ID NO: 497947 - RNA, 22 nt, Human
cagggcaguaccgcccucuggc

SEQ ID NO: 497948 - RNA, 22 nt, Human
uagcagcuccauuucucuggca

SEQ ID NO: 497949 - RNA, 22 nt, Human
cuggggacuugcagacacaauu

SEQ ID NO: 497950 - RNA, 22 nt, Human
aauaagaucuuaaagguuauau

SEQ ID NO: 497951 - RNA, 22 nt, Human
augaaauaucuugaagaaauuc

SEQ ID NO: 497952 - RNA, 22 nt, Human
gcugccacgaucucugcuguag

SEQ ID NO: 497953 - RNA, 22 nt, Human
ccuggugcuuaccagagcuuuu

SEQ ID NO: 497954 - RNA, 22 nt, Human
uagcugcugcagcacagggagg

SEQ ID NO: 497955 - RNA, 22 nt, Human
agcugagcauuugauccaccuc

SEQ ID NO: 497956 - RNA, 22 nt, Human
ggcagagcuuguuccuucuguu

SEQ ID NO: 497957 - RNA, 22 nt, Human
uggagcucaaaggccuguggga

SEQ ID NO: 497958 - RNA, 22 nt, Human
ccagucagccaagcugcagcgg

SEQ ID NO: 497959 - RNA, 22 nt, Human
acagcuggaggccccauugucc

SEQ ID NO: 497960 - RNA, 22 nt, Human
uugucacauguaguucauucuc

SEQ ID NO: 497961 - RNA, 22 nt, Human
acugccuguuuggcauggcccc

SEQ ID NO: 497962 - RNA, 22 nt, Human
cuguaucuguguuggaugaguu

SEQ ID NO: 497963 - RNA, 22 nt, Human
uggcuuccugcacagugucugc

SEQ ID NO: 497964 - RNA, 22 nt, Human
guuauguaugagggaaugauua

SEQ ID NO: 497965 - RNA, 22 nt, Human
ccagcuuuggaguguuguugcu

SEQ ID NO: 497966 - RNA, 22 nt, Human
cacagggcagagaccugggugc

SEQ ID NO: 497967 - RNA, 22 nt, Human
uagaaauguuagauguauugag

SEQ ID NO: 497968 - RNA, 22 nt, Human
uugaagucaguucauauuuuua

SEQ ID NO: 497969 - RNA, 22 nt, Human
augcugagacuggagcagcugg

SEQ ID NO: 497970 - RNA, 23 nt, Human
uaaagugcugauggugagggagc

SEQ ID NO: 497971 - RNA, 22 nt, Human
agcagcauguucauuacauuau

SEQ ID NO: 497972 - RNA, 22 nt, Human
aggaaagacuggggccccagaa

SEQ ID NO: 497973 - RNA, 22 nt, Human
uuccauaauaaccugagagaaa

SEQ ID NO: 497974 - RNA, 22 nt, Human
cagaagucacccucagaauaac

SEQ ID NO: 497975 - RNA, 22 nt, Human
ugcccugugugugcaagcacug

SEQ ID NO: 497976 - RNA, 22 nt, Human
gcuguacauucuguggguuugg

SEQ ID NO: 497977 - RNA, 22 nt, Human
uccuguuucuccugcaaaaucc

SEQ ID NO: 497978 - RNA, 22 nt, Human
uggcagcuguguccagguagaa

SEQ ID NO: 497979 - RNA, 22 nt, Human
caggaguggugugagggacucc

SEQ ID NO: 497980 - RNA, 22 nt, Human
uguacaagcaaauagaccuuca

SEQ ID NO: 497981 - RNA, 22 nt, Human
guggccugccgugugguauggg

SEQ ID NO: 497982 - RNA, 22 nt, Human
ccaggagagcaaaggucacucu

SEQ ID NO: 497983 - RNA, 22 nt, Human
agcucagagauaaucaagagac

SEQ ID NO: 497984 - RNA, 21 nt, Human
uuccucuugcuuccgccuugc

SEQ ID NO: 497985 - RNA, 22 nt, Human
uggcagaguuggagguggaaga

SEQ ID NO: 497986 - RNA, 22 nt, Human
uugauugaauuuugaaaaucua

SEQ ID NO: 497987 - RNA, 19 nt, Human
uggcagggagugauauuag

SEQ ID NO: 497988 - RNA, 22 nt, Human
ugaggcagguaagcaaguuuug

SEQ ID NO: 497989 - RNA, 22 nt, Human
cagggugcagugucgcugcuag

SEQ ID NO: 497990 - RNA, 22 nt, Human
ggagcugcuccuucagccaagu

SEQ ID NO: 497991 - RNA, 22 nt, Human
gaagcuucguggcucuucaaau

SEQ ID NO: 497992 - RNA, 22 nt, Human
gaauacauuggaaaucagaaua

SEQ ID NO: 497993 - RNA, 22 nt, Human
cuucaaaagccagaagccugcg

SEQ ID NO: 497994 - RNA, 22 nt, Human
aguuucucuuugacaccaaaau

SEQ ID NO: 497995 - RNA, 22 nt, Human
gggacagcuguagugcuuggcu

SEQ ID NO: 497996 - RNA, 22 nt, Human
uugauguacagaauuguucaca

SEQ ID NO: 497997 - RNA, 22 nt, Human
ccagucugaggccuggugaggg

SEQ ID NO: 497998 - RNA, 22 nt, Human
guuugccugccgacgcucucau

SEQ ID NO: 497999 - RNA, 22 nt, Human
cagugagauaccacagagcaaa

SEQ ID NO: 498000 - RNA, 22 nt, Human
gaagcuaaugagauaaaugcca

SEQ ID NO: 498001 - RNA, 21 nt, Human
ugcagcagaagucucuguguc

SEQ ID NO: 498002 - RNA, 18 nt, Human
agcaaagcaagagaucac

SEQ ID NO: 498003 - RNA, 22 nt, Human
ugccaaauugcccuauaaauga

SEQ ID NO: 498004 - RNA, 21 nt, Human
uucagcaguccucuagagaua

SEQ ID NO: 498005 - RNA, 22 nt, Human
cagagcucagagcugccaggca

SEQ ID NO: 498006 - RNA, 22 nt, Human
ggaaagagcuaaaagggugaga

SEQ ID NO: 498007 - RNA, 22 nt, Human
uauacaagugagaagaagaguu

SEQ ID NO: 498008 - RNA, 22 nt, Human
gcucucugccauaugaggauac

SEQ ID NO: 498009 - RNA, 22 nt, Human
ggguacaaagauuucauaagau

SEQ ID NO: 498010 - RNA, 22 nt, Human
cugggcccacgagggcucuggg

SEQ ID NO: 498011 - RNA, 22 nt, Human
gucaggauuugaacucaggucu

SEQ ID NO: 498012 - RNA, 21 nt, Human
ucagaggcacugagagcaaug

SEQ ID NO: 498013 - RNA, 22 nt, Human
cugcuugggguuaggguguccu

SEQ ID NO: 498014 - RNA, 22 nt, Human
ggccaccucugcccuaccgagu

SEQ ID NO: 498015 - RNA, 19 nt, Human
aagaagcaauaagcuguga

SEQ ID NO: 498016 - RNA, 22 nt, Human
acaggugggcuuaagagucggc

SEQ ID NO: 498017 - RNA, 22 nt, Human
acuguggcuaauucauuugguc

SEQ ID NO: 498018 - RNA, 22 nt, Human
ggcuuagcaacuccugaggcuc

SEQ ID NO: 498019 - RNA, 22 nt, Human
uggaaagaauuccuaugguuca

SEQ ID NO: 498020 - RNA, 22 nt, Human
uugcugaagugaagguauguuu

SEQ ID NO: 498021 - RNA, 20 nt, Human
aauaaacuacugagagaugu

SEQ ID NO: 498022 - RNA, 22 nt, Human
agcaggugggaucaagcuggca

SEQ ID NO: 498023 - RNA, 22 nt, Human
ucaugaaaauagaucagaaauu

SEQ ID NO: 498024 - RNA, 22 nt, Human
ucagaguguuuuacuaaacaag

SEQ ID NO: 498025 - RNA, 22 nt, Human
gcuguccaugucuggccucagu

SEQ ID NO: 498026 - RNA, 22 nt, Human
uuauuauaaugagggauaaaaa

SEQ ID NO: 498027 - RNA, 22 nt, Human
gcugcugcuugaaggcucggag

SEQ ID NO: 498028 - RNA, 23 nt, Human
auuuuacaggucaguuccuugaa

SEQ ID NO: 498029 - RNA, 22 nt, Human
ggccugagaaccauggggccaa

SEQ ID NO: 498030 - RNA, 22 nt, Human
gggccccugggaauucugugau

SEQ ID NO: 498031 - RNA, 22 nt, Human
uuugucauaucacacaauuuug

SEQ ID NO: 498032 - RNA, 22 nt, Human
aauaauuauuugagagcagacc

SEQ ID NO: 498033 - RNA, 20 nt, Human
uuuauuggccuuucaggaac

SEQ ID NO: 498034 - RNA, 22 nt, Human
auucuauuuuuuaagaaguagu

SEQ ID NO: 498035 - RNA, 22 nt, Human
agcucccagcagagcuggccac

SEQ ID NO: 498036 - RNA, 22 nt, Human
ucugcagcuuuuugguggggug

SEQ ID NO: 498037 - RNA, 22 nt, Human
uccaucauguucacagcuauau

SEQ ID NO: 498038 - RNA, 22 nt, Human
gcugagggcuguaacagcagag

SEQ ID NO: 498039 - RNA, 22 nt, Human
cuccuucccuucaaguguuccu

SEQ ID NO: 498040 - RNA, 22 nt, Human
uggcagcugaggggaggcuuug

SEQ ID NO: 498041 - RNA, 22 nt, Human
aggccuagaggaauggccaggg

SEQ ID NO: 498042 - RNA, 22 nt, Human
gcagggggauggaguugaaaug

SEQ ID NO: 498043 - RNA, 22 nt, Human
ucaccuuagcuagaggaagaga

SEQ ID NO: 498044 - RNA, 22 nt, Human
aguaacuaugcuugagaaucag

SEQ ID NO: 498045 - RNA, 22 nt, Human
aauaugugagguauguucagug

SEQ ID NO: 498046 - RNA, 22 nt, Human
ucaggaagcugcucuggguggu

SEQ ID NO: 498047 - RNA, 22 nt, Human
aacaaauguaaaaugcagaugc

SEQ ID NO: 498048 - RNA, 22 nt, Human
aaaugcauaucaaagacuugaa

SEQ ID NO: 498049 - RNA, 22 nt, Human
guucaaaauucaaaugguauac

SEQ ID NO: 498050 - RNA, 22 nt, Human
cuggcucaccuccgcuccagca

SEQ ID NO: 498051 - RNA, 22 nt, Human
agaucaaaucugggauuucuaa

SEQ ID NO: 498052 - RNA, 22 nt, Human
agggcagagauuaauuaagaca

SEQ ID NO: 498053 - RNA, 22 nt, Human
auacauuagcucauaugauuaa

SEQ ID NO: 498054 - RNA, 22 nt, Human
aaguccauucuuccagccagcu

SEQ ID NO: 498055 - RNA, 22 nt, Human
gccugggauuguguaagugaau

SEQ ID NO: 498056 - RNA, 22 nt, Human
aaagcucacaguaauacaaggc

SEQ ID NO: 498057 - RNA, 20 nt, Human
ugcuuugauggaaauacagc

SEQ ID NO: 498058 - RNA, 20 nt, Human
aggguggggacguucugacu

SEQ ID NO: 498059 - RNA, 22 nt, Human
aaagagaacuuuuacccaagaa

SEQ ID NO: 498060 - RNA, 20 nt, Human
ugugcccaauguccagguuc

SEQ ID NO: 498061 - RNA, 22 nt, Human
cugagauggucucuuuguuacu

SEQ ID NO: 498062 - RNA, 22 nt, Human
uagcugccaaaagggugggcua

SEQ ID NO: 498063 - RNA, 22 nt, Human
ugguuccaaucgcacuggcuca

SEQ ID NO: 498064 - RNA, 22 nt, Human
cuucacauguuggaguccuuug

SEQ ID NO: 498065 - RNA, 22 nt, Human
cccuguggcaggaggaggagca

SEQ ID NO: 498066 - RNA, 22 nt, Human
ggucagcagugcagggcagagc

SEQ ID NO: 498067 - RNA, 22 nt, Human
agccugguguggggcugcagag

SEQ ID NO: 498068 - RNA, 22 nt, Human
ggccagaaguuggaaaagagcc

SEQ ID NO: 498069 - RNA, 22 nt, Human
caaaugugguuucucagcauuc

SEQ ID NO: 498070 - RNA, 22 nt, Human
aucuggcuuaccuagggugccu

SEQ ID NO: 498071 - RNA, 22 nt, Human
ugugcauagacuuucaccaccu

SEQ ID NO: 498072 - RNA, 22 nt, Human
cugggcccaggcggcucucgga

SEQ ID NO: 498073 - RNA, 22 nt, Human
acacaguaugaaaagucuaguu

SEQ ID NO: 498074 - RNA, 22 nt, Human
acagaguaggugcugucgacug

SEQ ID NO: 498075 - RNA, 22 nt, Human
aggucaaguuuagauagaguua

SEQ ID NO: 498076 - RNA, 17 nt, Human
agcuccugcccauggcu

SEQ ID NO: 498077 - RNA, 18 nt, Human
cagaagcaggcagugcag

SEQ ID NO: 498078 - RNA, 22 nt, Human
cacccagcagcacuuaagacua

SEQ ID NO: 498079 - RNA, 22 nt, Human
ugggcugcacccucagccucug

SEQ ID NO: 498080 - RNA, 19 nt, Human
uugaaagauuagcuuucua

SEQ ID NO: 498081 - RNA, 22 nt, Human
uacccagcccaugccuaccuca

SEQ ID NO: 498082 - RNA, 22 nt, Human
aaaggcucuaacaaggagagag

SEQ ID NO: 498083 - RNA, 22 nt, Human
ugcagcagucagucaggccugg

SEQ ID NO: 498084 - RNA, 22 nt, Human
ccaguguuuccccagaagagag

SEQ ID NO: 498085 - RNA, 22 nt, Human
ggauaagaaaauuguaauaacu

SEQ ID NO: 498086 - RNA, 22 nt, Human
aaagcaagucucuacaaaguac

SEQ ID NO: 498087 - RNA, 21 nt, Human
aaacugaccuugccugagaca

SEQ ID NO: 498088 - RNA, 22 nt, Human
uagcuuuccuuguugccugugc

SEQ ID NO: 498089 - RNA, 21 nt, Human
cugcaucucauagaacauguc

SEQ ID NO: 498090 - RNA, 22 nt, Human
ucaauagcauagcaauuaaugu

SEQ ID NO: 498091 - RNA, 17 nt, Human
ugguccagguggagcca

SEQ ID NO: 498092 - RNA, 18 nt, Human
cuuguucuucucuuggcg

SEQ ID NO: 498093 - RNA, 22 nt, Human
ccuccugguccagcaucucuuu

SEQ ID NO: 498094 - RNA, 22 nt, Human
uggcucuggugcgggcuccugc

SEQ ID NO: 498095 - RNA, 22 nt, Human
aaaaaguuucaacugccaacuc

SEQ ID NO: 498096 - RNA, 22 nt, Human
aggcacugugcugaugucuuau

SEQ ID NO: 498097 - RNA, 22 nt, Human
cuggaagggggacagccacaca

SEQ ID NO: 498098 - RNA, 22 nt, Human
aaggcugagguagggccuaaaa

SEQ ID NO: 498099 - RNA, 22 nt, Human
agcaggcuaggaaccucacugc

SEQ ID NO: 498100 - RNA, 22 nt, Human
caguggguggcuaaguggcuga

SEQ ID NO: 498101 - RNA, 22 nt, Human
uccaggcacagaguuggucagu

SEQ ID NO: 498102 - RNA, 22 nt, Human
ugcuccuuccucauccugugca

SEQ ID NO: 498103 - RNA, 19 nt, Human
gggaaauucacuugcuucc

SEQ ID NO: 498104 - RNA, 22 nt, Human
gccagggcaggggagcaucugc

SEQ ID NO: 498105 - RNA, 20 nt, Human
auuucaguguuugcaauuuc

SEQ ID NO: 498106 - RNA, 22 nt, Human
aaacagcugucauuguuuuaaa

SEQ ID NO: 498107 - RNA, 22 nt, Human
cagacuugacggcagcugcuuu

SEQ ID NO: 498108 - RNA, 22 nt, Human
uguuacaaacuguuguuucuau

SEQ ID NO: 498109 - RNA, 22 nt, Human
ugcucagacaagcugaacagua

SEQ ID NO: 498110 - RNA, 22 nt, Human
gcuuuaaaccucuacucugucc

SEQ ID NO: 498111 - RNA, 22 nt, Human
ccacaggggucucuguagcuga

SEQ ID NO: 498112 - RNA, 22 nt, Human
cagggaugggauggagucaguu

SEQ ID NO: 498113 - RNA, 22 nt, Human
uuuccucuucgauuaaguuugg

SEQ ID NO: 498114 - RNA, 22 nt, Human
ugaggcagcccacuuuccuuag

SEQ ID NO: 498115 - RNA, 22 nt, Human
agcuccugcaccaggggccccu

SEQ ID NO: 498116 - RNA, 22 nt, Human
uuugugaauaagagaaugacag

SEQ ID NO: 498117 - RNA, 22 nt, Human
agcaucagcagacucucagcua

SEQ ID NO: 498118 - RNA, 20 nt, Human
gagagcuggaaauaaagucc

SEQ ID NO: 498119 - RNA, 22 nt, Human
uucacaguuuaauggcaaggau

SEQ ID NO: 498120 - RNA, 22 nt, Human
uucaggauccccuugaugggcu

SEQ ID NO: 498121 - RNA, 22 nt, Human
agcuccagaagccugcaaggua

SEQ ID NO: 498122 - RNA, 22 nt, Human
aacauuucagcaaauaagaaca

SEQ ID NO: 498123 - RNA, 22 nt, Human
agcuggagaugcccagcaccgg

SEQ ID NO: 498124 - RNA, 22 nt, Human
ccucagagacaguaacuggaau

SEQ ID NO: 498125 - RNA, 22 nt, Human
cuggggacuuugguucuccaug

SEQ ID NO: 498126 - RNA, 22 nt, Human
agacauggagaaggagccagug

SEQ ID NO: 498127 - RNA, 22 nt, Human
agccagcaggugagugcagccu

SEQ ID NO: 498128 - RNA, 20 nt, Human
ccagcuuucccugcagcauc

SEQ ID NO: 498129 - RNA, 22 nt, Human
uguccaguccuuggggugcugu

SEQ ID NO: 498130 - RNA, 22 nt, Human
agcuuuaucccuugcccaucga

SEQ ID NO: 498131 - RNA, 22 nt, Human
aguguuccuugcuuucccagag

SEQ ID NO: 498132 - RNA, 22 nt, Human
aggucauugaaguuauuuucuu

SEQ ID NO: 498133 - RNA, 21 nt, Human
gcagcaguguucuagaauacu

SEQ ID NO: 498134 - RNA, 22 nt, Human
ggccacaacuugcuccuagccc

SEQ ID NO: 498135 - RNA, 22 nt, Human
acagaauacuacagacugguua

SEQ ID NO: 498136 - RNA, 22 nt, Human
aucauacagccuuuguuagugu

SEQ ID NO: 498137 - RNA, 22 nt, Human
acacucuguaaugucacacucc

SEQ ID NO: 498138 - RNA, 22 nt, Human
gcaguguugagccagcuggggg

SEQ ID NO: 498139 - RNA, 22 nt, Human
cacugaagccacuggaagagga

SEQ ID NO: 498140 - RNA, 22 nt, Human
gccugccaguguuugaggauug

SEQ ID NO: 498141 - RNA, 22 nt, Human
gaccacagacuggaaagagggc

SEQ ID NO: 498142 - RNA, 22 nt, Human
gcacaggaaaugacucauguua

SEQ ID NO: 498143 - RNA, 22 nt, Human
uccagggccaagucauggaacc

SEQ ID NO: 498144 - RNA, 22 nt, Human
ugcuucagugugucauuauuua

SEQ ID NO: 498145 - RNA, 22 nt, Human
cagagcggccacuagagggcgc

SEQ ID NO: 498146 - RNA, 22 nt, Human
ccugggcucacagccaaggcuc

SEQ ID NO: 498147 - RNA, 22 nt, Human
cugccucuauaggaguccacca

SEQ ID NO: 498148 - RNA, 22 nt, Human
uuucuaaaugguggcugcauug

SEQ ID NO: 498149 - RNA, 22 nt, Human
gcucccugaaaagaacaaaguc

SEQ ID NO: 498150 - RNA, 18 nt, Human
acauuucucucugcguga

SEQ ID NO: 498151 - RNA, 21 nt, Human
caggccccaggccuggggugc

SEQ ID NO: 498152 - RNA, 22 nt, Human
aauguguacuuuuucaugcuca

SEQ ID NO: 498153 - RNA, 22 nt, Human
gcuuucuugguucugcaggggc

SEQ ID NO: 498154 - RNA, 18 nt, Human
ccaaggccccugcugggg

SEQ ID NO: 498155 - RNA, 22 nt, Human
ucacagaaauaagauaguuauu

SEQ ID NO: 498156 - RNA, 22 nt, Human
augagguaauacuuucaguccu

SEQ ID NO: 498157 - RNA, 22 nt, Human
uucagcacaguucaagauggua

SEQ ID NO: 498158 - RNA, 22 nt, Human
uuaauuacaaaacacauagguu

SEQ ID NO: 498159 - RNA, 22 nt, Human
auaugcaagcacauagaauacu

SEQ ID NO: 498160 - RNA, 22 nt, Human
cucccaggguagggagagacua

SEQ ID NO: 498161 - RNA, 22 nt, Human
cagaugaggcaaccucauugcu

SEQ ID NO: 498162 - RNA, 22 nt, Human
ggugaaggaggaagcugaugga

SEQ ID NO: 498163 - RNA, 22 nt, Human
aggaaucaggagaugagcacgg

SEQ ID NO: 498164 - RNA, 22 nt, Human
gugcccugugaacuguaaggaa

SEQ ID NO: 498165 - RNA, 22 nt, Human
uuucucauagucaugccucuua

SEQ ID NO: 498166 - RNA, 22 nt, Human
gcaggggcugcugggaacucgg

SEQ ID NO: 498167 - RNA, 19 nt, Human
acauuuaaauucagaucuc

SEQ ID NO: 498168 - RNA, 22 nt, Human
uagauaugaugagucacuugag

SEQ ID NO: 498169 - RNA, 22 nt, Human
uggccuggcugcccugucugga

SEQ ID NO: 498170 - RNA, 22 nt, Human
ggcuuuauuucacuguaccaua

SEQ ID NO: 498171 - RNA, 22 nt, Human
aaaugugucaguuucauucucu

SEQ ID NO: 498172 - RNA, 22 nt, Human
uagggcaguuauaacauuagug

SEQ ID NO: 498173 - RNA, 22 nt, Human
uaaguucucaauacauuguagc

SEQ ID NO: 498174 - RNA, 22 nt, Human
agcagccaaccuuacauucauc

SEQ ID NO: 498175 - RNA, 22 nt, Human
gccagcagcccagaaggacuuu

SEQ ID NO: 498176 - RNA, 22 nt, Human
acagauuuauugaagcugcugc

SEQ ID NO: 498177 - RNA, 23 nt, Human
ccaggcucuuucaccugcuauuc

SEQ ID NO: 498178 - RNA, 22 nt, Human
gccgaagcugccgucugguccu

SEQ ID NO: 498179 - RNA, 22 nt, Human
uaagaugguuguagauggacug

SEQ ID NO: 498180 - RNA, 22 nt, Human
uauuucuggcuuugagggugau

SEQ ID NO: 498181 - RNA, 22 nt, Human
guggagccaggaucuccgcaca

SEQ ID NO: 498182 - RNA, 22 nt, Human
cauggccagcccugagguucag

SEQ ID NO: 498183 - RNA, 22 nt, Human
auuuccaguccuaaugaucugg

SEQ ID NO: 498184 - RNA, 22 nt, Human
aaaagacaucuauuucaggcag

SEQ ID NO: 498185 - RNA, 22 nt, Human
gauuuauugucccuguccugcu

SEQ ID NO: 498186 - RNA, 22 nt, Human
cauucaaacauuaauuuauuca

SEQ ID NO: 498187 - RNA, 22 nt, Human
ugcaggugucugggggcaacag

SEQ ID NO: 498188 - RNA, 22 nt, Human
auguaucaugcaggguccauga

SEQ ID NO: 498189 - RNA, 22 nt, Human
agcagcagaucaaacaggcuug

SEQ ID NO: 498190 - RNA, 22 nt, Human
gggaagaagacauggugaaggc

SEQ ID NO: 498191 - RNA, 22 nt, Human
caccagguggaaaugucacagc

SEQ ID NO: 498192 - RNA, 22 nt, Human
gagccugggacugggggucaug

SEQ ID NO: 498193 - RNA, 22 nt, Human
agggcugcugaggaagccuugc

SEQ ID NO: 498194 - RNA, 22 nt, Human
caguuucuguuuuaaauagcag

SEQ ID NO: 498195 - RNA, 22 nt, Human
accagagcuuacaugcuagaaa

SEQ ID NO: 498196 - RNA, 22 nt, Human
aaucaguuaggguguuaaugag

SEQ ID NO: 498197 - RNA, 22 nt, Human
agagccugugggagaugcagcu

SEQ ID NO: 498198 - RNA, 22 nt, Human
uccaggcauuccagccauucca

SEQ ID NO: 498199 - RNA, 22 nt, Human
gggcuccaacggugagcaugga

SEQ ID NO: 498200 - RNA, 22 nt, Human
agggccugggccagcacccuuu

SEQ ID NO: 498201 - RNA, 22 nt, Human
aaagcuucuauucacuuacuug

SEQ ID NO: 498202 - RNA, 22 nt, Human
ggaaggaggggcaaagcaguuc

SEQ ID NO: 498203 - RNA, 22 nt, Human
gcugccucugcacagcucacuc

SEQ ID NO: 498204 - RNA, 18 nt, Human
ggcugccuguuccugaag

SEQ ID NO: 498205 - RNA, 22 nt, Human
acagauuuaggacuguagcgau

SEQ ID NO: 498206 - RNA, 22 nt, Human
ugaugaaaauaugauucugagg

SEQ ID NO: 498207 - RNA, 22 nt, Human
caaaguuaugaaugauaagauu

SEQ ID NO: 498208 - RNA, 22 nt, Human
ugcuggcccaugaagacgcagu

SEQ ID NO: 498209 - RNA, 22 nt, Human
agucagugaaaacuagaauguu

SEQ ID NO: 498210 - RNA, 22 nt, Human
cauuuauucaugaucuguagcu

SEQ ID NO: 498211 - RNA, 22 nt, Human
uggccucugggaaagcagauuc

SEQ ID NO: 498212 - RNA, 16 nt, Human
ccucuggcaauuagau

SEQ ID NO: 498213 - RNA, 22 nt, Human
aagggcuggaucucucugagca

SEQ ID NO: 498214 - RNA, 22 nt, Human
gggaaggcagugggaggaacug

SEQ ID NO: 498215 - RNA, 19 nt, Human
cagaguacaccagauagga

SEQ ID NO: 498216 - RNA, 20 nt, Human
aguaggggaaugcaagagca

SEQ ID NO: 498217 - RNA, 22 nt, Human
ugugagucuaggucaggguguu

SEQ ID NO: 498218 - RNA, 22 nt, Human
cggcaggugugcucacucugcc

SEQ ID NO: 498219 - RNA, 22 nt, Human
acaagagauuaucuacagauga

SEQ ID NO: 498220 - RNA, 22 nt, Human
gugaauaacuuucuauguuaau

SEQ ID NO: 498221 - RNA, 22 nt, Human
ggcagcuguggacgucgucauu

SEQ ID NO: 498222 - RNA, 21 nt, Human
agcaggucuacagguucauag

SEQ ID NO: 498223 - RNA, 22 nt, Human
cuggccagaguuggagggugug

SEQ ID NO: 498224 - RNA, 22 nt, Human
uggcuucaucugcagcacugcc

SEQ ID NO: 498225 - RNA, 18 nt, Human
gaaagugcggggcagggg

SEQ ID NO: 498226 - RNA, 22 nt, Human
aauaaaauggucaguuuucuca

SEQ ID NO: 498227 - RNA, 22 nt, Human
cugagccagcuggcaugugcua

SEQ ID NO: 498228 - RNA, 22 nt, Human
aacagaacccgagugugaaucu

SEQ ID NO: 498229 - RNA, 22 nt, Human
uuuguguaccuuguacauuugu

SEQ ID NO: 498230 - RNA, 22 nt, Human
aagaauguucuuguagucauga

SEQ ID NO: 498231 - RNA, 20 nt, Human
cuggccagaacgccuacaca

SEQ ID NO: 498232 - RNA, 22 nt, Human
aggucagguaucagcagguauu

SEQ ID NO: 498233 - RNA, 22 nt, Human
uuccaagugggggaagcugagu

SEQ ID NO: 498234 - RNA, 22 nt, Human
ugggcagauuaaugcaguggcu

SEQ ID NO: 498235 - RNA, 22 nt, Human
caugagagauccuucaugagag

SEQ ID NO: 498236 - RNA, 22 nt, Human
gggaaagaccuuccuggggugu

SEQ ID NO: 498237 - RNA, 22 nt, Human
aaugcacaugucuuggccucac

SEQ ID NO: 498238 - RNA, 21 nt, Human
aaguaaaucagagaaauaacc

SEQ ID NO: 498239 - RNA, 23 nt, Human
ggcacugaagcuacaauggugag

SEQ ID NO: 498240 - RNA, 22 nt, Human
uuuagggaaauugaggguuaag

SEQ ID NO: 498241 - RNA, 22 nt, Human
ccagaggcuggggaaggauaca

SEQ ID NO: 498242 - RNA, 22 nt, Human
ucaccugggagggcugugguag

SEQ ID NO: 498243 - RNA, 22 nt, Human
gccccagguugccugucccagg

SEQ ID NO: 498244 - RNA, 22 nt, Human
cugcugguuagucuuaguggga

SEQ ID NO: 498245 - RNA, 23 nt, Human
uacagaaggaguagucacuaaga

SEQ ID NO: 498246 - RNA, 22 nt, Human
cugugaaugcuaguaagagugc

SEQ ID NO: 498247 - RNA, 22 nt, Human
aagaauucacugguagagucaa

SEQ ID NO: 498248 - RNA, 22 nt, Human
cugaggaugguguggucuucuc

SEQ ID NO: 498249 - RNA, 22 nt, Human
ugccagaagugcuuuauaagug

SEQ ID NO: 498250 - RNA, 22 nt, Human
ugaagcaggaucguuugcuuca

SEQ ID NO: 498251 - RNA, 22 nt, Human
agugagggaugaagaacugcgg

SEQ ID NO: 498252 - RNA, 21 nt, Human
cagcccagcccauugacagug

SEQ ID NO: 498253 - RNA, 22 nt, Human
cagggagcuggugccagccgac

SEQ ID NO: 498254 - RNA, 23 nt, Human
ucuccuggcugcacuguggccac

SEQ ID NO: 498255 - RNA, 22 nt, Human
gaauauauuucucuuaccuuua

SEQ ID NO: 498256 - RNA, 22 nt, Human
gcugcugggggaacaguuaaaa

SEQ ID NO: 498257 - RNA, 19 nt, Human
augagcuggcauuucaggu

SEQ ID NO: 498258 - RNA, 22 nt, Human
cccaggcagucuggcucuaaag

SEQ ID NO: 498259 - RNA, 22 nt, Human
gcacagccacguaaugugguca

SEQ ID NO: 498260 - RNA, 22 nt, Human
acauuucuaauuuaauguaaca

SEQ ID NO: 498261 - RNA, 19 nt, Human
cuggcugcaaugccagggu

SEQ ID NO: 498262 - RNA, 22 nt, Human
gaauuacaugacccugaguaga

SEQ ID NO: 498263 - RNA, 22 nt, Human
acuuugaaggggaacauuuuaa

SEQ ID NO: 498264 - RNA, 22 nt, Human
agggcucccgugaggugacugc

SEQ ID NO: 498265 - RNA, 22 nt, Human
uauguaaaguagauggcaggua

SEQ ID NO: 498266 - RNA, 22 nt, Human
cuuugcuugacacugugauugu

SEQ ID NO: 498267 - RNA, 22 nt, Human
cagagccaaaccucagggcccg

SEQ ID NO: 498268 - RNA, 22 nt, Human
gaggccacagcuaucagggaca

SEQ ID NO: 498269 - RNA, 22 nt, Human
gucccagaggacagggucacau

SEQ ID NO: 498270 - RNA, 23 nt, Human
ugugaauugaggacaucaaaagc

SEQ ID NO: 498271 - RNA, 22 nt, Human
cacuggggaaaacaggcuucuu

SEQ ID NO: 498272 - RNA, 22 nt, Human
uuuuucauugcagccucucucc

SEQ ID NO: 498273 - RNA, 22 nt, Human
gcuggccauagaagccaaagag

SEQ ID NO: 498274 - RNA, 22 nt, Human
ucuuuaauuguggaagagcagc

SEQ ID NO: 498275 - RNA, 17 nt, Human
aagcauuuaauuugcua

SEQ ID NO: 498276 - RNA, 22 nt, Human
caaaguccauaguuuacaauag

SEQ ID NO: 498277 - RNA, 22 nt, Human
ggaggcuccacugcucuuccug

SEQ ID NO: 498278 - RNA, 22 nt, Human
uccaggaggaggaaggcugcca

SEQ ID NO: 498279 - RNA, 22 nt, Human
gcauugaauccuaucaggcaaa

SEQ ID NO: 498280 - RNA, 18 nt, Human
ugcuuuaugcuuauauaa

SEQ ID NO: 498281 - RNA, 22 nt, Human
ggagucuguuuuacaugcagga

SEQ ID NO: 498282 - RNA, 22 nt, Human
aguaugaacggaaggccuggga

SEQ ID NO: 498283 - RNA, 21 nt, Human
agguggagugcuuagcaucca

SEQ ID NO: 498284 - RNA, 20 nt, Human
uccagggcaacuagagugug

SEQ ID NO: 498285 - RNA, 22 nt, Human
uugcucuguaauaaucuggggu

SEQ ID NO: 498286 - RNA, 19 nt, Human
gcuccuggaugaccugugg

SEQ ID NO: 498287 - RNA, 22 nt, Human
uccugcagaccucagucagguc

SEQ ID NO: 498288 - RNA, 22 nt, Human
gucacuggggccacaugcagaa

SEQ ID NO: 498289 - RNA, 22 nt, Human
cacacacugacaccuuaucuug

SEQ ID NO: 498290 - RNA, 23 nt, Human
cugcagagaacugagggacagcc

SEQ ID NO: 498291 - RNA, 22 nt, Human
agacucaagcagauaggaauua

SEQ ID NO: 498292 - RNA, 22 nt, Human
ggaggccuagccagcuccaguu

SEQ ID NO: 498293 - RNA, 22 nt, Human
aagaacaacugcuuuaaaagca

SEQ ID NO: 498294 - RNA, 22 nt, Human
aaaugucaaggugauagaugca

SEQ ID NO: 498295 - RNA, 22 nt, Human
aauuucaaguggcaucuuugau

SEQ ID NO: 498296 - RNA, 21 nt, Human
acagauuuuauaucucugcug

SEQ ID NO: 498297 - RNA, 22 nt, Human
ggcuggccucaggguccucgcu

SEQ ID NO: 498298 - RNA, 22 nt, Human
gcagguguggaguggggugagc

SEQ ID NO: 498299 - RNA, 22 nt, Human
gccugugcuguucccucugcca

SEQ ID NO: 498300 - RNA, 22 nt, Human
caggugaagaggauaaaaaguu

SEQ ID NO: 498301 - RNA, 22 nt, Human
ccucaggggcuuuucguuguug

SEQ ID NO: 498302 - RNA, 22 nt, Human
ucgagucauguucucccauuaa

SEQ ID NO: 498303 - RNA, 22 nt, Human
gugcaaguccagaaagaacucu

SEQ ID NO: 498304 - RNA, 23 nt, Human
cauaugaauuuuagaggcaguuu

SEQ ID NO: 498305 - RNA, 22 nt, Human
agcuuuggagacugacuccauc

SEQ ID NO: 498306 - RNA, 22 nt, Human
uuggaggacuaguuaagagacc

SEQ ID NO: 498307 - RNA, 18 nt, Human
acagcagguuucauucuu

SEQ ID NO: 498308 - RNA, 22 nt, Human
uagccuucucaagacaaaguug

SEQ ID NO: 498309 - RNA, 22 nt, Human
guguccugcauuggcucugccc

SEQ ID NO: 498310 - RNA, 22 nt, Human
ccucagugcguacugaacagug

SEQ ID NO: 498311 - RNA, 22 nt, Human
cacugcauggaugauggcugua

SEQ ID NO: 498312 - RNA, 22 nt, Human
caggcugucugaauggaggccc

SEQ ID NO: 498313 - RNA, 22 nt, Human
cagaggaggccaccgcauaggc

SEQ ID NO: 498314 - RNA, 22 nt, Human
guggagcccugguagggacccc

SEQ ID NO: 498315 - RNA, 22 nt, Human
gcagugcuuuagucuguccuuu

SEQ ID NO: 498316 - RNA, 22 nt, Human
ccugccugcaaaaugggacaag

SEQ ID NO: 498317 - RNA, 22 nt, Human
ugggcagugagaaaggucaggu

SEQ ID NO: 498318 - RNA, 22 nt, Human
uuuucauuuacauuagggaaga

SEQ ID NO: 498319 - RNA, 22 nt, Human
uuagccauauagaaaaagagcu

SEQ ID NO: 498320 - RNA, 22 nt, Human
agcaggcaccagggcucguccu

SEQ ID NO: 498321 - RNA, 22 nt, Human
gggcuggcucccagguguugaa

SEQ ID NO: 498322 - RNA, 23 nt, Human
uucuuauuuacuuuggaaucucc

SEQ ID NO: 498323 - RNA, 22 nt, Human
uggccaguagauaggcaggcaa

SEQ ID NO: 498324 - RNA, 22 nt, Human
aaaguguagagacuuuggaacc

SEQ ID NO: 498325 - RNA, 22 nt, Human
cuggcucaugugaugagggcaa

SEQ ID NO: 498326 - RNA, 22 nt, Human
augauguuaccaguacuuagag

SEQ ID NO: 498327 - RNA, 22 nt, Human
ugugccugugacagcgaccugg

SEQ ID NO: 498328 - RNA, 22 nt, Human
augcuucagugcuaccuucaaa

SEQ ID NO: 498329 - RNA, 19 nt, Human
cagagcagugguuccugaa

SEQ ID NO: 498330 - RNA, 22 nt, Human
uaaauguauaggcacuaaaccu

SEQ ID NO: 498331 - RNA, 22 nt, Human
ccaacaguccagaugagauggu

SEQ ID NO: 498332 - RNA, 22 nt, Human
cugggcugagccugggcugugu

SEQ ID NO: 498333 - RNA, 22 nt, Human
ccagcuuuucuuaucauuauaa

SEQ ID NO: 498334 - RNA, 22 nt, Human
augaaggcuguguggagccccc

SEQ ID NO: 498335 - RNA, 22 nt, Human
aggaaauguaguccucaucucc

SEQ ID NO: 498336 - RNA, 22 nt, Human
uagguucacacaucuuccagau

SEQ ID NO: 498337 - RNA, 22 nt, Human
ugcaggagaaaguacggagcgu

SEQ ID NO: 498338 - RNA, 22 nt, Human
uggcagagaacacacaugauuc

SEQ ID NO: 498339 - RNA, 22 nt, Human
ucuauuuuauacucaaaucuuc

SEQ ID NO: 498340 - RNA, 20 nt, Human
cucauguggcaccaggcacu

SEQ ID NO: 498341 - RNA, 22 nt, Human
cugggcaggagaggugguugga

SEQ ID NO: 498342 - RNA, 22 nt, Human
aagauuuccuggauguaauucc

SEQ ID NO: 498343 - RNA, 22 nt, Human
uagaggccugaaagaaugauca

SEQ ID NO: 498344 - RNA, 22 nt, Human
cccaggguagcugagcuggcag

SEQ ID NO: 498345 - RNA, 22 nt, Human
agaaaucuuugaaguguaaugu

SEQ ID NO: 498346 - RNA, 22 nt, Human
ccaggcugaauauguuccaggg

SEQ ID NO: 498347 - RNA, 22 nt, Human
ucuccaggccuuucccaucuua

SEQ ID NO: 498348 - RNA, 22 nt, Human
ggaggagcacuugacggggucu

SEQ ID NO: 498349 - RNA, 22 nt, Human
cagagggaccagaacauacugu

SEQ ID NO: 498350 - RNA, 22 nt, Human
ugucugaaucucgguuuccuca

SEQ ID NO: 498351 - RNA, 19 nt, Human
aaaguuuuauucucauuug

SEQ ID NO: 498352 - RNA, 22 nt, Human
ugcuucugaacucagcaugugg

SEQ ID NO: 498353 - RNA, 22 nt, Human
uauguacauguuaaagggcaaa

SEQ ID NO: 498354 - RNA, 22 nt, Human
cacagcaauagcuaacugauac

SEQ ID NO: 498355 - RNA, 22 nt, Human
cccagagccucauucuguuggg

SEQ ID NO: 498356 - RNA, 22 nt, Human
gaaggccaguuuugagauaggu

SEQ ID NO: 498357 - RNA, 22 nt, Human
uucaauucugcucugaucuuag

SEQ ID NO: 498358 - RNA, 22 nt, Human
cagcacaucuucugaucuuuug

SEQ ID NO: 498359 - RNA, 22 nt, Human
ucagcuuuccugcagcuaaggg

SEQ ID NO: 498360 - RNA, 22 nt, Human
acuuuccuagacuucagugaca

SEQ ID NO: 498361 - RNA, 22 nt, Human
ggcaggcugggugucauggagu

SEQ ID NO: 498362 - RNA, 22 nt, Human
ucaaagcaugguuuugaaagac

SEQ ID NO: 498363 - RNA, 22 nt, Human
ucaguauccacaaaugcucaaa

SEQ ID NO: 498364 - RNA, 22 nt, Human
guucaaguucauaucucuuaac

SEQ ID NO: 498365 - RNA, 22 nt, Human
ggugcaggagcggggugcucgg

SEQ ID NO: 498366 - RNA, 22 nt, Human
cauuuggaccaaaauagccaac

SEQ ID NO: 498367 - RNA, 19 nt, Human
auaaggcaggaggaaauuu

SEQ ID NO: 498368 - RNA, 22 nt, Human
agcaucugcauauugggagacc

SEQ ID NO: 498369 - RNA, 22 nt, Human
cuguauuucccacauucucuau

SEQ ID NO: 498370 - RNA, 22 nt, Human
gaagcccuauccucuccuggga

SEQ ID NO: 498371 - RNA, 22 nt, Human
gggcuggaggaccggccucgga

SEQ ID NO: 498372 - RNA, 22 nt, Human
ccaggagcaacuugaaggcaag

SEQ ID NO: 498373 - RNA, 22 nt, Human
aacagcuugaggaauaucauca

SEQ ID NO: 498374 - RNA, 22 nt, Human
ugcugaauuaaacucuaugugg

SEQ ID NO: 498375 - RNA, 20 nt, Human
caggccagagguuugauggc

SEQ ID NO: 498376 - RNA, 22 nt, Human
aagcuuggaagucuuccuuuca

SEQ ID NO: 498377 - RNA, 22 nt, Human
cagaccuggaaaacaggcuugc

SEQ ID NO: 498378 - RNA, 22 nt, Human
ccagugcgcaggcgccaccugu

SEQ ID NO: 498379 - RNA, 22 nt, Human
caaggccaagguuuugugaacu

SEQ ID NO: 498380 - RNA, 22 nt, Human
auguuuuauauuuugcagcagu

SEQ ID NO: 498381 - RNA, 22 nt, Human
ccuggcucucugcagauccugg

SEQ ID NO: 498382 - RNA, 22 nt, Human
agagaggcugcuggacuauaug

SEQ ID NO: 498383 - RNA, 22 nt, Human
cuucugggauuuuugaagacuc

SEQ ID NO: 498384 - RNA, 22 nt, Human
gguccuugggucuccuguguuu

SEQ ID NO: 498385 - RNA, 22 nt, Human
auuauucaaucauauuaaaagu

SEQ ID NO: 498386 - RNA, 22 nt, Human
caggaggaacaagagguucugg

SEQ ID NO: 498387 - RNA, 20 nt, Human
cccagggaccugagcuccau

SEQ ID NO: 498388 - RNA, 23 nt, Human
ucuuuacauacugaugaguucuc

SEQ ID NO: 498389 - RNA, 22 nt, Human
gugccaaaagcuauaauuuggu

SEQ ID NO: 498390 - RNA, 22 nt, Human
gccuggagaccugcuccucuac

SEQ ID NO: 498391 - RNA, 22 nt, Human
cagggcugguuugucgaagaaa

SEQ ID NO: 498392 - RNA, 22 nt, Human
gacacagagcucacagucuccu

SEQ ID NO: 498393 - RNA, 22 nt, Human
gcuuaguggugugcaaaggggu

SEQ ID NO: 498394 - RNA, 22 nt, Human
aucgagggugaguacagcggac

SEQ ID NO: 498395 - RNA, 22 nt, Human
agagggggaaaauagagguguu

SEQ ID NO: 498396 - RNA, 22 nt, Human
gccagcaaagcaaguugucagc

SEQ ID NO: 498397 - RNA, 21 nt, Human
cuugaaagguagagucuacag

SEQ ID NO: 498398 - RNA, 22 nt, Human
uguggcugggaagaagguaacu

SEQ ID NO: 498399 - RNA, 22 nt, Human
ucaguguucagcggugugugca

SEQ ID NO: 498400 - RNA, 22 nt, Human
uggggacacagagguucguugg

SEQ ID NO: 498401 - RNA, 22 nt, Human
auauuuguugaguucuuaugau

SEQ ID NO: 498402 - RNA, 22 nt, Human
gaaugaguuaauauuugcuugg

SEQ ID NO: 498403 - RNA, 22 nt, Human
agguucaguaaauguuaguuga

SEQ ID NO: 498404 - RNA, 22 nt, Human
ugcauugauagaaaaacaugga

SEQ ID NO: 498405 - RNA, 22 nt, Human
aauggcucugauguuguuguga

SEQ ID NO: 498406 - RNA, 22 nt, Human
uuaucugucuaucaagacuagc

SEQ ID NO: 498407 - RNA, 22 nt, Human
auuuccauguccaaaaauuagu

SEQ ID NO: 498408 - RNA, 22 nt, Human
aguugaaauuagaguccuggcu

SEQ ID NO: 498409 - RNA, 22 nt, Human
acaauuccacauggcaugcagg

SEQ ID NO: 498410 - RNA, 22 nt, Human
cucuuuccaggguaccccaggu

SEQ ID NO: 498411 - RNA, 22 nt, Human
uuuuuccuagcgauuugucagc

SEQ ID NO: 498412 - RNA, 22 nt, Human
uuuucaggugcaguaaucauau

SEQ ID NO: 498413 - RNA, 22 nt, Human
cugugaggcccugggugcugga

SEQ ID NO: 498414 - RNA, 22 nt, Human
ucagugcauuaauaauaucagu

SEQ ID NO: 498415 - RNA, 18 nt, Human
guccauggccuccaccca

SEQ ID NO: 498416 - RNA, 22 nt, Human
agggcagagggugccucaccug

SEQ ID NO: 498417 - RNA, 22 nt, Human
gugcuuccaucuagagggucac

SEQ ID NO: 498418 - RNA, 22 nt, Human
accuggagaaagccucucccug

SEQ ID NO: 498419 - RNA, 22 nt, Human
auggccugggcccgcuucagau

SEQ ID NO: 498420 - RNA, 22 nt, Human
ucuuucuacaucauuugcuucu

SEQ ID NO: 498421 - RNA, 21 nt, Human
ugccagcauguaggcuaguug

SEQ ID NO: 498422 - RNA, 22 nt, Human
gcaguguucagugaagcaggag

SEQ ID NO: 498423 - RNA, 22 nt, Human
uuagccauuaauguccugugca

SEQ ID NO: 498424 - RNA, 23 nt, Human
uggagaauucuuccuuccacugu

SEQ ID NO: 498425 - RNA, 22 nt, Human
cugugggaugggaccucagcug

SEQ ID NO: 498426 - RNA, 22 nt, Human
augaaauguaugagucuggguu

SEQ ID NO: 498427 - RNA, 22 nt, Human
ugugacagccaguaaaguaagc

SEQ ID NO: 498428 - RNA, 19 nt, Human
uguccuguccugcucugac

SEQ ID NO: 498429 - RNA, 22 nt, Human
gaggccugguuuccagcauccu

SEQ ID NO: 498430 - RNA, 23 nt, Human
cagaugugcaacucuaggcaaug

SEQ ID NO: 498431 - RNA, 22 nt, Human
ugggaugggaucucgcuguguc

SEQ ID NO: 498432 - RNA, 22 nt, Human
aacagugucaggauuacagaua

SEQ ID NO: 498433 - RNA, 22 nt, Human
gagccuguguuuccuguagcca

SEQ ID NO: 498434 - RNA, 22 nt, Human
guugcugaaggcaugccagaga

SEQ ID NO: 498435 - RNA, 22 nt, Human
uuccaggauggcaauaaugaau

SEQ ID NO: 498436 - RNA, 22 nt, Human
cggggacacacuggcagcuccu

SEQ ID NO: 498437 - RNA, 22 nt, Human
ugucagggcuggacacagcugc

SEQ ID NO: 498438 - RNA, 22 nt, Human
ugggcagaggcagcagaaaccu

SEQ ID NO: 498439 - RNA, 22 nt, Human
aucucagggcuggagcccugga

SEQ ID NO: 498440 - RNA, 22 nt, Human
agggcagaaguacagacacuua

SEQ ID NO: 498441 - RNA, 22 nt, Human
agacuuugagcucuuagagaag

SEQ ID NO: 498442 - RNA, 22 nt, Human
gcuuucuaggcagagaugacug

SEQ ID NO: 498443 - RNA, 22 nt, Human
uauuccagugugaucuuuguag

SEQ ID NO: 498444 - RNA, 23 nt, Human
aagaguuuagagucuugcagagu

SEQ ID NO: 498445 - RNA, 22 nt, Human
uauuuugacgauuuuaugcaaa

SEQ ID NO: 498446 - RNA, 21 nt, Human
acagagcauaaugguguggca

SEQ ID NO: 498447 - RNA, 22 nt, Human
uaguagcaggaaucugaaggua

SEQ ID NO: 498448 - RNA, 22 nt, Human
guccuucaagguccuuggugug

SEQ ID NO: 498449 - RNA, 22 nt, Human
accugggauggggccagguuua

SEQ ID NO: 498450 - RNA, 22 nt, Human
uuucagaugcaauuaauuuuca

SEQ ID NO: 498451 - RNA, 22 nt, Human
ugucuucaguaaaauacacuau

SEQ ID NO: 498452 - RNA, 18 nt, Human
cagaugagaugcaaucuc

SEQ ID NO: 498453 - RNA, 22 nt, Human
ugaugguuuuauuaauaggacc

SEQ ID NO: 498454 - RNA, 22 nt, Human
uggggaggacgggcgccuuccu

SEQ ID NO: 498455 - RNA, 22 nt, Human
acauggaagcaaaguucuauuu

SEQ ID NO: 498456 - RNA, 22 nt, Human
auacagaacucucaguuguaua

SEQ ID NO: 498457 - RNA, 22 nt, Human
gcccaggccggagagcagugcu

SEQ ID NO: 498458 - RNA, 22 nt, Human
gaaaauguuagcuucauaguca

SEQ ID NO: 498459 - RNA, 22 nt, Human
aaaaagauguccugaaguuuag

SEQ ID NO: 498460 - RNA, 22 nt, Human
gcugugugaaaacugggccugg

SEQ ID NO: 498461 - RNA, 22 nt, Human
ggcacugaaccaggacacaagc

SEQ ID NO: 498462 - RNA, 22 nt, Human
cuaguucugccauucaguguca

SEQ ID NO: 498463 - RNA, 22 nt, Human
ggccuccuguuggcuaguguga

SEQ ID NO: 498464 - RNA, 22 nt, Human
aucuggaauccuuguggacaau

SEQ ID NO: 498465 - RNA, 18 nt, Human
acagaacucaggggcacc

SEQ ID NO: 498466 - RNA, 22 nt, Human
gcugagcugaggcagggcuggg

SEQ ID NO: 498467 - RNA, 22 nt, Human
cuggcagcaguuaugaaacaau

SEQ ID NO: 498468 - RNA, 22 nt, Human
cuguccuugcuggccagguaug

SEQ ID NO: 498469 - RNA, 22 nt, Human
cccagccugaucucggccagcu

SEQ ID NO: 498470 - RNA, 22 nt, Human
uccugggcacaagugagucucc

SEQ ID NO: 498471 - RNA, 22 nt, Human
ugggccacaagccaugggacca

SEQ ID NO: 498472 - RNA, 22 nt, Human
uguguauuaccauuuuacagcu

SEQ ID NO: 498473 - RNA, 22 nt, Human
aaagaacaaauuagcuguuuua

SEQ ID NO: 498474 - RNA, 17 nt, Human
uggcuucccugggccac

SEQ ID NO: 498475 - RNA, 17 nt, Human
auguaagaagaaagcag

SEQ ID NO: 498476 - RNA, 22 nt, Human
gaggguggggaauagacugcua

SEQ ID NO: 498477 - RNA, 22 nt, Human
uacacauguauuuauguguaca

SEQ ID NO: 498478 - RNA, 22 nt, Human
ggccccacgggggaguccuagu

SEQ ID NO: 498479 - RNA, 22 nt, Human
cggcuggguagaggugccgggu

SEQ ID NO: 498480 - RNA, 22 nt, Human
acagaugaugugcacagauaga

SEQ ID NO: 498481 - RNA, 22 nt, Human
agagaggcauucggugauccca

SEQ ID NO: 498482 - RNA, 22 nt, Human
aggcagggcugggauuagacuc

SEQ ID NO: 498483 - RNA, 22 nt, Human
aacagaaaucauuuagggcucu

SEQ ID NO: 498484 - RNA, 22 nt, Human
ccucuggggguccucagagucu

SEQ ID NO: 498485 - RNA, 22 nt, Human
uuauuuaaaauguagguuggga

SEQ ID NO: 498486 - RNA, 22 nt, Human
gagcugucuggggacucugggu

SEQ ID NO: 498487 - RNA, 22 nt, Human
ucaggaaagaguguauccauca

SEQ ID NO: 498488 - RNA, 22 nt, Human
guuguauucuucaauaucagag

SEQ ID NO: 498489 - RNA, 22 nt, Human
ugugaaggacuuguuccauugu

SEQ ID NO: 498490 - RNA, 22 nt, Human
cacaguggcuuugcuggucucg

SEQ ID NO: 498491 - RNA, 22 nt, Human
ugcagccaauucauucauucuu

SEQ ID NO: 498492 - RNA, 22 nt, Human
ugcugccaccugguggcugaag

SEQ ID NO: 498493 - RNA, 22 nt, Human
cagauguggaaugcagcaggcu

SEQ ID NO: 498494 - RNA, 22 nt, Human
gauaugaaguggcauugugaag

SEQ ID NO: 498495 - RNA, 22 nt, Human
gcacagcccugagcgcaugucu

SEQ ID NO: 498496 - RNA, 22 nt, Human
augggaggaaggaggcccuuga

SEQ ID NO: 498497 - RNA, 22 nt, Human
cugauauucuuugagcugcuaa

SEQ ID NO: 498498 - RNA, 22 nt, Human
acagguguccucacagggggug

SEQ ID NO: 498499 - RNA, 22 nt, Human
auauucguggucaaguaaggcc

SEQ ID NO: 498500 - RNA, 22 nt, Human
cacagagagcuacgugcagcgu

SEQ ID NO: 498501 - RNA, 21 nt, Human
ugauuuccagaaaauuggccc

SEQ ID NO: 498502 - RNA, 22 nt, Human
uaauuuaauuccauggauucua

SEQ ID NO: 498503 - RNA, 22 nt, Human
agagaaggaaagcugacauggg

SEQ ID NO: 498504 - RNA, 22 nt, Human
aaggucuguauuagaguuucau

SEQ ID NO: 498505 - RNA, 22 nt, Human
ugcagucuggauguccucagau

SEQ ID NO: 498506 - RNA, 22 nt, Human
cccaggcuggagggcaguguca

SEQ ID NO: 498507 - RNA, 19 nt, Human
ugcuuccucaccaucuccc

SEQ ID NO: 498508 - RNA, 22 nt, Human
uaucauaaguuaauuaaacagu

SEQ ID NO: 498509 - RNA, 22 nt, Human
aggcuggagggcaauggcaaga

SEQ ID NO: 498510 - RNA, 22 nt, Human
aaaugcagauugucauucagga

SEQ ID NO: 498511 - RNA, 19 nt, Human
agggagaauuccaagagga

SEQ ID NO: 498512 - RNA, 22 nt, Human
ccagcugggucccugcuggggc

SEQ ID NO: 498513 - RNA, 22 nt, Human
ucccagagcucugacaccagcu

SEQ ID NO: 498514 - RNA, 22 nt, Human
ugcagggaaucuguggcuggac

SEQ ID NO: 498515 - RNA, 22 nt, Human
cucugcaugccuugcucagaca

SEQ ID NO: 498516 - RNA, 22 nt, Human
ggcuccucucuggccgcucccg

SEQ ID NO: 498517 - RNA, 22 nt, Human
uuugaaucugauauggcagcau

SEQ ID NO: 498518 - RNA, 22 nt, Human
acaaagauaagucagaaaguca

SEQ ID NO: 498519 - RNA, 22 nt, Human
uacacauccauguuuugacuuu

SEQ ID NO: 498520 - RNA, 22 nt, Human
ucccagcccagauuugugugac

SEQ ID NO: 498521 - RNA, 22 nt, Human
acccacgaagaugagcggcaug

SEQ ID NO: 498522 - RNA, 22 nt, Human
ugaaggagaaauggaaaguggg

SEQ ID NO: 498523 - RNA, 22 nt, Human
ccugugccauccugagcauccc

SEQ ID NO: 498524 - RNA, 22 nt, Human
ucacagugaugacgugggagca

SEQ ID NO: 498525 - RNA, 22 nt, Human
ggugaaggucuacugugugcca

SEQ ID NO: 498526 - RNA, 21 nt, Human
auuagcuucaaaagcuugucu

SEQ ID NO: 498527 - RNA, 22 nt, Human
uggucucugacucugaagaccc

SEQ ID NO: 498528 - RNA, 20 nt, Human
ugagcaccaagaaucaagaa

SEQ ID NO: 498529 - RNA, 22 nt, Human
ucaaugauaucagcaggaugug

SEQ ID NO: 498530 - RNA, 22 nt, Human
ucagcacugaaauucuucacau

SEQ ID NO: 498531 - RNA, 22 nt, Human
gggcagagguucaacuucaaca

SEQ ID NO: 498532 - RNA, 22 nt, Human
ggagucugaguccucauagaca

SEQ ID NO: 498533 - RNA, 22 nt, Human
cacugcagaucagaggcugaga

SEQ ID NO: 498534 - RNA, 22 nt, Human
gacauaauaaucugaccuagau

SEQ ID NO: 498535 - RNA, 22 nt, Human
aggaggccgcugaugggcuccc

SEQ ID NO: 498536 - RNA, 22 nt, Human
caggaaugaggucguaaguguc

SEQ ID NO: 498537 - RNA, 23 nt, Human
aguguuccaguugguugagagug

SEQ ID NO: 498538 - RNA, 22 nt, Human
gugccugugcggacucagggaa

SEQ ID NO: 498539 - RNA, 20 nt, Human
ggcacuggaagcacacagga

SEQ ID NO: 498540 - RNA, 22 nt, Human
caguggcuguuucuggaaggca

SEQ ID NO: 498541 - RNA, 23 nt, Human
gcucugagggcuuaucccuccca

SEQ ID NO: 498542 - RNA, 22 nt, Human
ugcagguggcagcggggcacca

SEQ ID NO: 498543 - RNA, 22 nt, Human
cucuagaguacgggcuggcaug

SEQ ID NO: 498544 - RNA, 22 nt, Human
aucuacaggauuuuacagaguu

SEQ ID NO: 498545 - RNA, 22 nt, Human
gcagggcuauuggaaggagaug

SEQ ID NO: 498546 - RNA, 21 nt, Human
uuuagggaggauauuuaacuu

SEQ ID NO: 498547 - RNA, 22 nt, Human
ugcagcugauuaaagggcagac

SEQ ID NO: 498548 - RNA, 22 nt, Human
ugguccugggcacaguauaugc

SEQ ID NO: 498549 - RNA, 22 nt, Human
cagguggccaguacucaaggau

SEQ ID NO: 498550 - RNA, 22 nt, Human
aggcugaggaucccuguguucu

SEQ ID NO: 498551 - RNA, 21 nt, Human
gagugucuaauccaggcuguc

SEQ ID NO: 498552 - RNA, 22 nt, Human
cggcuggguucggcugcaggcc

SEQ ID NO: 498553 - RNA, 22 nt, Human
gcacuagucaagugaacaauuu

SEQ ID NO: 498554 - RNA, 22 nt, Human
acaggcuuggggcucagacaga

SEQ ID NO: 498555 - RNA, 22 nt, Human
ucaagagagugcugcuuggggu

SEQ ID NO: 498556 - RNA, 22 nt, Human
agggaaggaggccauguguccc

SEQ ID NO: 498557 - RNA, 22 nt, Human
ggagaaaauugaugaaguuggc

SEQ ID NO: 498558 - RNA, 22 nt, Human
cacagaggaaaggcaguuggua

SEQ ID NO: 498559 - RNA, 22 nt, Human
uugaauaauaugcuucguucuc

SEQ ID NO: 498560 - RNA, 22 nt, Human
ccagcucucaaggcucccuggg

SEQ ID NO: 498561 - RNA, 22 nt, Human
ugaugaauaaacuugagaguca

SEQ ID NO: 498562 - RNA, 22 nt, Human
agcugcuggggagggcagacac

SEQ ID NO: 498563 - RNA, 22 nt, Human
uauuccagguauucuucaagag

SEQ ID NO: 498564 - RNA, 22 nt, Human
cucugggucuauaaugcagcug

SEQ ID NO: 498565 - RNA, 22 nt, Human
uuucauggcuaggacuagagug

SEQ ID NO: 498566 - RNA, 22 nt, Human
aaaggagauaaagggcccuuca

SEQ ID NO: 498567 - RNA, 22 nt, Human
auacaaaguauuaauccuggau

SEQ ID NO: 498568 - RNA, 22 nt, Human
uuuauuaauguagcauccaugg

SEQ ID NO: 498569 - RNA, 22 nt, Human
caagggcucacggucugcuggg

SEQ ID NO: 498570 - RNA, 22 nt, Human
ccugugcauccgguggucauug

SEQ ID NO: 498571 - RNA, 22 nt, Human
cagcagugugcaggugugcugg

SEQ ID NO: 498572 - RNA, 22 nt, Human
uauacacaccuccaaagcagga

SEQ ID NO: 498573 - RNA, 22 nt, Human
gcccagcuggcuuccagcacau

SEQ ID NO: 498574 - RNA, 22 nt, Human
ugcagggcccuugggguugaac

SEQ ID NO: 498575 - RNA, 22 nt, Human
aagcacuuagaagagugccugc

SEQ ID NO: 498576 - RNA, 22 nt, Human
aaaugugucauauucaaaguca

SEQ ID NO: 498577 - RNA, 20 nt, Human
auauguguacguguauacau

SEQ ID NO: 498578 - RNA, 22 nt, Human
uuccuggggcuccagcuaccag

SEQ ID NO: 498579 - RNA, 22 nt, Human
augggcaagggguaaggacacu

SEQ ID NO: 498580 - RNA, 22 nt, Human
caggcugaggguuaggccuuag

SEQ ID NO: 498581 - RNA, 20 nt, Human
ggcaggcuuuauauggaggg

SEQ ID NO: 498582 - RNA, 22 nt, Human
cugaggcugggcauggggucca

SEQ ID NO: 498583 - RNA, 22 nt, Human
ucucuggguaaaguucucucau

SEQ ID NO: 498584 - RNA, 22 nt, Human
uucuuacuaguauguuucagca

SEQ ID NO: 498585 - RNA, 22 nt, Human
ggcucugccugcccagcagcac

SEQ ID NO: 498586 - RNA, 17 nt, Human
ugagcaguagaagaugc

SEQ ID NO: 498587 - RNA, 22 nt, Human
ggagggccaucuugggugugau

SEQ ID NO: 498588 - RNA, 22 nt, Human
aggacaaaggaccagaucugga

SEQ ID NO: 498589 - RNA, 19 nt, Human
aguagcagaaagugcagug

SEQ ID NO: 498590 - RNA, 22 nt, Human
caauagcaggucuacagagaga

SEQ ID NO: 498591 - RNA, 22 nt, Human
uauuugagcgaagcaguguuuu

SEQ ID NO: 498592 - RNA, 22 nt, Human
uuuagaguugaguauucauugg

SEQ ID NO: 498593 - RNA, 22 nt, Human
gcugccuguugaagggucugug

SEQ ID NO: 498594 - RNA, 22 nt, Human
ucucuucacacuaccccugugu

SEQ ID NO: 498595 - RNA, 22 nt, Human
gacccugagcaaaagcaguucu

SEQ ID NO: 498596 - RNA, 23 nt, Human
guggccuccccggaaugccucgc

SEQ ID NO: 498597 - RNA, 22 nt, Human
cucagcagugacaagagaguau

SEQ ID NO: 498598 - RNA, 22 nt, Human
ugcugucccuaagucucuucaa

SEQ ID NO: 498599 - RNA, 22 nt, Human
ccugcugggccugagcaaugag

SEQ ID NO: 498600 - RNA, 22 nt, Human
uuaguuaguggggcugucaguc

SEQ ID NO: 498601 - RNA, 22 nt, Human
gcugaggccaggccccaccgga

SEQ ID NO: 498602 - RNA, 20 nt, Human
acccagcucugugcccuggg

SEQ ID NO: 498603 - RNA, 22 nt, Human
gccuccugguugcuucuccaac

SEQ ID NO: 498604 - RNA, 22 nt, Human
ggcuuuaguguagguuucuguu

SEQ ID NO: 498605 - RNA, 22 nt, Human
gcucccuccaugaggcagaccg

SEQ ID NO: 498606 - RNA, 23 nt, Human
agcagguagguugaaauuuuccu

SEQ ID NO: 498607 - RNA, 19 nt, Human
gggcuuggggcugaagccu

SEQ ID NO: 498608 - RNA, 22 nt, Human
ggacucucaggcugucggcuuc

SEQ ID NO: 498609 - RNA, 22 nt, Human
gggcuccagaguccauguucuu

SEQ ID NO: 498610 - RNA, 22 nt, Human
cagcaccagcauauuccagggc

SEQ ID NO: 498611 - RNA, 22 nt, Human
gcagaggucucuucaaaauaau

SEQ ID NO: 498612 - RNA, 22 nt, Human
auggcugcagagaccugaagaa

SEQ ID NO: 498613 - RNA, 22 nt, Human
cauugcacucuggcuggaacgg

SEQ ID NO: 498614 - RNA, 22 nt, Human
aggcauggggcugcagucaggu

SEQ ID NO: 498615 - RNA, 22 nt, Human
caggucuuuguugcagcaugga

SEQ ID NO: 498616 - RNA, 22 nt, Human
gcccagcaccucucucaggguu

SEQ ID NO: 498617 - RNA, 22 nt, Human
ggagugaaucacuagaugcaga

SEQ ID NO: 498618 - RNA, 22 nt, Human
aagaggaacugggggcugaguc

SEQ ID NO: 498619 - RNA, 22 nt, Human
gugcugaauccacucuuaggaa

SEQ ID NO: 498620 - RNA, 22 nt, Human
cugggucucaggaguucugagg

SEQ ID NO: 498621 - RNA, 17 nt, Human
uucaaugauuaaugcau

SEQ ID NO: 498622 - RNA, 22 nt, Human
cacaaggagguccugaggaagc

SEQ ID NO: 498623 - RNA, 22 nt, Human
gcuggcuggaaugggagaagaa

SEQ ID NO: 498624 - RNA, 22 nt, Human
uacauucuggaaaggcacagac

SEQ ID NO: 498625 - RNA, 22 nt, Human
cagcucccagagugaccagcag

SEQ ID NO: 498626 - RNA, 22 nt, Human
uuucugcaaacuuccacgucuc

SEQ ID NO: 498627 - RNA, 22 nt, Human
aaacagcagcuguuuaauuugc

SEQ ID NO: 498628 - RNA, 22 nt, Human
gcagacuguaucaaugucagua

SEQ ID NO: 498629 - RNA, 20 nt, Human
gccagcccugacacaggagc

SEQ ID NO: 498630 - RNA, 22 nt, Human
uggcucaggcuugaaaauagau

SEQ ID NO: 498631 - RNA, 22 nt, Human
aacuguaauuuuuacauaguaa

SEQ ID NO: 498632 - RNA, 22 nt, Human
agggcuuucggcacucugaggg

SEQ ID NO: 498633 - RNA, 22 nt, Human
cagucucugugccagauccugg

SEQ ID NO: 498634 - RNA, 22 nt, Human
gaaagugcaugugcccaccauu

SEQ ID NO: 498635 - RNA, 22 nt, Human
aagcacaggaucuugaggagcg

SEQ ID NO: 498636 - RNA, 22 nt, Human
uccaggcugggcugaagggugc

SEQ ID NO: 498637 - RNA, 22 nt, Human
acaguguucaaaccacuaggcu

SEQ ID NO: 498638 - RNA, 22 nt, Human
caggagcagaggguggucagca

SEQ ID NO: 498639 - RNA, 22 nt, Human
aggcuuuggaaucagaguucug

SEQ ID NO: 498640 - RNA, 22 nt, Human
acucugugugaguagagccugu

SEQ ID NO: 498641 - RNA, 21 nt, Human
cagugcucaaucugacagugg

SEQ ID NO: 498642 - RNA, 23 nt, Human
ugaagguauuaccugagaugcuc

SEQ ID NO: 498643 - RNA, 22 nt, Human
uucaaaacaaucuguuugcauu

SEQ ID NO: 498644 - RNA, 22 nt, Human
aguggcugguaguuacugagca

SEQ ID NO: 498645 - RNA, 21 nt, Human
cauugucgacauuuuccccuc

SEQ ID NO: 498646 - RNA, 18 nt, Human
gagcugagaagaggaugc

SEQ ID NO: 498647 - RNA, 22 nt, Human
ucccagaaaaaggaggcuauga

SEQ ID NO: 498648 - RNA, 22 nt, Human
ccacagaaaauaaagcacgauu

SEQ ID NO: 498649 - RNA, 20 nt, Human
uucaugggagcaaagaggcc

SEQ ID NO: 498650 - RNA, 20 nt, Human
gcagcugaaaguaugacacc

SEQ ID NO: 498651 - RNA, 22 nt, Human
auaguggugagcugcauuuaug

SEQ ID NO: 498652 - RNA, 22 nt, Human
acacccaggcuggcgugcagug

SEQ ID NO: 498653 - RNA, 22 nt, Human
ucagugcuuauauucugagccu

SEQ ID NO: 498654 - RNA, 22 nt, Human
aguauuucuaguugguucuacu

SEQ ID NO: 498655 - RNA, 22 nt, Human
aaggcugauuagacugauagcu

SEQ ID NO: 498656 - RNA, 22 nt, Human
gccucaguugaucugugugagc

SEQ ID NO: 498657 - RNA, 22 nt, Human
cugccagcagaggccagcgcug

SEQ ID NO: 498658 - RNA, 22 nt, Human
gcuggcuccucuguccucacgg

SEQ ID NO: 498659 - RNA, 22 nt, Human
ccagguggcuucugcccgaugu

SEQ ID NO: 498660 - RNA, 22 nt, Human
ucaggcucaaagggccggauga

SEQ ID NO: 498661 - RNA, 18 nt, Human
cccucuugcacaaagcaa

SEQ ID NO: 498662 - RNA, 22 nt, Human
ccaguccuggccaguaacauga

SEQ ID NO: 498663 - RNA, 22 nt, Human
ccuccucugggaagauucagag

SEQ ID NO: 498664 - RNA, 22 nt, Human
uugcucaggcuuagagcuacua

SEQ ID NO: 498665 - RNA, 22 nt, Human
augcaaaaguaguugcaguuuu

SEQ ID NO: 498666 - RNA, 16 nt, Human
cuguggcucccagguu

SEQ ID NO: 498667 - RNA, 23 nt, Human
acaaaugcccauacaucuaguuc

SEQ ID NO: 498668 - RNA, 20 nt, Human
acacaugucaagcuaaaggc

SEQ ID NO: 498669 - RNA, 22 nt, Human
cauuaauaaacauuucagaaga

SEQ ID NO: 498670 - RNA, 19 nt, Human
aggcacagguugucuggac

SEQ ID NO: 498671 - RNA, 22 nt, Human
cuuagcuuuguccuaggucucu

SEQ ID NO: 498672 - RNA, 22 nt, Human
acaggcugcugagccauuugcu

SEQ ID NO: 498673 - RNA, 22 nt, Human
uuccuugguagagagaauauuu

SEQ ID NO: 498674 - RNA, 21 nt, Human
uccugcaggaggccugagagg

SEQ ID NO: 498675 - RNA, 22 nt, Human
gggaguggguuuggccuaggcc

SEQ ID NO: 498676 - RNA, 22 nt, Human
gcugcagcucgccuuccggccu

SEQ ID NO: 498677 - RNA, 22 nt, Human
guucacaagaguuacagacaga

SEQ ID NO: 498678 - RNA, 18 nt, Human
uggcugcuggaguagggu

SEQ ID NO: 498679 - RNA, 22 nt, Human
uuacaguaugaucaacuuuuca

SEQ ID NO: 498680 - RNA, 22 nt, Human
cugggugguuuugaugugaauu

SEQ ID NO: 498681 - RNA, 22 nt, Human
ccagcugagaaguguaaaguga

SEQ ID NO: 498682 - RNA, 22 nt, Human
aucagcaaucaaauugcagagu

SEQ ID NO: 498683 - RNA, 22 nt, Human
cugggucuccggcagccucggg

SEQ ID NO: 498684 - RNA, 22 nt, Human
ucagagagguuaaauaucuugu

SEQ ID NO: 498685 - RNA, 22 nt, Human
uggcucagcugucacagccugg

SEQ ID NO: 498686 - RNA, 22 nt, Human
uuuaaaauuuagaccucuccac

SEQ ID NO: 498687 - RNA, 22 nt, Human
gaggggcuggcacgauggcugc

SEQ ID NO: 498688 - RNA, 22 nt, Human
cugugugugucugcagcauacu

SEQ ID NO: 498689 - RNA, 22 nt, Human
agggaagaagcugguaguaggu

SEQ ID NO: 498690 - RNA, 22 nt, Human
ggcccaaacggguccagugaaa

SEQ ID NO: 498691 - RNA, 22 nt, Human
auaugguaagaguauauuuacu

SEQ ID NO: 498692 - RNA, 22 nt, Human
gcaguguugugauccaggucuu

SEQ ID NO: 498693 - RNA, 22 nt, Human
ucaggcucucagaccaacagca

SEQ ID NO: 498694 - RNA, 22 nt, Human
cccaagcagggugcagaggcau

SEQ ID NO: 498695 - RNA, 22 nt, Human
accagagcuggcucugagcacc

SEQ ID NO: 498696 - RNA, 22 nt, Human
agugccucuugucuacgguuuu

SEQ ID NO: 498697 - RNA, 22 nt, Human
acuuuguauaagacaauaaaga

SEQ ID NO: 498698 - RNA, 22 nt, Human
gcagggaccagggccagaucca

SEQ ID NO: 498699 - RNA, 22 nt, Human
cagcaggguagguuguaucagu

SEQ ID NO: 498700 - RNA, 22 nt, Human
caggggccuggcugucuaggaa

SEQ ID NO: 498701 - RNA, 22 nt, Human
gggcaguggguggcugcagccu

SEQ ID NO: 498702 - RNA, 18 nt, Human
caugucugcgccacaagg

SEQ ID NO: 498703 - RNA, 22 nt, Human
uggccaccuucccacuucugcc

SEQ ID NO: 498704 - RNA, 22 nt, Human
caccaggcuggagugcagaggu

SEQ ID NO: 498705 - RNA, 22 nt, Human
ugagggucuggaaucugggcuu

SEQ ID NO: 498706 - RNA, 22 nt, Human
cucugugcccuacugcucagcu

SEQ ID NO: 498707 - RNA, 21 nt, Human
cugguguagcacucaggugcu

SEQ ID NO: 498708 - RNA, 18 nt, Human
ggcucaggcuauccuaac

SEQ ID NO: 498709 - RNA, 22 nt, Human
cacucccucuaguugcauucug

SEQ ID NO: 498710 - RNA, 22 nt, Human
uuuuauucucaagacaauggga

SEQ ID NO: 498711 - RNA, 22 nt, Human
cuuuaguguuguugugaggauu

SEQ ID NO: 498712 - RNA, 22 nt, Human
ggguuucaugguucucacaaug

SEQ ID NO: 498713 - RNA, 22 nt, Human
gaggcugauucggggaacagca

SEQ ID NO: 498714 - RNA, 22 nt, Human
ugaagcuggaaguuagguagac

SEQ ID NO: 498715 - RNA, 22 nt, Human
acagauugaucuugagaauuau

SEQ ID NO: 498716 - RNA, 22 nt, Human
uuugaacaugcugcaugauaau

SEQ ID NO: 498717 - RNA, 22 nt, Human
guccagcccgggcuccgccagc

SEQ ID NO: 498718 - RNA, 22 nt, Human
aaguccaguuucauuugagguc

SEQ ID NO: 498719 - RNA, 22 nt, Human
gcaugggcaagaggacuggggg

SEQ ID NO: 498720 - RNA, 22 nt, Human
gagucugugguauuuuaucaua

SEQ ID NO: 498721 - RNA, 22 nt, Human
ugaggaagcaaaggcuugugug

SEQ ID NO: 498722 - RNA, 22 nt, Human
uaaguagacuguugaacuuggu

SEQ ID NO: 498723 - RNA, 22 nt, Human
ggcucuggagacauguggagag

SEQ ID NO: 498724 - RNA, 21 nt, Human
auuuacaaaacagucccuucc

SEQ ID NO: 498725 - RNA, 22 nt, Human
cacguuuuaugacagaagaagc

SEQ ID NO: 498726 - RNA, 22 nt, Human
aguggcugaagcaucaaaggca

SEQ ID NO: 498727 - RNA, 22 nt, Human
aaaaguauuuauggcuauguaa

SEQ ID NO: 498728 - RNA, 22 nt, Human
caggauggagagugagggguca

SEQ ID NO: 498729 - RNA, 22 nt, Human
cucaggauggaagccuacagga

SEQ ID NO: 498730 - RNA, 22 nt, Human
agcacuuaacugacaguacuau

SEQ ID NO: 498731 - RNA, 22 nt, Human
uuagaaucuaacauucuuaucu

SEQ ID NO: 498732 - RNA, 22 nt, Human
ccuggcacgaagggcugagguu

SEQ ID NO: 498733 - RNA, 19 nt, Human
agcagagcagggccguggg

SEQ ID NO: 498734 - RNA, 22 nt, Human
aggaccauccuaagguaggcaa

SEQ ID NO: 498735 - RNA, 22 nt, Human
cugggagcggcugucacugguu

SEQ ID NO: 498736 - RNA, 19 nt, Human
cacagggcaggucucaugu

SEQ ID NO: 498737 - RNA, 19 nt, Human
agcuccugggcucugggcc

SEQ ID NO: 498738 - RNA, 22 nt, Human
ucaaguagaacuauaaugaugu

SEQ ID NO: 498739 - RNA, 21 nt, Human
cugcuguggcccccgacaugc

SEQ ID NO: 498740 - RNA, 22 nt, Human
ucaggaaauacaagugacauca

SEQ ID NO: 498741 - RNA, 22 nt, Human
agcuuuauuugucauucacggc

SEQ ID NO: 498742 - RNA, 22 nt, Human
ugccucagucuaaagucucuca

SEQ ID NO: 498743 - RNA, 22 nt, Human
ugagcuggucuugaguguagcu

SEQ ID NO: 498744 - RNA, 22 nt, Human
ucuguggauuuuaguguucaug

SEQ ID NO: 498745 - RNA, 19 nt, Human
ccaguagagacagcugcag

SEQ ID NO: 498746 - RNA, 17 nt, Human
acagagcacaucaagau

SEQ ID NO: 498747 - RNA, 22 nt, Human
cacaagacuuauuuguguagaa

SEQ ID NO: 498748 - RNA, 21 nt, Human
ccugugugucugacugggcua

SEQ ID NO: 498749 - RNA, 22 nt, Human
caaauucucuuacuguuugaca

SEQ ID NO: 498750 - RNA, 22 nt, Human
ccagggugagaaaaggcuggau

SEQ ID NO: 498751 - RNA, 22 nt, Human
uuccagagcaguuuucagauca

SEQ ID NO: 498752 - RNA, 22 nt, Human
uaguguuuaguacauaugcaua

SEQ ID NO: 498753 - RNA, 22 nt, Human
gcacagccagcaucugagggau

SEQ ID NO: 498754 - RNA, 22 nt, Human
aagacaucagugaugacauuug

SEQ ID NO: 498755 - RNA, 22 nt, Human
ugccagccagggaagcucaccc

SEQ ID NO: 498756 - RNA, 22 nt, Human
ggccucugccucaucugggcac

SEQ ID NO: 498757 - RNA, 21 nt, Human
acaguucaugauaacuccauc

SEQ ID NO: 498758 - RNA, 22 nt, Human
gaggcagcugaaggagugacag

SEQ ID NO: 498759 - RNA, 22 nt, Human
cuggcagggugggcuuugcuuu

SEQ ID NO: 498760 - RNA, 22 nt, Human
guguccugagugaggccuggcc

SEQ ID NO: 498761 - RNA, 22 nt, Human
ugccacuggcucaauggugcag

SEQ ID NO: 498762 - RNA, 22 nt, Human
auagcauuauuuacaauuagua

SEQ ID NO: 498763 - RNA, 22 nt, Human
agcuccuggacgaacagggagu

SEQ ID NO: 498764 - RNA, 22 nt, Human
uaggaagggcucagggcucggu

SEQ ID NO: 498765 - RNA, 22 nt, Human
cagagccugcucacgucucugu

SEQ ID NO: 498766 - RNA, 22 nt, Human
aaguaacaaugcuguugaauug

SEQ ID NO: 498767 - RNA, 22 nt, Human
cagcagggggcagcgcagauca

SEQ ID NO: 498768 - RNA, 22 nt, Human
uugaaaaaauugguagaggaug

SEQ ID NO: 498769 - RNA, 22 nt, Human
cagggccacuguagaugaggag

SEQ ID NO: 498770 - RNA, 22 nt, Human
ggcaccugcucaucuggacuca

SEQ ID NO: 498771 - RNA, 22 nt, Human
uuugcauuuguucaaguauuga

SEQ ID NO: 498772 - RNA, 22 nt, Human
aaugucaaaggcuauacauuca

SEQ ID NO: 498773 - RNA, 22 nt, Human
cacagggcuucucauggggugc

SEQ ID NO: 498774 - RNA, 21 nt, Human
agauuacaggugugauccacc

SEQ ID NO: 498775 - RNA, 22 nt, Human
uaauuuacuugcaaauaacaau

SEQ ID NO: 498776 - RNA, 22 nt, Human
guguguccaggcgggagucaag

SEQ ID NO: 498777 - RNA, 22 nt, Human
gccaggcuggugcaaggauauu

SEQ ID NO: 498778 - RNA, 22 nt, Human
uagagguauaccaaaaaggcau

SEQ ID NO: 498779 - RNA, 22 nt, Human
gagccuggauugaagugggugg

SEQ ID NO: 498780 - RNA, 22 nt, Human
uucagucagugacuaagcaguu

SEQ ID NO: 498781 - RNA, 22 nt, Human
ugggguacuuguaucaaagcac

SEQ ID NO: 498782 - RNA, 22 nt, Human
aggugcagugaaggaaaaggaa

SEQ ID NO: 498783 - RNA, 22 nt, Human
uggcugggugcuauccaguacu

SEQ ID NO: 498784 - RNA, 22 nt, Human
uccagccaagccuugguagcug

SEQ ID NO: 498785 - RNA, 22 nt, Human
uauuauuaugcauagcaugaaa

SEQ ID NO: 498786 - RNA, 22 nt, Human
ggagccugcgggagcucccauu

SEQ ID NO: 498787 - RNA, 22 nt, Human
uuggauccaucucaggcauagg

SEQ ID NO: 498788 - RNA, 22 nt, Human
aauuuguguuauaccugcuccu

SEQ ID NO: 498789 - RNA, 22 nt, Human
uagaaaugcccagauucugcua

SEQ ID NO: 498790 - RNA, 22 nt, Human
uugcauuucccauugaguaaug

SEQ ID NO: 498791 - RNA, 22 nt, Human
cugaagagacuggagggggcau

SEQ ID NO: 498792 - RNA, 19 nt, Human
uggagaggaaaugcugcuc

SEQ ID NO: 498793 - RNA, 22 nt, Human
uaggacauaaguauucuaacuu

SEQ ID NO: 498794 - RNA, 22 nt, Human
uggguagagcaggcuggggcuu

SEQ ID NO: 498795 - RNA, 22 nt, Human
agcaugaaagcauaggacaguc

SEQ ID NO: 498796 - RNA, 22 nt, Human
gugcuuaauacaugucaauaac

SEQ ID NO: 498797 - RNA, 22 nt, Human
aagcugcccaagacugaagcau

SEQ ID NO: 498798 - RNA, 22 nt, Human
gucuugaucuccugaccuugug

SEQ ID NO: 498799 - RNA, 22 nt, Human
agcugcagagguuugugcaaca

SEQ ID NO: 498800 - RNA, 22 nt, Human
cagcuuggcuucacauucugua

SEQ ID NO: 498801 - RNA, 22 nt, Human
agaaaugggccuugggacacaa

SEQ ID NO: 498802 - RNA, 22 nt, Human
uuucuuauauucugucauuguu

SEQ ID NO: 498803 - RNA, 22 nt, Human
ccugccugcagaaaguaucucc

SEQ ID NO: 498804 - RNA, 22 nt, Human
guggcagguggagccuccugca

SEQ ID NO: 498805 - RNA, 22 nt, Human
gaugcacuuucuuuucaacagu

SEQ ID NO: 498806 - RNA, 22 nt, Human
cugggaggugaacagaaaaacu

SEQ ID NO: 498807 - RNA, 22 nt, Human
uacagagagagggguuaccagg

SEQ ID NO: 498808 - RNA, 22 nt, Human
gaaguucugguguaugugauaa

SEQ ID NO: 498809 - RNA, 22 nt, Human
ggcagcuggggcagugcccugu

SEQ ID NO: 498810 - RNA, 21 nt, Human
aucugaaguuugagaggaaag

SEQ ID NO: 498811 - RNA, 18 nt, Human
cucucugggugaggacaa

SEQ ID NO: 498812 - RNA, 22 nt, Human
ggcccagcgaggccaccuacag

SEQ ID NO: 498813 - RNA, 22 nt, Human
guugugaauagugccgcaauaa

SEQ ID NO: 498814 - RNA, 22 nt, Human
cagaagcagauucuaaagcaag

SEQ ID NO: 498815 - RNA, 20 nt, Human
ucacaucuggcagcugauga

SEQ ID NO: 498816 - RNA, 22 nt, Human
ucccagggcagcuguccagaag

SEQ ID NO: 498817 - RNA, 22 nt, Human
aaagguuuauuuaaucagggag

SEQ ID NO: 498818 - RNA, 22 nt, Human
gccauuuagggaggcaagguga

SEQ ID NO: 498819 - RNA, 22 nt, Human
uucugugugucucagcaagcug

SEQ ID NO: 498820 - RNA, 22 nt, Human
auguccuggggucuucucuuca

SEQ ID NO: 498821 - RNA, 22 nt, Human
agcagccacagucugggacagg

SEQ ID NO: 498822 - RNA, 22 nt, Human
ugaggcagcaauuguauuguau

SEQ ID NO: 498823 - RNA, 22 nt, Human
uuuuuguagucauuagaagagg

SEQ ID NO: 498824 - RNA, 22 nt, Human
guugcaggaagcacacacaugu

SEQ ID NO: 498825 - RNA, 22 nt, Human
uguguacagcaggauuucucaa

SEQ ID NO: 498826 - RNA, 22 nt, Human
uggagaggagcaccauggccau

SEQ ID NO: 498827 - RNA, 22 nt, Human
ucaugaaucguggaaugauuua

SEQ ID NO: 498828 - RNA, 22 nt, Human
cagaaauguuuguuaauauugu

SEQ ID NO: 498829 - RNA, 22 nt, Human
auaaaugauucagcaggaaaua

SEQ ID NO: 498830 - RNA, 22 nt, Human
uagaacagaggguugcccagau

SEQ ID NO: 498831 - RNA, 22 nt, Human
auaaaagaaguuuugguacuug

SEQ ID NO: 498832 - RNA, 22 nt, Human
ugggcagauguccucugaagug

SEQ ID NO: 498833 - RNA, 20 nt, Human
ugcagcugguuucacaggga

SEQ ID NO: 498834 - RNA, 22 nt, Human
agcaaugcuaccgggugauucg

SEQ ID NO: 498835 - RNA, 18 nt, Human
agggucagugucacuggc

SEQ ID NO: 498836 - RNA, 20 nt, Human
ucacuaguaaccaucugcuu

SEQ ID NO: 498837 - RNA, 22 nt, Human
agugauggggcccugcacugau

SEQ ID NO: 498838 - RNA, 21 nt, Human
ccacuguagacucauucugag

SEQ ID NO: 498839 - RNA, 22 nt, Human
uuauugugucuugguuuaucuu

SEQ ID NO: 498840 - RNA, 22 nt, Human
uggcuucuugggaugggucauu

SEQ ID NO: 498841 - RNA, 22 nt, Human
augcauugucugguuucauuuu

SEQ ID NO: 498842 - RNA, 21 nt, Human
cagagcagcguucugcugugg

SEQ ID NO: 498843 - RNA, 22 nt, Human
uuuacauggaauauugucuugu

SEQ ID NO: 498844 - RNA, 22 nt, Human
acucagaguuuuacccagagac

SEQ ID NO: 498845 - RNA, 22 nt, Human
ucacacauuucucaaguguagg

SEQ ID NO: 498846 - RNA, 22 nt, Human
cagccagguaugggcgugcggg

SEQ ID NO: 498847 - RNA, 22 nt, Human
gcacacccucucaccagcacug

SEQ ID NO: 498848 - RNA, 22 nt, Human
aacccaggagacagguugcagu

SEQ ID NO: 498849 - RNA, 22 nt, Human
uuuccucacacagaagaucuug

SEQ ID NO: 498850 - RNA, 22 nt, Human
caguguguggauccucccagga

SEQ ID NO: 498851 - RNA, 22 nt, Human
cucugagguccuacagugaccc

SEQ ID NO: 498852 - RNA, 22 nt, Human
aauucuuguuguuaguauauuu

SEQ ID NO: 498853 - RNA, 22 nt, Human
auuauuugacuugagaacaggu

SEQ ID NO: 498854 - RNA, 22 nt, Human
gaaaggcaguacagcugagccu

SEQ ID NO: 498855 - RNA, 22 nt, Human
ggcugucucugugacugccacc

SEQ ID NO: 498856 - RNA, 22 nt, Human
acugaaggaaagccuuugcaug

SEQ ID NO: 498857 - RNA, 22 nt, Human
agccuggaggccaggagacagu

SEQ ID NO: 498858 - RNA, 22 nt, Human
cacccacauggaaauucacagu

SEQ ID NO: 498859 - RNA, 22 nt, Human
gaggagagaacauuccuccaua

SEQ ID NO: 498860 - RNA, 18 nt, Human
aaauuagauggaccugug

SEQ ID NO: 498861 - RNA, 23 nt, Human
aacaauagguuuuggcagaauag

SEQ ID NO: 498862 - RNA, 22 nt, Human
cugagauggaguuucgcucuuc

SEQ ID NO: 498863 - RNA, 22 nt, Human
ugcaggugugguuccucagcca

SEQ ID NO: 498864 - RNA, 22 nt, Human
aaagugcaaggauuacaggcau

SEQ ID NO: 498865 - RNA, 22 nt, Human
ugugugcauucacaugcaugcc

SEQ ID NO: 498866 - RNA, 23 nt, Human
augauguuuuugguagucaaaug

SEQ ID NO: 498867 - RNA, 21 nt, Human
acagagccgggcacaaagcug

SEQ ID NO: 498868 - RNA, 22 nt, Human
auuuccuagccucucuugcagu

SEQ ID NO: 498869 - RNA, 22 nt, Human
aggcuccuugcucacaggcuca

SEQ ID NO: 498870 - RNA, 22 nt, Human
aaguuuggggagaauuucauuu

SEQ ID NO: 498871 - RNA, 22 nt, Human
cucugcagaauuugagcugcuc

SEQ ID NO: 498872 - RNA, 21 nt, Human
ugcucaugcaaugcaugucca

SEQ ID NO: 498873 - RNA, 22 nt, Human
cagagggagcccuccaggagca

SEQ ID NO: 498874 - RNA, 22 nt, Human
gagaguuccaguaaguggauuc

SEQ ID NO: 498875 - RNA, 23 nt, Human
ugcagagggacugaagccagcuu

SEQ ID NO: 498876 - RNA, 22 nt, Human
guccuagugccuggaagcuggg

SEQ ID NO: 498877 - RNA, 21 nt, Human
cuggaucugucaucgaguuuu

SEQ ID NO: 498878 - RNA, 19 nt, Human
ggcagguagagggccaguc

SEQ ID NO: 498879 - RNA, 22 nt, Human
gcucugggaaguccuuuaccau

SEQ ID NO: 498880 - RNA, 22 nt, Human
ugcaaauggagcauguauaaga

SEQ ID NO: 498881 - RNA, 22 nt, Human
ggccugcugcuaugacuuccug

SEQ ID NO: 498882 - RNA, 22 nt, Human
gaaaacacuuugaucugaaagu

SEQ ID NO: 498883 - RNA, 22 nt, Human
gcugccuguguggccacucacu

SEQ ID NO: 498884 - RNA, 22 nt, Human
uuacaauaguuccuucuuuugu

SEQ ID NO: 498885 - RNA, 22 nt, Human
acauauuuccaugcagcauguc

SEQ ID NO: 498886 - RNA, 22 nt, Human
ucucagagcuucagaaagcacc

SEQ ID NO: 498887 - RNA, 22 nt, Human
cuuccucaugugcaaugcaagc

SEQ ID NO: 498888 - RNA, 22 nt, Human
acagccagaagucaggguggga

SEQ ID NO: 498889 - RNA, 20 nt, Human
acagagaucagcugaugggc

SEQ ID NO: 498890 - RNA, 22 nt, Human
uggcucuggauuaaucuaggaa

SEQ ID NO: 498891 - RNA, 22 nt, Human
aucugggucacaguggcaucua

SEQ ID NO: 498892 - RNA, 22 nt, Human
aaggcugaggcagugaggcaga

SEQ ID NO: 498893 - RNA, 22 nt, Human
cuccagugggggugagccuaga

SEQ ID NO: 498894 - RNA, 22 nt, Human
uggcucaggauaauuuucccaa

SEQ ID NO: 498895 - RNA, 18 nt, Human
cugggcucgagagauccu

SEQ ID NO: 498896 - RNA, 22 nt, Human
cagcugccuucugcgggaaguc

SEQ ID NO: 498897 - RNA, 22 nt, Human
ucccaagagcucugggauaagg

SEQ ID NO: 498898 - RNA, 22 nt, Human
uggcagagagagugcagucgac

SEQ ID NO: 498899 - RNA, 22 nt, Human
cugggcaggagggcucuaugga

SEQ ID NO: 498900 - RNA, 22 nt, Human
uguccugggucaaauccugguc

SEQ ID NO: 498901 - RNA, 22 nt, Human
gagugcugaaugcgagaacaga

SEQ ID NO: 498902 - RNA, 22 nt, Human
auguuggagucguaaggcaugg

SEQ ID NO: 498903 - RNA, 22 nt, Human
guguccagggcuggaagugagg

SEQ ID NO: 498904 - RNA, 22 nt, Human
uaaaaaguagugagaauggcgc

SEQ ID NO: 498905 - RNA, 17 nt, Human
uauacacagacagacug

SEQ ID NO: 498906 - RNA, 22 nt, Human
cuggcagcauuaacagagagca

SEQ ID NO: 498907 - RNA, 22 nt, Human
ucagggacuuacaaaccagaag

SEQ ID NO: 498908 - RNA, 22 nt, Human
ggagaaggaagaaagcuacuau

SEQ ID NO: 498909 - RNA, 21 nt, Human
gccacugcacuccagccuggg

SEQ ID NO: 498910 - RNA, 18 nt, Human
uggguggcuagggaguuu

SEQ ID NO: 498911 - RNA, 22 nt, Human
ccauaaucuggcuuugagagag

SEQ ID NO: 498912 - RNA, 22 nt, Human
ggcugccuccucgagacaggau

SEQ ID NO: 498913 - RNA, 21 nt, Human
gcugcugccccuagugaggcc

SEQ ID NO: 498914 - RNA, 22 nt, Human
gacauaauccuccucaccuacu

SEQ ID NO: 498915 - RNA, 18 nt, Human
cauuaugugguuauagaa

SEQ ID NO: 498916 - RNA, 22 nt, Human
aagaauuuuccagcaugucagu

SEQ ID NO: 498917 - RNA, 22 nt, Human
ugugccaggcacuugcccaggc

SEQ ID NO: 498918 - RNA, 22 nt, Human
ugcaggugagugcaggggcuca

SEQ ID NO: 498919 - RNA, 22 nt, Human
gagggcugcaaugagacagaga

SEQ ID NO: 498920 - RNA, 22 nt, Human
gagcugcuggcuccucagguua

SEQ ID NO: 498921 - RNA, 22 nt, Human
gugcagagagguggagggacuu

SEQ ID NO: 498922 - RNA, 22 nt, Human
cuuaauguggaccugguuucua

SEQ ID NO: 498923 - RNA, 22 nt, Human
ugcccuuaggaaggcucaccaa

SEQ ID NO: 498924 - RNA, 22 nt, Human
uggcuuccuaaacugauuucca

SEQ ID NO: 498925 - RNA, 22 nt, Human
gcaggauggugcccuuucugcc

SEQ ID NO: 498926 - RNA, 22 nt, Human
uccuuagcuuacaagucuucug

SEQ ID NO: 498927 - RNA, 22 nt, Human
aucaaaucauugcauuaauguu

SEQ ID NO: 498928 - RNA, 22 nt, Human
guucaaagcuccugguacagua

SEQ ID NO: 498929 - RNA, 22 nt, Human
gcugcucuccauggccgugagu

SEQ ID NO: 498930 - RNA, 22 nt, Human
caggaaaucacucugauuuugg

SEQ ID NO: 498931 - RNA, 22 nt, Human
ucagcuuugggggucucaggag

SEQ ID NO: 498932 - RNA, 22 nt, Human
auucaagaggaacaaugaagau

SEQ ID NO: 498933 - RNA, 22 nt, Human
ucaguuuccugguuuuaauauu

SEQ ID NO: 498934 - RNA, 22 nt, Human
gggcuggcaggaccugggcuga

SEQ ID NO: 498935 - RNA, 22 nt, Human
uuuggaaacugccucagcucuu

SEQ ID NO: 498936 - RNA, 22 nt, Human
gggagucugggcuagacuccuu

SEQ ID NO: 498937 - RNA, 22 nt, Human
cuugggcucugugggccuuagu

SEQ ID NO: 498938 - RNA, 22 nt, Human
ggcacagggagccgcaguugca

SEQ ID NO: 498939 - RNA, 22 nt, Human
aagcacuaggucacacaaguua

SEQ ID NO: 498940 - RNA, 22 nt, Human
agagauguucauucagcauguu

SEQ ID NO: 498941 - RNA, 22 nt, Human
uggccagugauuaaugacgcuu

SEQ ID NO: 498942 - RNA, 23 nt, Human
gagggcucugagugcuugggcca

SEQ ID NO: 498943 - RNA, 22 nt, Human
aggagaaguaaggcuagaugau

SEQ ID NO: 498944 - RNA, 22 nt, Human
ugcagaagcugcaggucagugg

SEQ ID NO: 498945 - RNA, 22 nt, Human
ugcaucugauucucaggcagaa

SEQ ID NO: 498946 - RNA, 22 nt, Human
aaggcugguuccaucccuggug

SEQ ID NO: 498947 - RNA, 22 nt, Human
agucccagacuccaguuuucug

SEQ ID NO: 498948 - RNA, 22 nt, Human
gccugguguccagaggcgagug

SEQ ID NO: 498949 - RNA, 18 nt, Human
cagauccaggcagcuauu

SEQ ID NO: 498950 - RNA, 22 nt, Human
uccuucagcuuauuucuuagga

SEQ ID NO: 498951 - RNA, 22 nt, Human
ggacucagcagccaggaguggc

SEQ ID NO: 498952 - RNA, 22 nt, Human
gcagagaaaguuuuguccucag

SEQ ID NO: 498953 - RNA, 22 nt, Human
caaggccaguuucuccuaguca

SEQ ID NO: 498954 - RNA, 22 nt, Human
uucacauaaauagaucacauca

SEQ ID NO: 498955 - RNA, 22 nt, Human
agcuccugcuugacagaagagg

SEQ ID NO: 498956 - RNA, 22 nt, Human
caggugcugcguggcggagcug

SEQ ID NO: 498957 - RNA, 22 nt, Human
uugcugaagcugccaaaccagu

SEQ ID NO: 498958 - RNA, 22 nt, Human
uccucacagaguggcaggcaau

SEQ ID NO: 498959 - RNA, 22 nt, Human
acauuucuccuacuuguuauuu

SEQ ID NO: 498960 - RNA, 22 nt, Human
cagaguggcacucugcuggaug

SEQ ID NO: 498961 - RNA, 22 nt, Human
uugaagcaggaaaauuucuauu

SEQ ID NO: 498962 - RNA, 22 nt, Human
agagcagccugugaugaugcac

SEQ ID NO: 498963 - RNA, 22 nt, Human
aauaaacugcucaauugcauca

SEQ ID NO: 498964 - RNA, 19 nt, Human
accugcaguaauaauuccu

SEQ ID NO: 498965 - RNA, 22 nt, Human
agcagcuguuagaaacaggaag

SEQ ID NO: 498966 - RNA, 22 nt, Human
cuguguuugacaggcggucucc

SEQ ID NO: 498967 - RNA, 22 nt, Human
ggcagcaguggcugcuauuguc

SEQ ID NO: 498968 - RNA, 22 nt, Human
gcagcugaauguccauugcugc

SEQ ID NO: 498969 - RNA, 22 nt, Human
uuggcuucucuuaacccuaaag

SEQ ID NO: 498970 - RNA, 22 nt, Human
uuucacauaaauauuaugccua

SEQ ID NO: 498971 - RNA, 22 nt, Human
gcugcagguugggcaacagagu

SEQ ID NO: 498972 - RNA, 22 nt, Human
aaagugcugggauuacaggccu

SEQ ID NO: 498973 - RNA, 22 nt, Human
agggcaucucuaacagucuccu

SEQ ID NO: 498974 - RNA, 22 nt, Human
aagacugucugggacaagauga

SEQ ID NO: 498975 - RNA, 22 nt, Human
aauuaacaaauguagcugugau

SEQ ID NO: 498976 - RNA, 19 nt, Human
ucuccaaaaccaaucacua

SEQ ID NO: 498977 - RNA, 22 nt, Human
gggagagagaaaacguggcgca

SEQ ID NO: 498978 - RNA, 22 nt, Human
gucuccagggcugcuggcgccu

SEQ ID NO: 498979 - RNA, 22 nt, Human
cccaguccagaccaugaccuca

SEQ ID NO: 498980 - RNA, 22 nt, Human
uccccuccaacuccaacuaugg

SEQ ID NO: 498981 - RNA, 22 nt, Human
gagcauuuuugucugcauuuua

SEQ ID NO: 498982 - RNA, 21 nt, Human
uccugcagggcagcagagugg

SEQ ID NO: 498983 - RNA, 22 nt, Human
ugucugcagaagauggcauggg

SEQ ID NO: 498984 - RNA, 22 nt, Human
acucugacuggagugagagagg

SEQ ID NO: 498985 - RNA, 22 nt, Human
cucccucucaccggagcccugg

SEQ ID NO: 498986 - RNA, 22 nt, Human
ccagcucuggcuucuugcuggg

SEQ ID NO: 498987 - RNA, 22 nt, Human
gggcucuggacccaggcaagag

SEQ ID NO: 498988 - RNA, 21 nt, Human
ccaggacuccauggggucucu

SEQ ID NO: 498989 - RNA, 22 nt, Human
ucagcugaaguggagaagcaga

SEQ ID NO: 498990 - RNA, 22 nt, Human
cuguggcucaggccuguaagcc

SEQ ID NO: 498991 - RNA, 22 nt, Human
gagcucagacucgggccugggg

SEQ ID NO: 498992 - RNA, 22 nt, Human
cccaggcuggaauuccaggccu

SEQ ID NO: 498993 - RNA, 21 nt, Human
ccagccucagaucagggagcu

SEQ ID NO: 498994 - RNA, 19 nt, Human
aaaaagaggcuauaauauu

SEQ ID NO: 498995 - RNA, 22 nt, Human
uggcagcauuuuuuccagaaca

SEQ ID NO: 498996 - RNA, 22 nt, Human
acccagcaugacaccugcacau

SEQ ID NO: 498997 - RNA, 21 nt, Human
ugcacagccauacccuccuug

SEQ ID NO: 498998 - RNA, 22 nt, Human
ugcaggcuggaggagggacuaa

SEQ ID NO: 498999 - RNA, 22 nt, Human
cuccagggggcauccacacagc

SEQ ID NO: 499000 - RNA, 22 nt, Human
caaggcaggcaguucacuugag

SEQ ID NO: 499001 - RNA, 22 nt, Human
gggacuggaguagaggccggug

SEQ ID NO: 499002 - RNA, 22 nt, Human
aguuuccaaagcauguucacac

SEQ ID NO: 499003 - RNA, 22 nt, Human
ugagggcuaaauuguggcaggu

SEQ ID NO: 499004 - RNA, 22 nt, Human
cuggaagggaaaucucuuggca

SEQ ID NO: 499005 - RNA, 22 nt, Human
ccucccagugccuccagagcag

SEQ ID NO: 499006 - RNA, 22 nt, Human
ccuguacaagagccaucuggau

SEQ ID NO: 499007 - RNA, 22 nt, Human
uucaacacaggaacaugauaua

SEQ ID NO: 499008 - RNA, 22 nt, Human
uccuuagcugugaaaugagaau

SEQ ID NO: 499009 - RNA, 22 nt, Human
gguuucagcccugcuguuccug

SEQ ID NO: 499010 - RNA, 22 nt, Human
aaauuagaccaguucaggucca

SEQ ID NO: 499011 - RNA, 22 nt, Human
cccuggagcuagucugagcaga

SEQ ID NO: 499012 - RNA, 22 nt, Human
cuugaaauccagauuucagagg

SEQ ID NO: 499013 - RNA, 22 nt, Human
uuccaggagacuuccagaaaua

SEQ ID NO: 499014 - RNA, 22 nt, Human
ucucuggcuggcaccccaggga

SEQ ID NO: 499015 - RNA, 22 nt, Human
agcuccuguggcagcucuucug

SEQ ID NO: 499016 - RNA, 22 nt, Human
gaaaugugggucaugacccauu

SEQ ID NO: 499017 - RNA, 22 nt, Human
uaguuuuuucaacaaauggugc

SEQ ID NO: 499018 - RNA, 21 nt, Human
aaacugaagagacaggaacuu

SEQ ID NO: 499019 - RNA, 22 nt, Human
cugucagcacucuacuacagau

SEQ ID NO: 499020 - RNA, 22 nt, Human
cacucugcgcugggcgccagcg

SEQ ID NO: 499021 - RNA, 22 nt, Human
aaggucuguggccaccucuggg

SEQ ID NO: 499022 - RNA, 22 nt, Human
gcacagaacagagaaauagcca

SEQ ID NO: 499023 - RNA, 18 nt, Human
augggaggggccaagaga

SEQ ID NO: 499024 - RNA, 22 nt, Human
ucacagaaguugaauuugcaug

SEQ ID NO: 499025 - RNA, 22 nt, Human
cccgacuagcugggauuacagg

SEQ ID NO: 499026 - RNA, 22 nt, Human
ugauucuauggaaggcauaagg

SEQ ID NO: 499027 - RNA, 22 nt, Human
ugaggcagcuuuuucugugugu

SEQ ID NO: 499028 - RNA, 22 nt, Human
aguccuggguccagcagguccu

SEQ ID NO: 499029 - RNA, 20 nt, Human
cuccaggggaagagccuucc

SEQ ID NO: 499030 - RNA, 22 nt, Human
cagggccacccucugcugggug

SEQ ID NO: 499031 - RNA, 22 nt, Human
cagugcaacagauucgagaagc

SEQ ID NO: 499032 - RNA, 22 nt, Human
uauuucuguuuauuuguacauc

SEQ ID NO: 499033 - RNA, 22 nt, Human
uggccucuuacgacauagccuu

SEQ ID NO: 499034 - RNA, 22 nt, Human
acagucaaucagaacagcaugu

SEQ ID NO: 499035 - RNA, 23 nt, Human
ucacacagcuggucagguacaga

SEQ ID NO: 499036 - RNA, 22 nt, Human
uuuggacuuagccugcagaauu

SEQ ID NO: 499037 - RNA, 22 nt, Human
agguccugacuccacguucuag

SEQ ID NO: 499038 - RNA, 23 nt, Human
ugucaucuccagacucccagugc

SEQ ID NO: 499039 - RNA, 22 nt, Human
uuucagaugugugucucugaag

SEQ ID NO: 499040 - RNA, 22 nt, Human
cagcuucagggacagcuucuuu

SEQ ID NO: 499041 - RNA, 22 nt, Human
gcucagugaauuuuugcccaug

SEQ ID NO: 499042 - RNA, 23 nt, Human
gaggucaaggcugcagugauugc

SEQ ID NO: 499043 - RNA, 22 nt, Human
uggcccugcagaacuagccugg

SEQ ID NO: 499044 - RNA, 22 nt, Human
uaaugagaucauaucuucugag

SEQ ID NO: 499045 - RNA, 22 nt, Human
aaggcagcuucaccacagcauu

SEQ ID NO: 499046 - RNA, 22 nt, Human
aagagcugauuaagucaugagg

SEQ ID NO: 499047 - RNA, 22 nt, Human
ucagagaugcagugccaccuac

SEQ ID NO: 499048 - RNA, 22 nt, Human
auucagaaaggguugccugguu

SEQ ID NO: 499049 - RNA, 22 nt, Human
gccagguggucuggcuccagag

SEQ ID NO: 499050 - RNA, 22 nt, Human
cacagcugcccuacuccaugug

SEQ ID NO: 499051 - RNA, 22 nt, Human
uggcagccaucagagcaggggu

SEQ ID NO: 499052 - RNA, 22 nt, Human
caggcaugagccaggccccucc

SEQ ID NO: 499053 - RNA, 22 nt, Human
uggcccaggaggccagagggca

SEQ ID NO: 499054 - RNA, 22 nt, Human
gcugucugcaucucuagagcuu

SEQ ID NO: 499055 - RNA, 22 nt, Human
ucucuuaaaagauuuuaaugac

SEQ ID NO: 499056 - RNA, 22 nt, Human
gagauuuaauuggauuaacuua

SEQ ID NO: 499057 - RNA, 22 nt, Human
cuggaagggagcacuguagaga

SEQ ID NO: 499058 - RNA, 22 nt, Human
ccugcagaggucaggccagaaa

SEQ ID NO: 499059 - RNA, 22 nt, Human
aaguccagcucuaaauaucuga

SEQ ID NO: 499060 - RNA, 22 nt, Human
cccaguuguugccggcucugga

SEQ ID NO: 499061 - RNA, 22 nt, Human
cuguggcuuugcagggcuuguu

SEQ ID NO: 499062 - RNA, 21 nt, Human
uccuuccuugagguccuuucc

SEQ ID NO: 499063 - RNA, 22 nt, Human
uggggguguccuggugcacaca

SEQ ID NO: 499064 - RNA, 22 nt, Human
cucugcccgcggaugccacguc

SEQ ID NO: 499065 - RNA, 22 nt, Human
acuuuugguucuguaacuguga

SEQ ID NO: 499066 - RNA, 22 nt, Human
cuucaauaccugcguugcuagu

SEQ ID NO: 499067 - RNA, 22 nt, Human
uuucuacauucaaaaacuacca

SEQ ID NO: 499068 - RNA, 22 nt, Human
cagagacaccccagaaaauaag

SEQ ID NO: 499069 - RNA, 22 nt, Human
ugggcagacugagcccuguccc

SEQ ID NO: 499070 - RNA, 22 nt, Human
ccaggcugcagucaaggggcau

SEQ ID NO: 499071 - RNA, 22 nt, Human
uguacagacuuugcagugugca

SEQ ID NO: 499072 - RNA, 22 nt, Human
augucacagcaggaguauucuu

SEQ ID NO: 499073 - RNA, 22 nt, Human
accaccccagaauuuuucaagg

SEQ ID NO: 499074 - RNA, 23 nt, Human
cagcuccagugcacucagguagc

SEQ ID NO: 499075 - RNA, 22 nt, Human
augaguugaagcuacaagaggc

SEQ ID NO: 499076 - RNA, 22 nt, Human
agcagccaguucucugugguag

SEQ ID NO: 499077 - RNA, 22 nt, Human
uggcagggccuaccccaauauc

SEQ ID NO: 499078 - RNA, 22 nt, Human
uacccagcuucaagucaggacu

SEQ ID NO: 499079 - RNA, 22 nt, Human
ucacacugugaagagacaagca

SEQ ID NO: 499080 - RNA, 22 nt, Human
uguguugugacauucuuggaug

SEQ ID NO: 499081 - RNA, 22 nt, Human
aauaacuucauguaacauuuaa

SEQ ID NO: 499082 - RNA, 22 nt, Human
acaggcugcccgcuccccaccu

SEQ ID NO: 499083 - RNA, 22 nt, Human
ugcccacaggaagacaccagcg

SEQ ID NO: 499084 - RNA, 21 nt, Human
aaucaagaguacugguguggc

SEQ ID NO: 499085 - RNA, 17 nt, Human
gucuggaguggccuuca

SEQ ID NO: 499086 - RNA, 22 nt, Human
agagcuggguggacuuguaguu

SEQ ID NO: 499087 - RNA, 22 nt, Human
ggucccugaagaggccuggggu

SEQ ID NO: 499088 - RNA, 19 nt, Human
cagugcuguucauucagug

SEQ ID NO: 499089 - RNA, 22 nt, Human
ucugaauguuaggaaacuuucu

SEQ ID NO: 499090 - RNA, 22 nt, Human
uuaaaugagauguucagauauu

SEQ ID NO: 499091 - RNA, 23 nt, Human
uacauucuguauuuuuauagagu

SEQ ID NO: 499092 - RNA, 22 nt, Human
uguaaagguaggugcaaaauga

SEQ ID NO: 499093 - RNA, 22 nt, Human
aggcacuguggaagacaugguu

SEQ ID NO: 499094 - RNA, 22 nt, Human
ccagagagaaauggauuugagu

SEQ ID NO: 499095 - RNA, 22 nt, Human
uuccauauuuguguggcaaaag

SEQ ID NO: 499096 - RNA, 22 nt, Human
aauguguuauuucagaauccag

SEQ ID NO: 499097 - RNA, 22 nt, Human
gcagaugguggggcaggaaaau

SEQ ID NO: 499098 - RNA, 22 nt, Human
ugugugugcaggagagcaggug

SEQ ID NO: 499099 - RNA, 22 nt, Human
cagccaucccagccugugguuc

SEQ ID NO: 499100 - RNA, 22 nt, Human
ugccuggcaacuguggugggcu

SEQ ID NO: 499101 - RNA, 19 nt, Human
agucacagggaagaggaac

SEQ ID NO: 499102 - RNA, 22 nt, Human
ccaggccuagccccugagggua

SEQ ID NO: 499103 - RNA, 22 nt, Human
cuuugcauacaauuuuuagaaa

SEQ ID NO: 499104 - RNA, 22 nt, Human
uugauacauagcacaguuuagg

SEQ ID NO: 499105 - RNA, 22 nt, Human
cauggcugcgagaagagugggu

SEQ ID NO: 499106 - RNA, 22 nt, Human
aggaccagaggccagagucagc

SEQ ID NO: 499107 - RNA, 22 nt, Human
guguggccguguauccauggcu

SEQ ID NO: 499108 - RNA, 22 nt, Human
caguagcagggauuauuuuagg

SEQ ID NO: 499109 - RNA, 22 nt, Human
uaaaauguuugcaagagaccag

SEQ ID NO: 499110 - RNA, 22 nt, Human
ccugagccugaguggugcaggg

SEQ ID NO: 499111 - RNA, 22 nt, Human
cugucagguuggucucagagcu

SEQ ID NO: 499112 - RNA, 22 nt, Human
ucucccacgguacaggauaaac

SEQ ID NO: 499113 - RNA, 22 nt, Human
gcgguccaggagcgcagguccu

SEQ ID NO: 499114 - RNA, 22 nt, Human
ucccagccuuccagucugguuu

SEQ ID NO: 499115 - RNA, 22 nt, Human
uccuggagccacggagcuuuca

SEQ ID NO: 499116 - RNA, 22 nt, Human
cagaaugagauaacccagauug

SEQ ID NO: 499117 - RNA, 22 nt, Human
uggcagaguaggauggcccugu

SEQ ID NO: 499118 - RNA, 22 nt, Human
gugauuccuauuaguacaugca

SEQ ID NO: 499119 - RNA, 22 nt, Human
uuuuccucaccuaacucaaggu

SEQ ID NO: 499120 - RNA, 22 nt, Human
ucuggaguaauuacagugacug

SEQ ID NO: 499121 - RNA, 22 nt, Human
gacagagugcagggcuagaaga

SEQ ID NO: 499122 - RNA, 21 nt, Human
cgcagagcgaacuugcggcgc

SEQ ID NO: 499123 - RNA, 22 nt, Human
uggucaggcugcucugcggcgu

SEQ ID NO: 499124 - RNA, 23 nt, Human
gcaagagacagagcauccuguuc

SEQ ID NO: 499125 - RNA, 22 nt, Human
ugucugaacaaacucugccucc

SEQ ID NO: 499126 - RNA, 22 nt, Human
gaaagcagaugaaauugcaaca

SEQ ID NO: 499127 - RNA, 22 nt, Human
gugggcuuugcuggauccuucc

SEQ ID NO: 499128 - RNA, 22 nt, Human
ccugugugguagccagcggugc

SEQ ID NO: 499129 - RNA, 19 nt, Human
acugggcuuguccucgugg

SEQ ID NO: 499130 - RNA, 20 nt, Human
ggaaucuuugcaggaaaaua

SEQ ID NO: 499131 - RNA, 22 nt, Human
gcucagagcacucagacucagc

SEQ ID NO: 499132 - RNA, 22 nt, Human
aagaaguuaauaauggugagaa

SEQ ID NO: 499133 - RNA, 22 nt, Human
aaauauguaagauuagcacuag

SEQ ID NO: 499134 - RNA, 22 nt, Human
gacagaggcaagaccagaagcc

SEQ ID NO: 499135 - RNA, 21 nt, Human
cacuccacuuagaacaggguu

SEQ ID NO: 499136 - RNA, 22 nt, Human
ggaggcccagagaggugaagug

SEQ ID NO: 499137 - RNA, 22 nt, Human
acccaggcugcuucucaguggc

SEQ ID NO: 499138 - RNA, 22 nt, Human
ugucucaucucuuaaccccacu

SEQ ID NO: 499139 - RNA, 22 nt, Human
uggccucagauuauugcacagu

SEQ ID NO: 499140 - RNA, 23 nt, Human
ugccaaaguuuaccuaacacugg

SEQ ID NO: 499141 - RNA, 17 nt, Human
gggcagggacuccuggg

SEQ ID NO: 499142 - RNA, 22 nt, Human
auuuuccucaagccucuggaag

SEQ ID NO: 499143 - RNA, 22 nt, Human
gagcuggucaguuucaggagag

SEQ ID NO: 499144 - RNA, 19 nt, Human
gcugggagcagacccuccc

SEQ ID NO: 499145 - RNA, 22 nt, Human
cugagggaugggcugggccgcc

SEQ ID NO: 499146 - RNA, 22 nt, Human
caugcacagugauaucugaaga

SEQ ID NO: 499147 - RNA, 22 nt, Human
ucagcaaaggcaauucauuauu

SEQ ID NO: 499148 - RNA, 22 nt, Human
uggccacaguguccagcagcag

SEQ ID NO: 499149 - RNA, 22 nt, Human
cagguucuggagaugcagagau

SEQ ID NO: 499150 - RNA, 22 nt, Human
ccggggacuuaaagugaaggaa

SEQ ID NO: 499151 - RNA, 22 nt, Human
caagucugaccucugggugaag

SEQ ID NO: 499152 - RNA, 22 nt, Human
acagaugaggaagagucagcca

SEQ ID NO: 499153 - RNA, 22 nt, Human
cauugcacagcccuguggugau

SEQ ID NO: 499154 - RNA, 22 nt, Human
gggagcugaauggcaauggaga

SEQ ID NO: 499155 - RNA, 22 nt, Human
aaagguuuucaucacagcaaga

SEQ ID NO: 499156 - RNA, 23 nt, Human
ugagcaucacaggagaaccaggc

SEQ ID NO: 499157 - RNA, 22 nt, Human
gcacggcaagacggggccuccu

SEQ ID NO: 499158 - RNA, 22 nt, Human
acucccagguugccuggcaggc

SEQ ID NO: 499159 - RNA, 22 nt, Human
gagguuucacuguguuguccag

SEQ ID NO: 499160 - RNA, 22 nt, Human
ucccaaggccaggcaucuagaa

SEQ ID NO: 499161 - RNA, 22 nt, Human
agagccuggaccugagcuacaa

SEQ ID NO: 499162 - RNA, 22 nt, Human
uuauuuguaucaaggacgguug

SEQ ID NO: 499163 - RNA, 22 nt, Human
aagaaugagcucaaagaucuua

SEQ ID NO: 499164 - RNA, 22 nt, Human
ucccuucacagaugcgauguuu

SEQ ID NO: 499165 - RNA, 22 nt, Human
uccuuuggaacugacuccguua

SEQ ID NO: 499166 - RNA, 22 nt, Human
augaucucauucuuucaaaggg

SEQ ID NO: 499167 - RNA, 22 nt, Human
uguuaaucaaucaacaguauua

SEQ ID NO: 499168 - RNA, 19 nt, Human
gggaugggcccucacccuc

SEQ ID NO: 499169 - RNA, 22 nt, Human
ccaccaggacagcccugagggg

SEQ ID NO: 499170 - RNA, 19 nt, Human
ccuuccuccccagggccau

SEQ ID NO: 499171 - RNA, 22 nt, Human
uguacaugugucuguauaucuu

SEQ ID NO: 499172 - RNA, 22 nt, Human
uauuuuacuuuaaagcgagaga

SEQ ID NO: 499173 - RNA, 22 nt, Human
agagcaauggcauccagcugau

SEQ ID NO: 499174 - RNA, 22 nt, Human
caauauauaaugaguacuuucc

SEQ ID NO: 499175 - RNA, 22 nt, Human
ugagcuuacuucuguacacaga

SEQ ID NO: 499176 - RNA, 22 nt, Human
ugauguucuguauaucauauag

SEQ ID NO: 499177 - RNA, 22 nt, Human
ccaguccagugccaugcauggc

SEQ ID NO: 499178 - RNA, 22 nt, Human
aaacagcuccuuaguuuccauc

SEQ ID NO: 499179 - RNA, 22 nt, Human
auccuugacacacuccaguacu

SEQ ID NO: 499180 - RNA, 22 nt, Human
augggaggaagagaagaugucu

SEQ ID NO: 499181 - RNA, 22 nt, Human
aggagccccucuucaguccugg

SEQ ID NO: 499182 - RNA, 22 nt, Human
gcccagcugucuggcagggaug

SEQ ID NO: 499183 - RNA, 20 nt, Human
uccagcacccucacagagaa

SEQ ID NO: 499184 - RNA, 22 nt, Human
auaauuuaauuuucacaguggu

SEQ ID NO: 499185 - RNA, 22 nt, Human
auuucuacaguacacaugcauu

SEQ ID NO: 499186 - RNA, 22 nt, Human
gaggucuggaccaagucgcccc

SEQ ID NO: 499187 - RNA, 22 nt, Human
ccaaaguccauaguuuacauaa

SEQ ID NO: 499188 - RNA, 22 nt, Human
uaugcauagguaucuauacuca

SEQ ID NO: 499189 - RNA, 22 nt, Human
augcaguacauacaaacacuga

SEQ ID NO: 499190 - RNA, 19 nt, Human
uccauaagcuuguguucau

SEQ ID NO: 499191 - RNA, 22 nt, Human
cagcugcccaagccccagaugu

SEQ ID NO: 499192 - RNA, 22 nt, Human
aggaaagguagcgugccagcag

SEQ ID NO: 499193 - RNA, 22 nt, Human
agcauaaguugguacagccacu

SEQ ID NO: 499194 - RNA, 22 nt, Human
ggcagcuguuggcucucuagga

SEQ ID NO: 499195 - RNA, 22 nt, Human
uucuaagucacucagauuuugg

SEQ ID NO: 499196 - RNA, 22 nt, Human
cagguaagagacggauuggccc

SEQ ID NO: 499197 - RNA, 22 nt, Human
ucugggcuuuacacugugcuua

SEQ ID NO: 499198 - RNA, 22 nt, Human
ucuccugucuucucagcacccc

SEQ ID NO: 499199 - RNA, 22 nt, Human
uggaggaugccauccaggauac

SEQ ID NO: 499200 - RNA, 22 nt, Human
ggaggcucgcuggucgcacagc

SEQ ID NO: 499201 - RNA, 22 nt, Human
agccagagcagggaauuggaca

SEQ ID NO: 499202 - RNA, 22 nt, Human
gagcagugaagacagaaguaca

SEQ ID NO: 499203 - RNA, 22 nt, Human
augcuuuuccaggagaaauaua

SEQ ID NO: 499204 - RNA, 22 nt, Human
agagacaggaguucuguuucca

SEQ ID NO: 499205 - RNA, 22 nt, Human
agcugccuccauggucaaagau

SEQ ID NO: 499206 - RNA, 22 nt, Human
guguccagggccguguugucuu

SEQ ID NO: 499207 - RNA, 22 nt, Human
ggcaggcuugauauggggggac

SEQ ID NO: 499208 - RNA, 22 nt, Human
agagggaucacccuguuucugg

SEQ ID NO: 499209 - RNA, 22 nt, Human
aggcugccaaagcuucugucuc

SEQ ID NO: 499210 - RNA, 22 nt, Human
cagcuugcuaauuuugacuuca

SEQ ID NO: 499211 - RNA, 22 nt, Human
gugaaggaccaauaugacucau

SEQ ID NO: 499212 - RNA, 19 nt, Human
uuuggcacucugaaguguu

SEQ ID NO: 499213 - RNA, 22 nt, Human
gaaucucaaauuaagaauuuua

SEQ ID NO: 499214 - RNA, 20 nt, Human
uuguuuuaaauccuggauga

SEQ ID NO: 499215 - RNA, 22 nt, Human
uaaguauuggccuauagcuaga

SEQ ID NO: 499216 - RNA, 22 nt, Human
ugagaaugugcaauauccuucc

SEQ ID NO: 499217 - RNA, 22 nt, Human
ggccaggaagggaagaucagca

SEQ ID NO: 499218 - RNA, 22 nt, Human
uuguaacaggcacucugugcca

SEQ ID NO: 499219 - RNA, 23 nt, Human
uucuggauguucuagucugagag

SEQ ID NO: 499220 - RNA, 22 nt, Human
auaaacugaagggaacacugag

SEQ ID NO: 499221 - RNA, 22 nt, Human
uguggguuuaagaggcagcaug

SEQ ID NO: 499222 - RNA, 22 nt, Human
uuauuaaugaguacaaguuauu

SEQ ID NO: 499223 - RNA, 22 nt, Human
ccagagagguagcuuacccucu

SEQ ID NO: 499224 - RNA, 22 nt, Human
aaggucauggcaaauuacuuuu

SEQ ID NO: 499225 - RNA, 22 nt, Human
aaaucaguucucccuuucuuca

SEQ ID NO: 499226 - RNA, 22 nt, Human
ucaggcucagguuaggggccaa

SEQ ID NO: 499227 - RNA, 22 nt, Human
gagcagcuggacaggccucccu

SEQ ID NO: 499228 - RNA, 22 nt, Human
ugucugaaacuuaugauauacu

SEQ ID NO: 499229 - RNA, 22 nt, Human
cauugcaacuucaaacuccugg

SEQ ID NO: 499230 - RNA, 22 nt, Human
accugcaguggccacuccuaau

SEQ ID NO: 499231 - RNA, 19 nt, Human
cugugcaggccgggcugag

SEQ ID NO: 499232 - RNA, 22 nt, Human
ucccugggccuccugcuaugca

SEQ ID NO: 499233 - RNA, 22 nt, Human
ugcagagaaaacuccuggguac

SEQ ID NO: 499234 - RNA, 22 nt, Human
uuggagcccugaggaucuggau

SEQ ID NO: 499235 - RNA, 22 nt, Human
guggcuucuggcugggccucag

SEQ ID NO: 499236 - RNA, 22 nt, Human
ucacagaaaaguggagagccua

SEQ ID NO: 499237 - RNA, 22 nt, Human
gcccagugguaaaagcaggccu

SEQ ID NO: 499238 - RNA, 22 nt, Human
agcugguguccuccuggagcug

SEQ ID NO: 499239 - RNA, 22 nt, Human
gcauuaauguaagacccacucc

SEQ ID NO: 499240 - RNA, 22 nt, Human
caagaugacaaggcuggaggcu

SEQ ID NO: 499241 - RNA, 22 nt, Human
cucugggucucccugaggcuaa

SEQ ID NO: 499242 - RNA, 22 nt, Human
aaugcaaugcagcaccuccuug

SEQ ID NO: 499243 - RNA, 22 nt, Human
auuccuuguauaucuacaugca

SEQ ID NO: 499244 - RNA, 22 nt, Human
cagaaauguuuauauguggugu

SEQ ID NO: 499245 - RNA, 18 nt, Human
gaaaugugauucuagggc

SEQ ID NO: 499246 - RNA, 22 nt, Human
ggcugcaggaacgacggagggg

SEQ ID NO: 499247 - RNA, 22 nt, Human
gccugcagcaugcuaggucuug

SEQ ID NO: 499248 - RNA, 22 nt, Human
auaaaacuuauuagaauugugu

SEQ ID NO: 499249 - RNA, 22 nt, Human
gcuggccccgagugcuacgcuc

SEQ ID NO: 499250 - RNA, 22 nt, Human
cagcccagcacuaaguagauuu

SEQ ID NO: 499251 - RNA, 22 nt, Human
acaugauuuuaguaucauaaua

SEQ ID NO: 499252 - RNA, 22 nt, Human
uccugccagcuggggcugcuuc

SEQ ID NO: 499253 - RNA, 22 nt, Human
accuggcuuccaaucuaggagc

SEQ ID NO: 499254 - RNA, 22 nt, Human
aagaggucauaccagauaaggg

SEQ ID NO: 499255 - RNA, 22 nt, Human
caggagcuucugcccauggcca

SEQ ID NO: 499256 - RNA, 22 nt, Human
aaguucaaguguaaucuuuauu

SEQ ID NO: 499257 - RNA, 22 nt, Human
ccacaggcugcugcaggucccg

SEQ ID NO: 499258 - RNA, 22 nt, Human
ucccagcgcggggggaggaucc

SEQ ID NO: 499259 - RNA, 22 nt, Human
guuuuggcagccguguucacau

SEQ ID NO: 499260 - RNA, 22 nt, Human
aaauacacguacauguguaaaa

SEQ ID NO: 499261 - RNA, 22 nt, Human
agagaaaagaguucaggcuuug

SEQ ID NO: 499262 - RNA, 22 nt, Human
agggugcauguuugcaagagug

SEQ ID NO: 499263 - RNA, 21 nt, Human
ggugucaguuuuggucauuag

SEQ ID NO: 499264 - RNA, 22 nt, Human
uuucagcacuuuaggcagcagg

SEQ ID NO: 499265 - RNA, 21 nt, Human
uggcugccuacaugcugcagg

SEQ ID NO: 499266 - RNA, 22 nt, Human
cagggccaagcugcagcaucug

SEQ ID NO: 499267 - RNA, 22 nt, Human
cuguggcuguauuuggccagag

SEQ ID NO: 499268 - RNA, 22 nt, Human
uuuauugcauacacaaauguca

SEQ ID NO: 499269 - RNA, 22 nt, Human
gccuggcuauggccucccccau

SEQ ID NO: 499270 - RNA, 22 nt, Human
aucacgucaugguuugaucugg

SEQ ID NO: 499271 - RNA, 22 nt, Human
cagcauuuucuuaauguaggug

SEQ ID NO: 499272 - RNA, 22 nt, Human
aagugugggaaguugcuaaaau

SEQ ID NO: 499273 - RNA, 22 nt, Human
cuggcagcuuagcacucugguu

SEQ ID NO: 499274 - RNA, 22 nt, Human
caggugccgggaaugcagcaau

SEQ ID NO: 499275 - RNA, 22 nt, Human
aaacaaagccagggaaguuaug

SEQ ID NO: 499276 - RNA, 22 nt, Human
cugggcagccucacacaauguu

SEQ ID NO: 499277 - RNA, 22 nt, Human
auauuuaacuggucccaauaua

SEQ ID NO: 499278 - RNA, 22 nt, Human
aguguacauguuuacagcaucu

SEQ ID NO: 499279 - RNA, 23 nt, Human
gugcucugcggucugcuagucug

SEQ ID NO: 499280 - RNA, 23 nt, Human
ggcuccuggauucaaauccugcc

SEQ ID NO: 499281 - RNA, 22 nt, Human
aagauauagauaaaacuaugca

SEQ ID NO: 499282 - RNA, 22 nt, Human
gggcuguggagccgcgagggcu

SEQ ID NO: 499283 - RNA, 22 nt, Human
ugagcagcccuuccuccggcca

SEQ ID NO: 499284 - RNA, 22 nt, Human
uguuacuuaucucacgugaugc

SEQ ID NO: 499285 - RNA, 22 nt, Human
uuuucucuauauugucugugaa

SEQ ID NO: 499286 - RNA, 22 nt, Human
cccuggccccucacuccgaggc

SEQ ID NO: 499287 - RNA, 22 nt, Human
uagugcaaugugaggcaguacc

SEQ ID NO: 499288 - RNA, 22 nt, Human
uggcuccuucauucuccugcca

SEQ ID NO: 499289 - RNA, 22 nt, Human
ccugucagaugaaguaauugug

SEQ ID NO: 499290 - RNA, 22 nt, Human
auguguccacaggugugagaga

SEQ ID NO: 499291 - RNA, 22 nt, Human
uguccugggaggcgggguccag

SEQ ID NO: 499292 - RNA, 22 nt, Human
ccaggcauggggagagccagau

SEQ ID NO: 499293 - RNA, 21 nt, Human
aggccucuucauggccaugau

SEQ ID NO: 499294 - RNA, 22 nt, Human
cuggggcccugggucugcccuc

SEQ ID NO: 499295 - RNA, 22 nt, Human
gaugcacaugugaguauagaag

SEQ ID NO: 499296 - RNA, 22 nt, Human
gcagcagcucugaaugggcccc

SEQ ID NO: 499297 - RNA, 22 nt, Human
uugcuuuuuaauuaggaggcag

SEQ ID NO: 499298 - RNA, 22 nt, Human
acugagcugugacaaugcuuaa

SEQ ID NO: 499299 - RNA, 22 nt, Human
aauacaaucaaauucacuagca

SEQ ID NO: 499300 - RNA, 22 nt, Human
gggcugaccccaccccucacuc

SEQ ID NO: 499301 - RNA, 22 nt, Human
aacaaaggccguuaauaaccac

SEQ ID NO: 499302 - RNA, 22 nt, Human
uuccuguauuuugcgaauuuuc

SEQ ID NO: 499303 - RNA, 22 nt, Human
gucagaggaauggaugagugau

SEQ ID NO: 499304 - RNA, 22 nt, Human
gggugggaacaggaugccagga

SEQ ID NO: 499305 - RNA, 22 nt, Human
cauggccagggcagauggcagg

SEQ ID NO: 499306 - RNA, 22 nt, Human
cucugcuuuuuagggagccuag

SEQ ID NO: 499307 - RNA, 22 nt, Human
uggcucuguuuuaugaguacca

SEQ ID NO: 499308 - RNA, 22 nt, Human
uuuuccucaggaaugcuaagcu

SEQ ID NO: 499309 - RNA, 22 nt, Human
aaggaugauugguaaugacacu

SEQ ID NO: 499310 - RNA, 21 nt, Human
cucuggagucaagagcuucca

SEQ ID NO: 499311 - RNA, 23 nt, Human
cuuucauugugguuucacagagc

SEQ ID NO: 499312 - RNA, 22 nt, Human
ugacagcugagccccaggcaag

SEQ ID NO: 499313 - RNA, 22 nt, Human
gggcacugcuggaggcucccug

SEQ ID NO: 499314 - RNA, 22 nt, Human
ccuuagugugccugaggcagau

SEQ ID NO: 499315 - RNA, 22 nt, Human
acaguaauuaaaauggaucugc

SEQ ID NO: 499316 - RNA, 22 nt, Human
uuguccugugucuguuuggauu

SEQ ID NO: 499317 - RNA, 22 nt, Human
gucacaggccuggaugaggggc

SEQ ID NO: 499318 - RNA, 22 nt, Human
ucauugcaggcauuccccugcc

SEQ ID NO: 499319 - RNA, 22 nt, Human
cuuuauguuggggugucuuagu

SEQ ID NO: 499320 - RNA, 22 nt, Human
ucaguuuuuaagaguuaugcga

SEQ ID NO: 499321 - RNA, 22 nt, Human
ucuguucagaauuguaacacuc

SEQ ID NO: 499322 - RNA, 22 nt, Human
auuucucacucacaguccaugu

SEQ ID NO: 499323 - RNA, 20 nt, Human
cuggggacagcaauggcugu

SEQ ID NO: 499324 - RNA, 22 nt, Human
ggagcagcacugccacacagag

SEQ ID NO: 499325 - RNA, 22 nt, Human
gagggugggcuccuaucugggu

SEQ ID NO: 499326 - RNA, 22 nt, Human
cagaguguugaccauaagccca

SEQ ID NO: 499327 - RNA, 19 nt, Human
uaaggccaaaaguaagugu

SEQ ID NO: 499328 - RNA, 22 nt, Human
aaguucaaggcagguccugagg

SEQ ID NO: 499329 - RNA, 22 nt, Human
uccuaauugcuucauguguugu

SEQ ID NO: 499330 - RNA, 19 nt, Human
uagcugccuguuaccucca

SEQ ID NO: 499331 - RNA, 22 nt, Human
uccugagauguggagcuccaug

SEQ ID NO: 499332 - RNA, 22 nt, Human
uugaggagcaggaugggaggcu

SEQ ID NO: 499333 - RNA, 22 nt, Human
cccuggaguagcacugggucgc

SEQ ID NO: 499334 - RNA, 22 nt, Human
gucaggaaaaauugauaauuuu

SEQ ID NO: 499335 - RNA, 23 nt, Human
ugcagggcaaguuagagacccca

SEQ ID NO: 499336 - RNA, 22 nt, Human
gggagggccagugcucucuaga

SEQ ID NO: 499337 - RNA, 22 nt, Human
gagccagcuacauggucugcaa

SEQ ID NO: 499338 - RNA, 22 nt, Human
aggcagccagauggcagccugc

SEQ ID NO: 499339 - RNA, 22 nt, Human
gcagcugguuaaugggagaauu

SEQ ID NO: 499340 - RNA, 22 nt, Human
cucucuggauauuuguaugcug

SEQ ID NO: 499341 - RNA, 22 nt, Human
gcacacaguagggauucaauga

SEQ ID NO: 499342 - RNA, 22 nt, Human
gguuggaggugggaauagcuag

SEQ ID NO: 499343 - RNA, 22 nt, Human
acucacauuucaucaggccaag

SEQ ID NO: 499344 - RNA, 22 nt, Human
gcugucucggggcuuucuccug

SEQ ID NO: 499345 - RNA, 22 nt, Human
gaaggccauugcguccugggau

SEQ ID NO: 499346 - RNA, 22 nt, Human
acaacaaagacacuugaaauga

SEQ ID NO: 499347 - RNA, 22 nt, Human
ccagcucuguaagcugugaaau

SEQ ID NO: 499348 - RNA, 22 nt, Human
uugagaagaggcuuuguaggaa

SEQ ID NO: 499349 - RNA, 22 nt, Human
uuguuuucuccacugcaucuua

SEQ ID NO: 499350 - RNA, 22 nt, Human
ggaaagccaggugcucuggugu

SEQ ID NO: 499351 - RNA, 22 nt, Human
ggcugccagugagugcagaccg

SEQ ID NO: 499352 - RNA, 22 nt, Human
gaaguagaaaacucaguuucaa

SEQ ID NO: 499353 - RNA, 22 nt, Human
agugcauugcaucucugcuuca

SEQ ID NO: 499354 - RNA, 22 nt, Human
cccuggaggcggauguugcagu

SEQ ID NO: 499355 - RNA, 21 nt, Human
aggcacuguuugugguuuggg

SEQ ID NO: 499356 - RNA, 22 nt, Human
aagaaauuaaugugccauuacu

SEQ ID NO: 499357 - RNA, 22 nt, Human
acaagaauuauuucuaguuaac

SEQ ID NO: 499358 - RNA, 17 nt, Human
ggcuggaggggacccgg

SEQ ID NO: 499359 - RNA, 19 nt, Human
agacaaguuuccagaagcc

SEQ ID NO: 499360 - RNA, 22 nt, Human
ggcugaggggcccagaggaaca

SEQ ID NO: 499361 - RNA, 22 nt, Human
gcugccuggaauaacggcuggc

SEQ ID NO: 499362 - RNA, 22 nt, Human
guaguucugcagugucaccuga

SEQ ID NO: 499363 - RNA, 22 nt, Human
cuguggcugcgccaucgaaaac

SEQ ID NO: 499364 - RNA, 22 nt, Human
ccuggccucgugcucacggcuc

SEQ ID NO: 499365 - RNA, 22 nt, Human
aauuucucauggauucaguuau

SEQ ID NO: 499366 - RNA, 22 nt, Human
cugggcuggauaauucuuugcu

SEQ ID NO: 499367 - RNA, 22 nt, Human
aggccagguggucaugcuugcu

SEQ ID NO: 499368 - RNA, 22 nt, Human
uugaacaguuuugucagguuca

SEQ ID NO: 499369 - RNA, 22 nt, Human
acugggccuggauuggcguguc

SEQ ID NO: 499370 - RNA, 22 nt, Human
ccacugucuuuuccaggcugaa

SEQ ID NO: 499371 - RNA, 22 nt, Human
gcugggccgaccugggcugcag

SEQ ID NO: 499372 - RNA, 22 nt, Human
uggagucacuuccauaugggaa

SEQ ID NO: 499373 - RNA, 22 nt, Human
acagggcagagaggcaggcuug

SEQ ID NO: 499374 - RNA, 22 nt, Human
aauuagcuuuccgccaucacac

SEQ ID NO: 499375 - RNA, 22 nt, Human
gaguggguaccggagcaggugc

SEQ ID NO: 499376 - RNA, 22 nt, Human
caggcaaggagcuggcucaagu

SEQ ID NO: 499377 - RNA, 22 nt, Human
uuuugugagcccauaaaugcca

SEQ ID NO: 499378 - RNA, 22 nt, Human
auuauguagguuaggugguugu

SEQ ID NO: 499379 - RNA, 22 nt, Human
ccugaggcuggcccuuccaucc

SEQ ID NO: 499380 - RNA, 22 nt, Human
uggccugcccagagcagcucug

SEQ ID NO: 499381 - RNA, 22 nt, Human
ugggcuggugagggaucauuua

SEQ ID NO: 499382 - RNA, 22 nt, Human
cacaguggauugggugaugccc

SEQ ID NO: 499383 - RNA, 18 nt, Human
gcugggguugagcucucc

SEQ ID NO: 499384 - RNA, 22 nt, Human
guucauauuacuuugagugcag

SEQ ID NO: 499385 - RNA, 22 nt, Human
cuguggcugcgcccugggggag

SEQ ID NO: 499386 - RNA, 22 nt, Human
ggcagggaaacagcugauccca

SEQ ID NO: 499387 - RNA, 22 nt, Human
cucuguccacagguuugucccu

SEQ ID NO: 499388 - RNA, 22 nt, Human
cugggcaaauugugccagcuau

SEQ ID NO: 499389 - RNA, 22 nt, Human
cagcagcagauucagcgucugg

SEQ ID NO: 499390 - RNA, 21 nt, Human
uagaaucacuaauaagaugua

SEQ ID NO: 499391 - RNA, 22 nt, Human
uccaggucagacuucugugccc

SEQ ID NO: 499392 - RNA, 22 nt, Human
uucucuucuguucagugcccaa

SEQ ID NO: 499393 - RNA, 20 nt, Human
cuguggcaucugucauggug

SEQ ID NO: 499394 - RNA, 22 nt, Human
ugugugaacucucugauguaca

SEQ ID NO: 499395 - RNA, 22 nt, Human
ccucagccuuggccccaggcag

SEQ ID NO: 499396 - RNA, 22 nt, Human
caggcagccugagggaucuggg

SEQ ID NO: 499397 - RNA, 22 nt, Human
gccucugcaucuucgccgcacu

SEQ ID NO: 499398 - RNA, 18 nt, Human
gcuucucauuucuaagca

SEQ ID NO: 499399 - RNA, 22 nt, Human
uuucagaaccaagagagacauc

SEQ ID NO: 499400 - RNA, 21 nt, Human
gaagacaaaugggaauagcug

SEQ ID NO: 499401 - RNA, 22 nt, Human
gugccucagcaccgccugcagc

SEQ ID NO: 499402 - RNA, 22 nt, Human
cagugcaagugacugaucaagg

SEQ ID NO: 499403 - RNA, 22 nt, Human
caaaggcaacauauacuuguuu

SEQ ID NO: 499404 - RNA, 22 nt, Human
uccagcagaccaucaaggcuca

SEQ ID NO: 499405 - RNA, 22 nt, Human
ucuuuaauauaaaggaaugaau

SEQ ID NO: 499406 - RNA, 22 nt, Human
caguaaaagauggaaauagaau

SEQ ID NO: 499407 - RNA, 22 nt, Human
ccucuuugacuauaguaguuaa

SEQ ID NO: 499408 - RNA, 22 nt, Human
cagggccuccccggcagucuuu

SEQ ID NO: 499409 - RNA, 22 nt, Human
gggaccugcgccacucacuguc

SEQ ID NO: 499410 - RNA, 22 nt, Human
uccuggccuuauccccaaacug

SEQ ID NO: 499411 - RNA, 22 nt, Human
caguucuuaauaccaugugguu

SEQ ID NO: 499412 - RNA, 22 nt, Human
gccuucuguccaaccccacgau

SEQ ID NO: 499413 - RNA, 22 nt, Human
uaaaaguggauaagcuguagga

SEQ ID NO: 499414 - RNA, 22 nt, Human
uagaggugucacuuugggaagu

SEQ ID NO: 499415 - RNA, 22 nt, Human
auaagcuuccuguuagaaaccg

SEQ ID NO: 499416 - RNA, 22 nt, Human
ggccacagugggaaauccuggg

SEQ ID NO: 499417 - RNA, 22 nt, Human
aaugcacacauuugguacugaa

SEQ ID NO: 499418 - RNA, 22 nt, Human
uucuuugugcugaagaagcccu

SEQ ID NO: 499419 - RNA, 22 nt, Human
cagcaggaggcauggcuucccu

SEQ ID NO: 499420 - RNA, 22 nt, Human
cagcccugcucuuagugucucc

SEQ ID NO: 499421 - RNA, 22 nt, Human
ggagucugacucugacccugga

SEQ ID NO: 499422 - RNA, 20 nt, Human
gucuccacuggggguuaacc

SEQ ID NO: 499423 - RNA, 22 nt, Human
ggagaaggcacacccaccucug

SEQ ID NO: 499424 - RNA, 22 nt, Human
gucacacuagggccaaguggag

SEQ ID NO: 499425 - RNA, 20 nt, Human
gaguuccccauuucuccugg

SEQ ID NO: 499426 - RNA, 22 nt, Human
ugucucugccagcuagcagaau

SEQ ID NO: 499427 - RNA, 22 nt, Human
gccaccagccccaugcgcugug

SEQ ID NO: 499428 - RNA, 22 nt, Human
ugagggagucaugauuaaggaa

SEQ ID NO: 499429 - RNA, 22 nt, Human
cagccaggccuggugaccaaag

SEQ ID NO: 499430 - RNA, 22 nt, Human
acagccugcugccugcuucuug

SEQ ID NO: 499431 - RNA, 22 nt, Human
agccacagcaacaagugcaauu

SEQ ID NO: 499432 - RNA, 22 nt, Human
gcucaggaucccaggggugugc

SEQ ID NO: 499433 - RNA, 22 nt, Human
aaggcaguacuuuauguccaua

SEQ ID NO: 499434 - RNA, 22 nt, Human
auaauggccgggggcugaaugc

SEQ ID NO: 499435 - RNA, 22 nt, Human
guaagagcacugucuccugcug

SEQ ID NO: 499436 - RNA, 21 nt, Human
aaaguucaugcuuuaauauuc

SEQ ID NO: 499437 - RNA, 22 nt, Human
uuucucaucuggaaacagugcu

SEQ ID NO: 499438 - RNA, 20 nt, Human
ccugucuggagacaaagaga

SEQ ID NO: 499439 - RNA, 22 nt, Human
ucagucuccuuuccucuagaca

SEQ ID NO: 499440 - RNA, 22 nt, Human
cagucuccaaaucagucugaau

SEQ ID NO: 499441 - RNA, 22 nt, Human
uaaaugugucuuuuuaaggccu

SEQ ID NO: 499442 - RNA, 18 nt, Human
caggaugagugaugggga

SEQ ID NO: 499443 - RNA, 22 nt, Human
aguucuucauaaccuuacugug

SEQ ID NO: 499444 - RNA, 22 nt, Human
ucucccaagugaccaggaaaga

SEQ ID NO: 499445 - RNA, 22 nt, Human
uagcagggguagauagagugug

SEQ ID NO: 499446 - RNA, 22 nt, Human
guugcacaguuccucaagcagg

SEQ ID NO: 499447 - RNA, 22 nt, Human
gugugcagaagacacaagacau

SEQ ID NO: 499448 - RNA, 22 nt, Human
uuccauaaaggugauaguauac

SEQ ID NO: 499449 - RNA, 20 nt, Human
ggcugugcccuuccguggcc

SEQ ID NO: 499450 - RNA, 23 nt, Human
agccagggcacugguggagauug

SEQ ID NO: 499451 - RNA, 22 nt, Human
ggagaggacauggcucccacag

SEQ ID NO: 499452 - RNA, 19 nt, Human
caaguucuggagauuaggg

SEQ ID NO: 499453 - RNA, 22 nt, Human
acagggccaggugagaggugcu

SEQ ID NO: 499454 - RNA, 22 nt, Human
auguuucagauacagaucaaau

SEQ ID NO: 499455 - RNA, 22 nt, Human
aguagaaagaaggcacugggcc

SEQ ID NO: 499456 - RNA, 22 nt, Human
ccacagagacaggguccuugcu

SEQ ID NO: 499457 - RNA, 22 nt, Human
cuguccugaaguuuucaugaga

SEQ ID NO: 499458 - RNA, 22 nt, Human
uucuaauuguguuugcauaucu

SEQ ID NO: 499459 - RNA, 22 nt, Human
uuccagaauuuuguucugcuug

SEQ ID NO: 499460 - RNA, 22 nt, Human
aaguuacaguuacagaauggag

SEQ ID NO: 499461 - RNA, 22 nt, Human
auaaauuaugaauggcccuuuu

SEQ ID NO: 499462 - RNA, 23 nt, Human
guucauuuuauugucugauugcu

SEQ ID NO: 499463 - RNA, 22 nt, Human
cgcauacauagaaacacacaga

SEQ ID NO: 499464 - RNA, 22 nt, Human
aagggggcacagucacuguaau

SEQ ID NO: 499465 - RNA, 22 nt, Human
ggaaaaggccauuguuucucug

SEQ ID NO: 499466 - RNA, 20 nt, Human
gagguagggcuuaaggcaag

SEQ ID NO: 499467 - RNA, 22 nt, Human
aaugcuguaaagaugcuaucug

SEQ ID NO: 499468 - RNA, 15 nt, Human
aggcacugugggacc

SEQ ID NO: 499469 - RNA, 22 nt, Human
caagaaauuucuuaagaacuaa

SEQ ID NO: 499470 - RNA, 22 nt, Human
aggccagcccugggcugagaga

SEQ ID NO: 499471 - RNA, 22 nt, Human
caaaugauaccuauuacuaggc

SEQ ID NO: 499472 - RNA, 22 nt, Human
ccacuguuuuucaguuaacuuu

SEQ ID NO: 499473 - RNA, 22 nt, Human
uaagauaugguaggaaguuugg

SEQ ID NO: 499474 - RNA, 21 nt, Human
ggucuuccaaauaaggagaaa

SEQ ID NO: 499475 - RNA, 22 nt, Human
ccugggcuuuggaacaguacuu

SEQ ID NO: 499476 - RNA, 22 nt, Human
gggcggggcuuccguccuccac

SEQ ID NO: 499477 - RNA, 22 nt, Human
aaaguuucaauagaggaagugg

SEQ ID NO: 499478 - RNA, 22 nt, Human
uccagccuaggggaacagcugc

SEQ ID NO: 499479 - RNA, 22 nt, Human
ugucauuuauucucuuauucua

SEQ ID NO: 499480 - RNA, 22 nt, Human
auucuguauggaaaagcacuau

SEQ ID NO: 499481 - RNA, 22 nt, Human
caugugugaaucuugugaucau

SEQ ID NO: 499482 - RNA, 22 nt, Human
agaacagcaguuaugguucauu

SEQ ID NO: 499483 - RNA, 22 nt, Human
gacuagucauuugcauuccguc

SEQ ID NO: 499484 - RNA, 22 nt, Human
acuuucuuauccaugaucucac

SEQ ID NO: 499485 - RNA, 22 nt, Human
aacagugagaagguggacagga

SEQ ID NO: 499486 - RNA, 20 nt, Human
uauuuguauuugggaaaguu

SEQ ID NO: 499487 - RNA, 22 nt, Human
uuuccuugggucucuuaguggc

SEQ ID NO: 499488 - RNA, 22 nt, Human
ugggccugggagggcagacgcu

SEQ ID NO: 499489 - RNA, 22 nt, Human
uuaguaaauaaagucuacuuuc

SEQ ID NO: 499490 - RNA, 22 nt, Human
cuucuggguguggagugaggac

SEQ ID NO: 499491 - RNA, 22 nt, Human
ugcagugccucggcagugcagc

SEQ ID NO: 499492 - RNA, 22 nt, Human
acuacagaagucuuauuagaga

SEQ ID NO: 499493 - RNA, 22 nt, Human
uucugggguuaugggugauucu

SEQ ID NO: 499494 - RNA, 22 nt, Human
gaggcuggcagaaaagcacagg

SEQ ID NO: 499495 - RNA, 19 nt, Human
ugacaggcuguugccuuga

SEQ ID NO: 499496 - RNA, 22 nt, Human
agcauauaggaaauguugaauc

SEQ ID NO: 499497 - RNA, 22 nt, Human
gccuuuuuuguugcucugucac

SEQ ID NO: 499498 - RNA, 22 nt, Human
gcuguucacggaggaggauggg

SEQ ID NO: 499499 - RNA, 17 nt, Human
agaggcagauacuugga

SEQ ID NO: 499500 - RNA, 22 nt, Human
ugaggggcggccugcagaggcc

SEQ ID NO: 499501 - RNA, 22 nt, Human
aggagggcaggcuggcugccua

SEQ ID NO: 499502 - RNA, 22 nt, Human
aauuaaaagauaacccaugagu

SEQ ID NO: 499503 - RNA, 22 nt, Human
auuauuagugauguuguuacug

SEQ ID NO: 499504 - RNA, 22 nt, Human
ccuggguuauuuuggucuagug

SEQ ID NO: 499505 - RNA, 22 nt, Human
gcugcucuugaggggcucacug

SEQ ID NO: 499506 - RNA, 22 nt, Human
aauuuguuagcauacucuaguu

SEQ ID NO: 499507 - RNA, 22 nt, Human
aaggagcugggagggacacaug

SEQ ID NO: 499508 - RNA, 22 nt, Human
uuucacauuuuauacuuaagcc

SEQ ID NO: 499509 - RNA, 22 nt, Human
gagccaccuucaacucaggaau

SEQ ID NO: 499510 - RNA, 17 nt, Human
aggcauggucuggggug

SEQ ID NO: 499511 - RNA, 18 nt, Human
gcaggagauggguggggu

SEQ ID NO: 499512 - RNA, 22 nt, Human
ggacaggugcaaagggcacaug

SEQ ID NO: 499513 - RNA, 22 nt, Human
uuacauuuugggguaaggauaa

SEQ ID NO: 499514 - RNA, 22 nt, Human
ugggggcagccaggcugucaag

SEQ ID NO: 499515 - RNA, 22 nt, Human
uccuugaagcuuguaucuaaua

SEQ ID NO: 499516 - RNA, 20 nt, Human
aagguccaaacucuguguuc

SEQ ID NO: 499517 - RNA, 22 nt, Human
ucucccaacauguggaggucag

SEQ ID NO: 499518 - RNA, 22 nt, Human
uggccugcagaggcuguggggc

SEQ ID NO: 499519 - RNA, 22 nt, Human
caugucuguguacacaugcaca

SEQ ID NO: 499520 - RNA, 22 nt, Human
agaugagggguagaaaggacuu

SEQ ID NO: 499521 - RNA, 21 nt, Human
uucuacaggaugaaugaaaac

SEQ ID NO: 499522 - RNA, 21 nt, Human
ggagaaggacaauguugagua

SEQ ID NO: 499523 - RNA, 22 nt, Human
ggugcccagcgaaguggcugug

SEQ ID NO: 499524 - RNA, 22 nt, Human
uccuggcccggccgggccugcu

SEQ ID NO: 499525 - RNA, 22 nt, Human
gggaucugacuugcuggugggu

SEQ ID NO: 499526 - RNA, 22 nt, Human
cucaggauagcugcgcagccug

SEQ ID NO: 499527 - RNA, 22 nt, Human
aucagcaaggcaaucacugcag

SEQ ID NO: 499528 - RNA, 22 nt, Human
aggccucugggucuccucugac

SEQ ID NO: 499529 - RNA, 22 nt, Human
auaauguagguauguguauuua

SEQ ID NO: 499530 - RNA, 22 nt, Human
uaagaacagugacagccaacau

SEQ ID NO: 499531 - RNA, 22 nt, Human
caguccugggcaggucaggcca

SEQ ID NO: 499532 - RNA, 22 nt, Human
cagagguagggagcuauguuau

SEQ ID NO: 499533 - RNA, 22 nt, Human
cucugcccacgucuugcccaga

SEQ ID NO: 499534 - RNA, 22 nt, Human
agggacuuguguccuauguaug

SEQ ID NO: 499535 - RNA, 22 nt, Human
ucugggcuuuuccaugccugug

SEQ ID NO: 499536 - RNA, 22 nt, Human
uggcacugccaaccugcuaggu

SEQ ID NO: 499537 - RNA, 22 nt, Human
aguauucuggaauucuauguga

SEQ ID NO: 499538 - RNA, 22 nt, Human
ccacaggaaguuaugaguacua

SEQ ID NO: 499539 - RNA, 22 nt, Human
cacauguguauaugugaggggg

SEQ ID NO: 499540 - RNA, 22 nt, Human
agaggcccuggcuagagcagcu

SEQ ID NO: 499541 - RNA, 18 nt, Human
cagucccaaaccuuagga

SEQ ID NO: 499542 - RNA, 22 nt, Human
gcagggugccgacuucagggau

SEQ ID NO: 499543 - RNA, 22 nt, Human
agguccaggauuuguggggucu

SEQ ID NO: 499544 - RNA, 22 nt, Human
aaggagaagucuguugagauug

SEQ ID NO: 499545 - RNA, 22 nt, Human
cucugggaauucugagcaagca

SEQ ID NO: 499546 - RNA, 19 nt, Human
acacauuugcacaauccac

SEQ ID NO: 499547 - RNA, 22 nt, Human
auggccaguguuucccucaguu

SEQ ID NO: 499548 - RNA, 22 nt, Human
caguccagcucaucaguggcac

SEQ ID NO: 499549 - RNA, 22 nt, Human
ccugauguccauaauccuguaa

SEQ ID NO: 499550 - RNA, 22 nt, Human
uccaagcuuuccaugcccucac

SEQ ID NO: 499551 - RNA, 22 nt, Human
gcccugagggguggugucugua

SEQ ID NO: 499552 - RNA, 21 nt, Human
ccagggaagaaaugagggcag

SEQ ID NO: 499553 - RNA, 22 nt, Human
uggguggcacuucuggggucca

SEQ ID NO: 499554 - RNA, 22 nt, Human
ccuggaccaaacacuggccugg

SEQ ID NO: 499555 - RNA, 22 nt, Human
uuuguacacugucuacuaugaa

SEQ ID NO: 499556 - RNA, 22 nt, Human
cugagcugggcucucuugaggg

SEQ ID NO: 499557 - RNA, 22 nt, Human
uagcagcaauuucagaaguuug

SEQ ID NO: 499558 - RNA, 22 nt, Human
cccugugucuucuugccuuugu

SEQ ID NO: 499559 - RNA, 22 nt, Human
ucuguucaguugauguaguuuu

SEQ ID NO: 499560 - RNA, 17 nt, Human
gagucuguguucaucag

SEQ ID NO: 499561 - RNA, 22 nt, Human
aaaggccauuacuugcuuuuag

SEQ ID NO: 499562 - RNA, 22 nt, Human
acacugaauauacaaugaauau

SEQ ID NO: 499563 - RNA, 22 nt, Human
cugagccagcgggcucacuuuu

SEQ ID NO: 499564 - RNA, 21 nt, Human
gacaggggaagaagcaaggag

SEQ ID NO: 499565 - RNA, 22 nt, Human
agggauggaagcucgucugcaa

SEQ ID NO: 499566 - RNA, 22 nt, Human
cacugaaggacaguaggaaggg

SEQ ID NO: 499567 - RNA, 22 nt, Human
uuccagaagccuccauauuacu

SEQ ID NO: 499568 - RNA, 22 nt, Human
acuaagugauucuaagcaucuu

SEQ ID NO: 499569 - RNA, 22 nt, Human
gaguuauuggguggaaagguag

SEQ ID NO: 499570 - RNA, 20 nt, Human
cucaguguauucugggugcu

SEQ ID NO: 499571 - RNA, 22 nt, Human
cagcaauaagccagguuagaca

SEQ ID NO: 499572 - RNA, 22 nt, Human
agggccugucagcgguguccug

SEQ ID NO: 499573 - RNA, 22 nt, Human
cagcugagaccagaaugcaggu

SEQ ID NO: 499574 - RNA, 22 nt, Human
gauccuguuauaauuuggaugu

SEQ ID NO: 499575 - RNA, 22 nt, Human
gauacuuuccauccaaaugcau

SEQ ID NO: 499576 - RNA, 22 nt, Human
agacuguaauugacaugucagc

SEQ ID NO: 499577 - RNA, 22 nt, Human
agcucccagucuccucuccaug

SEQ ID NO: 499578 - RNA, 22 nt, Human
agaggcugggaaggguccccgg

SEQ ID NO: 499579 - RNA, 21 nt, Human
acaggcuuuagaaaaugacuc

SEQ ID NO: 499580 - RNA, 18 nt, Human
uggagcugagugcugugc

SEQ ID NO: 499581 - RNA, 22 nt, Human
uccuggcugucacucggguuga

SEQ ID NO: 499582 - RNA, 22 nt, Human
uuagcagcaauggcaucaacua

SEQ ID NO: 499583 - RNA, 22 nt, Human
ggggagcagaagcagcaacaac

SEQ ID NO: 499584 - RNA, 22 nt, Human
gucucccaaccccugugcccag

SEQ ID NO: 499585 - RNA, 22 nt, Human
uucauacaguggcugcacucca

SEQ ID NO: 499586 - RNA, 22 nt, Human
agguuauaugucauacugaagu

SEQ ID NO: 499587 - RNA, 22 nt, Human
gcucugaggcugggagcacucu

SEQ ID NO: 499588 - RNA, 22 nt, Human
gcagggcuguggacacuuuggu

SEQ ID NO: 499589 - RNA, 22 nt, Human
augucacagcucccauuccucc

SEQ ID NO: 499590 - RNA, 22 nt, Human
uaagcaaauaaugcaucaaggg

SEQ ID NO: 499591 - RNA, 22 nt, Human
caaaugaagguggugggucauu

SEQ ID NO: 499592 - RNA, 22 nt, Human
agggaaaggcugaugcuguggg

SEQ ID NO: 499593 - RNA, 22 nt, Human
ugguccaguuuagcauugagug

SEQ ID NO: 499594 - RNA, 22 nt, Human
cagggcagaaggcacucuacuc

SEQ ID NO: 499595 - RNA, 22 nt, Human
cacagggcagaggguccguggc

SEQ ID NO: 499596 - RNA, 22 nt, Human
caggcugggcugguguuagagu

SEQ ID NO: 499597 - RNA, 22 nt, Human
cccagguggcagaagcugcagu

SEQ ID NO: 499598 - RNA, 22 nt, Human
uguuuucuauuaccugagauug

SEQ ID NO: 499599 - RNA, 22 nt, Human
cagcccuguccagcagagggug

SEQ ID NO: 499600 - RNA, 22 nt, Human
uuuguuugaaagucucuacagc

SEQ ID NO: 499601 - RNA, 22 nt, Human
aaaguagcuuuguagguacagu

SEQ ID NO: 499602 - RNA, 22 nt, Human
aguggcaucaaaucaagguuug

SEQ ID NO: 499603 - RNA, 22 nt, Human
agcaccugcacaguggaggaaa

SEQ ID NO: 499604 - RNA, 21 nt, Human
uagggcaggcauuggaagaga

SEQ ID NO: 499605 - RNA, 22 nt, Human
guggccagccccauggacaguu

SEQ ID NO: 499606 - RNA, 22 nt, Human
ugaucacaagucugaagaauga

SEQ ID NO: 499607 - RNA, 22 nt, Human
gcagcuuucuacuuccuacagc

SEQ ID NO: 499608 - RNA, 19 nt, Human
uggcuucuguuuucauguu

SEQ ID NO: 499609 - RNA, 22 nt, Human
cccaggccagaacuugguugcu

SEQ ID NO: 499610 - RNA, 22 nt, Human
uuguuuucacagcuuugcccgg

SEQ ID NO: 499611 - RNA, 22 nt, Human
gagcucugacugcugggugaca

SEQ ID NO: 499612 - RNA, 22 nt, Human
gucccagaugucuggaacuccc

SEQ ID NO: 499613 - RNA, 21 nt, Human
ugucuucauaugagauggugu

SEQ ID NO: 499614 - RNA, 22 nt, Human
cucaacauuuaacagugaaaaa

SEQ ID NO: 499615 - RNA, 22 nt, Human
accuguuucucucugaguuacu

SEQ ID NO: 499616 - RNA, 22 nt, Human
gaaggccacuuuguguugagaa

SEQ ID NO: 499617 - RNA, 22 nt, Human
uguacaaugccagggaacacca

SEQ ID NO: 499618 - RNA, 22 nt, Human
gcagaggcauuucugacgcugc

SEQ ID NO: 499619 - RNA, 22 nt, Human
uauuuugagguauuuuugagcu

SEQ ID NO: 499620 - RNA, 22 nt, Human
aaagucaaugauuucuccugga

SEQ ID NO: 499621 - RNA, 22 nt, Human
gcuccaagguauccaccagggu

SEQ ID NO: 499622 - RNA, 18 nt, Human
cugaggcuggcaggagcc

SEQ ID NO: 499623 - RNA, 22 nt, Human
ggagaaagcuguaguggaaugu

SEQ ID NO: 499624 - RNA, 22 nt, Human
cugagcugaaacuugagaggcu

SEQ ID NO: 499625 - RNA, 22 nt, Human
agaagcagacucugaggcaagg

SEQ ID NO: 499626 - RNA, 22 nt, Human
auacagugaauacuuacagugu

SEQ ID NO: 499627 - RNA, 22 nt, Human
aucaaaaugcuccagugauggu

SEQ ID NO: 499628 - RNA, 22 nt, Human
caggagacuauggcccaaggcc

SEQ ID NO: 499629 - RNA, 21 nt, Human
uucuccaggcaaccauuucag

SEQ ID NO: 499630 - RNA, 22 nt, Human
ggaaggaggaugcucuggccuu

SEQ ID NO: 499631 - RNA, 22 nt, Human
gggaaagaagaucuagauacug

SEQ ID NO: 499632 - RNA, 22 nt, Human
ccucugccuuuagugaaaguug

SEQ ID NO: 499633 - RNA, 22 nt, Human
cuuaacagcaagaucuguguca

SEQ ID NO: 499634 - RNA, 22 nt, Human
cuauaauuaugcucaaaaugua

SEQ ID NO: 499635 - RNA, 22 nt, Human
gcugggcagccccuacagagag

SEQ ID NO: 499636 - RNA, 22 nt, Human
gaaagacauaguugcaagaugg

SEQ ID NO: 499637 - RNA, 22 nt, Human
ugcugcuuugauguguaaauca

SEQ ID NO: 499638 - RNA, 22 nt, Human
uuuccuuguuauuauuuguccu

SEQ ID NO: 499639 - RNA, 22 nt, Human
uuguuaaaaugcauauucuggu

SEQ ID NO: 499640 - RNA, 22 nt, Human
aaguuugacagaaguuucuaau

SEQ ID NO: 499641 - RNA, 22 nt, Human
acaguaaugauucugagucucu

SEQ ID NO: 499642 - RNA, 22 nt, Human
aggugccuaucuggucucugca

SEQ ID NO: 499643 - RNA, 22 nt, Human
gccuggaggggccaggguggua

SEQ ID NO: 499644 - RNA, 22 nt, Human
gugaaugaaaggaugauucuuu

SEQ ID NO: 499645 - RNA, 22 nt, Human
uuccagauauuuuuauguggaa

SEQ ID NO: 499646 - RNA, 21 nt, Human
aaugcauuaacauaaagcuga

SEQ ID NO: 499647 - RNA, 22 nt, Human
agugcugaagacuggcuaggga

SEQ ID NO: 499648 - RNA, 22 nt, Human
gcacauacugcaaagauuacua

SEQ ID NO: 499649 - RNA, 22 nt, Human
aucagagauuguaguaugugca

SEQ ID NO: 499650 - RNA, 23 nt, Human
cagugcagggcaacucagacucc

SEQ ID NO: 499651 - RNA, 22 nt, Human
agaagccacuggagguugagau

SEQ ID NO: 499652 - RNA, 22 nt, Human
acuguacacagugguguacugu

SEQ ID NO: 499653 - RNA, 22 nt, Human
ugaaaucauugggguugaauaa

SEQ ID NO: 499654 - RNA, 22 nt, Human
ugcccuggcacacacacagcug

SEQ ID NO: 499655 - RNA, 22 nt, Human
agcagcugccagagagaguucc

SEQ ID NO: 499656 - RNA, 22 nt, Human
agaauuagucacaauuauagga

SEQ ID NO: 499657 - RNA, 22 nt, Human
ugcuauaagaauuauauuacuc

SEQ ID NO: 499658 - RNA, 22 nt, Human
uucuggggccccaguguccucg

SEQ ID NO: 499659 - RNA, 22 nt, Human
uaagaugggggaaagaaauagu

SEQ ID NO: 499660 - RNA, 22 nt, Human
gggcugcuuauacugaugauaa

SEQ ID NO: 499661 - RNA, 22 nt, Human
guguuuccucuagaagccaugg

SEQ ID NO: 499662 - RNA, 22 nt, Human
ugguccuggagaucaauaugca

SEQ ID NO: 499663 - RNA, 22 nt, Human
agagcuguggauaguccuggau

SEQ ID NO: 499664 - RNA, 22 nt, Human
acaggcugccacuugcauccaa

SEQ ID NO: 499665 - RNA, 22 nt, Human
ucucugaguaagugacaguuca

SEQ ID NO: 499666 - RNA, 22 nt, Human
uugucuggucaaaucacuugua

SEQ ID NO: 499667 - RNA, 22 nt, Human
cccuggagguggagguugcagg

SEQ ID NO: 499668 - RNA, 22 nt, Human
cuucuccuuauaugucccguuc

SEQ ID NO: 499669 - RNA, 22 nt, Human
cuggaagaggaagccagcugga

SEQ ID NO: 499670 - RNA, 22 nt, Human
cugccugugccaaugcuccuuu

SEQ ID NO: 499671 - RNA, 22 nt, Human
cugccagcucucuggaggcucu

SEQ ID NO: 499672 - RNA, 22 nt, Human
cagcagcaggcgcacggccguc

SEQ ID NO: 499673 - RNA, 22 nt, Human
cugaggucuagacaccccaggg

SEQ ID NO: 499674 - RNA, 22 nt, Human
ggguccaggcggcauaguugua

SEQ ID NO: 499675 - RNA, 22 nt, Human
aaauugcaaaaguacuuuuagg

SEQ ID NO: 499676 - RNA, 23 nt, Human
ccaggcaguagcuauugaaguga

SEQ ID NO: 499677 - RNA, 22 nt, Human
ugcagucuuccagcugcacaaa

SEQ ID NO: 499678 - RNA, 22 nt, Human
agccuggaggaggaguugagca

SEQ ID NO: 499679 - RNA, 22 nt, Human
caaaguuuaaaguagauuucag

SEQ ID NO: 499680 - RNA, 22 nt, Human
uaaagugcagacucccggaaac

SEQ ID NO: 499681 - RNA, 22 nt, Human
gagggggcgugcaaggcuccgc

SEQ ID NO: 499682 - RNA, 22 nt, Human
ugaacacugccauauuuaagaa

SEQ ID NO: 499683 - RNA, 22 nt, Human
ucuguccagcucuggggcucac

SEQ ID NO: 499684 - RNA, 22 nt, Human
ccuguggcacaugcagggauuc

SEQ ID NO: 499685 - RNA, 22 nt, Human
ucuuuccuacuuuauugugaac

SEQ ID NO: 499686 - RNA, 22 nt, Human
uuccaggaggcacugacagagg

SEQ ID NO: 499687 - RNA, 22 nt, Human
agggcuuuguggcagucacuau

SEQ ID NO: 499688 - RNA, 22 nt, Human
ugcagcuccucuggcugccuga

SEQ ID NO: 499689 - RNA, 22 nt, Human
cauugcacugcagcccgggcaa

SEQ ID NO: 499690 - RNA, 22 nt, Human
aagaacaguguccugggacucg

SEQ ID NO: 499691 - RNA, 22 nt, Human
gcugguuagaaaacagagcuca

SEQ ID NO: 499692 - RNA, 19 nt, Human
cugaggugcaguaagaggc

SEQ ID NO: 499693 - RNA, 22 nt, Human
gaagaucagaguaagcuuuuua

SEQ ID NO: 499694 - RNA, 22 nt, Human
gaagggggagcucuuccuaauu

SEQ ID NO: 499695 - RNA, 22 nt, Human
guacuuccagccaagugagaca

SEQ ID NO: 499696 - RNA, 22 nt, Human
uuuuccuucugauacuccauuu

SEQ ID NO: 499697 - RNA, 22 nt, Human
ccugggggccaggaagguguga

SEQ ID NO: 499698 - RNA, 22 nt, Human
ugagagcagaggugggcagccu

SEQ ID NO: 499699 - RNA, 23 nt, Human
gcagauggccccagagugcugcc

SEQ ID NO: 499700 - RNA, 22 nt, Human
augugugccugagugauggacu

SEQ ID NO: 499701 - RNA, 22 nt, Human
gacacagaaggucacauguuca

SEQ ID NO: 499702 - RNA, 22 nt, Human
aggagacagaauuuaaauuugg

SEQ ID NO: 499703 - RNA, 22 nt, Human
guuugauucaagaacaaagagu

SEQ ID NO: 499704 - RNA, 22 nt, Human
uccucagucucuaaggccucag

SEQ ID NO: 499705 - RNA, 22 nt, Human
uucuggaaaagaaaguuaagau

SEQ ID NO: 499706 - RNA, 22 nt, Human
uaaaacugcuugguauggucua

SEQ ID NO: 499707 - RNA, 22 nt, Human
gauccuugcacuugacuuggca

SEQ ID NO: 499708 - RNA, 22 nt, Human
uggaacacuggcuuuccacugu

SEQ ID NO: 499709 - RNA, 22 nt, Human
uaaaguauauuuuuucucaaua

SEQ ID NO: 499710 - RNA, 22 nt, Human
ggcaggugcuaagagagguaaa

SEQ ID NO: 499711 - RNA, 22 nt, Human
gauauuuuuaggugaugcaggc

SEQ ID NO: 499712 - RNA, 22 nt, Human
uugauguaaagugauucauggg

SEQ ID NO: 499713 - RNA, 22 nt, Human
guccaaguacauguguguacau

SEQ ID NO: 499714 - RNA, 23 nt, Human
ucugggccacuugucugcacuuc

SEQ ID NO: 499715 - RNA, 22 nt, Human
cuucaaguugggcggcgggcag

SEQ ID NO: 499716 - RNA, 20 nt, Human
guccaggacccagcaggagg

SEQ ID NO: 499717 - RNA, 22 nt, Human
auggaaagggaagcaaggaaca

SEQ ID NO: 499718 - RNA, 22 nt, Human
agugcuggaaagggacggagga

SEQ ID NO: 499719 - RNA, 22 nt, Human
gccucaaaaguguuguagaggg

SEQ ID NO: 499720 - RNA, 22 nt, Human
uggaaucucuuuggggacugaa

SEQ ID NO: 499721 - RNA, 22 nt, Human
aauuguuguacagaauaaauga

SEQ ID NO: 499722 - RNA, 22 nt, Human
gaaauauuacaguggaggggau

SEQ ID NO: 499723 - RNA, 17 nt, Human
ucugggcuucagugguc

SEQ ID NO: 499724 - RNA, 22 nt, Human
agcaugaaaggcgugccaacuu

SEQ ID NO: 499725 - RNA, 22 nt, Human
uccgcccgcacguauggagugg

SEQ ID NO: 499726 - RNA, 22 nt, Human
ugguuccucaagcgcuggcggc

SEQ ID NO: 499727 - RNA, 22 nt, Human
aagauacauaaagguagagucu

SEQ ID NO: 499728 - RNA, 22 nt, Human
cucugggcugaauggcugaacc

SEQ ID NO: 499729 - RNA, 22 nt, Human
acauuuuuggguugaugucuga

SEQ ID NO: 499730 - RNA, 22 nt, Human
ucaaauaccagcuuuuccagaa

SEQ ID NO: 499731 - RNA, 22 nt, Human
uggaagcaucacuucuugccug

SEQ ID NO: 499732 - RNA, 22 nt, Human
ucauuacaguguuuauaugucu

SEQ ID NO: 499733 - RNA, 22 nt, Human
gucuggaguggggccugagaau

SEQ ID NO: 499734 - RNA, 19 nt, Human
cccucuugcacaaagcaaa

SEQ ID NO: 499735 - RNA, 22 nt, Human
aguuucuguuaccauauuugac

SEQ ID NO: 499736 - RNA, 23 nt, Human
gccugggacucaggaggagcuca

SEQ ID NO: 499737 - RNA, 22 nt, Human
gcugcaggcauuuuccugggca

SEQ ID NO: 499738 - RNA, 22 nt, Human
auuagcuuugguggaaaggagu

SEQ ID NO: 499739 - RNA, 21 nt, Human
aagaagcaauuuauuggaagg

SEQ ID NO: 499740 - RNA, 22 nt, Human
cauguguggucuguggcuaucu

SEQ ID NO: 499741 - RNA, 22 nt, Human
ucucaggggccuggaguccugg

SEQ ID NO: 499742 - RNA, 22 nt, Human
cuugugcauuucauuccucagg

SEQ ID NO: 499743 - RNA, 22 nt, Human
ucucaggaauagaguggcagca

SEQ ID NO: 499744 - RNA, 22 nt, Human
gagcuuccacucuagaaggagu

SEQ ID NO: 499745 - RNA, 23 nt, Human
gaaucaguggcuaacaaggaaac

SEQ ID NO: 499746 - RNA, 22 nt, Human
agccacagagcaggagaccuuu

SEQ ID NO: 499747 - RNA, 22 nt, Human
ccagggaaaggagguugacuug

SEQ ID NO: 499748 - RNA, 22 nt, Human
uucaaacacagacagcagcaug

SEQ ID NO: 499749 - RNA, 22 nt, Human
aucaguuucuaccauguggaau

SEQ ID NO: 499750 - RNA, 22 nt, Human
ucugggugcccuuugcucuguu

SEQ ID NO: 499751 - RNA, 22 nt, Human
ccagcuuuauagcuucaaagga

SEQ ID NO: 499752 - RNA, 22 nt, Human
ucauugcagacuaacaaucuca

SEQ ID NO: 499753 - RNA, 22 nt, Human
auuugccuugugaauuggauau

SEQ ID NO: 499754 - RNA, 22 nt, Human
uauaguacauggaaucuucaua

SEQ ID NO: 499755 - RNA, 18 nt, Human
ccucugccauagccagca

SEQ ID NO: 499756 - RNA, 23 nt, Human
caguggagacucaugcuuccuua

SEQ ID NO: 499757 - RNA, 22 nt, Human
ucuagucauauuuuuucaguau

SEQ ID NO: 499758 - RNA, 22 nt, Human
agaaaugcagucucgucaaaag

SEQ ID NO: 499759 - RNA, 22 nt, Human
cacucugagaaguacaagcucc

SEQ ID NO: 499760 - RNA, 22 nt, Human
uguauuugaguuaugaaagaga

SEQ ID NO: 499761 - RNA, 22 nt, Human
uauaaagagucucaaagaaguu

SEQ ID NO: 499762 - RNA, 22 nt, Human
ugcccagccaauuuguuauguu

SEQ ID NO: 499763 - RNA, 22 nt, Human
gcaugucaugucauguaggaau

SEQ ID NO: 499764 - RNA, 22 nt, Human
ggcugccuucauagaccauggg

SEQ ID NO: 499765 - RNA, 22 nt, Human
ugcugccaugcagagcaacaga

SEQ ID NO: 499766 - RNA, 22 nt, Human
uucacaggauauaugugcaggg

SEQ ID NO: 499767 - RNA, 22 nt, Human
ggcacugauaauguccucucuc

SEQ ID NO: 499768 - RNA, 22 nt, Human
uauuugaaggcauacauuuuga

SEQ ID NO: 499769 - RNA, 22 nt, Human
acaguguuuaaaauaauaugcu

SEQ ID NO: 499770 - RNA, 18 nt, Human
ugaauuaguuugugguuu

SEQ ID NO: 499771 - RNA, 22 nt, Human
ugaugcugcugggaguggugcu

SEQ ID NO: 499772 - RNA, 22 nt, Human
gcugggcaccggagagacccca

SEQ ID NO: 499773 - RNA, 22 nt, Human
uagggaccuuagaauuguaugu

SEQ ID NO: 499774 - RNA, 22 nt, Human
ccugaggucaugguccaguguu

SEQ ID NO: 499775 - RNA, 22 nt, Human
uuucuacauuuguaaccagauu

SEQ ID NO: 499776 - RNA, 22 nt, Human
uguaggccuauguccagcaauu

SEQ ID NO: 499777 - RNA, 22 nt, Human
ucucucagucagaugcuaaaga

SEQ ID NO: 499778 - RNA, 19 nt, Human
cuguccugguuuggucccu

SEQ ID NO: 499779 - RNA, 22 nt, Human
gaccuucaguguguuucucaca

SEQ ID NO: 499780 - RNA, 22 nt, Human
aagggcaggcagagaucauaua

SEQ ID NO: 499781 - RNA, 22 nt, Human
cauuuagacauuugauuugggg

SEQ ID NO: 499782 - RNA, 22 nt, Human
cagagcacccaaggagcauuug

SEQ ID NO: 499783 - RNA, 22 nt, Human
uggcucugggaaugggaagaug

SEQ ID NO: 499784 - RNA, 22 nt, Human
uagaaagcugaguaauacauuu

SEQ ID NO: 499785 - RNA, 22 nt, Human
aaggaccuauauugucagagga

SEQ ID NO: 499786 - RNA, 22 nt, Human
uucaguguggugcacaguuuug

SEQ ID NO: 499787 - RNA, 22 nt, Human
ucaaaugcuguauuguaguaau

SEQ ID NO: 499788 - RNA, 22 nt, Human
ggcucagguuaccagucccucc

SEQ ID NO: 499789 - RNA, 22 nt, Human
aggcacuguacuagguacaggg

SEQ ID NO: 499790 - RNA, 22 nt, Human
ccaaaguccacaguuuacauua

SEQ ID NO: 499791 - RNA, 22 nt, Human
ugaugauguuuaucuugguauu

SEQ ID NO: 499792 - RNA, 22 nt, Human
uguggcucucagauccuccaau

SEQ ID NO: 499793 - RNA, 22 nt, Human
cguguacacgcacacguguccu

SEQ ID NO: 499794 - RNA, 22 nt, Human
caggaaauaaaaaguaucuucu

SEQ ID NO: 499795 - RNA, 22 nt, Human
cucaggaggaugacugccuugg

SEQ ID NO: 499796 - RNA, 22 nt, Human
ugauacuuuucuuuuagacuaa

SEQ ID NO: 499797 - RNA, 18 nt, Human
gaucgggggcgccccaag

SEQ ID NO: 499798 - RNA, 22 nt, Human
aucaaaguggaaguuuacuagg

SEQ ID NO: 499799 - RNA, 22 nt, Human
aaggaucaaguggauuuucuua

SEQ ID NO: 499800 - RNA, 22 nt, Human
gcagagguggcaucugggcucu

SEQ ID NO: 499801 - RNA, 22 nt, Human
ccaguguguucccugccucacu

SEQ ID NO: 499802 - RNA, 22 nt, Human
agcagguggacagaggaagaaa

SEQ ID NO: 499803 - RNA, 22 nt, Human
auggacuuaagagucagaagcu

SEQ ID NO: 499804 - RNA, 22 nt, Human
cagccuggauugcagaaugcua

SEQ ID NO: 499805 - RNA, 22 nt, Human
ugcagcugaggccagcuaugcc

SEQ ID NO: 499806 - RNA, 22 nt, Human
aagcagaaaaacugagcuccaa

SEQ ID NO: 499807 - RNA, 22 nt, Human
ugcauuuuacuuaccuguuagu

SEQ ID NO: 499808 - RNA, 22 nt, Human
ggggcuccagucuucacauuuu

SEQ ID NO: 499809 - RNA, 22 nt, Human
aaggaagguacucagugauucu

SEQ ID NO: 499810 - RNA, 22 nt, Human
gcagguggauuaucagaagugc

SEQ ID NO: 499811 - RNA, 22 nt, Human
aagcagcacaguaauauuggug

SEQ ID NO: 499812 - RNA, 22 nt, Human
aagaucaauguucauuaagaug

SEQ ID NO: 499813 - RNA, 22 nt, Human
ggcagcaugugugguccgcugg

SEQ ID NO: 499814 - RNA, 22 nt, Human
uggaaugacagagagucugaau

SEQ ID NO: 499815 - RNA, 22 nt, Human
cuuagcaugugguguccuugua

SEQ ID NO: 499816 - RNA, 20 nt, Human
agguuccagccacaaccagc

SEQ ID NO: 499817 - RNA, 20 nt, Human
ucagagagagggugccacuu

SEQ ID NO: 499818 - RNA, 21 nt, Human
gcucccuggcugugugaccug

SEQ ID NO: 499819 - RNA, 22 nt, Human
ggagcugaaggggugggcucag

SEQ ID NO: 499820 - RNA, 22 nt, Human
cugccugugauuuuucucuagu

SEQ ID NO: 499821 - RNA, 22 nt, Human
gggcagagagcuggaacuccuu

SEQ ID NO: 499822 - RNA, 22 nt, Human
uugucugaagucacacagaugc

SEQ ID NO: 499823 - RNA, 22 nt, Human
uaugcuuuuaaccuguaacuga

SEQ ID NO: 499824 - RNA, 22 nt, Human
agggccagccgacuuccagccu

SEQ ID NO: 499825 - RNA, 22 nt, Human
ggggauggaggcgugugguccu

SEQ ID NO: 499826 - RNA, 22 nt, Human
ucugccuggguguggagcagag

SEQ ID NO: 499827 - RNA, 22 nt, Human
gcucuucucagauuguacacuc

SEQ ID NO: 499828 - RNA, 22 nt, Human
cagagacagaaaauggaucuag

SEQ ID NO: 499829 - RNA, 22 nt, Human
aaauugugagcuauagaucuag

SEQ ID NO: 499830 - RNA, 22 nt, Human
gaagagcauaugaagagcauau

SEQ ID NO: 499831 - RNA, 22 nt, Human
acucugcuuauugcugcaggca

SEQ ID NO: 499832 - RNA, 22 nt, Human
agggccagcccauaaugccaaa

SEQ ID NO: 499833 - RNA, 22 nt, Human
cugcccacuauguugucauggg

SEQ ID NO: 499834 - RNA, 19 nt, Human
ucccuggcgccucucgggc

SEQ ID NO: 499835 - RNA, 22 nt, Human
uucacccuggaccagaaauugg

SEQ ID NO: 499836 - RNA, 22 nt, Human
aagaguuugucagaucugcacg

SEQ ID NO: 499837 - RNA, 22 nt, Human
uaaggccaaguucauauacaac

SEQ ID NO: 499838 - RNA, 22 nt, Human
gcaguguugcuaggugcgguga

SEQ ID NO: 499839 - RNA, 21 nt, Human
cuguuucuugugaagugacac

SEQ ID NO: 499840 - RNA, 20 nt, Human
gcugucuggauuagaagccu

SEQ ID NO: 499841 - RNA, 22 nt, Human
caguguccucagccagcagcua

SEQ ID NO: 499842 - RNA, 22 nt, Human
ugaggcaggagaaucaccggaa

SEQ ID NO: 499843 - RNA, 22 nt, Human
uuuacagucuauguugaauuaa

SEQ ID NO: 499844 - RNA, 22 nt, Human
uuuggacugcaugaugaucugg

SEQ ID NO: 499845 - RNA, 22 nt, Human
aagcagaugggacuccaaggca

SEQ ID NO: 499846 - RNA, 22 nt, Human
ugcuuccuugaucauucccaaa

SEQ ID NO: 499847 - RNA, 22 nt, Human
uccacagaccaguaucugcagc

SEQ ID NO: 499848 - RNA, 22 nt, Human
uaauuuugucccccugcacaua

SEQ ID NO: 499849 - RNA, 22 nt, Human
ccuguucacccuccaugcacag

SEQ ID NO: 499850 - RNA, 22 nt, Human
gcuggcagggacagcugcgugu

SEQ ID NO: 499851 - RNA, 22 nt, Human
aguaaaaauugaggugcaaaau

SEQ ID NO: 499852 - RNA, 19 nt, Human
cccuggcaggcaagccugg

SEQ ID NO: 499853 - RNA, 22 nt, Human
ccacagggcacaagggagguug

SEQ ID NO: 499854 - RNA, 22 nt, Human
acagagaugucagauuggcagc

SEQ ID NO: 499855 - RNA, 22 nt, Human
uccccaccuaagauacccaucu

SEQ ID NO: 499856 - RNA, 19 nt, Human
uuuuuacaaguagguguga

SEQ ID NO: 499857 - RNA, 23 nt, Human
caugcaaacacuauugcauuugg

SEQ ID NO: 499858 - RNA, 22 nt, Human
aagcacagugccaaguucuauu

SEQ ID NO: 499859 - RNA, 22 nt, Human
guacacacuguuugaucauuuc

SEQ ID NO: 499860 - RNA, 22 nt, Human
uuccugcauggauugaggcuau

SEQ ID NO: 499861 - RNA, 22 nt, Human
gcaggcucguuggaaguccccu

SEQ ID NO: 499862 - RNA, 22 nt, Human
ugguccuuuaagucuuucucug

SEQ ID NO: 499863 - RNA, 22 nt, Human
acugggaguucuccaugucccu

SEQ ID NO: 499864 - RNA, 22 nt, Human
uuggaauugaggauuuacauag

SEQ ID NO: 499865 - RNA, 22 nt, Human
uuucauugucaauaaacuguau

SEQ ID NO: 499866 - RNA, 20 nt, Human
agcagcuguguuuucauccu

SEQ ID NO: 499867 - RNA, 23 nt, Human
uggacgccgacuuuggaggcgcu

SEQ ID NO: 499868 - RNA, 22 nt, Human
agccuggcccugcugaacucug

SEQ ID NO: 499869 - RNA, 22 nt, Human
uuucuaagugaacauucaaguu

SEQ ID NO: 499870 - RNA, 22 nt, Human
ugccugcugcuaagcucuuugu

SEQ ID NO: 499871 - RNA, 22 nt, Human
cuacuuuaauuuucugcagaga

SEQ ID NO: 499872 - RNA, 22 nt, Human
ucugggcugaaaugaaggccuu

SEQ ID NO: 499873 - RNA, 22 nt, Human
cacccaggacaggccagaugug

SEQ ID NO: 499874 - RNA, 22 nt, Human
uuccaagucuaaguuauaaauc

SEQ ID NO: 499875 - RNA, 22 nt, Human
auuggucaccucccucagcucu

SEQ ID NO: 499876 - RNA, 21 nt, Human
uauacaugugugcauacgugu

SEQ ID NO: 499877 - RNA, 22 nt, Human
ucugggccucaccugcugcuca

SEQ ID NO: 499878 - RNA, 22 nt, Human
acauacauaugacaacuuuccu

SEQ ID NO: 499879 - RNA, 22 nt, Human
gaugcacuugccccuccucaga

SEQ ID NO: 499880 - RNA, 22 nt, Human
caggcagcagccacucugguau

SEQ ID NO: 499881 - RNA, 22 nt, Human
aaucacaauuacuuuugcacca

SEQ ID NO: 499882 - RNA, 23 nt, Human
agcccagcagagaaccuaggucc

SEQ ID NO: 499883 - RNA, 22 nt, Human
ugguccaguaaggguggagaga

SEQ ID NO: 499884 - RNA, 22 nt, Human
aagcuugggaaccacgguaauc

SEQ ID NO: 499885 - RNA, 22 nt, Human
agcagcacacgggagaaagaca

SEQ ID NO: 499886 - RNA, 22 nt, Human
ccaccagcuucagcagccgcgg

SEQ ID NO: 499887 - RNA, 22 nt, Human
ucuuguuucuucuaagcagcag

SEQ ID NO: 499888 - RNA, 22 nt, Human
gccagcucccaagugagccccu

SEQ ID NO: 499889 - RNA, 22 nt, Human
uuguuucaaauauuucagaaua

SEQ ID NO: 499890 - RNA, 22 nt, Human
ggaggcucugcuccguguguuc

SEQ ID NO: 499891 - RNA, 22 nt, Human
gaugcacugcaguauauacugu

SEQ ID NO: 499892 - RNA, 22 nt, Human
ucuuuggauaucgcuagaccgu

SEQ ID NO: 499893 - RNA, 22 nt, Human
cuuggacuuuagucucucucca

SEQ ID NO: 499894 - RNA, 23 nt, Human
auguccugcauaguugcuucugu

SEQ ID NO: 499895 - RNA, 22 nt, Human
gucacacucagaaugacuagag

SEQ ID NO: 499896 - RNA, 22 nt, Human
uuuacagucugucuagcaaugu

SEQ ID NO: 499897 - RNA, 22 nt, Human
cugccucuguugggcauggucu

SEQ ID NO: 499898 - RNA, 20 nt, Human
uccagccacuuccgcugguc

SEQ ID NO: 499899 - RNA, 19 nt, Human
aguguguacugaaagcacu

SEQ ID NO: 499900 - RNA, 15 nt, Human
aaucuggcggcaagu

SEQ ID NO: 499901 - RNA, 22 nt, Human
cagggucaccagagaucugcau

SEQ ID NO: 499902 - RNA, 22 nt, Human
auuaaaauuccaagguaugcca

SEQ ID NO: 499903 - RNA, 22 nt, Human
caaggcugcugcgggucgcacc

SEQ ID NO: 499904 - RNA, 22 nt, Human
uuccacauuccuuacauucaua

SEQ ID NO: 499905 - RNA, 18 nt, Human
gagacacaagggccugga

SEQ ID NO: 499906 - RNA, 22 nt, Human
ugccugccaugcagaaagcuga

SEQ ID NO: 499907 - RNA, 22 nt, Human
augaaguucuagugagaaaugc

SEQ ID NO: 499908 - RNA, 22 nt, Human
cuggcucaguucuugguuuuca

SEQ ID NO: 499909 - RNA, 22 nt, Human
uggcucagauaauucaaggggc

SEQ ID NO: 499910 - RNA, 22 nt, Human
auguaaauuguacugacacacg

SEQ ID NO: 499911 - RNA, 22 nt, Human
uguugagacugagggagucagc

SEQ ID NO: 499912 - RNA, 22 nt, Human
aaggcucugcaaaaccuccaag

SEQ ID NO: 499913 - RNA, 22 nt, Human
uagaggugacacugagaccaua

SEQ ID NO: 499914 - RNA, 22 nt, Human
ugucuuuaagcaaacaguguuu

SEQ ID NO: 499915 - RNA, 22 nt, Human
agcauaaaggcacuagaaagag

SEQ ID NO: 499916 - RNA, 22 nt, Human
aagcagauauugugggaguggg

SEQ ID NO: 499917 - RNA, 22 nt, Human
aggcccugcuuuccagagcuca

SEQ ID NO: 499918 - RNA, 22 nt, Human
caaaauuagaaaugcagcuguu

SEQ ID NO: 499919 - RNA, 23 nt, Human
uuguuuuuagagguggcaugaga

SEQ ID NO: 499920 - RNA, 22 nt, Human
gaggggcuggcuguggucccau

SEQ ID NO: 499921 - RNA, 22 nt, Human
ggaugcaggaguugaagaagga

SEQ ID NO: 499922 - RNA, 22 nt, Human
ucugugucugguugggccagua

SEQ ID NO: 499923 - RNA, 22 nt, Human
uucccucuuuuccaacaguugu

SEQ ID NO: 499924 - RNA, 22 nt, Human
ugaaaugagcauuuauucuuua

SEQ ID NO: 499925 - RNA, 22 nt, Human
ccaggauggggagcagauagaa

SEQ ID NO: 499926 - RNA, 22 nt, Human
uuugacauuggcuuauucuguu

SEQ ID NO: 499927 - RNA, 22 nt, Human
cagaguggcgacccccucagcu

SEQ ID NO: 499928 - RNA, 22 nt, Human
cuuucucaaugccggaaggcac

SEQ ID NO: 499929 - RNA, 22 nt, Human
gcugggaggaucucucccuguc

SEQ ID NO: 499930 - RNA, 22 nt, Human
gggggaggugaaugcaauaagg

SEQ ID NO: 499931 - RNA, 22 nt, Human
uuagaaagguuuugcucugaaa

SEQ ID NO: 499932 - RNA, 22 nt, Human
cccagccucagcuuuacuucca

SEQ ID NO: 499933 - RNA, 17 nt, Human
auuuccucagggcugag

SEQ ID NO: 499934 - RNA, 22 nt, Human
cacaauguauauguauaucaaa

SEQ ID NO: 499935 - RNA, 22 nt, Human
agaaaugaagcaggaguuauua

SEQ ID NO: 499936 - RNA, 22 nt, Human
gagggcucacugagaaagcagu

SEQ ID NO: 499937 - RNA, 22 nt, Human
cguguacagucuaucuuuuuuc

SEQ ID NO: 499938 - RNA, 22 nt, Human
gcaguggcaugaugugggcuca

SEQ ID NO: 499939 - RNA, 22 nt, Human
gucuggccauuugcccauugug

SEQ ID NO: 499940 - RNA, 22 nt, Human
gaccacagaagccuugauaggg

SEQ ID NO: 499941 - RNA, 22 nt, Human
acagaauuaaugaaaauuacaa

SEQ ID NO: 499942 - RNA, 22 nt, Human
uuagaaaacauaagugguaaag

SEQ ID NO: 499943 - RNA, 22 nt, Human
gagauggggaauaggagcaagc

SEQ ID NO: 499944 - RNA, 22 nt, Human
agagguagagguugcagugagc

SEQ ID NO: 499945 - RNA, 22 nt, Human
agaugagaauuuuuagagugcu

SEQ ID NO: 499946 - RNA, 22 nt, Human
uuaaagcauccugucagucugu

SEQ ID NO: 499947 - RNA, 22 nt, Human
gccaccucggcuuucucugcuc

SEQ ID NO: 499948 - RNA, 22 nt, Human
ggcugcugacaaacaugaucau

SEQ ID NO: 499949 - RNA, 20 nt, Human
ucauccaggacaggaguggc

SEQ ID NO: 499950 - RNA, 20 nt, Human
agagaauucccuuuggagau

SEQ ID NO: 499951 - RNA, 22 nt, Human
aucaggaucugggagccugaaa

SEQ ID NO: 499952 - RNA, 22 nt, Human
uggcauggcaacccugcaggga

SEQ ID NO: 499953 - RNA, 22 nt, Human
gauucugagcugguguuuuacg

SEQ ID NO: 499954 - RNA, 23 nt, Human
ugaggagcauagcugacugacag

SEQ ID NO: 499955 - RNA, 22 nt, Human
uuuacaguuaagaaauguuacc

SEQ ID NO: 499956 - RNA, 19 nt, Human
ggaaggagagaaaugcaug

SEQ ID NO: 499957 - RNA, 22 nt, Human
ucaagacauauuaaaugugcga

SEQ ID NO: 499958 - RNA, 22 nt, Human
ccaggagcaggagcuggacaga

SEQ ID NO: 499959 - RNA, 22 nt, Human
ugccauauugcaaagugucugc

SEQ ID NO: 499960 - RNA, 22 nt, Human
ucauuucaguggcacagaagau

SEQ ID NO: 499961 - RNA, 22 nt, Human
ugcucuguaaggucagaaaagg

SEQ ID NO: 499962 - RNA, 22 nt, Human
acucagugggcuugaugucgaa

SEQ ID NO: 499963 - RNA, 22 nt, Human
gccucaugagggaucugcccuc

SEQ ID NO: 499964 - RNA, 22 nt, Human
auggaaaggcuguggaaacuua

SEQ ID NO: 499965 - RNA, 22 nt, Human
aauaaauguuuguuggauguuu

SEQ ID NO: 499966 - RNA, 23 nt, Human
agggcugaugccauugcagcucu

SEQ ID NO: 499967 - RNA, 22 nt, Human
acuugaauuuaguuuuuccuaa

SEQ ID NO: 499968 - RNA, 22 nt, Human
uucauugugauucuuggcuagc

SEQ ID NO: 499969 - RNA, 22 nt, Human
uuuuucaucugauugauaacuc

SEQ ID NO: 499970 - RNA, 22 nt, Human
uggccuuguguuuaagcaagaa

SEQ ID NO: 499971 - RNA, 22 nt, Human
cuggcagcuucaggacacucgg

SEQ ID NO: 499972 - RNA, 22 nt, Human
aggcucugcagaccccagcugu

SEQ ID NO: 499973 - RNA, 22 nt, Human
caggggcucugggugaugugag

SEQ ID NO: 499974 - RNA, 22 nt, Human
cagcucagucuugaagcacugg

SEQ ID NO: 499975 - RNA, 22 nt, Human
caucuuuucagaagccauucug

SEQ ID NO: 499976 - RNA, 20 nt, Human
gccuguccugagugucaugg

SEQ ID NO: 499977 - RNA, 22 nt, Human
ucauacauaacuuguacaguga

SEQ ID NO: 499978 - RNA, 22 nt, Human
uuuuagaagugccuauccuaug

SEQ ID NO: 499979 - RNA, 22 nt, Human
gcugucuugcucacucuugcag

SEQ ID NO: 499980 - RNA, 22 nt, Human
auggggcuguucucugcccugc

SEQ ID NO: 499981 - RNA, 22 nt, Human
gaggcugcaggcaaugcugccc

SEQ ID NO: 499982 - RNA, 22 nt, Human
ugccuacuaguacuauuuugug

SEQ ID NO: 499983 - RNA, 22 nt, Human
ucucagagaagugaugagcaau

SEQ ID NO: 499984 - RNA, 20 nt, Human
ggccacagggugcuggugga

SEQ ID NO: 499985 - RNA, 21 nt, Human
ccaccaggucuucugcucggg

SEQ ID NO: 499986 - RNA, 22 nt, Human
ccucaguguguuuggggugagg

SEQ ID NO: 499987 - RNA, 22 nt, Human
agaaaguuaaacagugauaaga

SEQ ID NO: 499988 - RNA, 22 nt, Human
uucacauuagugguucuauaua

SEQ ID NO: 499989 - RNA, 22 nt, Human
uggcucuguugugcugagccag

SEQ ID NO: 499990 - RNA, 22 nt, Human
ucagagagcagaacuuuuuuac

SEQ ID NO: 499991 - RNA, 22 nt, Human
cagcuucuguuucuagccccug

SEQ ID NO: 499992 - RNA, 22 nt, Human
ucugucaccauucagcuugaau

SEQ ID NO: 499993 - RNA, 16 nt, Human
gcagggguggguggag

SEQ ID NO: 499994 - RNA, 22 nt, Human
agaguggggaagguguugagaa

SEQ ID NO: 499995 - RNA, 22 nt, Human
ucaaaacaaucauuggaugugc

SEQ ID NO: 499996 - RNA, 22 nt, Human
augaggcaguacacacaaagcc

SEQ ID NO: 499997 - RNA, 22 nt, Human
aggcugaggcagguggaucacc

SEQ ID NO: 499998 - RNA, 22 nt, Human
cauugcacuuuggguccaggac

SEQ ID NO: 499999 - RNA, 22 nt, Human
uggcuggagcauuccuugucuu

SEQ ID NO: 500000 - RNA, 22 nt, Human
aagaguuucugggucaaggauu

SEQ ID NO: 500001 - RNA, 22 nt, Human
uuucacauguggaaugccaggu

SEQ ID NO: 500002 - RNA, 22 nt, Human
ucacuuagauggggaucaucac

SEQ ID NO: 500003 - RNA, 22 nt, Human
acagaugaggcuggcgagggca

SEQ ID NO: 500004 - RNA, 22 nt, Human
gccuggcugcuuagccuacuuc

SEQ ID NO: 500005 - RNA, 22 nt, Human
cccuggcauaaaacuucuccag

SEQ ID NO: 500006 - RNA, 22 nt, Human
agugucuggugagggcucucuc

SEQ ID NO: 500007 - RNA, 22 nt, Human
acuuuggggaacuuuucuccuc

SEQ ID NO: 500008 - RNA, 21 nt, Human
ccuccaggugauuccgugcuc

SEQ ID NO: 500009 - RNA, 22 nt, Human
agagccugggcagcuccucugg

SEQ ID NO: 500010 - RNA, 22 nt, Human
uagagcagaacuuguuaacacc

SEQ ID NO: 500011 - RNA, 21 nt, Human
gcagggaccgcgacuucuggg

SEQ ID NO: 500012 - RNA, 22 nt, Human
gucaaaacaaaguuaagaauuc

SEQ ID NO: 500013 - RNA, 22 nt, Human
cggcagagcuuccugcucagcg

SEQ ID NO: 500014 - RNA, 22 nt, Human
acugccuugaaagauuguugag

SEQ ID NO: 500015 - RNA, 22 nt, Human
gcagcaggcacuuaccguugcu

SEQ ID NO: 500016 - RNA, 22 nt, Human
aaggcugagccagggccccuau

SEQ ID NO: 500017 - RNA, 22 nt, Human
uuguuuuuaugaacauccagga

SEQ ID NO: 500018 - RNA, 22 nt, Human
gaaggccacaagagaaguuaag

SEQ ID NO: 500019 - RNA, 23 nt, Human
ucagugcaaaaauaggauuuugg

SEQ ID NO: 500020 - RNA, 19 nt, Human
gcagccaccgcggcggccg

SEQ ID NO: 500021 - RNA, 22 nt, Human
auggccagccacuccugauggc

SEQ ID NO: 500022 - RNA, 22 nt, Human
gcuggccagugucccagggauc

SEQ ID NO: 500023 - RNA, 22 nt, Human
cugggucuggugucaggcgacg

SEQ ID NO: 500024 - RNA, 22 nt, Human
auauuagguuggugcaaaagua

SEQ ID NO: 500025 - RNA, 22 nt, Human
aaaugauguuauaagaccagga

SEQ ID NO: 500026 - RNA, 22 nt, Human
aggauccuccuuagaaaagacc

SEQ ID NO: 500027 - RNA, 22 nt, Human
uccagggcuacaaggcaccaga

SEQ ID NO: 500028 - RNA, 20 nt, Human
uacugggcaagcccacagac

SEQ ID NO: 500029 - RNA, 22 nt, Human
ggguggcacaggugcagagggu

SEQ ID NO: 500030 - RNA, 22 nt, Human
caaagcaagggcugaagacucc

SEQ ID NO: 500031 - RNA, 22 nt, Human
ugcuggagaucauuaauguuca

SEQ ID NO: 500032 - RNA, 22 nt, Human
agcgcaggaacacgucugccuu

SEQ ID NO: 500033 - RNA, 22 nt, Human
cagcugccccgcuggcugacca

SEQ ID NO: 500034 - RNA, 22 nt, Human
ugcuggcuacugauggcaggcc

SEQ ID NO: 500035 - RNA, 22 nt, Human
ugugcuucagguugucgccacg

SEQ ID NO: 500036 - RNA, 22 nt, Human
acagggcaaccucugggagacu

SEQ ID NO: 500037 - RNA, 22 nt, Human
guuucuuagguaaauucuuuga

SEQ ID NO: 500038 - RNA, 22 nt, Human
aaggcacugacugugcagggga

SEQ ID NO: 500039 - RNA, 22 nt, Human
cagggacaugacuggucucugu

SEQ ID NO: 500040 - RNA, 22 nt, Human
uugaaggugacauaucuggagc

SEQ ID NO: 500041 - RNA, 22 nt, Human
uuuuagaaggaaugcuauggug

SEQ ID NO: 500042 - RNA, 22 nt, Human
cuguggcucuuuaguugagcac

SEQ ID NO: 500043 - RNA, 22 nt, Human
gcugcugucuggucugagggcu

SEQ ID NO: 500044 - RNA, 22 nt, Human
uccugaggacuaacaggaagga

SEQ ID NO: 500045 - RNA, 22 nt, Human
ccugaggcuccaccuccagaga

SEQ ID NO: 500046 - RNA, 22 nt, Human
cagcucccuauggugaggcgac

SEQ ID NO: 500047 - RNA, 17 nt, Human
ugagcuucaaucaggug

SEQ ID NO: 500048 - RNA, 22 nt, Human
ggggaagaggcgugauggaucc

SEQ ID NO: 500049 - RNA, 22 nt, Human
acucugugaagaugcaggcuug

SEQ ID NO: 500050 - RNA, 22 nt, Human
cuggagcauccaugcccagggu

SEQ ID NO: 500051 - RNA, 22 nt, Human
gcuuccuagcauuagccauugc

SEQ ID NO: 500052 - RNA, 22 nt, Human
gauauuuugagaaauccuauga

SEQ ID NO: 500053 - RNA, 22 nt, Human
ccagcccuugaggucuguccau

SEQ ID NO: 500054 - RNA, 19 nt, Human
gcuuuaguuuacucaucua

SEQ ID NO: 500055 - RNA, 16 nt, Human
ucucuggguugcacag

SEQ ID NO: 500056 - RNA, 22 nt, Human
agcagggcagugcuucagcucu

SEQ ID NO: 500057 - RNA, 22 nt, Human
ggaggccuugaggccaggagcu

SEQ ID NO: 500058 - RNA, 22 nt, Human
cuuuucauuguuuguacaugca

SEQ ID NO: 500059 - RNA, 22 nt, Human
cugccuggggaaugugaggauu

SEQ ID NO: 500060 - RNA, 22 nt, Human
ccucugggggcuuccuuacccu

SEQ ID NO: 500061 - RNA, 19 nt, Human
aggugaugugacucuagaa

SEQ ID NO: 500062 - RNA, 22 nt, Human
aaauuacagaucaccaaugcau

SEQ ID NO: 500063 - RNA, 22 nt, Human
ggcugggccagggccuguggac

SEQ ID NO: 500064 - RNA, 19 nt, Human
gcaggcacagcccugggug

SEQ ID NO: 500065 - RNA, 22 nt, Human
acagggcagguggcuacugguc

SEQ ID NO: 500066 - RNA, 23 nt, Human
aagaauaaaugacauuaaaggug

SEQ ID NO: 500067 - RNA, 22 nt, Human
ucccaugugacucagcugccug

SEQ ID NO: 500068 - RNA, 22 nt, Human
aggcagagagcaguggccgucu

SEQ ID NO: 500069 - RNA, 22 nt, Human
gggagggacacaaagaguuccc

SEQ ID NO: 500070 - RNA, 22 nt, Human
gggcugcaaugcuucaguuguu

SEQ ID NO: 500071 - RNA, 22 nt, Human
aaagauuuaagaauaauuugug

SEQ ID NO: 500072 - RNA, 22 nt, Human
agccccucuguggcucugccuc

SEQ ID NO: 500073 - RNA, 22 nt, Human
acagcuguggggacucuugccc

SEQ ID NO: 500074 - RNA, 22 nt, Human
uccaucuguuuacuauaaagau

SEQ ID NO: 500075 - RNA, 22 nt, Human
auguaguauuuggaaauguaaa

SEQ ID NO: 500076 - RNA, 22 nt, Human
gagagguccauuccccugucag

SEQ ID NO: 500077 - RNA, 22 nt, Human
uuucaugugcaauuagcaauau

SEQ ID NO: 500078 - RNA, 22 nt, Human
gcuucagagauuucacuaguuu

SEQ ID NO: 500079 - RNA, 22 nt, Human
cacaacuuuaggaaccacauuc

SEQ ID NO: 500080 - RNA, 22 nt, Human
ccaggcagggcucaaggaaccu

SEQ ID NO: 500081 - RNA, 22 nt, Human
gcuaggagugggauggaagucg

SEQ ID NO: 500082 - RNA, 23 nt, Human
uaguuauuuucucuguaauuugc

SEQ ID NO: 500083 - RNA, 22 nt, Human
uccuguuuaggcuguggucugg

SEQ ID NO: 500084 - RNA, 22 nt, Human
uaaguuuuaagcaaucugauaa

SEQ ID NO: 500085 - RNA, 22 nt, Human
aggaccaacauagcagcagugg

SEQ ID NO: 500086 - RNA, 22 nt, Human
uccugaggccucugugauguga

SEQ ID NO: 500087 - RNA, 22 nt, Human
ucucugggccucccuuuccaag

SEQ ID NO: 500088 - RNA, 22 nt, Human
cagagcagggguuucccagguu

SEQ ID NO: 500089 - RNA, 22 nt, Human
uuccagaaaucuuucagcucaa

SEQ ID NO: 500090 - RNA, 22 nt, Human
aggaaaugcaggcaaauacucu

SEQ ID NO: 500091 - RNA, 22 nt, Human
cagcuucugagcaagccagggg

SEQ ID NO: 500092 - RNA, 22 nt, Human
ccacagaaagccugggaagugg

SEQ ID NO: 500093 - RNA, 22 nt, Human
gacagaguuguugauguaugcu

SEQ ID NO: 500094 - RNA, 19 nt, Human
ggcauggucggaagagcuc

SEQ ID NO: 500095 - RNA, 19 nt, Human
acacugaauguagaauugg

SEQ ID NO: 500096 - RNA, 22 nt, Human
gucagaggggcagcugccaggc

SEQ ID NO: 500097 - RNA, 22 nt, Human
ccagcaggagaugccugugucu

SEQ ID NO: 500098 - RNA, 17 nt, Human
gcaucacagauaacacg

SEQ ID NO: 500099 - RNA, 22 nt, Human
guaggcagggcuguggggagaa

SEQ ID NO: 500100 - RNA, 22 nt, Human
guaauugacucagcucuguuca

SEQ ID NO: 500101 - RNA, 22 nt, Human
cgcuggggcuuuuugcuugaga

SEQ ID NO: 500102 - RNA, 19 nt, Human
aggcccagcgcugggggcu

SEQ ID NO: 500103 - RNA, 22 nt, Human
uacagagagauaaguguaaaag

SEQ ID NO: 500104 - RNA, 22 nt, Human
uagggcucagcucuagcuccug

SEQ ID NO: 500105 - RNA, 22 nt, Human
agaucuggaaaaucacaggugc

SEQ ID NO: 500106 - RNA, 22 nt, Human
ucucccaaggcacagaaagagu

SEQ ID NO: 500107 - RNA, 21 nt, Human
ucuuugcaucaguuguuuucu

SEQ ID NO: 500108 - RNA, 18 nt, Human
gcacauguaagaguaaag

SEQ ID NO: 500109 - RNA, 22 nt, Human
cuguuuaucucuaaccuguuua

SEQ ID NO: 500110 - RNA, 22 nt, Human
cagcuggggcagccacgugcgg

SEQ ID NO: 500111 - RNA, 22 nt, Human
aaguccagugaaauagaaugca

SEQ ID NO: 500112 - RNA, 19 nt, Human
gcaucagagcagaaggggu

SEQ ID NO: 500113 - RNA, 22 nt, Human
guaacacagaaaugaaauucca

SEQ ID NO: 500114 - RNA, 22 nt, Human
uguguccuucugggagucccag

SEQ ID NO: 500115 - RNA, 22 nt, Human
uccucaugccgggucucacgcu

SEQ ID NO: 500116 - RNA, 22 nt, Human
uccuggagcuuccuucauggua

SEQ ID NO: 500117 - RNA, 22 nt, Human
aacagaaaagguagguggcuuu

SEQ ID NO: 500118 - RNA, 22 nt, Human
gcaguaaaaaaggauaugugca

SEQ ID NO: 500119 - RNA, 22 nt, Human
cagugaggaguccagggcagag

SEQ ID NO: 500120 - RNA, 22 nt, Human
gauuucuuuagcucaucagauc

SEQ ID NO: 500121 - RNA, 22 nt, Human
gcaggcaguuauuuaguagaau

SEQ ID NO: 500122 - RNA, 22 nt, Human
uucuuacaaguauuccaggucc

SEQ ID NO: 500123 - RNA, 22 nt, Human
caucuuuguucuguaaacuuuu

SEQ ID NO: 500124 - RNA, 22 nt, Human
aaggcuuucagcuaacuugauu

SEQ ID NO: 500125 - RNA, 22 nt, Human
gcugccugaagugucuacacug

SEQ ID NO: 500126 - RNA, 22 nt, Human
uuucaugcacaaaugagcaagg

SEQ ID NO: 500127 - RNA, 22 nt, Human
auggcagcaaaugucuggcugg

SEQ ID NO: 500128 - RNA, 22 nt, Human
acugcuuuuagaaaucuauaga

SEQ ID NO: 500129 - RNA, 22 nt, Human
caggcuggagugcaauggcaca

SEQ ID NO: 500130 - RNA, 22 nt, Human
ugcaggcugcucaagacuuagu

SEQ ID NO: 500131 - RNA, 20 nt, Human
guggccucucacauucugag

SEQ ID NO: 500132 - RNA, 19 nt, Human
guggccagggcaggggcug

SEQ ID NO: 500133 - RNA, 22 nt, Human
cagaguguauucugcaguugca

SEQ ID NO: 500134 - RNA, 22 nt, Human
cuggcuccaucacugggugaug

SEQ ID NO: 500135 - RNA, 21 nt, Human
ugaaagaggauguggucauuc

SEQ ID NO: 500136 - RNA, 22 nt, Human
uauugacaauaggcaacugagg

SEQ ID NO: 500137 - RNA, 20 nt, Human
cuguggugagcaggagagua

SEQ ID NO: 500138 - RNA, 22 nt, Human
gugucugcuugcugagcauuua

SEQ ID NO: 500139 - RNA, 22 nt, Human
cucucccagucaggcucaggau

SEQ ID NO: 500140 - RNA, 22 nt, Human
ucugcaggacugaggccuguuu

SEQ ID NO: 500141 - RNA, 17 nt, Human
uucucuuccuggauagu

SEQ ID NO: 500142 - RNA, 22 nt, Human
uaagcuucaaagaacauauugg

SEQ ID NO: 500143 - RNA, 22 nt, Human
ucuauuucgcauauaaguuuug

SEQ ID NO: 500144 - RNA, 22 nt, Human
gauaauuauaggcuaagccacu

SEQ ID NO: 500145 - RNA, 22 nt, Human
uaaggcacacaguugcugcaug

SEQ ID NO: 500146 - RNA, 22 nt, Human
aauaagaauugccagauuugaa

SEQ ID NO: 500147 - RNA, 22 nt, Human
ccuggcucugaaguccacauca

SEQ ID NO: 500148 - RNA, 22 nt, Human
uuguaaauaguaguaagaugcc

SEQ ID NO: 500149 - RNA, 20 nt, Human
ucauuacagugcuaagaugu

SEQ ID NO: 500150 - RNA, 22 nt, Human
caguacuuggucaaggaagcag

SEQ ID NO: 500151 - RNA, 22 nt, Human
uuccuccacgugacaggagcca

SEQ ID NO: 500152 - RNA, 22 nt, Human
gaacaguaaauuuaugcagcac

SEQ ID NO: 500153 - RNA, 16 nt, Human
ugggcagaugagaaga

SEQ ID NO: 500154 - RNA, 22 nt, Human
gugggcuggauuugcuugcaga

SEQ ID NO: 500155 - RNA, 23 nt, Human
uugcacaguuucggaaacugagg

SEQ ID NO: 500156 - RNA, 18 nt, Human
cugccuguugcugagagg

SEQ ID NO: 500157 - RNA, 22 nt, Human
ggcuccuguccccucagcugcu

SEQ ID NO: 500158 - RNA, 17 nt, Human
uauuagcuagcuuccag

SEQ ID NO: 500159 - RNA, 22 nt, Human
gaggagaagcuauuggaaggac

SEQ ID NO: 500160 - RNA, 22 nt, Human
caaggccauaagagauacaaaa

SEQ ID NO: 500161 - RNA, 22 nt, Human
gacagcuuaggaaguuucuauu

SEQ ID NO: 500162 - RNA, 23 nt, Human
ccagugugguagguccacaggug

SEQ ID NO: 500163 - RNA, 22 nt, Human
agcugccuaguagauugauugg

SEQ ID NO: 500164 - RNA, 22 nt, Human
uuggaaggguuucaguuagucu

SEQ ID NO: 500165 - RNA, 22 nt, Human
ucccagagugagccaggggcag

SEQ ID NO: 500166 - RNA, 22 nt, Human
cuggaagggucagagugaugag

SEQ ID NO: 500167 - RNA, 22 nt, Human
ucucccacugcaagcccaggcu

SEQ ID NO: 500168 - RNA, 22 nt, Human
uuugcuauaaaagggucacacg

SEQ ID NO: 500169 - RNA, 22 nt, Human
uugcaccaaaugaguuaaaauu

SEQ ID NO: 500170 - RNA, 22 nt, Human
cugggccaggaccaggguugaa

SEQ ID NO: 500171 - RNA, 18 nt, Human
gccugcaggcacgggggu

SEQ ID NO: 500172 - RNA, 22 nt, Human
acuguucacuagugaggguuga

SEQ ID NO: 500173 - RNA, 22 nt, Human
uggccacccccaaugucaguag

SEQ ID NO: 500174 - RNA, 22 nt, Human
ugccugcucuuaccacucuccc

SEQ ID NO: 500175 - RNA, 22 nt, Human
aaugaagaaauggacaucuuua

SEQ ID NO: 500176 - RNA, 22 nt, Human
cuagggacugggaccuuaguua

SEQ ID NO: 500177 - RNA, 22 nt, Human
gcagugacagggcugcugccuu

SEQ ID NO: 500178 - RNA, 22 nt, Human
agaaggaaggauaacugcauua

SEQ ID NO: 500179 - RNA, 22 nt, Human
ccaguguuggaggauggcuugc

SEQ ID NO: 500180 - RNA, 22 nt, Human
uaaagcaaaaaugaacugccau

SEQ ID NO: 500181 - RNA, 22 nt, Human
ccagcugacgaugccuggucuc

SEQ ID NO: 500182 - RNA, 22 nt, Human
ugcccuuauaaaggaggccuga

SEQ ID NO: 500183 - RNA, 22 nt, Human
gaaaugugcagaauguguuaga

SEQ ID NO: 500184 - RNA, 22 nt, Human
gaggcugcuguuagcccugggc

SEQ ID NO: 500185 - RNA, 22 nt, Human
ugcugccuccaacuccugggcu

SEQ ID NO: 500186 - RNA, 22 nt, Human
ccagcuccagguagaugggcag

SEQ ID NO: 500187 - RNA, 22 nt, Human
augaggauaccgcagggggcag

SEQ ID NO: 500188 - RNA, 22 nt, Human
gguggccauucuaccgccuucu

SEQ ID NO: 500189 - RNA, 22 nt, Human
cacauacugagaaucacaccca

SEQ ID NO: 500190 - RNA, 22 nt, Human
agcagcugggcucagagcuggg

SEQ ID NO: 500191 - RNA, 22 nt, Human
gucucagaccacccucuuuggc

SEQ ID NO: 500192 - RNA, 22 nt, Human
auuagaagaggcugacgaaugu

SEQ ID NO: 500193 - RNA, 22 nt, Human
guacagagaagguuacauauga

SEQ ID NO: 500194 - RNA, 22 nt, Human
gauagcagcucuggggucagac

SEQ ID NO: 500195 - RNA, 22 nt, Human
aaguucuaauuuugcauucagg

SEQ ID NO: 500196 - RNA, 18 nt, Human
cgaggcaggcggaucacg

SEQ ID NO: 500197 - RNA, 22 nt, Human
agcaggcuaaauaauaauacau

SEQ ID NO: 500198 - RNA, 21 nt, Human
cagcuuugucugucuucgggg

SEQ ID NO: 500199 - RNA, 22 nt, Human
gcucuuauagucccagcauguu

SEQ ID NO: 500200 - RNA, 22 nt, Human
auacuugagguagcaacuuaag

SEQ ID NO: 500201 - RNA, 22 nt, Human
cacugcuuuuuuggcuauguac

SEQ ID NO: 500202 - RNA, 22 nt, Human
cuuccugggucagccuggaggu

SEQ ID NO: 500203 - RNA, 22 nt, Human
cugugcuugacagugggaagca

SEQ ID NO: 500204 - RNA, 22 nt, Human
uaaguucauaagcuuauucuua

SEQ ID NO: 500205 - RNA, 22 nt, Human
uguauacaggauuacucauagc

SEQ ID NO: 500206 - RNA, 22 nt, Human
ugguaauuuacgcauuucugua

SEQ ID NO: 500207 - RNA, 22 nt, Human
ggaugcaggggcagcagagccu

SEQ ID NO: 500208 - RNA, 22 nt, Human
uggcaguggcucagagugcaga

SEQ ID NO: 500209 - RNA, 22 nt, Human
uuuugccugagagugaaaauaa

SEQ ID NO: 500210 - RNA, 22 nt, Human
cccucugccugggaccaagucc

SEQ ID NO: 500211 - RNA, 22 nt, Human
ucucugggaaauggagaauuuu

SEQ ID NO: 500212 - RNA, 22 nt, Human
ccugggcuuacgaccucugacu

SEQ ID NO: 500213 - RNA, 22 nt, Human
acauuucuuugcuagacagcag

SEQ ID NO: 500214 - RNA, 19 nt, Human
ucauuuguuaguagaaguu

SEQ ID NO: 500215 - RNA, 21 nt, Human
ugcucaguaaaugcugaguga

SEQ ID NO: 500216 - RNA, 22 nt, Human
ucaguguuucaguuuggaaaug

SEQ ID NO: 500217 - RNA, 22 nt, Human
gcucucagaaguaacuugucca

SEQ ID NO: 500218 - RNA, 22 nt, Human
ugcaaggcuauucacauguauu

SEQ ID NO: 500219 - RNA, 22 nt, Human
acucuggggcgcuacuccaacu

SEQ ID NO: 500220 - RNA, 22 nt, Human
cugagcugggacucaguagcaa

SEQ ID NO: 500221 - RNA, 21 nt, Human
cacugcagccuugaccugggc

SEQ ID NO: 500222 - RNA, 22 nt, Human
cugcugugaguuuggaggucua

SEQ ID NO: 500223 - RNA, 18 nt, Human
uugagucuagccauggaa

SEQ ID NO: 500224 - RNA, 21 nt, Human
ucucuacaaauuauguuaggu

SEQ ID NO: 500225 - RNA, 22 nt, Human
caaagguauucucauuuuggaa

SEQ ID NO: 500226 - RNA, 22 nt, Human
ugcuuuaaaccauggaugugag

SEQ ID NO: 500227 - RNA, 22 nt, Human
agguagagcuccaguagaaaau

SEQ ID NO: 500228 - RNA, 22 nt, Human
ucagaaaugaucguuauucauu

SEQ ID NO: 500229 - RNA, 22 nt, Human
uucugaagcucccuuuuguagu

SEQ ID NO: 500230 - RNA, 22 nt, Human
ggccuggagucagggaaagcaa

SEQ ID NO: 500231 - RNA, 21 nt, Human
acucaggagacuaacuauguc

SEQ ID NO: 500232 - RNA, 22 nt, Human
caaacugagcaucagaaaguuu

SEQ ID NO: 500233 - RNA, 22 nt, Human
agggcacaggcuggcaggaucu

SEQ ID NO: 500234 - RNA, 22 nt, Human
uuuuauaaagagagucaguugg

SEQ ID NO: 500235 - RNA, 22 nt, Human
uaaaagauuuuauaggaacaag

SEQ ID NO: 500236 - RNA, 22 nt, Human
agugcugucccgacaacugagg

SEQ ID NO: 500237 - RNA, 22 nt, Human
ggcucaagcagucugccugccu

SEQ ID NO: 500238 - RNA, 22 nt, Human
ggugcaggaaucugcaauugaa

SEQ ID NO: 500239 - RNA, 22 nt, Human
guccugggcggagggcugcugu

SEQ ID NO: 500240 - RNA, 22 nt, Human
uucugaaaggcagguuguuugc

SEQ ID NO: 500241 - RNA, 22 nt, Human
uauuagcuguguaacucugguu

SEQ ID NO: 500242 - RNA, 22 nt, Human
ugcagggauuguuggcauccau

SEQ ID NO: 500243 - RNA, 22 nt, Human
ucagugcaguagaacuuuaguu

SEQ ID NO: 500244 - RNA, 22 nt, Human
gcugggucucucccugguccug

SEQ ID NO: 500245 - RNA, 22 nt, Human
uuaaagcauguugcuuaacagg

SEQ ID NO: 500246 - RNA, 22 nt, Human
cugcccugcucuccgggaucuu

SEQ ID NO: 500247 - RNA, 22 nt, Human
gcagcccaaaaaagagguagau

SEQ ID NO: 500248 - RNA, 22 nt, Human
agcucauggugcuaucucaggg

SEQ ID NO: 500249 - RNA, 22 nt, Human
ucagaggagaaguugggaaaau

SEQ ID NO: 500250 - RNA, 22 nt, Human
aggcucagcccaagguggagag

SEQ ID NO: 500251 - RNA, 22 nt, Human
ucuuccucuagaucugaggccc

SEQ ID NO: 500252 - RNA, 22 nt, Human
ggcagggcaggaaagucaggaa

SEQ ID NO: 500253 - RNA, 22 nt, Human
accucugcuucccggguucaag

SEQ ID NO: 500254 - RNA, 22 nt, Human
caaggaaaacagaugaucaaca

SEQ ID NO: 500255 - RNA, 22 nt, Human
cacccacauuccaucacucugc

SEQ ID NO: 500256 - RNA, 17 nt, Human
uucaaagcuuaucaagg

SEQ ID NO: 500257 - RNA, 22 nt, Human
ggcugccuggaccuccucuuuc

SEQ ID NO: 500258 - RNA, 22 nt, Human
cugggcaguuuauucaguucug

SEQ ID NO: 500259 - RNA, 22 nt, Human
cuucccagacgggguggcagcc

SEQ ID NO: 500260 - RNA, 17 nt, Human
ugaguuaaguuuagauc

SEQ ID NO: 500261 - RNA, 22 nt, Human
gggccugggaacuugcauuuag

SEQ ID NO: 500262 - RNA, 22 nt, Human
ccugggcaggaugggcccggug

SEQ ID NO: 500263 - RNA, 22 nt, Human
uacuccugcugauccugccagc

SEQ ID NO: 500264 - RNA, 22 nt, Human
ccaggacucaguggggaaaggg

SEQ ID NO: 500265 - RNA, 22 nt, Human
gcagaagcccggucagcgcacg

SEQ ID NO: 500266 - RNA, 22 nt, Human
auaggccaauacuguagaguuu

SEQ ID NO: 500267 - RNA, 22 nt, Human
acaggugauucaggcucuggga

SEQ ID NO: 500268 - RNA, 22 nt, Human
uuggaaggagucuuuggggaug

SEQ ID NO: 500269 - RNA, 21 nt, Human
gcaaguacuaucaucauuauc

SEQ ID NO: 500270 - RNA, 22 nt, Human
guuuauaagguaaaggagagag

SEQ ID NO: 500271 - RNA, 23 nt, Human
ucugggcugagacuuggaagguc

SEQ ID NO: 500272 - RNA, 22 nt, Human
aggccuggccugggcggcauug

SEQ ID NO: 500273 - RNA, 19 nt, Human
ucuggcuccugccaggcug

SEQ ID NO: 500274 - RNA, 22 nt, Human
gugcagcagggggaagacagug

SEQ ID NO: 500275 - RNA, 22 nt, Human
cacccacccacugcucauuggc

SEQ ID NO: 500276 - RNA, 22 nt, Human
acccagagcugggcuuggcaaa

SEQ ID NO: 500277 - RNA, 23 nt, Human
gugugccaagcacugugccagga

SEQ ID NO: 500278 - RNA, 20 nt, Human
acagguucauucugugugac

SEQ ID NO: 500279 - RNA, 22 nt, Human
gggcaggagagaacagucaugg

SEQ ID NO: 500280 - RNA, 19 nt, Human
gcagccaggugcucuaccu

SEQ ID NO: 500281 - RNA, 22 nt, Human
cuccagcuucccucagcugugg

SEQ ID NO: 500282 - RNA, 22 nt, Human
ucucagagcucacaccuccugg

SEQ ID NO: 500283 - RNA, 22 nt, Human
cagcugaauucuucagacucca

SEQ ID NO: 500284 - RNA, 22 nt, Human
acagugcauaaaaacaacuuuu

SEQ ID NO: 500285 - RNA, 22 nt, Human
guucuaauaggagaaaagacag

SEQ ID NO: 500286 - RNA, 23 nt, Human
guccucuggagagaaaggcagua

SEQ ID NO: 500287 - RNA, 22 nt, Human
aauaaauguuaagauugucuca

SEQ ID NO: 500288 - RNA, 22 nt, Human
augagguaguauuagaaggaga

SEQ ID NO: 500289 - RNA, 22 nt, Human
auguuucaaauauauagaguug

SEQ ID NO: 500290 - RNA, 22 nt, Human
uuuagcaucgaaguaaauuuag

SEQ ID NO: 500291 - RNA, 20 nt, Human
cauuugaaucuccauucugc

SEQ ID NO: 500292 - RNA, 22 nt, Human
gaggccugguuugcaugagaau

SEQ ID NO: 500293 - RNA, 22 nt, Human
uucuguguggguagcuccuguu

SEQ ID NO: 500294 - RNA, 22 nt, Human
agggggugcccagaugaaggau

SEQ ID NO: 500295 - RNA, 22 nt, Human
uuuugaaagggugauuuggcuu

SEQ ID NO: 500296 - RNA, 22 nt, Human
ugccugccuaggaagcugugaa

SEQ ID NO: 500297 - RNA, 22 nt, Human
uccugagggcugcagucauagg

SEQ ID NO: 500298 - RNA, 22 nt, Human
uauuucugggaguucagaaauu

SEQ ID NO: 500299 - RNA, 22 nt, Human
cuccuggcaguuccccuuguca

SEQ ID NO: 500300 - RNA, 22 nt, Human
acagccuguguaccagcuggga

SEQ ID NO: 500301 - RNA, 22 nt, Human
gggcagcuguaucugagcuuau

SEQ ID NO: 500302 - RNA, 22 nt, Human
gccagccuucuguggccugcaa

SEQ ID NO: 500303 - RNA, 22 nt, Human
gcugucacacauggccccagcu

SEQ ID NO: 500304 - RNA, 22 nt, Human
aaggcacuagcaagcugccugg

SEQ ID NO: 500305 - RNA, 22 nt, Human
cuugaaagauuuggccucugug

SEQ ID NO: 500306 - RNA, 22 nt, Human
auguacacaugcaugcaugugc

SEQ ID NO: 500307 - RNA, 22 nt, Human
cccagcccaucucaaaggucua

SEQ ID NO: 500308 - RNA, 22 nt, Human
uaagacaauucuucagucacaa

SEQ ID NO: 500309 - RNA, 22 nt, Human
gccucugucauagcucauguga

SEQ ID NO: 500310 - RNA, 22 nt, Human
gccugggagggcagcagugugg

SEQ ID NO: 500311 - RNA, 17 nt, Human
caggaaaauaugaguga

SEQ ID NO: 500312 - RNA, 22 nt, Human
guaaacauuacugugcuguaua

SEQ ID NO: 500313 - RNA, 22 nt, Human
gcuggagauaguaggauccaua

SEQ ID NO: 500314 - RNA, 22 nt, Human
auaggagaucaauaugcaauuu

SEQ ID NO: 500315 - RNA, 22 nt, Human
ugccugccuugcugcuggacag

SEQ ID NO: 500316 - RNA, 23 nt, Human
gggcagguuuuuauaggcuucag

SEQ ID NO: 500317 - RNA, 22 nt, Human
gugcugaggugggugggcagcc

SEQ ID NO: 500318 - RNA, 22 nt, Human
gagaaagacguaggcugggagg

SEQ ID NO: 500319 - RNA, 22 nt, Human
caggcugggacugaccccugcu

SEQ ID NO: 500320 - RNA, 22 nt, Human
gagguggccucaagcagucuuc

SEQ ID NO: 500321 - RNA, 22 nt, Human
gcauucaucuuccuccaugcag

SEQ ID NO: 500322 - RNA, 22 nt, Human
uuggaaggaauuaaggucauga

SEQ ID NO: 500323 - RNA, 22 nt, Human
accugagcaugccaggagagug

SEQ ID NO: 500324 - RNA, 22 nt, Human
uucaauguuucuuaucaaguug

SEQ ID NO: 500325 - RNA, 21 nt, Human
aguuuccucaacugcagaagg

SEQ ID NO: 500326 - RNA, 22 nt, Human
cacagcagagggagccauugaa

SEQ ID NO: 500327 - RNA, 19 nt, Human
cucagagaggggcagugcc

SEQ ID NO: 500328 - RNA, 22 nt, Human
gugcaggggccuccccuugcug

SEQ ID NO: 500329 - RNA, 22 nt, Human
aauguggcauugucauuauugg

SEQ ID NO: 500330 - RNA, 22 nt, Human
uaaucacagaaacagacuguuu

SEQ ID NO: 500331 - RNA, 22 nt, Human
agagccugucaauuguaaagag

SEQ ID NO: 500332 - RNA, 22 nt, Human
gcacuggggucauagccuccag

SEQ ID NO: 500333 - RNA, 22 nt, Human
uagcuuaaaccaaucugaauaa

SEQ ID NO: 500334 - RNA, 22 nt, Human
cuucugggcauggcagagccug

SEQ ID NO: 500335 - RNA, 22 nt, Human
agcuucagggacuuguggcaga

SEQ ID NO: 500336 - RNA, 20 nt, Human
acagugcauggggggacagc

SEQ ID NO: 500337 - RNA, 22 nt, Human
ugcuucugcauucaauguugga

SEQ ID NO: 500338 - RNA, 22 nt, Human
agggcagaggcggacacggaag

SEQ ID NO: 500339 - RNA, 20 nt, Human
aggcaguguagagaugagua

SEQ ID NO: 500340 - RNA, 22 nt, Human
aagggcagcuauuaucgucauc

SEQ ID NO: 500341 - RNA, 22 nt, Human
gugaccauaauagauuaugagu

SEQ ID NO: 500342 - RNA, 22 nt, Human
gugucccaaucuacuuuucccu

SEQ ID NO: 500343 - RNA, 22 nt, Human
gcagaggcagggcccuccucca

SEQ ID NO: 500344 - RNA, 22 nt, Human
acagauuuuauuauucagguau

SEQ ID NO: 500345 - RNA, 22 nt, Human
cuggaagggucuacuuagcaga

SEQ ID NO: 500346 - RNA, 22 nt, Human
agguggcuccucccauggcugg

SEQ ID NO: 500347 - RNA, 22 nt, Human
ugguccugcuugcugcuuaaga

SEQ ID NO: 500348 - RNA, 22 nt, Human
cugcccagaagccagaugggca

SEQ ID NO: 500349 - RNA, 22 nt, Human
caaauagauuguucaauccuga

SEQ ID NO: 500350 - RNA, 22 nt, Human
gcaagcaagcagguagagcuga

SEQ ID NO: 500351 - RNA, 22 nt, Human
ucucagagaccugaacucccug

SEQ ID NO: 500352 - RNA, 22 nt, Human
gcugggcuccacccucaacugu

SEQ ID NO: 500353 - RNA, 22 nt, Human
auuaaaacuaaaaugccugauu

SEQ ID NO: 500354 - RNA, 22 nt, Human
gacuguacuugagagaggaacu

SEQ ID NO: 500355 - RNA, 22 nt, Human
uccaggcagggcagccaucaag

SEQ ID NO: 500356 - RNA, 22 nt, Human
ucucccacagccgugcuucaag

SEQ ID NO: 500357 - RNA, 21 nt, Human
ccuccaggagcagagcccuga

SEQ ID NO: 500358 - RNA, 22 nt, Human
ucaggggagguugaaucgucuc

SEQ ID NO: 500359 - RNA, 23 nt, Human
gccuggagaaaagcugcaguuca

SEQ ID NO: 500360 - RNA, 22 nt, Human
gccuggucucuuucaugucagu

SEQ ID NO: 500361 - RNA, 23 nt, Human
cagcagcugccugguuuuuuggu

SEQ ID NO: 500362 - RNA, 22 nt, Human
gacagcuucuaugugacgagca

SEQ ID NO: 500363 - RNA, 22 nt, Human
ugaacaacugcaaaaaucucca

SEQ ID NO: 500364 - RNA, 20 nt, Human
uaugaguauuacuuucagga

SEQ ID NO: 500365 - RNA, 22 nt, Human
agggguggccugccuuacuccc

SEQ ID NO: 500366 - RNA, 22 nt, Human
uauauuaacacccacuugccuc

SEQ ID NO: 500367 - RNA, 22 nt, Human
ucucagggcgcagugaggcagu

SEQ ID NO: 500368 - RNA, 22 nt, Human
ucaggccccaucccagacuuau

SEQ ID NO: 500369 - RNA, 17 nt, Human
agcaggcacgucagcac

SEQ ID NO: 500370 - RNA, 22 nt, Human
uuuaacaugugaauuuuggaag

SEQ ID NO: 500371 - RNA, 22 nt, Human
caugcacaacauacucaagagg

SEQ ID NO: 500372 - RNA, 17 nt, Human
ucugcagaggcaaaccu

SEQ ID NO: 500373 - RNA, 22 nt, Human
acagugcaaacuuuugucuccu

SEQ ID NO: 500374 - RNA, 22 nt, Human
guuuucuuugaaugcuucuaga

SEQ ID NO: 500375 - RNA, 15 nt, Human
gcucuggguauuuga

SEQ ID NO: 500376 - RNA, 22 nt, Human
aucuuucaguuucauaccaauu

SEQ ID NO: 500377 - RNA, 22 nt, Human
agccaggauggucucgaucggc

SEQ ID NO: 500378 - RNA, 22 nt, Human
guuuuacaagguuaaucagcag

SEQ ID NO: 500379 - RNA, 23 nt, Human
agucuucauuguauuuccagacc

SEQ ID NO: 500380 - RNA, 22 nt, Human
ccuucuucuguguggcccaaga

SEQ ID NO: 500381 - RNA, 21 nt, Human
ugcacagggcccaggagagcc

SEQ ID NO: 500382 - RNA, 22 nt, Human
gugcuucucuucacacccaacu

SEQ ID NO: 500383 - RNA, 22 nt, Human
uacccagcuccucagaagacca

SEQ ID NO: 500384 - RNA, 22 nt, Human
uuuuccuaguaggccuauuaga

SEQ ID NO: 500385 - RNA, 22 nt, Human
aaaauagguacggauuagaaug

SEQ ID NO: 500386 - RNA, 22 nt, Human
auugacuuccauagcuaccugg

SEQ ID NO: 500387 - RNA, 22 nt, Human
ggaccagagcucgggcuucuca

SEQ ID NO: 500388 - RNA, 22 nt, Human
augacacaauuuuagagcugaa

SEQ ID NO: 500389 - RNA, 22 nt, Human
gacaagacugguuuauuuaagg

SEQ ID NO: 500390 - RNA, 22 nt, Human
gaaaauaggcugcaucuccuuc

SEQ ID NO: 500391 - RNA, 22 nt, Human
ggcagcagggucuagauugaug

SEQ ID NO: 500392 - RNA, 22 nt, Human
uguccuggugcuccagguggcu

SEQ ID NO: 500393 - RNA, 20 nt, Human
ucaaagcaaagggagaugau

SEQ ID NO: 500394 - RNA, 22 nt, Human
aauggagacccuaaggaagagg

SEQ ID NO: 500395 - RNA, 20 nt, Human
uucgcugggaguggccaggc

SEQ ID NO: 500396 - RNA, 22 nt, Human
gccaggcuggccagcaccuucu

SEQ ID NO: 500397 - RNA, 22 nt, Human
gugucagauguccagggcagca

SEQ ID NO: 500398 - RNA, 22 nt, Human
uccagcagguuggucaggugca

SEQ ID NO: 500399 - RNA, 22 nt, Human
cuuaagauugucagcuucagcc

SEQ ID NO: 500400 - RNA, 22 nt, Human
cuuggcccaguugccaaggaaa

SEQ ID NO: 500401 - RNA, 22 nt, Human
caggagcugggucuggaagcag

SEQ ID NO: 500402 - RNA, 22 nt, Human
cagcaggacccaggaauccugc

SEQ ID NO: 500403 - RNA, 22 nt, Human
acaggcagggaccuuggcuaag

SEQ ID NO: 500404 - RNA, 22 nt, Human
agcaggaggguuuuguagaguc

SEQ ID NO: 500405 - RNA, 18 nt, Human
uggcuccugccuccugca

SEQ ID NO: 500406 - RNA, 22 nt, Human
ugucuggcauaguugcucccug

SEQ ID NO: 500407 - RNA, 22 nt, Human
uucccaggcugugcuaccagag

SEQ ID NO: 500408 - RNA, 22 nt, Human
acagaaagaagguguauuugag

SEQ ID NO: 500409 - RNA, 22 nt, Human
agaaggcuggccauggugcccu

SEQ ID NO: 500410 - RNA, 22 nt, Human
uccucaguuuucuaguauggca

SEQ ID NO: 500411 - RNA, 23 nt, Human
acagcaagaggaccagaugugag

SEQ ID NO: 500412 - RNA, 22 nt, Human
acagagcacugcccugugccgc

SEQ ID NO: 500413 - RNA, 16 nt, Human
ccaccugcagcucuca

SEQ ID NO: 500414 - RNA, 22 nt, Human
agcaggguuuggggauuggcac

SEQ ID NO: 500415 - RNA, 22 nt, Human
ucagugcagacuguaaguugga

SEQ ID NO: 500416 - RNA, 22 nt, Human
ggcagguggccaagugucuaag

SEQ ID NO: 500417 - RNA, 22 nt, Human
aaaagucagucucuccuagcuc

SEQ ID NO: 500418 - RNA, 22 nt, Human
ucucuuuguggccaggagagga

SEQ ID NO: 500419 - RNA, 22 nt, Human
uuagucacuucuuccuucauca

SEQ ID NO: 500420 - RNA, 22 nt, Human
uccauguggcaauaggagacag

SEQ ID NO: 500421 - RNA, 22 nt, Human
agcaggcuuguuaugucugaga

SEQ ID NO: 500422 - RNA, 22 nt, Human
aggucauuccagccauuccccu

SEQ ID NO: 500423 - RNA, 22 nt, Human
uaccugcagcgggaauccauua

SEQ ID NO: 500424 - RNA, 22 nt, Human
ugguccuucuugaagagugagu

SEQ ID NO: 500425 - RNA, 22 nt, Human
ugccaggagagugcaugcaggg

SEQ ID NO: 500426 - RNA, 22 nt, Human
cugaagagaaagggagcucuuc

SEQ ID NO: 500427 - RNA, 22 nt, Human
gaguuguucaacgugugugaaa

SEQ ID NO: 500428 - RNA, 22 nt, Human
ugccucuguugagccuuggcug

SEQ ID NO: 500429 - RNA, 22 nt, Human
uggaauuuuguauuagcuuuga

SEQ ID NO: 500430 - RNA, 20 nt, Human
uguuucugacgguaggagag

SEQ ID NO: 500431 - RNA, 22 nt, Human
ugcuuaaaauaguucauuuuug

SEQ ID NO: 500432 - RNA, 22 nt, Human
aauguguacaugacagauagaa

SEQ ID NO: 500433 - RNA, 22 nt, Human
uccagggaccucccugagagcu

SEQ ID NO: 500434 - RNA, 22 nt, Human
acacauaagccuaaucaucucc

SEQ ID NO: 500435 - RNA, 22 nt, Human
gcuucuggagucuucagaggaa

SEQ ID NO: 500436 - RNA, 22 nt, Human
aagccaguaaguuuuugucauu

SEQ ID NO: 500437 - RNA, 22 nt, Human
agaaaacauuacauaggugugu

SEQ ID NO: 500438 - RNA, 22 nt, Human
ucugccuguucaagucuucuag

SEQ ID NO: 500439 - RNA, 22 nt, Human
uuaguuagucccugguaccuuu

SEQ ID NO: 500440 - RNA, 22 nt, Human
aaacuuguucucauguugcaga

SEQ ID NO: 500441 - RNA, 22 nt, Human
uucugggccaaucucuuaaucu

SEQ ID NO: 500442 - RNA, 22 nt, Human
uaaagacaugcaaagucuaauu

SEQ ID NO: 500443 - RNA, 22 nt, Human
uauuucuuucagguauguguug

SEQ ID NO: 500444 - RNA, 22 nt, Human
ucuuaaaccacaaaauucagag

SEQ ID NO: 500445 - RNA, 22 nt, Human
auuugucuucaguagguucuuc

SEQ ID NO: 500446 - RNA, 22 nt, Human
aagacauugucauuuuauaauu

SEQ ID NO: 500447 - RNA, 22 nt, Human
cuggagucuuagguuaugguga

SEQ ID NO: 500448 - RNA, 22 nt, Human
agcuuuauucaugauuucaggg

SEQ ID NO: 500449 - RNA, 22 nt, Human
cugcagggaugugaggcccguu

SEQ ID NO: 500450 - RNA, 22 nt, Human
uguggcuguugaggaccccaag

SEQ ID NO: 500451 - RNA, 22 nt, Human
uguggcugcaggcgauggagga

SEQ ID NO: 500452 - RNA, 22 nt, Human
ccuggguggcugccugccuuuc

SEQ ID NO: 500453 - RNA, 22 nt, Human
guggaaggugaaggagcagcga

SEQ ID NO: 500454 - RNA, 22 nt, Human
uaauuucuucaucucugcagcu

SEQ ID NO: 500455 - RNA, 19 nt, Human
ugcuucuggaaccaugauc

SEQ ID NO: 500456 - RNA, 22 nt, Human
agauaaauuccuaagauuucag

SEQ ID NO: 500457 - RNA, 20 nt, Human
aggaggcaauguagauaagc

SEQ ID NO: 500458 - RNA, 22 nt, Human
ggcucugcccagaugaagagga

SEQ ID NO: 500459 - RNA, 22 nt, Human
cagcagcugauggggaagugau

SEQ ID NO: 500460 - RNA, 22 nt, Human
uuucagaaaacuuaucaucagu

SEQ ID NO: 500461 - RNA, 22 nt, Human
agcuuuauggugccucacuuga

SEQ ID NO: 500462 - RNA, 22 nt, Human
acaaugcaauuguaaggugugu

SEQ ID NO: 500463 - RNA, 22 nt, Human
ugguuuugcuccaguauaaaua

SEQ ID NO: 500464 - RNA, 22 nt, Human
uuugugaagggaacagaagugu

SEQ ID NO: 500465 - RNA, 22 nt, Human
aagaugcgguugaccauggugu

SEQ ID NO: 500466 - RNA, 22 nt, Human
gcccagcacagcuggaagaguc

SEQ ID NO: 500467 - RNA, 22 nt, Human
ucaguuuuuaaaugauauaauu

SEQ ID NO: 500468 - RNA, 22 nt, Human
aucuggcuuucuuaaugacuua

SEQ ID NO: 500469 - RNA, 22 nt, Human
uuccuguauucuaaagggaaag

SEQ ID NO: 500470 - RNA, 22 nt, Human
uagcagcaauucaggugugaug

SEQ ID NO: 500471 - RNA, 22 nt, Human
ucagagaacacagaggugaugu

SEQ ID NO: 500472 - RNA, 22 nt, Human
aaaaaguauuggccaugguuga

SEQ ID NO: 500473 - RNA, 22 nt, Human
uacaggaacugggcaggacauu

SEQ ID NO: 500474 - RNA, 22 nt, Human
caggugggccaugaaaaaugac

SEQ ID NO: 500475 - RNA, 22 nt, Human
aaagauuucagaagccugugcc

SEQ ID NO: 500476 - RNA, 22 nt, Human
aguaaugucccuuaaauguggu

SEQ ID NO: 500477 - RNA, 22 nt, Human
acuuauaagagugcuaugggga

SEQ ID NO: 500478 - RNA, 22 nt, Human
auuuaaugucgagcuauuguag

SEQ ID NO: 500479 - RNA, 22 nt, Human
ucuagaaugacaugcaagagua

SEQ ID NO: 500480 - RNA, 22 nt, Human
auuagcaugccaagcuuuuaga

SEQ ID NO: 500481 - RNA, 22 nt, Human
cauauucuguuggucacauaga

SEQ ID NO: 500482 - RNA, 22 nt, Human
ucagcaggcugucagcaggggc

SEQ ID NO: 500483 - RNA, 22 nt, Human
ucauggcacuuagcacaguccu

SEQ ID NO: 500484 - RNA, 22 nt, Human
gccugagcuacuagggagucug

SEQ ID NO: 500485 - RNA, 22 nt, Human
ugcugggggugucucaccaggc

SEQ ID NO: 500486 - RNA, 22 nt, Human
aaaggagagugagucagaugcc

SEQ ID NO: 500487 - RNA, 22 nt, Human
uugaggcaaaaucaacgggaag

SEQ ID NO: 500488 - RNA, 20 nt, Human
gccugccucagcuagcugag

SEQ ID NO: 500489 - RNA, 22 nt, Human
cuggucuggcuacccagcgaau

SEQ ID NO: 500490 - RNA, 20 nt, Human
ggcucuggaaucuggugggc

SEQ ID NO: 500491 - RNA, 22 nt, Human
caccuuguggcccagucagguu

SEQ ID NO: 500492 - RNA, 19 nt, Human
uggcauugguccagauaaa

SEQ ID NO: 500493 - RNA, 22 nt, Human
uguacacaauucuuaacauaca

SEQ ID NO: 500494 - RNA, 22 nt, Human
cugggagcccgcguccuggugg

SEQ ID NO: 500495 - RNA, 22 nt, Human
ugagucaugggcuugagguuac

SEQ ID NO: 500496 - RNA, 22 nt, Human
uucccagagaaggaugaaaaag

SEQ ID NO: 500497 - RNA, 22 nt, Human
ucacaggguguacaucaccuau

SEQ ID NO: 500498 - RNA, 23 nt, Human
aaacaugcagcacaugaaugcua

SEQ ID NO: 500499 - RNA, 22 nt, Human
uggaggcaguaacugagcaaca

SEQ ID NO: 500500 - RNA, 16 nt, Human
auuguuuucaauuaga

SEQ ID NO: 500501 - RNA, 22 nt, Human
cccagccagccucuucccauau

SEQ ID NO: 500502 - RNA, 22 nt, Human
gagguccaggguggggccugag

SEQ ID NO: 500503 - RNA, 22 nt, Human
uuucugaauaacucuaugauau

SEQ ID NO: 500504 - RNA, 22 nt, Human
ucucaggaucuaauacauggua

SEQ ID NO: 500505 - RNA, 22 nt, Human
cuguucauggaaaaauaguugg

SEQ ID NO: 500506 - RNA, 22 nt, Human
aaaugcuguaacugauauucug

SEQ ID NO: 500507 - RNA, 22 nt, Human
gcaaagcaaucaggaguagcau

SEQ ID NO: 500508 - RNA, 21 nt, Human
ugcuuuaugggaaaaauguca

SEQ ID NO: 500509 - RNA, 22 nt, Human
ucuacagacagagcagguggga

SEQ ID NO: 500510 - RNA, 22 nt, Human
acaggcuuacuguuucauaggg

SEQ ID NO: 500511 - RNA, 22 nt, Human
uugcauguguaauuuuucuaaa

SEQ ID NO: 500512 - RNA, 22 nt, Human
cugggagauaugaggaucugga

SEQ ID NO: 500513 - RNA, 22 nt, Human
uagagcugauaaugaggccaag

SEQ ID NO: 500514 - RNA, 22 nt, Human
cccuggcuuaaaaaccucauau

SEQ ID NO: 500515 - RNA, 22 nt, Human
gcuuccucaccuucucuugcau

SEQ ID NO: 500516 - RNA, 22 nt, Human
uucauaaugagguccuagaggc

SEQ ID NO: 500517 - RNA, 22 nt, Human
ugucuuuagaaagaagcagaca

SEQ ID NO: 500518 - RNA, 22 nt, Human
uuccaggaggagguacuagagg

SEQ ID NO: 500519 - RNA, 22 nt, Human
auccugggaagcugacauugaa

SEQ ID NO: 500520 - RNA, 22 nt, Human
acaaaagugagugugucucaga

SEQ ID NO: 500521 - RNA, 22 nt, Human
agucugucuaauauuauucagg

SEQ ID NO: 500522 - RNA, 22 nt, Human
ucucagaguuccucuggagucc

SEQ ID NO: 500523 - RNA, 22 nt, Human
agugacuggugugaaguuaaau

SEQ ID NO: 500524 - RNA, 22 nt, Human
gaggcugguaggaaaggaaaca

SEQ ID NO: 500525 - RNA, 20 nt, Human
gugugaagcccucaggagga

SEQ ID NO: 500526 - RNA, 22 nt, Human
ccucugugccucguguccucug

SEQ ID NO: 500527 - RNA, 22 nt, Human
ugcauuuuuaacaaggcuaauu

SEQ ID NO: 500528 - RNA, 22 nt, Human
ugucacuucaggaaugcaggga

SEQ ID NO: 500529 - RNA, 22 nt, Human
uggaccugggguggccuccucu

SEQ ID NO: 500530 - RNA, 22 nt, Human
agcaggaaggggaugaugggca

SEQ ID NO: 500531 - RNA, 22 nt, Human
gcggcgccuaagccccgaccuc

SEQ ID NO: 500532 - RNA, 22 nt, Human
agcagcaucaacccucccgugu

SEQ ID NO: 500533 - RNA, 22 nt, Human
gcccacaccauuuauucuuugu

SEQ ID NO: 500534 - RNA, 22 nt, Human
caguggguggccucuugaguca

SEQ ID NO: 500535 - RNA, 22 nt, Human
caaggccauauugccuguaugu

SEQ ID NO: 500536 - RNA, 22 nt, Human
agcugucuaccugcagaguccu

SEQ ID NO: 500537 - RNA, 22 nt, Human
aagucacagaacccauuguaac

SEQ ID NO: 500538 - RNA, 22 nt, Human
uggaaacaucucugccuuuauu

SEQ ID NO: 500539 - RNA, 22 nt, Human
cauuugcuguauuuucagauuc

SEQ ID NO: 500540 - RNA, 22 nt, Human
acaauucugaugguuucccagu

SEQ ID NO: 500541 - RNA, 22 nt, Human
agcacuagcuuuaagcauucug

SEQ ID NO: 500542 - RNA, 22 nt, Human
agcaccugcuaugugucaggga

SEQ ID NO: 500543 - RNA, 22 nt, Human
cagaccagcucuaugaacccaa

SEQ ID NO: 500544 - RNA, 22 nt, Human
guccugguggagucucugggga

SEQ ID NO: 500545 - RNA, 22 nt, Human
aagauguuacucaaccaggaua

SEQ ID NO: 500546 - RNA, 21 nt, Human
ugaagccugaggcauagcccc

SEQ ID NO: 500547 - RNA, 22 nt, Human
aaggcucccucuucucgagugu

SEQ ID NO: 500548 - RNA, 20 nt, Human
gaggccucagccucagcucc

SEQ ID NO: 500549 - RNA, 22 nt, Human
uggcacuuuacacccauuuggc

SEQ ID NO: 500550 - RNA, 22 nt, Human
aacaugaaguuuucuauaguga

SEQ ID NO: 500551 - RNA, 22 nt, Human
gccuuggacucggguggacuca

SEQ ID NO: 500552 - RNA, 22 nt, Human
cugugccugccuuguucacuga

SEQ ID NO: 500553 - RNA, 22 nt, Human
guggauggacaugggcaagagg

SEQ ID NO: 500554 - RNA, 22 nt, Human
gcuguguaucagaugccacggg

SEQ ID NO: 500555 - RNA, 22 nt, Human
aagcauuuggcaugaaacucuu

SEQ ID NO: 500556 - RNA, 22 nt, Human
ucaguguuugaacccaggguua

SEQ ID NO: 500557 - RNA, 22 nt, Human
agccuccuggaguuucugggau

SEQ ID NO: 500558 - RNA, 22 nt, Human
ggggucugggcuuagcuggaau

SEQ ID NO: 500559 - RNA, 22 nt, Human
caggaaauuggcuauuugggau

SEQ ID NO: 500560 - RNA, 22 nt, Human
ucuggagcuugaagcuuugguu

SEQ ID NO: 500561 - RNA, 22 nt, Human
cacuguccaauagauacauaau

SEQ ID NO: 500562 - RNA, 23 nt, Human
aagcuuccuucacgucuccuggg

SEQ ID NO: 500563 - RNA, 22 nt, Human
uguguucaccaaaguguagaaa

SEQ ID NO: 500564 - RNA, 22 nt, Human
auccaaaccuggacaugagugg

SEQ ID NO: 500565 - RNA, 22 nt, Human
ucucagugcagcaaggaauuua

SEQ ID NO: 500566 - RNA, 22 nt, Human
gaugagaaauggacaggagugg

SEQ ID NO: 500567 - RNA, 22 nt, Human
gaauguaauagucaguagaaca

SEQ ID NO: 500568 - RNA, 22 nt, Human
gcucuccacugaccacggggca

SEQ ID NO: 500569 - RNA, 22 nt, Human
uggaguggacuucaugaggcca

SEQ ID NO: 500570 - RNA, 22 nt, Human
uaccaggcagcugcacagaggc

SEQ ID NO: 500571 - RNA, 21 nt, Human
aggaggaacccguggcugggc

SEQ ID NO: 500572 - RNA, 22 nt, Human
cagggcuuuccugagaagugau

SEQ ID NO: 500573 - RNA, 22 nt, Human
ugucugaagcagccagugcugu

SEQ ID NO: 500574 - RNA, 18 nt, Human
cccaggcuuugugggucu

SEQ ID NO: 500575 - RNA, 22 nt, Human
cuggagcuaauaauccaucuga

SEQ ID NO: 500576 - RNA, 22 nt, Human
ggcaguggaggacccugugucu

SEQ ID NO: 500577 - RNA, 22 nt, Human
cccagcuccuuggaugggcagg

SEQ ID NO: 500578 - RNA, 22 nt, Human
ggagcugaugguagaagaauga

SEQ ID NO: 500579 - RNA, 22 nt, Human
agcaauaugacauugcuacauc

SEQ ID NO: 500580 - RNA, 22 nt, Human
uucaggaucaaguugccaguag

SEQ ID NO: 500581 - RNA, 22 nt, Human
cccuguacagucucuguggcac

SEQ ID NO: 500582 - RNA, 22 nt, Human
ucugagccaauuucugugucca

SEQ ID NO: 500583 - RNA, 22 nt, Human
augcagaaagagaauguaaugu

SEQ ID NO: 500584 - RNA, 22 nt, Human
cagugcagaacacauggaaaau

SEQ ID NO: 500585 - RNA, 22 nt, Human
ccucugggcugccugcacgggu

SEQ ID NO: 500586 - RNA, 22 nt, Human
agucaaagaugaccgaguuccu

SEQ ID NO: 500587 - RNA, 22 nt, Human
uauuuaucaagguaggagaaua

SEQ ID NO: 500588 - RNA, 22 nt, Human
ggucagagggugggcugccugu

SEQ ID NO: 500589 - RNA, 22 nt, Human
ggccuguccagccugccuggcu

SEQ ID NO: 500590 - RNA, 22 nt, Human
cuggaaugagcagggcuuaugg

SEQ ID NO: 500591 - RNA, 22 nt, Human
ugaccuguguuugcuguugcuc

SEQ ID NO: 500592 - RNA, 22 nt, Human
gcucucugggugugucuagaua

SEQ ID NO: 500593 - RNA, 23 nt, Human
ugguccugguugaggugggcccc

SEQ ID NO: 500594 - RNA, 22 nt, Human
agugaauuuaaaacacugagga

SEQ ID NO: 500595 - RNA, 22 nt, Human
ucuggguccgggacuguggaug

SEQ ID NO: 500596 - RNA, 22 nt, Human
agaguauugugaccauuuguca

SEQ ID NO: 500597 - RNA, 22 nt, Human
ugagucuuuccaaagccgucau

SEQ ID NO: 500598 - RNA, 22 nt, Human
ggcagcaugagccuggugaauu

SEQ ID NO: 500599 - RNA, 22 nt, Human
gcuggccugcaaagcccggcug

SEQ ID NO: 500600 - RNA, 22 nt, Human
aggaaaugcugaugcuccugga

SEQ ID NO: 500601 - RNA, 18 nt, Human
cugggucuccaggcugcc

SEQ ID NO: 500602 - RNA, 22 nt, Human
ucauccaguaugacuggugucu

SEQ ID NO: 500603 - RNA, 22 nt, Human
cagcuggaucccugcagaacuu

SEQ ID NO: 500604 - RNA, 22 nt, Human
auuugcugaaucaaugaauuuu

SEQ ID NO: 500605 - RNA, 22 nt, Human
cugggcuuugaagccaggcugc

SEQ ID NO: 500606 - RNA, 23 nt, Human
gccugccauauaccuggaaacag

SEQ ID NO: 500607 - RNA, 22 nt, Human
aauguguagauguugcauuccu

SEQ ID NO: 500608 - RNA, 22 nt, Human
uuaaagcaggcaucauuccuca

SEQ ID NO: 500609 - RNA, 22 nt, Human
cagcacaucuccaagaauuucu

SEQ ID NO: 500610 - RNA, 22 nt, Human
uuagcaaauaucuugaaacagg

SEQ ID NO: 500611 - RNA, 22 nt, Human
cagggcagugaagaacacacgu

SEQ ID NO: 500612 - RNA, 22 nt, Human
cccaggcacaccccgaacggaa

SEQ ID NO: 500613 - RNA, 22 nt, Human
uucucuuuuagaggcuccauga

SEQ ID NO: 500614 - RNA, 17 nt, Human
ugcaggcuguuauagcc

SEQ ID NO: 500615 - RNA, 22 nt, Human
ucauuucugagccuuccaugau

SEQ ID NO: 500616 - RNA, 22 nt, Human
uuagcugcugauuaaauauguu

SEQ ID NO: 500617 - RNA, 21 nt, Human
ugcuccuuagcugccccugcc

SEQ ID NO: 500618 - RNA, 22 nt, Human
ggccucuguuuggagccaggau

SEQ ID NO: 500619 - RNA, 22 nt, Human
acagagcugggaucugaaccca

SEQ ID NO: 500620 - RNA, 22 nt, Human
ccaggaaggcaggccuccccgc

SEQ ID NO: 500621 - RNA, 22 nt, Human
ccagagagaaaauggagggcca

SEQ ID NO: 500622 - RNA, 22 nt, Human
uuuagcuucauuuggcgugauu

SEQ ID NO: 500623 - RNA, 22 nt, Human
gcuguauuuauuuucuaggguu

SEQ ID NO: 500624 - RNA, 21 nt, Human
aguggcugucaagggggccuu

SEQ ID NO: 500625 - RNA, 22 nt, Human
auuugcuucugcuaaacaacuu

SEQ ID NO: 500626 - RNA, 22 nt, Human
gagagugauucccucccauaga

SEQ ID NO: 500627 - RNA, 22 nt, Human
guucacauguggucaugcuguc

SEQ ID NO: 500628 - RNA, 22 nt, Human
gaaagugccagaauaggaggcc

SEQ ID NO: 500629 - RNA, 22 nt, Human
acaauucucucauaucuuauua

SEQ ID NO: 500630 - RNA, 22 nt, Human
acuuugcagagccagaagagaa

SEQ ID NO: 500631 - RNA, 22 nt, Human
uaugauauucuaaauugacacc

SEQ ID NO: 500632 - RNA, 22 nt, Human
aucaggaucugcaucauaagaa

SEQ ID NO: 500633 - RNA, 22 nt, Human
agccaaggcagcuagagcucug

SEQ ID NO: 500634 - RNA, 22 nt, Human
uucuuuccacagaggggaugau

SEQ ID NO: 500635 - RNA, 22 nt, Human
aguauguauuuuauacuuacag

SEQ ID NO: 500636 - RNA, 22 nt, Human
ugugacugagcugcagaguguc

SEQ ID NO: 500637 - RNA, 22 nt, Human
ccuuuccuuuuuagugugggag

SEQ ID NO: 500638 - RNA, 22 nt, Human
uggagcugagaaguggagcucu

SEQ ID NO: 500639 - RNA, 22 nt, Human
uucuggaaguggaauuuuugua

SEQ ID NO: 500640 - RNA, 22 nt, Human
aggugaguugguaggaaguuug

SEQ ID NO: 500641 - RNA, 20 nt, Human
aaagagaagccucaccuugu

SEQ ID NO: 500642 - RNA, 22 nt, Human
cacacacucuuccuggcaccua

SEQ ID NO: 500643 - RNA, 22 nt, Human
uuagcucagaaaauuuaaacuu

SEQ ID NO: 500644 - RNA, 22 nt, Human
uuagugcaaaccucagagacac

SEQ ID NO: 500645 - RNA, 22 nt, Human
caccauaaccaacaugucaguu

SEQ ID NO: 500646 - RNA, 23 nt, Human
gccugggacugguagugugaccu

SEQ ID NO: 500647 - RNA, 22 nt, Human
ccagugcaccaagaggccuaga

SEQ ID NO: 500648 - RNA, 19 nt, Human
agacucugugugagacuuu

SEQ ID NO: 500649 - RNA, 22 nt, Human
acccagagccagggucaggagc

SEQ ID NO: 500650 - RNA, 22 nt, Human
ggccaccucugcccuacugagu

SEQ ID NO: 500651 - RNA, 22 nt, Human
ucccagggauuaggacauggau

SEQ ID NO: 500652 - RNA, 22 nt, Human
gcagcagcaggcgcucggccgu

SEQ ID NO: 500653 - RNA, 22 nt, Human
ugggcagcagcaaagccagacu

SEQ ID NO: 500654 - RNA, 22 nt, Human
gagcccaggaaguggaggcuga

SEQ ID NO: 500655 - RNA, 22 nt, Human
agguccagaacgugccuacucu

SEQ ID NO: 500656 - RNA, 22 nt, Human
gagcucagauucuggugucaga

SEQ ID NO: 500657 - RNA, 22 nt, Human
ugcuucugaaaugcaggucuuc

SEQ ID NO: 500658 - RNA, 22 nt, Human
gccugccuggagcuugagguga

SEQ ID NO: 500659 - RNA, 22 nt, Human
cauacauuuauacacaucuaug

SEQ ID NO: 500660 - RNA, 22 nt, Human
cugucuuuucuucucauugaug

SEQ ID NO: 500661 - RNA, 22 nt, Human
uucucugggaacauaaaugaag

SEQ ID NO: 500662 - RNA, 22 nt, Human
gagcucauccccaugguccguc

SEQ ID NO: 500663 - RNA, 22 nt, Human
aggccugagguuccugugcuca

SEQ ID NO: 500664 - RNA, 22 nt, Human
uggcucaguagcagugugguca

SEQ ID NO: 500665 - RNA, 22 nt, Human
gagcugccaagauuacaaucag

SEQ ID NO: 500666 - RNA, 22 nt, Human
accuagaauuuaaaacauugcu

SEQ ID NO: 500667 - RNA, 22 nt, Human
augcugaggacaaagagaucaa

SEQ ID NO: 500668 - RNA, 22 nt, Human
agugucugcucagacagcuaca

SEQ ID NO: 500669 - RNA, 22 nt, Human
ccugccaggagcuggugcugca

SEQ ID NO: 500670 - RNA, 22 nt, Human
ugguccuguagcacuugauuag

SEQ ID NO: 500671 - RNA, 22 nt, Human
uugacaauguccuuugaauuuc

SEQ ID NO: 500672 - RNA, 22 nt, Human
cagagagcaugggaggcccgag

SEQ ID NO: 500673 - RNA, 22 nt, Human
agcagggcagugaucagaaagg

SEQ ID NO: 500674 - RNA, 22 nt, Human
gccugaggaaugcuccugacuu

SEQ ID NO: 500675 - RNA, 22 nt, Human
uuugauuuacuggauauucuca

SEQ ID NO: 500676 - RNA, 22 nt, Human
caugagaaugaagaagacuuaa

SEQ ID NO: 500677 - RNA, 22 nt, Human
cugcacagggauauggggagcu

SEQ ID NO: 500678 - RNA, 22 nt, Human
agcaguggcugaagauguuccu

SEQ ID NO: 500679 - RNA, 22 nt, Human
gcaccugcaggaugagccaggg

SEQ ID NO: 500680 - RNA, 22 nt, Human
ucaaaucccagcucagccucuc

SEQ ID NO: 500681 - RNA, 22 nt, Human
acugagcucuugacugggaguu

SEQ ID NO: 500682 - RNA, 22 nt, Human
gagcccagcuugcacauggagc

SEQ ID NO: 500683 - RNA, 22 nt, Human
ugagccugaguucaaggcugca

SEQ ID NO: 500684 - RNA, 22 nt, Human
ugguccagcuugauucucuucu

SEQ ID NO: 500685 - RNA, 22 nt, Human
gcccuuuguggucagaggccug

SEQ ID NO: 500686 - RNA, 21 nt, Human
cugagggccgcagcugggcuc

SEQ ID NO: 500687 - RNA, 22 nt, Human
gugucccaggccucuggaauua

SEQ ID NO: 500688 - RNA, 22 nt, Human
caggccuggcccccggcacacc

SEQ ID NO: 500689 - RNA, 22 nt, Human
acacccagagcgccagugccga

SEQ ID NO: 500690 - RNA, 22 nt, Human
ucaaaaaguugaagaguugggg

SEQ ID NO: 500691 - RNA, 22 nt, Human
gcucccaccuccagccugaguu

SEQ ID NO: 500692 - RNA, 22 nt, Human
ugcagaaguauuccaggcccca

SEQ ID NO: 500693 - RNA, 22 nt, Human
aaggcugagggcuguaccuggc

SEQ ID NO: 500694 - RNA, 22 nt, Human
aagugacacauggcacuucuau

SEQ ID NO: 500695 - RNA, 22 nt, Human
uugucugaauauguauguaucc

SEQ ID NO: 500696 - RNA, 22 nt, Human
aaaaaugucauuauggaacuga

SEQ ID NO: 500697 - RNA, 22 nt, Human
uuacauuagacccacuuucaug

SEQ ID NO: 500698 - RNA, 22 nt, Human
aaggaugaacauuaauacauca

SEQ ID NO: 500699 - RNA, 23 nt, Human
aucugggcaucuggagugguccu

SEQ ID NO: 500700 - RNA, 17 nt, Human
agcuucaguugcaaaac

SEQ ID NO: 500701 - RNA, 22 nt, Human
ugcauaaaauaugagaaaugua

SEQ ID NO: 500702 - RNA, 22 nt, Human
cagggcucagaagacagaccuc

SEQ ID NO: 500703 - RNA, 22 nt, Human
uacagcuuuugcagcuguuuug

SEQ ID NO: 500704 - RNA, 22 nt, Human
gccuucugauugcuggacugac

SEQ ID NO: 500705 - RNA, 20 nt, Human
acuggacacugaggugagcu

SEQ ID NO: 500706 - RNA, 22 nt, Human
uuccucucucuugccagaaugu

SEQ ID NO: 500707 - RNA, 22 nt, Human
uuugcagcaaggagagagcauu

SEQ ID NO: 500708 - RNA, 22 nt, Human
gcucuggcuacuguggcuaccg

SEQ ID NO: 500709 - RNA, 22 nt, Human
cccaaguuaauuuguagcugaa

SEQ ID NO: 500710 - RNA, 22 nt, Human
aaaugcacugaacacauguugu

SEQ ID NO: 500711 - RNA, 22 nt, Human
gcagacugcgagcgugcuggug

SEQ ID NO: 500712 - RNA, 22 nt, Human
acagggccucagcugauucugg

SEQ ID NO: 500713 - RNA, 21 nt, Human
ccagacuggccuaugugguag

SEQ ID NO: 500714 - RNA, 22 nt, Human
uaucuuuagaggaagagaaucu

SEQ ID NO: 500715 - RNA, 22 nt, Human
gagcuggcuccgccaugcugcu

SEQ ID NO: 500716 - RNA, 22 nt, Human
caggcacacccacuggugcaga

SEQ ID NO: 500717 - RNA, 22 nt, Human
auguaacuucugugaaucugac

SEQ ID NO: 500718 - RNA, 22 nt, Human
aaggcagagggcuggaucagag

SEQ ID NO: 500719 - RNA, 22 nt, Human
cuggagucagcaaggacgaggc

SEQ ID NO: 500720 - RNA, 22 nt, Human
gccugccuguuggcugaggugc

SEQ ID NO: 500721 - RNA, 22 nt, Human
aaguucuacuguggguaaaaug

SEQ ID NO: 500722 - RNA, 21 nt, Human
uaaaacuguaacuuuguccug

SEQ ID NO: 500723 - RNA, 22 nt, Human
uucuuacuacauuugcaggcua

SEQ ID NO: 500724 - RNA, 22 nt, Human
aaagacugcaaaaacgcacaga

SEQ ID NO: 500725 - RNA, 22 nt, Human
ggcugaaggaugaaagcugcag

SEQ ID NO: 500726 - RNA, 22 nt, Human
gcaguuaaaaauaaaccuucau

SEQ ID NO: 500727 - RNA, 22 nt, Human
cauacauaugcauguguguaua

SEQ ID NO: 500728 - RNA, 20 nt, Human
ggggcccaagcccucuugcc

SEQ ID NO: 500729 - RNA, 22 nt, Human
gcacaugugagaguagaggccu

SEQ ID NO: 500730 - RNA, 22 nt, Human
aagagagaccaugggggacagg

SEQ ID NO: 500731 - RNA, 23 nt, Human
ugggaguguugggaucucugcuc

SEQ ID NO: 500732 - RNA, 22 nt, Human
gaaaguauuagccuagaaguca

SEQ ID NO: 500733 - RNA, 18 nt, Human
caggagcaggaguugaac

SEQ ID NO: 500734 - RNA, 22 nt, Human
caggcuggaguuaccuuuaggg

SEQ ID NO: 500735 - RNA, 22 nt, Human
uaagaacaguguuucaucucua

SEQ ID NO: 500736 - RNA, 22 nt, Human
ccuucagaccuagacaggaauc

SEQ ID NO: 500737 - RNA, 22 nt, Human
aaaaugcugggaaaguuggaau

SEQ ID NO: 500738 - RNA, 22 nt, Human
auauuugugguuuuuggcuccu

SEQ ID NO: 500739 - RNA, 22 nt, Human
uugccagggccagugggggugu

SEQ ID NO: 500740 - RNA, 22 nt, Human
agaagccauggggucaccagag

SEQ ID NO: 500741 - RNA, 22 nt, Human
cuccagggaugagacagaguag

SEQ ID NO: 500742 - RNA, 22 nt, Human
uuugaaaguguuuacuugggaa

SEQ ID NO: 500743 - RNA, 22 nt, Human
aaccauuugcaguuacugagac

SEQ ID NO: 500744 - RNA, 22 nt, Human
agacucugauaagcaacucuug

SEQ ID NO: 500745 - RNA, 22 nt, Human
uaaaucucacuggguauauugg

SEQ ID NO: 500746 - RNA, 22 nt, Human
uccagcccugcuuccugccuca

SEQ ID NO: 500747 - RNA, 23 nt, Human
ucucagugcacgcaccaugccug

SEQ ID NO: 500748 - RNA, 18 nt, Human
ggucaggggcggagagaa

SEQ ID NO: 500749 - RNA, 22 nt, Human
gagcccucucuguaggcaagua

SEQ ID NO: 500750 - RNA, 22 nt, Human
agcuuuaaaucaauccagugag

SEQ ID NO: 500751 - RNA, 20 nt, Human
ugcaggcuucgcucuaggag

SEQ ID NO: 500752 - RNA, 19 nt, Human
agaggcagucuccaacagg

SEQ ID NO: 500753 - RNA, 22 nt, Human
ccaucagcaugggagcaugggc

SEQ ID NO: 500754 - RNA, 22 nt, Human
agguccaggagauuuggcaauu

SEQ ID NO: 500755 - RNA, 22 nt, Human
ggaaggagcauuugccaguuua

SEQ ID NO: 500756 - RNA, 22 nt, Human
uugaauaggacucagcagugau

SEQ ID NO: 500757 - RNA, 22 nt, Human
aaauggaucuguggaauacauu

SEQ ID NO: 500758 - RNA, 22 nt, Human
gcgcaggugcugcuggagcagc

SEQ ID NO: 500759 - RNA, 22 nt, Human
ucugucuccucugaggugccag

SEQ ID NO: 500760 - RNA, 22 nt, Human
agacacagauuuuggaaaagau

SEQ ID NO: 500761 - RNA, 22 nt, Human
augagcuagaaaaccaugugga

SEQ ID NO: 500762 - RNA, 22 nt, Human
ccugaggcuugggaguuccgcc

SEQ ID NO: 500763 - RNA, 22 nt, Human
auccaaaucaugucagaagaac

SEQ ID NO: 500764 - RNA, 22 nt, Human
uugucugacuucuuuaguuacu

SEQ ID NO: 500765 - RNA, 22 nt, Human
ucccacacuacacgguuguugg

SEQ ID NO: 500766 - RNA, 22 nt, Human
auagcauuuacuuuucagaaau

SEQ ID NO: 500767 - RNA, 22 nt, Human
gagguucugggggucugccugg

SEQ ID NO: 500768 - RNA, 22 nt, Human
cagcccuuuccuucucagcuuu

SEQ ID NO: 500769 - RNA, 22 nt, Human
agagccagcauuugacacuggc

SEQ ID NO: 500770 - RNA, 22 nt, Human
cagcccugcagccauggccugu

SEQ ID NO: 500771 - RNA, 22 nt, Human
aacggcuguggcuggcggcagc

SEQ ID NO: 500772 - RNA, 22 nt, Human
cugugucuucacauuugugugc

SEQ ID NO: 500773 - RNA, 22 nt, Human
ugaaguuuaagguuagauaagu

SEQ ID NO: 500774 - RNA, 22 nt, Human
guuucaauuugacccaaaucuu

SEQ ID NO: 500775 - RNA, 22 nt, Human
ggagccuugggcgcucucccau

SEQ ID NO: 500776 - RNA, 23 nt, Human
cagaaaugacaguaagcacccug

SEQ ID NO: 500777 - RNA, 22 nt, Human
ugcagggauuagaggccgggga

SEQ ID NO: 500778 - RNA, 22 nt, Human
ucaaagccuguggauaguuugg

SEQ ID NO: 500779 - RNA, 21 nt, Human
ggagcugcaggagccgaaggc

SEQ ID NO: 500780 - RNA, 22 nt, Human
gauuucaauccagcuuucuucu

SEQ ID NO: 500781 - RNA, 22 nt, Human
auuuccagcagcauauuugucu

SEQ ID NO: 500782 - RNA, 22 nt, Human
ugccucaggcaccuggcagguu

SEQ ID NO: 500783 - RNA, 22 nt, Human
cagagacccuucucaguggcca

SEQ ID NO: 500784 - RNA, 22 nt, Human
caucugccuaaguggcccuguu

SEQ ID NO: 500785 - RNA, 22 nt, Human
guucauucugaaaagcagcuug

SEQ ID NO: 500786 - RNA, 22 nt, Human
auguucaaacuuuuuacacacc

SEQ ID NO: 500787 - RNA, 22 nt, Human
cccagugucucuugugccuuuc

SEQ ID NO: 500788 - RNA, 22 nt, Human
uucuuccucagcagggcugccu

SEQ ID NO: 500789 - RNA, 22 nt, Human
aagcugaggcccauggcaaggu

SEQ ID NO: 500790 - RNA, 22 nt, Human
agugaguggacccugcaaggaa

SEQ ID NO: 500791 - RNA, 22 nt, Human
aaacucaagucuaugaacaagg

SEQ ID NO: 500792 - RNA, 22 nt, Human
gggaucuggaauuuugguaugu

SEQ ID NO: 500793 - RNA, 22 nt, Human
gcaaggacucccugggucauuc

SEQ ID NO: 500794 - RNA, 22 nt, Human
uacauuguuuuuucuugccauc

SEQ ID NO: 500795 - RNA, 22 nt, Human
gagaugagugggggaucucuca

SEQ ID NO: 500796 - RNA, 22 nt, Human
aagugacaccucuucccuuucc

SEQ ID NO: 500797 - RNA, 22 nt, Human
aggggagagaacauaaggaagu

SEQ ID NO: 500798 - RNA, 22 nt, Human
ugaaggccuaacuuccagugcu

SEQ ID NO: 500799 - RNA, 22 nt, Human
cugagcagcaccuucaagaaac

SEQ ID NO: 500800 - RNA, 22 nt, Human
augauacaagcaaaacuaauca

SEQ ID NO: 500801 - RNA, 17 nt, Human
ccucccacaccgcccug

SEQ ID NO: 500802 - RNA, 22 nt, Human
agggcucugggguggcagagau

SEQ ID NO: 500803 - RNA, 22 nt, Human
ucucagucuuugcaaggaugcu

SEQ ID NO: 500804 - RNA, 22 nt, Human
ugccccucuugagaagcucagc

SEQ ID NO: 500805 - RNA, 22 nt, Human
caugaagcacagcucucuuuuu

SEQ ID NO: 500806 - RNA, 22 nt, Human
uaucacuacaccuggcuaauua

SEQ ID NO: 500807 - RNA, 22 nt, Human
aacagaaugcaggggaugcugc

SEQ ID NO: 500808 - RNA, 23 nt, Human
accaugaugggagugcaaauaag

SEQ ID NO: 500809 - RNA, 22 nt, Human
ccuggcagcaggugggcccgug

SEQ ID NO: 500810 - RNA, 22 nt, Human
ugaguacucggagugcuuugga

SEQ ID NO: 500811 - RNA, 22 nt, Human
cgcugggcgccgaccugcuggc

SEQ ID NO: 500812 - RNA, 22 nt, Human
auaaauagugcugccaugagua

SEQ ID NO: 500813 - RNA, 20 nt, Human
caguagcaauaauuagaagc

SEQ ID NO: 500814 - RNA, 22 nt, Human
cucuggagguugagcccagcaa

SEQ ID NO: 500815 - RNA, 20 nt, Human
agaauucuuacccuuugaug

SEQ ID NO: 500816 - RNA, 22 nt, Human
uuucuuaggcucuaaaaugacu

SEQ ID NO: 500817 - RNA, 22 nt, Human
aucuucaaagcacaucguuugu

SEQ ID NO: 500818 - RNA, 22 nt, Human
aggaaggacuccaugguccguc

SEQ ID NO: 500819 - RNA, 22 nt, Human
acacugacgcuugacagucacc

SEQ ID NO: 500820 - RNA, 22 nt, Human
uucccucuuucacugugauuuu

SEQ ID NO: 500821 - RNA, 22 nt, Human
ucaggaaagccuagaagagaac

SEQ ID NO: 500822 - RNA, 22 nt, Human
cugagggucaacuugauuguau

SEQ ID NO: 500823 - RNA, 22 nt, Human
ugugugccagccuacgaggagc

SEQ ID NO: 500824 - RNA, 22 nt, Human
gagcuucagagaccacuuaacu

SEQ ID NO: 500825 - RNA, 22 nt, Human
ucaaauacauggucaaucaacu

SEQ ID NO: 500826 - RNA, 22 nt, Human
gggugcaggcagcccaggcagg

SEQ ID NO: 500827 - RNA, 22 nt, Human
acagccagaggagccaggcugg

SEQ ID NO: 500828 - RNA, 22 nt, Human
cugaugauagugauuuauugag

SEQ ID NO: 500829 - RNA, 22 nt, Human
uugcauuguugcaaugaaguau

SEQ ID NO: 500830 - RNA, 22 nt, Human
augugaggaagaaagagguaag

SEQ ID NO: 500831 - RNA, 22 nt, Human
aaugaugugaguuuuuauucuc

SEQ ID NO: 500832 - RNA, 22 nt, Human
uuuacaaggcagaacugauuaa

SEQ ID NO: 500833 - RNA, 22 nt, Human
ccaaaggaugucccuguguuuu

SEQ ID NO: 500834 - RNA, 23 nt, Human
uucuggaagauuuacuugagaca

SEQ ID NO: 500835 - RNA, 22 nt, Human
agaaaugacaagacugaucagg

SEQ ID NO: 500836 - RNA, 22 nt, Human
gagauggggucagcugggacau

SEQ ID NO: 500837 - RNA, 22 nt, Human
agcagggcuucugugccugugc

SEQ ID NO: 500838 - RNA, 20 nt, Human
agagauuuuaguagccacag

SEQ ID NO: 500839 - RNA, 22 nt, Human
ugaggcagaguaagauacauga

SEQ ID NO: 500840 - RNA, 22 nt, Human
uguuuuucaaauauugcucugu

SEQ ID NO: 500841 - RNA, 22 nt, Human
gugccuggagcuaauguguaua

SEQ ID NO: 500842 - RNA, 18 nt, Human
agcagguggcgucugcag

SEQ ID NO: 500843 - RNA, 21 nt, Human
agagaauugccuuagauguuc

SEQ ID NO: 500844 - RNA, 22 nt, Human
aagggcucugggcuacgcacug

SEQ ID NO: 500845 - RNA, 22 nt, Human
gaggagaggggcucccaagagc

SEQ ID NO: 500846 - RNA, 22 nt, Human
uucugucucccugauguagagc

SEQ ID NO: 500847 - RNA, 22 nt, Human
uguggggaagaguaugacuugg

SEQ ID NO: 500848 - RNA, 22 nt, Human
ugccugaugcaggaguaucaga

SEQ ID NO: 500849 - RNA, 22 nt, Human
aaguagaaaaccgcacuggacu

SEQ ID NO: 500850 - RNA, 22 nt, Human
guguggcugugggagauguuca

SEQ ID NO: 500851 - RNA, 22 nt, Human
ugagcuuacgugggaacagacu

SEQ ID NO: 500852 - RNA, 17 nt, Human
aaaauucuguaaagagg

SEQ ID NO: 500853 - RNA, 22 nt, Human
agaggcaggaagagcugauuuu

SEQ ID NO: 500854 - RNA, 22 nt, Human
uauuacaagaaagggcaugaau

SEQ ID NO: 500855 - RNA, 21 nt, Human
ucagcagcaucugccuagagu

SEQ ID NO: 500856 - RNA, 22 nt, Human
ugucucagauacgccaucaagg

SEQ ID NO: 500857 - RNA, 22 nt, Human
uuagugcaauucagagaacaau

SEQ ID NO: 500858 - RNA, 22 nt, Human
caaggccagggaauuuuucugg

SEQ ID NO: 500859 - RNA, 22 nt, Human
ccuuugggugaauuccucucuu

SEQ ID NO: 500860 - RNA, 22 nt, Human
gcagggacgccagggacagcaa

SEQ ID NO: 500861 - RNA, 22 nt, Human
gaaaaagugaccuugguagcua

SEQ ID NO: 500862 - RNA, 22 nt, Human
gcucugugcaguucagggacac

SEQ ID NO: 500863 - RNA, 22 nt, Human
ucacugcagagaccucuaguca

SEQ ID NO: 500864 - RNA, 22 nt, Human
auucuucauguugaagcuguca

SEQ ID NO: 500865 - RNA, 22 nt, Human
acaaugucaccucucauguuuu

SEQ ID NO: 500866 - RNA, 23 nt, Human
ugcucugggaggcccuggagagc

SEQ ID NO: 500867 - RNA, 22 nt, Human
aggaggccuacgcacaugucua

SEQ ID NO: 500868 - RNA, 22 nt, Human
agaauucuuggugguuagaaua

SEQ ID NO: 500869 - RNA, 22 nt, Human
uccaggacuagcauuucugaua

SEQ ID NO: 500870 - RNA, 22 nt, Human
ccagcccaugcccuuauagcau

SEQ ID NO: 500871 - RNA, 22 nt, Human
caaaguccuagaacagugcuug

SEQ ID NO: 500872 - RNA, 19 nt, Human
uggcucugucgaaggcaca

SEQ ID NO: 500873 - RNA, 22 nt, Human
cugggcugaaaguguuccuuga

SEQ ID NO: 500874 - RNA, 22 nt, Human
uuuccaggagaaagagagccuu

SEQ ID NO: 500875 - RNA, 22 nt, Human
ugcuucuguucuuucaccuacg

SEQ ID NO: 500876 - RNA, 17 nt, Human
aggagggaaauagcuug

SEQ ID NO: 500877 - RNA, 22 nt, Human
uugggccaagugauucucugcc

SEQ ID NO: 500878 - RNA, 22 nt, Human
agcuggugcugaagcucuugag

SEQ ID NO: 500879 - RNA, 22 nt, Human
ggcuguggucugggugcucccc

SEQ ID NO: 500880 - RNA, 22 nt, Human
acaaacuaccuacagauguuca

SEQ ID NO: 500881 - RNA, 21 nt, Human
ccagcagcucaaggaucucuu

SEQ ID NO: 500882 - RNA, 22 nt, Human
auguaaguauucaaaauauuuc

SEQ ID NO: 500883 - RNA, 22 nt, Human
aaggcugguggauuaugagguc

SEQ ID NO: 500884 - RNA, 22 nt, Human
cauguguguggacgagcguggc

SEQ ID NO: 500885 - RNA, 22 nt, Human
uggccagguguggguucucaga

SEQ ID NO: 500886 - RNA, 22 nt, Human
cuuguacaggaauccaugguau

SEQ ID NO: 500887 - RNA, 22 nt, Human
ggaggcugagaaguccaagauc

SEQ ID NO: 500888 - RNA, 22 nt, Human
gugggccuugcagggugcaggg

SEQ ID NO: 500889 - RNA, 22 nt, Human
gcacagggagcaggucucuggu

SEQ ID NO: 500890 - RNA, 22 nt, Human
ucucagggccucccucuguuuc

SEQ ID NO: 500891 - RNA, 22 nt, Human
uggcucugguaacauuggguag

SEQ ID NO: 500892 - RNA, 22 nt, Human
ucacugcugcugccaugaugga

SEQ ID NO: 500893 - RNA, 22 nt, Human
guccacauaggaacccagcuuc

SEQ ID NO: 500894 - RNA, 22 nt, Human
agcagccagugggagugauaca

SEQ ID NO: 500895 - RNA, 22 nt, Human
ugcuuccuugagcucuccaauc

SEQ ID NO: 500896 - RNA, 22 nt, Human
uccauuggucucugugcccagg

SEQ ID NO: 500897 - RNA, 22 nt, Human
aauaauacaugagauuaauguu

SEQ ID NO: 500898 - RNA, 22 nt, Human
gagcaggugccuguagcucucu

SEQ ID NO: 500899 - RNA, 23 nt, Human
ccagggagguugauugguuaccc

SEQ ID NO: 500900 - RNA, 22 nt, Human
cuggaugcuuccucucugcuag

SEQ ID NO: 500901 - RNA, 22 nt, Human
aagauuugguaucagaagaccu

SEQ ID NO: 500902 - RNA, 17 nt, Human
uccagagcacagagcuc

SEQ ID NO: 500903 - RNA, 22 nt, Human
gaccuggccugcacagcccuua

SEQ ID NO: 500904 - RNA, 22 nt, Human
ucaggggcuugaggugcauguc

SEQ ID NO: 500905 - RNA, 22 nt, Human
cagcagcuaccugcucuugugg

SEQ ID NO: 500906 - RNA, 22 nt, Human
uauaauuuaucaugucacaguu

SEQ ID NO: 500907 - RNA, 22 nt, Human
uccacagaauguaagauccaca

SEQ ID NO: 500908 - RNA, 22 nt, Human
uauauguaagcuauguaagagu

SEQ ID NO: 500909 - RNA, 22 nt, Human
cucagcccagcccaggaccagg

SEQ ID NO: 500910 - RNA, 22 nt, Human
ugcauauccacaccuuaucucu

SEQ ID NO: 500911 - RNA, 22 nt, Human
caaagaguuuuuucauauaaug

SEQ ID NO: 500912 - RNA, 20 nt, Human
aagggcagagggaacagacu

SEQ ID NO: 500913 - RNA, 22 nt, Human
gccuguuucccugacgcuuaca

SEQ ID NO: 500914 - RNA, 22 nt, Human
gccuguuuggcaucauugguug

SEQ ID NO: 500915 - RNA, 22 nt, Human
ugggagagugcucaaugugcaa

SEQ ID NO: 500916 - RNA, 22 nt, Human
cugccuggccacaacccagggu

SEQ ID NO: 500917 - RNA, 22 nt, Human
ccuggcaguggugaagaagagg

SEQ ID NO: 500918 - RNA, 20 nt, Human
agugucugggccucaggccc

SEQ ID NO: 500919 - RNA, 22 nt, Human
auuaagggccaauccuccagcc

SEQ ID NO: 500920 - RNA, 22 nt, Human
acucuguguuuugguggcagca

SEQ ID NO: 500921 - RNA, 22 nt, Human
ugcaauaaguuguguuaucacu

SEQ ID NO: 500922 - RNA, 20 nt, Human
aaagcauuuacuugugauug

SEQ ID NO: 500923 - RNA, 22 nt, Human
aaguguguugacugaauugggg

SEQ ID NO: 500924 - RNA, 22 nt, Human
cacccagccuucacacaggagu

SEQ ID NO: 500925 - RNA, 20 nt, Human
acaugaaaggaaacaggaaa

SEQ ID NO: 500926 - RNA, 22 nt, Human
gcagccagggcuaagcugggga

SEQ ID NO: 500927 - RNA, 22 nt, Human
uagaaaagaauuuuauuugaua

SEQ ID NO: 500928 - RNA, 22 nt, Human
agcaguuugaaucaauggccag

SEQ ID NO: 500929 - RNA, 22 nt, Human
ugggaagaugaggugccauggg

SEQ ID NO: 500930 - RNA, 22 nt, Human
gccuccuggaagucacauguuu

SEQ ID NO: 500931 - RNA, 22 nt, Human
aaguagacuuuugcaucaagga

SEQ ID NO: 500932 - RNA, 22 nt, Human
gcugggcuucaccuccagaguu

SEQ ID NO: 500933 - RNA, 22 nt, Human
cugcauccauguugcugcaaag

SEQ ID NO: 500934 - RNA, 22 nt, Human
uauuauuaaauggcagaauuuu

SEQ ID NO: 500935 - RNA, 22 nt, Human
ccagccaguccagcauuggugu

SEQ ID NO: 500936 - RNA, 22 nt, Human
ucugcagcgugcaggcuggugc

SEQ ID NO: 500937 - RNA, 22 nt, Human
agaccgagaaguucuccaggcc

SEQ ID NO: 500938 - RNA, 22 nt, Human
ucugggagugaagcaacagaug

SEQ ID NO: 500939 - RNA, 22 nt, Human
ccucccuuccccaguagucaag

SEQ ID NO: 500940 - RNA, 22 nt, Human
ccacagagacagagcccagggu

SEQ ID NO: 500941 - RNA, 22 nt, Human
agcaccugugcccugauggaga

SEQ ID NO: 500942 - RNA, 22 nt, Human
ucccagaggcuccagucucuau

SEQ ID NO: 500943 - RNA, 22 nt, Human
uggcuucugcuuucaguggagg

SEQ ID NO: 500944 - RNA, 22 nt, Human
ugagagugaaaugucacauguc

SEQ ID NO: 500945 - RNA, 22 nt, Human
auguaauaggguaacauaacau

SEQ ID NO: 500946 - RNA, 22 nt, Human
uggcuucauguaguuugaguug

SEQ ID NO: 500947 - RNA, 22 nt, Human
agagaguugaggaagcaacacu

SEQ ID NO: 500948 - RNA, 22 nt, Human
uagaaacauguucuguucuguu

SEQ ID NO: 500949 - RNA, 22 nt, Human
acaguacagugcagaggaagau

SEQ ID NO: 500950 - RNA, 22 nt, Human
gaagccuugaacugcaaacccc

SEQ ID NO: 500951 - RNA, 22 nt, Human
gugcuacagacugaguacacuu

SEQ ID NO: 500952 - RNA, 22 nt, Human
cuuccuggcucggugccucacc

SEQ ID NO: 500953 - RNA, 22 nt, Human
agagccaggcaggcaauguuga

SEQ ID NO: 500954 - RNA, 20 nt, Human
ugcucugucuaaaacuuccc

SEQ ID NO: 500955 - RNA, 22 nt, Human
uccugugguaugggagugaugu

SEQ ID NO: 500956 - RNA, 22 nt, Human
ugaggaaacuuacaaggcagaa

SEQ ID NO: 500957 - RNA, 22 nt, Human
caaggccaguccauuuuggaag

SEQ ID NO: 500958 - RNA, 22 nt, Human
ucacaguaucacacaaggauua

SEQ ID NO: 500959 - RNA, 22 nt, Human
ugccugggaucugugcccuuug

SEQ ID NO: 500960 - RNA, 19 nt, Human
acaggggccuuuccagggu

SEQ ID NO: 500961 - RNA, 22 nt, Human
aggcuccauuccaggagcuaga

SEQ ID NO: 500962 - RNA, 22 nt, Human
aguccaaagcagaugagggcca

SEQ ID NO: 500963 - RNA, 22 nt, Human
aguugucccggucuagccacuu

SEQ ID NO: 500964 - RNA, 22 nt, Human
cagcaggcucugaguggcugcc

SEQ ID NO: 500965 - RNA, 22 nt, Human
caguuaaacgggccaugugagu

SEQ ID NO: 500966 - RNA, 23 nt, Human
caggacaugggaggaaguauggc

SEQ ID NO: 500967 - RNA, 18 nt, Human
cugccacuuaauguggug

SEQ ID NO: 500968 - RNA, 22 nt, Human
agaggccugugugcuccagugg

SEQ ID NO: 500969 - RNA, 22 nt, Human
ccugggucuauagacuucaaga

SEQ ID NO: 500970 - RNA, 19 nt, Human
ugagcuggcugagccucuc

SEQ ID NO: 500971 - RNA, 19 nt, Human
ugaggccaaggucacagau

SEQ ID NO: 500972 - RNA, 22 nt, Human
ugagcccagagaucugagcuau

SEQ ID NO: 500973 - RNA, 22 nt, Human
uaaagguaacaugaacugcuuu

SEQ ID NO: 500974 - RNA, 23 nt, Human
cugggcugcuugagucccuggcu

SEQ ID NO: 500975 - RNA, 22 nt, Human
ucucaagcuuguugguauguuu

SEQ ID NO: 500976 - RNA, 22 nt, Human
uuucucaaaagacagaagugaa

SEQ ID NO: 500977 - RNA, 22 nt, Human
gaaggggguugcagucuagggu

SEQ ID NO: 500978 - RNA, 19 nt, Human
ucucuggcaguucagagca

SEQ ID NO: 500979 - RNA, 22 nt, Human
aacauuguuuucccuauaucca

SEQ ID NO: 500980 - RNA, 22 nt, Human
gugauauuuuuaaagauuaagg

SEQ ID NO: 500981 - RNA, 22 nt, Human
ccuggcacugaccaggcacuga

SEQ ID NO: 500982 - RNA, 22 nt, Human
ccagggccaagagaccucgagg

SEQ ID NO: 500983 - RNA, 22 nt, Human
cuggggcuucaaugcuucggug

SEQ ID NO: 500984 - RNA, 22 nt, Human
caagggcucuuuugaggaaugu

SEQ ID NO: 500985 - RNA, 22 nt, Human
acagcuuuuaugggaccagcca

SEQ ID NO: 500986 - RNA, 22 nt, Human
guuguauagagggcaugaaucu

SEQ ID NO: 500987 - RNA, 22 nt, Human
uugauacaggccuucuagauga

SEQ ID NO: 500988 - RNA, 22 nt, Human
aaaaucuaaguagcgaguaagg

SEQ ID NO: 500989 - RNA, 22 nt, Human
guggagcaggacuagcugagaa

SEQ ID NO: 500990 - RNA, 19 nt, Human
gcuuccagcacugcaggag

SEQ ID NO: 500991 - RNA, 22 nt, Human
agcaggaguuugaugcuuuuau

SEQ ID NO: 500992 - RNA, 22 nt, Human
agguccaguuuucugacaaggg

SEQ ID NO: 500993 - RNA, 22 nt, Human
ccuggagcccaaggcagugaga

SEQ ID NO: 500994 - RNA, 22 nt, Human
cuccugugguacucccagggcc

SEQ ID NO: 500995 - RNA, 21 nt, Human
agggagcuauuuauaguaagc

SEQ ID NO: 500996 - RNA, 22 nt, Human
cgguccaggauggcuggcaagc

SEQ ID NO: 500997 - RNA, 21 nt, Human
agcagccauuucacagagacu

SEQ ID NO: 500998 - RNA, 22 nt, Human
aggaagcccuugucauuucugu

SEQ ID NO: 500999 - RNA, 22 nt, Human
auuaguguucuuaucuucuagg

SEQ ID NO: 501000 - RNA, 17 nt, Human
ucucagugacugauagc

SEQ ID NO: 501001 - RNA, 22 nt, Human
agcugcucuuugaaggacacuu

SEQ ID NO: 501002 - RNA, 22 nt, Human
guuuccugugggaacucggcug

SEQ ID NO: 501003 - RNA, 22 nt, Human
uccugccaggagugcuggcccu

SEQ ID NO: 501004 - RNA, 22 nt, Human
uggaucugguucccugagccuu

SEQ ID NO: 501005 - RNA, 22 nt, Human
cauagaaacuugcagcaagcac

SEQ ID NO: 501006 - RNA, 22 nt, Human
gacacagaaugggugcucagua

SEQ ID NO: 501007 - RNA, 23 nt, Human
agaaaaguucauaccuuuuuaac

SEQ ID NO: 501008 - RNA, 22 nt, Human
ccccagcccacaagcauauuaa

SEQ ID NO: 501009 - RNA, 22 nt, Human
gccaaugacagucucaguucug

SEQ ID NO: 501010 - RNA, 22 nt, Human
uguuccuaaauaugaauggaga

SEQ ID NO: 501011 - RNA, 21 nt, Human
ucucuggaguuagcagagaga

SEQ ID NO: 501012 - RNA, 22 nt, Human
agcaggcuugguccccagccuc

SEQ ID NO: 501013 - RNA, 22 nt, Human
ugcagggaauccagucuagggu

SEQ ID NO: 501014 - RNA, 22 nt, Human
augcaagucuuaauaguuuagg

SEQ ID NO: 501015 - RNA, 18 nt, Human
aaggcuucaaagaguaga

SEQ ID NO: 501016 - RNA, 22 nt, Human
caacagcuuuagaaacacuuuc

SEQ ID NO: 501017 - RNA, 22 nt, Human
caucagagucagagcucuuucu

SEQ ID NO: 501018 - RNA, 22 nt, Human
auguaaggcugccuaugacacu

SEQ ID NO: 501019 - RNA, 20 nt, Human
uugcauuggaugugcaggug

SEQ ID NO: 501020 - RNA, 22 nt, Human
guggccagcaagugcugccucu

SEQ ID NO: 501021 - RNA, 17 nt, Human
cagugaucauuacauua

SEQ ID NO: 501022 - RNA, 22 nt, Human
ucucugcucugugccucaguuu

SEQ ID NO: 501023 - RNA, 22 nt, Human
gcucaggacccaggugugaccu

SEQ ID NO: 501024 - RNA, 22 nt, Human
uuuaagaaguuauguuauaaau

SEQ ID NO: 501025 - RNA, 22 nt, Human
gcugagcuagcuaucucagucu

SEQ ID NO: 501026 - RNA, 19 nt, Human
ugaggggcucacagucuca

SEQ ID NO: 501027 - RNA, 22 nt, Human
ugccacacucacuucuguggac

SEQ ID NO: 501028 - RNA, 22 nt, Human
cugcagagaauuguggggcuuc

SEQ ID NO: 501029 - RNA, 23 nt, Human
ucauggaacugggcaaucuugaa

SEQ ID NO: 501030 - RNA, 22 nt, Human
aagcccagaugggagcauuuca

SEQ ID NO: 501031 - RNA, 22 nt, Human
ugccuuggugcuucuucaugug

SEQ ID NO: 501032 - RNA, 22 nt, Human
ccccagcucagugcagggacau

SEQ ID NO: 501033 - RNA, 22 nt, Human
cacaaaaguaggaggcaggcgg

SEQ ID NO: 501034 - RNA, 22 nt, Human
cugaggagcccccucucagcau

SEQ ID NO: 501035 - RNA, 22 nt, Human
cuggagccaugucuugacugcu

SEQ ID NO: 501036 - RNA, 22 nt, Human
aacaaagcaccacugagucagu

SEQ ID NO: 501037 - RNA, 22 nt, Human
uaaaguucuggugagagguaag

SEQ ID NO: 501038 - RNA, 17 nt, Human
uucaagauauugaaaug

SEQ ID NO: 501039 - RNA, 22 nt, Human
ugggagucagucguucucagag

SEQ ID NO: 501040 - RNA, 21 nt, Human
uggccucccacacuuccaugg

SEQ ID NO: 501041 - RNA, 22 nt, Human
gcagagccgugaauggauuuca

SEQ ID NO: 501042 - RNA, 22 nt, Human
ucugccuuuucacugccacuaa

SEQ ID NO: 501043 - RNA, 22 nt, Human
ugggccaguuucucauugaaau

SEQ ID NO: 501044 - RNA, 22 nt, Human
cugccaucugagccaaaagugc

SEQ ID NO: 501045 - RNA, 22 nt, Human
aucugggccaauccuaguacca

SEQ ID NO: 501046 - RNA, 22 nt, Human
cauucacucagcgaugccagua

SEQ ID NO: 501047 - RNA, 22 nt, Human
ggugacuggagggacccaggcc

SEQ ID NO: 501048 - RNA, 22 nt, Human
ucaaaggauaacugagggcagu

SEQ ID NO: 501049 - RNA, 23 nt, Human
uuguaaaacagugugacgguucc

SEQ ID NO: 501050 - RNA, 22 nt, Human
cauaacauguacauauaaaugc

SEQ ID NO: 501051 - RNA, 22 nt, Human
agauuuagugguggaauuuugg

SEQ ID NO: 501052 - RNA, 22 nt, Human
uuguauuucgaugcacguguag

SEQ ID NO: 501053 - RNA, 22 nt, Human
ucauuuguucucauucucuacu

SEQ ID NO: 501054 - RNA, 22 nt, Human
gacuguacgucauugaaggcca

SEQ ID NO: 501055 - RNA, 22 nt, Human
cugccacucugggugggccugg

SEQ ID NO: 501056 - RNA, 22 nt, Human
gugcagagaaaugagaagucga

SEQ ID NO: 501057 - RNA, 22 nt, Human
uuaaagcaguuuguauacaugg

SEQ ID NO: 501058 - RNA, 22 nt, Human
guggcugcuguccucucugguu

SEQ ID NO: 501059 - RNA, 22 nt, Human
agggcgacaauggagagcguuu

SEQ ID NO: 501060 - RNA, 22 nt, Human
cuuccuucugaagcauagaagc

SEQ ID NO: 501061 - RNA, 22 nt, Human
agcuguguguuuccacugagcu

SEQ ID NO: 501062 - RNA, 22 nt, Human
aauuagaaucuuauuuggggaa

SEQ ID NO: 501063 - RNA, 22 nt, Human
ucugccagcccugugagucuug

SEQ ID NO: 501064 - RNA, 22 nt, Human
uuauuauagauuaugcaagauu

SEQ ID NO: 501065 - RNA, 22 nt, Human
uugaagguaaauuauauugauc

SEQ ID NO: 501066 - RNA, 22 nt, Human
uuaacagacauauauauuugua

SEQ ID NO: 501067 - RNA, 22 nt, Human
aguccuggugacacuccucuuc

SEQ ID NO: 501068 - RNA, 22 nt, Human
uugaaucauuacaauagauaag

SEQ ID NO: 501069 - RNA, 22 nt, Human
caaugaaagcaacugccuauaa

SEQ ID NO: 501070 - RNA, 22 nt, Human
ucagggugaaccaggcaggaau

SEQ ID NO: 501071 - RNA, 22 nt, Human
cuguuauuucugccaggugagu

SEQ ID NO: 501072 - RNA, 22 nt, Human
uaaugaauaaacuugagaguca

SEQ ID NO: 501073 - RNA, 22 nt, Human
cuaugaaaugucagauucugca

SEQ ID NO: 501074 - RNA, 18 nt, Human
gggcaagcggcugucacc

SEQ ID NO: 501075 - RNA, 19 nt, Human
uccuccuuacuuccucuug

SEQ ID NO: 501076 - RNA, 22 nt, Human
uacagcuuauccagcuugauag

SEQ ID NO: 501077 - RNA, 22 nt, Human
gccuguuucuaaucucauuucu

SEQ ID NO: 501078 - RNA, 22 nt, Human
ucacauuuuccuugguaucugu

SEQ ID NO: 501079 - RNA, 22 nt, Human
cagaccucaguccucaguagga

SEQ ID NO: 501080 - RNA, 22 nt, Human
ccagcuuucucagaggcuucua

SEQ ID NO: 501081 - RNA, 22 nt, Human
auuuucuagauagaugaugcau

SEQ ID NO: 501082 - RNA, 22 nt, Human
aggagggcuaggaaaaccagga

SEQ ID NO: 501083 - RNA, 22 nt, Human
ugauuucaaguagugacaugcu

SEQ ID NO: 501084 - RNA, 22 nt, Human
uggcagcagggccccuggagga

SEQ ID NO: 501085 - RNA, 22 nt, Human
augacagaaggccucccugaca

SEQ ID NO: 501086 - RNA, 22 nt, Human
ugcugccugguuucuucuugcu

SEQ ID NO: 501087 - RNA, 22 nt, Human
ugucaaauuuuuauugcaguau

SEQ ID NO: 501088 - RNA, 22 nt, Human
cagggcucgcugccagcuucag

SEQ ID NO: 501089 - RNA, 22 nt, Human
caggucuuuucuacugguggag

SEQ ID NO: 501090 - RNA, 22 nt, Human
gggagggaaggaccuuaugaau

SEQ ID NO: 501091 - RNA, 22 nt, Human
agcucagaacugcagacaugug

SEQ ID NO: 501092 - RNA, 19 nt, Human
ucugcuggcagaauucccu

SEQ ID NO: 501093 - RNA, 22 nt, Human
aggacacacagaauacaaaucc

SEQ ID NO: 501094 - RNA, 23 nt, Human
ucagaaugcacugaauuuacccu

SEQ ID NO: 501095 - RNA, 22 nt, Human
caguacuuugcaucauuccacu

SEQ ID NO: 501096 - RNA, 22 nt, Human
acugaggacagugaggagggcu

SEQ ID NO: 501097 - RNA, 21 nt, Human
uuucuaaguaacuggcagcau

SEQ ID NO: 501098 - RNA, 22 nt, Human
aaaaaugcuuggacuuaauaaa

SEQ ID NO: 501099 - RNA, 22 nt, Human
cugcagccucaaccuccugagc

SEQ ID NO: 501100 - RNA, 22 nt, Human
uuuuccuacugauaaacaguua

SEQ ID NO: 501101 - RNA, 22 nt, Human
agugucuuugacacauucaaag

SEQ ID NO: 501102 - RNA, 22 nt, Human
uaacagaauagcagaaacagaa

SEQ ID NO: 501103 - RNA, 22 nt, Human
gggaaccagccgcuuccgccuc

SEQ ID NO: 501104 - RNA, 22 nt, Human
gacagggccgcagauggagacu

SEQ ID NO: 501105 - RNA, 22 nt, Human
ugaugcaguguccucccaugca

SEQ ID NO: 501106 - RNA, 22 nt, Human
gaacagcucugaagcaguaaau

SEQ ID NO: 501107 - RNA, 20 nt, Human
uuugcuaugcauaucugacc

SEQ ID NO: 501108 - RNA, 22 nt, Human
uucucugggacaggaacaguuu

SEQ ID NO: 501109 - RNA, 22 nt, Human
ucugcagcuugcacaggcaggc

SEQ ID NO: 501110 - RNA, 22 nt, Human
aggaggguggggucugccuguc

SEQ ID NO: 501111 - RNA, 22 nt, Human
aggagcugaagucucugcacuc

SEQ ID NO: 501112 - RNA, 23 nt, Human
ugucuggggcgccagaagagaga

SEQ ID NO: 501113 - RNA, 22 nt, Human
auuuagaaauuccaaaaguauu

SEQ ID NO: 501114 - RNA, 22 nt, Human
gacaggcuuccuaagugccaga

SEQ ID NO: 501115 - RNA, 22 nt, Human
ucuuugcaaauguuauuaucuu

SEQ ID NO: 501116 - RNA, 22 nt, Human
aggcacaggaaugucauccagu

SEQ ID NO: 501117 - RNA, 22 nt, Human
gaauuucuggacccuuugagaa

SEQ ID NO: 501118 - RNA, 22 nt, Human
uauuuguauuucaugcaguaaa

SEQ ID NO: 501119 - RNA, 19 nt, Human
gaguuauugccagggcaug

SEQ ID NO: 501120 - RNA, 22 nt, Human
ucaaaggaaacacaagcuucug

SEQ ID NO: 501121 - RNA, 22 nt, Human
ugagaaaugggucugcugaaga

SEQ ID NO: 501122 - RNA, 22 nt, Human
ggaaggguucaggugggccugc

SEQ ID NO: 501123 - RNA, 22 nt, Human
ugcagaagacacaagguaacgu

SEQ ID NO: 501124 - RNA, 22 nt, Human
ggcagaggaaggaugaauucac

SEQ ID NO: 501125 - RNA, 22 nt, Human
aagggcagcuuaaauugguagc

SEQ ID NO: 501126 - RNA, 22 nt, Human
ugcucugguaacucacuuccau

SEQ ID NO: 501127 - RNA, 22 nt, Human
agccagggcugcagguuccuug

SEQ ID NO: 501128 - RNA, 22 nt, Human
guggggaggccuaagcaaguug

SEQ ID NO: 501129 - RNA, 22 nt, Human
ucuuauuauuguuguaaaagca

SEQ ID NO: 501130 - RNA, 22 nt, Human
ugaaugauuucuuaggcaauug

SEQ ID NO: 501131 - RNA, 22 nt, Human
uaacaguauagccuaacauuuc

SEQ ID NO: 501132 - RNA, 22 nt, Human
ucagcuuugccaccagcuguaa

SEQ ID NO: 501133 - RNA, 22 nt, Human
cagcccucagguccucagcagc

SEQ ID NO: 501134 - RNA, 22 nt, Human
aaacagaaauuuccucaugcuc

SEQ ID NO: 501135 - RNA, 22 nt, Human
cagcugcccaggccaccuggag

SEQ ID NO: 501136 - RNA, 22 nt, Human
ccccugcuggccugcugguuuc

SEQ ID NO: 501137 - RNA, 21 nt, Human
gagauuuagaaggaucaauuu

SEQ ID NO: 501138 - RNA, 22 nt, Human
agaugcagauuuggauucagga

SEQ ID NO: 501139 - RNA, 22 nt, Human
augacagaggagugcaggugau

SEQ ID NO: 501140 - RNA, 22 nt, Human
aaaggucuugucuugacagagu

SEQ ID NO: 501141 - RNA, 22 nt, Human
gccagcugcuucuccagaauuu

SEQ ID NO: 501142 - RNA, 22 nt, Human
uauuagcuucugguuuuguucu

SEQ ID NO: 501143 - RNA, 22 nt, Human
cucacuggcaagacuacaggug

SEQ ID NO: 501144 - RNA, 22 nt, Human
ugcaggcuguaaucugaggcua

SEQ ID NO: 501145 - RNA, 22 nt, Human
cucagcaguauacucugaagau

SEQ ID NO: 501146 - RNA, 22 nt, Human
augggcugggaauacacagggg

SEQ ID NO: 501147 - RNA, 22 nt, Human
cacaggaaagucagccagaaga

SEQ ID NO: 501148 - RNA, 19 nt, Human
gagaggccugugcuugaag

SEQ ID NO: 501149 - RNA, 22 nt, Human
gggcagguauuuaucuucuauu

SEQ ID NO: 501150 - RNA, 22 nt, Human
ggcaguuuggcaggauggaggg

SEQ ID NO: 501151 - RNA, 22 nt, Human
cugauauucuauuuugcuugcu

SEQ ID NO: 501152 - RNA, 22 nt, Human
uuccuuugggaaaucacuaagg

SEQ ID NO: 501153 - RNA, 22 nt, Human
ugaagccaaucugccaggcaga

SEQ ID NO: 501154 - RNA, 16 nt, Human
gaaggagauucagaaa

SEQ ID NO: 501155 - RNA, 22 nt, Human
acauuucuaguuguucaucucc

SEQ ID NO: 501156 - RNA, 22 nt, Human
cugugccuaagaugcaugucuc

SEQ ID NO: 501157 - RNA, 22 nt, Human
agggaaauuaaugugagcaaug

SEQ ID NO: 501158 - RNA, 22 nt, Human
cagugagagagaacgcauucau

SEQ ID NO: 501159 - RNA, 23 nt, Human
uuucacaaugagcauuacagaau

SEQ ID NO: 501160 - RNA, 22 nt, Human
agcagcugauggggaaggaguu

SEQ ID NO: 501161 - RNA, 22 nt, Human
uuuucuuaggugcuccaaguag

SEQ ID NO: 501162 - RNA, 22 nt, Human
caggcuugauuauucagacaau

SEQ ID NO: 501163 - RNA, 22 nt, Human
ggcagcuggccuccucgcccac

SEQ ID NO: 501164 - RNA, 22 nt, Human
aggagcugucagagugccagag

SEQ ID NO: 501165 - RNA, 22 nt, Human
uacagccucgaacuccugcauu

SEQ ID NO: 501166 - RNA, 22 nt, Human
gugcucaggaagcuguuccugc

SEQ ID NO: 501167 - RNA, 22 nt, Human
agugaaaucagguuuugacugc

SEQ ID NO: 501168 - RNA, 22 nt, Human
uuucacaaugcaauccuacuuc

SEQ ID NO: 501169 - RNA, 17 nt, Human
uagagcugguucaggag

SEQ ID NO: 501170 - RNA, 22 nt, Human
gagccuggccuccugccucagc

SEQ ID NO: 501171 - RNA, 22 nt, Human
auccacagucuuagccaucaaa

SEQ ID NO: 501172 - RNA, 22 nt, Human
guugggaagcagauggaugagc

SEQ ID NO: 501173 - RNA, 22 nt, Human
aaagcaguauauugguaguugu

SEQ ID NO: 501174 - RNA, 22 nt, Human
accuucugaccaguuaucuuga

SEQ ID NO: 501175 - RNA, 22 nt, Human
uguaauggaagugggauugcau

SEQ ID NO: 501176 - RNA, 22 nt, Human
cagagccuaaaacgacuccacu

SEQ ID NO: 501177 - RNA, 22 nt, Human
agguuucuaugcuguuuaucuu

SEQ ID NO: 501178 - RNA, 20 nt, Human
auuccauaguuggcacuuuu

SEQ ID NO: 501179 - RNA, 22 nt, Human
gucuccugagccuugacugcaa

SEQ ID NO: 501180 - RNA, 22 nt, Human
uuccaggacucguucuggcuca

SEQ ID NO: 501181 - RNA, 22 nt, Human
gcagggaccucacuacccccag

SEQ ID NO: 501182 - RNA, 22 nt, Human
caagaauuguacaaacugggug

SEQ ID NO: 501183 - RNA, 22 nt, Human
ucaggcugaggucaucugcauc

SEQ ID NO: 501184 - RNA, 17 nt, Human
ugggccaguagaaggga

SEQ ID NO: 501185 - RNA, 22 nt, Human
uuagaaaugauuucaccucuuu

SEQ ID NO: 501186 - RNA, 22 nt, Human
aaaggcaggacugcagcauagg

SEQ ID NO: 501187 - RNA, 22 nt, Human
auccugggcaagucaauguccc

SEQ ID NO: 501188 - RNA, 23 nt, Human
agggcccaagccuggacagcagg

SEQ ID NO: 501189 - RNA, 22 nt, Human
ucucuggagcugcagauccagg

SEQ ID NO: 501190 - RNA, 20 nt, Human
uccaauuuaagaauuuagag

SEQ ID NO: 501191 - RNA, 22 nt, Human
uuugaaagagcugauacaugaa

SEQ ID NO: 501192 - RNA, 22 nt, Human
ucccugggacucagacauggaa

SEQ ID NO: 501193 - RNA, 22 nt, Human
agggaccucuucuugcagcuga

SEQ ID NO: 501194 - RNA, 22 nt, Human
caggcacuagcagaaugaggcu

SEQ ID NO: 501195 - RNA, 22 nt, Human
caugauauaaaguaguagauaa

SEQ ID NO: 501196 - RNA, 23 nt, Human
aucaaaguggaaaucaauuaucu

SEQ ID NO: 501197 - RNA, 17 nt, Human
ccagguggaaucgugga

SEQ ID NO: 501198 - RNA, 22 nt, Human
cuucucccuggcuucugcacac

SEQ ID NO: 501199 - RNA, 22 nt, Human
ugauuuccaaaaggcuucuaag

SEQ ID NO: 501200 - RNA, 23 nt, Human
uuguauuuuuaguagagacaggg

SEQ ID NO: 501201 - RNA, 22 nt, Human
ggcagguggaaguuggcagagc

SEQ ID NO: 501202 - RNA, 20 nt, Human
aagggagaauaaugauugua

SEQ ID NO: 501203 - RNA, 22 nt, Human
ugaaugaucuccgauuaguccu

SEQ ID NO: 501204 - RNA, 22 nt, Human
ugaauuuaccuugccuauauuu

SEQ ID NO: 501205 - RNA, 22 nt, Human
aauuugauucagcaaauguuca

SEQ ID NO: 501206 - RNA, 22 nt, Human
aaaguucagauuagacucaaga

SEQ ID NO: 501207 - RNA, 22 nt, Human
auucaagguuuauucaguuuag

SEQ ID NO: 501208 - RNA, 22 nt, Human
cagcagcugacuccaagagagc

SEQ ID NO: 501209 - RNA, 22 nt, Human
gcagaaguaggcucuguguagg

SEQ ID NO: 501210 - RNA, 20 nt, Human
uaugaagauaugugaacagc

SEQ ID NO: 501211 - RNA, 22 nt, Human
ccauuuguucgcccagcuccaa

SEQ ID NO: 501212 - RNA, 22 nt, Human
uucauguuuuauucaguaauua

SEQ ID NO: 501213 - RNA, 22 nt, Human
aaggccacacuugcuggccagc

SEQ ID NO: 501214 - RNA, 22 nt, Human
agcagggguaacagaaggaaag

SEQ ID NO: 501215 - RNA, 22 nt, Human
ucucagucuuuuugguuacuca

SEQ ID NO: 501216 - RNA, 22 nt, Human
ugcugaaugaauggaugguugc

SEQ ID NO: 501217 - RNA, 22 nt, Human
gaacagcuauaaucaucugucc

SEQ ID NO: 501218 - RNA, 22 nt, Human
agagguggccaugggcgcugga

SEQ ID NO: 501219 - RNA, 22 nt, Human
ucuguuccaguagaaaggugca

SEQ ID NO: 501220 - RNA, 22 nt, Human
gagcagcuuaugucaagccaga

SEQ ID NO: 501221 - RNA, 22 nt, Human
ggagccaguuuagaccucaguu

SEQ ID NO: 501222 - RNA, 22 nt, Human
gcucagugcaucauuccaggcu

SEQ ID NO: 501223 - RNA, 22 nt, Human
acacagcuagugaguggcagag

SEQ ID NO: 501224 - RNA, 22 nt, Human
aggcucugacccaugggaccca

SEQ ID NO: 501225 - RNA, 22 nt, Human
agccucugucaagcuuuucaaa

SEQ ID NO: 501226 - RNA, 22 nt, Human
ccaaagcaagucacaugaucaa

SEQ ID NO: 501227 - RNA, 22 nt, Human
cccugccuuguuggagccuaug

SEQ ID NO: 501228 - RNA, 22 nt, Human
gucuggagccacccuaagcauu

SEQ ID NO: 501229 - RNA, 22 nt, Human
uucaggaaauuggaguccuucu

SEQ ID NO: 501230 - RNA, 21 nt, Human
acuuugggcacuuuccugccc

SEQ ID NO: 501231 - RNA, 22 nt, Human
ugaaccagagucuccagugguu

SEQ ID NO: 501232 - RNA, 21 nt, Human
cucaggaucuuauauauuagu

SEQ ID NO: 501233 - RNA, 22 nt, Human
gcggagggcgagcccgcggagc

SEQ ID NO: 501234 - RNA, 22 nt, Human
ggccuuggugcucuguguugca

SEQ ID NO: 501235 - RNA, 22 nt, Human
uggcucagaugcucuuccagug

SEQ ID NO: 501236 - RNA, 22 nt, Human
guguccugcaggccaggaaugg

SEQ ID NO: 501237 - RNA, 22 nt, Human
aucaggauccaccuugagccug

SEQ ID NO: 501238 - RNA, 22 nt, Human
cuuacauuuaaucaugugucau

SEQ ID NO: 501239 - RNA, 22 nt, Human
cuguccagucuuuagcaagcug

SEQ ID NO: 501240 - RNA, 22 nt, Human
uguggagacuauagccauaaca

SEQ ID NO: 501241 - RNA, 22 nt, Human
cagcuguucuugggacagacag

SEQ ID NO: 501242 - RNA, 22 nt, Human
ucucagagauucagggagaagu

SEQ ID NO: 501243 - RNA, 20 nt, Human
auacacauauucuugcaacu

SEQ ID NO: 501244 - RNA, 18 nt, Human
ugaccugcgcuucacggu

SEQ ID NO: 501245 - RNA, 22 nt, Human
guggggacgggauggcucacug

SEQ ID NO: 501246 - RNA, 22 nt, Human
uggaggagggcuggugucugua

SEQ ID NO: 501247 - RNA, 22 nt, Human
agcucuggaacucccggcugcu

SEQ ID NO: 501248 - RNA, 22 nt, Human
auguggcucagcaggcucccgu

SEQ ID NO: 501249 - RNA, 22 nt, Human
cugaaggauguguggugggagu

SEQ ID NO: 501250 - RNA, 22 nt, Human
aguaacaaagugggagaaugau

SEQ ID NO: 501251 - RNA, 22 nt, Human
caucuugaagguuucuuuagcu

SEQ ID NO: 501252 - RNA, 22 nt, Human
cagagcuggagcuugaauggag

SEQ ID NO: 501253 - RNA, 21 nt, Human
ucgugcagcagcugaggcuug

SEQ ID NO: 501254 - RNA, 22 nt, Human
ggcaggcugggagucaucagag

SEQ ID NO: 501255 - RNA, 22 nt, Human
gcuaggaaucggacccaggaag

SEQ ID NO: 501256 - RNA, 22 nt, Human
ccagggcugagcugugaccaug

SEQ ID NO: 501257 - RNA, 22 nt, Human
ucuucauuuuauagcaucugug

SEQ ID NO: 501258 - RNA, 20 nt, Human
auguccuguugcugccccag

SEQ ID NO: 501259 - RNA, 22 nt, Human
gaaguccuccuaucuugcucuu

SEQ ID NO: 501260 - RNA, 22 nt, Human
ucucucuacuggggcacuagga

SEQ ID NO: 501261 - RNA, 21 nt, Human
uuuagggaccaggucauaggc

SEQ ID NO: 501262 - RNA, 22 nt, Human
aaagcccauguggaaguacagg

SEQ ID NO: 501263 - RNA, 22 nt, Human
uuaugaaguuccuguuacagug

SEQ ID NO: 501264 - RNA, 22 nt, Human
guauuugauagauuucaaagga

SEQ ID NO: 501265 - RNA, 22 nt, Human
uagcuaucuguguccagaucca

SEQ ID NO: 501266 - RNA, 22 nt, Human
gggccggagcugggucccgcgc

SEQ ID NO: 501267 - RNA, 22 nt, Human
cugccuggguucaaguccuguu

SEQ ID NO: 501268 - RNA, 22 nt, Human
ucuguucacugagcaauggcaa

SEQ ID NO: 501269 - RNA, 22 nt, Human
ucagcacugucuauuagugaga

SEQ ID NO: 501270 - RNA, 22 nt, Human
ggagcagccacgucucagggca

SEQ ID NO: 501271 - RNA, 22 nt, Human
ucucagcaaggaaagaggcagg

SEQ ID NO: 501272 - RNA, 22 nt, Human
ucauaaaugcagugucauaaau

SEQ ID NO: 501273 - RNA, 22 nt, Human
gcugucugucucugucccacca

SEQ ID NO: 501274 - RNA, 22 nt, Human
uggaugcuguaggacacgcucu

SEQ ID NO: 501275 - RNA, 22 nt, Human
ucugggccugauggcuaaagcc

SEQ ID NO: 501276 - RNA, 22 nt, Human
gugucaugggagucagaaguga

SEQ ID NO: 501277 - RNA, 22 nt, Human
ggcugcuguacugaugucaguu

SEQ ID NO: 501278 - RNA, 23 nt, Human
gcucuggcagcuugugucagcac

SEQ ID NO: 501279 - RNA, 22 nt, Human
cucucuggcccauccuguugcc

SEQ ID NO: 501280 - RNA, 22 nt, Human
cucuuucaguucugauagucuc

SEQ ID NO: 501281 - RNA, 22 nt, Human
augcagcaguuuacaaagcaau

SEQ ID NO: 501282 - RNA, 22 nt, Human
uuccauaaucaccuuauucuuu

SEQ ID NO: 501283 - RNA, 22 nt, Human
ugcuucuggguaggccucagga

SEQ ID NO: 501284 - RNA, 22 nt, Human
gcaguaagaaagucaagcaguu

SEQ ID NO: 501285 - RNA, 21 nt, Human
uuuauuaacaacuguggacgu

SEQ ID NO: 501286 - RNA, 22 nt, Human
caggcuugggagcagagccacu

SEQ ID NO: 501287 - RNA, 22 nt, Human
gccaggguucgaauccguaugg

SEQ ID NO: 501288 - RNA, 22 nt, Human
augcaguaaauguuaagaaaaa

SEQ ID NO: 501289 - RNA, 22 nt, Human
gguaacuugaguguguuguuca

SEQ ID NO: 501290 - RNA, 22 nt, Human
gcagguggcagaggugggaucu

SEQ ID NO: 501291 - RNA, 20 nt, Human
gggaguggugguagccugug

SEQ ID NO: 501292 - RNA, 22 nt, Human
uugccaggagacaucuggagcc

SEQ ID NO: 501293 - RNA, 22 nt, Human
cuucuauucacuggucacaguu

SEQ ID NO: 501294 - RNA, 22 nt, Human
ccagugcaccauuucccucugu

SEQ ID NO: 501295 - RNA, 22 nt, Human
caggcacucauucagagaggug

SEQ ID NO: 501296 - RNA, 22 nt, Human
ccagggagccuggugugucagc

SEQ ID NO: 501297 - RNA, 22 nt, Human
agcuucuugaccaagccuguaa

SEQ ID NO: 501298 - RNA, 22 nt, Human
ucagcugccucucccuggaaga

SEQ ID NO: 501299 - RNA, 22 nt, Human
augcaaaugucaccacuucuaa

SEQ ID NO: 501300 - RNA, 22 nt, Human
guuuguugauaugccccuuugu

SEQ ID NO: 501301 - RNA, 22 nt, Human
ccccaggacacauggaccaagu

SEQ ID NO: 501302 - RNA, 22 nt, Human
gagcugccagacaugggaauga

SEQ ID NO: 501303 - RNA, 22 nt, Human
cuggaggggcuggcaugguagc

SEQ ID NO: 501304 - RNA, 18 nt, Human
ucucugaauauuuuaugu

SEQ ID NO: 501305 - RNA, 22 nt, Human
uucugggcaguuggaaauuuca

SEQ ID NO: 501306 - RNA, 22 nt, Human
ugacugugccuguugaaugaau

SEQ ID NO: 501307 - RNA, 22 nt, Human
caggccugguugagcccugaga

SEQ ID NO: 501308 - RNA, 18 nt, Human
cagagcagagguggagcg

SEQ ID NO: 501309 - RNA, 22 nt, Human
cauucaaaagcuccauguuugu

SEQ ID NO: 501310 - RNA, 22 nt, Human
cacagugugacugaccuucagc

SEQ ID NO: 501311 - RNA, 22 nt, Human
cugccugcaugcugccauagcu

SEQ ID NO: 501312 - RNA, 22 nt, Human
ugcauuaagugucugcauaugg

SEQ ID NO: 501313 - RNA, 22 nt, Human
gccaggggugcccacccaagga

SEQ ID NO: 501314 - RNA, 22 nt, Human
caccuaggguuucgccuuucuu

SEQ ID NO: 501315 - RNA, 22 nt, Human
uuucacaggggcaaccuccaug

SEQ ID NO: 501316 - RNA, 22 nt, Human
gcuucaugaaaaucacugguca

SEQ ID NO: 501317 - RNA, 22 nt, Human
ggagcugggaauuggaucaucu

SEQ ID NO: 501318 - RNA, 21 nt, Human
ccaggcagagcugugaguucu

SEQ ID NO: 501319 - RNA, 22 nt, Human
cguggcuggggcgacuccacgg

SEQ ID NO: 501320 - RNA, 23 nt, Human
cagaagcaccuguugacugcugc

SEQ ID NO: 501321 - RNA, 22 nt, Human
uuuggaauggaauagagauugc

SEQ ID NO: 501322 - RNA, 22 nt, Human
ugaagcaguuacuggguguuaa

SEQ ID NO: 501323 - RNA, 22 nt, Human
ugcuuuauuggaaccucauccu

SEQ ID NO: 501324 - RNA, 22 nt, Human
aggcacaguggcucacaccugu

SEQ ID NO: 501325 - RNA, 19 nt, Human
uggcucuuuuuaugacauu

SEQ ID NO: 501326 - RNA, 22 nt, Human
cauguuaauaugcauugaguac

SEQ ID NO: 501327 - RNA, 22 nt, Human
ucuuuauuuaagucuguuguaa

SEQ ID NO: 501328 - RNA, 22 nt, Human
acauguguauagccuguauaga

SEQ ID NO: 501329 - RNA, 20 nt, Human
gaggaaaagcugccaggccu

SEQ ID NO: 501330 - RNA, 22 nt, Human
caggggaagaugccaagggaga

SEQ ID NO: 501331 - RNA, 22 nt, Human
ugggcugccagcucuccagaug

SEQ ID NO: 501332 - RNA, 22 nt, Human
gugcauugcgaugcagacgacc

SEQ ID NO: 501333 - RNA, 21 nt, Human
aaggcagaagcauggaaugag

SEQ ID NO: 501334 - RNA, 22 nt, Human
caaaccuugcagaacugggcag

SEQ ID NO: 501335 - RNA, 22 nt, Human
cagcucugacacaguacaaaau

SEQ ID NO: 501336 - RNA, 22 nt, Human
auggaucuaccuucaggcucug

SEQ ID NO: 501337 - RNA, 22 nt, Human
gcauacagagaggauguggcau

SEQ ID NO: 501338 - RNA, 21 nt, Human
cccaccccauaaggcagaacc

SEQ ID NO: 501339 - RNA, 22 nt, Human
uguccuggaucaugccucugaa

SEQ ID NO: 501340 - RNA, 22 nt, Human
gcuggccugcugggcaccaccg

SEQ ID NO: 501341 - RNA, 20 nt, Human
ugccuuggagcagccaaggu

SEQ ID NO: 501342 - RNA, 22 nt, Human
aggaccagccuccaggucucuu

SEQ ID NO: 501343 - RNA, 22 nt, Human
agaaguuugguccuauaaacuc

SEQ ID NO: 501344 - RNA, 22 nt, Human
augcagcuucaggauuaugaug

SEQ ID NO: 501345 - RNA, 22 nt, Human
ggagucugucaccuguuucucu

SEQ ID NO: 501346 - RNA, 22 nt, Human
auagcaaagccuggcacaauga

SEQ ID NO: 501347 - RNA, 22 nt, Human
gucaacuuaucucuuuaucugu

SEQ ID NO: 501348 - RNA, 22 nt, Human
ugcugccauggucgcugguguc

SEQ ID NO: 501349 - RNA, 22 nt, Human
auguguuuguaccuuuaaauau

SEQ ID NO: 501350 - RNA, 22 nt, Human
cugggccucauccucagaguuu

SEQ ID NO: 501351 - RNA, 22 nt, Human
ccaggcucugacauagauggga

SEQ ID NO: 501352 - RNA, 22 nt, Human
gggccucucccuucucacgcau

SEQ ID NO: 501353 - RNA, 22 nt, Human
acacuaauuaagcugcuuuacu

SEQ ID NO: 501354 - RNA, 22 nt, Human
cucugagcuccuggaagcgugc

SEQ ID NO: 501355 - RNA, 22 nt, Human
caggaaugacugcagauggggc

SEQ ID NO: 501356 - RNA, 22 nt, Human
agcuuccuguugagagagggag

SEQ ID NO: 501357 - RNA, 22 nt, Human
cacauaaucaccaaguccuuuc

SEQ ID NO: 501358 - RNA, 22 nt, Human
aguguacaaaaugauagauaaa

SEQ ID NO: 501359 - RNA, 23 nt, Human
agcacagacuagaaaggucuuuc

SEQ ID NO: 501360 - RNA, 22 nt, Human
ugcccucauuauaagaggcuca

SEQ ID NO: 501361 - RNA, 23 nt, Human
uccaggcugaaggagcagauuuu

SEQ ID NO: 501362 - RNA, 22 nt, Human
caggagcaaggagcagugggau

SEQ ID NO: 501363 - RNA, 20 nt, Human
acuuuacagagaagacugac

SEQ ID NO: 501364 - RNA, 18 nt, Human
uccaggucccaggggaag

SEQ ID NO: 501365 - RNA, 22 nt, Human
cugcacaguggguggggcguca

SEQ ID NO: 501366 - RNA, 20 nt, Human
ugcagcugcaggaggguggg

SEQ ID NO: 501367 - RNA, 22 nt, Human
ccuccagguguuacauaugacu

SEQ ID NO: 501368 - RNA, 22 nt, Human
uaccagccucuguugggggugg

SEQ ID NO: 501369 - RNA, 22 nt, Human
uccugggcagccucucuggaag

SEQ ID NO: 501370 - RNA, 22 nt, Human
gcuggccauauauuuugcuguu

SEQ ID NO: 501371 - RNA, 22 nt, Human
accugccucuaagcagcaggug

SEQ ID NO: 501372 - RNA, 22 nt, Human
gcagggcucugcuguaguccua

SEQ ID NO: 501373 - RNA, 22 nt, Human
gcagugcaggacaaaucagugc

SEQ ID NO: 501374 - RNA, 21 nt, Human
ugcagcagaguaagcagggga

SEQ ID NO: 501375 - RNA, 22 nt, Human
caggcuggaguacaauugugug

SEQ ID NO: 501376 - RNA, 22 nt, Human
gagccuccuccuggugugccga

SEQ ID NO: 501377 - RNA, 22 nt, Human
ccugucuggccuuccacggggg

SEQ ID NO: 501378 - RNA, 18 nt, Human
aaugugaauauuuacuuc

SEQ ID NO: 501379 - RNA, 22 nt, Human
uaguucuacucaaagugugauc

SEQ ID NO: 501380 - RNA, 22 nt, Human
uaauuacaaagcaagcacaggg

SEQ ID NO: 501381 - RNA, 22 nt, Human
gaaguauuacucugaauguauu

SEQ ID NO: 501382 - RNA, 22 nt, Human
ugggaggacuugugggcuucau

SEQ ID NO: 501383 - RNA, 22 nt, Human
aggccuuaccauagcuguagca

SEQ ID NO: 501384 - RNA, 22 nt, Human
uggccugggucacaccaggguc

SEQ ID NO: 501385 - RNA, 22 nt, Human
gagccagguuugaaucucaguc

SEQ ID NO: 501386 - RNA, 22 nt, Human
ccuggguccaauucuggcuugu

SEQ ID NO: 501387 - RNA, 22 nt, Human
uaggggcagaagcggcggucca

SEQ ID NO: 501388 - RNA, 22 nt, Human
gcgaaaaauguguaaauauguu

SEQ ID NO: 501389 - RNA, 22 nt, Human
ugaaucauggauaaauagcuua

SEQ ID NO: 501390 - RNA, 23 nt, Human
uuuuccagaaucgacucuguaga

SEQ ID NO: 501391 - RNA, 22 nt, Human
ggggagugacgcagggccauag

SEQ ID NO: 501392 - RNA, 21 nt, Human
uggcucaguugcugggcacag

SEQ ID NO: 501393 - RNA, 22 nt, Human
uuugaaagggaaauaaacuccu

SEQ ID NO: 501394 - RNA, 22 nt, Human
caaacauucaaguacaagucuu

SEQ ID NO: 501395 - RNA, 16 nt, Human
uuuauuuacuaguguu

SEQ ID NO: 501396 - RNA, 22 nt, Human
aguccagucucacucuuggcag

SEQ ID NO: 501397 - RNA, 22 nt, Human
cugggcugucaauggcccucug

SEQ ID NO: 501398 - RNA, 22 nt, Human
uuucauucauuauacaguagag

SEQ ID NO: 501399 - RNA, 22 nt, Human
cuggcugggagcgagcugcuca

SEQ ID NO: 501400 - RNA, 22 nt, Human
cuggcagcucuacucagagccu

SEQ ID NO: 501401 - RNA, 22 nt, Human
ucagcagggcugugguguggcu

SEQ ID NO: 501402 - RNA, 19 nt, Human
gcugcuggcucuggcugga

SEQ ID NO: 501403 - RNA, 22 nt, Human
uggcagagagacucuccuugau

SEQ ID NO: 501404 - RNA, 22 nt, Human
cugucccagauguucucagcac

SEQ ID NO: 501405 - RNA, 22 nt, Human
aaauucagcagugaaaugcccc

SEQ ID NO: 501406 - RNA, 22 nt, Human
ggagggcugccagguggagcgg

SEQ ID NO: 501407 - RNA, 18 nt, Human
uuucacagauucaugacu

SEQ ID NO: 501408 - RNA, 22 nt, Human
uauguucaugcuuaugcagaau

SEQ ID NO: 501409 - RNA, 22 nt, Human
uuuacuaaguacuuguaucccu

SEQ ID NO: 501410 - RNA, 22 nt, Human
gucucaguuacucucccuggua

SEQ ID NO: 501411 - RNA, 18 nt, Human
ugagaggcuauuuuuugc

SEQ ID NO: 501412 - RNA, 21 nt, Human
acagcagggcuggcaugacag

SEQ ID NO: 501413 - RNA, 22 nt, Human
ccagggcugcugugggacucca

SEQ ID NO: 501414 - RNA, 22 nt, Human
cuggccucaccucagacuuacu

SEQ ID NO: 501415 - RNA, 22 nt, Human
uggcagcaauuagcuagagcug

SEQ ID NO: 501416 - RNA, 22 nt, Human
ugugcacauaaaacaguacuag

SEQ ID NO: 501417 - RNA, 22 nt, Human
ugaaggcuguuggauggggaag

SEQ ID NO: 501418 - RNA, 22 nt, Human
acaguggagaaggcaugaggcu

SEQ ID NO: 501419 - RNA, 22 nt, Human
ucacuguugaccuggaaguggg

SEQ ID NO: 501420 - RNA, 22 nt, Human
uuaauaaaguaugaauuggaaa

SEQ ID NO: 501421 - RNA, 22 nt, Human
cugcucuggggaagccagaugu

SEQ ID NO: 501422 - RNA, 22 nt, Human
cuucccacuaguaucacagagc

SEQ ID NO: 501423 - RNA, 19 nt, Human
aauaagcuuggguaaaacu

SEQ ID NO: 501424 - RNA, 22 nt, Human
aagcgccaugguuccugcgcag

SEQ ID NO: 501425 - RNA, 23 nt, Human
gugcaugugucuuuacaguagca

SEQ ID NO: 501426 - RNA, 22 nt, Human
cccaggacucugacacccccaa

SEQ ID NO: 501427 - RNA, 22 nt, Human
uggcagcuccuggggccagcac

SEQ ID NO: 501428 - RNA, 22 nt, Human
caggaaauaucucaacacuuua

SEQ ID NO: 501429 - RNA, 22 nt, Human
ugggcuguggagcaccuuugca

SEQ ID NO: 501430 - RNA, 22 nt, Human
cacaggaccaauucacauucca

SEQ ID NO: 501431 - RNA, 22 nt, Human
uccuugaacagagggccugggu

SEQ ID NO: 501432 - RNA, 22 nt, Human
ggaccugaacauaaaacgaggc

SEQ ID NO: 501433 - RNA, 22 nt, Human
aaggugucacugggacaggaaa

SEQ ID NO: 501434 - RNA, 22 nt, Human
ccaguguuccauggagugauua

SEQ ID NO: 501435 - RNA, 22 nt, Human
uccuugaaugaauguucucucc

SEQ ID NO: 501436 - RNA, 22 nt, Human
ggcucugcuggauugaggccag

SEQ ID NO: 501437 - RNA, 22 nt, Human
ucaggcagaguggaagcugcaa

SEQ ID NO: 501438 - RNA, 22 nt, Human
cuccaggugcagaaggacucag

SEQ ID NO: 501439 - RNA, 18 nt, Human
gaagggagcuggaaugca

SEQ ID NO: 501440 - RNA, 22 nt, Human
gcugggagaggcccugaaguga

SEQ ID NO: 501441 - RNA, 22 nt, Human
cagagcuggguuugggaaaccu

SEQ ID NO: 501442 - RNA, 22 nt, Human
ggcacuuuucuccccggucaug

SEQ ID NO: 501443 - RNA, 22 nt, Human
uuuaauuuucugggcccagcag

SEQ ID NO: 501444 - RNA, 22 nt, Human
caucauuguuagggacucuaac

SEQ ID NO: 501445 - RNA, 19 nt, Human
ucaaaacacaaaugguuga

SEQ ID NO: 501446 - RNA, 23 nt, Human
gaagcagaugucugaguaggcag

SEQ ID NO: 501447 - RNA, 22 nt, Human
ccagcuuuucagaaucugccug

SEQ ID NO: 501448 - RNA, 22 nt, Human
gcugucaguuuuacccacagac

SEQ ID NO: 501449 - RNA, 22 nt, Human
cuuguggcccauggcuuccugc

SEQ ID NO: 501450 - RNA, 22 nt, Human
gagcacagccaaaguaagaagg

SEQ ID NO: 501451 - RNA, 22 nt, Human
cauguguuuugucauuucaaua

SEQ ID NO: 501452 - RNA, 19 nt, Human
uaaaaacugaaggaagcag

SEQ ID NO: 501453 - RNA, 18 nt, Human
gcccagaggucugggccc

SEQ ID NO: 501454 - RNA, 22 nt, Human
gcaccaugauggagccucauua

SEQ ID NO: 501455 - RNA, 22 nt, Human
ccuuagcaaauuggcaucuucu

SEQ ID NO: 501456 - RNA, 22 nt, Human
acugaaggaagcgggcaggggu

SEQ ID NO: 501457 - RNA, 22 nt, Human
ugagcuguggugggguagagga

SEQ ID NO: 501458 - RNA, 22 nt, Human
aacaaagcccugcccaagagcu

SEQ ID NO: 501459 - RNA, 22 nt, Human
gacucguucauaguuccaauuu

SEQ ID NO: 501460 - RNA, 22 nt, Human
gaggggcaaugagggaaagagu

SEQ ID NO: 501461 - RNA, 22 nt, Human
ugaagaugucagcagggguggu

SEQ ID NO: 501462 - RNA, 19 nt, Human
ccagcuggccugggaccuc

SEQ ID NO: 501463 - RNA, 22 nt, Human
agcagccauccuuagagaaaga

SEQ ID NO: 501464 - RNA, 22 nt, Human
aaguuugugguuauacuugauu

SEQ ID NO: 501465 - RNA, 22 nt, Human
aaacagcuacuucuguauaaug

SEQ ID NO: 501466 - RNA, 22 nt, Human
cuguguggacugguugaggccc

SEQ ID NO: 501467 - RNA, 22 nt, Human
agagauaugaguaguugugaca

SEQ ID NO: 501468 - RNA, 22 nt, Human
ucacaucuuauuagaguaucuc

SEQ ID NO: 501469 - RNA, 22 nt, Human
ucuuccucucuaauugaucaga

SEQ ID NO: 501470 - RNA, 22 nt, Human
uguguacaaacuaacaacauau

SEQ ID NO: 501471 - RNA, 22 nt, Human
cauggcaggaggcugcuggcag

SEQ ID NO: 501472 - RNA, 22 nt, Human
aguuucuauuuucaugucuguu

SEQ ID NO: 501473 - RNA, 22 nt, Human
uuugacagcuuguuacaaaguu

SEQ ID NO: 501474 - RNA, 22 nt, Human
ucgugaagucacaauaaagucu

SEQ ID NO: 501475 - RNA, 22 nt, Human
ugguggccaauucacagggcuc

SEQ ID NO: 501476 - RNA, 22 nt, Human
uucccucucacuuaaagcuugg

SEQ ID NO: 501477 - RNA, 22 nt, Human
augcacgccccacacuggugug

SEQ ID NO: 501478 - RNA, 19 nt, Human
uaccaaauugcauuauggc

SEQ ID NO: 501479 - RNA, 22 nt, Human
cugaugcuauaagccacagugg

SEQ ID NO: 501480 - RNA, 22 nt, Human
augauauuugcaaugugcuugc

SEQ ID NO: 501481 - RNA, 22 nt, Human
cuggcccuguaggaugugaguu

SEQ ID NO: 501482 - RNA, 22 nt, Human
ucccagcagggccgaccagccu

SEQ ID NO: 501483 - RNA, 22 nt, Human
ccaggcucugccaggcccuuga

SEQ ID NO: 501484 - RNA, 22 nt, Human
caggugcuguccugcacauguc

SEQ ID NO: 501485 - RNA, 22 nt, Human
uacauguauugauuucucuucu

SEQ ID NO: 501486 - RNA, 22 nt, Human
ucacuucacacccacuaucaug

SEQ ID NO: 501487 - RNA, 22 nt, Human
agcagcauuuaaguuucuucua

SEQ ID NO: 501488 - RNA, 22 nt, Human
uagauuuaagacccugaauuug

SEQ ID NO: 501489 - RNA, 22 nt, Human
ggcaggcuguucaccugcuuuu

SEQ ID NO: 501490 - RNA, 22 nt, Human
uuuguuuagaaagagauuggug

SEQ ID NO: 501491 - RNA, 22 nt, Human
ugugaagauuuggcaugcagaa

SEQ ID NO: 501492 - RNA, 22 nt, Human
aaaugucuuucaauagagaaau

SEQ ID NO: 501493 - RNA, 22 nt, Human
gaaaccucuuagccucucuuug

SEQ ID NO: 501494 - RNA, 22 nt, Human
cacacaugucucuccaugcucu

SEQ ID NO: 501495 - RNA, 20 nt, Human
agugggagagggcagacugc

SEQ ID NO: 501496 - RNA, 22 nt, Human
gagcagcugagcuggaaugaga

SEQ ID NO: 501497 - RNA, 22 nt, Human
cccugccuugggguccacaccg

SEQ ID NO: 501498 - RNA, 22 nt, Human
gagcuccagcaucucugccaaa

SEQ ID NO: 501499 - RNA, 22 nt, Human
uagcuuggaauaaaaugagaau

SEQ ID NO: 501500 - RNA, 22 nt, Human
ccagggcagcagaauuggggca

SEQ ID NO: 501501 - RNA, 22 nt, Human
cgagaguuagcuaggagucaca

SEQ ID NO: 501502 - RNA, 22 nt, Human
uagggcucugcucaucaguugu

SEQ ID NO: 501503 - RNA, 22 nt, Human
cauuucuguacauguuuuggug

SEQ ID NO: 501504 - RNA, 22 nt, Human
aaugaaugaaccacauauaaca

SEQ ID NO: 501505 - RNA, 22 nt, Human
ucucgacagccuggcacagugg

SEQ ID NO: 501506 - RNA, 22 nt, Human
ugccacaccaacaucuuucagc

SEQ ID NO: 501507 - RNA, 22 nt, Human
gcauggcagugaggauggugcu

SEQ ID NO: 501508 - RNA, 22 nt, Human
ugcagugggccggaggccaggg

SEQ ID NO: 501509 - RNA, 22 nt, Human
gaaucauuuagcucugcaugga

SEQ ID NO: 501510 - RNA, 22 nt, Human
aaaaugacauuccagugauauu

SEQ ID NO: 501511 - RNA, 22 nt, Human
gccagacacuccccugggcagg

SEQ ID NO: 501512 - RNA, 19 nt, Human
agagaccacagagcugccu

SEQ ID NO: 501513 - RNA, 22 nt, Human
uggagcagcuaagccucugaga

SEQ ID NO: 501514 - RNA, 21 nt, Human
ucuggagcccuaagcugagaa

SEQ ID NO: 501515 - RNA, 22 nt, Human
ggucucuguugccuccaucaag

SEQ ID NO: 501516 - RNA, 19 nt, Human
ggcauccacgaaugcagag

SEQ ID NO: 501517 - RNA, 22 nt, Human
gcacccagugggaugcuuagca

SEQ ID NO: 501518 - RNA, 21 nt, Human
ugcuucucuagaucaacuacu

SEQ ID NO: 501519 - RNA, 22 nt, Human
ucugaggcagcuugccacucua

SEQ ID NO: 501520 - RNA, 22 nt, Human
cugacucuccucaagcauaaau

SEQ ID NO: 501521 - RNA, 22 nt, Human
cccuggggcugagggauggccg

SEQ ID NO: 501522 - RNA, 19 nt, Human
guugaaaguaggugagggu

SEQ ID NO: 501523 - RNA, 22 nt, Human
ugugugucuggaagcucaggga

SEQ ID NO: 501524 - RNA, 22 nt, Human
aaaugcagguaguauuuauuuu

SEQ ID NO: 501525 - RNA, 22 nt, Human
uguugaagauaaaguucucauu

SEQ ID NO: 501526 - RNA, 22 nt, Human
aaaaaagauugaugguggaugc

SEQ ID NO: 501527 - RNA, 22 nt, Human
cuucacaguauaggucccugag

SEQ ID NO: 501528 - RNA, 22 nt, Human
ucugggcucuuaguguacccuc

SEQ ID NO: 501529 - RNA, 22 nt, Human
gcugagggcauguguggcgacu

SEQ ID NO: 501530 - RNA, 22 nt, Human
caguggcgugaucucugcucac

SEQ ID NO: 501531 - RNA, 22 nt, Human
uggggaagggcacccuggagac

SEQ ID NO: 501532 - RNA, 22 nt, Human
uucagcagguggugaguucugc

SEQ ID NO: 501533 - RNA, 18 nt, Human
acagugguuugaugugcu

SEQ ID NO: 501534 - RNA, 22 nt, Human
caggccuggcugcagcucgccu

SEQ ID NO: 501535 - RNA, 22 nt, Human
agggcuccuaugccccauggac

SEQ ID NO: 501536 - RNA, 22 nt, Human
agaaagaacguugguuaucuua

SEQ ID NO: 501537 - RNA, 22 nt, Human
uucuuccucacacucucaccca

SEQ ID NO: 501538 - RNA, 22 nt, Human
uccaggcuuuuucaugcugucu

SEQ ID NO: 501539 - RNA, 22 nt, Human
ucucuucuaauuaggguccaug

SEQ ID NO: 501540 - RNA, 22 nt, Human
uaaagugcucauaaaaauggau

SEQ ID NO: 501541 - RNA, 22 nt, Human
ggaggugacgaaaagaaauugu

SEQ ID NO: 501542 - RNA, 22 nt, Human
ggcaggcgugguggccucagaa

SEQ ID NO: 501543 - RNA, 22 nt, Human
aauuuguacaaaauguuuauaa

SEQ ID NO: 501544 - RNA, 22 nt, Human
augaugaagaguaacaggcuga

SEQ ID NO: 501545 - RNA, 22 nt, Human
ucucagagagcuguguuuuccu

SEQ ID NO: 501546 - RNA, 22 nt, Human
ucuggccuuaucuguccaagcc

SEQ ID NO: 501547 - RNA, 22 nt, Human
uccuggcuccacugagcaggcc

SEQ ID NO: 501548 - RNA, 23 nt, Human
acacauuuuucccguucugaggu

SEQ ID NO: 501549 - RNA, 20 nt, Human
guguggccaggagcugcgcu

SEQ ID NO: 501550 - RNA, 22 nt, Human
gaugaggggucauuggcuggga

SEQ ID NO: 501551 - RNA, 22 nt, Human
gaggaaccaaucugugauauuc

SEQ ID NO: 501552 - RNA, 22 nt, Human
caggguggcaggcaccauggcc

SEQ ID NO: 501553 - RNA, 22 nt, Human
uugcugagcaguguuuaauugu

SEQ ID NO: 501554 - RNA, 22 nt, Human
uggcaggggaggugcuugcuua

SEQ ID NO: 501555 - RNA, 22 nt, Human
auacaaugggugcaaagaugug

SEQ ID NO: 501556 - RNA, 22 nt, Human
uucucuggccauagcuggcuag

SEQ ID NO: 501557 - RNA, 22 nt, Human
uaaggcagaaauaugagcaggg

SEQ ID NO: 501558 - RNA, 22 nt, Human
ucacugaagacugggcucuaaa

SEQ ID NO: 501559 - RNA, 22 nt, Human
cugaagcacagcauauaaauaa

SEQ ID NO: 501560 - RNA, 22 nt, Human
agugaaauacugucguuuuuag

SEQ ID NO: 501561 - RNA, 21 nt, Human
uucuucaugaugauuaauggc

SEQ ID NO: 501562 - RNA, 17 nt, Human
ugaaacaccaagacugu

SEQ ID NO: 501563 - RNA, 17 nt, Human
acaugggcugagacucc

SEQ ID NO: 501564 - RNA, 18 nt, Human
ucaagacaucaugaaaua

SEQ ID NO: 501565 - RNA, 22 nt, Human
ucagagugaggcccagcaaucu

SEQ ID NO: 501566 - RNA, 22 nt, Human
guggccuggaguuugauguagg

SEQ ID NO: 501567 - RNA, 22 nt, Human
aaaugcaggaaauuaugcuuuu

SEQ ID NO: 501568 - RNA, 22 nt, Human
ucaacacuauccaggcaaucuu

SEQ ID NO: 501569 - RNA, 22 nt, Human
uggagccagagcgcagccuggg

SEQ ID NO: 501570 - RNA, 22 nt, Human
uccaggcaguuuuccagguugu

SEQ ID NO: 501571 - RNA, 21 nt, Human
gaaaauacaaugagcuugacc

SEQ ID NO: 501572 - RNA, 22 nt, Human
cugccucuauucacugaggcag

SEQ ID NO: 501573 - RNA, 22 nt, Human
gcugguuaggugagggugcgcc

SEQ ID NO: 501574 - RNA, 22 nt, Human
cugcagagcaaguaacauccuc

SEQ ID NO: 501575 - RNA, 22 nt, Human
gcagccagaagacucagaacaa

SEQ ID NO: 501576 - RNA, 22 nt, Human
ucuggggagugccuaaguggaa

SEQ ID NO: 501577 - RNA, 22 nt, Human
gugccuggcaugcgccggugcu

SEQ ID NO: 501578 - RNA, 22 nt, Human
aggcugcuuccuuacguggcug

SEQ ID NO: 501579 - RNA, 22 nt, Human
acuccuggguugcaguccucaa

SEQ ID NO: 501580 - RNA, 22 nt, Human
acuguguggaccacucugaggc

SEQ ID NO: 501581 - RNA, 22 nt, Human
uuacaugggccauuuagacaug

SEQ ID NO: 501582 - RNA, 21 nt, Human
uuucaauguguucuuuguagu

SEQ ID NO: 501583 - RNA, 20 nt, Human
gaggcccagagaggugaagc

SEQ ID NO: 501584 - RNA, 22 nt, Human
cugccuggaaugccagcuucuc

SEQ ID NO: 501585 - RNA, 22 nt, Human
acuguccaagcaugccuggcuu

SEQ ID NO: 501586 - RNA, 22 nt, Human
cagcuuugauucuuucugccau

SEQ ID NO: 501587 - RNA, 22 nt, Human
auuguacauaaaauguaugucu

SEQ ID NO: 501588 - RNA, 22 nt, Human
gcuggcucuacauuugagguca

SEQ ID NO: 501589 - RNA, 22 nt, Human
gcugaggcucaauccccuucug

SEQ ID NO: 501590 - RNA, 22 nt, Human
cuguuuauaaauagaggggagu

SEQ ID NO: 501591 - RNA, 22 nt, Human
aucuguaacaucaguagcagaa

SEQ ID NO: 501592 - RNA, 22 nt, Human
aacaucugaucgaacagugcca

SEQ ID NO: 501593 - RNA, 22 nt, Human
ugaaugauuaaaacccggacua

SEQ ID NO: 501594 - RNA, 22 nt, Human
ucaugaauauugaaugcuucau

SEQ ID NO: 501595 - RNA, 22 nt, Human
ucugccugcuaacuccugcacc

SEQ ID NO: 501596 - RNA, 20 nt, Human
gguagcagcugcugucaucc

SEQ ID NO: 501597 - RNA, 22 nt, Human
ccuacucugagcgccuccgcau

SEQ ID NO: 501598 - RNA, 20 nt, Human
cucuuaaauguaaaguaggc

SEQ ID NO: 501599 - RNA, 22 nt, Human
cuguggcucaaaaucccaugau

SEQ ID NO: 501600 - RNA, 22 nt, Human
cuguggcuggccuuauugcugc

SEQ ID NO: 501601 - RNA, 22 nt, Human
caagacuuagagcaucuugaaa

SEQ ID NO: 501602 - RNA, 22 nt, Human
ucuggcugcugcgugagugcuu

SEQ ID NO: 501603 - RNA, 22 nt, Human
cugcugggcagaggcugcauga

SEQ ID NO: 501604 - RNA, 22 nt, Human
gggcucuguuuagaucagagau

SEQ ID NO: 501605 - RNA, 22 nt, Human
ggcccaguguaccccaggcagu

SEQ ID NO: 501606 - RNA, 22 nt, Human
caugaaugcuggguucauguaa

SEQ ID NO: 501607 - RNA, 22 nt, Human
auuucacaaagaacagaugcag

SEQ ID NO: 501608 - RNA, 22 nt, Human
uucagugugugauaccugcugu

SEQ ID NO: 501609 - RNA, 22 nt, Human
uagugcaaaggucuugcaccag

SEQ ID NO: 501610 - RNA, 22 nt, Human
ucaggagucugugcaguuccac

SEQ ID NO: 501611 - RNA, 22 nt, Human
uucugggggccaggacaguggu

SEQ ID NO: 501612 - RNA, 22 nt, Human
uuccucagccaaggcugggauc

SEQ ID NO: 501613 - RNA, 22 nt, Human
agaguccaaaugugcaguuaug

SEQ ID NO: 501614 - RNA, 22 nt, Human
agccccaguaagggagggccug

SEQ ID NO: 501615 - RNA, 22 nt, Human
ccuguucauuuuuugacucugc

SEQ ID NO: 501616 - RNA, 22 nt, Human
ggcagcucugugucugggaagc

SEQ ID NO: 501617 - RNA, 22 nt, Human
aaauuucuugaggcucucuagc

SEQ ID NO: 501618 - RNA, 22 nt, Human
acagaauuaucaggaaauguua

SEQ ID NO: 501619 - RNA, 21 nt, Human
uucucuggucaagcacacaua

SEQ ID NO: 501620 - RNA, 21 nt, Human
cugcaggaugcugaagccagg

SEQ ID NO: 501621 - RNA, 22 nt, Human
caggcuggcaaugcgucaagca

SEQ ID NO: 501622 - RNA, 22 nt, Human
uaggcaggugugcacugcccac

SEQ ID NO: 501623 - RNA, 22 nt, Human
gacucugcuacaggccgagguu

SEQ ID NO: 501624 - RNA, 21 nt, Human
ggagauggguaucgccugggc

SEQ ID NO: 501625 - RNA, 22 nt, Human
auuuaauuugugucuuuagcug

SEQ ID NO: 501626 - RNA, 22 nt, Human
ugcccugcugugccuggagcca

SEQ ID NO: 501627 - RNA, 22 nt, Human
caauuucugggccucacacaag

SEQ ID NO: 501628 - RNA, 22 nt, Human
uguuuucauuugauguaacaaa

SEQ ID NO: 501629 - RNA, 22 nt, Human
ucuuuauugcuacugguuuguc

SEQ ID NO: 501630 - RNA, 22 nt, Human
uuuacaaguacaccuaacagcu

SEQ ID NO: 501631 - RNA, 22 nt, Human
guccugggaaggaagccaggga

SEQ ID NO: 501632 - RNA, 22 nt, Human
guuucaaauagguuucagcaaa

SEQ ID NO: 501633 - RNA, 22 nt, Human
uucaaucauuuuuacauagucc

SEQ ID NO: 501634 - RNA, 22 nt, Human
ugccuggcaaugccagaagcca

SEQ ID NO: 501635 - RNA, 19 nt, Human
aggacucuggaggcaugag

SEQ ID NO: 501636 - RNA, 18 nt, Human
gggcuuuacagaguggag

SEQ ID NO: 501637 - RNA, 22 nt, Human
cugagggaacuugggcaagucu

SEQ ID NO: 501638 - RNA, 22 nt, Human
ugugcacauauacucauauucc

SEQ ID NO: 501639 - RNA, 22 nt, Human
agcugccauccgaggugucaga

SEQ ID NO: 501640 - RNA, 22 nt, Human
gauauuuuugcagacaccuggg

SEQ ID NO: 501641 - RNA, 22 nt, Human
uauuaauaagugacuacuagcu

SEQ ID NO: 501642 - RNA, 22 nt, Human
cagagcugagaauguugaugcu

SEQ ID NO: 501643 - RNA, 22 nt, Human
ccucuugccaaucagcuacaga

SEQ ID NO: 501644 - RNA, 22 nt, Human
ugccagggcugcuacuggcuga

SEQ ID NO: 501645 - RNA, 22 nt, Human
cccugguucagguuucucugaa

SEQ ID NO: 501646 - RNA, 22 nt, Human
gcugcugggcacccccugagcu

SEQ ID NO: 501647 - RNA, 20 nt, Human
agucccuuuggucagguauu

SEQ ID NO: 501648 - RNA, 22 nt, Human
ugucaugggcauuuauugaggg

SEQ ID NO: 501649 - RNA, 22 nt, Human
aaagugcugggauuacaggugu

SEQ ID NO: 501650 - RNA, 23 nt, Human
agcagcccugggaccuggccugc

SEQ ID NO: 501651 - RNA, 22 nt, Human
cugugggcauuugagugugggu

SEQ ID NO: 501652 - RNA, 22 nt, Human
ucaaaugcucuuugcagagagg

SEQ ID NO: 501653 - RNA, 22 nt, Human
ugccuaggcuggaaugcagugg

SEQ ID NO: 501654 - RNA, 22 nt, Human
ucugggcccugagauguucuuc

SEQ ID NO: 501655 - RNA, 22 nt, Human
uucugaauucaugagauuuggg

SEQ ID NO: 501656 - RNA, 22 nt, Human
uguaggcugaagaugaagugga

SEQ ID NO: 501657 - RNA, 22 nt, Human
cagccugggcuccagagucccu

SEQ ID NO: 501658 - RNA, 22 nt, Human
uucugggcccacuguagcaucc

SEQ ID NO: 501659 - RNA, 22 nt, Human
agcuggccuccgggugccuggg

SEQ ID NO: 501660 - RNA, 22 nt, Human
gugggcuuuugacagugccugg

SEQ ID NO: 501661 - RNA, 22 nt, Human
cuguuuauuacacuggauagca

SEQ ID NO: 501662 - RNA, 22 nt, Human
gaaguauuauagcauauuagcc

SEQ ID NO: 501663 - RNA, 16 nt, Human
uggcagguuuuuaucu

SEQ ID NO: 501664 - RNA, 22 nt, Human
ugcagggccuucuagaccaugg

SEQ ID NO: 501665 - RNA, 21 nt, Human
cuggagucuggggguggcagu

SEQ ID NO: 501666 - RNA, 22 nt, Human
ccagaggcuggcaagggcuccu

SEQ ID NO: 501667 - RNA, 22 nt, Human
cugggcugucaguuuuguuuua

SEQ ID NO: 501668 - RNA, 22 nt, Human
gggcacugcuuugcucugucac

SEQ ID NO: 501669 - RNA, 22 nt, Human
gaaaaaugcuccaaaucugugg

SEQ ID NO: 501670 - RNA, 22 nt, Human
aacaggcaggagaauucugccu

SEQ ID NO: 501671 - RNA, 22 nt, Human
ucucagucaguuuggacugugu

SEQ ID NO: 501672 - RNA, 22 nt, Human
agauacaucauuuauaccuuca

SEQ ID NO: 501673 - RNA, 23 nt, Human
uccugcagauaagcugguugaca

SEQ ID NO: 501674 - RNA, 22 nt, Human
aggaccuguaccucagcaucua

SEQ ID NO: 501675 - RNA, 22 nt, Human
ugccugucuuuccucccucgua

SEQ ID NO: 501676 - RNA, 22 nt, Human
agacagaccauggcuauucaga

SEQ ID NO: 501677 - RNA, 22 nt, Human
aaacucuguauuugcugugggu

SEQ ID NO: 501678 - RNA, 22 nt, Human
uggaagggguuacgcagcagga

SEQ ID NO: 501679 - RNA, 22 nt, Human
uccaaagggaagcgcuuucugu

SEQ ID NO: 501680 - RNA, 22 nt, Human
caagauggaguccgggaaugug

SEQ ID NO: 501681 - RNA, 22 nt, Human
agugaaccaggcugcgucccug

SEQ ID NO: 501682 - RNA, 22 nt, Human
ggaaacuuggaugccagcacuc

SEQ ID NO: 501683 - RNA, 22 nt, Human
aauaguuugaauuuaucagaug

SEQ ID NO: 501684 - RNA, 22 nt, Human
ggucacaggggagaagagugau

SEQ ID NO: 501685 - RNA, 22 nt, Human
agagacuguaaugagagguaca

SEQ ID NO: 501686 - RNA, 23 nt, Human
uggagaugccccacucccugucu

SEQ ID NO: 501687 - RNA, 22 nt, Human
cccaggcuggagugcaauggug

SEQ ID NO: 501688 - RNA, 22 nt, Human
acugcaacaccuccuggguuca

SEQ ID NO: 501689 - RNA, 22 nt, Human
gcacagggaggcuggccuggcc

SEQ ID NO: 501690 - RNA, 22 nt, Human
uucuuuguugagcaaguaggac

SEQ ID NO: 501691 - RNA, 22 nt, Human
uccuguguuacugccuggagcg

SEQ ID NO: 501692 - RNA, 22 nt, Human
ccagcugaggcagccacacagg

SEQ ID NO: 501693 - RNA, 22 nt, Human
uaguuucagcuccuucauccug

SEQ ID NO: 501694 - RNA, 22 nt, Human
ggcuuuauaggguagaggauca

SEQ ID NO: 501695 - RNA, 22 nt, Human
cuggcugcauuggcaagucaau

SEQ ID NO: 501696 - RNA, 22 nt, Human
aagggccuccuggggagccugg

SEQ ID NO: 501697 - RNA, 23 nt, Human
uaaagacagccuucaggauucug

SEQ ID NO: 501698 - RNA, 21 nt, Human
ucauuucucuauguauuucac

SEQ ID NO: 501699 - RNA, 22 nt, Human
cccagcucucugcucuuagccu

SEQ ID NO: 501700 - RNA, 22 nt, Human
gcuuccugagaaacaaucugau

SEQ ID NO: 501701 - RNA, 22 nt, Human
ucucugggucucaguuuguaca

SEQ ID NO: 501702 - RNA, 22 nt, Human
guggccagccagggugcugaug

SEQ ID NO: 501703 - RNA, 20 nt, Human
ucagauuuuucuaacuuuga

SEQ ID NO: 501704 - RNA, 22 nt, Human
caaaaguaauugcgguuuuugc

SEQ ID NO: 501705 - RNA, 18 nt, Human
acauuucuaugcuucugg

SEQ ID NO: 501706 - RNA, 22 nt, Human
uggaaggcagugauauuguuga

SEQ ID NO: 501707 - RNA, 22 nt, Human
agaaggguaguuguaagaguga

SEQ ID NO: 501708 - RNA, 22 nt, Human
cacaguggcaaaggggcuuggg

SEQ ID NO: 501709 - RNA, 20 nt, Human
uacugggucuggguccugga

SEQ ID NO: 501710 - RNA, 22 nt, Human
uugugaaugcuuaauauguuuc

SEQ ID NO: 501711 - RNA, 22 nt, Human
cuuccuugcugucugcuccagg

SEQ ID NO: 501712 - RNA, 22 nt, Human
cugggccaucuccuuugugugg

SEQ ID NO: 501713 - RNA, 22 nt, Human
cugcugagguccuugcucagac

SEQ ID NO: 501714 - RNA, 22 nt, Human
ucuccuggcucaccaggcugga

SEQ ID NO: 501715 - RNA, 22 nt, Human
guguccugguuccuuguggcug

SEQ ID NO: 501716 - RNA, 22 nt, Human
agcaggugggcaugaaagcuga

SEQ ID NO: 501717 - RNA, 22 nt, Human
ggugucccaggccagcugugug

SEQ ID NO: 501718 - RNA, 22 nt, Human
auaagaugagaucagcuuucug

SEQ ID NO: 501719 - RNA, 20 nt, Human
gugcccugugggcuauuuuc

SEQ ID NO: 501720 - RNA, 22 nt, Human
cuuguccuuuacuugagacuca

SEQ ID NO: 501721 - RNA, 22 nt, Human
cagcaggauagguuucuuugga

SEQ ID NO: 501722 - RNA, 22 nt, Human
aagagggaggugcgggugcaga

SEQ ID NO: 501723 - RNA, 22 nt, Human
auuuuuccaauuaggauaaaga

SEQ ID NO: 501724 - RNA, 22 nt, Human
ucucagagaucuuucugcaugu

SEQ ID NO: 501725 - RNA, 22 nt, Human
caaagaugucauugguaagaca

SEQ ID NO: 501726 - RNA, 19 nt, Human
ggccaccucucuucccagg

SEQ ID NO: 501727 - RNA, 22 nt, Human
cacaguguuugauuuaggggcc

SEQ ID NO: 501728 - RNA, 22 nt, Human
cuggcuucccugucuuauggaa

SEQ ID NO: 501729 - RNA, 21 nt, Human
uccucugcucucauaccacaa

SEQ ID NO: 501730 - RNA, 22 nt, Human
agauacaucuugaacuucuaga

SEQ ID NO: 501731 - RNA, 21 nt, Human
aggcccagagucuugggggga

SEQ ID NO: 501732 - RNA, 22 nt, Human
uugagucucugccaaaacacaa

SEQ ID NO: 501733 - RNA, 20 nt, Human
ugcuggggacauacagggug

SEQ ID NO: 501734 - RNA, 22 nt, Human
uuucaaauaccauaaaccuaau

SEQ ID NO: 501735 - RNA, 22 nt, Human
acagcacuuauucagcacagug

SEQ ID NO: 501736 - RNA, 22 nt, Human
agcuggguacagccugugccua

SEQ ID NO: 501737 - RNA, 18 nt, Human
gggcauggaugcagcauc

SEQ ID NO: 501738 - RNA, 19 nt, Human
ucagcaucaauuugguccu

SEQ ID NO: 501739 - RNA, 22 nt, Human
uuugcauuauauuuauagaaga

SEQ ID NO: 501740 - RNA, 22 nt, Human
cagggagcuggcuggcugugcc

SEQ ID NO: 501741 - RNA, 22 nt, Human
uugcauuccaguccccacugug

SEQ ID NO: 501742 - RNA, 22 nt, Human
caggaaaaaugccaggagucag

SEQ ID NO: 501743 - RNA, 22 nt, Human
ucagcuuugaucucaggcaauc

SEQ ID NO: 501744 - RNA, 22 nt, Human
gucacccugcuggcuguucagc

SEQ ID NO: 501745 - RNA, 22 nt, Human
ugcuaggaauacacagagcaau

SEQ ID NO: 501746 - RNA, 22 nt, Human
agcacagacuggucccaggucu

SEQ ID NO: 501747 - RNA, 22 nt, Human
ucuggccacccgaggccccugc

SEQ ID NO: 501748 - RNA, 22 nt, Human
uagugcacacgcauguagcagu

SEQ ID NO: 501749 - RNA, 22 nt, Human
aggcacugacucaagggagcca

SEQ ID NO: 501750 - RNA, 18 nt, Human
agcuggggccucuggucc

SEQ ID NO: 501751 - RNA, 22 nt, Human
gaggagcuggcagcgucuccgc

SEQ ID NO: 501752 - RNA, 20 nt, Human
agugcauggagggagagggc

SEQ ID NO: 501753 - RNA, 22 nt, Human
ucucuucauagugacacccauc

SEQ ID NO: 501754 - RNA, 22 nt, Human
cuuaauuuaagccuagaaugca

SEQ ID NO: 501755 - RNA, 22 nt, Human
auguccagggggcuugacuggu

SEQ ID NO: 501756 - RNA, 22 nt, Human
uuucaaauagaaucuuuccaaa

SEQ ID NO: 501757 - RNA, 22 nt, Human
guggugaguucaggcuggggug

SEQ ID NO: 501758 - RNA, 22 nt, Human
agaaguaggcagggcuguauca

SEQ ID NO: 501759 - RNA, 22 nt, Human
ucaggcugguggucagauggcu

SEQ ID NO: 501760 - RNA, 22 nt, Human
ucagggcacauucugcaguggc

SEQ ID NO: 501761 - RNA, 22 nt, Human
aagucagauaggugaguccaaa

SEQ ID NO: 501762 - RNA, 22 nt, Human
aggaaaauuaucaugagagcca

SEQ ID NO: 501763 - RNA, 22 nt, Human
agcagccagaaauccagaggug

SEQ ID NO: 501764 - RNA, 22 nt, Human
ucucaggaagauuagggcuaag

SEQ ID NO: 501765 - RNA, 22 nt, Human
acacauguuuacagucuucagu

SEQ ID NO: 501766 - RNA, 22 nt, Human
uacaguucacaguaucauaaau

SEQ ID NO: 501767 - RNA, 19 nt, Human
aaagaucugggauugagac

SEQ ID NO: 501768 - RNA, 22 nt, Human
ugagccuguggggugacaacca

SEQ ID NO: 501769 - RNA, 22 nt, Human
uaaagucaucuuuacaucuuug

SEQ ID NO: 501770 - RNA, 22 nt, Human
agcccugggaggccagcuugua

SEQ ID NO: 501771 - RNA, 22 nt, Human
gagcuuaggccagggacaggga

SEQ ID NO: 501772 - RNA, 22 nt, Human
ugugaggaacaggacuagagca

SEQ ID NO: 501773 - RNA, 22 nt, Human
ugcagggagcucuggggugcag

SEQ ID NO: 501774 - RNA, 22 nt, Human
ggcuuuaugcacagcagauggu

SEQ ID NO: 501775 - RNA, 22 nt, Human
aagcagcuggaagaguaagaug

SEQ ID NO: 501776 - RNA, 22 nt, Human
cuguggcugcagccuugguccu

SEQ ID NO: 501777 - RNA, 22 nt, Human
uagaucugauacaauucaucug

SEQ ID NO: 501778 - RNA, 22 nt, Human
aaaaugcucaucagcgauggcu

SEQ ID NO: 501779 - RNA, 22 nt, Human
gagcaucacuguccucuccccg

SEQ ID NO: 501780 - RNA, 22 nt, Human
uggaugagucugagauugggca

SEQ ID NO: 501781 - RNA, 22 nt, Human
cccagcugcaccucuauggccu

SEQ ID NO: 501782 - RNA, 22 nt, Human
cuggagcccugaaugggcagga

SEQ ID NO: 501783 - RNA, 22 nt, Human
ucaggcucugagcugaugcuaa

SEQ ID NO: 501784 - RNA, 22 nt, Human
caggcaccccaggugagcacug

SEQ ID NO: 501785 - RNA, 21 nt, Human
uacauugacuacaaauaaagc

SEQ ID NO: 501786 - RNA, 22 nt, Human
uaggcagcugcaaacuucgguc

SEQ ID NO: 501787 - RNA, 22 nt, Human
gccugccuuuguaugacccuga

SEQ ID NO: 501788 - RNA, 22 nt, Human
cagaguacugggagaacagaag

SEQ ID NO: 501789 - RNA, 22 nt, Human
cuaaaugacuuccagugguuau

SEQ ID NO: 501790 - RNA, 22 nt, Human
accaagcuucguggaggaaguu

SEQ ID NO: 501791 - RNA, 23 nt, Human
cccuggccuuggggcacaggcug

SEQ ID NO: 501792 - RNA, 22 nt, Human
uuggaaggugagucccuggguu

SEQ ID NO: 501793 - RNA, 22 nt, Human
acaacaaaaucacuagucuucc

SEQ ID NO: 501794 - RNA, 22 nt, Human
gagagaagaauguuccgaggcc

SEQ ID NO: 501795 - RNA, 22 nt, Human
ccagaggucuccugcacgggau

SEQ ID NO: 501796 - RNA, 22 nt, Human
ucucagugguguuuugagucca

SEQ ID NO: 501797 - RNA, 20 nt, Human
uucuagcauacuuacaagga

SEQ ID NO: 501798 - RNA, 22 nt, Human
caguacuugggggguucuaagu

SEQ ID NO: 501799 - RNA, 22 nt, Human
gaguaggaauguucugccaucu

SEQ ID NO: 501800 - RNA, 22 nt, Human
uuuuuccuaagcaguggagcug

SEQ ID NO: 501801 - RNA, 22 nt, Human
gggcugugggacccggcacuuu

SEQ ID NO: 501802 - RNA, 20 nt, Human
agucccagaucaaauuucug

SEQ ID NO: 501803 - RNA, 22 nt, Human
aagaguuucuuuauuaaccuuu

SEQ ID NO: 501804 - RNA, 21 nt, Human
gauugaaaccauggcagugag

SEQ ID NO: 501805 - RNA, 22 nt, Human
cugugucccuugucccagagcc

SEQ ID NO: 501806 - RNA, 19 nt, Human
gggcuuuacuccaaguggg

SEQ ID NO: 501807 - RNA, 22 nt, Human
ucaggaagugguaaaggauguu

SEQ ID NO: 501808 - RNA, 22 nt, Human
cagggguguuuuuggccaggag

SEQ ID NO: 501809 - RNA, 22 nt, Human
ugguucauagccucacaggaua

SEQ ID NO: 501810 - RNA, 23 nt, Human
aggagccaggaaccagcuucccc

SEQ ID NO: 501811 - RNA, 22 nt, Human
uucauguauuuaucauguaaau

SEQ ID NO: 501812 - RNA, 18 nt, Human
uccagagcuacuguggug

SEQ ID NO: 501813 - RNA, 22 nt, Human
aguuucaguucugucauuuaua

SEQ ID NO: 501814 - RNA, 22 nt, Human
uguuuuaagggucaacugucac

SEQ ID NO: 501815 - RNA, 22 nt, Human
ggcucugcugguaagaugccuc

SEQ ID NO: 501816 - RNA, 19 nt, Human
acagaaauguaagugagac

SEQ ID NO: 501817 - RNA, 22 nt, Human
ucugugcucuucucaguaucac

SEQ ID NO: 501818 - RNA, 22 nt, Human
agaagcagaaaagggcacuuuu

SEQ ID NO: 501819 - RNA, 17 nt, Human
uccaggcagcaacugag

SEQ ID NO: 501820 - RNA, 22 nt, Human
uguaagccuucccugagaaagu

SEQ ID NO: 501821 - RNA, 22 nt, Human
uuccgcuguuuaguugaaguuu

SEQ ID NO: 501822 - RNA, 22 nt, Human
aggcagcagccacaaggccuga

SEQ ID NO: 501823 - RNA, 22 nt, Human
ugcuuuauggauuuguguccug

SEQ ID NO: 501824 - RNA, 22 nt, Human
uuccacaggacuaaaugucauc

SEQ ID NO: 501825 - RNA, 18 nt, Human
auuuugaacaaugcugua

SEQ ID NO: 501826 - RNA, 22 nt, Human
uccaccccugggaaugucaaua

SEQ ID NO: 501827 - RNA, 22 nt, Human
gaggggcuugaggcccugaugg

SEQ ID NO: 501828 - RNA, 18 nt, Human
uuuguccuguggcagcug

SEQ ID NO: 501829 - RNA, 22 nt, Human
gacagcaucuguguggcaggag

SEQ ID NO: 501830 - RNA, 22 nt, Human
gugccugugccaggggugugcu

SEQ ID NO: 501831 - RNA, 22 nt, Human
gcccugcuccaggagaauaccc

SEQ ID NO: 501832 - RNA, 22 nt, Human
agaguuuggugaagcaauuuga

SEQ ID NO: 501833 - RNA, 22 nt, Human
acuggcaguggcagcagaaaga

SEQ ID NO: 501834 - RNA, 22 nt, Human
ugaggcaguauuuuagugacuu

SEQ ID NO: 501835 - RNA, 22 nt, Human
gugucccaaagauuagaaauca

SEQ ID NO: 501836 - RNA, 19 nt, Human
auuugaaagcugugcuugc

SEQ ID NO: 501837 - RNA, 22 nt, Human
uucuuucacucaagaaggaucu

SEQ ID NO: 501838 - RNA, 22 nt, Human
uacauuccauguguguguauuc

SEQ ID NO: 501839 - RNA, 18 nt, Human
acuggcuuuagcaucaga

SEQ ID NO: 501840 - RNA, 22 nt, Human
aguucaaagcugcaguaaugga

SEQ ID NO: 501841 - RNA, 22 nt, Human
cacaggugcuccucggggagcu

SEQ ID NO: 501842 - RNA, 22 nt, Human
ucccagccauuccuuuaggugu

SEQ ID NO: 501843 - RNA, 22 nt, Human
cagggagggaggaaaauuugcu

SEQ ID NO: 501844 - RNA, 22 nt, Human
ucucugggaguugagcagcagc

SEQ ID NO: 501845 - RNA, 22 nt, Human
uggccugggcaugaagcaucgu

SEQ ID NO: 501846 - RNA, 22 nt, Human
auuuaaauuuucugauggagag

SEQ ID NO: 501847 - RNA, 22 nt, Human
cccagcucuaggagugguggca

SEQ ID NO: 501848 - RNA, 22 nt, Human
gccaguuccuguggagucagag

SEQ ID NO: 501849 - RNA, 22 nt, Human
gugucccaggagaggagacaau

SEQ ID NO: 501850 - RNA, 22 nt, Human
augcaacaaaugcuacgaaucg

SEQ ID NO: 501851 - RNA, 22 nt, Human
cugcaaaaguaauuggggcuuu

SEQ ID NO: 501852 - RNA, 22 nt, Human
ucucugucucccguguguccgg

SEQ ID NO: 501853 - RNA, 22 nt, Human
gcuguggcuuucuguuucuguu

SEQ ID NO: 501854 - RNA, 22 nt, Human
uggcacuuaaugcaugugcuau

SEQ ID NO: 501855 - RNA, 22 nt, Human
cucaggcuccagacuuccgucc

SEQ ID NO: 501856 - RNA, 22 nt, Human
ugauuuaaaagaaacauugucu

SEQ ID NO: 501857 - RNA, 22 nt, Human
acuaggaacgggguuugcacuc

SEQ ID NO: 501858 - RNA, 22 nt, Human
gagggacagcuaaagagaaauu

SEQ ID NO: 501859 - RNA, 22 nt, Human
ucucagaguaauucuuuaaggu

SEQ ID NO: 501860 - RNA, 22 nt, Human
auuucucaaccaggucaaaaag

SEQ ID NO: 501861 - RNA, 22 nt, Human
acucugggaucuugaaaagagu

SEQ ID NO: 501862 - RNA, 22 nt, Human
gaggccaaucaauagggcaaua

SEQ ID NO: 501863 - RNA, 22 nt, Human
agagcugaaaaagcugacccgg

SEQ ID NO: 501864 - RNA, 22 nt, Human
acuguacacacuucucugucuu

SEQ ID NO: 501865 - RNA, 19 nt, Human
aaauggagcuaaucuuguc

SEQ ID NO: 501866 - RNA, 21 nt, Human
agaugcaguuaugagaugcag

SEQ ID NO: 501867 - RNA, 22 nt, Human
uagaaaagauaacauucugugc

SEQ ID NO: 501868 - RNA, 22 nt, Human
ggcaaaaaccgcaauaacuucu

SEQ ID NO: 501869 - RNA, 22 nt, Human
ugccuggcucuaucaguggugg

SEQ ID NO: 501870 - RNA, 22 nt, Human
uguggccuccccacuucugggg

SEQ ID NO: 501871 - RNA, 22 nt, Human
gcccagccuccaagcuccaagg

SEQ ID NO: 501872 - RNA, 22 nt, Human
uuuccucuuuguaccuugacua

SEQ ID NO: 501873 - RNA, 22 nt, Human
cuuauuagaguuguguucuguu

SEQ ID NO: 501874 - RNA, 22 nt, Human
gcugcagcaagcccuccagggg

SEQ ID NO: 501875 - RNA, 22 nt, Human
uggagcuguagccaccacccug

SEQ ID NO: 501876 - RNA, 22 nt, Human
gccaggcucagcagucaaccug

SEQ ID NO: 501877 - RNA, 22 nt, Human
cagcaguggaacuacccaggga

SEQ ID NO: 501878 - RNA, 22 nt, Human
gcagagaccccgcagugaggcc

SEQ ID NO: 501879 - RNA, 22 nt, Human
uuaauuuuaaccuguuuguguc

SEQ ID NO: 501880 - RNA, 20 nt, Human
ccagaagagaugaucaucca

SEQ ID NO: 501881 - RNA, 22 nt, Human
acagaggcugaucuucaagccc

SEQ ID NO: 501882 - RNA, 22 nt, Human
cagcuuguuaccgagggagggu

SEQ ID NO: 501883 - RNA, 22 nt, Human
ccggucccaggugccccgguga

SEQ ID NO: 501884 - RNA, 22 nt, Human
aagggcagggaguuugugucua

SEQ ID NO: 501885 - RNA, 23 nt, Human
uccuucagagccucccuccaagc

SEQ ID NO: 501886 - RNA, 22 nt, Human
aggaaagcucccaguagggcuc

SEQ ID NO: 501887 - RNA, 22 nt, Human
auuauuuuaugugcggccugau

SEQ ID NO: 501888 - RNA, 21 nt, Human
gcagccaggacuuugggcugg

SEQ ID NO: 501889 - RNA, 22 nt, Human
gccagcucagugccaggccccu

SEQ ID NO: 501890 - RNA, 22 nt, Human
ugcugcugaggcuaaaguauag

SEQ ID NO: 501891 - RNA, 19 nt, Human
ucugugcugggaggcagca

SEQ ID NO: 501892 - RNA, 22 nt, Human
gcugagaguccaggaaaacauc

SEQ ID NO: 501893 - RNA, 22 nt, Human
ugcagucuccaccuccugggug

SEQ ID NO: 501894 - RNA, 20 nt, Human
cucugcugcccgccggcugc

SEQ ID NO: 501895 - RNA, 22 nt, Human
ccagcuuucugggugguuucug

SEQ ID NO: 501896 - RNA, 17 nt, Human
ucaggauccaggguucu

SEQ ID NO: 501897 - RNA, 22 nt, Human
gggcugccaagccugccugccu

SEQ ID NO: 501898 - RNA, 22 nt, Human
cuccucucaaaaguagguugac

SEQ ID NO: 501899 - RNA, 22 nt, Human
gaggcccagagagguugcauga

SEQ ID NO: 501900 - RNA, 22 nt, Human
aggagggagcuuaagccaggca

SEQ ID NO: 501901 - RNA, 22 nt, Human
ugauuacacuauuugggaauag

SEQ ID NO: 501902 - RNA, 22 nt, Human
gcaguguuguuaaaagauuaga

SEQ ID NO: 501903 - RNA, 22 nt, Human
ucagccucucugaguccagacc

SEQ ID NO: 501904 - RNA, 19 nt, Human
uccaggagcaaagccaguu

SEQ ID NO: 501905 - RNA, 22 nt, Human
ucuaaaaaagucuguucacuug

SEQ ID NO: 501906 - RNA, 22 nt, Human
caaaauucugcauuucuaauaa

SEQ ID NO: 501907 - RNA, 22 nt, Human
gcagcugcaggcaggcuugcug

SEQ ID NO: 501908 - RNA, 22 nt, Human
gaggagcuucagaggaaucuua

SEQ ID NO: 501909 - RNA, 22 nt, Human
aauguagaaugauccuuaggau

SEQ ID NO: 501910 - RNA, 22 nt, Human
aggcccuggcacugccugggag

SEQ ID NO: 501911 - RNA, 22 nt, Human
aagaagagaaaugugcugcugg

SEQ ID NO: 501912 - RNA, 22 nt, Human
aauauucaaguuauucuuucuu

SEQ ID NO: 501913 - RNA, 20 nt, Human
auauuucuuaagaacuuuca

SEQ ID NO: 501914 - RNA, 22 nt, Human
cuggguguagcccaguaugagg

SEQ ID NO: 501915 - RNA, 22 nt, Human
agucauuaauuaguaggaaggu

SEQ ID NO: 501916 - RNA, 22 nt, Human
gccuggguuccaugaucuccag

SEQ ID NO: 501917 - RNA, 22 nt, Human
ucuucaaaaauacagguuuuca

SEQ ID NO: 501918 - RNA, 22 nt, Human
uugauauuuugcacgcuuggua

SEQ ID NO: 501919 - RNA, 22 nt, Human
cagugcagguggcagaggacag

SEQ ID NO: 501920 - RNA, 22 nt, Human
ucuguaguagguuguaguucuu

SEQ ID NO: 501921 - RNA, 22 nt, Human
ugcccccuuuucuuguuacacu

SEQ ID NO: 501922 - RNA, 22 nt, Human
cagagccugccaccuuucuccc

SEQ ID NO: 501923 - RNA, 22 nt, Human
uuugggaagaggaaucucugga

SEQ ID NO: 501924 - RNA, 22 nt, Human
ucugcaggaucagagccagagg

SEQ ID NO: 501925 - RNA, 22 nt, Human
cuggagcucuucugagugugcu

SEQ ID NO: 501926 - RNA, 22 nt, Human
cagagcagguaucuuuggugaa

SEQ ID NO: 501927 - RNA, 22 nt, Human
aaugcagugagccauuaaaugg

SEQ ID NO: 501928 - RNA, 22 nt, Human
agcagggcagcugaugcgcacg

SEQ ID NO: 501929 - RNA, 22 nt, Human
cagcagcugggaaggaggcuga

SEQ ID NO: 501930 - RNA, 22 nt, Human
uuuguauuuuucccagcuagcu

SEQ ID NO: 501931 - RNA, 22 nt, Human
uugucuuaaauggauggacaau

SEQ ID NO: 501932 - RNA, 22 nt, Human
gcuggcuguaucaccuggccag

SEQ ID NO: 501933 - RNA, 17 nt, Human
uccugccaccugucagg

SEQ ID NO: 501934 - RNA, 22 nt, Human
aguauacauauauuagccuucg

SEQ ID NO: 501935 - RNA, 22 nt, Human
augcaguaaaauaggagguaau

SEQ ID NO: 501936 - RNA, 22 nt, Human
gucuuucuuaauucaagugcuu

SEQ ID NO: 501937 - RNA, 22 nt, Human
ccugagcaucagcgccuccuua

SEQ ID NO: 501938 - RNA, 22 nt, Human
gaggccuggugugucucccgcu

SEQ ID NO: 501939 - RNA, 22 nt, Human
ggcccaguguggguggauguug

SEQ ID NO: 501940 - RNA, 22 nt, Human
uccaggcagucauuaaucucua

SEQ ID NO: 501941 - RNA, 20 nt, Human
ucagccuugaaugcuugaaa

SEQ ID NO: 501942 - RNA, 22 nt, Human
cagggcugugcccaucuucccc

SEQ ID NO: 501943 - RNA, 22 nt, Human
ucugcucuaguugcuuccugcc

SEQ ID NO: 501944 - RNA, 22 nt, Human
caguuuauuuccaagaugacaa

SEQ ID NO: 501945 - RNA, 22 nt, Human
ugggagaagcauggggugcaga

SEQ ID NO: 501946 - RNA, 22 nt, Human
ugucuucaucucagacacaguu

SEQ ID NO: 501947 - RNA, 22 nt, Human
uuacagaacugucuugaaauuu

SEQ ID NO: 501948 - RNA, 22 nt, Human
gagccagacugccugaagcuca

SEQ ID NO: 501949 - RNA, 22 nt, Human
uggcaaaggaaaugauuuaaga

SEQ ID NO: 501950 - RNA, 22 nt, Human
uugggcugaacccugcagcuga

SEQ ID NO: 501951 - RNA, 22 nt, Human
auacauguuguaccauauguuu

SEQ ID NO: 501952 - RNA, 22 nt, Human
gccugagggcuccuagcaggcu

SEQ ID NO: 501953 - RNA, 22 nt, Human
acuuuuuuauaaggaagaagau

SEQ ID NO: 501954 - RNA, 22 nt, Human
agacauuauggcuuucacuggg

SEQ ID NO: 501955 - RNA, 22 nt, Human
ggcaguuucaucaggagaaaag

SEQ ID NO: 501956 - RNA, 22 nt, Human
uaaaguucuuagaacaaggccu

SEQ ID NO: 501957 - RNA, 22 nt, Human
ggugggcaggcgaggcccaggu

SEQ ID NO: 501958 - RNA, 22 nt, Human
cagggccugagggcugcucugc

SEQ ID NO: 501959 - RNA, 22 nt, Human
ccuggcuuccuggagcucacaa

SEQ ID NO: 501960 - RNA, 17 nt, Human
gcacugagccacaguuu

SEQ ID NO: 501961 - RNA, 22 nt, Human
uccucugccccagaugaaauuu

SEQ ID NO: 501962 - RNA, 22 nt, Human
gaguccaguucuuuccagcagu

SEQ ID NO: 501963 - RNA, 19 nt, Human
caaggccaccauuucuccg

SEQ ID NO: 501964 - RNA, 18 nt, Human
gguggcuggggacggaca

SEQ ID NO: 501965 - RNA, 22 nt, Human
gguggcugggauuaguagccca

SEQ ID NO: 501966 - RNA, 22 nt, Human
aaagcaaugcccguucauuauc

SEQ ID NO: 501967 - RNA, 22 nt, Human
ggguccaguuucaucugagguu

SEQ ID NO: 501968 - RNA, 22 nt, Human
uaagacacaugcguacaagaua

SEQ ID NO: 501969 - RNA, 22 nt, Human
accaaacaaaauugugcacugu

SEQ ID NO: 501970 - RNA, 22 nt, Human
cgcaggcuggcgcggaguggca

SEQ ID NO: 501971 - RNA, 22 nt, Human
acucugccccgaguucugggaa

SEQ ID NO: 501972 - RNA, 22 nt, Human
agcccuagagcuggaggucagu

SEQ ID NO: 501973 - RNA, 22 nt, Human
uuagcauucuucuggggggcac

SEQ ID NO: 501974 - RNA, 22 nt, Human
gccuggugugcgccgcgcagcu

SEQ ID NO: 501975 - RNA, 22 nt, Human
ccaggcucugugugggcuagag

SEQ ID NO: 501976 - RNA, 22 nt, Human
cccagccucuguuugcuccucu

SEQ ID NO: 501977 - RNA, 22 nt, Human
aaggccagagcguguccugccu

SEQ ID NO: 501978 - RNA, 22 nt, Human
caccagcuugggcuguggaaau

SEQ ID NO: 501979 - RNA, 22 nt, Human
ccucugagaccagcucugcacc

SEQ ID NO: 501980 - RNA, 22 nt, Human
ucccuccugcaugaggcucggc

SEQ ID NO: 501981 - RNA, 20 nt, Human
ugguccugucccacccacuc

SEQ ID NO: 501982 - RNA, 22 nt, Human
cagcuggguggcucuucugcuc

SEQ ID NO: 501983 - RNA, 22 nt, Human
cuguggcuucugcuugggccuc

SEQ ID NO: 501984 - RNA, 22 nt, Human
auaauuuacuaagcucuaccuu

SEQ ID NO: 501985 - RNA, 22 nt, Human
gcuguucauagaaauggucuca

SEQ ID NO: 501986 - RNA, 22 nt, Human
uuuaacuuagaagagauauccu

SEQ ID NO: 501987 - RNA, 22 nt, Human
agaacaauguuaaauuauuaag

SEQ ID NO: 501988 - RNA, 22 nt, Human
cagucacauugcccugcauuua

SEQ ID NO: 501989 - RNA, 22 nt, Human
uucugggcccaacccuagagug

SEQ ID NO: 501990 - RNA, 22 nt, Human
guuagggaagcgcuguguucuu

SEQ ID NO: 501991 - RNA, 22 nt, Human
ugcuccauucucuagccagugc

SEQ ID NO: 501992 - RNA, 22 nt, Human
caggagugaaaugaggcccagg

SEQ ID NO: 501993 - RNA, 22 nt, Human
gcagugcagugggacagggcgc

SEQ ID NO: 501994 - RNA, 20 nt, Human
caucaucacaugagccaauu

SEQ ID NO: 501995 - RNA, 22 nt, Human
gaaucauagaacauuaauagaa

SEQ ID NO: 501996 - RNA, 22 nt, Human
gcaguguuaaugcgaguguuca

SEQ ID NO: 501997 - RNA, 22 nt, Human
ugaguccagaugggccagcagg

SEQ ID NO: 501998 - RNA, 22 nt, Human
ggcucccaggagggccuggagg

SEQ ID NO: 501999 - RNA, 22 nt, Human
uggguccugcacugcaagcacc

SEQ ID NO: 502000 - RNA, 22 nt, Human
aaauugcucuuuaaaaguacug

SEQ ID NO: 502001 - RNA, 22 nt, Human
uccaggcuugagaccaggcucu

SEQ ID NO: 502002 - RNA, 23 nt, Human
acaggcucuuaaucagugcuccu

SEQ ID NO: 502003 - RNA, 20 nt, Human
uaggaaauauguuuuuaccc

SEQ ID NO: 502004 - RNA, 22 nt, Human
aguacuuugcacuuugcucaga

SEQ ID NO: 502005 - RNA, 22 nt, Human
ccucuuugacaaguaccugccc

SEQ ID NO: 502006 - RNA, 22 nt, Human
acuuuggacgccaugcuguuug

SEQ ID NO: 502007 - RNA, 22 nt, Human
auuuggcaacauuaauugaauc

SEQ ID NO: 502008 - RNA, 22 nt, Human
ggucucagacuggcaggcagug

SEQ ID NO: 502009 - RNA, 22 nt, Human
cucuccucagaacaggcccucu

SEQ ID NO: 502010 - RNA, 22 nt, Human
uuacaagauaacggagaaagca

SEQ ID NO: 502011 - RNA, 22 nt, Human
ggucagggcucuuccaguggcu

SEQ ID NO: 502012 - RNA, 22 nt, Human
ucagcuuuugucagaaauugua

SEQ ID NO: 502013 - RNA, 22 nt, Human
aggcuaggguaacagauguggc

SEQ ID NO: 502014 - RNA, 22 nt, Human
aucuuugugcuaauguaguucu

SEQ ID NO: 502015 - RNA, 22 nt, Human
cagcacuaauccugcaauuucu

SEQ ID NO: 502016 - RNA, 22 nt, Human
gggcucugguacuuccuggcuc

SEQ ID NO: 502017 - RNA, 22 nt, Human
cugaggucagaguuuagucugg

SEQ ID NO: 502018 - RNA, 22 nt, Human
auagcauauaaguuauaaaacu

SEQ ID NO: 502019 - RNA, 22 nt, Human
uguaccuuuuucugugcaugcu

SEQ ID NO: 502020 - RNA, 22 nt, Human
agcucagcccuccugugcagcu

SEQ ID NO: 502021 - RNA, 22 nt, Human
ggccucucuccuuggcuugcag

SEQ ID NO: 502022 - RNA, 23 nt, Human
uccagcagccaagaaggguagaa

SEQ ID NO: 502023 - RNA, 22 nt, Human
ggcugccugccuccaagccggg

SEQ ID NO: 502024 - RNA, 23 nt, Human
uaaauuaccuuuccagugcaggg

SEQ ID NO: 502025 - RNA, 22 nt, Human
agggaguguaaauggugcucag

SEQ ID NO: 502026 - RNA, 19 nt, Human
ugggcuuccccagggcaga

SEQ ID NO: 502027 - RNA, 22 nt, Human
aaggcugccucugccagaggag

SEQ ID NO: 502028 - RNA, 22 nt, Human
ucucaguggguuaaaagagaag

SEQ ID NO: 502029 - RNA, 22 nt, Human
agaaauccugauggagucugaa

SEQ ID NO: 502030 - RNA, 22 nt, Human
ucagagcuuuggagaccaggaa

SEQ ID NO: 502031 - RNA, 22 nt, Human
cuccagugagcgcggggcaugg

SEQ ID NO: 502032 - RNA, 22 nt, Human
cgcauccagggcgcaggaucug

SEQ ID NO: 502033 - RNA, 22 nt, Human
auuuuacuucauuugaaaugcc

SEQ ID NO: 502034 - RNA, 22 nt, Human
ggccagaggugguacauagcuu

SEQ ID NO: 502035 - RNA, 22 nt, Human
ggcuucugcucagccugcacgc

SEQ ID NO: 502036 - RNA, 22 nt, Human
ucuguggccuguguccaagugc

SEQ ID NO: 502037 - RNA, 22 nt, Human
caguggagagacuuuuacucuu

SEQ ID NO: 502038 - RNA, 22 nt, Human
aagagauguggaaucauuuaca

SEQ ID NO: 502039 - RNA, 22 nt, Human
auagaauagcauagaaaauuga

SEQ ID NO: 502040 - RNA, 22 nt, Human
ugaaucaauaguugcaaguauu

SEQ ID NO: 502041 - RNA, 20 nt, Human
ggguccaggacucugaauuu

SEQ ID NO: 502042 - RNA, 22 nt, Human
ugacaaagacaaagauaugucc

SEQ ID NO: 502043 - RNA, 22 nt, Human
aagacagaccacgugacagggc

SEQ ID NO: 502044 - RNA, 22 nt, Human
caggagacaaguuagcagcuga

SEQ ID NO: 502045 - RNA, 17 nt, Human
gccugcaggcccgcaga

SEQ ID NO: 502046 - RNA, 23 nt, Human
uggggagaguuacccuggaagcg

SEQ ID NO: 502047 - RNA, 22 nt, Human
uagauauaagguccuuagaaca

SEQ ID NO: 502048 - RNA, 22 nt, Human
gaggccacaguccugaggcauc

SEQ ID NO: 502049 - RNA, 22 nt, Human
uauuucugucagccagauaugg

SEQ ID NO: 502050 - RNA, 22 nt, Human
aagccagccagugccagucuua

SEQ ID NO: 502051 - RNA, 22 nt, Human
uuauguauggauggcugaaagu

SEQ ID NO: 502052 - RNA, 23 nt, Human
ugucccagagggagggauaggcu

SEQ ID NO: 502053 - RNA, 22 nt, Human
agagccagcauuugggcccugc

SEQ ID NO: 502054 - RNA, 22 nt, Human
ugcacagcuggcucuccuuuuc

SEQ ID NO: 502055 - RNA, 22 nt, Human
aaaaaauuccauucugugccuu

SEQ ID NO: 502056 - RNA, 22 nt, Human
cauuucugcagaauugcucuuc

SEQ ID NO: 502057 - RNA, 22 nt, Human
gugagggcaaauuagaaucaaa

SEQ ID NO: 502058 - RNA, 22 nt, Human
guucauuuuacuguaaauagca

SEQ ID NO: 502059 - RNA, 22 nt, Human
acagacaguaaauaguguggcu

SEQ ID NO: 502060 - RNA, 22 nt, Human
cugggcagcacaucaucguauc

SEQ ID NO: 502061 - RNA, 22 nt, Human
gaguggguaaaggugcuuggcu

SEQ ID NO: 502062 - RNA, 22 nt, Human
auugucgcuuauuuaggugcuu

SEQ ID NO: 502063 - RNA, 22 nt, Human
caggcaggugcagauuccucuu

SEQ ID NO: 502064 - RNA, 22 nt, Human
aguagggagaccggaggccgcc

SEQ ID NO: 502065 - RNA, 22 nt, Human
ggcugggcucgcugauuggcug

SEQ ID NO: 502066 - RNA, 22 nt, Human
uuucucaaauacuguuccagga

SEQ ID NO: 502067 - RNA, 22 nt, Human
cagagaaagggugaauuccuuc

SEQ ID NO: 502068 - RNA, 22 nt, Human
gcugugcugauucauucccugc

SEQ ID NO: 502069 - RNA, 22 nt, Human
cuggccugagcacagcggcugc

SEQ ID NO: 502070 - RNA, 22 nt, Human
ucuccaaauaguuauauuuaga

SEQ ID NO: 502071 - RNA, 22 nt, Human
agaggggcucaagcaguggucu

SEQ ID NO: 502072 - RNA, 22 nt, Human
ugcucagugagucugugacagg

SEQ ID NO: 502073 - RNA, 22 nt, Human
gacagcauuccaucugcagguu

SEQ ID NO: 502074 - RNA, 22 nt, Human
gcugaggccucagaaggcugag

SEQ ID NO: 502075 - RNA, 22 nt, Human
augcuggucugcagaguuggga

SEQ ID NO: 502076 - RNA, 22 nt, Human
gaaggcuugcagcucuguggca

SEQ ID NO: 502077 - RNA, 22 nt, Human
aaggaaccauuugugugcaugg

SEQ ID NO: 502078 - RNA, 19 nt, Human
auaaauaaaaagugggaga

SEQ ID NO: 502079 - RNA, 23 nt, Human
ucuccagugucucuucauugagu

SEQ ID NO: 502080 - RNA, 22 nt, Human
aggugcuguuugucagcaguuu

SEQ ID NO: 502081 - RNA, 22 nt, Human
ugauuuccacagucaggggugc

SEQ ID NO: 502082 - RNA, 22 nt, Human
agcugcuguuucuugcacguau

SEQ ID NO: 502083 - RNA, 17 nt, Human
agugugugaaauggugg

SEQ ID NO: 502084 - RNA, 22 nt, Human
accagugucuuauugaccaucu

SEQ ID NO: 502085 - RNA, 22 nt, Human
uucugugaaacuaaagagagga

SEQ ID NO: 502086 - RNA, 18 nt, Human
agaaggagcuaugggcag

SEQ ID NO: 502087 - RNA, 22 nt, Human
aauaguguuguucacucaggag

SEQ ID NO: 502088 - RNA, 22 nt, Human
aaguuuugaaauacugaagugu

SEQ ID NO: 502089 - RNA, 22 nt, Human
cugcagccuaggugcagcuggg

SEQ ID NO: 502090 - RNA, 22 nt, Human
gcaggaugguggaaggccugcu

SEQ ID NO: 502091 - RNA, 22 nt, Human
cucugcaggggaggcaugcacu

SEQ ID NO: 502092 - RNA, 22 nt, Human
uccaggcaugguguaauuuugc

SEQ ID NO: 502093 - RNA, 22 nt, Human
ggucugagugccagggagagaa

SEQ ID NO: 502094 - RNA, 22 nt, Human
ugagccuggguggucgaggcug

SEQ ID NO: 502095 - RNA, 22 nt, Human
ucucuguaguugggcagcugcu

SEQ ID NO: 502096 - RNA, 22 nt, Human
cuggcugcuuguuuugaugggu

SEQ ID NO: 502097 - RNA, 22 nt, Human
gauuucaaggaguuuucacagu

SEQ ID NO: 502098 - RNA, 22 nt, Human
acacauuucucuuuuuguaagu

SEQ ID NO: 502099 - RNA, 22 nt, Human
gaggucugggcuugggccuggu

SEQ ID NO: 502100 - RNA, 22 nt, Human
uggccaggcuggucuggaacgc

SEQ ID NO: 502101 - RNA, 22 nt, Human
agugaccaucuaacgccuguga

SEQ ID NO: 502102 - RNA, 22 nt, Human
guuucacagucugcagaauuuu

SEQ ID NO: 502103 - RNA, 22 nt, Human
ugcaggcucucugcugccagau

SEQ ID NO: 502104 - RNA, 22 nt, Human
uauuuucuguggaggaccagau

SEQ ID NO: 502105 - RNA, 22 nt, Human
ccagcugcuugggaaaaugucu

SEQ ID NO: 502106 - RNA, 22 nt, Human
guggagaggaacccagcucugu

SEQ ID NO: 502107 - RNA, 22 nt, Human
uccagaccauggauggcugcaa

SEQ ID NO: 502108 - RNA, 23 nt, Human
agcuccagaacauagcacaggaa

SEQ ID NO: 502109 - RNA, 22 nt, Human
ccagugcgagccugugcuggcc

SEQ ID NO: 502110 - RNA, 22 nt, Human
auuucucaguuccuacuguuua

SEQ ID NO: 502111 - RNA, 22 nt, Human
ugggcucauggcccagcacugg

SEQ ID NO: 502112 - RNA, 19 nt, Human
uguggcugagcacuccuua

SEQ ID NO: 502113 - RNA, 22 nt, Human
ccaggcucaccuggagccccug

SEQ ID NO: 502114 - RNA, 22 nt, Human
cagcuauuuucucauuaaggau

SEQ ID NO: 502115 - RNA, 22 nt, Human
cucuggcuggcaccugaucuga

SEQ ID NO: 502116 - RNA, 22 nt, Human
agcuggguguguaucagauaaa

SEQ ID NO: 502117 - RNA, 22 nt, Human
gucaaguuuauccgcucauuca

SEQ ID NO: 502118 - RNA, 22 nt, Human
uggcagcuuccugcucauagga

SEQ ID NO: 502119 - RNA, 22 nt, Human
gcagcuggacccacacggcuua

SEQ ID NO: 502120 - RNA, 22 nt, Human
cugagaggugacagcgugcugg

SEQ ID NO: 502121 - RNA, 22 nt, Human
uuugcauuucuaaugagcuccg

SEQ ID NO: 502122 - RNA, 22 nt, Human
aggagggauagaaaaauacuug

SEQ ID NO: 502123 - RNA, 22 nt, Human
ggcgggugcacagacccuuccc

SEQ ID NO: 502124 - RNA, 22 nt, Human
uaguccagccuuggguguagcc

SEQ ID NO: 502125 - RNA, 20 nt, Human
ugcauggcgcacaucugugg

SEQ ID NO: 502126 - RNA, 22 nt, Human
ugaggcagggaguuuaauuguc

SEQ ID NO: 502127 - RNA, 22 nt, Human
cacccagcauuggcuaagagag

SEQ ID NO: 502128 - RNA, 22 nt, Human
ugugugcagccucugucuuugg

SEQ ID NO: 502129 - RNA, 19 nt, Human
cucuggccucuggaugcug

SEQ ID NO: 502130 - RNA, 22 nt, Human
gggacuggcacagggcugggag

SEQ ID NO: 502131 - RNA, 22 nt, Human
uuuccuaagguagugauaauuu

SEQ ID NO: 502132 - RNA, 22 nt, Human
gagugaugucuguagugaagaa

SEQ ID NO: 502133 - RNA, 22 nt, Human
ugagcacagcuuucacuagaaa

SEQ ID NO: 502134 - RNA, 22 nt, Human
cagggagcuggcuggcgugagu

SEQ ID NO: 502135 - RNA, 22 nt, Human
uagugcaacagggaaagagugu

SEQ ID NO: 502136 - RNA, 22 nt, Human
auucagcugacuuugauucauu

SEQ ID NO: 502137 - RNA, 22 nt, Human
acagcucuuaggcagaaccaac

SEQ ID NO: 502138 - RNA, 22 nt, Human
acacacuuuaaauuaaaccucu

SEQ ID NO: 502139 - RNA, 22 nt, Human
acuugaauuauauuucuagaga

SEQ ID NO: 502140 - RNA, 22 nt, Human
agggcucuguccccagaggccc

SEQ ID NO: 502141 - RNA, 22 nt, Human
ugccaggccaaugaaggcaggg

SEQ ID NO: 502142 - RNA, 22 nt, Human
aagguccacaacugguaaaugg

SEQ ID NO: 502143 - RNA, 22 nt, Human
aaugugaaaccgcacagaauaa

SEQ ID NO: 502144 - RNA, 22 nt, Human
ggauccuucuuugaccucacag

SEQ ID NO: 502145 - RNA, 22 nt, Human
cagcaggaaacuuaaagguaau

SEQ ID NO: 502146 - RNA, 22 nt, Human
agcaggcuuacuuucugauuag

SEQ ID NO: 502147 - RNA, 22 nt, Human
aaaugcaaggcacauuccuuuu

SEQ ID NO: 502148 - RNA, 22 nt, Human
ccagggcauccucacaucgcag

SEQ ID NO: 502149 - RNA, 22 nt, Human
gaaaggccauuucugaggguuu

SEQ ID NO: 502150 - RNA, 22 nt, Human
uuaucguacgcuucagaaauuu

SEQ ID NO: 502151 - RNA, 22 nt, Human
ucauuaaucccgggguccaggg

SEQ ID NO: 502152 - RNA, 19 nt, Human
ugcccugcacgcuguccug

SEQ ID NO: 502153 - RNA, 22 nt, Human
uuacaaagagaaguuguagaau

SEQ ID NO: 502154 - RNA, 22 nt, Human
ggagaaggcgaagucauucuuu

SEQ ID NO: 502155 - RNA, 22 nt, Human
uggcaauguaggcaagaacauu

SEQ ID NO: 502156 - RNA, 22 nt, Human
aaaacuguaggaauugggugcc

SEQ ID NO: 502157 - RNA, 22 nt, Human
gcuguacaaauuccacaagaga

SEQ ID NO: 502158 - RNA, 20 nt, Human
uggagccacagucagguucc

SEQ ID NO: 502159 - RNA, 22 nt, Human
ucucuggcagacuggcugggcu

SEQ ID NO: 502160 - RNA, 18 nt, Human
uggagccagcucuaggau

SEQ ID NO: 502161 - RNA, 22 nt, Human
aggcacagauuuggggaaagca

SEQ ID NO: 502162 - RNA, 22 nt, Human
uccagggcaggugcugggcucu

SEQ ID NO: 502163 - RNA, 22 nt, Human
agggucugaccaccaguaggga

SEQ ID NO: 502164 - RNA, 22 nt, Human
ugaugaauuaguaacaaaugag

SEQ ID NO: 502165 - RNA, 22 nt, Human
ugcaccauuaauuuaugugaga

SEQ ID NO: 502166 - RNA, 20 nt, Human
gaaauucucguauuaguuua

SEQ ID NO: 502167 - RNA, 22 nt, Human
uucauauaaauggaaucagaau

SEQ ID NO: 502168 - RNA, 22 nt, Human
uagagcuauuuagagcauuuua

SEQ ID NO: 502169 - RNA, 22 nt, Human
gcagcauccugggccacagucc

SEQ ID NO: 502170 - RNA, 22 nt, Human
gcagugcugaucccauggcaga

SEQ ID NO: 502171 - RNA, 22 nt, Human
cccugcagccuugcaugccuuc

SEQ ID NO: 502172 - RNA, 22 nt, Human
uuauacuaaaacgcauugaauu

SEQ ID NO: 502173 - RNA, 22 nt, Human
aggcuucccagcugagcucagc

SEQ ID NO: 502174 - RNA, 22 nt, Human
gccuggugcuaugagggccagc

SEQ ID NO: 502175 - RNA, 22 nt, Human
aacacagacauagugauuacag

SEQ ID NO: 502176 - RNA, 22 nt, Human
gcucaguguuucugguagaaaa

SEQ ID NO: 502177 - RNA, 18 nt, Human
ccagagcuggcuccucgc

SEQ ID NO: 502178 - RNA, 22 nt, Human
ucaaaacacuauuaccuuuaau

SEQ ID NO: 502179 - RNA, 22 nt, Human
gcucaagggaugggagugggug

SEQ ID NO: 502180 - RNA, 22 nt, Human
ucucugcugagaagggcuggca

SEQ ID NO: 502181 - RNA, 22 nt, Human
uccugggaaguugcaucaccgu

SEQ ID NO: 502182 - RNA, 17 nt, Human
aggugcuggagcaucag

SEQ ID NO: 502183 - RNA, 22 nt, Human
acugucaccaucagagcgggaa

SEQ ID NO: 502184 - RNA, 22 nt, Human
caguccuggagcccuucuuggc

SEQ ID NO: 502185 - RNA, 22 nt, Human
agagccagcaagugaauaguga

SEQ ID NO: 502186 - RNA, 22 nt, Human
cugggcuuugguacugugauua

SEQ ID NO: 502187 - RNA, 20 nt, Human
aucaggauucuugcuuuguu

SEQ ID NO: 502188 - RNA, 22 nt, Human
aauaugcaaagcguguuaucug

SEQ ID NO: 502189 - RNA, 22 nt, Human
uguugauuugugggcugcaaaa

SEQ ID NO: 502190 - RNA, 22 nt, Human
ucuucauuccguagauauuuau

SEQ ID NO: 502191 - RNA, 22 nt, Human
ggccacacucugguagagguga

SEQ ID NO: 502192 - RNA, 22 nt, Human
agaagaaaugaggccguucugc

SEQ ID NO: 502193 - RNA, 22 nt, Human
ugaaaaaccucaguccgcuuua

SEQ ID NO: 502194 - RNA, 21 nt, Human
gcugccaccgcgugcuccagg

SEQ ID NO: 502195 - RNA, 22 nt, Human
agcaguuguagucauggaaaau

SEQ ID NO: 502196 - RNA, 22 nt, Human
uucuucaaaauccagcaugauu

SEQ ID NO: 502197 - RNA, 22 nt, Human
ccaggggcuggugcugagcugg

SEQ ID NO: 502198 - RNA, 22 nt, Human
uggcucaggggucuggcucugu

SEQ ID NO: 502199 - RNA, 21 nt, Human
ccaggaaggacugagcucccu

SEQ ID NO: 502200 - RNA, 22 nt, Human
aaauccuaaugacaaguuuagu

SEQ ID NO: 502201 - RNA, 22 nt, Human
gcugucacaaauauuucucagc

SEQ ID NO: 502202 - RNA, 19 nt, Human
uuagggacaugaauucuag

SEQ ID NO: 502203 - RNA, 22 nt, Human
cugaaugaggaaaagagugagg

SEQ ID NO: 502204 - RNA, 23 nt, Human
ccagggcuacgggcaccguccug

SEQ ID NO: 502205 - RNA, 22 nt, Human
aauuuucugguguguaaugaag

SEQ ID NO: 502206 - RNA, 22 nt, Human
uggcagaguggaccauacucaa

SEQ ID NO: 502207 - RNA, 22 nt, Human
agcccuccucacaucagcgucc

SEQ ID NO: 502208 - RNA, 22 nt, Human
ugggagcugggguuggacgucu

SEQ ID NO: 502209 - RNA, 22 nt, Human
acagagccaaaaggacauagua

SEQ ID NO: 502210 - RNA, 22 nt, Human
cuggugggagcagcaggcagcu

SEQ ID NO: 502211 - RNA, 22 nt, Human
gaugaagcuuugaagucuaauc

SEQ ID NO: 502212 - RNA, 22 nt, Human
ucccuguggauaucugcagcug

SEQ ID NO: 502213 - RNA, 22 nt, Human
aauuucucgguuuugauauugu

SEQ ID NO: 502214 - RNA, 22 nt, Human
caaguauuuccugauggccugu

SEQ ID NO: 502215 - RNA, 22 nt, Human
auguucuuccaaaucuguaaca

SEQ ID NO: 502216 - RNA, 22 nt, Human
gugguaaucggauucuuaccgg

SEQ ID NO: 502217 - RNA, 22 nt, Human
ucaucaaagucaaagaaugacu

SEQ ID NO: 502218 - RNA, 22 nt, Human
ccugggcugaagucaagugugg

SEQ ID NO: 502219 - RNA, 22 nt, Human
cucuggaauguuuacaugcccu

SEQ ID NO: 502220 - RNA, 22 nt, Human
ggcugugcgggcagccguggga

SEQ ID NO: 502221 - RNA, 19 nt, Human
agcucuuugcugcauucca

SEQ ID NO: 502222 - RNA, 22 nt, Human
gugagcaguugugagccccaaa

SEQ ID NO: 502223 - RNA, 21 nt, Human
cuccugggcuaagauauagug

SEQ ID NO: 502224 - RNA, 22 nt, Human
augugcauuaaaugucaauguu

SEQ ID NO: 502225 - RNA, 22 nt, Human
acucugggauuguuucugguau

SEQ ID NO: 502226 - RNA, 22 nt, Human
ccugagggcgccgagcucccag

SEQ ID NO: 502227 - RNA, 22 nt, Human
cacacaucuuaucccaguuauu

SEQ ID NO: 502228 - RNA, 22 nt, Human
uccuucaguuaucacaguacug

SEQ ID NO: 502229 - RNA, 22 nt, Human
ggcacugaucugauuucccucc

SEQ ID NO: 502230 - RNA, 22 nt, Human
aaaguuuguugcuuacaaagaa

SEQ ID NO: 502231 - RNA, 22 nt, Human
agaaauguuguggguuuuguua

SEQ ID NO: 502232 - RNA, 22 nt, Human
auaauuaucucagacacuuguu

SEQ ID NO: 502233 - RNA, 22 nt, Human
guggaauuuuuaccuaugaaug

SEQ ID NO: 502234 - RNA, 22 nt, Human
uuuuauuaucuuugaaugggac

SEQ ID NO: 502235 - RNA, 22 nt, Human
auuccaaagccugaauaaugga

SEQ ID NO: 502236 - RNA, 22 nt, Human
gcuggcucugccccaccuguuc

SEQ ID NO: 502237 - RNA, 23 nt, Human
auuuuuagccucucugagcugag

SEQ ID NO: 502238 - RNA, 22 nt, Human
uuuaucaaacaaauuauccagc

SEQ ID NO: 502239 - RNA, 22 nt, Human
aguccagugucaaggugccauu

SEQ ID NO: 502240 - RNA, 22 nt, Human
acaugcauacaagcacauguag

SEQ ID NO: 502241 - RNA, 22 nt, Human
ccuggguccacccugugaagua

SEQ ID NO: 502242 - RNA, 22 nt, Human
ggcucucuccuuggcuuucaga

SEQ ID NO: 502243 - RNA, 22 nt, Human
gggcuggcugauuuuccucucu

SEQ ID NO: 502244 - RNA, 22 nt, Human
aaugggagguaguaugggaggu

SEQ ID NO: 502245 - RNA, 22 nt, Human
cuuccaaagcacuuuauggacc

SEQ ID NO: 502246 - RNA, 20 nt, Human
cccucccagaugcuucccaa

SEQ ID NO: 502247 - RNA, 22 nt, Human
gguggccuccagggcauaggug

SEQ ID NO: 502248 - RNA, 22 nt, Human
ugguccuggugcaagugcauuu

SEQ ID NO: 502249 - RNA, 22 nt, Human
ggccugaggccaccagcagccc

SEQ ID NO: 502250 - RNA, 22 nt, Human
cacaggagagcugggaggugcc

SEQ ID NO: 502251 - RNA, 22 nt, Human
agccaagcacucaacuccugga

SEQ ID NO: 502252 - RNA, 22 nt, Human
agaaaucugacugcugugcaca

SEQ ID NO: 502253 - RNA, 21 nt, Human
acaugcauagagagauuucug

SEQ ID NO: 502254 - RNA, 22 nt, Human
cuccuggcucgcccccagcuga

SEQ ID NO: 502255 - RNA, 22 nt, Human
gagcuuuaagggauaaaaugau

SEQ ID NO: 502256 - RNA, 22 nt, Human
ucaggcuggaaugcaguggggc

SEQ ID NO: 502257 - RNA, 22 nt, Human
uuuguuugccacacaaaacagu

SEQ ID NO: 502258 - RNA, 22 nt, Human
caucaugucugcaggaaugugu

SEQ ID NO: 502259 - RNA, 22 nt, Human
agccagagcugaugucauucuc

SEQ ID NO: 502260 - RNA, 22 nt, Human
guccucaggaaagcagauaaca

SEQ ID NO: 502261 - RNA, 22 nt, Human
ccagcuccggugugcuuauuuc

SEQ ID NO: 502262 - RNA, 22 nt, Human
uuucuguaauuaaaagggcagg

SEQ ID NO: 502263 - RNA, 22 nt, Human
auuuuuaugacaaaccauccuc

SEQ ID NO: 502264 - RNA, 22 nt, Human
aucugggcagggcagcaaggcg

SEQ ID NO: 502265 - RNA, 22 nt, Human
guggccugggguuuguucugag

SEQ ID NO: 502266 - RNA, 20 nt, Human
cagaggcaaggagacuugga

SEQ ID NO: 502267 - RNA, 22 nt, Human
uacauuccuguuagcaucuaag

SEQ ID NO: 502268 - RNA, 22 nt, Human
gcaucuucacacaaagccagug

SEQ ID NO: 502269 - RNA, 19 nt, Human
gcucaacagcucggguccu

SEQ ID NO: 502270 - RNA, 21 nt, Human
gagacagacuuucguccccug

SEQ ID NO: 502271 - RNA, 23 nt, Human
cucugcaggagagugggcagggc

SEQ ID NO: 502272 - RNA, 22 nt, Human
auaauuuacaacugcuuuuaau

SEQ ID NO: 502273 - RNA, 21 nt, Human
auucugaguugucagucuuca

SEQ ID NO: 502274 - RNA, 22 nt, Human
guuguaaguuuaaugucaauug

SEQ ID NO: 502275 - RNA, 22 nt, Human
ccucccuuggccauagccagcc

SEQ ID NO: 502276 - RNA, 22 nt, Human
gauguacaagauuguaggaaug

SEQ ID NO: 502277 - RNA, 22 nt, Human
cuggcugguccucggggacagc

SEQ ID NO: 502278 - RNA, 22 nt, Human
auguugagagcugagaucagcc

SEQ ID NO: 502279 - RNA, 22 nt, Human
ugguccuggccuugaccccagg

SEQ ID NO: 502280 - RNA, 22 nt, Human
ugucugucugcaagccagaaag

SEQ ID NO: 502281 - RNA, 22 nt, Human
uucacaagucauuagcugcaua

SEQ ID NO: 502282 - RNA, 22 nt, Human
uacaagacgagggaaguucuuu

SEQ ID NO: 502283 - RNA, 22 nt, Human
agagccuugaagaucuggaaaa

SEQ ID NO: 502284 - RNA, 22 nt, Human
ugcacuuugcaggcauggaaac

SEQ ID NO: 502285 - RNA, 19 nt, Human
cugucaggggcuggauguu

SEQ ID NO: 502286 - RNA, 22 nt, Human
uugaaauagaugcgucagagau

SEQ ID NO: 502287 - RNA, 22 nt, Human
ugugucuguccucgguugaugc

SEQ ID NO: 502288 - RNA, 22 nt, Human
accaaggaagagauucucaguu

SEQ ID NO: 502289 - RNA, 22 nt, Human
aaaggagacuucagaucuccuu

SEQ ID NO: 502290 - RNA, 22 nt, Human
cccaggcugguccugaacuccu

SEQ ID NO: 502291 - RNA, 22 nt, Human
ugccccucgacgcaaugaaggg

SEQ ID NO: 502292 - RNA, 22 nt, Human
gagcuuggccucuugaacgugg

SEQ ID NO: 502293 - RNA, 22 nt, Human
acaaaguccugguguauggcca

SEQ ID NO: 502294 - RNA, 22 nt, Human
auuaaauacugcaggcuaagca

SEQ ID NO: 502295 - RNA, 22 nt, Human
cucagcacacucccaucuaauu

SEQ ID NO: 502296 - RNA, 22 nt, Human
uucuuuuaaugucuggcuuuca

SEQ ID NO: 502297 - RNA, 22 nt, Human
gccugggugaauuugauccuaa

SEQ ID NO: 502298 - RNA, 22 nt, Human
cugggcugcaucaaagaggcau

SEQ ID NO: 502299 - RNA, 22 nt, Human
guugggaaggcaagaaguagaa

SEQ ID NO: 502300 - RNA, 22 nt, Human
cagcacagugaccagacccacu

SEQ ID NO: 502301 - RNA, 22 nt, Human
agcacuagagccaaaauuuggg

SEQ ID NO: 502302 - RNA, 22 nt, Human
ccaggcugggcuacaaguugag

SEQ ID NO: 502303 - RNA, 22 nt, Human
aggagcugacuuguaaagcauu

SEQ ID NO: 502304 - RNA, 22 nt, Human
uauguacauggagagcaauuga

SEQ ID NO: 502305 - RNA, 22 nt, Human
cugcuguguuccuccugcaucu

SEQ ID NO: 502306 - RNA, 22 nt, Human
ucccagagcugauaagccuuua

SEQ ID NO: 502307 - RNA, 22 nt, Human
uccucaggugacuagguaucuu

SEQ ID NO: 502308 - RNA, 22 nt, Human
cugcuggggucagagcacuggg

SEQ ID NO: 502309 - RNA, 22 nt, Human
agccagacauggcuccugcucc

SEQ ID NO: 502310 - RNA, 22 nt, Human
ucugagagagggucagaugcua

SEQ ID NO: 502311 - RNA, 22 nt, Human
uuagaauuauuguuuccuucua

SEQ ID NO: 502312 - RNA, 22 nt, Human
gugugcaguagagaaagagcag

SEQ ID NO: 502313 - RNA, 22 nt, Human
uucaaugagcccaagaacguga

SEQ ID NO: 502314 - RNA, 22 nt, Human
agcagcuuaucuuggagaggca

SEQ ID NO: 502315 - RNA, 22 nt, Human
uuauuuaauuuucucacucaga

SEQ ID NO: 502316 - RNA, 22 nt, Human
ggcagcuguaagaugagugaau

SEQ ID NO: 502317 - RNA, 22 nt, Human
ugccugucuccucugcagggug

SEQ ID NO: 502318 - RNA, 22 nt, Human
uuccugggcugcagagagcacc

SEQ ID NO: 502319 - RNA, 22 nt, Human
cuaggcuguaaagagcuaggag

SEQ ID NO: 502320 - RNA, 22 nt, Human
cugagccaaccacagcaggagc

SEQ ID NO: 502321 - RNA, 22 nt, Human
cuggaaggcggagguuguagug

SEQ ID NO: 502322 - RNA, 21 nt, Human
ugccuggccuuugcuuuuccu

SEQ ID NO: 502323 - RNA, 22 nt, Human
caguccugggagacuuacccag

SEQ ID NO: 502324 - RNA, 22 nt, Human
auucauucugaccucaagagaa

SEQ ID NO: 502325 - RNA, 21 nt, Human
uugcacagaaaaccauagaga

SEQ ID NO: 502326 - RNA, 20 nt, Human
gcagcugcccccagucccug

SEQ ID NO: 502327 - RNA, 22 nt, Human
caggaaagccgagugccauagg

SEQ ID NO: 502328 - RNA, 22 nt, Human
gagccagguuggaggcugcagu

SEQ ID NO: 502329 - RNA, 22 nt, Human
cauuuguguccgucccaguucu

SEQ ID NO: 502330 - RNA, 19 nt, Human
aggucugcagcugcaguuu

SEQ ID NO: 502331 - RNA, 22 nt, Human
ugcuggccaagcagaggucaau

SEQ ID NO: 502332 - RNA, 22 nt, Human
uaugaaaagguggccaauguag

SEQ ID NO: 502333 - RNA, 22 nt, Human
uccagaggcucugagggagagu

SEQ ID NO: 502334 - RNA, 18 nt, Human
aaauguacuguccauggc

SEQ ID NO: 502335 - RNA, 22 nt, Human
agggccaggcucccaugucagg

SEQ ID NO: 502336 - RNA, 20 nt, Human
uggccuuggggagcucacac

SEQ ID NO: 502337 - RNA, 21 nt, Human
agccuggcccagggggaggcu

SEQ ID NO: 502338 - RNA, 22 nt, Human
gagcugucucuauaugaaugcu

SEQ ID NO: 502339 - RNA, 22 nt, Human
uccaugucuucaugugucuaac

SEQ ID NO: 502340 - RNA, 22 nt, Human
auucuggacaaggcaagcuccu

SEQ ID NO: 502341 - RNA, 22 nt, Human
cucaggauuuaaaggggcacuc

SEQ ID NO: 502342 - RNA, 22 nt, Human
aggcuucuugagccccacaggc

SEQ ID NO: 502343 - RNA, 22 nt, Human
cccagcucuuuuagcggcaucu

SEQ ID NO: 502344 - RNA, 22 nt, Human
caggaaggcccaccuguccugu

SEQ ID NO: 502345 - RNA, 22 nt, Human
cugauucuuugaagaugcaccc

SEQ ID NO: 502346 - RNA, 22 nt, Human
uagugcaaaggcccugagaugg

SEQ ID NO: 502347 - RNA, 22 nt, Human
gagucauugcacacuagcucag

SEQ ID NO: 502348 - RNA, 22 nt, Human
uaaaguguaugccaucucucau

SEQ ID NO: 502349 - RNA, 22 nt, Human
aaaugcaaggccaugugaagga

SEQ ID NO: 502350 - RNA, 22 nt, Human
ccacuaguuuaauaccuuccuu

SEQ ID NO: 502351 - RNA, 22 nt, Human
acugagcugcuugaagugaacu

SEQ ID NO: 502352 - RNA, 22 nt, Human
ggcagguggacgugcuaaagcu

SEQ ID NO: 502353 - RNA, 21 nt, Human
uggcucugagccucauggcug

SEQ ID NO: 502354 - RNA, 22 nt, Human
ggugggcacccgagacuggauc

SEQ ID NO: 502355 - RNA, 22 nt, Human
cugggccugccaccaucuuagg

SEQ ID NO: 502356 - RNA, 22 nt, Human
gccaacaggccuugcucugcuc

SEQ ID NO: 502357 - RNA, 22 nt, Human
cuauuauuuccucaucuauaaa

SEQ ID NO: 502358 - RNA, 22 nt, Human
guagaauuaccucucuaugucc

SEQ ID NO: 502359 - RNA, 22 nt, Human
uccagcuggggcaguggcuggg

SEQ ID NO: 502360 - RNA, 22 nt, Human
uugcagcugugagcuuuacacg

SEQ ID NO: 502361 - RNA, 22 nt, Human
cagugggugccaucgugcccuu

SEQ ID NO: 502362 - RNA, 22 nt, Human
uguaaacagccccauggagagc

SEQ ID NO: 502363 - RNA, 22 nt, Human
ugcagccuugccuccucccagc

SEQ ID NO: 502364 - RNA, 21 nt, Human
ugcucacagaugugcucagug

SEQ ID NO: 502365 - RNA, 22 nt, Human
cuggagggagauucaaaggagg

SEQ ID NO: 502366 - RNA, 22 nt, Human
gaaaugcauaaucuuaguagau

SEQ ID NO: 502367 - RNA, 22 nt, Human
agccagagagccccagguucua

SEQ ID NO: 502368 - RNA, 22 nt, Human
aggcucugcagugcuggaggac

SEQ ID NO: 502369 - RNA, 22 nt, Human
augcuuggcguuucacuuccug

SEQ ID NO: 502370 - RNA, 22 nt, Human
agaggccagggacacugcucaa

SEQ ID NO: 502371 - RNA, 22 nt, Human
gcacagggagacagccguggcc

SEQ ID NO: 502372 - RNA, 22 nt, Human
cagagcuguugcggggcuuggc

SEQ ID NO: 502373 - RNA, 22 nt, Human
ugccaggcccagcuccagagcu

SEQ ID NO: 502374 - RNA, 22 nt, Human
cugaagccacgauagcuuccua

SEQ ID NO: 502375 - RNA, 22 nt, Human
ugaauuuaucaaagauucuuaa

SEQ ID NO: 502376 - RNA, 22 nt, Human
aggaguccucaugucugugcga

SEQ ID NO: 502377 - RNA, 22 nt, Human
acauuaacaccgugaguuuggu

SEQ ID NO: 502378 - RNA, 22 nt, Human
gaaggagacccugaagaugcug

SEQ ID NO: 502379 - RNA, 22 nt, Human
ugcucauuggcgaucugaggga

SEQ ID NO: 502380 - RNA, 22 nt, Human
caucacauuagucucaagagaa

SEQ ID NO: 502381 - RNA, 19 nt, Human
aauguaguguuaugucaac

SEQ ID NO: 502382 - RNA, 22 nt, Human
uagguucucuauugcccccaaa

SEQ ID NO: 502383 - RNA, 22 nt, Human
uccucacauggugagccacaca

SEQ ID NO: 502384 - RNA, 22 nt, Human
auguggcugguaguugacaacu

SEQ ID NO: 502385 - RNA, 22 nt, Human
agcucucugauaaauugauaaa

SEQ ID NO: 502386 - RNA, 22 nt, Human
gggcacaguacuccaaucaacu

SEQ ID NO: 502387 - RNA, 22 nt, Human
cucaaauagaacugaucuauaa

SEQ ID NO: 502388 - RNA, 22 nt, Human
gaaauacaggaaugccacacag

SEQ ID NO: 502389 - RNA, 19 nt, Human
caggaaugagguaauggcu

SEQ ID NO: 502390 - RNA, 22 nt, Human
ccugagguggcugcagcacugc

SEQ ID NO: 502391 - RNA, 22 nt, Human
agagcacagaaguuauauguua

SEQ ID NO: 502392 - RNA, 22 nt, Human
ggaugggcugaaagguagcccc

SEQ ID NO: 502393 - RNA, 19 nt, Human
aaaugugaugguacaauuc

SEQ ID NO: 502394 - RNA, 22 nt, Human
ugcaggcucacccuggagcuga

SEQ ID NO: 502395 - RNA, 22 nt, Human
agggcucagaacaaugagugua

SEQ ID NO: 502396 - RNA, 22 nt, Human
gagcagcugguaggugaaccca

SEQ ID NO: 502397 - RNA, 22 nt, Human
aucaggaucacagaaacuuuua

SEQ ID NO: 502398 - RNA, 21 nt, Human
auuuucauuaauucagugugg

SEQ ID NO: 502399 - RNA, 21 nt, Human
aggcucccagaaaugggcauc

SEQ ID NO: 502400 - RNA, 22 nt, Human
cauauuuauagaucuggcauuu

SEQ ID NO: 502401 - RNA, 22 nt, Human
aggcuuccgaguagcugggacu

SEQ ID NO: 502402 - RNA, 22 nt, Human
cccaaggccucuccuuggcuug

SEQ ID NO: 502403 - RNA, 22 nt, Human
uggcagguccacucacagaucu

SEQ ID NO: 502404 - RNA, 23 nt, Human
aacguccucaacaggauugcacc

SEQ ID NO: 502405 - RNA, 22 nt, Human
uucucauucugacucaguguag

SEQ ID NO: 502406 - RNA, 22 nt, Human
gcugccagucuaaugggaaaca

SEQ ID NO: 502407 - RNA, 22 nt, Human
uuccaagugaaaguagcuuugu

SEQ ID NO: 502408 - RNA, 22 nt, Human
cuuccuuggcuucuggggugug

SEQ ID NO: 502409 - RNA, 22 nt, Human
aggcagcauuucugcuuaucca

SEQ ID NO: 502410 - RNA, 22 nt, Human
ccagcacuccugucucaagucu

SEQ ID NO: 502411 - RNA, 22 nt, Human
ggagcuguucaggacugcuuca

SEQ ID NO: 502412 - RNA, 22 nt, Human
cuccaggguuccccgauccacu

SEQ ID NO: 502413 - RNA, 22 nt, Human
ccaucccuccuccaccagcuag

SEQ ID NO: 502414 - RNA, 22 nt, Human
aaggaaauacaacauguauuca

SEQ ID NO: 502415 - RNA, 20 nt, Human
auaaaauaacugccacaaga

SEQ ID NO: 502416 - RNA, 22 nt, Human
uggagaaugauauuccaucauu

SEQ ID NO: 502417 - RNA, 19 nt, Human
cugugcuuuaaacuccuau

SEQ ID NO: 502418 - RNA, 22 nt, Human
ccaggcuccgcauagaccccac

SEQ ID NO: 502419 - RNA, 22 nt, Human
agcauggggcaaugcaugugcu

SEQ ID NO: 502420 - RNA, 22 nt, Human
aaugagaauguaagugaagaga

SEQ ID NO: 502421 - RNA, 22 nt, Human
gggagcugagcuggaagagaau

SEQ ID NO: 502422 - RNA, 22 nt, Human
uuaacuugucagaaaauacagu

SEQ ID NO: 502423 - RNA, 21 nt, Human
ugcugaaucugccauauuuuc

SEQ ID NO: 502424 - RNA, 22 nt, Human
aggcccugcccagugccacaag

SEQ ID NO: 502425 - RNA, 22 nt, Human
agcuguguggugucugacagcu

SEQ ID NO: 502426 - RNA, 22 nt, Human
uugaggaguguuuagggugagg

SEQ ID NO: 502427 - RNA, 22 nt, Human
cuccuggggcacuuagaagcaa

SEQ ID NO: 502428 - RNA, 22 nt, Human
ucuuuaagccaagauauauuua

SEQ ID NO: 502429 - RNA, 22 nt, Human
cuuauuugaauguaugaguuuu

SEQ ID NO: 502430 - RNA, 22 nt, Human
auguaauuugcccucaaguuaa

SEQ ID NO: 502431 - RNA, 22 nt, Human
uuguuaaaacuccauugguuug

SEQ ID NO: 502432 - RNA, 22 nt, Human
gucaggauuuuaaaaucccagu

SEQ ID NO: 502433 - RNA, 22 nt, Human
uucaauucugaugaaggcaaua

SEQ ID NO: 502434 - RNA, 22 nt, Human
gggcuacauugugagagaaguu

SEQ ID NO: 502435 - RNA, 22 nt, Human
ugggaggaucgcuugagcccag

SEQ ID NO: 502436 - RNA, 22 nt, Human
cuuucucugugugguaaagggc

SEQ ID NO: 502437 - RNA, 22 nt, Human
cccugcagaucuaggguccuuc

SEQ ID NO: 502438 - RNA, 21 nt, Human
gcagacugcccugcugucccc

SEQ ID NO: 502439 - RNA, 22 nt, Human
ugcccucaagcaacagagagga

SEQ ID NO: 502440 - RNA, 22 nt, Human
cagcucugugggagcguaugug

SEQ ID NO: 502441 - RNA, 22 nt, Human
cugagggccuuggcuccugccc

SEQ ID NO: 502442 - RNA, 22 nt, Human
gccagggaacccaagggccuca

SEQ ID NO: 502443 - RNA, 22 nt, Human
aggcacugaauauccaguaaaa

SEQ ID NO: 502444 - RNA, 22 nt, Human
uuugcaaacacuuaagaagaga

SEQ ID NO: 502445 - RNA, 22 nt, Human
aagauaauauucauuaacuaga

SEQ ID NO: 502446 - RNA, 22 nt, Human
uagaauaguguuuucauuaugg

SEQ ID NO: 502447 - RNA, 22 nt, Human
uucuggaggccccuuccuucuc

SEQ ID NO: 502448 - RNA, 22 nt, Human
guuugcauguauuaagucaaua

SEQ ID NO: 502449 - RNA, 22 nt, Human
ggcccagcccgagucagccuuc

SEQ ID NO: 502450 - RNA, 22 nt, Human
ugauuuccuggcuuuggaguuc

SEQ ID NO: 502451 - RNA, 22 nt, Human
augaggauguuaguggacugga

SEQ ID NO: 502452 - RNA, 22 nt, Human
uucacagaauggcaaguuaugg

SEQ ID NO: 502453 - RNA, 22 nt, Human
cuguggcagggaagaggccaug

SEQ ID NO: 502454 - RNA, 22 nt, Human
agcccagcuuugaaccauauca

SEQ ID NO: 502455 - RNA, 22 nt, Human
uccucucugcacuggcccugcc

SEQ ID NO: 502456 - RNA, 22 nt, Human
gugcugggauuacaggugugag

SEQ ID NO: 502457 - RNA, 22 nt, Human
augaaauuaaucaacacauaca

SEQ ID NO: 502458 - RNA, 22 nt, Human
aauuaugauuggucuaaaccag

SEQ ID NO: 502459 - RNA, 22 nt, Human
uccugcagcucugagaagcauc

SEQ ID NO: 502460 - RNA, 22 nt, Human
uggcuccuaucaaggagugggu

SEQ ID NO: 502461 - RNA, 22 nt, Human
uuauucuucuucucuugccagg

SEQ ID NO: 502462 - RNA, 18 nt, Human
cucagggcaucagucugg

SEQ ID NO: 502463 - RNA, 22 nt, Human
ucagcagucacauguuguccca

SEQ ID NO: 502464 - RNA, 22 nt, Human
cagcauuucaggaggcugaggu

SEQ ID NO: 502465 - RNA, 22 nt, Human
gcacagaggaagcacagacucu

SEQ ID NO: 502466 - RNA, 22 nt, Human
guuaaccaaggcaccaagugua

SEQ ID NO: 502467 - RNA, 22 nt, Human
agcuggccuuagugagcaccug

SEQ ID NO: 502468 - RNA, 22 nt, Human
cugcaaaaguaauugcagguuu

SEQ ID NO: 502469 - RNA, 22 nt, Human
aacacagaucaaaauauuuccu

SEQ ID NO: 502470 - RNA, 22 nt, Human
ccagugcauugccgugucuagg

SEQ ID NO: 502471 - RNA, 22 nt, Human
ugggugcucugcgaccguaggg

SEQ ID NO: 502472 - RNA, 22 nt, Human
cagacaggcuagccagacucac

SEQ ID NO: 502473 - RNA, 22 nt, Human
gcccuuagccuuauagccucua

SEQ ID NO: 502474 - RNA, 22 nt, Human
aagagagucagucugagcacca

SEQ ID NO: 502475 - RNA, 18 nt, Human
gcaggugccacugcuguu

SEQ ID NO: 502476 - RNA, 21 nt, Human
uccugggggguaggugaguuu

SEQ ID NO: 502477 - RNA, 19 nt, Human
cccaguccuuguccugggc

SEQ ID NO: 502478 - RNA, 22 nt, Human
auagauuagcccuauaguuuua

SEQ ID NO: 502479 - RNA, 22 nt, Human
uucacauugguucuugauagcu

SEQ ID NO: 502480 - RNA, 22 nt, Human
accuaaaucuaccucauguuuu

SEQ ID NO: 502481 - RNA, 22 nt, Human
cagucuggcacagcacacugaa

SEQ ID NO: 502482 - RNA, 22 nt, Human
ggagcugggguuggcaucuucc

SEQ ID NO: 502483 - RNA, 22 nt, Human
agugacugguuuugacaggaau

SEQ ID NO: 502484 - RNA, 22 nt, Human
uccuugaauauaauaacaguag

SEQ ID NO: 502485 - RNA, 20 nt, Human
agaaacagcacaauucuguu

SEQ ID NO: 502486 - RNA, 20 nt, Human
agaaaauguuuucagcugga

SEQ ID NO: 502487 - RNA, 22 nt, Human
aggucuggaggcggagucagga

SEQ ID NO: 502488 - RNA, 22 nt, Human
uccucaguaaggaucgucagcu

SEQ ID NO: 502489 - RNA, 22 nt, Human
uccaguggcacuggagacuaga

SEQ ID NO: 502490 - RNA, 22 nt, Human
gcucaggacuggaggagcgggg

SEQ ID NO: 502491 - RNA, 22 nt, Human
uccagcagcccgaaggcccauc

SEQ ID NO: 502492 - RNA, 22 nt, Human
caaagaugcugauguuggauca

SEQ ID NO: 502493 - RNA, 22 nt, Human
aguuauguccucagcaaaucaa

SEQ ID NO: 502494 - RNA, 22 nt, Human
ccugugucagccccugccucca

SEQ ID NO: 502495 - RNA, 22 nt, Human
auaaauagugugucauaaaguc

SEQ ID NO: 502496 - RNA, 22 nt, Human
cagggcccaggccacuggguug

SEQ ID NO: 502497 - RNA, 22 nt, Human
ugagcacagcucgcaccagcuu

SEQ ID NO: 502498 - RNA, 22 nt, Human
ugcccuuaugaaagaggcccaa

SEQ ID NO: 502499 - RNA, 19 nt, Human
ggcaccuuucugcuguguc

SEQ ID NO: 502500 - RNA, 22 nt, Human
ugaguagacgugaucuaguaac

SEQ ID NO: 502501 - RNA, 22 nt, Human
cuucuuccugcugcagccucca

SEQ ID NO: 502502 - RNA, 22 nt, Human
uccuggcucaggccccuggugc

SEQ ID NO: 502503 - RNA, 22 nt, Human
aggagacauacuauaggaauau

SEQ ID NO: 502504 - RNA, 17 nt, Human
ggaacaaauacuaugca

SEQ ID NO: 502505 - RNA, 22 nt, Human
ucagugcagcggcagcagcucu

SEQ ID NO: 502506 - RNA, 22 nt, Human
gggugccacagagcuuccacuu

SEQ ID NO: 502507 - RNA, 22 nt, Human
ugcagccauuuucugccaaugc

SEQ ID NO: 502508 - RNA, 22 nt, Human
ucugagccguauggcuuggcua

SEQ ID NO: 502509 - RNA, 19 nt, Human
uagcuucacguggucuaga

SEQ ID NO: 502510 - RNA, 22 nt, Human
uaaagcaauuacucaguggcuu

SEQ ID NO: 502511 - RNA, 22 nt, Human
cucagagaagucuuugcuaaac

SEQ ID NO: 502512 - RNA, 22 nt, Human
cugcagggagaggggacagccu

SEQ ID NO: 502513 - RNA, 22 nt, Human
cuguuuuaucucaagaguucaa

SEQ ID NO: 502514 - RNA, 22 nt, Human
aaaguuuucugccuucauuaga

SEQ ID NO: 502515 - RNA, 22 nt, Human
caucagucccacggagcagccc

SEQ ID NO: 502516 - RNA, 22 nt, Human
guccaggaguuuccaauuaagc

SEQ ID NO: 502517 - RNA, 23 nt, Human
ucuguacaauugagaagagaaca

SEQ ID NO: 502518 - RNA, 22 nt, Human
ccacagcuagggcaaucugauu

SEQ ID NO: 502519 - RNA, 22 nt, Human
cugggcucaguggcucauggcu

SEQ ID NO: 502520 - RNA, 22 nt, Human
aguuuccuuggauucaauuugg

SEQ ID NO: 502521 - RNA, 22 nt, Human
gcuggggucugugaggagggcu

SEQ ID NO: 502522 - RNA, 22 nt, Human
ggggugggcgugcagggacacc

SEQ ID NO: 502523 - RNA, 22 nt, Human
cagugcagccaaggacaggcac

SEQ ID NO: 502524 - RNA, 22 nt, Human
uccgccaggacugagggcccau

SEQ ID NO: 502525 - RNA, 22 nt, Human
ggcagcugaccuagcaccaucc

SEQ ID NO: 502526 - RNA, 22 nt, Human
ccuaggaagcugagauugcagu

SEQ ID NO: 502527 - RNA, 22 nt, Human
agccaaagugguauauagggaa

SEQ ID NO: 502528 - RNA, 22 nt, Human
ccuggccaaucuagggcuguua

SEQ ID NO: 502529 - RNA, 22 nt, Human
ucagaggucccuagcaggagug

SEQ ID NO: 502530 - RNA, 23 nt, Human
ggauggagccacuuugaaaccac

SEQ ID NO: 502531 - RNA, 22 nt, Human
ucagcagggaggcucugugccc

SEQ ID NO: 502532 - RNA, 22 nt, Human
aauucacauguugaaguccuaa

SEQ ID NO: 502533 - RNA, 22 nt, Human
uagugcaaggauugcugcagag

SEQ ID NO: 502534 - RNA, 22 nt, Human
agguacagaugaaagucuaguu

SEQ ID NO: 502535 - RNA, 22 nt, Human
agucugcacucagguggagguc

SEQ ID NO: 502536 - RNA, 20 nt, Human
aauuagcuuaagucaaucag

SEQ ID NO: 502537 - RNA, 22 nt, Human
auuugccucugcuuucaaggau

SEQ ID NO: 502538 - RNA, 22 nt, Human
cucuggagaacgcuauggaucu

SEQ ID NO: 502539 - RNA, 22 nt, Human
gcugcucuacccaugcaucugu

SEQ ID NO: 502540 - RNA, 22 nt, Human
ccacagaagauggggagagugg

SEQ ID NO: 502541 - RNA, 22 nt, Human
gaaagugcuaggaaguguuaga

SEQ ID NO: 502542 - RNA, 22 nt, Human
auuuugaagggaauugaaguuc

SEQ ID NO: 502543 - RNA, 20 nt, Human
acauugauuauguuuguaga

SEQ ID NO: 502544 - RNA, 22 nt, Human
ucagaacagaagaaggaacacg

SEQ ID NO: 502545 - RNA, 22 nt, Human
uuugaguugcuuauuuaauagg

SEQ ID NO: 502546 - RNA, 22 nt, Human
ucccugggccacagcugugagc

SEQ ID NO: 502547 - RNA, 21 nt, Human
uccuguaagcuuggguggcuc

SEQ ID NO: 502548 - RNA, 22 nt, Human
aguuauauaacuaucuagaugc

SEQ ID NO: 502549 - RNA, 22 nt, Human
agguccuggacugcucuuguua

SEQ ID NO: 502550 - RNA, 22 nt, Human
caauaauauccugugcuguuug

SEQ ID NO: 502551 - RNA, 22 nt, Human
uccagagcagguggucagaagg

SEQ ID NO: 502552 - RNA, 22 nt, Human
cugaggccguuggugggccuua

SEQ ID NO: 502553 - RNA, 22 nt, Human
guccagagaggcaggaggcuac

SEQ ID NO: 502554 - RNA, 22 nt, Human
auuauuauuguugauguuaggg

SEQ ID NO: 502555 - RNA, 22 nt, Human
aggcccugaagucggccccuca

SEQ ID NO: 502556 - RNA, 22 nt, Human
cuguggaguggggaguacuggu

SEQ ID NO: 502557 - RNA, 22 nt, Human
caggcagcaucagucugcugua

SEQ ID NO: 502558 - RNA, 22 nt, Human
caucaucuggcuuuuagaaaaa

SEQ ID NO: 502559 - RNA, 22 nt, Human
ucagcaggcacggacaggcugc

SEQ ID NO: 502560 - RNA, 22 nt, Human
caaauagacuucaaucucuuga

SEQ ID NO: 502561 - RNA, 22 nt, Human
aaaugguaagacaacacauuau

SEQ ID NO: 502562 - RNA, 22 nt, Human
ugucccugauccacuggacccc

SEQ ID NO: 502563 - RNA, 22 nt, Human
cucuuuguggccaccuaaucuu

SEQ ID NO: 502564 - RNA, 22 nt, Human
uuugaaagcaccauuugaguag

SEQ ID NO: 502565 - RNA, 22 nt, Human
gggcacagucugcagcccccca

SEQ ID NO: 502566 - RNA, 22 nt, Human
aucuacucaguaacugcuuagg

SEQ ID NO: 502567 - RNA, 22 nt, Human
aagcagaugccaagauuuacca

SEQ ID NO: 502568 - RNA, 22 nt, Human
ucucuggcagacaccucccuga

SEQ ID NO: 502569 - RNA, 22 nt, Human
ccuucauugcaucuuuaagaga

SEQ ID NO: 502570 - RNA, 22 nt, Human
acacaguaaauauguauugaau

SEQ ID NO: 502571 - RNA, 22 nt, Human
ucuggccaacaaaaacuaaguc

SEQ ID NO: 502572 - RNA, 22 nt, Human
uuagcugcauuaucaaaguuau

SEQ ID NO: 502573 - RNA, 22 nt, Human
uugaagaggacuuugcagcugu

SEQ ID NO: 502574 - RNA, 22 nt, Human
ccagccuggagggcaguggugg

SEQ ID NO: 502575 - RNA, 22 nt, Human
uccaggcaucuguauuuuuuaa

SEQ ID NO: 502576 - RNA, 22 nt, Human
ucuguucauuugccucggcucu

SEQ ID NO: 502577 - RNA, 22 nt, Human
ccagggcaucacauccaguguu

SEQ ID NO: 502578 - RNA, 22 nt, Human
gggauggcucaaaggagucagg

SEQ ID NO: 502579 - RNA, 22 nt, Human
aaaguagaguuguggaauuacu

SEQ ID NO: 502580 - RNA, 22 nt, Human
cagaggcaggaagaugggcagu

SEQ ID NO: 502581 - RNA, 22 nt, Human
uugaaugaguguuuuacucaug

SEQ ID NO: 502582 - RNA, 22 nt, Human
uagaaucuaguucauucauuug

SEQ ID NO: 502583 - RNA, 21 nt, Human
ugcugccaucaugcagagaug

SEQ ID NO: 502584 - RNA, 22 nt, Human
uccuauugguagacauuucugu

SEQ ID NO: 502585 - RNA, 22 nt, Human
uuuauauuguaaaaaugguucu

SEQ ID NO: 502586 - RNA, 20 nt, Human
aggcacuguugucuguaucc

SEQ ID NO: 502587 - RNA, 22 nt, Human
gcccacacaccagcucaggagg

SEQ ID NO: 502588 - RNA, 22 nt, Human
cuugccuucuguuccuauagaa

SEQ ID NO: 502589 - RNA, 22 nt, Human
cucuuccucucaugcggucaua

SEQ ID NO: 502590 - RNA, 19 nt, Human
cccucaggucugagcaguc

SEQ ID NO: 502591 - RNA, 22 nt, Human
ucugugcugucucagagaaagc

SEQ ID NO: 502592 - RNA, 22 nt, Human
uauguugaucauagguaaaaga

SEQ ID NO: 502593 - RNA, 22 nt, Human
ugucacauugaauaugauuuau

SEQ ID NO: 502594 - RNA, 22 nt, Human
guguccaucagcagccacugug

SEQ ID NO: 502595 - RNA, 22 nt, Human
gcagggcugcagagggcacugu

SEQ ID NO: 502596 - RNA, 22 nt, Human
uccagggcugacuugggagagg

SEQ ID NO: 502597 - RNA, 22 nt, Human
gacugccagaaugugaggccug

SEQ ID NO: 502598 - RNA, 22 nt, Human
caguccugagccaaucaugaug

SEQ ID NO: 502599 - RNA, 22 nt, Human
cugugccacugccccaggccuc

SEQ ID NO: 502600 - RNA, 22 nt, Human
aaauagaauuaacuagcuacug

SEQ ID NO: 502601 - RNA, 23 nt, Human
cccuguagcccaggacaggcuuu

SEQ ID NO: 502602 - RNA, 22 nt, Human
guuuagaaaauagugaagcaag

SEQ ID NO: 502603 - RNA, 22 nt, Human
uuuccucugacugcuccccugc

SEQ ID NO: 502604 - RNA, 22 nt, Human
caaaagucuuccuauucucuua

SEQ ID NO: 502605 - RNA, 22 nt, Human
agguuucugcuguccuccuucu

SEQ ID NO: 502606 - RNA, 22 nt, Human
ugaaggaaagagggaacauccc

SEQ ID NO: 502607 - RNA, 22 nt, Human
augggugugaaaauggucaucu

SEQ ID NO: 502608 - RNA, 22 nt, Human
aacagacagaaaaaugugaucu

SEQ ID NO: 502609 - RNA, 22 nt, Human
gcagaggcacagccccagauga

SEQ ID NO: 502610 - RNA, 22 nt, Human
agcagagacaugaaauaugcuu

SEQ ID NO: 502611 - RNA, 22 nt, Human
cagaggcucagauggcccuggc

SEQ ID NO: 502612 - RNA, 22 nt, Human
agcuucuguucaucuuccaggc

SEQ ID NO: 502613 - RNA, 18 nt, Human
cagacacucugcucugca

SEQ ID NO: 502614 - RNA, 22 nt, Human
uuccucuggggccaggccaaca

SEQ ID NO: 502615 - RNA, 22 nt, Human
ucucuggguaugguaacguugg

SEQ ID NO: 502616 - RNA, 23 nt, Human
ucuugaaaagccuacagcaguuc

SEQ ID NO: 502617 - RNA, 22 nt, Human
uccuagaaucuuuguaagauug

SEQ ID NO: 502618 - RNA, 22 nt, Human
aggggugaaagagggcccucaa

SEQ ID NO: 502619 - RNA, 22 nt, Human
gcugcaggggggucuggacuug

SEQ ID NO: 502620 - RNA, 20 nt, Human
uggaggcaccuguggagauc

SEQ ID NO: 502621 - RNA, 22 nt, Human
agcugggaugauaaccucaguc

SEQ ID NO: 502622 - RNA, 22 nt, Human
auaaggaaaugaaacucuaaua

SEQ ID NO: 502623 - RNA, 22 nt, Human
gcagcaggagaguaauagcggu

SEQ ID NO: 502624 - RNA, 22 nt, Human
ugcugucuuccaggauggugaa

SEQ ID NO: 502625 - RNA, 22 nt, Human
cacagugcaugaugggcagaag

SEQ ID NO: 502626 - RNA, 22 nt, Human
augcagaauugcuaaguaucug

SEQ ID NO: 502627 - RNA, 22 nt, Human
uuuuuauaugaaggauagugcg

SEQ ID NO: 502628 - RNA, 22 nt, Human
uggggcagcuccaucuauucca

SEQ ID NO: 502629 - RNA, 22 nt, Human
aucuucaacuugaucauuugaa

SEQ ID NO: 502630 - RNA, 22 nt, Human
aaugaucuacucucauuaucuc

SEQ ID NO: 502631 - RNA, 22 nt, Human
uaccuguugucacgauaacacu

SEQ ID NO: 502632 - RNA, 21 nt, Human
agucuggggaagggaucccag

SEQ ID NO: 502633 - RNA, 22 nt, Human
uguccucuaauuggccucuugc

SEQ ID NO: 502634 - RNA, 22 nt, Human
ucuggugucaguauucuuugaa

SEQ ID NO: 502635 - RNA, 22 nt, Human
agaugguaaucacauuuaucug

SEQ ID NO: 502636 - RNA, 22 nt, Human
cugggagaggcugcuccgcucu

SEQ ID NO: 502637 - RNA, 22 nt, Human
gaggaaggucccaucagaauuu

SEQ ID NO: 502638 - RNA, 22 nt, Human
uggcaggguacaccuuaacacc

SEQ ID NO: 502639 - RNA, 22 nt, Human
gaagaagcaggaguguguagca

SEQ ID NO: 502640 - RNA, 22 nt, Human
caggucuguuuccaucagugcu

SEQ ID NO: 502641 - RNA, 22 nt, Human
gccucugcucggacuuugccuc

SEQ ID NO: 502642 - RNA, 22 nt, Human
guuuuuaucuaauagcaguuau

SEQ ID NO: 502643 - RNA, 22 nt, Human
uugaagcauuugcuauagcauu

SEQ ID NO: 502644 - RNA, 22 nt, Human
ccauccuaucugaccuacuugu

SEQ ID NO: 502645 - RNA, 22 nt, Human
gcacccaggccggcgacugcag

SEQ ID NO: 502646 - RNA, 22 nt, Human
ucucaucauuccuucaaagccc

SEQ ID NO: 502647 - RNA, 22 nt, Human
uuuguuuagaugguaaaucagu

SEQ ID NO: 502648 - RNA, 22 nt, Human
ugggcagggagcuggaaccaca

SEQ ID NO: 502649 - RNA, 22 nt, Human
aagcuucauuucaacucagggg

SEQ ID NO: 502650 - RNA, 22 nt, Human
caaggagaguaauugaaugaga

SEQ ID NO: 502651 - RNA, 20 nt, Human
aggaaggaaguuugcaugga

SEQ ID NO: 502652 - RNA, 22 nt, Human
agcugguggauuaugcuguaca

SEQ ID NO: 502653 - RNA, 22 nt, Human
agcugguaaaggggaaagcaga

SEQ ID NO: 502654 - RNA, 22 nt, Human
gggccaggaguggagauauggg

SEQ ID NO: 502655 - RNA, 22 nt, Human
ucaaaaauaagauauucuggac

SEQ ID NO: 502656 - RNA, 22 nt, Human
acaugauuaaaagauuuuaaag

SEQ ID NO: 502657 - RNA, 22 nt, Human
gaauuccacuuuggcuuuuggg

SEQ ID NO: 502658 - RNA, 16 nt, Human
uucucugggguugugc

SEQ ID NO: 502659 - RNA, 22 nt, Human
cauuugaauuguucugugggaa

SEQ ID NO: 502660 - RNA, 22 nt, Human
ggcugcuugcuguuucuuggau

SEQ ID NO: 502661 - RNA, 22 nt, Human
aggggcaggugcugcacuuaga

SEQ ID NO: 502662 - RNA, 22 nt, Human
uuuucuaaaagaagucacugau

SEQ ID NO: 502663 - RNA, 22 nt, Human
gugcuuuccauccucccugcug

SEQ ID NO: 502664 - RNA, 22 nt, Human
uuuuucauauuccccucucugg

SEQ ID NO: 502665 - RNA, 22 nt, Human
aaaugcauugguuucuacuugu

SEQ ID NO: 502666 - RNA, 22 nt, Human
ucagaccauccugcuguuagug

SEQ ID NO: 502667 - RNA, 22 nt, Human
uuuaauuguuguggguacauag

SEQ ID NO: 502668 - RNA, 22 nt, Human
agcugcaggccucuccugggga

SEQ ID NO: 502669 - RNA, 22 nt, Human
caugcacuuaccugaaauucaa

SEQ ID NO: 502670 - RNA, 22 nt, Human
cuggcagccaagugggauacuc

SEQ ID NO: 502671 - RNA, 22 nt, Human
ucuuuccucugagcuccuguag

SEQ ID NO: 502672 - RNA, 22 nt, Human
gcauuauuaauagcugcaugag

SEQ ID NO: 502673 - RNA, 22 nt, Human
ggcaggcuggcuuuguuccagg

SEQ ID NO: 502674 - RNA, 22 nt, Human
acugucuccucaucaugccugg

SEQ ID NO: 502675 - RNA, 22 nt, Human
uagguagggaccaccuugggga

SEQ ID NO: 502676 - RNA, 22 nt, Human
ugcccugggaggcuuuccuguu

SEQ ID NO: 502677 - RNA, 22 nt, Human
acacccuuguccauagcagaug

SEQ ID NO: 502678 - RNA, 22 nt, Human
aagaacauuuuguagaaugaca

SEQ ID NO: 502679 - RNA, 22 nt, Human
gccaccugcgggccguggugga

SEQ ID NO: 502680 - RNA, 22 nt, Human
aagcuuuaugacuuggagacag

SEQ ID NO: 502681 - RNA, 22 nt, Human
ugaaucaaagcugaaguuuuca

SEQ ID NO: 502682 - RNA, 23 nt, Human
auuuacagcugugugagcaaguu

SEQ ID NO: 502683 - RNA, 18 nt, Human
gcuccuggaccaggucac

SEQ ID NO: 502684 - RNA, 22 nt, Human
gagcuuggugcacagugguuaa

SEQ ID NO: 502685 - RNA, 22 nt, Human
uuccagcuaacucacaucccuu

SEQ ID NO: 502686 - RNA, 22 nt, Human
agaaagcacucugucuuuuacc

SEQ ID NO: 502687 - RNA, 22 nt, Human
uaagaguuacugguuuagaacc

SEQ ID NO: 502688 - RNA, 22 nt, Human
uuggaauuccuguuguuucguc

SEQ ID NO: 502689 - RNA, 22 nt, Human
aggucaagaguaaauuugggua

SEQ ID NO: 502690 - RNA, 22 nt, Human
ugaguucucacccauucuucuu

SEQ ID NO: 502691 - RNA, 22 nt, Human
gguggcugaaucaaaucaggcc

SEQ ID NO: 502692 - RNA, 22 nt, Human
aaagccuuugucucaggcucug

SEQ ID NO: 502693 - RNA, 20 nt, Human
caccuucaaauuuccuggca

SEQ ID NO: 502694 - RNA, 19 nt, Human
acugugcucgggaaccacu

SEQ ID NO: 502695 - RNA, 22 nt, Human
cuggaaggguacauaggaaacu

SEQ ID NO: 502696 - RNA, 22 nt, Human
aagucacaagcauauaugcauu

SEQ ID NO: 502697 - RNA, 22 nt, Human
cagucucagaggugggaguggg

SEQ ID NO: 502698 - RNA, 22 nt, Human
uuccacuuaguggaagggcaug

SEQ ID NO: 502699 - RNA, 22 nt, Human
cugagggagaagucacgggcag

SEQ ID NO: 502700 - RNA, 22 nt, Human
accugccagaauccaagccaca

SEQ ID NO: 502701 - RNA, 22 nt, Human
cccaggcucagacuggcuuguu

SEQ ID NO: 502702 - RNA, 22 nt, Human
ucacauuuuaucuauuuuaagu

SEQ ID NO: 502703 - RNA, 22 nt, Human
uggguccuaaaugcagucacau

SEQ ID NO: 502704 - RNA, 22 nt, Human
gccuuaauugcagagcaauaua

SEQ ID NO: 502705 - RNA, 22 nt, Human
aagcaggauggagguugaguua

SEQ ID NO: 502706 - RNA, 22 nt, Human
gcuggcugcgucaucacagggc

SEQ ID NO: 502707 - RNA, 22 nt, Human
agaggccuaauugcuacccuuu

SEQ ID NO: 502708 - RNA, 21 nt, Human
uggcauggagguagcagugug

SEQ ID NO: 502709 - RNA, 22 nt, Human
cuuguuuuggcuaguaugaugu

SEQ ID NO: 502710 - RNA, 22 nt, Human
uugucugaaccaucucccuggc

SEQ ID NO: 502711 - RNA, 22 nt, Human
ugacaguuaagguauacauuca

SEQ ID NO: 502712 - RNA, 22 nt, Human
acacaggggaaaguggagcuga

SEQ ID NO: 502713 - RNA, 22 nt, Human
uggcagagguauauugggagga

SEQ ID NO: 502714 - RNA, 23 nt, Human
gcugagguacauuuacaggaaga

SEQ ID NO: 502715 - RNA, 22 nt, Human
gcuguaaagaacauuaggaauc

SEQ ID NO: 502716 - RNA, 22 nt, Human
cucagucucuugggcugugaag

SEQ ID NO: 502717 - RNA, 22 nt, Human
cagcaauaagguaagcuucucc

SEQ ID NO: 502718 - RNA, 22 nt, Human
gagagucuagugcaccuaguuu

SEQ ID NO: 502719 - RNA, 22 nt, Human
gacucugugggaggaggcucag

SEQ ID NO: 502720 - RNA, 22 nt, Human
agcuacucagaguuccacucua

SEQ ID NO: 502721 - RNA, 22 nt, Human
cucccagggccaucgagucacu

SEQ ID NO: 502722 - RNA, 22 nt, Human
gggcaggagagggccaccugga

SEQ ID NO: 502723 - RNA, 22 nt, Human
aggggccuggacauggacgcgc

SEQ ID NO: 502724 - RNA, 22 nt, Human
aaauagaauuggaagcagaguu

SEQ ID NO: 502725 - RNA, 20 nt, Human
ugccagggccagcagaggcu

SEQ ID NO: 502726 - RNA, 22 nt, Human
cuggguauaggaaacaguuaag

SEQ ID NO: 502727 - RNA, 22 nt, Human
ccagcucuaaacggcucugugg

SEQ ID NO: 502728 - RNA, 17 nt, Human
cccugccaccaggaagc

SEQ ID NO: 502729 - RNA, 19 nt, Human
aggcugcaagguggugggc

SEQ ID NO: 502730 - RNA, 17 nt, Human
ucaggauguagcaguag

SEQ ID NO: 502731 - RNA, 22 nt, Human
caggaaaugcuaucauagcuga

SEQ ID NO: 502732 - RNA, 22 nt, Human
ugcauuaaggccauugaaauuu

SEQ ID NO: 502733 - RNA, 22 nt, Human
aagaguuuccaugcucugugcu

SEQ ID NO: 502734 - RNA, 22 nt, Human
cuggccuggggggacacauccc

SEQ ID NO: 502735 - RNA, 22 nt, Human
aagaugaaucaguauguguccu

SEQ ID NO: 502736 - RNA, 22 nt, Human
uacauuuauaaggcuucucugu

SEQ ID NO: 502737 - RNA, 22 nt, Human
ugccagcuccgaggagcugcag

SEQ ID NO: 502738 - RNA, 22 nt, Human
guccugggcccaggggcugccu

SEQ ID NO: 502739 - RNA, 21 nt, Human
cugcucuggggaccggcugug

SEQ ID NO: 502740 - RNA, 22 nt, Human
ugucccagaucacaggagggga

SEQ ID NO: 502741 - RNA, 22 nt, Human
uacauguucaaauuugucuuuc

SEQ ID NO: 502742 - RNA, 22 nt, Human
ccuaaguauuuucaguguuaac

SEQ ID NO: 502743 - RNA, 22 nt, Human
ucuggcuccacuuucuucauuu

SEQ ID NO: 502744 - RNA, 22 nt, Human
ucucacuggguauaaaugagua

SEQ ID NO: 502745 - RNA, 22 nt, Human
cucagggucugguccuuagauu

SEQ ID NO: 502746 - RNA, 22 nt, Human
ugggccuccuccgacagccggg

SEQ ID NO: 502747 - RNA, 22 nt, Human
uccugacuccagguccugugug

SEQ ID NO: 502748 - RNA, 23 nt, Human
cuuuucauugccuuagcgcagag

SEQ ID NO: 502749 - RNA, 22 nt, Human
ccugcaggcugcaggccaguuc

SEQ ID NO: 502750 - RNA, 22 nt, Human
gcaaagaaaugucagugagagg

SEQ ID NO: 502751 - RNA, 22 nt, Human
cuccuggacauggagcggagga

SEQ ID NO: 502752 - RNA, 22 nt, Human
gcacagguugcaaaaguucaca

SEQ ID NO: 502753 - RNA, 20 nt, Human
ugaagcagccuugauucugu

SEQ ID NO: 502754 - RNA, 22 nt, Human
guauacauagaugaugaacaag

SEQ ID NO: 502755 - RNA, 22 nt, Human
ccacagggccuuuccugcuggc

SEQ ID NO: 502756 - RNA, 22 nt, Human
cagcugccagcuucucuccauc

SEQ ID NO: 502757 - RNA, 22 nt, Human
cauuugaaccuggauguucuua

SEQ ID NO: 502758 - RNA, 23 nt, Human
aggaagcuaaguguggcugcgga

SEQ ID NO: 502759 - RNA, 22 nt, Human
auggggugaccaugagcauuua

SEQ ID NO: 502760 - RNA, 21 nt, Human
agaguuacugucauccuaggu

SEQ ID NO: 502761 - RNA, 22 nt, Human
ugggcagaauugugguaguuaa

SEQ ID NO: 502762 - RNA, 20 nt, Human
cccucugcacauggcugugg

SEQ ID NO: 502763 - RNA, 22 nt, Human
ccaggcaucacgggcauguggc

SEQ ID NO: 502764 - RNA, 22 nt, Human
ugcccuugaggacagcucccag

SEQ ID NO: 502765 - RNA, 22 nt, Human
gagcaguugggcucuaggaagu

SEQ ID NO: 502766 - RNA, 22 nt, Human
uucauauauaugcacuacguac

SEQ ID NO: 502767 - RNA, 22 nt, Human
ccucccugcuccucaacuggca

SEQ ID NO: 502768 - RNA, 22 nt, Human
cauggcagcuuugggaggagga

SEQ ID NO: 502769 - RNA, 22 nt, Human
agcaggggucucugcuaaugaa

SEQ ID NO: 502770 - RNA, 22 nt, Human
uuuauauccaucuuugaaguaa

SEQ ID NO: 502771 - RNA, 22 nt, Human
agggaaaguaagcauuucauua

SEQ ID NO: 502772 - RNA, 22 nt, Human
auguccuuccauuuugaucugu

SEQ ID NO: 502773 - RNA, 22 nt, Human
ucugacccguggcucugccucc

SEQ ID NO: 502774 - RNA, 22 nt, Human
acacugcagaugaaagcauaag

SEQ ID NO: 502775 - RNA, 22 nt, Human
aguggcugacaacuggguuaac

SEQ ID NO: 502776 - RNA, 22 nt, Human
cuguggagguaggagcaggaca

SEQ ID NO: 502777 - RNA, 22 nt, Human
auucagcaguuccugcuucagu

SEQ ID NO: 502778 - RNA, 21 nt, Human
cucaaagaccaaaaguguaga

SEQ ID NO: 502779 - RNA, 22 nt, Human
ugcagcugguuuagaacuagau

SEQ ID NO: 502780 - RNA, 22 nt, Human
agauggaguuaguaccagaguc

SEQ ID NO: 502781 - RNA, 22 nt, Human
gaacaaacacaucccagcagug

SEQ ID NO: 502782 - RNA, 22 nt, Human
caaaggaagcuccuugauggcg

SEQ ID NO: 502783 - RNA, 22 nt, Human
ccagcugcaggggagcagugga

SEQ ID NO: 502784 - RNA, 22 nt, Human
uccaggaugcccgcuuuugcuu

SEQ ID NO: 502785 - RNA, 22 nt, Human
caauuucuuguuaauucucagg

SEQ ID NO: 502786 - RNA, 22 nt, Human
cugcccagaagcuuagagcuua

SEQ ID NO: 502787 - RNA, 22 nt, Human
gccugagcccaggugugcagag

SEQ ID NO: 502788 - RNA, 22 nt, Human
uccugggaguaauugagucaug

SEQ ID NO: 502789 - RNA, 22 nt, Human
gcuuuuauuucuucacaaaagu

SEQ ID NO: 502790 - RNA, 22 nt, Human
ggguccagcuacaucagggugg

SEQ ID NO: 502791 - RNA, 22 nt, Human
gagacugggggcuuggccuuuu

SEQ ID NO: 502792 - RNA, 21 nt, Human
ugcaggaaagugcugcgaccc

SEQ ID NO: 502793 - RNA, 22 nt, Human
aaaagaugaaauggugucuugg

SEQ ID NO: 502794 - RNA, 22 nt, Human
ccuggagcaggagcugcagagg

SEQ ID NO: 502795 - RNA, 22 nt, Human
aaagcagucucagacuuaagca

SEQ ID NO: 502796 - RNA, 22 nt, Human
cggcacagccgggcaaggcugg

SEQ ID NO: 502797 - RNA, 22 nt, Human
aguggcuguacuauuuuuucau

SEQ ID NO: 502798 - RNA, 20 nt, Human
ccuggcugcauucaggacgg

SEQ ID NO: 502799 - RNA, 21 nt, Human
ugcagccauucagcccuaugc

SEQ ID NO: 502800 - RNA, 22 nt, Human
ggagaggugagagguacaaguu

SEQ ID NO: 502801 - RNA, 22 nt, Human
auucauuuagguauucacuuac

SEQ ID NO: 502802 - RNA, 22 nt, Human
agaaagaggaugcagaucucau

SEQ ID NO: 502803 - RNA, 22 nt, Human
gcaaggcugcugccacccaucu

SEQ ID NO: 502804 - RNA, 22 nt, Human
agagucugccuuuuucuccugc

SEQ ID NO: 502805 - RNA, 21 nt, Human
uggaccuguccuucucgcugu

SEQ ID NO: 502806 - RNA, 22 nt, Human
gaaauauugggacucagagcuu

SEQ ID NO: 502807 - RNA, 22 nt, Human
gggcaagugucaagcaugucau

SEQ ID NO: 502808 - RNA, 22 nt, Human
ucccugugggaugaggacucug

SEQ ID NO: 502809 - RNA, 22 nt, Human
aaggaaaggaugagcaugcauu

SEQ ID NO: 502810 - RNA, 22 nt, Human
acucaggaauggggcugggacu

SEQ ID NO: 502811 - RNA, 18 nt, Human
uacagcuugaguugacug

SEQ ID NO: 502812 - RNA, 22 nt, Human
aggcaaaauuacaaaguuauua

SEQ ID NO: 502813 - RNA, 22 nt, Human
cccagcccacgguccugggugg

SEQ ID NO: 502814 - RNA, 22 nt, Human
uuuacucuugcuacacaacugu

SEQ ID NO: 502815 - RNA, 22 nt, Human
acacugugagcugaagggcugc

SEQ ID NO: 502816 - RNA, 22 nt, Human
uuacaagauaaccugaugcugu

SEQ ID NO: 502817 - RNA, 22 nt, Human
guguggcugauugacaugguca

SEQ ID NO: 502818 - RNA, 22 nt, Human
uaaaugugucuauggacccgcc

SEQ ID NO: 502819 - RNA, 22 nt, Human
aaaccuuuaccagacuagcaag

SEQ ID NO: 502820 - RNA, 22 nt, Human
ugcaggucucugcaaggccuau

SEQ ID NO: 502821 - RNA, 22 nt, Human
agucucugucguagaucagcgu

SEQ ID NO: 502822 - RNA, 22 nt, Human
uaccuggggcugggcuuugauu

SEQ ID NO: 502823 - RNA, 22 nt, Human
ggauggagaugaccauggugac

SEQ ID NO: 502824 - RNA, 22 nt, Human
cugugacagagcuugagugaga

SEQ ID NO: 502825 - RNA, 22 nt, Human
caaaaggcaggggaaagagugc

SEQ ID NO: 502826 - RNA, 22 nt, Human
ugccuggguucccaccccaaag

SEQ ID NO: 502827 - RNA, 22 nt, Human
ggccccuggcaccaggcugauu

SEQ ID NO: 502828 - RNA, 20 nt, Human
uuucagagugucuuuccauu

SEQ ID NO: 502829 - RNA, 22 nt, Human
acuguguguuugucuagcacag

SEQ ID NO: 502830 - RNA, 22 nt, Human
auaugaaaauguuuuagcugua

SEQ ID NO: 502831 - RNA, 22 nt, Human
acacaugcauaagccuucccuu

SEQ ID NO: 502832 - RNA, 22 nt, Human
cagagcugauuggauccagaga

SEQ ID NO: 502833 - RNA, 22 nt, Human
ugagcaguaggucugaauagug

SEQ ID NO: 502834 - RNA, 22 nt, Human
agaggaggcucugggaucgucc

SEQ ID NO: 502835 - RNA, 20 nt, Human
ccucucugaagaggucaucu

SEQ ID NO: 502836 - RNA, 22 nt, Human
ucuuugaaaagauauuccuccu

SEQ ID NO: 502837 - RNA, 22 nt, Human
cccaggucuaugccagcucuga

SEQ ID NO: 502838 - RNA, 22 nt, Human
uuguggcucaucuucagcuccc

SEQ ID NO: 502839 - RNA, 22 nt, Human
uaaaacaccuguagugucugcc

SEQ ID NO: 502840 - RNA, 22 nt, Human
uuuuccucugcagagcaguuag

SEQ ID NO: 502841 - RNA, 22 nt, Human
uuuccuuugcccaauacauguc

SEQ ID NO: 502842 - RNA, 21 nt, Human
acagaugggaugagcacacug

SEQ ID NO: 502843 - RNA, 21 nt, Human
aucagaaucucuagauuugga

SEQ ID NO: 502844 - RNA, 21 nt, Human
cuguggccuggcuagcaccgu

SEQ ID NO: 502845 - RNA, 22 nt, Human
caacauguguuagacaauagac

SEQ ID NO: 502846 - RNA, 22 nt, Human
aggaaaaucgagucuggaggca

SEQ ID NO: 502847 - RNA, 22 nt, Human
auuauugugauaggugucagug

SEQ ID NO: 502848 - RNA, 22 nt, Human
gcugccuucccaggccuuugcu

SEQ ID NO: 502849 - RNA, 22 nt, Human
agcugguucauucauucauggu

SEQ ID NO: 502850 - RNA, 22 nt, Human
ccagcuugaagaugugcugguu

SEQ ID NO: 502851 - RNA, 22 nt, Human
ucccugugagaaaugaagcagg

SEQ ID NO: 502852 - RNA, 22 nt, Human
uguauauucugccuaaaagcuu

SEQ ID NO: 502853 - RNA, 19 nt, Human
acucaagucuaaugaaauc

SEQ ID NO: 502854 - RNA, 22 nt, Human
cucuggagcauuucaccuacau

SEQ ID NO: 502855 - RNA, 22 nt, Human
gagccagccgcaagagcuguga

SEQ ID NO: 502856 - RNA, 23 nt, Human
agcuggguggccugcgugaagcu

SEQ ID NO: 502857 - RNA, 22 nt, Human
cacaggaggaggugcccgggcc

SEQ ID NO: 502858 - RNA, 22 nt, Human
aaaugcucuggggauaagacug

SEQ ID NO: 502859 - RNA, 22 nt, Human
ggagcuguaacgagccauugcu

SEQ ID NO: 502860 - RNA, 22 nt, Human
uguaugaaucucauuuguuuaa

SEQ ID NO: 502861 - RNA, 22 nt, Human
uucuaccagcuacucacugaua

SEQ ID NO: 502862 - RNA, 22 nt, Human
cugggccucacacccaccaaau

SEQ ID NO: 502863 - RNA, 22 nt, Human
gggcaggucugggucagccuga

SEQ ID NO: 502864 - RNA, 22 nt, Human
agaagcugacagaugcagcagg

SEQ ID NO: 502865 - RNA, 22 nt, Human
cucacugcaaguuccaccuacc

SEQ ID NO: 502866 - RNA, 22 nt, Human
gucaggaucucccaguacauau

SEQ ID NO: 502867 - RNA, 22 nt, Human
gagcuuccugaugccgaccagu

SEQ ID NO: 502868 - RNA, 22 nt, Human
uccaauaacaucuaaaaacuua

SEQ ID NO: 502869 - RNA, 22 nt, Human
uuguuuuaaccuaguguuuaug

SEQ ID NO: 502870 - RNA, 22 nt, Human
aaagacuuucaccuagcaaaga

SEQ ID NO: 502871 - RNA, 22 nt, Human
cugaggccgucugggucugcag

SEQ ID NO: 502872 - RNA, 20 nt, Human
uggccaccacuguauaucaa

SEQ ID NO: 502873 - RNA, 22 nt, Human
acuggggcagugggcagugguu

SEQ ID NO: 502874 - RNA, 22 nt, Human
uuuugagauggugucucgcucc

SEQ ID NO: 502875 - RNA, 22 nt, Human
agggcuccaggggaccaucagu

SEQ ID NO: 502876 - RNA, 22 nt, Human
ggcagccuccagggcacuggug

SEQ ID NO: 502877 - RNA, 22 nt, Human
gggucagcugcugggggcugac

SEQ ID NO: 502878 - RNA, 22 nt, Human
ugguaaauauguccauucucuu

SEQ ID NO: 502879 - RNA, 22 nt, Human
aucaauaucagaucagacagga

SEQ ID NO: 502880 - RNA, 22 nt, Human
uggcuccguuguacaggcugga

SEQ ID NO: 502881 - RNA, 22 nt, Human
uugcaauuaacauaugucaacu

SEQ ID NO: 502882 - RNA, 22 nt, Human
ggagcagacauaaccuuacaga

SEQ ID NO: 502883 - RNA, 22 nt, Human
cugccuguuuucugauagauuu

SEQ ID NO: 502884 - RNA, 22 nt, Human
agguccagguuccguuucugcg

SEQ ID NO: 502885 - RNA, 22 nt, Human
aggcagaagccagccagggucc

SEQ ID NO: 502886 - RNA, 22 nt, Human
uuucaaggcuaguuuuaauuag

SEQ ID NO: 502887 - RNA, 22 nt, Human
ggagugggcagcacugcccugu

SEQ ID NO: 502888 - RNA, 22 nt, Human
gccagcugaaauuucaguucug

SEQ ID NO: 502889 - RNA, 19 nt, Human
cuggaaugauagagaccuc

SEQ ID NO: 502890 - RNA, 22 nt, Human
uccuucagaaccugugauggaa

SEQ ID NO: 502891 - RNA, 22 nt, Human
uagccaggcgaggucagugucg

SEQ ID NO: 502892 - RNA, 23 nt, Human
uuuggcauguuaacuucacuuac

SEQ ID NO: 502893 - RNA, 22 nt, Human
uggcuccaucauccaugcaaga

SEQ ID NO: 502894 - RNA, 18 nt, Human
uggcagagugucuguucu

SEQ ID NO: 502895 - RNA, 22 nt, Human
ccaguccugcucccugaccacc

SEQ ID NO: 502896 - RNA, 22 nt, Human
gggcauguacauaaucuagaaa

SEQ ID NO: 502897 - RNA, 22 nt, Human
auauaguuggguuucauucuac

SEQ ID NO: 502898 - RNA, 22 nt, Human
aggcagguuggugagaagacug

SEQ ID NO: 502899 - RNA, 23 nt, Human
acugggcuuaugaggaggcuugu

SEQ ID NO: 502900 - RNA, 18 nt, Human
uagcagcacuggccgcuu

SEQ ID NO: 502901 - RNA, 22 nt, Human
uucaguuucagucuugcaaaaa

SEQ ID NO: 502902 - RNA, 21 nt, Human
aagcagcuuaauaaaguaugu

SEQ ID NO: 502903 - RNA, 22 nt, Human
cuggccugugggcugucuccgg

SEQ ID NO: 502904 - RNA, 22 nt, Human
gucuggcauaugcaaagugcau

SEQ ID NO: 502905 - RNA, 22 nt, Human
cgggcagaucacacagggcuug

SEQ ID NO: 502906 - RNA, 22 nt, Human
uauaguaaaauuuucauuuaug

SEQ ID NO: 502907 - RNA, 22 nt, Human
uuucucuaaauagggaggcuua

SEQ ID NO: 502908 - RNA, 22 nt, Human
agccaggggauucaucagggac

SEQ ID NO: 502909 - RNA, 22 nt, Human
uguguacacaaugauugcagag

SEQ ID NO: 502910 - RNA, 22 nt, Human
ugaggcucaaggucugguggag

SEQ ID NO: 502911 - RNA, 19 nt, Human
caugagcugcucacuuccc

SEQ ID NO: 502912 - RNA, 22 nt, Human
acaaauccagugaacuccagug

SEQ ID NO: 502913 - RNA, 22 nt, Human
ucuguggcuuucuuauguugua

SEQ ID NO: 502914 - RNA, 22 nt, Human
uugacucauaccugccugaccc

SEQ ID NO: 502915 - RNA, 22 nt, Human
aagguccuguagccacagagcc

SEQ ID NO: 502916 - RNA, 22 nt, Human
cuggaagguggauggcgaggcc

SEQ ID NO: 502917 - RNA, 22 nt, Human
acagugcacauccugagugauu

SEQ ID NO: 502918 - RNA, 22 nt, Human
cuaggaaagacacagagaguuu

SEQ ID NO: 502919 - RNA, 22 nt, Human
agaugaagacucaggagcaggu

SEQ ID NO: 502920 - RNA, 22 nt, Human
cucugggcuuccuuuguggguu

SEQ ID NO: 502921 - RNA, 22 nt, Human
ucuucuuccuccacagggccca

SEQ ID NO: 502922 - RNA, 22 nt, Human
aaggguggauuucugagcucua

SEQ ID NO: 502923 - RNA, 22 nt, Human
cagccucuuuccacaucaggca

SEQ ID NO: 502924 - RNA, 22 nt, Human
gagcacagcuggagguagcauu

SEQ ID NO: 502925 - RNA, 19 nt, Human
ucauucaggaccaguggau

SEQ ID NO: 502926 - RNA, 22 nt, Human
ucacacagauugguagagcuga

SEQ ID NO: 502927 - RNA, 22 nt, Human
ugcugaauaaauaaagucuauu

SEQ ID NO: 502928 - RNA, 22 nt, Human
ccagagccggauugugaagugc

SEQ ID NO: 502929 - RNA, 22 nt, Human
gaagcagcuaggaucuucauuu

SEQ ID NO: 502930 - RNA, 22 nt, Human
uuugcaaauaccaugaaacuug

SEQ ID NO: 502931 - RNA, 22 nt, Human
uaaacagcuacugugucaaagg

SEQ ID NO: 502932 - RNA, 22 nt, Human
agucaguugcaaacaucaggca

SEQ ID NO: 502933 - RNA, 22 nt, Human
gaaauccaguucccuacucuua

SEQ ID NO: 502934 - RNA, 22 nt, Human
aucaggauagugguuaccuggg

SEQ ID NO: 502935 - RNA, 22 nt, Human
ucauuuacauagaaacaauaua

SEQ ID NO: 502936 - RNA, 22 nt, Human
ccugugaggucaucugugguaa

SEQ ID NO: 502937 - RNA, 22 nt, Human
ugagccuggggccugggcagcg

SEQ ID NO: 502938 - RNA, 22 nt, Human
uagagcaguuggcagcuguauu

SEQ ID NO: 502939 - RNA, 22 nt, Human
aauggcagaaugggccagaagc

SEQ ID NO: 502940 - RNA, 22 nt, Human
auaauuuaaauuaguaugugau

SEQ ID NO: 502941 - RNA, 22 nt, Human
gcuggcugccuuacuuugugga

SEQ ID NO: 502942 - RNA, 22 nt, Human
auuuuguggcagaugcagaacc

SEQ ID NO: 502943 - RNA, 22 nt, Human
agucucugugagcucccaaugg

SEQ ID NO: 502944 - RNA, 22 nt, Human
ggcagaccucuccagccccaca

SEQ ID NO: 502945 - RNA, 22 nt, Human
cagggcucuucaucacacagua

SEQ ID NO: 502946 - RNA, 22 nt, Human
ucucuuugacccuuuagcucca

SEQ ID NO: 502947 - RNA, 22 nt, Human
aacuuucuuucacagaaguauc

SEQ ID NO: 502948 - RNA, 22 nt, Human
ugggcuuugagcucggucaccu

SEQ ID NO: 502949 - RNA, 22 nt, Human
uagcagaggcuacugcuccuug

SEQ ID NO: 502950 - RNA, 17 nt, Human
ccaggcuauaccaggcu

SEQ ID NO: 502951 - RNA, 22 nt, Human
cucaggagacaguguccacaug

SEQ ID NO: 502952 - RNA, 22 nt, Human
caggccagcagggccuccgugg

SEQ ID NO: 502953 - RNA, 22 nt, Human
uuucuuugagucucaguuugcu

SEQ ID NO: 502954 - RNA, 22 nt, Human
ugcugucugauucagggugauu

SEQ ID NO: 502955 - RNA, 17 nt, Human
cucagaguugcuuuguc

SEQ ID NO: 502956 - RNA, 22 nt, Human
agcagauguuucagagcaggcu

SEQ ID NO: 502957 - RNA, 22 nt, Human
guccacagggauggccacacau

SEQ ID NO: 502958 - RNA, 20 nt, Human
ucucuggccagaaacaacag

SEQ ID NO: 502959 - RNA, 22 nt, Human
gucaggaugacaagugcuuuca

SEQ ID NO: 502960 - RNA, 22 nt, Human
ucugaauuuuaacuacacaaag

SEQ ID NO: 502961 - RNA, 22 nt, Human
auucaaaagaccaugcagacuc

SEQ ID NO: 502962 - RNA, 22 nt, Human
ugaaggaggaauguggccucca

SEQ ID NO: 502963 - RNA, 22 nt, Human
ccaggugguucaggucaccaua

SEQ ID NO: 502964 - RNA, 18 nt, Human
cucaguguuugcugaaaa

SEQ ID NO: 502965 - RNA, 22 nt, Human
agagccugucugccuuucuacc

SEQ ID NO: 502966 - RNA, 22 nt, Human
ucugcagguagagcucaggaau

SEQ ID NO: 502967 - RNA, 22 nt, Human
uguuucuugggugcucacauca

SEQ ID NO: 502968 - RNA, 22 nt, Human
aaugauauuuauugaauagaug

SEQ ID NO: 502969 - RNA, 22 nt, Human
uuugacuucugggcauuuuggu

SEQ ID NO: 502970 - RNA, 22 nt, Human
gaccaaggaagaggggagccag

SEQ ID NO: 502971 - RNA, 22 nt, Human
ccauaagguuuggggccaugca

SEQ ID NO: 502972 - RNA, 21 nt, Human
ggcccugguuacgccuccucu

SEQ ID NO: 502973 - RNA, 22 nt, Human
aggggacacggcuucuccaggg

SEQ ID NO: 502974 - RNA, 22 nt, Human
agccuggaauuaaggaaaugca

SEQ ID NO: 502975 - RNA, 21 nt, Human
acucccugcauaagugauuua

SEQ ID NO: 502976 - RNA, 22 nt, Human
cauuaaaauaucucaugguguu

SEQ ID NO: 502977 - RNA, 22 nt, Human
cagcucccagaacugaccaugu

SEQ ID NO: 502978 - RNA, 22 nt, Human
ugcagaggaccauuguccugga

SEQ ID NO: 502979 - RNA, 22 nt, Human
gugagggguggcugagcaguuu

SEQ ID NO: 502980 - RNA, 22 nt, Human
ugcagggcuaagucagagccug

SEQ ID NO: 502981 - RNA, 22 nt, Human
cuggagccccaggcugugcaga

SEQ ID NO: 502982 - RNA, 22 nt, Human
caaauccagaucccagucguag

SEQ ID NO: 502983 - RNA, 23 nt, Human
cagcuuucagggcuuuagggaag

SEQ ID NO: 502984 - RNA, 22 nt, Human
agccaggcugcaguuggcuggc

SEQ ID NO: 502985 - RNA, 22 nt, Human
uccugccucuugccuucuucac

SEQ ID NO: 502986 - RNA, 22 nt, Human
agauggaguuguagcagugacu

SEQ ID NO: 502987 - RNA, 22 nt, Human
ugcuguuauacuuagcugguua

SEQ ID NO: 502988 - RNA, 22 nt, Human
ucccagagccucugccacucug

SEQ ID NO: 502989 - RNA, 22 nt, Human
ggucagggggaucugugaggua

SEQ ID NO: 502990 - RNA, 22 nt, Human
auaagcuugauguaacuaacca

SEQ ID NO: 502991 - RNA, 22 nt, Human
cccagguccccaccugucugcu

SEQ ID NO: 502992 - RNA, 22 nt, Human
ggggcagauggaacagagcaca

SEQ ID NO: 502993 - RNA, 22 nt, Human
uggaggucgcuagcgagcgggc

SEQ ID NO: 502994 - RNA, 22 nt, Human
gggcugugagaguggggcugcu

SEQ ID NO: 502995 - RNA, 22 nt, Human
ugguacuuggaggcagaaaaau

SEQ ID NO: 502996 - RNA, 22 nt, Human
ugaaggccucugguacaugcca

SEQ ID NO: 502997 - RNA, 22 nt, Human
guuaucuuaggguacaaaggac

SEQ ID NO: 502998 - RNA, 22 nt, Human
ucaggucuauacuaugagaggc

SEQ ID NO: 502999 - RNA, 22 nt, Human
cugaggagcugaaggcccucca

SEQ ID NO: 503000 - RNA, 18 nt, Human
guuucaugcaugugaaac

SEQ ID NO: 503001 - RNA, 22 nt, Human
gcugccuucaguucugauucau

SEQ ID NO: 503002 - RNA, 22 nt, Human
cugccagccaggccagguaggc

SEQ ID NO: 503003 - RNA, 22 nt, Human
auacuuaugauaaauaauugcu

SEQ ID NO: 503004 - RNA, 22 nt, Human
agcuggguguucuugggccuaa

SEQ ID NO: 503005 - RNA, 22 nt, Human
cagaccagaaggaagccgacaa

SEQ ID NO: 503006 - RNA, 22 nt, Human
aggcaucugaguuugcaagcuu

SEQ ID NO: 503007 - RNA, 22 nt, Human
ggggaccuggccacccauccuu

SEQ ID NO: 503008 - RNA, 22 nt, Human
ugccugggccuucccaccucug

SEQ ID NO: 503009 - RNA, 22 nt, Human
ccucugggccuggaagggcagu

SEQ ID NO: 503010 - RNA, 22 nt, Human
aaaaaccucaauuacuuuugca

SEQ ID NO: 503011 - RNA, 22 nt, Human
uucccacagagauuacauugaa

SEQ ID NO: 503012 - RNA, 22 nt, Human
guccucugggagccuugagccu

SEQ ID NO: 503013 - RNA, 22 nt, Human
ugucucagggcagcagcagggg

SEQ ID NO: 503014 - RNA, 22 nt, Human
gcagauggcagcccaggcuggg

SEQ ID NO: 503015 - RNA, 22 nt, Human
uuguuuguaaggcucuuagaau

SEQ ID NO: 503016 - RNA, 22 nt, Human
ucucagugacugcugggucccc

SEQ ID NO: 503017 - RNA, 22 nt, Human
uguagaaauuaguaagaucaac

SEQ ID NO: 503018 - RNA, 22 nt, Human
acugaaauacugcucuuggauu

SEQ ID NO: 503019 - RNA, 22 nt, Human
ccagcuccccucagcagguaau

SEQ ID NO: 503020 - RNA, 20 nt, Human
uccugggguaagccaugguc

SEQ ID NO: 503021 - RNA, 20 nt, Human
gccagcacagggagcaguuc

SEQ ID NO: 503022 - RNA, 22 nt, Human
gccccucccagucaggagcacu

SEQ ID NO: 503023 - RNA, 22 nt, Human
uauuugcugaaucugauucaga

SEQ ID NO: 503024 - RNA, 22 nt, Human
ugaggcagcaauugauuauuca

SEQ ID NO: 503025 - RNA, 22 nt, Human
ccagucccaucucugucgcuua

SEQ ID NO: 503026 - RNA, 22 nt, Human
cagggccugcuuccuucuuguu

SEQ ID NO: 503027 - RNA, 22 nt, Human
caggguggaaaagcuaguugga

SEQ ID NO: 503028 - RNA, 22 nt, Human
ggcaaaaaccauaauuacuuuu

SEQ ID NO: 503029 - RNA, 22 nt, Human
gcagggacaacugugcaccuga

SEQ ID NO: 503030 - RNA, 22 nt, Human
ucacugaauacuugucucaucc

SEQ ID NO: 503031 - RNA, 22 nt, Human
ggugccaggcuguagucagggu

SEQ ID NO: 503032 - RNA, 22 nt, Human
cagcauggguuccgggggccug

SEQ ID NO: 503033 - RNA, 22 nt, Human
uauucccagccucuuucuaucu

SEQ ID NO: 503034 - RNA, 22 nt, Human
ugcuucaggagaugucaccaug

SEQ ID NO: 503035 - RNA, 22 nt, Human
uaacagaaaggggacagaaaua

SEQ ID NO: 503036 - RNA, 22 nt, Human
auguaacuguuauauuuuguug

SEQ ID NO: 503037 - RNA, 20 nt, Human
uugauucccucuaaacucgc

SEQ ID NO: 503038 - RNA, 22 nt, Human
ucgcugugaaaaccuuggacaa

SEQ ID NO: 503039 - RNA, 22 nt, Human
aggcuucccaagcagcugcaaa

SEQ ID NO: 503040 - RNA, 22 nt, Human
ucacuguagugagcagaauaua

SEQ ID NO: 503041 - RNA, 22 nt, Human
ugcauugcauuugucaugaaga

SEQ ID NO: 503042 - RNA, 22 nt, Human
ucugggcuuuaagaacucuguu

SEQ ID NO: 503043 - RNA, 22 nt, Human
cacaccagagguuaccugcaaa

SEQ ID NO: 503044 - RNA, 22 nt, Human
cuguauuuaguuaaaaugcuaa

SEQ ID NO: 503045 - RNA, 22 nt, Human
uggcucucaggccugcugcguu

SEQ ID NO: 503046 - RNA, 22 nt, Human
gggcuggaggagauccagaggc

SEQ ID NO: 503047 - RNA, 23 nt, Human
ucucuggccuuugaucagguuga

SEQ ID NO: 503048 - RNA, 22 nt, Human
agucccagcccaguccuguaag

SEQ ID NO: 503049 - RNA, 22 nt, Human
auauguguguauuucuuacuag

SEQ ID NO: 503050 - RNA, 22 nt, Human
uucauuccuucuguaccuugcc

SEQ ID NO: 503051 - RNA, 22 nt, Human
cagauuuagaguggggcuugga

SEQ ID NO: 503052 - RNA, 22 nt, Human
cuuugauauaaguauacauagu

SEQ ID NO: 503053 - RNA, 22 nt, Human
aaaaauguuaucuacuguccga

SEQ ID NO: 503054 - RNA, 22 nt, Human
gugucugcacauaggaucucaa

SEQ ID NO: 503055 - RNA, 22 nt, Human
cuggccacaugugugcugagca

SEQ ID NO: 503056 - RNA, 22 nt, Human
ucagagagugcaaaauauagcu

SEQ ID NO: 503057 - RNA, 19 nt, Human
uuagaaacuguugacacug

SEQ ID NO: 503058 - RNA, 22 nt, Human
acaaauagagauucaaauaaag

SEQ ID NO: 503059 - RNA, 22 nt, Human
cuucauuuggagaacugugcuu

SEQ ID NO: 503060 - RNA, 22 nt, Human
aggagcugcauggauaccuggu

SEQ ID NO: 503061 - RNA, 22 nt, Human
cugugugcucggauggacucgu

SEQ ID NO: 503062 - RNA, 22 nt, Human
gucugggcuuagggacauggca

SEQ ID NO: 503063 - RNA, 22 nt, Human
cccaggcuggggcuccuccagc

SEQ ID NO: 503064 - RNA, 22 nt, Human
aaggcagcagugcacgacugau

SEQ ID NO: 503065 - RNA, 22 nt, Human
uguccugcaacugaaggagaag

SEQ ID NO: 503066 - RNA, 22 nt, Human
aggacccugagcgggcaugccg

SEQ ID NO: 503067 - RNA, 22 nt, Human
aaaguguggagauugaacuaaa

SEQ ID NO: 503068 - RNA, 19 nt, Human
acauuuagaauguacuugc

SEQ ID NO: 503069 - RNA, 22 nt, Human
aauaugcaaauagguguaauga

SEQ ID NO: 503070 - RNA, 21 nt, Human
augugcagcaagcagcaugcu

SEQ ID NO: 503071 - RNA, 22 nt, Human
uccugaggcucacuuugaaugu

SEQ ID NO: 503072 - RNA, 22 nt, Human
gcauccagagguagccacugug

SEQ ID NO: 503073 - RNA, 22 nt, Human
ucuuagcaaauacuacuuagaa

SEQ ID NO: 503074 - RNA, 21 nt, Human
agagaagggacucuuccaguc

SEQ ID NO: 503075 - RNA, 20 nt, Human
accugggaaaaccuuuuccu

SEQ ID NO: 503076 - RNA, 22 nt, Human
acuggcugaaguuuacuuuuug

SEQ ID NO: 503077 - RNA, 22 nt, Human
agccaggaaccagcuacagucu

SEQ ID NO: 503078 - RNA, 22 nt, Human
cuccagucuaguagagccugcu

SEQ ID NO: 503079 - RNA, 22 nt, Human
uuacaguauuguuaaacucuuu

SEQ ID NO: 503080 - RNA, 22 nt, Human
cugaggagagaucacguggugu

SEQ ID NO: 503081 - RNA, 22 nt, Human
agucacccuccaacucuccacu

SEQ ID NO: 503082 - RNA, 21 nt, Human
uuagcuuucuagaaucuuugu

SEQ ID NO: 503083 - RNA, 22 nt, Human
uuauguugggaaaagucagauu

SEQ ID NO: 503084 - RNA, 20 nt, Human
uccagcccagcagccugaca

SEQ ID NO: 503085 - RNA, 22 nt, Human
agcugccugggcuuguacaccu

SEQ ID NO: 503086 - RNA, 22 nt, Human
aagccuaaaugaugcuauuaug

SEQ ID NO: 503087 - RNA, 22 nt, Human
gcacagcccuggucggggcccc

SEQ ID NO: 503088 - RNA, 21 nt, Human
ugaaugaucugguugccuuuu

SEQ ID NO: 503089 - RNA, 22 nt, Human
auuacaguggacagcuaugcac

SEQ ID NO: 503090 - RNA, 22 nt, Human
uccugagguggauugagcagag

SEQ ID NO: 503091 - RNA, 22 nt, Human
ucagaggacgcacuaggguugu

SEQ ID NO: 503092 - RNA, 22 nt, Human
gaagcagaaguacgauuuacua

SEQ ID NO: 503093 - RNA, 22 nt, Human
gcuggcagcauuagacccuggg

SEQ ID NO: 503094 - RNA, 22 nt, Human
cuucagcaccucagcuggagag

SEQ ID NO: 503095 - RNA, 22 nt, Human
ggaaucagaauuaggauuugaa

SEQ ID NO: 503096 - RNA, 22 nt, Human
gcacagaacuucucuuaguagg

SEQ ID NO: 503097 - RNA, 22 nt, Human
aauguuugugcauaaauauguu

SEQ ID NO: 503098 - RNA, 21 nt, Human
caaaggacuguagcucacuga

SEQ ID NO: 503099 - RNA, 22 nt, Human
gaggguggccuuuagagcccau

SEQ ID NO: 503100 - RNA, 22 nt, Human
uugaaagucacaauggcauuaa

SEQ ID NO: 503101 - RNA, 22 nt, Human
aagggggccacaccugguguga

SEQ ID NO: 503102 - RNA, 22 nt, Human
ccaggcucuaucccuccuucuu

SEQ ID NO: 503103 - RNA, 22 nt, Human
gcugcucuggcucugcaguguc

SEQ ID NO: 503104 - RNA, 22 nt, Human
aggcugggaaauguauuccagc

SEQ ID NO: 503105 - RNA, 22 nt, Human
ggaccugcauuuuaacaagauc

SEQ ID NO: 503106 - RNA, 22 nt, Human
gguggcugcaauggcuaacuuc

SEQ ID NO: 503107 - RNA, 22 nt, Human
cugcagaguggagccucggcug

SEQ ID NO: 503108 - RNA, 22 nt, Human
ucauuucuccgaccugcugucc

SEQ ID NO: 503109 - RNA, 22 nt, Human
ugcauacacaagcauacaugua

SEQ ID NO: 503110 - RNA, 23 nt, Human
uugaaggagaaagcuuucuuggu

SEQ ID NO: 503111 - RNA, 22 nt, Human
cucuuaaauaacaucauugcuu

SEQ ID NO: 503112 - RNA, 22 nt, Human
agguuucugcaauguguguaca

SEQ ID NO: 503113 - RNA, 22 nt, Human
cccugaggaugucuccuuccug

SEQ ID NO: 503114 - RNA, 22 nt, Human
gcaaagcaaaugccugaaggcg

SEQ ID NO: 503115 - RNA, 22 nt, Human
caggucuggcaucagcugugug

SEQ ID NO: 503116 - RNA, 22 nt, Human
uuucuauaugaggagcuaaagu

SEQ ID NO: 503117 - RNA, 22 nt, Human
ucuuuuaguaauaaauauuugu

SEQ ID NO: 503118 - RNA, 22 nt, Human
aaagugcugagauuacaagcgu

SEQ ID NO: 503119 - RNA, 22 nt, Human
agcugcuguggggcucggccug

SEQ ID NO: 503120 - RNA, 22 nt, Human
gcucucagaugcuccagcagcc

SEQ ID NO: 503121 - RNA, 22 nt, Human
accugccuauggagccacaugg

SEQ ID NO: 503122 - RNA, 22 nt, Human
acugggccacauagaccugcug

SEQ ID NO: 503123 - RNA, 22 nt, Human
gagcuuggacaagcucugaagg

SEQ ID NO: 503124 - RNA, 22 nt, Human
cacugugggguuuggcuggaac

SEQ ID NO: 503125 - RNA, 22 nt, Human
uucuugauuucaugcaguuaag

SEQ ID NO: 503126 - RNA, 22 nt, Human
uuuacuuugugucaagucaaga

SEQ ID NO: 503127 - RNA, 22 nt, Human
uguucuuucaguuagacacagu

SEQ ID NO: 503128 - RNA, 22 nt, Human
caccagcuucucauugcggguc

SEQ ID NO: 503129 - RNA, 22 nt, Human
uucaaugagcccggggccauag

SEQ ID NO: 503130 - RNA, 22 nt, Human
ggccaccuggguucgacugggc

SEQ ID NO: 503131 - RNA, 22 nt, Human
ccuugcagacaucaguaguggc

SEQ ID NO: 503132 - RNA, 22 nt, Human
agugcaauguguacagaaaaau

SEQ ID NO: 503133 - RNA, 20 nt, Human
uguuaaaggacacuugcuuu

SEQ ID NO: 503134 - RNA, 22 nt, Human
ucucagcucuuuuuucacagaa

SEQ ID NO: 503135 - RNA, 22 nt, Human
aggagcagcccacuccuguccu

SEQ ID NO: 503136 - RNA, 23 nt, Human
ucuggcuuugcuggaaguuuuga

SEQ ID NO: 503137 - RNA, 22 nt, Human
uggacaggugagugacucaggg

SEQ ID NO: 503138 - RNA, 22 nt, Human
uguguacaagaguguuuacugu

SEQ ID NO: 503139 - RNA, 18 nt, Human
ccugugcuccagcaucug

SEQ ID NO: 503140 - RNA, 22 nt, Human
ucuugcuagaaucauuuggaga

SEQ ID NO: 503141 - RNA, 21 nt, Human
agacuucuagaagugagauag

SEQ ID NO: 503142 - RNA, 22 nt, Human
ggucaguggcaggggguacuuc

SEQ ID NO: 503143 - RNA, 22 nt, Human
aaucucuucccaguaaaaaugg

SEQ ID NO: 503144 - RNA, 22 nt, Human
agcacuagccuguuuugcugug

SEQ ID NO: 503145 - RNA, 20 nt, Human
cugggcucaagugagccucc

SEQ ID NO: 503146 - RNA, 22 nt, Human
cccucccuauguagaugauguu

SEQ ID NO: 503147 - RNA, 22 nt, Human
caggucagaggcgcagccccca

SEQ ID NO: 503148 - RNA, 22 nt, Human
uguguaaauuuauuuacauaaa

SEQ ID NO: 503149 - RNA, 22 nt, Human
gcuuccugauauucauacuguu

SEQ ID NO: 503150 - RNA, 22 nt, Human
aggacagugguguucuggagug

SEQ ID NO: 503151 - RNA, 22 nt, Human
caggcagccugcggucugcaca

SEQ ID NO: 503152 - RNA, 22 nt, Human
cccagcucugcagaccugcccu

SEQ ID NO: 503153 - RNA, 22 nt, Human
aaaugucuuucuucugcuacgu

SEQ ID NO: 503154 - RNA, 22 nt, Human
ccagcuuucauaucaugaggua

SEQ ID NO: 503155 - RNA, 22 nt, Human
gcuggcagaagagcugguucaa

SEQ ID NO: 503156 - RNA, 23 nt, Human
caggaaauguucuugaagccuga

SEQ ID NO: 503157 - RNA, 22 nt, Human
uuccuggggugaagauauuuuu

SEQ ID NO: 503158 - RNA, 22 nt, Human
agucccagugagaugagccacg

SEQ ID NO: 503159 - RNA, 22 nt, Human
ggagagaacuggcuccuucuag

SEQ ID NO: 503160 - RNA, 22 nt, Human
ucaaagucauggcaggcucaga

SEQ ID NO: 503161 - RNA, 22 nt, Human
agccucucuuaucccuucaaag

SEQ ID NO: 503162 - RNA, 22 nt, Human
cucaggcucuguacucccuuug

SEQ ID NO: 503163 - RNA, 22 nt, Human
ugucaguguauacauacaguau

SEQ ID NO: 503164 - RNA, 22 nt, Human
agggcuccuaugaugcucugcc

SEQ ID NO: 503165 - RNA, 22 nt, Human
cuaaauuaucaugagaauuaug

SEQ ID NO: 503166 - RNA, 22 nt, Human
aaauaagaaauucuucuuugca

SEQ ID NO: 503167 - RNA, 18 nt, Human
ggccugaggauuucagca

SEQ ID NO: 503168 - RNA, 22 nt, Human
aagucacagcuaaauagcuaag

SEQ ID NO: 503169 - RNA, 22 nt, Human
uggaaacagaucauaacuaagc

SEQ ID NO: 503170 - RNA, 22 nt, Human
acucaucagauuagauuagggc

SEQ ID NO: 503171 - RNA, 19 nt, Human
ucuccagcuuugggcuuuu

SEQ ID NO: 503172 - RNA, 22 nt, Human
ugcaaagccacaaugaaaucag

SEQ ID NO: 503173 - RNA, 22 nt, Human
gagccuucaucgcagccuuguu

SEQ ID NO: 503174 - RNA, 22 nt, Human
uuguccuguuacuuguuuggau

SEQ ID NO: 503175 - RNA, 22 nt, Human
cagagucaugggccgucaggca

SEQ ID NO: 503176 - RNA, 22 nt, Human
uucacauugugcagauuauggu

SEQ ID NO: 503177 - RNA, 19 nt, Human
ccagcagacacagcugccc

SEQ ID NO: 503178 - RNA, 22 nt, Human
caggcacuucugcugcuugucu

SEQ ID NO: 503179 - RNA, 22 nt, Human
ugcagaguaaaagcagaugcua

SEQ ID NO: 503180 - RNA, 22 nt, Human
cauuguuaccaucuuuuaccua

SEQ ID NO: 503181 - RNA, 22 nt, Human
cugaggucucuuuccauaguga

SEQ ID NO: 503182 - RNA, 22 nt, Human
gugggaugguagguagguaaua

SEQ ID NO: 503183 - RNA, 22 nt, Human
ugcugcacucaccaacagauaa

SEQ ID NO: 503184 - RNA, 22 nt, Human
aagugggaauagaaaugaaggu

SEQ ID NO: 503185 - RNA, 22 nt, Human
aggcuucuuagauuggcuggag

SEQ ID NO: 503186 - RNA, 22 nt, Human
augucuguuuauccuucaagau

SEQ ID NO: 503187 - RNA, 22 nt, Human
uaauacuuuugccuuguauuca

SEQ ID NO: 503188 - RNA, 22 nt, Human
augauauuauucuagcccagag

SEQ ID NO: 503189 - RNA, 19 nt, Human
cagcucaguuugauucucu

SEQ ID NO: 503190 - RNA, 22 nt, Human
gagaauuagggcguaauucaga

SEQ ID NO: 503191 - RNA, 20 nt, Human
acagaaagcugccuuguccc

SEQ ID NO: 503192 - RNA, 22 nt, Human
guuuccugaugugggagaucuu

SEQ ID NO: 503193 - RNA, 22 nt, Human
uuuacacauaccucuuuaaagu

SEQ ID NO: 503194 - RNA, 22 nt, Human
uguggcuggauugauuuuaccu

SEQ ID NO: 503195 - RNA, 22 nt, Human
acagaggaaggcugagcugccc

SEQ ID NO: 503196 - RNA, 22 nt, Human
gcaggcucccuugcagagcagg

SEQ ID NO: 503197 - RNA, 22 nt, Human
ccugucugaaggcagggggaug

SEQ ID NO: 503198 - RNA, 22 nt, Human
ccagcucccauucuucaccugu

SEQ ID NO: 503199 - RNA, 22 nt, Human
gggcagugguuacacagcugag

SEQ ID NO: 503200 - RNA, 22 nt, Human
ggcugccugaacuuuggggaaa

SEQ ID NO: 503201 - RNA, 22 nt, Human
auuuggaaacaauuauauucuu

SEQ ID NO: 503202 - RNA, 22 nt, Human
agcauguaaagcucuuagcacc

SEQ ID NO: 503203 - RNA, 22 nt, Human
accauugccuagaaaaauuccu

SEQ ID NO: 503204 - RNA, 22 nt, Human
gguccugucugacaucacugcu

SEQ ID NO: 503205 - RNA, 20 nt, Human
ggcuucuuuacaucuguguu

SEQ ID NO: 503206 - RNA, 22 nt, Human
uugaagcagagaaauacuugaa

SEQ ID NO: 503207 - RNA, 22 nt, Human
uguauuuuuagaccuuuagacc

SEQ ID NO: 503208 - RNA, 22 nt, Human
uuucuucugagaucagggagaa

SEQ ID NO: 503209 - RNA, 22 nt, Human
ucacaggcuccagggccuggau

SEQ ID NO: 503210 - RNA, 22 nt, Human
caaggccugccucuggcagaaa

SEQ ID NO: 503211 - RNA, 22 nt, Human
uuuugugauggcauuacauuua

SEQ ID NO: 503212 - RNA, 22 nt, Human
ucucuuccaguaagagucuuua

SEQ ID NO: 503213 - RNA, 22 nt, Human
auuuacagccuugaaaacagca

SEQ ID NO: 503214 - RNA, 22 nt, Human
uccuugaaaaucuugguuuaga

SEQ ID NO: 503215 - RNA, 22 nt, Human
uauuccaguucaccuuuucauc

SEQ ID NO: 503216 - RNA, 20 nt, Human
aggaaaaggguggugguaga

SEQ ID NO: 503217 - RNA, 22 nt, Human
cugcagagguugguucuaagau

SEQ ID NO: 503218 - RNA, 22 nt, Human
auucauuugcuauuguguaugg

SEQ ID NO: 503219 - RNA, 22 nt, Human
uuccuuccauagcaaaacaugc

SEQ ID NO: 503220 - RNA, 22 nt, Human
cagagcagaaaccugggugauu

SEQ ID NO: 503221 - RNA, 22 nt, Human
gcaguguuaccuugggcugguu

SEQ ID NO: 503222 - RNA, 20 nt, Human
cuccugggacugcugguuau

SEQ ID NO: 503223 - RNA, 21 nt, Human
aaagagcccgcugagagguuc

SEQ ID NO: 503224 - RNA, 22 nt, Human
auguaugauauuuccaguauca

SEQ ID NO: 503225 - RNA, 22 nt, Human
ugcuggggcagaagagccaaga

SEQ ID NO: 503226 - RNA, 20 nt, Human
cagagcugggauuugaacac

SEQ ID NO: 503227 - RNA, 22 nt, Human
gagauggagucuuuuucuguca

SEQ ID NO: 503228 - RNA, 22 nt, Human
uccugcagagacagaggccuca

SEQ ID NO: 503229 - RNA, 22 nt, Human
ccugggaggcggagguugcagu

SEQ ID NO: 503230 - RNA, 22 nt, Human
agacagcaggggagucugguuu

SEQ ID NO: 503231 - RNA, 22 nt, Human
acuuagugcccuggcccuuaca

SEQ ID NO: 503232 - RNA, 22 nt, Human
ugaaugcuuggagucauaaaau

SEQ ID NO: 503233 - RNA, 22 nt, Human
agcugucuccagauacaggauu

SEQ ID NO: 503234 - RNA, 22 nt, Human
cacugccuggaaggagagacau

SEQ ID NO: 503235 - RNA, 23 nt, Human
ugagcugguauuguccaucucca

SEQ ID NO: 503236 - RNA, 22 nt, Human
cauuuguaggaugcuucuuguu

SEQ ID NO: 503237 - RNA, 22 nt, Human
ggagccaggcaaucuguacuuu

SEQ ID NO: 503238 - RNA, 22 nt, Human
gcccagcaggacagagugguuu

SEQ ID NO: 503239 - RNA, 22 nt, Human
accagggcuuacagcaguagcu

SEQ ID NO: 503240 - RNA, 22 nt, Human
ccucagagguguggcaucucug

SEQ ID NO: 503241 - RNA, 22 nt, Human
ccuggccuccuggccuucucau

SEQ ID NO: 503242 - RNA, 22 nt, Human
agggcccaggacagcaucaggg

SEQ ID NO: 503243 - RNA, 19 nt, Human
ccuggguccacucagacua

SEQ ID NO: 503244 - RNA, 22 nt, Human
agucagggguuggacggggcca

SEQ ID NO: 503245 - RNA, 20 nt, Human
ccugucuccucuuaccuggc

SEQ ID NO: 503246 - RNA, 22 nt, Human
acauaucuuucccucuccugaa

SEQ ID NO: 503247 - RNA, 16 nt, Human
uguuagcugugcauua

SEQ ID NO: 503248 - RNA, 22 nt, Human
aaggaggagugggguccuggaa

SEQ ID NO: 503249 - RNA, 22 nt, Human
cagugcuggagauggguggaac

SEQ ID NO: 503250 - RNA, 23 nt, Human
ccuggggagcuguauccagagug

SEQ ID NO: 503251 - RNA, 22 nt, Human
agguucagugccuggaacaggg

SEQ ID NO: 503252 - RNA, 23 nt, Human
ggacagggcccugcccuauggcc

SEQ ID NO: 503253 - RNA, 22 nt, Human
cagagcugagucuucaagguug

SEQ ID NO: 503254 - RNA, 22 nt, Human
ggcugccugugcccaggcacac

SEQ ID NO: 503255 - RNA, 22 nt, Human
agcugccagaugacagugcuau

SEQ ID NO: 503256 - RNA, 22 nt, Human
ugcuucugggucccagccuggc

SEQ ID NO: 503257 - RNA, 22 nt, Human
cacagcugaaguagccaugugg

SEQ ID NO: 503258 - RNA, 22 nt, Human
uucaaaacagcuagauauugga

SEQ ID NO: 503259 - RNA, 22 nt, Human
cccaggcuccugacucauucua

SEQ ID NO: 503260 - RNA, 22 nt, Human
cuaggccaguuaggaagagaag

SEQ ID NO: 503261 - RNA, 22 nt, Human
ggccugagaauguaccagaucu

SEQ ID NO: 503262 - RNA, 22 nt, Human
auuuauguaucuguguagauca

SEQ ID NO: 503263 - RNA, 22 nt, Human
uuuccugugcuuaacaaauauu

SEQ ID NO: 503264 - RNA, 22 nt, Human
uucacagucacccuucuccaug

SEQ ID NO: 503265 - RNA, 23 nt, Human
uuuaacuuuccaauaauucauug

SEQ ID NO: 503266 - RNA, 22 nt, Human
auaguauuuaauaguuagcuca

SEQ ID NO: 503267 - RNA, 22 nt, Human
gaggugggaugugugugcuacu

SEQ ID NO: 503268 - RNA, 22 nt, Human
gagugcaauggcaugaucuggg

SEQ ID NO: 503269 - RNA, 22 nt, Human
uccauuuacuauucucauaucg

SEQ ID NO: 503270 - RNA, 22 nt, Human
uagcaguggaaucuuuugucca

SEQ ID NO: 503271 - RNA, 22 nt, Human
ccuguccuccaagagcacaucu

SEQ ID NO: 503272 - RNA, 22 nt, Human
aaagcaguaguuuucaaauagu

SEQ ID NO: 503273 - RNA, 22 nt, Human
uguuacacagcagaauagcaag

SEQ ID NO: 503274 - RNA, 22 nt, Human
uugauucagaaaaagauggaga

SEQ ID NO: 503275 - RNA, 22 nt, Human
caaggagaaaacggcuucugaa

SEQ ID NO: 503276 - RNA, 22 nt, Human
gcaaagcagaacccucucuauc

SEQ ID NO: 503277 - RNA, 22 nt, Human
gcagaggcucuuuaaugcuuag

SEQ ID NO: 503278 - RNA, 22 nt, Human
gaagaccacccccuacagcaca

SEQ ID NO: 503279 - RNA, 22 nt, Human
ggcacagcucaggucccagcuc

SEQ ID NO: 503280 - RNA, 22 nt, Human
ugaagccagcuuuggaagacac

SEQ ID NO: 503281 - RNA, 22 nt, Human
ccagcacucuauugaauauucu

SEQ ID NO: 503282 - RNA, 22 nt, Human
agaccaagugcaggugccacua

SEQ ID NO: 503283 - RNA, 20 nt, Human
gugggcagaugugugcaugg

SEQ ID NO: 503284 - RNA, 22 nt, Human
agggccuggcgcguggccgccg

SEQ ID NO: 503285 - RNA, 22 nt, Human
caaguagaguucacuugucuuu

SEQ ID NO: 503286 - RNA, 22 nt, Human
cuggggugucucgucugccauu

SEQ ID NO: 503287 - RNA, 22 nt, Human
agggccugugaauucucccugc

SEQ ID NO: 503288 - RNA, 22 nt, Human
acagagcuucccagccugagca

SEQ ID NO: 503289 - RNA, 22 nt, Human
gccucaguguccuccuccaugu

SEQ ID NO: 503290 - RNA, 22 nt, Human
uccaugagacagauacuguaag

SEQ ID NO: 503291 - RNA, 22 nt, Human
guagauuccaguggucuguguc

SEQ ID NO: 503292 - RNA, 22 nt, Human
uucucaaagaaagcugucauua

SEQ ID NO: 503293 - RNA, 22 nt, Human
uggagccaggagccugggaguc

SEQ ID NO: 503294 - RNA, 22 nt, Human
uauguuaaauguuugauguuua

SEQ ID NO: 503295 - RNA, 22 nt, Human
ccuggcuccaaagcugugacuc

SEQ ID NO: 503296 - RNA, 22 nt, Human
accuucaagauugugggucaau

SEQ ID NO: 503297 - RNA, 22 nt, Human
aaugcugcucucauaauuauag

SEQ ID NO: 503298 - RNA, 22 nt, Human
ucucuggcugauauuccucugc

SEQ ID NO: 503299 - RNA, 22 nt, Human
ucuggcucuguguccccaccca

SEQ ID NO: 503300 - RNA, 17 nt, Human
caguggccuauggcuuu

SEQ ID NO: 503301 - RNA, 22 nt, Human
cucagcagagaccagggaggaa

SEQ ID NO: 503302 - RNA, 22 nt, Human
gcucucuggaggccauggacag

SEQ ID NO: 503303 - RNA, 22 nt, Human
uuuauuaugauggacaccuucg

SEQ ID NO: 503304 - RNA, 22 nt, Human
uuaaauauuuucagcaggguca

SEQ ID NO: 503305 - RNA, 22 nt, Human
gggaguguugagcgcccugcca

SEQ ID NO: 503306 - RNA, 22 nt, Human
gcaucuaaauaaacgugggagu

SEQ ID NO: 503307 - RNA, 22 nt, Human
gggcaggaugcaguuucagaga

SEQ ID NO: 503308 - RNA, 22 nt, Human
uauacaagaggugagaugagca

SEQ ID NO: 503309 - RNA, 22 nt, Human
guacaugucaaaaaaugcauaa

SEQ ID NO: 503310 - RNA, 18 nt, Human
uuuuacucauagcaggcc

SEQ ID NO: 503311 - RNA, 22 nt, Human
uucuaguucauauucucaaaga

SEQ ID NO: 503312 - RNA, 22 nt, Human
guauacagauacuuagacgugc

SEQ ID NO: 503313 - RNA, 22 nt, Human
agagaaggguguagccugggcc

SEQ ID NO: 503314 - RNA, 22 nt, Human
ggaaggaacaaacccugugugg

SEQ ID NO: 503315 - RNA, 22 nt, Human
uacauaauuaaucuuuaaguuc

SEQ ID NO: 503316 - RNA, 22 nt, Human
auauuugugguaaagguaagaa

SEQ ID NO: 503317 - RNA, 22 nt, Human
uggguaggaccagaaaugcacu

SEQ ID NO: 503318 - RNA, 17 nt, Human
acagagguuauacagac

SEQ ID NO: 503319 - RNA, 22 nt, Human
gguggcggccacuucagcccug

SEQ ID NO: 503320 - RNA, 22 nt, Human
ccucugggcuggaaaauuaaug

SEQ ID NO: 503321 - RNA, 16 nt, Human
ccuuucucugccuucc

SEQ ID NO: 503322 - RNA, 23 nt, Human
aaguuaguuucaauaaagcaauu

SEQ ID NO: 503323 - RNA, 22 nt, Human
ggucccaggauugguugcgcag

SEQ ID NO: 503324 - RNA, 22 nt, Human
agcagcagaggucagaaaggua

SEQ ID NO: 503325 - RNA, 22 nt, Human
gauaauaagcacagcaggaugu

SEQ ID NO: 503326 - RNA, 22 nt, Human
auagucuuagaucagauaaagu

SEQ ID NO: 503327 - RNA, 23 nt, Human
agucagugcgggauggucagggg

SEQ ID NO: 503328 - RNA, 22 nt, Human
uaguuaggaaaguccagggagc

SEQ ID NO: 503329 - RNA, 22 nt, Human
auaagguaugaaaaguaaaugg

SEQ ID NO: 503330 - RNA, 22 nt, Human
guugcugaaagcccugacuggc

SEQ ID NO: 503331 - RNA, 18 nt, Human
cucucuuuccacucuuug

SEQ ID NO: 503332 - RNA, 22 nt, Human
agagugaaguaauuguuaggau

SEQ ID NO: 503333 - RNA, 22 nt, Human
auucaccuguuaguaaaaaucu

SEQ ID NO: 503334 - RNA, 22 nt, Human
uggcacugggaugcuacuguua

SEQ ID NO: 503335 - RNA, 17 nt, Human
cacaggugugguuugag

SEQ ID NO: 503336 - RNA, 22 nt, Human
uagucacacaauuguguacauu

SEQ ID NO: 503337 - RNA, 22 nt, Human
cccaggcucacuguccgcuucc

SEQ ID NO: 503338 - RNA, 21 nt, Human
uggauaaaggcacuuuucauc

SEQ ID NO: 503339 - RNA, 22 nt, Human
uacaagagguauauagaaacag

SEQ ID NO: 503340 - RNA, 22 nt, Human
cagagacacuuaacaggaaugg

SEQ ID NO: 503341 - RNA, 22 nt, Human
agaggccagguccagaguuugu

SEQ ID NO: 503342 - RNA, 19 nt, Human
uuccugggguuccauugug

SEQ ID NO: 503343 - RNA, 22 nt, Human
aauaauauuccucugugugcgu

SEQ ID NO: 503344 - RNA, 22 nt, Human
gcugggcucguucccacacgcg

SEQ ID NO: 503345 - RNA, 22 nt, Human
uauuacugagguuuuauggagu

SEQ ID NO: 503346 - RNA, 22 nt, Human
ggagagaacugaccugaaagga

SEQ ID NO: 503347 - RNA, 22 nt, Human
gagacacacccaagguuaugag

SEQ ID NO: 503348 - RNA, 22 nt, Human
uguacauuuagagcucaauaga

SEQ ID NO: 503349 - RNA, 22 nt, Human
gccuccuggguucaugccauuc

SEQ ID NO: 503350 - RNA, 22 nt, Human
ugucccagauacuggacauaga

SEQ ID NO: 503351 - RNA, 22 nt, Human
gugcuccucacaguguggcccu

SEQ ID NO: 503352 - RNA, 22 nt, Human
ccaggccugugcaaggagggag

SEQ ID NO: 503353 - RNA, 22 nt, Human
ggcuuuggggugugcagagaug

SEQ ID NO: 503354 - RNA, 22 nt, Human
aacaugauuuaguauaaugcag

SEQ ID NO: 503355 - RNA, 22 nt, Human
gcucagugaaacaucaaauagu

SEQ ID NO: 503356 - RNA, 22 nt, Human
agucaauuaucucuaggucauc

SEQ ID NO: 503357 - RNA, 22 nt, Human
cagcucagucuggagagaugca

SEQ ID NO: 503358 - RNA, 22 nt, Human
uuuaggauauuaauguucagag

SEQ ID NO: 503359 - RNA, 22 nt, Human
agaggccggccgagcccauggg

SEQ ID NO: 503360 - RNA, 22 nt, Human
ggagaggaaaugccagcacuuc

SEQ ID NO: 503361 - RNA, 22 nt, Human
uaaagguacgaagugagggauu

SEQ ID NO: 503362 - RNA, 22 nt, Human
uggggcuccuccuggcaggagg

SEQ ID NO: 503363 - RNA, 21 nt, Human
ugaauuucgguauggcuauaa

SEQ ID NO: 503364 - RNA, 23 nt, Human
gcccaugcuguugggcccgagca

SEQ ID NO: 503365 - RNA, 22 nt, Human
gcacagaaaugucuacacaugu

SEQ ID NO: 503366 - RNA, 22 nt, Human
aucugggggagcugcucaugga

SEQ ID NO: 503367 - RNA, 22 nt, Human
ugcuaucucuauauccauuuau

SEQ ID NO: 503368 - RNA, 22 nt, Human
aacuagaaccacuuguauuucc

SEQ ID NO: 503369 - RNA, 22 nt, Human
gugugagggacagagaaagggg

SEQ ID NO: 503370 - RNA, 22 nt, Human
gggaaagagugcuuguccagag

SEQ ID NO: 503371 - RNA, 22 nt, Human
cuucaauaggaacugcauggca

SEQ ID NO: 503372 - RNA, 22 nt, Human
gaggagaagggcacggagaaaa

SEQ ID NO: 503373 - RNA, 23 nt, Human
augagguaaagaucagcuuuaaa

SEQ ID NO: 503374 - RNA, 22 nt, Human
cacagcugccauggcugcacuu

SEQ ID NO: 503375 - RNA, 22 nt, Human
ccugggcucugucagaauuggg

SEQ ID NO: 503376 - RNA, 22 nt, Human
ggcagugaaaaaguauguuucc

SEQ ID NO: 503377 - RNA, 22 nt, Human
ggauccuuaacuaucacaguga

SEQ ID NO: 503378 - RNA, 22 nt, Human
cccuggagggauuucucaauca

SEQ ID NO: 503379 - RNA, 22 nt, Human
uuuagaaauugcagagugggug

SEQ ID NO: 503380 - RNA, 22 nt, Human
cugggcagugguggcaucuuug

SEQ ID NO: 503381 - RNA, 22 nt, Human
cucuggggaagcagccagcugg

SEQ ID NO: 503382 - RNA, 22 nt, Human
gcagggcacagacagugccaag

SEQ ID NO: 503383 - RNA, 22 nt, Human
uguggccucaaggcugcccuca

SEQ ID NO: 503384 - RNA, 22 nt, Human
auucauaacggcaaaugucacc

SEQ ID NO: 503385 - RNA, 22 nt, Human
augcaguagauaggcacuuuua

SEQ ID NO: 503386 - RNA, 22 nt, Human
uaaaacugaauacauacugagg

SEQ ID NO: 503387 - RNA, 22 nt, Human
agcaggguuccaggaguugcag

SEQ ID NO: 503388 - RNA, 22 nt, Human
gcaguguuacuuggaguacuaa

SEQ ID NO: 503389 - RNA, 17 nt, Human
aaucuguuuacagucag

SEQ ID NO: 503390 - RNA, 22 nt, Human
aggucaccauggcaugcuccac

SEQ ID NO: 503391 - RNA, 22 nt, Human
acuguccauaauauuggugaac

SEQ ID NO: 503392 - RNA, 22 nt, Human
agguauagaauugaaaggguuu

SEQ ID NO: 503393 - RNA, 22 nt, Human
acaggcucuggggcaggauggc

SEQ ID NO: 503394 - RNA, 21 nt, Human
caguguggugaccagggucuc

SEQ ID NO: 503395 - RNA, 22 nt, Human
uggaaggcaugggaacuguucu

SEQ ID NO: 503396 - RNA, 22 nt, Human
aggcuccugcaggugaggugcu

SEQ ID NO: 503397 - RNA, 22 nt, Human
uacaguuaaaaaguucaauggu

SEQ ID NO: 503398 - RNA, 22 nt, Human
auucugaguacaacaagauguu

SEQ ID NO: 503399 - RNA, 22 nt, Human
ucacagggauggaauagaaaua

SEQ ID NO: 503400 - RNA, 17 nt, Human
ccugucuuguuucugcc

SEQ ID NO: 503401 - RNA, 22 nt, Human
cucagggccaaggaugcuguug

SEQ ID NO: 503402 - RNA, 22 nt, Human
agcagagcgccugcucagaggg

SEQ ID NO: 503403 - RNA, 22 nt, Human
ccucugccugcacaucauccug

SEQ ID NO: 503404 - RNA, 22 nt, Human
ugucaccagcugcuccucagga

SEQ ID NO: 503405 - RNA, 22 nt, Human
gcagaggcaaucagguaugugg

SEQ ID NO: 503406 - RNA, 16 nt, Human
uaugugugugggagug

SEQ ID NO: 503407 - RNA, 22 nt, Human
auucaguaggucuagaauaaga

SEQ ID NO: 503408 - RNA, 22 nt, Human
agucucagaguaccugagggac

SEQ ID NO: 503409 - RNA, 22 nt, Human
uucuuguauauaaaaaucauuu

SEQ ID NO: 503410 - RNA, 22 nt, Human
cagguggguacaucacagagac

SEQ ID NO: 503411 - RNA, 22 nt, Human
gacuacucaaacuuucucuaua

SEQ ID NO: 503412 - RNA, 23 nt, Human
cuucacaaucaaaaucaguucug

SEQ ID NO: 503413 - RNA, 22 nt, Human
gcagcauacagggagaguacuc

SEQ ID NO: 503414 - RNA, 22 nt, Human
cagagacagggcagggagugug

SEQ ID NO: 503415 - RNA, 22 nt, Human
ugggugggagcacccugucugg

SEQ ID NO: 503416 - RNA, 22 nt, Human
ggagggcuguagaggagaccug

SEQ ID NO: 503417 - RNA, 22 nt, Human
agcagccagagucugaacauua

SEQ ID NO: 503418 - RNA, 22 nt, Human
gcacagccuugcccugugcccu

SEQ ID NO: 503419 - RNA, 22 nt, Human
aaaugucuguuagucauaucau

SEQ ID NO: 503420 - RNA, 22 nt, Human
ccugggcucaagugaugguccc

SEQ ID NO: 503421 - RNA, 22 nt, Human
acaacacauguguauaugugug

SEQ ID NO: 503422 - RNA, 22 nt, Human
gaagcagcugccagagaugucu

SEQ ID NO: 503423 - RNA, 22 nt, Human
uuccauaauaggcuuaagugaa

SEQ ID NO: 503424 - RNA, 20 nt, Human
agcacauuaaacauacuccu

SEQ ID NO: 503425 - RNA, 22 nt, Human
ugcaggugugggcaggggagca

SEQ ID NO: 503426 - RNA, 22 nt, Human
cccaggaguuugaguucagcau

SEQ ID NO: 503427 - RNA, 22 nt, Human
gaggcugcacuggcuaaaggcu

SEQ ID NO: 503428 - RNA, 22 nt, Human
gucugggcuccuggcaggcagc

SEQ ID NO: 503429 - RNA, 22 nt, Human
acagcagcuaaaggugucuccu

SEQ ID NO: 503430 - RNA, 22 nt, Human
ucacugcucuccaauguggagu

SEQ ID NO: 503431 - RNA, 22 nt, Human
ggacacaguggaagacagcuug

SEQ ID NO: 503432 - RNA, 22 nt, Human
acugggccuugccauggcagcc

SEQ ID NO: 503433 - RNA, 22 nt, Human
ucuguaaucaagauauuugaga

SEQ ID NO: 503434 - RNA, 22 nt, Human
cagcuggaugggagaccauguu

SEQ ID NO: 503435 - RNA, 19 nt, Human
agggcuuugugugcugcuc

SEQ ID NO: 503436 - RNA, 22 nt, Human
gcaguggcaccgcuggcucugg

SEQ ID NO: 503437 - RNA, 22 nt, Human
ccagagagagaggucaauggca

SEQ ID NO: 503438 - RNA, 22 nt, Human
uaaagcauguacugugugcuag

SEQ ID NO: 503439 - RNA, 22 nt, Human
caggaaccuaaugaaggcucac

SEQ ID NO: 503440 - RNA, 22 nt, Human
ucuguucagguuucagagaacu

SEQ ID NO: 503441 - RNA, 22 nt, Human
gccagaaacauacacaucacuu

SEQ ID NO: 503442 - RNA, 22 nt, Human
gcagguccagucaccagagaga

SEQ ID NO: 503443 - RNA, 22 nt, Human
cagcuuugcaggcuggucagug

SEQ ID NO: 503444 - RNA, 22 nt, Human
uucauugucucuguuugccuuc

SEQ ID NO: 503445 - RNA, 22 nt, Human
agaggaauaaauuucuguagug

SEQ ID NO: 503446 - RNA, 22 nt, Human
ugagccuggagucguggagggg

SEQ ID NO: 503447 - RNA, 22 nt, Human
aggcuggcuuggcucuccugug

SEQ ID NO: 503448 - RNA, 22 nt, Human
auggaguucugccagcgcugcu

SEQ ID NO: 503449 - RNA, 19 nt, Human
agcuguggaugugggauuu

SEQ ID NO: 503450 - RNA, 22 nt, Human
agcauucaaguaauucacuugg

SEQ ID NO: 503451 - RNA, 22 nt, Human
aggaccuggaucacagagaucu

SEQ ID NO: 503452 - RNA, 22 nt, Human
ccugaggggcugcaggccagcu

SEQ ID NO: 503453 - RNA, 22 nt, Human
agggcugcugcuccgggcccag

SEQ ID NO: 503454 - RNA, 20 nt, Human
cugugccuaaaccuccgggu

SEQ ID NO: 503455 - RNA, 22 nt, Human
ggaaccacagcccccagcaggc

SEQ ID NO: 503456 - RNA, 22 nt, Human
uucaaggagauuggagucuacu

SEQ ID NO: 503457 - RNA, 22 nt, Human
ccaccagcuuugccacccugcu

SEQ ID NO: 503458 - RNA, 22 nt, Human
ccaggcuuccuaaugugugcag

SEQ ID NO: 503459 - RNA, 22 nt, Human
cgacccuacagacagugcugag

SEQ ID NO: 503460 - RNA, 22 nt, Human
ucacagaagagcauuaagauga

SEQ ID NO: 503461 - RNA, 22 nt, Human
ucuucuuuuauuucaagggugu

SEQ ID NO: 503462 - RNA, 22 nt, Human
gagagcccugcuccuaucccag

SEQ ID NO: 503463 - RNA, 22 nt, Human
cggucaggugcagcguuggcac

SEQ ID NO: 503464 - RNA, 22 nt, Human
ucaggggaaaucucucagcgaa

SEQ ID NO: 503465 - RNA, 22 nt, Human
ugccuucacugagcuuauggga

SEQ ID NO: 503466 - RNA, 22 nt, Human
uguagcacagagcuuugacacu

SEQ ID NO: 503467 - RNA, 22 nt, Human
cagcagcugguuauaccugugg

SEQ ID NO: 503468 - RNA, 22 nt, Human
acaguaaaaagccuuagaauuu

SEQ ID NO: 503469 - RNA, 22 nt, Human
caggccugggcuucggggcuga

SEQ ID NO: 503470 - RNA, 18 nt, Human
guuaauuuugaaguucau

SEQ ID NO: 503471 - RNA, 22 nt, Human
cuccucugucuggcccugagcc

SEQ ID NO: 503472 - RNA, 22 nt, Human
caagagcauuuaguuagcuggu

SEQ ID NO: 503473 - RNA, 22 nt, Human
ugaaggagcucaaugaugaugc

SEQ ID NO: 503474 - RNA, 22 nt, Human
aaauuuuguauucuaguucuag

SEQ ID NO: 503475 - RNA, 17 nt, Human
gugaagagucauugaau

SEQ ID NO: 503476 - RNA, 22 nt, Human
caguuucuuggaugccaauuuc

SEQ ID NO: 503477 - RNA, 22 nt, Human
auccugugcaaugacugcaucu

SEQ ID NO: 503478 - RNA, 22 nt, Human
uugaagcacaaugucuuuuauc

SEQ ID NO: 503479 - RNA, 21 nt, Human
agugaaauugcaucagaggga

SEQ ID NO: 503480 - RNA, 22 nt, Human
ucauguguguuucauguaugga

SEQ ID NO: 503481 - RNA, 22 nt, Human
caggcccugggcaggaucagcc

SEQ ID NO: 503482 - RNA, 22 nt, Human
guucuuccucauugcuuugaag

SEQ ID NO: 503483 - RNA, 22 nt, Human
ggccuggaaugcuuuccuacca

SEQ ID NO: 503484 - RNA, 22 nt, Human
uucaaaauuguucuaagcucug

SEQ ID NO: 503485 - RNA, 23 nt, Human
gugauuucagggaacagaaucag

SEQ ID NO: 503486 - RNA, 20 nt, Human
ucucuggcaagaagcugcag

SEQ ID NO: 503487 - RNA, 22 nt, Human
acccucccauuuccauguagca

SEQ ID NO: 503488 - RNA, 23 nt, Human
aguguucagcauguaguaaauac

SEQ ID NO: 503489 - RNA, 22 nt, Human
ugugccuacugauagagccaag

SEQ ID NO: 503490 - RNA, 23 nt, Human
agacugaggcugccagggucaga

SEQ ID NO: 503491 - RNA, 22 nt, Human
gggaucagaaacauagcccuga

SEQ ID NO: 503492 - RNA, 22 nt, Human
aauucuagcauugugaaaauau

SEQ ID NO: 503493 - RNA, 22 nt, Human
ucuggccugaaaguccaugcuu

SEQ ID NO: 503494 - RNA, 22 nt, Human
uuucugaagggcagcagacucu

SEQ ID NO: 503495 - RNA, 22 nt, Human
uccugcugcuaccuggcccacg

SEQ ID NO: 503496 - RNA, 22 nt, Human
ggagccugggccuccugcccuu

SEQ ID NO: 503497 - RNA, 22 nt, Human
aaugagacacgugaagcagaug

SEQ ID NO: 503498 - RNA, 19 nt, Human
gaaggggaagguggguacc

SEQ ID NO: 503499 - RNA, 16 nt, Human
ccacagggcaaggggc

SEQ ID NO: 503500 - RNA, 22 nt, Human
cagaaauguacugacaugcagu

SEQ ID NO: 503501 - RNA, 22 nt, Human
uuaccuguuuuacaugcacaac

SEQ ID NO: 503502 - RNA, 22 nt, Human
cacuguaucuuuuccaaagucu

SEQ ID NO: 503503 - RNA, 22 nt, Human
ccaggugggaggaaagcagaga

SEQ ID NO: 503504 - RNA, 22 nt, Human
acugggccuugugugucucauc

SEQ ID NO: 503505 - RNA, 22 nt, Human
cagagggcucuuggcugccugc

SEQ ID NO: 503506 - RNA, 22 nt, Human
gggaccugaggagggguuucag

SEQ ID NO: 503507 - RNA, 22 nt, Human
aauaauuacccaucuuuuugua

SEQ ID NO: 503508 - RNA, 20 nt, Human
agcugaggcaccugagguua

SEQ ID NO: 503509 - RNA, 15 nt, Human
gggcaggucuggggc

SEQ ID NO: 503510 - RNA, 22 nt, Human
auucuguguuaggauagauggu

SEQ ID NO: 503511 - RNA, 22 nt, Human
cuccagagaguccagcucuggg

SEQ ID NO: 503512 - RNA, 22 nt, Human
caggcacuguguuaggcacugu

SEQ ID NO: 503513 - RNA, 22 nt, Human
agggcugcuccuccuucaggcc

SEQ ID NO: 503514 - RNA, 22 nt, Human
ucccagccuuccuuguggugaa

SEQ ID NO: 503515 - RNA, 22 nt, Human
cuguacaucccgagagccagua

SEQ ID NO: 503516 - RNA, 22 nt, Human
ucugaggcccaguucaacucuu

SEQ ID NO: 503517 - RNA, 22 nt, Human
ggagucugagcuuguguccugg

SEQ ID NO: 503518 - RNA, 23 nt, Human
uccuggguuugaauucuagucuu

SEQ ID NO: 503519 - RNA, 22 nt, Human
gaugcugaagugaagugaucuu

SEQ ID NO: 503520 - RNA, 22 nt, Human
ugaaaaggaguccuuguuuuca

SEQ ID NO: 503521 - RNA, 22 nt, Human
uauacagauaucuaagauguaa

SEQ ID NO: 503522 - RNA, 22 nt, Human
gcuggccugucuagagccuuac

SEQ ID NO: 503523 - RNA, 22 nt, Human
uauaauaugaggcaggagugau

SEQ ID NO: 503524 - RNA, 22 nt, Human
gcagggcagcuuagucccuguc

SEQ ID NO: 503525 - RNA, 22 nt, Human
caaguagaaggaugugauugua

SEQ ID NO: 503526 - RNA, 22 nt, Human
uucuuguauguaugcaaaauca

SEQ ID NO: 503527 - RNA, 22 nt, Human
uuugugaacaaacaugaagaug

SEQ ID NO: 503528 - RNA, 22 nt, Human
aggcuagaggcuucuggcuuca

SEQ ID NO: 503529 - RNA, 22 nt, Human
ggccucaggguugggcccauua

SEQ ID NO: 503530 - RNA, 22 nt, Human
uggggacauagccagucuggcu

SEQ ID NO: 503531 - RNA, 19 nt, Human
guccaguguuuuccaguca

SEQ ID NO: 503532 - RNA, 22 nt, Human
acaggggcuccgaaggugaggg

SEQ ID NO: 503533 - RNA, 22 nt, Human
gacuggauauugaguacugcaa

SEQ ID NO: 503534 - RNA, 22 nt, Human
ggccaccuaggagccacaguga

SEQ ID NO: 503535 - RNA, 22 nt, Human
acuuucaacuuggugggagagc

SEQ ID NO: 503536 - RNA, 22 nt, Human
ggcugccuucagacuccagcuu

SEQ ID NO: 503537 - RNA, 22 nt, Human
ggaggagagagguugcaaacac

SEQ ID NO: 503538 - RNA, 22 nt, Human
ugucucugaaauauguggcucc

SEQ ID NO: 503539 - RNA, 22 nt, Human
uugaagcauuguggcuuguauu

SEQ ID NO: 503540 - RNA, 23 nt, Human
ggccauggagacuuagaaugggc

SEQ ID NO: 503541 - RNA, 22 nt, Human
cacaggaauaagucaaacuuca

SEQ ID NO: 503542 - RNA, 22 nt, Human
ucauugcagugauguuguaugu

SEQ ID NO: 503543 - RNA, 22 nt, Human
caaagucccagcugcuuagaga

SEQ ID NO: 503544 - RNA, 22 nt, Human
uuccagcaggcagacaggagau

SEQ ID NO: 503545 - RNA, 22 nt, Human
ccaggcugggcggggaaccugg

SEQ ID NO: 503546 - RNA, 22 nt, Human
agggggaguuucaguuagaaag

SEQ ID NO: 503547 - RNA, 22 nt, Human
uuucuauugaucuaauaaacau

SEQ ID NO: 503548 - RNA, 22 nt, Human
aauuagggagagguagcuaggu

SEQ ID NO: 503549 - RNA, 22 nt, Human
ugucaugcagguuuguuauaga

SEQ ID NO: 503550 - RNA, 21 nt, Human
uccccacauuucuaaacagac

SEQ ID NO: 503551 - RNA, 22 nt, Human
uuuuagaaagaucccuggcagg

SEQ ID NO: 503552 - RNA, 22 nt, Human
uugccaggagacaaagugggcc

SEQ ID NO: 503553 - RNA, 22 nt, Human
aggcagguguugggagacacca

SEQ ID NO: 503554 - RNA, 22 nt, Human
aucuucaaagggauguccaugg

SEQ ID NO: 503555 - RNA, 22 nt, Human
ucacacagguuugcaaugauuu

SEQ ID NO: 503556 - RNA, 22 nt, Human
aaucucuuuggcucaaggaucc

SEQ ID NO: 503557 - RNA, 22 nt, Human
guuugcauuuauuagucuucug

SEQ ID NO: 503558 - RNA, 23 nt, Human
uagagcaguagaucaccauggga

SEQ ID NO: 503559 - RNA, 20 nt, Human
gugcagccaagcugagccgc

SEQ ID NO: 503560 - RNA, 23 nt, Human
cagaccuggcagucauccucaac

SEQ ID NO: 503561 - RNA, 22 nt, Human
uacuuccagcaaucugcauauu

SEQ ID NO: 503562 - RNA, 22 nt, Human
guggcugcagcucugaacggac

SEQ ID NO: 503563 - RNA, 22 nt, Human
cagcugccccuccagggcuggg

SEQ ID NO: 503564 - RNA, 22 nt, Human
cagagccagcccacuguucccg

SEQ ID NO: 503565 - RNA, 22 nt, Human
uaauaagcguagaagguauauc

SEQ ID NO: 503566 - RNA, 22 nt, Human
uuugcugauauuuugcugauac

SEQ ID NO: 503567 - RNA, 22 nt, Human
agccaggacguugcucagcucc

SEQ ID NO: 503568 - RNA, 22 nt, Human
ucugcugcugagcacacuccua

SEQ ID NO: 503569 - RNA, 22 nt, Human
aggcuucuggggcaccgagcga

SEQ ID NO: 503570 - RNA, 22 nt, Human
cagggcuucgugucucagugcu

SEQ ID NO: 503571 - RNA, 22 nt, Human
aggugauguccacagcuugcag

SEQ ID NO: 503572 - RNA, 22 nt, Human
acaaugaagauaauguugcagu

SEQ ID NO: 503573 - RNA, 22 nt, Human
gcuggcucugaugggcuccagg

SEQ ID NO: 503574 - RNA, 22 nt, Human
auuucuuccucugucaguaacu

SEQ ID NO: 503575 - RNA, 22 nt, Human
agagcaggcauaaagcuuugaa

SEQ ID NO: 503576 - RNA, 21 nt, Human
cggaaacucggcucugguucc

SEQ ID NO: 503577 - RNA, 22 nt, Human
cgcugccaggauccccugccgg

SEQ ID NO: 503578 - RNA, 22 nt, Human
agucuugaaagcacauuagagu

SEQ ID NO: 503579 - RNA, 21 nt, Human
aaagcagcccauggcacaguc

SEQ ID NO: 503580 - RNA, 22 nt, Human
ucccaggauguuggcggcaggu

SEQ ID NO: 503581 - RNA, 22 nt, Human
gaaaguuucuucauuaagaugu

SEQ ID NO: 503582 - RNA, 23 nt, Human
aguaugaauucauuguuuuaguu

SEQ ID NO: 503583 - RNA, 19 nt, Human
guuuuucccagacgaggca

SEQ ID NO: 503584 - RNA, 23 nt, Human
ggucccugacagcgggcaaguug

SEQ ID NO: 503585 - RNA, 22 nt, Human
gacacagagauaggccuguguu

SEQ ID NO: 503586 - RNA, 22 nt, Human
uagauguuuugauauuugcuga

SEQ ID NO: 503587 - RNA, 22 nt, Human
cuucugggcagaaguuuugaga

SEQ ID NO: 503588 - RNA, 22 nt, Human
guuucauucggcagcucauaag

SEQ ID NO: 503589 - RNA, 22 nt, Human
aguagcagaaggucuugaaggg

SEQ ID NO: 503590 - RNA, 22 nt, Human
cagggccaugaggcacaggguc

SEQ ID NO: 503591 - RNA, 22 nt, Human
uuccuuguuuguagcucuggga

SEQ ID NO: 503592 - RNA, 22 nt, Human
ucagagcuaaggggagagcaaa

SEQ ID NO: 503593 - RNA, 22 nt, Human
aaaggcucacgcaguuagugau

SEQ ID NO: 503594 - RNA, 22 nt, Human
uccccagccgugaaggagagga

SEQ ID NO: 503595 - RNA, 22 nt, Human
uggaccccagacaagccagggu

SEQ ID NO: 503596 - RNA, 22 nt, Human
cuggcucaggaaaguugcugcu

SEQ ID NO: 503597 - RNA, 22 nt, Human
aaucuuuuaggggauccugagg

SEQ ID NO: 503598 - RNA, 22 nt, Human
ugcacuccaggcugggugacag

SEQ ID NO: 503599 - RNA, 21 nt, Human
ugcaugcuauguuuuuauuuc

SEQ ID NO: 503600 - RNA, 22 nt, Human
uucaugugaauauauuugucuu

SEQ ID NO: 503601 - RNA, 22 nt, Human
ucagcaauaugauaggcuuugu

SEQ ID NO: 503602 - RNA, 21 nt, Human
uccagaggaggacagacucag

SEQ ID NO: 503603 - RNA, 22 nt, Human
agcuggagaguuuccaggaagg

SEQ ID NO: 503604 - RNA, 22 nt, Human
cacacaugaaucccuaguaccu

SEQ ID NO: 503605 - RNA, 21 nt, Human
uuuucuggaguaugucuccuc

SEQ ID NO: 503606 - RNA, 22 nt, Human
gaguguucccacaccccaguug

SEQ ID NO: 503607 - RNA, 22 nt, Human
uuccucuuuagggcuggccagg

SEQ ID NO: 503608 - RNA, 22 nt, Human
uggcagggaauacagauguuua

SEQ ID NO: 503609 - RNA, 22 nt, Human
aauguacacugaaagccuauca

SEQ ID NO: 503610 - RNA, 22 nt, Human
agcacuuuccuggcaaaugugg

SEQ ID NO: 503611 - RNA, 22 nt, Human
caaaaugugagucccaccucaa

SEQ ID NO: 503612 - RNA, 22 nt, Human
agaggcagccguauuucaaagg

SEQ ID NO: 503613 - RNA, 22 nt, Human
uuguuuuaacgacucagcuugu

SEQ ID NO: 503614 - RNA, 22 nt, Human
ugucauuuaguccucugugugu

SEQ ID NO: 503615 - RNA, 22 nt, Human
uugaagaugguagcaauuuccu

SEQ ID NO: 503616 - RNA, 22 nt, Human
auguccuguuuuggcuugcucu

SEQ ID NO: 503617 - RNA, 22 nt, Human
cuggaucugucuuuuggauccc

SEQ ID NO: 503618 - RNA, 22 nt, Human
uuuccucuucuggcaggcaggg

SEQ ID NO: 503619 - RNA, 22 nt, Human
cugucaccuguucacugcagca

SEQ ID NO: 503620 - RNA, 22 nt, Human
aauucucaggaauuucaucugu

SEQ ID NO: 503621 - RNA, 22 nt, Human
uggcgugcccuccagacuuggc

SEQ ID NO: 503622 - RNA, 23 nt, Human
ucacagggcacuggcugggguug

SEQ ID NO: 503623 - RNA, 22 nt, Human
uagagguacuccccucaaaguu

SEQ ID NO: 503624 - RNA, 22 nt, Human
ugcgcccagccaagucuggcac

SEQ ID NO: 503625 - RNA, 22 nt, Human
ccugcgucgugugggcagugac

SEQ ID NO: 503626 - RNA, 22 nt, Human
gggcacuguacacugugcaugg

SEQ ID NO: 503627 - RNA, 22 nt, Human
gggauggggggaagcguccaug

SEQ ID NO: 503628 - RNA, 22 nt, Human
ucagggcaaugucccucagaag

SEQ ID NO: 503629 - RNA, 22 nt, Human
augcccugugacucuccuggac

SEQ ID NO: 503630 - RNA, 22 nt, Human
caggcagcucgaugccuuguug

SEQ ID NO: 503631 - RNA, 22 nt, Human
uaauuuauuucaacugccaagg

SEQ ID NO: 503632 - RNA, 22 nt, Human
agaguguuuuucugucaaggac

SEQ ID NO: 503633 - RNA, 22 nt, Human
ccugcagagccacgugccagcg

SEQ ID NO: 503634 - RNA, 22 nt, Human
agguacuaccagggauuuucag

SEQ ID NO: 503635 - RNA, 22 nt, Human
auuuaugacuggugaauagaac

SEQ ID NO: 503636 - RNA, 22 nt, Human
uaaaauguguuucuguaugguu

SEQ ID NO: 503637 - RNA, 22 nt, Human
cccagcagugacccagugauac

SEQ ID NO: 503638 - RNA, 22 nt, Human
ugggcugcagagcccggccuuc

SEQ ID NO: 503639 - RNA, 22 nt, Human
cauguuaaaauauacauucuga

SEQ ID NO: 503640 - RNA, 22 nt, Human
ugccugucucugacugccauua

SEQ ID NO: 503641 - RNA, 22 nt, Human
gggguccuggaggccagcugga

SEQ ID NO: 503642 - RNA, 22 nt, Human
guccuggcuagucguccgcgac

SEQ ID NO: 503643 - RNA, 22 nt, Human
ucccagccggugccuggguccc

SEQ ID NO: 503644 - RNA, 22 nt, Human
gacccagccugguuuuuauagg

SEQ ID NO: 503645 - RNA, 22 nt, Human
caugucuuauuuaugcuucuua

SEQ ID NO: 503646 - RNA, 22 nt, Human
cuuagaugaagucacagaaccc

SEQ ID NO: 503647 - RNA, 22 nt, Human
aggguccaucaaggacugcaca

SEQ ID NO: 503648 - RNA, 22 nt, Human
aaugaaguguuauuuaguuuca

SEQ ID NO: 503649 - RNA, 22 nt, Human
gccagaggcccaaggacagcug

SEQ ID NO: 503650 - RNA, 19 nt, Human
cagaugagaaaagugaggu

SEQ ID NO: 503651 - RNA, 18 nt, Human
uggccuggagacaacucu

SEQ ID NO: 503652 - RNA, 22 nt, Human
uagaaagacuguccagauuuca

SEQ ID NO: 503653 - RNA, 22 nt, Human
ugucaugcccaggagcaaggua

SEQ ID NO: 503654 - RNA, 18 nt, Human
ccagguggugacagagau

SEQ ID NO: 503655 - RNA, 22 nt, Human
caggaugagaggcccagggaag

SEQ ID NO: 503656 - RNA, 22 nt, Human
gcuggcugaguucugucgucug

SEQ ID NO: 503657 - RNA, 21 nt, Human
cagcuucuucugugaccuggu

SEQ ID NO: 503658 - RNA, 22 nt, Human
cagucccagcugcucagaaggc

SEQ ID NO: 503659 - RNA, 22 nt, Human
cccacucccugcacgccugccg

SEQ ID NO: 503660 - RNA, 22 nt, Human
acccagcuggaugcauggaggc

SEQ ID NO: 503661 - RNA, 22 nt, Human
gaagcccauuuguacagcacau

SEQ ID NO: 503662 - RNA, 22 nt, Human
ccagcgcuucccaucagggagg

SEQ ID NO: 503663 - RNA, 22 nt, Human
guauuagguuggugcaaaagua

SEQ ID NO: 503664 - RNA, 21 nt, Human
uguguucuucuaggucagcua

SEQ ID NO: 503665 - RNA, 23 nt, Human
acugagccagggccugggucagc

SEQ ID NO: 503666 - RNA, 22 nt, Human
ucacagacacagggagaagcau

SEQ ID NO: 503667 - RNA, 21 nt, Human
acugccuggggugcuggccaa

SEQ ID NO: 503668 - RNA, 22 nt, Human
cugggccucauccccagaguuu

SEQ ID NO: 503669 - RNA, 22 nt, Human
gaggagcccagcaccaucacuu

SEQ ID NO: 503670 - RNA, 22 nt, Human
ucauuuauaaggaugcaauuaa

SEQ ID NO: 503671 - RNA, 22 nt, Human
aaguucaagucugcaucuuuuu

SEQ ID NO: 503672 - RNA, 22 nt, Human
cuggcagcuuccuuugcaucug

SEQ ID NO: 503673 - RNA, 22 nt, Human
ugaaaggugacauuucuuggau

SEQ ID NO: 503674 - RNA, 22 nt, Human
caggccugcaggaaaggcuccc

SEQ ID NO: 503675 - RNA, 20 nt, Human
aggucucagagcaagagccc

SEQ ID NO: 503676 - RNA, 22 nt, Human
ggcugggcugcugggucagagc

SEQ ID NO: 503677 - RNA, 22 nt, Human
augagacuaccuguaauguggc

SEQ ID NO: 503678 - RNA, 22 nt, Human
uuauuuuaccuuccucugagcu

SEQ ID NO: 503679 - RNA, 22 nt, Human
uguuugugguuauaauaaguau

SEQ ID NO: 503680 - RNA, 22 nt, Human
acaaaugagaauguagacagag

SEQ ID NO: 503681 - RNA, 22 nt, Human
ggcccucugcucacuuccuauu

SEQ ID NO: 503682 - RNA, 21 nt, Human
ugauccuuucccccauguugc

SEQ ID NO: 503683 - RNA, 22 nt, Human
augucugauaaauaaugcauaa

SEQ ID NO: 503684 - RNA, 22 nt, Human
guaaauauuaaaggcugcuaga

SEQ ID NO: 503685 - RNA, 19 nt, Human
acagagcucucugcuucug

SEQ ID NO: 503686 - RNA, 22 nt, Human
cuguggccccacccucuuggcc

SEQ ID NO: 503687 - RNA, 22 nt, Human
gucaggaaguggcauuggagaa

SEQ ID NO: 503688 - RNA, 22 nt, Human
ggucauuguucuuuucugugau

SEQ ID NO: 503689 - RNA, 22 nt, Human
gaaagugcuuuugagugugugc

SEQ ID NO: 503690 - RNA, 22 nt, Human
uucauuguacuuuaagagaugc

SEQ ID NO: 503691 - RNA, 22 nt, Human
uaaagugcaugcggggccagau

SEQ ID NO: 503692 - RNA, 22 nt, Human
gaaagggcaugggcaugacaac

SEQ ID NO: 503693 - RNA, 22 nt, Human
cucagagaaaugucacaacaau

SEQ ID NO: 503694 - RNA, 22 nt, Human
gaggaugugucuggucugggca

SEQ ID NO: 503695 - RNA, 22 nt, Human
uuuuccuuucaucaggacaaag

SEQ ID NO: 503696 - RNA, 22 nt, Human
uaggccagcccuuaguccuguc

SEQ ID NO: 503697 - RNA, 22 nt, Human
ucugagcuguggccauucuucc

SEQ ID NO: 503698 - RNA, 21 nt, Human
uguaugcacgcacaugcacac

SEQ ID NO: 503699 - RNA, 22 nt, Human
ccugccuguaagauggguacaa

SEQ ID NO: 503700 - RNA, 22 nt, Human
ucacuguauuuggaagggaugg

SEQ ID NO: 503701 - RNA, 22 nt, Human
ugaauccagagcuauuucgucc

SEQ ID NO: 503702 - RNA, 22 nt, Human
uacauauuugucuuuguacugu

SEQ ID NO: 503703 - RNA, 19 nt, Human
ucuguucacauuguuucgc

SEQ ID NO: 503704 - RNA, 22 nt, Human
ugaggcaggacuugcauaaagu

SEQ ID NO: 503705 - RNA, 22 nt, Human
agagcagaggcauggccguggg

SEQ ID NO: 503706 - RNA, 22 nt, Human
uuccauuuuucuaacucucaga

SEQ ID NO: 503707 - RNA, 19 nt, Human
cucaccuggaggugcugau

SEQ ID NO: 503708 - RNA, 22 nt, Human
ugccaaguuucucucagggacu

SEQ ID NO: 503709 - RNA, 22 nt, Human
ccagcuccaaguuugggcauca

SEQ ID NO: 503710 - RNA, 22 nt, Human
aagauuucugcuuuuggaggca

SEQ ID NO: 503711 - RNA, 22 nt, Human
cacagcuugggcucugacaaua

SEQ ID NO: 503712 - RNA, 22 nt, Human
gaguucuauuaugguuagaagu

SEQ ID NO: 503713 - RNA, 23 nt, Human
ccagcccuccaccagcucuaggc

SEQ ID NO: 503714 - RNA, 22 nt, Human
gcuggagccaagcugcucuugg

SEQ ID NO: 503715 - RNA, 22 nt, Human
uuccuguaugucagugaagagc

SEQ ID NO: 503716 - RNA, 22 nt, Human
ucccagggacugggcuaggcuu

SEQ ID NO: 503717 - RNA, 22 nt, Human
ugucaaaaagcugggacaagca

SEQ ID NO: 503718 - RNA, 21 nt, Human
ggagcuggggagcuggcccca

SEQ ID NO: 503719 - RNA, 22 nt, Human
acuccugggugcugaccagcgu

SEQ ID NO: 503720 - RNA, 22 nt, Human
gcccagccccuggguggacgug

SEQ ID NO: 503721 - RNA, 22 nt, Human
acgcagaagggccuggcgugcc

SEQ ID NO: 503722 - RNA, 22 nt, Human
cuauuaggcuuccauuucaugc

SEQ ID NO: 503723 - RNA, 22 nt, Human
uucucuuagcuguaaagucaau

SEQ ID NO: 503724 - RNA, 19 nt, Human
uggcagaggcaguuuguac

SEQ ID NO: 503725 - RNA, 22 nt, Human
cugcucugagaggcucuuccua

SEQ ID NO: 503726 - RNA, 22 nt, Human
ucugggcugugccaaagcucuu

SEQ ID NO: 503727 - RNA, 22 nt, Human
gaggcugccccuuccucagcug

SEQ ID NO: 503728 - RNA, 22 nt, Human
uuuauuuaccuuauguccucca

SEQ ID NO: 503729 - RNA, 22 nt, Human
caggcccucaggcaagggcucu

SEQ ID NO: 503730 - RNA, 22 nt, Human
ugaccugcguaggugguuucug

SEQ ID NO: 503731 - RNA, 22 nt, Human
acccagaggcggagguugcagu

SEQ ID NO: 503732 - RNA, 22 nt, Human
caaagaagagauuuacagagcu

SEQ ID NO: 503733 - RNA, 22 nt, Human
gccuggcccagggcucuuguug

SEQ ID NO: 503734 - RNA, 22 nt, Human
uugcaacaucugaacauuuauc

SEQ ID NO: 503735 - RNA, 22 nt, Human
cuggguucuauuuuuggcuuca

SEQ ID NO: 503736 - RNA, 22 nt, Human
uggccuggccacauccagcagg

SEQ ID NO: 503737 - RNA, 22 nt, Human
ggagugacucucggggccacua

SEQ ID NO: 503738 - RNA, 22 nt, Human
agguccagccugcccucucucc

SEQ ID NO: 503739 - RNA, 22 nt, Human
aagauggcuuagaguccuggug

SEQ ID NO: 503740 - RNA, 22 nt, Human
uacagagauuuauugcuaaggc

SEQ ID NO: 503741 - RNA, 23 nt, Human
uccuuuaaugcuggaauggcuag

SEQ ID NO: 503742 - RNA, 19 nt, Human
ugucuuaauuaacucagag

SEQ ID NO: 503743 - RNA, 22 nt, Human
aguggcuggucuaaggucacag

SEQ ID NO: 503744 - RNA, 22 nt, Human
auacagugccccuuuucacaug

SEQ ID NO: 503745 - RNA, 22 nt, Human
ucccaggacaggccacauggaa

SEQ ID NO: 503746 - RNA, 22 nt, Human
cucuuaguuuaucuuugacaaa

SEQ ID NO: 503747 - RNA, 22 nt, Human
gcauguguggaggagaugugcu

SEQ ID NO: 503748 - RNA, 19 nt, Human
ccacuuugcuucucugggu

SEQ ID NO: 503749 - RNA, 22 nt, Human
gcaaagcaagcugucagccuca

SEQ ID NO: 503750 - RNA, 22 nt, Human
uugaaauaucaaguuauuagug

SEQ ID NO: 503751 - RNA, 22 nt, Human
augcacuugcguguuugcaaau

SEQ ID NO: 503752 - RNA, 22 nt, Human
agcaggcagccauuuggaaggc

SEQ ID NO: 503753 - RNA, 22 nt, Human
gccuuccuuacaccugcucagc

SEQ ID NO: 503754 - RNA, 22 nt, Human
uuuguuaauucuuauguuagag

SEQ ID NO: 503755 - RNA, 22 nt, Human
ugagaaccaugaaaagcuguca

SEQ ID NO: 503756 - RNA, 22 nt, Human
ggcuuugggcccucaagucucc

SEQ ID NO: 503757 - RNA, 22 nt, Human
cucaggagcuuccucagcccau

SEQ ID NO: 503758 - RNA, 22 nt, Human
gcccugugcgcugaguucaggg

SEQ ID NO: 503759 - RNA, 22 nt, Human
cagagcuuugugucagggcugu

SEQ ID NO: 503760 - RNA, 22 nt, Human
ccuccagggcagacggggagca

SEQ ID NO: 503761 - RNA, 22 nt, Human
gggggcuggaauauccaucaac

SEQ ID NO: 503762 - RNA, 22 nt, Human
accuguuuuagucuuuaaucau

SEQ ID NO: 503763 - RNA, 22 nt, Human
augggcuggcagccugaacagc

SEQ ID NO: 503764 - RNA, 22 nt, Human
cuuuauguccuugaagaguugu

SEQ ID NO: 503765 - RNA, 22 nt, Human
agggcagcagcggcccaggccu

SEQ ID NO: 503766 - RNA, 22 nt, Human
gggagggauuaguucugccugg

SEQ ID NO: 503767 - RNA, 22 nt, Human
uggcagagucaucacaucugga

SEQ ID NO: 503768 - RNA, 22 nt, Human
uuguaugaauguauccuaauuu

SEQ ID NO: 503769 - RNA, 22 nt, Human
guccuggccucuggggguaugg

SEQ ID NO: 503770 - RNA, 22 nt, Human
uuuagaaauucaucuauggccu

SEQ ID NO: 503771 - RNA, 22 nt, Human
ggcaguggguuccccaaggcac

SEQ ID NO: 503772 - RNA, 22 nt, Human
agggggcucagcauggauggag

SEQ ID NO: 503773 - RNA, 22 nt, Human
ucugggucuuuacccauggaau

SEQ ID NO: 503774 - RNA, 22 nt, Human
cuggaaggcagagguugcagug

SEQ ID NO: 503775 - RNA, 22 nt, Human
ucugaaaauguugacuuuguuu

SEQ ID NO: 503776 - RNA, 22 nt, Human
ugaagcaggguggccagauugu

SEQ ID NO: 503777 - RNA, 22 nt, Human
gagacagagaucuugcugaguc

SEQ ID NO: 503778 - RNA, 22 nt, Human
uuuccaggcagaggaguuguga

SEQ ID NO: 503779 - RNA, 22 nt, Human
ucucugaucuuuaauucagaua

SEQ ID NO: 503780 - RNA, 22 nt, Human
gacagcuccuuuuggugcauau

SEQ ID NO: 503781 - RNA, 22 nt, Human
cuggcuuccaugcuguaguggc

SEQ ID NO: 503782 - RNA, 22 nt, Human
ucaaaggagacacaaggagaaa

SEQ ID NO: 503783 - RNA, 22 nt, Human
aaggcugacguuuguguuuauu

SEQ ID NO: 503784 - RNA, 22 nt, Human
cagcccaggccgacaguuccuc

SEQ ID NO: 503785 - RNA, 22 nt, Human
uaaaguauaagcauuggaguau

SEQ ID NO: 503786 - RNA, 22 nt, Human
uuugcauuuugauaagaucacu

SEQ ID NO: 503787 - RNA, 22 nt, Human
ggcccacacugacagcugagcu

SEQ ID NO: 503788 - RNA, 22 nt, Human
ucagcuuucucucgccaucagg

SEQ ID NO: 503789 - RNA, 22 nt, Human
auucauguuagcccacauguag

SEQ ID NO: 503790 - RNA, 22 nt, Human
ugggggagccuucacaguagcu

SEQ ID NO: 503791 - RNA, 18 nt, Human
aaaugcuaggcuacauga

SEQ ID NO: 503792 - RNA, 21 nt, Human
gucagcagauccagcacuugu

SEQ ID NO: 503793 - RNA, 22 nt, Human
uguuucagucccuguguucaau

SEQ ID NO: 503794 - RNA, 21 nt, Human
uguccaagguaugcacugggg

SEQ ID NO: 503795 - RNA, 22 nt, Human
agcagguguauauaaggcugag

SEQ ID NO: 503796 - RNA, 21 nt, Human
cagaccauugcaugagcaggu

SEQ ID NO: 503797 - RNA, 22 nt, Human
gaggcugaacagguucucauga

SEQ ID NO: 503798 - RNA, 22 nt, Human
agaacagaagggaggaaggccu

SEQ ID NO: 503799 - RNA, 22 nt, Human
augccaggaacaaacaguggug

SEQ ID NO: 503800 - RNA, 22 nt, Human
ggagagaauuccauggacaugu

SEQ ID NO: 503801 - RNA, 22 nt, Human
aaggcagggaaaguggauuagg

SEQ ID NO: 503802 - RNA, 22 nt, Human
uaaauguguuguggaugaaguu

SEQ ID NO: 503803 - RNA, 22 nt, Human
ccucugggugggaggccgggcg

SEQ ID NO: 503804 - RNA, 22 nt, Human
ucaguggaacugucugggugag

SEQ ID NO: 503805 - RNA, 22 nt, Human
uaacagaaauauuuccagguga

SEQ ID NO: 503806 - RNA, 21 nt, Human
aggggacagaguagcuccagg

SEQ ID NO: 503807 - RNA, 22 nt, Human
uguaucaaggguuuauguaagc

SEQ ID NO: 503808 - RNA, 22 nt, Human
agagcggggauaguuaauauuc

SEQ ID NO: 503809 - RNA, 22 nt, Human
gcuguguccucacacagccuuu

SEQ ID NO: 503810 - RNA, 22 nt, Human
cauuuguucugauuucaaaagg

SEQ ID NO: 503811 - RNA, 22 nt, Human
uccuguggagaggacuggaggu

SEQ ID NO: 503812 - RNA, 22 nt, Human
aggguucugccagugucuugag

SEQ ID NO: 503813 - RNA, 19 nt, Human
agacagagcucaguggguu

SEQ ID NO: 503814 - RNA, 22 nt, Human
ccucccuggccagagcagcagc

SEQ ID NO: 503815 - RNA, 22 nt, Human
gaugccuccaaaugagggcaga

SEQ ID NO: 503816 - RNA, 22 nt, Human
agccugagugcuuaggacuguu

SEQ ID NO: 503817 - RNA, 22 nt, Human
ggcugaguugagaggauuacuu

SEQ ID NO: 503818 - RNA, 22 nt, Human
ccucugcaaagaauuugucucc

SEQ ID NO: 503819 - RNA, 18 nt, Human
cuccagggaacucaguca

SEQ ID NO: 503820 - RNA, 22 nt, Human
gucccagggaugcagacaugag

SEQ ID NO: 503821 - RNA, 22 nt, Human
gcccugggauuggguggaggcu

SEQ ID NO: 503822 - RNA, 22 nt, Human
uacagaagcugagacacugaga

SEQ ID NO: 503823 - RNA, 22 nt, Human
aaaugcaaggauuuuguuaggc

SEQ ID NO: 503824 - RNA, 22 nt, Human
uccugggaguggccauguaaug

SEQ ID NO: 503825 - RNA, 22 nt, Human
aaggagagagcuuugcuggaac

SEQ ID NO: 503826 - RNA, 22 nt, Human
ucuggggacggggcccagcaau

SEQ ID NO: 503827 - RNA, 22 nt, Human
cuucaucuuucugagccucagu

SEQ ID NO: 503828 - RNA, 22 nt, Human
agacccugucaguguuaggaaa

SEQ ID NO: 503829 - RNA, 22 nt, Human
ucagaggcuucuggccagucug

SEQ ID NO: 503830 - RNA, 21 nt, Human
uccugggagucugagauccug

SEQ ID NO: 503831 - RNA, 22 nt, Human
caaagucauggggaugcagguc

SEQ ID NO: 503832 - RNA, 19 nt, Human
aggccugggguuuugcacu

SEQ ID NO: 503833 - RNA, 22 nt, Human
ggucuggccaauagacagcccc

SEQ ID NO: 503834 - RNA, 22 nt, Human
aggcaccuugagagcaggagcu

SEQ ID NO: 503835 - RNA, 22 nt, Human
cugucccucucacaccucacca

SEQ ID NO: 503836 - RNA, 22 nt, Human
gaggccugcuuuggcacucugg

SEQ ID NO: 503837 - RNA, 20 nt, Human
aggcacuggggauagguaag

SEQ ID NO: 503838 - RNA, 22 nt, Human
acuuugcacuaaguuacucauu

SEQ ID NO: 503839 - RNA, 22 nt, Human
ccugcccccgucagaggugaug

SEQ ID NO: 503840 - RNA, 22 nt, Human
cuucagcagccucuugcauaaa

SEQ ID NO: 503841 - RNA, 22 nt, Human
agaaguccccccagcaucguag

SEQ ID NO: 503842 - RNA, 22 nt, Human
ucaugcacaugugucaccauca

SEQ ID NO: 503843 - RNA, 22 nt, Human
uuccauaacugaccgaaugcau

SEQ ID NO: 503844 - RNA, 23 nt, Human
uuauaaauauuuucagguguguu

SEQ ID NO: 503845 - RNA, 22 nt, Human
agggccacaguaaugcugagua

SEQ ID NO: 503846 - RNA, 22 nt, Human
uggagccauaacccuuucguac

SEQ ID NO: 503847 - RNA, 22 nt, Human
uuugaaagaauuuauguacuuu

SEQ ID NO: 503848 - RNA, 22 nt, Human
uggcacuggcgcaggauggcgg

SEQ ID NO: 503849 - RNA, 22 nt, Human
aggcagguguuaacccucugag

SEQ ID NO: 503850 - RNA, 22 nt, Human
ccaaagugauaugugcuguaag

SEQ ID NO: 503851 - RNA, 22 nt, Human
cagggggugcaggcccugugac

SEQ ID NO: 503852 - RNA, 22 nt, Human
ggcagagcugcaugagcacuca

SEQ ID NO: 503853 - RNA, 22 nt, Human
uugccaggggacaucuggagcc

SEQ ID NO: 503854 - RNA, 22 nt, Human
caguuccuaugggcaaaacaca

SEQ ID NO: 503855 - RNA, 22 nt, Human
cugggagguggagguugcauug

SEQ ID NO: 503856 - RNA, 22 nt, Human
aggucaaagaaccuagcuauag

SEQ ID NO: 503857 - RNA, 22 nt, Human
aagcauuucagguagagauauu

SEQ ID NO: 503858 - RNA, 22 nt, Human
ucagugcaaucaagguauguuu

SEQ ID NO: 503859 - RNA, 22 nt, Human
cagagacuggagugcaguggcg

SEQ ID NO: 503860 - RNA, 22 nt, Human
ugcuucuguauugaaauuguua

SEQ ID NO: 503861 - RNA, 22 nt, Human
uuuaaacuaacaguacacguug

SEQ ID NO: 503862 - RNA, 19 nt, Human
ccaaaagcaauuccaagua

SEQ ID NO: 503863 - RNA, 22 nt, Human
agaagcagcaagcccuucaaag

SEQ ID NO: 503864 - RNA, 22 nt, Human
auaucuuuuagagcaagcuugu

SEQ ID NO: 503865 - RNA, 22 nt, Human
agguuccagguucgaaucccau

SEQ ID NO: 503866 - RNA, 22 nt, Human
agcuugggcaacacagcaagac

SEQ ID NO: 503867 - RNA, 22 nt, Human
ggcaagucaggaaguugacauu

SEQ ID NO: 503868 - RNA, 22 nt, Human
agcuuuaaaaauccaauaucca

SEQ ID NO: 503869 - RNA, 22 nt, Human
agcucuccacacauaggacuag

SEQ ID NO: 503870 - RNA, 22 nt, Human
agaacagugcugauaaaucaua

SEQ ID NO: 503871 - RNA, 22 nt, Human
cagugcuggcuguuaggacagu

SEQ ID NO: 503872 - RNA, 22 nt, Human
cagcuccuauuagacacugaau

SEQ ID NO: 503873 - RNA, 22 nt, Human
gguggcagagaggagguaguuu

SEQ ID NO: 503874 - RNA, 21 nt, Human
uauacagaggggaacaggaga

SEQ ID NO: 503875 - RNA, 21 nt, Human
ucuggggaagacaucuaggau

SEQ ID NO: 503876 - RNA, 22 nt, Human
ucucaaauuuguuagauaaaau

SEQ ID NO: 503877 - RNA, 22 nt, Human
ucuugauuacaaauaacaucau

SEQ ID NO: 503878 - RNA, 22 nt, Human
uugggcugaaguagagggcaga

SEQ ID NO: 503879 - RNA, 22 nt, Human
agaucugaaucucauccgagga

SEQ ID NO: 503880 - RNA, 22 nt, Human
ugaaggccagcagagugaaggc

SEQ ID NO: 503881 - RNA, 22 nt, Human
agagugaucagauaucaggugu

SEQ ID NO: 503882 - RNA, 22 nt, Human
gccaggcauuuauugauugaau

SEQ ID NO: 503883 - RNA, 22 nt, Human
ggcuucuccagguacugagcau

SEQ ID NO: 503884 - RNA, 19 nt, Human
cuuaugcagcugagcuugg

SEQ ID NO: 503885 - RNA, 22 nt, Human
acaugaaaguuauucugaguug

SEQ ID NO: 503886 - RNA, 22 nt, Human
ggucugcccuggguggaggcgc

SEQ ID NO: 503887 - RNA, 22 nt, Human
acaaagcuagagaagagaauug

SEQ ID NO: 503888 - RNA, 22 nt, Human
ccacccagccagaugcaggaag

SEQ ID NO: 503889 - RNA, 22 nt, Human
agucucugggcaugguugugac

SEQ ID NO: 503890 - RNA, 22 nt, Human
agguccagugaaacuuuauuug

SEQ ID NO: 503891 - RNA, 22 nt, Human
gcagcagcccagggcucucaga

SEQ ID NO: 503892 - RNA, 22 nt, Human
caugaaauguuagaauuagaca

SEQ ID NO: 503893 - RNA, 22 nt, Human
ccuuaaagaauaagucuuaucu

SEQ ID NO: 503894 - RNA, 22 nt, Human
cccagcuccuuacagggccgaa

SEQ ID NO: 503895 - RNA, 22 nt, Human
aucaggaugacaacugcugggu

SEQ ID NO: 503896 - RNA, 22 nt, Human
cccugccuacaggguuuucuuu

SEQ ID NO: 503897 - RNA, 22 nt, Human
guguaugaacgaaagaauggau

SEQ ID NO: 503898 - RNA, 20 nt, Human
ugucaugcauuagaugaaga

SEQ ID NO: 503899 - RNA, 22 nt, Human
ccuggccacagggcucugcauu

SEQ ID NO: 503900 - RNA, 22 nt, Human
aagcaauaagccagauuuggau

SEQ ID NO: 503901 - RNA, 22 nt, Human
uccaggcauaagccuugagugu

SEQ ID NO: 503902 - RNA, 22 nt, Human
caucucaugggcaugccaagcu

SEQ ID NO: 503903 - RNA, 22 nt, Human
augugcaaauccaaugugaaug

SEQ ID NO: 503904 - RNA, 22 nt, Human
gcugugcagguccccacugccu

SEQ ID NO: 503905 - RNA, 22 nt, Human
uuguaugagcuccaggaacuca

SEQ ID NO: 503906 - RNA, 22 nt, Human
cugagcauggccgguccauggu

SEQ ID NO: 503907 - RNA, 22 nt, Human
cuccugggaggaugcggacccg

SEQ ID NO: 503908 - RNA, 22 nt, Human
uaagaauuguguugaauagagu

SEQ ID NO: 503909 - RNA, 22 nt, Human
cagaggccuuucuacagugaua

SEQ ID NO: 503910 - RNA, 17 nt, Human
uuaagguggaucagcac

SEQ ID NO: 503911 - RNA, 22 nt, Human
aagcugccuugcugaggagaaa

SEQ ID NO: 503912 - RNA, 22 nt, Human
ggaccugcucucccaguucucu

SEQ ID NO: 503913 - RNA, 22 nt, Human
uuuauuaagaugcgaaugcuga

SEQ ID NO: 503914 - RNA, 22 nt, Human
auuugucaaaacacagagaaca

SEQ ID NO: 503915 - RNA, 22 nt, Human
uaagagcuaggauuuuaaauca

SEQ ID NO: 503916 - RNA, 22 nt, Human
ggaaucuuugaaggauuuuaag

SEQ ID NO: 503917 - RNA, 22 nt, Human
gcacugcaucuacuggcaagua

SEQ ID NO: 503918 - RNA, 22 nt, Human
gcauggccuugcuguaguggua

SEQ ID NO: 503919 - RNA, 22 nt, Human
gcagaggcugggugucccaguc

SEQ ID NO: 503920 - RNA, 22 nt, Human
cugcacugagcucucccagccc

SEQ ID NO: 503921 - RNA, 22 nt, Human
uucuuuuaauguucugaaguuu

SEQ ID NO: 503922 - RNA, 22 nt, Human
caggccugugacaccgugucug

SEQ ID NO: 503923 - RNA, 22 nt, Human
caaagcucaugcucuuagccau

SEQ ID NO: 503924 - RNA, 22 nt, Human
ggccuuugcguccacgccgcuu

SEQ ID NO: 503925 - RNA, 22 nt, Human
ugaagccacagagcaucugccu

SEQ ID NO: 503926 - RNA, 22 nt, Human
gaaggaagauucuguuggaauc

SEQ ID NO: 503927 - RNA, 22 nt, Human
agcuguggaguaggggguugga

SEQ ID NO: 503928 - RNA, 22 nt, Human
cuggaucugaacaucgguauca

SEQ ID NO: 503929 - RNA, 22 nt, Human
agcaccaucagaugcaauaucu

SEQ ID NO: 503930 - RNA, 22 nt, Human
aggagcugggagaaggacuaaa

SEQ ID NO: 503931 - RNA, 22 nt, Human
ccagagccucuuaugaagaucg

SEQ ID NO: 503932 - RNA, 22 nt, Human
cagaugagaguggccaggguuc

SEQ ID NO: 503933 - RNA, 22 nt, Human
cuggacuuuggcccaucugcca

SEQ ID NO: 503934 - RNA, 22 nt, Human
agcuuccugucuucugcacaaa

SEQ ID NO: 503935 - RNA, 22 nt, Human
ggcuuuaagguuuaggaagcaa

SEQ ID NO: 503936 - RNA, 22 nt, Human
cugggcuguucugccccugggu

SEQ ID NO: 503937 - RNA, 22 nt, Human
cagagcaugaauaaaaguuaca

SEQ ID NO: 503938 - RNA, 23 nt, Human
aguucaaaaucaaccaggacacu

SEQ ID NO: 503939 - RNA, 22 nt, Human
ucagggcaggacaguguaggcc

SEQ ID NO: 503940 - RNA, 22 nt, Human
agcagcaucuucuaaguaaggc

SEQ ID NO: 503941 - RNA, 22 nt, Human
gccucuggggcagcugagucau

SEQ ID NO: 503942 - RNA, 22 nt, Human
aaggcacuguacuaguuaguua

SEQ ID NO: 503943 - RNA, 22 nt, Human
cacaguggaaguccaggauccc

SEQ ID NO: 503944 - RNA, 22 nt, Human
acagagagggagugauaaaucc

SEQ ID NO: 503945 - RNA, 22 nt, Human
agcaguuuuccugagcuccuca

SEQ ID NO: 503946 - RNA, 22 nt, Human
gggcucuggaaggugcaccaug

SEQ ID NO: 503947 - RNA, 22 nt, Human
ugggcagaaaucaguaucagau

SEQ ID NO: 503948 - RNA, 22 nt, Human
ccuuuuuucuaugccaacucug

SEQ ID NO: 503949 - RNA, 22 nt, Human
agagaagacuuacagccacagu

SEQ ID NO: 503950 - RNA, 17 nt, Human
cagagucugucugcauc

SEQ ID NO: 503951 - RNA, 22 nt, Human
aaaugcuagggagaaacucucc

SEQ ID NO: 503952 - RNA, 22 nt, Human
caggcccugccuugagggaccu

SEQ ID NO: 503953 - RNA, 20 nt, Human
ucucaggguucagcaaagua

SEQ ID NO: 503954 - RNA, 23 nt, Human
uccuuccuuugagaggcuccauc

SEQ ID NO: 503955 - RNA, 22 nt, Human
uggcuuggcuaagaucuaagcu

SEQ ID NO: 503956 - RNA, 22 nt, Human
aguacauacuucaaauguacuu

SEQ ID NO: 503957 - RNA, 22 nt, Human
gccuguuuguuugcaaaggagc

SEQ ID NO: 503958 - RNA, 22 nt, Human
aggcagcaaagaaaugaugcug

SEQ ID NO: 503959 - RNA, 22 nt, Human
acuuguguaacacagaaagaac

SEQ ID NO: 503960 - RNA, 22 nt, Human
uucucacuauguauguagauug

SEQ ID NO: 503961 - RNA, 22 nt, Human
agucauccaagagccugggcag

SEQ ID NO: 503962 - RNA, 22 nt, Human
caguaaauacauaucagagaag

SEQ ID NO: 503963 - RNA, 18 nt, Human
acacacacaccuguguau

SEQ ID NO: 503964 - RNA, 20 nt, Human
guaaaauauggucuuugggu

SEQ ID NO: 503965 - RNA, 21 nt, Human
gcagccagccgagaccaugcc

SEQ ID NO: 503966 - RNA, 20 nt, Human
ccuguguggccagcugaggc

SEQ ID NO: 503967 - RNA, 22 nt, Human
agugacagcugggaaggugaaa

SEQ ID NO: 503968 - RNA, 22 nt, Human
ggagccaguauuuaguggucuu

SEQ ID NO: 503969 - RNA, 22 nt, Human
cagguggccuugccaucuccug

SEQ ID NO: 503970 - RNA, 22 nt, Human
uacacagaagccagaaggccug

SEQ ID NO: 503971 - RNA, 22 nt, Human
uggcagagucugggcuugggca

SEQ ID NO: 503972 - RNA, 22 nt, Human
ucugccaccuucauccuccacu

SEQ ID NO: 503973 - RNA, 22 nt, Human
ccagcccuguaaggaugaggca

SEQ ID NO: 503974 - RNA, 22 nt, Human
cgugagcaaaauggacacuccc

SEQ ID NO: 503975 - RNA, 22 nt, Human
cagaauuugaaguaauauucca

SEQ ID NO: 503976 - RNA, 22 nt, Human
guuuuauuggaacacagccaug

SEQ ID NO: 503977 - RNA, 20 nt, Human
ccugggcucaaagcauccuc

SEQ ID NO: 503978 - RNA, 22 nt, Human
acccugccgugggcugcuugug

SEQ ID NO: 503979 - RNA, 22 nt, Human
cacuguacagcauuaacaaggc

SEQ ID NO: 503980 - RNA, 22 nt, Human
gagacacaaucucauuuacauu

SEQ ID NO: 503981 - RNA, 22 nt, Human
aguguuguaugggaugacugcu

SEQ ID NO: 503982 - RNA, 22 nt, Human
agggccaguaccaggugggugg

SEQ ID NO: 503983 - RNA, 22 nt, Human
aaaaacugguaacuauucccca

SEQ ID NO: 503984 - RNA, 22 nt, Human
ccagcagggcagugcccuggac

SEQ ID NO: 503985 - RNA, 22 nt, Human
aaugauuuccccuacacagaag

SEQ ID NO: 503986 - RNA, 22 nt, Human
gaccugggguaagcuuggcaac

SEQ ID NO: 503987 - RNA, 20 nt, Human
agggcagcuugaggagccgg

SEQ ID NO: 503988 - RNA, 22 nt, Human
aaucagaauuuauugaaucuuu

SEQ ID NO: 503989 - RNA, 22 nt, Human
ucucugagcucaggagcugcag

SEQ ID NO: 503990 - RNA, 22 nt, Human
uucaguguuuguagagauaacu

SEQ ID NO: 503991 - RNA, 22 nt, Human
accccacagcauacaaaggcac

SEQ ID NO: 503992 - RNA, 22 nt, Human
ccucugcucugguccaugugcu

SEQ ID NO: 503993 - RNA, 19 nt, Human
uggcugggugccaauggcc

SEQ ID NO: 503994 - RNA, 22 nt, Human
cuggagcucuguguguuccuga

SEQ ID NO: 503995 - RNA, 22 nt, Human
cucucugaggaaggagcaucug

SEQ ID NO: 503996 - RNA, 22 nt, Human
cagcucugaagaaaggugucua

SEQ ID NO: 503997 - RNA, 22 nt, Human
gcugagcucccagcaguaucug

SEQ ID NO: 503998 - RNA, 18 nt, Human
ugaggcagucagugaugg

SEQ ID NO: 503999 - RNA, 22 nt, Human
uucauucacccaggaaacaucu

SEQ ID NO: 504000 - RNA, 22 nt, Human
ucacagaagggaaagaugccaa

SEQ ID NO: 504001 - RNA, 22 nt, Human
caggccagaggcuguuguugcg

SEQ ID NO: 504002 - RNA, 22 nt, Human
gacccaggguggucaccugaaa

SEQ ID NO: 504003 - RNA, 22 nt, Human
uugccacuaacuagcugugaga

SEQ ID NO: 504004 - RNA, 22 nt, Human
cagggcucuuccggagcaggga

SEQ ID NO: 504005 - RNA, 22 nt, Human
ucuccaggagcaagucacccag

SEQ ID NO: 504006 - RNA, 22 nt, Human
guggccaguggugggcgcccug

SEQ ID NO: 504007 - RNA, 20 nt, Human
cagaccugcacccacuucga

SEQ ID NO: 504008 - RNA, 22 nt, Human
agagaaaugauuccugggcaga

SEQ ID NO: 504009 - RNA, 22 nt, Human
ccuaauuugauuuuaaauagcc

SEQ ID NO: 504010 - RNA, 22 nt, Human
gcucuggacccuggaguggcug

SEQ ID NO: 504011 - RNA, 22 nt, Human
cugggaugucuauagaacacuu

SEQ ID NO: 504012 - RNA, 22 nt, Human
uuguauuuggguaguauagaga

SEQ ID NO: 504013 - RNA, 22 nt, Human
cagguccaagguuccugaauag

SEQ ID NO: 504014 - RNA, 22 nt, Human
uucaaguucauguguagucagu

SEQ ID NO: 504015 - RNA, 22 nt, Human
aggacuucaucaccuguauaaa

SEQ ID NO: 504016 - RNA, 22 nt, Human
cacugagaggucucauuuccaa

SEQ ID NO: 504017 - RNA, 22 nt, Human
auacaugacucacacauucugc

SEQ ID NO: 504018 - RNA, 22 nt, Human
cuguggcucucugcaggguccc

SEQ ID NO: 504019 - RNA, 22 nt, Human
gcugccuggcuuuaguccacuu

SEQ ID NO: 504020 - RNA, 20 nt, Human
gcauccagacacccagcugc

SEQ ID NO: 504021 - RNA, 22 nt, Human
uacaaaguuuucuuggauugag

SEQ ID NO: 504022 - RNA, 22 nt, Human
caguuucuucaucaguuaagca

SEQ ID NO: 504023 - RNA, 22 nt, Human
uacaguauggaaaauguauagu

SEQ ID NO: 504024 - RNA, 19 nt, Human
ccuuugaaucaggacacuu

SEQ ID NO: 504025 - RNA, 22 nt, Human
uagcugucagcaaucaaguggu

SEQ ID NO: 504026 - RNA, 22 nt, Human
caggugcccagcuccugcugug

SEQ ID NO: 504027 - RNA, 22 nt, Human
aggcugccuguuccaaucuccu

SEQ ID NO: 504028 - RNA, 22 nt, Human
gacugugacuucugaagcaaua

SEQ ID NO: 504029 - RNA, 22 nt, Human
ucaauaauggcaggauaaauuu

SEQ ID NO: 504030 - RNA, 22 nt, Human
ggcaguucuggaugcauuguca

SEQ ID NO: 504031 - RNA, 22 nt, Human
ucuggcucuauaacuccuagcu

SEQ ID NO: 504032 - RNA, 22 nt, Human
cuugagcuuagguucaggauug

SEQ ID NO: 504033 - RNA, 22 nt, Human
uguaucaaaccaaauuaauucu

SEQ ID NO: 504034 - RNA, 22 nt, Human
gaaaaugugucaucccuacugu

SEQ ID NO: 504035 - RNA, 22 nt, Human
uccagggcaugcucagacucag

SEQ ID NO: 504036 - RNA, 22 nt, Human
ggccaggcuggucucagacuuc

SEQ ID NO: 504037 - RNA, 22 nt, Human
aaaaucuugacuguuuuuagaa

SEQ ID NO: 504038 - RNA, 22 nt, Human
cagaggccuauccaguguccau

SEQ ID NO: 504039 - RNA, 22 nt, Human
agguuucuggaaagguuuugcu

SEQ ID NO: 504040 - RNA, 22 nt, Human
uauacuuuccugcaacuuugau

SEQ ID NO: 504041 - RNA, 22 nt, Human
gucccugggaugcccuucuggg

SEQ ID NO: 504042 - RNA, 22 nt, Human
aaaguccuagcgauccacagaa

SEQ ID NO: 504043 - RNA, 22 nt, Human
cagcaggaggugaguagcaggu

SEQ ID NO: 504044 - RNA, 22 nt, Human
gcagcccagguguagcucuuug

SEQ ID NO: 504045 - RNA, 23 nt, Human
uucaagauacgguuuccaggcug

SEQ ID NO: 504046 - RNA, 22 nt, Human
cuggccuuuaaaaugaccuuau

SEQ ID NO: 504047 - RNA, 22 nt, Human
cucugaauggacacuccagugu

SEQ ID NO: 504048 - RNA, 22 nt, Human
accgaaggaaacuggaaccguu

SEQ ID NO: 504049 - RNA, 22 nt, Human
cugggcugcuguccacuagggu

SEQ ID NO: 504050 - RNA, 22 nt, Human
uugcaggggaaggagcagagcu

SEQ ID NO: 504051 - RNA, 22 nt, Human
aaaguauguuguggcuuuuaaa

SEQ ID NO: 504052 - RNA, 22 nt, Human
gccuggcugccggccuuggcaa

SEQ ID NO: 504053 - RNA, 22 nt, Human
uauuuucaucuuguccuuggau

SEQ ID NO: 504054 - RNA, 22 nt, Human
auuugccuuggugauuuguaaa

SEQ ID NO: 504055 - RNA, 22 nt, Human
gcauuucugugcauacacauga

SEQ ID NO: 504056 - RNA, 22 nt, Human
ugccagccuccugauaucaucc

SEQ ID NO: 504057 - RNA, 22 nt, Human
aucagcaagauugugucuugua

SEQ ID NO: 504058 - RNA, 22 nt, Human
uacaacagaccuagaugaauga

SEQ ID NO: 504059 - RNA, 22 nt, Human
cuuuguuuuacucagaggcaug

SEQ ID NO: 504060 - RNA, 22 nt, Human
agaaauguggaucguuuuaaaa

SEQ ID NO: 504061 - RNA, 22 nt, Human
auuuuagcuguccaguggauug

SEQ ID NO: 504062 - RNA, 22 nt, Human
cucagccccaauucuccccauu

SEQ ID NO: 504063 - RNA, 22 nt, Human
accucugccaagaugugcuccc

SEQ ID NO: 504064 - RNA, 22 nt, Human
uucacagaccaggaggcuguga

SEQ ID NO: 504065 - RNA, 22 nt, Human
ucugucacuuuuauuuacugaa

SEQ ID NO: 504066 - RNA, 22 nt, Human
ccaggcucagcuauuaagaaac

SEQ ID NO: 504067 - RNA, 22 nt, Human
acuguuuucuguaaagggccag

SEQ ID NO: 504068 - RNA, 22 nt, Human
agguaacacuacuuaguauacu

SEQ ID NO: 504069 - RNA, 22 nt, Human
aggaagccuggggcugcccucg

SEQ ID NO: 504070 - RNA, 22 nt, Human
agaccaagaaaggaugaggauc

SEQ ID NO: 504071 - RNA, 22 nt, Human
ucaauucaacacaugcacauug

SEQ ID NO: 504072 - RNA, 20 nt, Human
ggcaggaccccaguggcauc

SEQ ID NO: 504073 - RNA, 17 nt, Human
gcagugaaaagagauca

SEQ ID NO: 504074 - RNA, 22 nt, Human
uugaauuuagauuguauguuga

SEQ ID NO: 504075 - RNA, 22 nt, Human
ggagucuuaaaaaucaaaugga

SEQ ID NO: 504076 - RNA, 22 nt, Human
gaguccaguuagugaggcuggg

SEQ ID NO: 504077 - RNA, 22 nt, Human
cucugugggggagaggcagcug

SEQ ID NO: 504078 - RNA, 22 nt, Human
cauacuuuugcccugacauucu

SEQ ID NO: 504079 - RNA, 22 nt, Human
cuuugaaagcucccaggacuua

SEQ ID NO: 504080 - RNA, 19 nt, Human
gcuggggaauggauauuga

SEQ ID NO: 504081 - RNA, 22 nt, Human
uacauuccacuagugacuggcg

SEQ ID NO: 504082 - RNA, 22 nt, Human
auuguugagugcuucagcugua

SEQ ID NO: 504083 - RNA, 22 nt, Human
ugccuggguccaggccaagccu

SEQ ID NO: 504084 - RNA, 22 nt, Human
ggccagaggccauccuccugcu

SEQ ID NO: 504085 - RNA, 22 nt, Human
ggcccagcugugcuuccagccc

SEQ ID NO: 504086 - RNA, 22 nt, Human
agaagucaaugaugagagugcu

SEQ ID NO: 504087 - RNA, 22 nt, Human
uuggaaggagccuaaaagagac

SEQ ID NO: 504088 - RNA, 22 nt, Human
cagagccuggcgaugucaugga

SEQ ID NO: 504089 - RNA, 22 nt, Human
ggcuagaagucagaggucaaga

SEQ ID NO: 504090 - RNA, 22 nt, Human
uuccagugaugggcaauuuggu

SEQ ID NO: 504091 - RNA, 21 nt, Human
guucaauagcucuuugaaugc

SEQ ID NO: 504092 - RNA, 23 nt, Human
cauguacacacagcuguacagug

SEQ ID NO: 504093 - RNA, 21 nt, Human
ccacaggggcuccccugucag

SEQ ID NO: 504094 - RNA, 22 nt, Human
uggcuccuaggauggugccugg

SEQ ID NO: 504095 - RNA, 19 nt, Human
gccugccuggguuucugag

SEQ ID NO: 504096 - RNA, 22 nt, Human
cagaggucccuguucuuaagga

SEQ ID NO: 504097 - RNA, 22 nt, Human
gagcuuuacuucugacuggugc

SEQ ID NO: 504098 - RNA, 22 nt, Human
cagcagcugccucagcugggga

SEQ ID NO: 504099 - RNA, 22 nt, Human
agcaguggaccucagugcuauu

SEQ ID NO: 504100 - RNA, 22 nt, Human
ccugaguuaguugcugugucuc

SEQ ID NO: 504101 - RNA, 22 nt, Human
ggcugcucugccuuccagcugg

SEQ ID NO: 504102 - RNA, 22 nt, Human
ugagccaugggacuccaaggga

SEQ ID NO: 504103 - RNA, 23 nt, Human
aacaccaaggcucagagagauaa

SEQ ID NO: 504104 - RNA, 18 nt, Human
aguggucuguuauaucau

SEQ ID NO: 504105 - RNA, 18 nt, Human
aggucuguggucaccagg

SEQ ID NO: 504106 - RNA, 22 nt, Human
accucugcaguagggcugugcc

SEQ ID NO: 504107 - RNA, 22 nt, Human
uacagcuugaugagagcgcgag

SEQ ID NO: 504108 - RNA, 22 nt, Human
ucaguggagcuaagcaugagau

SEQ ID NO: 504109 - RNA, 22 nt, Human
gaaucucaguggaagcaggaag

SEQ ID NO: 504110 - RNA, 22 nt, Human
augcuauguaacuggcagauag

SEQ ID NO: 504111 - RNA, 21 nt, Human
ucuuuuaacaccaggaauucc

SEQ ID NO: 504112 - RNA, 22 nt, Human
caagagcuagaaauugguuaga

SEQ ID NO: 504113 - RNA, 22 nt, Human
agaggccaugcuagaggccugg

SEQ ID NO: 504114 - RNA, 22 nt, Human
auuuccucaugaucauaaugca

SEQ ID NO: 504115 - RNA, 22 nt, Human
gccuggcugcucagccacucac

SEQ ID NO: 504116 - RNA, 22 nt, Human
guugaaagagcauggacuugaa

SEQ ID NO: 504117 - RNA, 22 nt, Human
caaacuguucucugugggauuc

SEQ ID NO: 504118 - RNA, 22 nt, Human
cuucaagaagacagcagagcau

SEQ ID NO: 504119 - RNA, 22 nt, Human
agcaguuuuagggagacacauu

SEQ ID NO: 504120 - RNA, 22 nt, Human
ccagcugcugugcagggaggcu

SEQ ID NO: 504121 - RNA, 22 nt, Human
cagggucaggaggaucuggcuu

SEQ ID NO: 504122 - RNA, 22 nt, Human
cuuucucuguguuucacaugcu

SEQ ID NO: 504123 - RNA, 22 nt, Human
ucauaaauugauuaugugcuuu

SEQ ID NO: 504124 - RNA, 22 nt, Human
ggcucaggggccaggccugucc

SEQ ID NO: 504125 - RNA, 22 nt, Human
uucacaguggcugugccauuug

SEQ ID NO: 504126 - RNA, 22 nt, Human
uccugcagagucccacugauuu

SEQ ID NO: 504127 - RNA, 22 nt, Human
aggagaggucucccuuccccag

SEQ ID NO: 504128 - RNA, 22 nt, Human
gcuaggagauugagcucugaag

SEQ ID NO: 504129 - RNA, 22 nt, Human
uauacaggaaauuuuggaacag

SEQ ID NO: 504130 - RNA, 18 nt, Human
gucauugcaacauacugu

SEQ ID NO: 504131 - RNA, 22 nt, Human
uaagaacaagcuggggguucca

SEQ ID NO: 504132 - RNA, 22 nt, Human
uuagauaaauugcaacuugauu

SEQ ID NO: 504133 - RNA, 22 nt, Human
uguguucaaucccuagucucag

SEQ ID NO: 504134 - RNA, 23 nt, Human
ucucagugccgauugcauacaca

SEQ ID NO: 504135 - RNA, 22 nt, Human
uggaaagagguagaggaucugg

SEQ ID NO: 504136 - RNA, 22 nt, Human
uauuucuuguucccuccaaguu

SEQ ID NO: 504137 - RNA, 17 nt, Human
uuacaacaauucaugag

SEQ ID NO: 504138 - RNA, 18 nt, Human
ucuuggaguaaugaucaa

SEQ ID NO: 504139 - RNA, 22 nt, Human
gaguuuaaauaacacauuucca

SEQ ID NO: 504140 - RNA, 21 nt, Human
ugaaugaugccccagaguugu

SEQ ID NO: 504141 - RNA, 22 nt, Human
gcuggccugaccagccacaggc

SEQ ID NO: 504142 - RNA, 22 nt, Human
uaacuuuggggacacuucucuu

SEQ ID NO: 504143 - RNA, 22 nt, Human
ugcugcacaauuggaaaguauc

SEQ ID NO: 504144 - RNA, 22 nt, Human
aagacaauguuucugauagaua

SEQ ID NO: 504145 - RNA, 22 nt, Human
cugcccugccuggccagugugg

SEQ ID NO: 504146 - RNA, 22 nt, Human
gauccugucuguggagucagca

SEQ ID NO: 504147 - RNA, 22 nt, Human
ggcaguggguggaucucaggga

SEQ ID NO: 504148 - RNA, 22 nt, Human
cugggccauggaagucucugcc

SEQ ID NO: 504149 - RNA, 22 nt, Human
gucagauuaauagcaauaauaa

SEQ ID NO: 504150 - RNA, 22 nt, Human
agggaucaaaaaauguacaugc

SEQ ID NO: 504151 - RNA, 22 nt, Human
uccagccaagggagguuacuag

SEQ ID NO: 504152 - RNA, 22 nt, Human
uggggcuggcacagucucuauu

SEQ ID NO: 504153 - RNA, 22 nt, Human
ugcuucaggaagaaacgccagg

SEQ ID NO: 504154 - RNA, 22 nt, Human
uggccaggggaguuccccucca

SEQ ID NO: 504155 - RNA, 22 nt, Human
ugcccccugguggccagagccg

SEQ ID NO: 504156 - RNA, 21 nt, Human
ugcaauauauauuugccugaa

SEQ ID NO: 504157 - RNA, 21 nt, Human
gagcucucaggcaagaagcag

SEQ ID NO: 504158 - RNA, 22 nt, Human
uccugggaggcaggaccccuuu

SEQ ID NO: 504159 - RNA, 22 nt, Human
accuucaaguaugugggcugaa

SEQ ID NO: 504160 - RNA, 22 nt, Human
gcagugguggagcuuacauauc

SEQ ID NO: 504161 - RNA, 22 nt, Human
guggcucuggcuuuccaggcgg

SEQ ID NO: 504162 - RNA, 22 nt, Human
ggcuggcacucuguccaguguc

SEQ ID NO: 504163 - RNA, 22 nt, Human
aacaugauggggaagaacaaga

SEQ ID NO: 504164 - RNA, 22 nt, Human
accucugcaacccuggaauggg

SEQ ID NO: 504165 - RNA, 22 nt, Human
uagcauuccuuguggcuucuga

SEQ ID NO: 504166 - RNA, 22 nt, Human
cuggcuggccggagcgaggcgg

SEQ ID NO: 504167 - RNA, 23 nt, Human
agggccugauggcucccgcuggc

SEQ ID NO: 504168 - RNA, 22 nt, Human
ugggccugggcuccuguccucu

SEQ ID NO: 504169 - RNA, 22 nt, Human
ccagggaaguaguugugagagc

SEQ ID NO: 504170 - RNA, 22 nt, Human
ccagcagaggggcggagugcag

SEQ ID NO: 504171 - RNA, 21 nt, Human
uccaaaucccauucuguaguc

SEQ ID NO: 504172 - RNA, 22 nt, Human
gaagauuugaaacacauagaca

SEQ ID NO: 504173 - RNA, 22 nt, Human
cggcagagacggcgcuuugaac

SEQ ID NO: 504174 - RNA, 22 nt, Human
acaguguuuucuuaaggagaaa

SEQ ID NO: 504175 - RNA, 22 nt, Human
cuggcugaggcagagccugggg

SEQ ID NO: 504176 - RNA, 22 nt, Human
cauugacaguucuuuaaguugc

SEQ ID NO: 504177 - RNA, 22 nt, Human
ugggcaggggcccugcuuccgu

SEQ ID NO: 504178 - RNA, 22 nt, Human
gguuccacgguguuuggaggca

SEQ ID NO: 504179 - RNA, 22 nt, Human
gggcuucucuuuagugagcuga

SEQ ID NO: 504180 - RNA, 16 nt, Human
cagcccugaggaagaa

SEQ ID NO: 504181 - RNA, 22 nt, Human
auucucaauuuugccaaagggu

SEQ ID NO: 504182 - RNA, 22 nt, Human
ugugcagagaagccacuggggg

SEQ ID NO: 504183 - RNA, 22 nt, Human
cugggcuccacucccacagugu

SEQ ID NO: 504184 - RNA, 22 nt, Human
uucauucccaagaguaaacaua

SEQ ID NO: 504185 - RNA, 22 nt, Human
gagccagcugagcugcacuguc

SEQ ID NO: 504186 - RNA, 22 nt, Human
gccaggcagagccccgugcagc

SEQ ID NO: 504187 - RNA, 22 nt, Human
ugucucagaauggcucauaaua

SEQ ID NO: 504188 - RNA, 22 nt, Human
ugccaggcuaaguggaggacuu

SEQ ID NO: 504189 - RNA, 22 nt, Human
aaugaagccagguagaagagaa

SEQ ID NO: 504190 - RNA, 22 nt, Human
gagagguagaggcucugcuuaa

SEQ ID NO: 504191 - RNA, 22 nt, Human
uacagugucuggauaucaaagg

SEQ ID NO: 504192 - RNA, 21 nt, Human
agcgucaauaucgucaacagg

SEQ ID NO: 504193 - RNA, 21 nt, Human
uccaagcucaacucccuuccu

SEQ ID NO: 504194 - RNA, 22 nt, Human
gagcuggucaguuucagggcca

SEQ ID NO: 504195 - RNA, 22 nt, Human
aaaggagaguagguuacuccau

SEQ ID NO: 504196 - RNA, 22 nt, Human
agcacagauucugaagaguccu

SEQ ID NO: 504197 - RNA, 22 nt, Human
uccaaagaaccuggcuacuguc

SEQ ID NO: 504198 - RNA, 22 nt, Human
uucuuuccucccagccuuugga

SEQ ID NO: 504199 - RNA, 22 nt, Human
uggcugaaggaagauucuucua

SEQ ID NO: 504200 - RNA, 22 nt, Human
aaauuauuacaagcuaguuggc

SEQ ID NO: 504201 - RNA, 22 nt, Human
cugccucucaggucccugagau

SEQ ID NO: 504202 - RNA, 22 nt, Human
uagagaaauaagcuuugccuug

SEQ ID NO: 504203 - RNA, 22 nt, Human
gaggcaguuugccaugccagga

SEQ ID NO: 504204 - RNA, 22 nt, Human
aagggcuccauccuuauaaaug

SEQ ID NO: 504205 - RNA, 22 nt, Human
cuaaaauuaucaagauaauucc

SEQ ID NO: 504206 - RNA, 19 nt, Human
ggggagaacuagagacagc

SEQ ID NO: 504207 - RNA, 22 nt, Human
ucauuaauuugcuuagacuuau

SEQ ID NO: 504208 - RNA, 22 nt, Human
cuuccucuguguccugggcuuc

SEQ ID NO: 504209 - RNA, 22 nt, Human
ucagcaggcgguuccuuguggg

SEQ ID NO: 504210 - RNA, 22 nt, Human
accugagaaugggggcaugugu

SEQ ID NO: 504211 - RNA, 22 nt, Human
cugccucugcgucccacagagu

SEQ ID NO: 504212 - RNA, 19 nt, Human
uggggccuccugucccugg

SEQ ID NO: 504213 - RNA, 23 nt, Human
ugaaauauucuuuugcaugagcu

SEQ ID NO: 504214 - RNA, 22 nt, Human
acuauucaagugcucauucaga

SEQ ID NO: 504215 - RNA, 20 nt, Human
gcucaguggagaaaugcacc

SEQ ID NO: 504216 - RNA, 22 nt, Human
ucuggauuuguggaaaaucugc

SEQ ID NO: 504217 - RNA, 22 nt, Human
cuccucccacggucucaggaag

SEQ ID NO: 504218 - RNA, 22 nt, Human
caagaccucaaaaugagagggg

SEQ ID NO: 504219 - RNA, 22 nt, Human
auggcugcaucauccugguuga

SEQ ID NO: 504220 - RNA, 22 nt, Human
ugggcuccagcaccugugcucu

SEQ ID NO: 504221 - RNA, 22 nt, Human
gaaacaauuuuuguugucuaag

SEQ ID NO: 504222 - RNA, 22 nt, Human
guccucuguuagaaaugugcuu

SEQ ID NO: 504223 - RNA, 20 nt, Human
uagguccaaugcucgucuuc

SEQ ID NO: 504224 - RNA, 22 nt, Human
aaacagcucaagaaguuacucu

SEQ ID NO: 504225 - RNA, 22 nt, Human
ggguccaguaguugguggccgu

SEQ ID NO: 504226 - RNA, 22 nt, Human
ucucagcagccagauccagagc

SEQ ID NO: 504227 - RNA, 22 nt, Human
gaaggggaaaguugagcaaaua

SEQ ID NO: 504228 - RNA, 22 nt, Human
gggcuccagcccgggaccaggu

SEQ ID NO: 504229 - RNA, 22 nt, Human
auccugggaaugggagggucau

SEQ ID NO: 504230 - RNA, 22 nt, Human
cugagaggaugcugcaguggag

SEQ ID NO: 504231 - RNA, 22 nt, Human
auguagcugcagaugauaaugc

SEQ ID NO: 504232 - RNA, 20 nt, Human
uggaccugucucuuuaggga

SEQ ID NO: 504233 - RNA, 22 nt, Human
gagcuggugaucagcuggagga

SEQ ID NO: 504234 - RNA, 22 nt, Human
agugauuugggugucagaaagu

SEQ ID NO: 504235 - RNA, 22 nt, Human
cucugggcccacuuaaaucugg

SEQ ID NO: 504236 - RNA, 19 nt, Human
ucucagagcccuagaggcc

SEQ ID NO: 504237 - RNA, 22 nt, Human
uggcugcucaagggaggaggcu

SEQ ID NO: 504238 - RNA, 22 nt, Human
ggcucagaccucccagcuccag

SEQ ID NO: 504239 - RNA, 22 nt, Human
cugguucauccccuuccaggaa

SEQ ID NO: 504240 - RNA, 22 nt, Human
ggccugccucacagucagcacc

SEQ ID NO: 504241 - RNA, 22 nt, Human
gggaguggauuauguggaccca

SEQ ID NO: 504242 - RNA, 22 nt, Human
uggaaggaagccaaggaagguu

SEQ ID NO: 504243 - RNA, 22 nt, Human
uaucugcaucugcauguguauu

SEQ ID NO: 504244 - RNA, 22 nt, Human
gacaagacaugugaugacauca

SEQ ID NO: 504245 - RNA, 22 nt, Human
aggcaguguauugcuagcggcu

SEQ ID NO: 504246 - RNA, 22 nt, Human
gcccuguguguuugcacugauu

SEQ ID NO: 504247 - RNA, 22 nt, Human
ugcagcaggcacaggacggaag

SEQ ID NO: 504248 - RNA, 22 nt, Human
uauuagggaacugcaagacuaa

SEQ ID NO: 504249 - RNA, 22 nt, Human
cugcaguguucuggaaugcauu

SEQ ID NO: 504250 - RNA, 22 nt, Human
gggcugcuuuuaagggucucag

SEQ ID NO: 504251 - RNA, 22 nt, Human
cauaaguuggguaauauaauga

SEQ ID NO: 504252 - RNA, 22 nt, Human
uuucaucuuccuuggcauaggu

SEQ ID NO: 504253 - RNA, 18 nt, Human
auguacauuugcuaaagc

SEQ ID NO: 504254 - RNA, 22 nt, Human
cagagccaucaugauauggagu

SEQ ID NO: 504255 - RNA, 23 nt, Human
uaugagaacccauacgcugucuu

SEQ ID NO: 504256 - RNA, 22 nt, Human
uucaggaugacaccauguccag

SEQ ID NO: 504257 - RNA, 22 nt, Human
agggacacacuccaguguuauu

SEQ ID NO: 504258 - RNA, 22 nt, Human
caggccagcguccagaacaagc

SEQ ID NO: 504259 - RNA, 22 nt, Human
ugcucagagcuccagcucuccu

SEQ ID NO: 504260 - RNA, 22 nt, Human
gggaaaucucguccucuauuua

SEQ ID NO: 504261 - RNA, 20 nt, Human
aggcagacaaggagucuguu

SEQ ID NO: 504262 - RNA, 22 nt, Human
uuagggagcucaguccucagau

SEQ ID NO: 504263 - RNA, 22 nt, Human
gcaguguuaaacaacugcugcu

SEQ ID NO: 504264 - RNA, 22 nt, Human
cagggaguuuuuguuccucuag

SEQ ID NO: 504265 - RNA, 22 nt, Human
agcagcauagaugcuauccgag

SEQ ID NO: 504266 - RNA, 22 nt, Human
ucucuccuuaucauuguguuua

SEQ ID NO: 504267 - RNA, 17 nt, Human
ccuguguuugcuccuuc

SEQ ID NO: 504268 - RNA, 22 nt, Human
gcugcagggggugggcgucucc

SEQ ID NO: 504269 - RNA, 22 nt, Human
cggggcugcucguccuccugug

SEQ ID NO: 504270 - RNA, 22 nt, Human
guccucugggcagcugccccac

SEQ ID NO: 504271 - RNA, 23 nt, Human
agagccugaaagacuucuggcac

SEQ ID NO: 504272 - RNA, 22 nt, Human
ucagagugguagccuauuuucu

SEQ ID NO: 504273 - RNA, 22 nt, Human
uucuuacauuacuuuacaugug

SEQ ID NO: 504274 - RNA, 22 nt, Human
cucugggcuucaagucagauuu

SEQ ID NO: 504275 - RNA, 22 nt, Human
uagcagcugucaguuucacaua

SEQ ID NO: 504276 - RNA, 22 nt, Human
gagggaccccaggcuggcccuu

SEQ ID NO: 504277 - RNA, 22 nt, Human
ggcagggcuugucucugugaug

SEQ ID NO: 504278 - RNA, 22 nt, Human
gggcuuuagauugcagaggauu

SEQ ID NO: 504279 - RNA, 22 nt, Human
acagagucauucacugaugaag

SEQ ID NO: 504280 - RNA, 22 nt, Human
cuguggcuuuggggcggaggac

SEQ ID NO: 504281 - RNA, 22 nt, Human
aaaaguauuggccaccauuucu

SEQ ID NO: 504282 - RNA, 22 nt, Human
agccagaaaggggcauuaucug

SEQ ID NO: 504283 - RNA, 22 nt, Human
gugggugauguacuggaggcca

SEQ ID NO: 504284 - RNA, 22 nt, Human
ugcugggcuagaagcugaggcc

SEQ ID NO: 504285 - RNA, 22 nt, Human
ggcccuguuagagcucccacaa

SEQ ID NO: 504286 - RNA, 22 nt, Human
gagagcuggccagcuucaguau

SEQ ID NO: 504287 - RNA, 19 nt, Human
aggugacaugugacagccu

SEQ ID NO: 504288 - RNA, 22 nt, Human
auggccuggggagcaugggaag

SEQ ID NO: 504289 - RNA, 22 nt, Human
aacagcuuuguauacaguaacu

SEQ ID NO: 504290 - RNA, 22 nt, Human
agccagggauggcagugcccag

SEQ ID NO: 504291 - RNA, 19 nt, Human
aacuagaaagguuuugaga

SEQ ID NO: 504292 - RNA, 22 nt, Human
agcuggagauucuggggacagu

SEQ ID NO: 504293 - RNA, 22 nt, Human
agaguguuucagucuuccuaga

SEQ ID NO: 504294 - RNA, 22 nt, Human
ucaaaagucugcauucuucaca

SEQ ID NO: 504295 - RNA, 22 nt, Human
uacaaaguuugagaaugcuuuc

SEQ ID NO: 504296 - RNA, 22 nt, Human
aguaaaauuguauuggaaaaca

SEQ ID NO: 504297 - RNA, 22 nt, Human
augcuggugguugauggcagga

SEQ ID NO: 504298 - RNA, 22 nt, Human
ugcaggucuauuuaaaugauug

SEQ ID NO: 504299 - RNA, 22 nt, Human
aaggaaaugugccugacacugc

SEQ ID NO: 504300 - RNA, 22 nt, Human
ucccaaggugcucggcaacagg

SEQ ID NO: 504301 - RNA, 22 nt, Human
aaagccuuuuaugaucaguuaa

SEQ ID NO: 504302 - RNA, 22 nt, Human
uuuauauguuuguacaauuaag

SEQ ID NO: 504303 - RNA, 22 nt, Human
cucuggcuucuaccuugcaguu

SEQ ID NO: 504304 - RNA, 22 nt, Human
guccucagggagucccagucau

SEQ ID NO: 504305 - RNA, 22 nt, Human
ccugguguugugaaguagccgu

SEQ ID NO: 504306 - RNA, 22 nt, Human
aggccacaguugaggccagcaa

SEQ ID NO: 504307 - RNA, 22 nt, Human
aggccucaguucuugccaggug

SEQ ID NO: 504308 - RNA, 19 nt, Human
accucugcagagauguuua

SEQ ID NO: 504309 - RNA, 22 nt, Human
aaaacauugaauugcacacuau

SEQ ID NO: 504310 - RNA, 22 nt, Human
agccagcugccuuucacaucug

SEQ ID NO: 504311 - RNA, 22 nt, Human
gagaaagauuguccuucagggg

SEQ ID NO: 504312 - RNA, 22 nt, Human
caguggucccugagguugcugg

SEQ ID NO: 504313 - RNA, 22 nt, Human
guuccaggcaagugggauagga

SEQ ID NO: 504314 - RNA, 22 nt, Human
ucaauucaguccaacaguaauu

SEQ ID NO: 504315 - RNA, 22 nt, Human
agccuggaagaaccugaagucu

SEQ ID NO: 504316 - RNA, 22 nt, Human
gcccaucaucacuguggaggcu

SEQ ID NO: 504317 - RNA, 22 nt, Human
gccaggagugucccacucauuu

SEQ ID NO: 504318 - RNA, 22 nt, Human
ucacuugccuagcccaguucag

SEQ ID NO: 504319 - RNA, 22 nt, Human
guaacauuauucaugagauaca

SEQ ID NO: 504320 - RNA, 22 nt, Human
gagagcugcauucucagacaca

SEQ ID NO: 504321 - RNA, 22 nt, Human
uuuuucugccauucaaagagga

SEQ ID NO: 504322 - RNA, 22 nt, Human
guacauuucucuuguucuuauu

SEQ ID NO: 504323 - RNA, 22 nt, Human
agauacaaaagauaagauuuag

SEQ ID NO: 504324 - RNA, 22 nt, Human
auacaucucauguaagagauaa

SEQ ID NO: 504325 - RNA, 18 nt, Human
agacccucuaagggcagu

SEQ ID NO: 504326 - RNA, 22 nt, Human
uccuggagaauccugccaccug

SEQ ID NO: 504327 - RNA, 22 nt, Human
cagcugccacuugcucucggcu

SEQ ID NO: 504328 - RNA, 22 nt, Human
auagaagauagcuuuuguuucu

SEQ ID NO: 504329 - RNA, 22 nt, Human
ggccucucucccuggcuugcag

SEQ ID NO: 504330 - RNA, 22 nt, Human
uuagccaugugggaaaaacagc

SEQ ID NO: 504331 - RNA, 22 nt, Human
ggcagugacuggggacccccaa

SEQ ID NO: 504332 - RNA, 22 nt, Human
caucuugagacaugaaaggugu

SEQ ID NO: 504333 - RNA, 22 nt, Human
ucaccucuuuuuuaacaggcuu

SEQ ID NO: 504334 - RNA, 23 nt, Human
acuuaaaugguucuuuaucucag

SEQ ID NO: 504335 - RNA, 22 nt, Human
ucucuuugucugcucuuaguug

SEQ ID NO: 504336 - RNA, 21 nt, Human
uacagaugaggagaccaaggc

SEQ ID NO: 504337 - RNA, 22 nt, Human
ucaggcugagaaaaucuggacc

SEQ ID NO: 504338 - RNA, 22 nt, Human
uucuacuuuagcaugcucauuc

SEQ ID NO: 504339 - RNA, 22 nt, Human
ggcuggaagguagaagaugagg

SEQ ID NO: 504340 - RNA, 22 nt, Human
uggguacuccuauuaguucagu

SEQ ID NO: 504341 - RNA, 22 nt, Human
aagaaagggcuauuguucucca

SEQ ID NO: 504342 - RNA, 22 nt, Human
ugcauuguuuagaacucuuugg

SEQ ID NO: 504343 - RNA, 22 nt, Human
uaaauacagucauuugagccau

SEQ ID NO: 504344 - RNA, 22 nt, Human
ggcucuggaaaguguccuugau

SEQ ID NO: 504345 - RNA, 22 nt, Human
ccucuccuugcacccgucccgc

SEQ ID NO: 504346 - RNA, 22 nt, Human
ggccucacccaucggugccuuu

SEQ ID NO: 504347 - RNA, 22 nt, Human
ugcagcuucuccaucuccuugu

SEQ ID NO: 504348 - RNA, 19 nt, Human
ccauggcaaugaucugaug

SEQ ID NO: 504349 - RNA, 22 nt, Human
ucaaggaagauagcuauuauga

SEQ ID NO: 504350 - RNA, 22 nt, Human
agagccuggcucccagcuaccg

SEQ ID NO: 504351 - RNA, 17 nt, Human
cugaagauaauggcaac

SEQ ID NO: 504352 - RNA, 22 nt, Human
agagaaugcagggcuucggaca

SEQ ID NO: 504353 - RNA, 22 nt, Human
ugcuggccgugagcucucggga

SEQ ID NO: 504354 - RNA, 22 nt, Human
ggcacagcuacuugcucacucu

SEQ ID NO: 504355 - RNA, 22 nt, Human
ugccugcauuuuguggcuggcu

SEQ ID NO: 504356 - RNA, 22 nt, Human
cuggaaggggcagucuuugggc

SEQ ID NO: 504357 - RNA, 22 nt, Human
uaggaacacacauguguagcug

SEQ ID NO: 504358 - RNA, 22 nt, Human
agacauaagugcuaugacauug

SEQ ID NO: 504359 - RNA, 22 nt, Human
auuucucaucaagugccaacuc

SEQ ID NO: 504360 - RNA, 22 nt, Human
aucuggcuugacuuugcgacuu

SEQ ID NO: 504361 - RNA, 21 nt, Human
uucucuggauaggccaguccu

SEQ ID NO: 504362 - RNA, 22 nt, Human
uaagcauucaaugcuuagcacu

SEQ ID NO: 504363 - RNA, 22 nt, Human
ugaugauuucauuucuagcugu

SEQ ID NO: 504364 - RNA, 22 nt, Human
ugggcacuguagcuggugcugg

SEQ ID NO: 504365 - RNA, 22 nt, Human
gcaagcugcuuaagcucauugu

SEQ ID NO: 504366 - RNA, 22 nt, Human
aggcugugggaguugagagucu

SEQ ID NO: 504367 - RNA, 22 nt, Human
ccugagugaauucccucacugu

SEQ ID NO: 504368 - RNA, 22 nt, Human
gucugggcuucagaguuagaga

SEQ ID NO: 504369 - RNA, 22 nt, Human
aaaaugaugcuguaauuuggca

SEQ ID NO: 504370 - RNA, 22 nt, Human
gaguccugcuuucaauucuuuu

SEQ ID NO: 504371 - RNA, 22 nt, Human
acugccauuggucaaaugagug

SEQ ID NO: 504372 - RNA, 20 nt, Human
ggccuuggguuucgccuguu

SEQ ID NO: 504373 - RNA, 22 nt, Human
uucagccuguucaugcuguugc

SEQ ID NO: 504374 - RNA, 22 nt, Human
uguccuggguggaugcuucauu

SEQ ID NO: 504375 - RNA, 22 nt, Human
aaugcaaagcaagcagagauuu

SEQ ID NO: 504376 - RNA, 22 nt, Human
ucagaauaugcuaaugacauuu

SEQ ID NO: 504377 - RNA, 22 nt, Human
cacuguguaagaagaugggcuu

SEQ ID NO: 504378 - RNA, 22 nt, Human
uuaauacagucuccagaaguaa

SEQ ID NO: 504379 - RNA, 22 nt, Human
ugaggcaggaguuaaugugcuc

SEQ ID NO: 504380 - RNA, 22 nt, Human
cugcagagaugaagaagguggc

SEQ ID NO: 504381 - RNA, 22 nt, Human
ucaggcagaccaccgugggcag

SEQ ID NO: 504382 - RNA, 22 nt, Human
uccagcauucuuagaccucuau

SEQ ID NO: 504383 - RNA, 22 nt, Human
cauuugcuagcaggccuuuuau

SEQ ID NO: 504384 - RNA, 22 nt, Human
gcugcucucucccuaaguuggg

SEQ ID NO: 504385 - RNA, 22 nt, Human
cucuggcacacuccuuccaggu

SEQ ID NO: 504386 - RNA, 22 nt, Human
ugccugggacaugcuguggacu

SEQ ID NO: 504387 - RNA, 22 nt, Human
gagucaggcacugcugcugcuc

SEQ ID NO: 504388 - RNA, 22 nt, Human
aagcagcuuaaauuagagccug

SEQ ID NO: 504389 - RNA, 22 nt, Human
agggccagggaagcuguauuuu

SEQ ID NO: 504390 - RNA, 22 nt, Human
gcuguucuuugcaucucuggug

SEQ ID NO: 504391 - RNA, 17 nt, Human
ugaaggccaugaccacg

SEQ ID NO: 504392 - RNA, 22 nt, Human
auuucauagauuguaaaucccu

SEQ ID NO: 504393 - RNA, 22 nt, Human
ggccauggaccccgagcugacc

SEQ ID NO: 504394 - RNA, 22 nt, Human
ugucccaguuuaucugggacug

SEQ ID NO: 504395 - RNA, 21 nt, Human
caauuacagauggcucagggg

SEQ ID NO: 504396 - RNA, 22 nt, Human
auguccaguuucuacacacaua

SEQ ID NO: 504397 - RNA, 22 nt, Human
ggcuggccagggcccucgcugg

SEQ ID NO: 504398 - RNA, 22 nt, Human
agggguggagaguguugccagu

SEQ ID NO: 504399 - RNA, 22 nt, Human
uaaagguagcaugaaacugcaa

SEQ ID NO: 504400 - RNA, 23 nt, Human
gcugcagcuguggauguucucag

SEQ ID NO: 504401 - RNA, 22 nt, Human
agcagaugagccucaugacugg

SEQ ID NO: 504402 - RNA, 22 nt, Human
cucugcuuggaacuggacagaa

SEQ ID NO: 504403 - RNA, 22 nt, Human
ucagaacaauuccuuuauaaca

SEQ ID NO: 504404 - RNA, 22 nt, Human
acauccagaucucagcauggcu

SEQ ID NO: 504405 - RNA, 22 nt, Human
ugcaggcuccaugaggacaggc

SEQ ID NO: 504406 - RNA, 22 nt, Human
gagggucccgagcccugucaga

SEQ ID NO: 504407 - RNA, 22 nt, Human
cagcaggcguugggagaaagac

SEQ ID NO: 504408 - RNA, 18 nt, Human
uuauuuguuacagcacau

SEQ ID NO: 504409 - RNA, 22 nt, Human
ggaggccaccugaccugcuguu

SEQ ID NO: 504410 - RNA, 22 nt, Human
ccugugucuuccccacuggugu

SEQ ID NO: 504411 - RNA, 22 nt, Human
uucuggaaguguuagaaucugg

SEQ ID NO: 504412 - RNA, 21 nt, Human
agcagcagaucuggugagggc

SEQ ID NO: 504413 - RNA, 22 nt, Human
uccugucuuaaugaucucgugc

SEQ ID NO: 504414 - RNA, 22 nt, Human
augggcagcagcugccauucau

SEQ ID NO: 504415 - RNA, 22 nt, Human
gcaugguggccuuaggguagcc

SEQ ID NO: 504416 - RNA, 22 nt, Human
ugucccauggauaccaggcuau

SEQ ID NO: 504417 - RNA, 22 nt, Human
ugagcugggaguggugaugagg

SEQ ID NO: 504418 - RNA, 22 nt, Human
aucccugcccucauggagcuua

SEQ ID NO: 504419 - RNA, 22 nt, Human
uaaugcaguacugauauaaaca

SEQ ID NO: 504420 - RNA, 22 nt, Human
uggcacagugcuggauggugcu

SEQ ID NO: 504421 - RNA, 22 nt, Human
aguggcugcuggaguggagaug

SEQ ID NO: 504422 - RNA, 23 nt, Human
auugaugacuugauuacacuuuu

SEQ ID NO: 504423 - RNA, 23 nt, Human
agccacuucuaucuugcuccugg

SEQ ID NO: 504424 - RNA, 22 nt, Human
caggucaaagguuaguuauguu

SEQ ID NO: 504425 - RNA, 22 nt, Human
aagacaugacugcacagccaaa

SEQ ID NO: 504426 - RNA, 22 nt, Human
caggaaaugcguaguugaacuu

SEQ ID NO: 504427 - RNA, 22 nt, Human
aggaagaaaacuaauuagaugg

SEQ ID NO: 504428 - RNA, 22 nt, Human
gcugggcuucacagagccuuua

SEQ ID NO: 504429 - RNA, 22 nt, Human
guggcccugucccaggccuccu

SEQ ID NO: 504430 - RNA, 22 nt, Human
gcuccucuucucccacugaaug

SEQ ID NO: 504431 - RNA, 22 nt, Human
cgcagggauuucaaggggccuu

SEQ ID NO: 504432 - RNA, 22 nt, Human
uacacauguccaaggugucacc

SEQ ID NO: 504433 - RNA, 22 nt, Human
uugggggguugaggaguagaua

SEQ ID NO: 504434 - RNA, 22 nt, Human
uagcaaaauguggauguaguug

SEQ ID NO: 504435 - RNA, 22 nt, Human
ggcaugggccgaggugccuccu

SEQ ID NO: 504436 - RNA, 22 nt, Human
cccagcaguaaccaguggaaau

SEQ ID NO: 504437 - RNA, 22 nt, Human
acaaaugaaucauacauaaugu

SEQ ID NO: 504438 - RNA, 22 nt, Human
cuuccaaacccaggguaugggc

SEQ ID NO: 504439 - RNA, 22 nt, Human
ucugagcucuaucugugggaau

SEQ ID NO: 504440 - RNA, 22 nt, Human
ucuggccugggccugccggugc

SEQ ID NO: 504441 - RNA, 22 nt, Human
cagccagcuggcacugugagua

SEQ ID NO: 504442 - RNA, 22 nt, Human
acccugggucauauacagugug

SEQ ID NO: 504443 - RNA, 22 nt, Human
cuggcugcgucugcucugacag

SEQ ID NO: 504444 - RNA, 22 nt, Human
uucugggcagagcuggagcugc

SEQ ID NO: 504445 - RNA, 22 nt, Human
agaggccuuucuguugagugaa

SEQ ID NO: 504446 - RNA, 22 nt, Human
acuuagcauuauguaauuacua

SEQ ID NO: 504447 - RNA, 20 nt, Human
gccuggcacccggggcuggc

SEQ ID NO: 504448 - RNA, 22 nt, Human
acagggagaugggugaaagcgg

SEQ ID NO: 504449 - RNA, 22 nt, Human
aggcagguagaaggaucuuuau

SEQ ID NO: 504450 - RNA, 22 nt, Human
uccugggcagaaugggauggcu

SEQ ID NO: 504451 - RNA, 22 nt, Human
aggcagcccacaggacacagga

SEQ ID NO: 504452 - RNA, 22 nt, Human
aggagagagcugagcuuugcug

SEQ ID NO: 504453 - RNA, 22 nt, Human
aggaggaaagaaggcccccagc

SEQ ID NO: 504454 - RNA, 22 nt, Human
ucucugggaauucacaagcccu

SEQ ID NO: 504455 - RNA, 22 nt, Human
uuacaaagauuauauucaguua

SEQ ID NO: 504456 - RNA, 22 nt, Human
aucauguuccagaaacagugau

SEQ ID NO: 504457 - RNA, 22 nt, Human
ucuaggaguaaugagcuagcac

SEQ ID NO: 504458 - RNA, 22 nt, Human
ugccucuguggaaauggugguc

SEQ ID NO: 504459 - RNA, 22 nt, Human
uggacagguugaguaggaggag

SEQ ID NO: 504460 - RNA, 22 nt, Human
gugacagauuugcugcgcaugg

SEQ ID NO: 504461 - RNA, 21 nt, Human
ucaguccuguuagccuuuggg

SEQ ID NO: 504462 - RNA, 22 nt, Human
gccuggagggcucuagagaggc

SEQ ID NO: 504463 - RNA, 22 nt, Human
ucuuuauuucugaaucccccau

SEQ ID NO: 504464 - RNA, 22 nt, Human
acaggcucacagucauuucauu

SEQ ID NO: 504465 - RNA, 22 nt, Human
gcuucuuuggcaacccugacau

SEQ ID NO: 504466 - RNA, 20 nt, Human
ccucaguguccuggacuggg

SEQ ID NO: 504467 - RNA, 22 nt, Human
aaagaaugucugaacagcuggc

SEQ ID NO: 504468 - RNA, 22 nt, Human
ccuggcuccugccucugcaggg

SEQ ID NO: 504469 - RNA, 22 nt, Human
acauguuuaaguuuaaugaaaa

SEQ ID NO: 504470 - RNA, 22 nt, Human
guguuuuaucagacaaaguaua

SEQ ID NO: 504471 - RNA, 22 nt, Human
ucuuguuuggauuuugggcagu

SEQ ID NO: 504472 - RNA, 22 nt, Human
aaggaggaauucugaguucaug

SEQ ID NO: 504473 - RNA, 22 nt, Human
aaguccaccagucagacuagga

SEQ ID NO: 504474 - RNA, 22 nt, Human
uggcucaguuugggggauugaa

SEQ ID NO: 504475 - RNA, 21 nt, Human
uaugagaaaacugaggugcau

SEQ ID NO: 504476 - RNA, 22 nt, Human
ucacaacucuuuccauuuaaua

SEQ ID NO: 504477 - RNA, 22 nt, Human
cccaggaggccaagguugcagu

SEQ ID NO: 504478 - RNA, 17 nt, Human
ccaggucuccuugcuuu

SEQ ID NO: 504479 - RNA, 22 nt, Human
gugugcuguuguucagguagaa

SEQ ID NO: 504480 - RNA, 22 nt, Human
caggacauugauccauuggcac

SEQ ID NO: 504481 - RNA, 22 nt, Human
gggcucuggauggagccugcag

SEQ ID NO: 504482 - RNA, 21 nt, Human
caucacauuacucaaaguccu

SEQ ID NO: 504483 - RNA, 22 nt, Human
uggcagagucucuccuuuccag

SEQ ID NO: 504484 - RNA, 22 nt, Human
agccauugaguuuuaugugcua

SEQ ID NO: 504485 - RNA, 22 nt, Human
gcugaggcaaaccaagaaugua

SEQ ID NO: 504486 - RNA, 22 nt, Human
cucugagagagcuggugagcac

SEQ ID NO: 504487 - RNA, 21 nt, Human
ucaggggcuguguuuuccauc

SEQ ID NO: 504488 - RNA, 22 nt, Human
cagcuccuagaucggcgaagug

SEQ ID NO: 504489 - RNA, 22 nt, Human
gccuggaagugugucgugggaa

SEQ ID NO: 504490 - RNA, 22 nt, Human
ugcaggagcagagauggcugga

SEQ ID NO: 504491 - RNA, 22 nt, Human
ucuggcagggguucugcacuug

SEQ ID NO: 504492 - RNA, 22 nt, Human
caggcuugcugcuagagcacuu

SEQ ID NO: 504493 - RNA, 18 nt, Human
gagaggcccggcugugcc

SEQ ID NO: 504494 - RNA, 22 nt, Human
ccugggcagguguggcuucccc

SEQ ID NO: 504495 - RNA, 22 nt, Human
cagggcaggaauuugacauugc

SEQ ID NO: 504496 - RNA, 21 nt, Human
uucauuuguuauagacaaagu

SEQ ID NO: 504497 - RNA, 22 nt, Human
aaaugcuaacaaggaaugcugc

SEQ ID NO: 504498 - RNA, 22 nt, Human
gaaacagcacguuuggagagau

SEQ ID NO: 504499 - RNA, 22 nt, Human
agcagcuccucuaggaacggau

SEQ ID NO: 504500 - RNA, 21 nt, Human
gcugcagggcccagggcaccc

SEQ ID NO: 504501 - RNA, 22 nt, Human
ccugagagagaagcgaccuggu

SEQ ID NO: 504502 - RNA, 21 nt, Human
ugugucacuaacuagaggcua

SEQ ID NO: 504503 - RNA, 22 nt, Human
aaauguguauaugaaacaugau

SEQ ID NO: 504504 - RNA, 22 nt, Human
uguggcagaguaaggacccagu

SEQ ID NO: 504505 - RNA, 22 nt, Human
augcuuuacaguuuuccaaaca

SEQ ID NO: 504506 - RNA, 22 nt, Human
ccucuggcauagcaaguggccu

SEQ ID NO: 504507 - RNA, 22 nt, Human
ggcacacagauggagcacuagc

SEQ ID NO: 504508 - RNA, 22 nt, Human
cccaggagguggagcuugcagu

SEQ ID NO: 504509 - RNA, 22 nt, Human
ccugccuggcugucagcagagc

SEQ ID NO: 504510 - RNA, 22 nt, Human
gcagugcauuacucacauguuu

SEQ ID NO: 504511 - RNA, 22 nt, Human
cuggcuuuuagugugaagacuu

SEQ ID NO: 504512 - RNA, 22 nt, Human
caggcuggagugcaauggugcu

SEQ ID NO: 504513 - RNA, 19 nt, Human
agaggccucagcagcuggc

SEQ ID NO: 504514 - RNA, 22 nt, Human
cauuguauugaggauacuuaag

SEQ ID NO: 504515 - RNA, 22 nt, Human
ugagucuuuuauccugggaaug

SEQ ID NO: 504516 - RNA, 22 nt, Human
aguccuucaagaaaucuggaaa

SEQ ID NO: 504517 - RNA, 22 nt, Human
uugcagcugaggaaauugaagc

SEQ ID NO: 504518 - RNA, 22 nt, Human
ccugcagguaaggcuaacugcc

SEQ ID NO: 504519 - RNA, 22 nt, Human
ugcagcucaggauucucagggc

SEQ ID NO: 504520 - RNA, 22 nt, Human
acuguggccggaacagugggac

SEQ ID NO: 504521 - RNA, 22 nt, Human
ucagaguguggugagaugugca

SEQ ID NO: 504522 - RNA, 22 nt, Human
agcugauacauuucuuguagcc

SEQ ID NO: 504523 - RNA, 22 nt, Human
uuuagcuuugaaggauaugguu

SEQ ID NO: 504524 - RNA, 22 nt, Human
uuuucaguuacuguuuauguga

SEQ ID NO: 504525 - RNA, 22 nt, Human
aaggcuggaguacagugcagug

SEQ ID NO: 504526 - RNA, 22 nt, Human
guuugcauuccaauuuagggga

SEQ ID NO: 504527 - RNA, 22 nt, Human
aaagcauuucaugucuagaaag

SEQ ID NO: 504528 - RNA, 22 nt, Human
gagcuuuagcugagaccugcuu

SEQ ID NO: 504529 - RNA, 22 nt, Human
uccagaccaugugagaggcgca

SEQ ID NO: 504530 - RNA, 22 nt, Human
acugaggauggauaggucauau

SEQ ID NO: 504531 - RNA, 22 nt, Human
guggccuggcgagcuggcgcgg

SEQ ID NO: 504532 - RNA, 22 nt, Human
acaucacagagcccagauaaag

SEQ ID NO: 504533 - RNA, 22 nt, Human
acagguggagugguuagcaggc

SEQ ID NO: 504534 - RNA, 22 nt, Human
ggcaggcucagcagccaaggag

SEQ ID NO: 504535 - RNA, 22 nt, Human
uguguacauaucuauccuagau

SEQ ID NO: 504536 - RNA, 22 nt, Human
cagccaggcccccgagucguug

SEQ ID NO: 504537 - RNA, 22 nt, Human
uugugaaacauucauggauuug

SEQ ID NO: 504538 - RNA, 22 nt, Human
gugcagugagcagugcagcacc

SEQ ID NO: 504539 - RNA, 22 nt, Human
uccugcagccauuagaggucaa

SEQ ID NO: 504540 - RNA, 22 nt, Human
auuauuggacacuucuucugca

SEQ ID NO: 504541 - RNA, 22 nt, Human
uaccagccugacccugucugac

SEQ ID NO: 504542 - RNA, 22 nt, Human
auuagcuuuggauucagaagau

SEQ ID NO: 504543 - RNA, 22 nt, Human
cauccaggcaccacaaccagcu

SEQ ID NO: 504544 - RNA, 22 nt, Human
auaaacagaguaguugcuacug

SEQ ID NO: 504545 - RNA, 22 nt, Human
gggacaucuuucuagucagggu

SEQ ID NO: 504546 - RNA, 22 nt, Human
aaagcaauggcacaugauggua

SEQ ID NO: 504547 - RNA, 17 nt, Human
acagcaggcccggaggg

SEQ ID NO: 504548 - RNA, 22 nt, Human
aggccugaaguguggagugggg

SEQ ID NO: 504549 - RNA, 22 nt, Human
aggaugaggcuggcaggucuug

SEQ ID NO: 504550 - RNA, 22 nt, Human
uguguucauguauguauacaua

SEQ ID NO: 504551 - RNA, 22 nt, Human
acagugcucaugugacauggug

SEQ ID NO: 504552 - RNA, 22 nt, Human
gagagggcaaacuuguagcuaa

SEQ ID NO: 504553 - RNA, 22 nt, Human
aggagaguucacacuggucaga

SEQ ID NO: 504554 - RNA, 22 nt, Human
cagcaaggguuauaucaaagau

SEQ ID NO: 504555 - RNA, 22 nt, Human
aaggccaucuacuuacggaauu

SEQ ID NO: 504556 - RNA, 22 nt, Human
ugaggccagucucaucacaggc

SEQ ID NO: 504557 - RNA, 22 nt, Human
gaaggcucuggggauugagaua

SEQ ID NO: 504558 - RNA, 22 nt, Human
gccaugccugugucuccaggcc

SEQ ID NO: 504559 - RNA, 19 nt, Human
uccaaaggacccaccucca

SEQ ID NO: 504560 - RNA, 22 nt, Human
uauuuuugccucucagauaaaa

SEQ ID NO: 504561 - RNA, 22 nt, Human
gaauuacagccagaagaaugaa

SEQ ID NO: 504562 - RNA, 22 nt, Human
acagcucacucacagggcuagu

SEQ ID NO: 504563 - RNA, 22 nt, Human
guucgcaucuugaucauggacu

SEQ ID NO: 504564 - RNA, 22 nt, Human
aguccagggcuuagucagcggg

SEQ ID NO: 504565 - RNA, 22 nt, Human
acagaaauuagcagugaguuua

SEQ ID NO: 504566 - RNA, 22 nt, Human
gaggcacugcugggccccugua

SEQ ID NO: 504567 - RNA, 22 nt, Human
aagcaaaagguuacacuucugg

SEQ ID NO: 504568 - RNA, 22 nt, Human
uuccaggauagcuuucaggaau

SEQ ID NO: 504569 - RNA, 22 nt, Human
agaagccaauucugugugaguc

SEQ ID NO: 504570 - RNA, 22 nt, Human
aggaaaggccucagcagaaacc

SEQ ID NO: 504571 - RNA, 22 nt, Human
cugggccuagcaacagaggagu

SEQ ID NO: 504572 - RNA, 22 nt, Human
gcuaccugagcaagagcuucaa

SEQ ID NO: 504573 - RNA, 22 nt, Human
uaucuugagagacaacacagca

SEQ ID NO: 504574 - RNA, 22 nt, Human
cagcacaggucaguuuuuuaag

SEQ ID NO: 504575 - RNA, 17 nt, Human
ucugucuugacugucac

SEQ ID NO: 504576 - RNA, 22 nt, Human
cugcaggcccccuuccuggagu

SEQ ID NO: 504577 - RNA, 22 nt, Human
aaaauccugcugacucgagaug

SEQ ID NO: 504578 - RNA, 22 nt, Human
ggcucaggacacagugguuuag

SEQ ID NO: 504579 - RNA, 22 nt, Human
cagccagggagggcaaaugaga

SEQ ID NO: 504580 - RNA, 22 nt, Human
ucagugcuccuaaagugaaugc

SEQ ID NO: 504581 - RNA, 22 nt, Human
cugcauccuggaaauagcuaag

SEQ ID NO: 504582 - RNA, 22 nt, Human
uggacagguuugggugccuguu

SEQ ID NO: 504583 - RNA, 22 nt, Human
uaagacauuugaaaugugaucc

SEQ ID NO: 504584 - RNA, 22 nt, Human
cuauuuguacagcauuaguaau

SEQ ID NO: 504585 - RNA, 22 nt, Human
aagguccaguuugaauuacugu

SEQ ID NO: 504586 - RNA, 22 nt, Human
gauuauauaauggaagcucuug

SEQ ID NO: 504587 - RNA, 22 nt, Human
uauguacaauuuguuguauguc

SEQ ID NO: 504588 - RNA, 22 nt, Human
ugagccaggcucaagugauccu

SEQ ID NO: 504589 - RNA, 22 nt, Human
gggcaaaaccugggcaucauga

SEQ ID NO: 504590 - RNA, 22 nt, Human
caggacacagaauaaggcaguu

SEQ ID NO: 504591 - RNA, 23 nt, Human
aagcacagaaugguuuaggaguu

SEQ ID NO: 504592 - RNA, 22 nt, Human
uugaauucauuucucauugagu

SEQ ID NO: 504593 - RNA, 22 nt, Human
uguuuaagcugaugagguaucg

SEQ ID NO: 504594 - RNA, 22 nt, Human
aaaguauucaaaaauauuuggu

SEQ ID NO: 504595 - RNA, 22 nt, Human
aggccugacuugaauuuagggc

SEQ ID NO: 504596 - RNA, 20 nt, Human
gggaggcauuggucccucac

SEQ ID NO: 504597 - RNA, 22 nt, Human
acacugcucacuucuucccuug

SEQ ID NO: 504598 - RNA, 22 nt, Human
agucugaagacucaugucugaa

SEQ ID NO: 504599 - RNA, 22 nt, Human
uccuggugcugacacccauagc

SEQ ID NO: 504600 - RNA, 22 nt, Human
gcugcuggggucacaugguaag

SEQ ID NO: 504601 - RNA, 22 nt, Human
ccagucuguacuuugcucuguu

SEQ ID NO: 504602 - RNA, 22 nt, Human
caggcuggagugcaguugugca

SEQ ID NO: 504603 - RNA, 22 nt, Human
cuccugggggacagcggcaggg

SEQ ID NO: 504604 - RNA, 22 nt, Human
uacauauacugagugauuugcu

SEQ ID NO: 504605 - RNA, 22 nt, Human
uccuggcccaaucugcccauga

SEQ ID NO: 504606 - RNA, 22 nt, Human
ucaaaaauggucuuugagcugc

SEQ ID NO: 504607 - RNA, 22 nt, Human
ucuguucauacagaguauagua

SEQ ID NO: 504608 - RNA, 19 nt, Human
aggcuuggcuagauuuacu

SEQ ID NO: 504609 - RNA, 22 nt, Human
uaaugcacauagaaguacuuag

SEQ ID NO: 504610 - RNA, 22 nt, Human
caagguaguucuggucauugac

SEQ ID NO: 504611 - RNA, 22 nt, Human
cagcugccacaggacuuucuga

SEQ ID NO: 504612 - RNA, 22 nt, Human
cagcuuggcgaauguagguaug

SEQ ID NO: 504613 - RNA, 22 nt, Human
gaggaggucgcugcugagcccc

SEQ ID NO: 504614 - RNA, 22 nt, Human
uggcucagcagguuagaaacua

SEQ ID NO: 504615 - RNA, 22 nt, Human
aagucaauuaguaaacuuggaa

SEQ ID NO: 504616 - RNA, 22 nt, Human
gcauuuauuucuuuacugcauc

SEQ ID NO: 504617 - RNA, 22 nt, Human
gguaugaauucacuacuuccaa

SEQ ID NO: 504618 - RNA, 22 nt, Human
ccugggucccugagagaugauu

SEQ ID NO: 504619 - RNA, 22 nt, Human
cuuuucaugccagcccaucaca

SEQ ID NO: 504620 - RNA, 22 nt, Human
ccugggaggcagagguugcagu

SEQ ID NO: 504621 - RNA, 22 nt, Human
agggcuuuacuucucaguucua

SEQ ID NO: 504622 - RNA, 22 nt, Human
ucaggcagaugcagggauggau

SEQ ID NO: 504623 - RNA, 22 nt, Human
acagcagcauaaacugacuaag

SEQ ID NO: 504624 - RNA, 22 nt, Human
uuaccuaaaauagcucaauuua

SEQ ID NO: 504625 - RNA, 22 nt, Human
ugccucugcugcuguggcauca

SEQ ID NO: 504626 - RNA, 22 nt, Human
agucugggagaaggugagauua

SEQ ID NO: 504627 - RNA, 22 nt, Human
gaauuccuuaggcucuugacug

SEQ ID NO: 504628 - RNA, 22 nt, Human
ugccugucuucaggagugucac

SEQ ID NO: 504629 - RNA, 22 nt, Human
agccucucugaugugacagcua

SEQ ID NO: 504630 - RNA, 22 nt, Human
aagcuucacauugaacuugggu

SEQ ID NO: 504631 - RNA, 22 nt, Human
uugggaaggcguggaagcagaa

SEQ ID NO: 504632 - RNA, 22 nt, Human
ucccucuguguugggcaugccu

SEQ ID NO: 504633 - RNA, 19 nt, Human
agcaaauauaauaguguuc

SEQ ID NO: 504634 - RNA, 22 nt, Human
ugaaagcuguccacuaggcugu

SEQ ID NO: 504635 - RNA, 22 nt, Human
accccaagacaguagaagagaa

SEQ ID NO: 504636 - RNA, 22 nt, Human
cauugcuguuaauugucucuag

SEQ ID NO: 504637 - RNA, 22 nt, Human
ggguucagguuggccugagcac

SEQ ID NO: 504638 - RNA, 22 nt, Human
ggcagaggaagcuggaaguggg

SEQ ID NO: 504639 - RNA, 22 nt, Human
ggggccugcgagguucaacuuc

SEQ ID NO: 504640 - RNA, 23 nt, Human
gaagugucugagcuguauuuuuc

SEQ ID NO: 504641 - RNA, 22 nt, Human
cauggcaggugcagauucugug

SEQ ID NO: 504642 - RNA, 22 nt, Human
cagcagcuggugagacacagcc

SEQ ID NO: 504643 - RNA, 22 nt, Human
cucuccagaucugcugagccag

SEQ ID NO: 504644 - RNA, 22 nt, Human
ggacuggacucucaggcucaca

SEQ ID NO: 504645 - RNA, 22 nt, Human
gcuguucucuguaacaugcauu

SEQ ID NO: 504646 - RNA, 22 nt, Human
aaugacuaauaaguuuuacugu

SEQ ID NO: 504647 - RNA, 22 nt, Human
gccccagccaaggugacacgaa

SEQ ID NO: 504648 - RNA, 22 nt, Human
uagcagcugugaguaaaagcca

SEQ ID NO: 504649 - RNA, 22 nt, Human
aucagagaccggucaagucaug

SEQ ID NO: 504650 - RNA, 22 nt, Human
gagggcucaacuacuacuaggc

SEQ ID NO: 504651 - RNA, 22 nt, Human
uggccacacugcccccacuggg

SEQ ID NO: 504652 - RNA, 22 nt, Human
cagggugggcacccagccucca

SEQ ID NO: 504653 - RNA, 19 nt, Human
cagguggcgcucuacaggg

SEQ ID NO: 504654 - RNA, 22 nt, Human
gcugcccugucugcagcaggac

SEQ ID NO: 504655 - RNA, 22 nt, Human
ggagcaaaugccaagugggagg

SEQ ID NO: 504656 - RNA, 22 nt, Human
ugugcccauuccacuugaguac

SEQ ID NO: 504657 - RNA, 21 nt, Human
uuuauguacuucauagaguag

SEQ ID NO: 504658 - RNA, 22 nt, Human
agagaugaaaaguggagacugg

SEQ ID NO: 504659 - RNA, 22 nt, Human
ccucuggcagccagccaguugu

SEQ ID NO: 504660 - RNA, 17 nt, Human
gcuuccugugcugggga

SEQ ID NO: 504661 - RNA, 22 nt, Human
aaugaaaucugcuggguaaaga

SEQ ID NO: 504662 - RNA, 22 nt, Human
uggcagggugccaguugcgagu

SEQ ID NO: 504663 - RNA, 22 nt, Human
aguauaugccagagagauagcu

SEQ ID NO: 504664 - RNA, 22 nt, Human
uuguuuuaguagguacacugag

SEQ ID NO: 504665 - RNA, 22 nt, Human
cuguucucuggcgguggcuguu

SEQ ID NO: 504666 - RNA, 22 nt, Human
cuuagggaauugggaggaugcc

SEQ ID NO: 504667 - RNA, 20 nt, Human
uucaggauucuagaccacac

SEQ ID NO: 504668 - RNA, 22 nt, Human
ggcauggcucggagucagaaca

SEQ ID NO: 504669 - RNA, 22 nt, Human
augugggccgugcggguguccu

SEQ ID NO: 504670 - RNA, 22 nt, Human
auucuucacuguuucagaauga

SEQ ID NO: 504671 - RNA, 22 nt, Human
uucaaagcagagggucaauaca

SEQ ID NO: 504672 - RNA, 22 nt, Human
uucagugugcuucaggacguua

SEQ ID NO: 504673 - RNA, 22 nt, Human
aggggagguggcagaaaugugc

SEQ ID NO: 504674 - RNA, 22 nt, Human
acagggccagccugggaccugg

SEQ ID NO: 504675 - RNA, 22 nt, Human
aaaaguauuuugagcacuuuau

SEQ ID NO: 504676 - RNA, 22 nt, Human
uaaagauggagaugaccuagga

SEQ ID NO: 504677 - RNA, 22 nt, Human
augaagcugaccuugucuugcu

SEQ ID NO: 504678 - RNA, 22 nt, Human
ugugaauauuuccuucuuugga

SEQ ID NO: 504679 - RNA, 22 nt, Human
gcagcuuugaagacuuauuugc

SEQ ID NO: 504680 - RNA, 22 nt, Human
gcagcauugcacuuuuguucuu

SEQ ID NO: 504681 - RNA, 22 nt, Human
uuaauuuucucaucugugaaau

SEQ ID NO: 504682 - RNA, 22 nt, Human
cugccagguuggcgcucgcucu

SEQ ID NO: 504683 - RNA, 22 nt, Human
cugugccacugcccugccacgc

SEQ ID NO: 504684 - RNA, 20 nt, Human
uagaaaucuuauaaaagacu

SEQ ID NO: 504685 - RNA, 22 nt, Human
cagcagggaagcugugcuguuu

SEQ ID NO: 504686 - RNA, 22 nt, Human
cugcagcugucucuacugggca

SEQ ID NO: 504687 - RNA, 22 nt, Human
ugaugggacugccagcugcuga

SEQ ID NO: 504688 - RNA, 22 nt, Human
caggagcuggauaggaccacaa

SEQ ID NO: 504689 - RNA, 22 nt, Human
uggcuguguuaccacuucaugu

SEQ ID NO: 504690 - RNA, 22 nt, Human
aaacauagauaauagauagaug

SEQ ID NO: 504691 - RNA, 22 nt, Human
ucccagggacucucugccuucc

SEQ ID NO: 504692 - RNA, 22 nt, Human
aucuccagauugugaucaucag

SEQ ID NO: 504693 - RNA, 22 nt, Human
agacagaacagaauaauuguug

SEQ ID NO: 504694 - RNA, 23 nt, Human
agguggagcugugcagccggggc

SEQ ID NO: 504695 - RNA, 22 nt, Human
uuuuuaguagagguggguuuca

SEQ ID NO: 504696 - RNA, 22 nt, Human
cuggguuccauguagccaagag

SEQ ID NO: 504697 - RNA, 22 nt, Human
ggagcugaugacgucaccaugg

SEQ ID NO: 504698 - RNA, 22 nt, Human
gauguacacucagaaaagucau

SEQ ID NO: 504699 - RNA, 22 nt, Human
uucagugucccuaguagaaguu

SEQ ID NO: 504700 - RNA, 22 nt, Human
ccucuggcuuacuguuggguuu

SEQ ID NO: 504701 - RNA, 22 nt, Human
uaugcacauugguuuccucauu

SEQ ID NO: 504702 - RNA, 22 nt, Human
ugaaucaaugaauugcacuuca

SEQ ID NO: 504703 - RNA, 22 nt, Human
gggauggcuuuguggcugacuc

SEQ ID NO: 504704 - RNA, 22 nt, Human
agaagagaacugccaaacacuu

SEQ ID NO: 504705 - RNA, 22 nt, Human
auacauauccacaggagauaaa

SEQ ID NO: 504706 - RNA, 22 nt, Human
uauuccagguuucuuguuguau

SEQ ID NO: 504707 - RNA, 22 nt, Human
agcagggccucuggcacugguc

SEQ ID NO: 504708 - RNA, 22 nt, Human
uuugucuucccccuuuaaucag

SEQ ID NO: 504709 - RNA, 22 nt, Human
cugcaggggaccaaagucugac

SEQ ID NO: 504710 - RNA, 22 nt, Human
gaaaagcuaggccaguucagcu

SEQ ID NO: 504711 - RNA, 22 nt, Human
gcuguucugcgucccaggcugg

SEQ ID NO: 504712 - RNA, 22 nt, Human
cugagccauccauaccagcuua

SEQ ID NO: 504713 - RNA, 22 nt, Human
auccugggcaaaguaugcuguc

SEQ ID NO: 504714 - RNA, 22 nt, Human
uguaugcaccauuguauuaccu

SEQ ID NO: 504715 - RNA, 22 nt, Human
ucugggggcgaccagggacugc

SEQ ID NO: 504716 - RNA, 22 nt, Human
cauuuacauuuaagguuaauau

SEQ ID NO: 504717 - RNA, 22 nt, Human
uuauuuucagcuaggaaagcca

SEQ ID NO: 504718 - RNA, 21 nt, Human
acagugugcuucucucccucc

SEQ ID NO: 504719 - RNA, 22 nt, Human
gcucugcuguguuuguucagca

SEQ ID NO: 504720 - RNA, 22 nt, Human
auggccucuagcugagaccaau

SEQ ID NO: 504721 - RNA, 22 nt, Human
acagagaugcaaguguguauuu

SEQ ID NO: 504722 - RNA, 22 nt, Human
ccucuaggauguggcuggagga

SEQ ID NO: 504723 - RNA, 22 nt, Human
agccucugcuggcccuggcacu

SEQ ID NO: 504724 - RNA, 22 nt, Human
guuucauuaccugacccaugag

SEQ ID NO: 504725 - RNA, 20 nt, Human
uggcccaguggggcagggug

SEQ ID NO: 504726 - RNA, 22 nt, Human
gccuuggagaucacugcucaug

SEQ ID NO: 504727 - RNA, 22 nt, Human
agugucuggucucugaacuaaa

SEQ ID NO: 504728 - RNA, 22 nt, Human
guagucacaaaccauucauaug

SEQ ID NO: 504729 - RNA, 22 nt, Human
auggauaaauacuuggugguau

SEQ ID NO: 504730 - RNA, 22 nt, Human
ucugagcugggcacagaaggcg

SEQ ID NO: 504731 - RNA, 21 nt, Human
agaaguccccacucugucgca

SEQ ID NO: 504732 - RNA, 22 nt, Human
uaucuaagagagucaauauuua

SEQ ID NO: 504733 - RNA, 22 nt, Human
uuugcauuuguuuagaaccuga

SEQ ID NO: 504734 - RNA, 22 nt, Human
ugguccugagaauccuguccuc

SEQ ID NO: 504735 - RNA, 22 nt, Human
ggccagggccuggggacugucc

SEQ ID NO: 504736 - RNA, 22 nt, Human
ugggccugauucuugaauccug

SEQ ID NO: 504737 - RNA, 22 nt, Human
gcccucugcuggccucaccucg

SEQ ID NO: 504738 - RNA, 22 nt, Human
auaaacaguagagaaagguggu

SEQ ID NO: 504739 - RNA, 22 nt, Human
aaaauaacuucuacuauuugca

SEQ ID NO: 504740 - RNA, 22 nt, Human
ggcagagaugugggucagaauc

SEQ ID NO: 504741 - RNA, 22 nt, Human
uaguaaaaguuuaguugaaagu

SEQ ID NO: 504742 - RNA, 22 nt, Human
uaaagacaugguguaggugaac

SEQ ID NO: 504743 - RNA, 22 nt, Human
ucugaggccugaagcagcagag

SEQ ID NO: 504744 - RNA, 22 nt, Human
ugagcuguagcagaugcuguug

SEQ ID NO: 504745 - RNA, 22 nt, Human
ucugugccuuuaagaagcucau

SEQ ID NO: 504746 - RNA, 22 nt, Human
guccagaguauucaaguaacuu

SEQ ID NO: 504747 - RNA, 22 nt, Human
agcuugccucuuaaucaccuca

SEQ ID NO: 504748 - RNA, 22 nt, Human
gcuggcagaauuucuucuugcu

SEQ ID NO: 504749 - RNA, 22 nt, Human
uucaaugauuuuuagggaucau

SEQ ID NO: 504750 - RNA, 22 nt, Human
ucugaagaacugaguaaacaug

SEQ ID NO: 504751 - RNA, 22 nt, Human
cuggagagaaaugacaaagcua

SEQ ID NO: 504752 - RNA, 22 nt, Human
uggccugccccgagauccuggc

SEQ ID NO: 504753 - RNA, 22 nt, Human
uccuuuuuauaguuagagaaac

SEQ ID NO: 504754 - RNA, 22 nt, Human
ggcugccuugacccuggcuccg

SEQ ID NO: 504755 - RNA, 22 nt, Human
uuuguaaauagcaguacucaug

SEQ ID NO: 504756 - RNA, 22 nt, Human
uagcagcaggggaaacagcugu

SEQ ID NO: 504757 - RNA, 22 nt, Human
cagcccuguccaaugucugcuc

SEQ ID NO: 504758 - RNA, 22 nt, Human
aggaccaggucuaaugaagaca

SEQ ID NO: 504759 - RNA, 22 nt, Human
ugggcugcccugaugguccuca

SEQ ID NO: 504760 - RNA, 22 nt, Human
agggagaagagaacaaagcccu

SEQ ID NO: 504761 - RNA, 22 nt, Human
ccaggccuguguuguguggagg

SEQ ID NO: 504762 - RNA, 22 nt, Human
aagugaguggccuggagaggug

SEQ ID NO: 504763 - RNA, 22 nt, Human
uccucaggagagcuccuaugcc

SEQ ID NO: 504764 - RNA, 22 nt, Human
cuauacaguaaccacagugauu

SEQ ID NO: 504765 - RNA, 22 nt, Human
aguguucuucuucaaagcucug

SEQ ID NO: 504766 - RNA, 22 nt, Human
uuggaaaugcaaauauauugaa

SEQ ID NO: 504767 - RNA, 18 nt, Human
ugcaggcugggguuccuc

SEQ ID NO: 504768 - RNA, 22 nt, Human
acagcaaaggacgaacacucug

SEQ ID NO: 504769 - RNA, 22 nt, Human
ugucucugugacuccuuccgcc

SEQ ID NO: 504770 - RNA, 22 nt, Human
ggagucuggaguggggcccaag

SEQ ID NO: 504771 - RNA, 22 nt, Human
caguacuuaguucucaugguuu

SEQ ID NO: 504772 - RNA, 22 nt, Human
uacauaauugucuuuguccuca

SEQ ID NO: 504773 - RNA, 22 nt, Human
guaagccucugcucuaucuggu

SEQ ID NO: 504774 - RNA, 22 nt, Human
ucagaagcaggagugugcacaa

SEQ ID NO: 504775 - RNA, 22 nt, Human
uuaaaagagacuuccuuuguuu

SEQ ID NO: 504776 - RNA, 22 nt, Human
uugugaauagugcugcaauaaa

SEQ ID NO: 504777 - RNA, 22 nt, Human
gccuggaggaauguagcugagg

SEQ ID NO: 504778 - RNA, 22 nt, Human
ccaguccucagauggucugugc

SEQ ID NO: 504779 - RNA, 22 nt, Human
gagaaggaaguugagccagcau

SEQ ID NO: 504780 - RNA, 22 nt, Human
ucagaacauuuaaaaagugguu

SEQ ID NO: 504781 - RNA, 22 nt, Human
ggugggaucaaagagucauucg

SEQ ID NO: 504782 - RNA, 22 nt, Human
gaaauucacuguauuucuuggg

SEQ ID NO: 504783 - RNA, 22 nt, Human
caguucugagcuuucccagaag

SEQ ID NO: 504784 - RNA, 22 nt, Human
ccagggccaguaagauuggcau

SEQ ID NO: 504785 - RNA, 22 nt, Human
cagcagcuuugccaagucagcc

SEQ ID NO: 504786 - RNA, 22 nt, Human
uuuccuccuagccuccagccgc

SEQ ID NO: 504787 - RNA, 22 nt, Human
ugccagcacuucuggcugucug

SEQ ID NO: 504788 - RNA, 21 nt, Human
ggacuuacauagguaaggggu

SEQ ID NO: 504789 - RNA, 22 nt, Human
ggagaagggccaauuccaugua

SEQ ID NO: 504790 - RNA, 22 nt, Human
gagcaggcuugcagagaagggg

SEQ ID NO: 504791 - RNA, 22 nt, Human
aggaaagauggaaggaggauaa

SEQ ID NO: 504792 - RNA, 22 nt, Human
cccugggcaagcccuauuuucc

SEQ ID NO: 504793 - RNA, 22 nt, Human
ccagggcaugggaagaacugaa

SEQ ID NO: 504794 - RNA, 22 nt, Human
aggaagagcccgggugacauaa

SEQ ID NO: 504795 - RNA, 22 nt, Human
accaggcaugauguggagcaca

SEQ ID NO: 504796 - RNA, 22 nt, Human
cuucagaggggacucaaaguca

SEQ ID NO: 504797 - RNA, 22 nt, Human
cugcugcucagugucaucaugu

SEQ ID NO: 504798 - RNA, 22 nt, Human
gaggcagcauucgcauagacag

SEQ ID NO: 504799 - RNA, 22 nt, Human
ugagcagacuugaugaggcagc

SEQ ID NO: 504800 - RNA, 22 nt, Human
uuccugagucccggguaaagau

SEQ ID NO: 504801 - RNA, 22 nt, Human
gagcugccugugugccaugaug

SEQ ID NO: 504802 - RNA, 22 nt, Human
ucagcagggccuccuugugcag

SEQ ID NO: 504803 - RNA, 22 nt, Human
augaggcaucugcagucacuag

SEQ ID NO: 504804 - RNA, 22 nt, Human
guguauaacuaucuaucuagua

SEQ ID NO: 504805 - RNA, 22 nt, Human
agaaaggguucucugaggugcu

SEQ ID NO: 504806 - RNA, 22 nt, Human
aacuucauggguucaaagcugg

SEQ ID NO: 504807 - RNA, 22 nt, Human
gcugcugggauccugggucuca

SEQ ID NO: 504808 - RNA, 22 nt, Human
agcagcuguacuuucaucuguu

SEQ ID NO: 504809 - RNA, 19 nt, Human
agucuguggauuugugggu

SEQ ID NO: 504810 - RNA, 22 nt, Human
acacagggcaaugcuuugaccu

SEQ ID NO: 504811 - RNA, 22 nt, Human
caguucuuauuuggccaguguc

SEQ ID NO: 504812 - RNA, 22 nt, Human
aaguuaugaaauuuggacagcu

SEQ ID NO: 504813 - RNA, 18 nt, Human
ccugcagcccaggaggcc

SEQ ID NO: 504814 - RNA, 22 nt, Human
guggccugccagcagauggcgc

SEQ ID NO: 504815 - RNA, 22 nt, Human
ugucucugauaaguaguucagu

SEQ ID NO: 504816 - RNA, 22 nt, Human
gccaccuggacagcugugcccu

SEQ ID NO: 504817 - RNA, 22 nt, Human
uucauacucacuccaauaacug

SEQ ID NO: 504818 - RNA, 22 nt, Human
caggcugauuaggccucgucca

SEQ ID NO: 504819 - RNA, 22 nt, Human
gagaagcaauuuccaacugugc

SEQ ID NO: 504820 - RNA, 22 nt, Human
cugguggagagugggcucugga

SEQ ID NO: 504821 - RNA, 22 nt, Human
gaagaggaugacaggagccggu

SEQ ID NO: 504822 - RNA, 19 nt, Human
ugggcagguucaguaaugg

SEQ ID NO: 504823 - RNA, 22 nt, Human
agaagccagcuucagcugcccg

SEQ ID NO: 504824 - RNA, 22 nt, Human
aguuucuaacauauagcauugg

SEQ ID NO: 504825 - RNA, 22 nt, Human
aagcagaauuuaauagaaaggu

SEQ ID NO: 504826 - RNA, 22 nt, Human
cacagccugcugcacucaagaa

SEQ ID NO: 504827 - RNA, 22 nt, Human
cuggccagcauuuuugcuuuag

SEQ ID NO: 504828 - RNA, 22 nt, Human
agggccugggauguccuccuag

SEQ ID NO: 504829 - RNA, 22 nt, Human
ggagaguggauuccagcuguau

SEQ ID NO: 504830 - RNA, 22 nt, Human
agagcacacugacgucagucug

SEQ ID NO: 504831 - RNA, 22 nt, Human
uuuucuaacaucuaguaauuug

SEQ ID NO: 504832 - RNA, 22 nt, Human
cuucuggaggacacuggcccca

SEQ ID NO: 504833 - RNA, 22 nt, Human
gccuucugugcuccuggccuuu

SEQ ID NO: 504834 - RNA, 22 nt, Human
ugaggcagugcugggaagccug

SEQ ID NO: 504835 - RNA, 22 nt, Human
ccucuggguuaguuuagggagc

SEQ ID NO: 504836 - RNA, 22 nt, Human
gccuguuuuagaugcauugaug

SEQ ID NO: 504837 - RNA, 22 nt, Human
agcagggagaccaucucuuccu

SEQ ID NO: 504838 - RNA, 22 nt, Human
ggucuccauuccuucaucucac

SEQ ID NO: 504839 - RNA, 22 nt, Human
uaaagcaggcaucucucuccuc

SEQ ID NO: 504840 - RNA, 22 nt, Human
gaaugcuacuugacucagcuca

SEQ ID NO: 504841 - RNA, 22 nt, Human
cguggccaguuucaagcuacca

SEQ ID NO: 504842 - RNA, 22 nt, Human
ugcuggggauccguaccaaccc

SEQ ID NO: 504843 - RNA, 22 nt, Human
ccagggucucugcugccugaga

SEQ ID NO: 504844 - RNA, 22 nt, Human
ugucacauaauuuaucuguagg

SEQ ID NO: 504845 - RNA, 22 nt, Human
ucagacaguuugcagugugccu

SEQ ID NO: 504846 - RNA, 22 nt, Human
uuauuagggugguuuauguucu

SEQ ID NO: 504847 - RNA, 22 nt, Human
agcuuuaaagcauauuucuaag

SEQ ID NO: 504848 - RNA, 22 nt, Human
aagccgggccugagaaaugaca

SEQ ID NO: 504849 - RNA, 18 nt, Human
uggcagcaggaagccauu

SEQ ID NO: 504850 - RNA, 22 nt, Human
ucauauaagagcuuuagaguca

SEQ ID NO: 504851 - RNA, 22 nt, Human
ccuggggcucugcacagagcag

SEQ ID NO: 504852 - RNA, 22 nt, Human
aaggaguuuggguagucauaca

SEQ ID NO: 504853 - RNA, 22 nt, Human
cauaauuuuuuuaagucagaac

SEQ ID NO: 504854 - RNA, 22 nt, Human
aggaaaaagaguugcugccuuc

SEQ ID NO: 504855 - RNA, 22 nt, Human
aucaaaguucguaacugauaac

SEQ ID NO: 504856 - RNA, 20 nt, Human
aaucagaaagugugagcucu

SEQ ID NO: 504857 - RNA, 22 nt, Human
cacuacuugaaagaauuacaga

SEQ ID NO: 504858 - RNA, 22 nt, Human
agagguaugugucagugcuuau

SEQ ID NO: 504859 - RNA, 22 nt, Human
augaaugacugucuacuuuggg

SEQ ID NO: 504860 - RNA, 22 nt, Human
ggcagcuccuccuagucugccc

SEQ ID NO: 504861 - RNA, 22 nt, Human
ggaggugggcuaaggacucucu

SEQ ID NO: 504862 - RNA, 22 nt, Human
agcagcaccuguccucgcugcu

SEQ ID NO: 504863 - RNA, 22 nt, Human
ucagugcaggaaucucuagcca

SEQ ID NO: 504864 - RNA, 22 nt, Human
uccugagguauaugcuuugcag

SEQ ID NO: 504865 - RNA, 22 nt, Human
agauggaguggagaugaguaaa

SEQ ID NO: 504866 - RNA, 20 nt, Human
cacaggaaagcuacucaguu

SEQ ID NO: 504867 - RNA, 22 nt, Human
caagaggagcaggcaggugugc

SEQ ID NO: 504868 - RNA, 21 nt, Human
ccccugggagcccugucagua

SEQ ID NO: 504869 - RNA, 22 nt, Human
cccaaguuaaaauucagugcuc

SEQ ID NO: 504870 - RNA, 22 nt, Human
cuggaaaggguccucauucugu

SEQ ID NO: 504871 - RNA, 22 nt, Human
agcuugaguuuuggaugaagug

SEQ ID NO: 504872 - RNA, 22 nt, Human
uugcaacuaaaagaacuugaca

SEQ ID NO: 504873 - RNA, 22 nt, Human
ccuccuggugggcgcuucuggc

SEQ ID NO: 504874 - RNA, 22 nt, Human
ggaaggagucuuuaacacccau

SEQ ID NO: 504875 - RNA, 22 nt, Human
aagcagggugucuugacccaug

SEQ ID NO: 504876 - RNA, 22 nt, Human
uagaaagaacuucauguaaaac

SEQ ID NO: 504877 - RNA, 22 nt, Human
acagaaauauagaagguaggaa

SEQ ID NO: 504878 - RNA, 22 nt, Human
uugcaacauuguaaguuuauau

SEQ ID NO: 504879 - RNA, 22 nt, Human
aaugucaaagugcuuugcaaac

SEQ ID NO: 504880 - RNA, 22 nt, Human
ggggcugggauuugaacccagg

SEQ ID NO: 504881 - RNA, 22 nt, Human
uggccagcagaguucacucucu

SEQ ID NO: 504882 - RNA, 22 nt, Human
uaugagcuuccaguguugcaug

SEQ ID NO: 504883 - RNA, 22 nt, Human
agucuucacucuucacuacuau

SEQ ID NO: 504884 - RNA, 22 nt, Human
uacacaucucugucaguaguga

SEQ ID NO: 504885 - RNA, 22 nt, Human
aagcaauaggguaaucuacuca

SEQ ID NO: 504886 - RNA, 22 nt, Human
uuguuuuaagccagucugccua

SEQ ID NO: 504887 - RNA, 22 nt, Human
gggagucagagagguaauggga

SEQ ID NO: 504888 - RNA, 22 nt, Human
ucagggcaagucucagaagguu

SEQ ID NO: 504889 - RNA, 22 nt, Human
cugggcucagugucucacuccu

SEQ ID NO: 504890 - RNA, 22 nt, Human
augccuguaaucccagugcuuu

SEQ ID NO: 504891 - RNA, 22 nt, Human
gccucccuccaccacugcaggu

SEQ ID NO: 504892 - RNA, 22 nt, Human
aaugcuuuaauugcauguagug

SEQ ID NO: 504893 - RNA, 22 nt, Human
acaaugcauaccuagcagcuca

SEQ ID NO: 504894 - RNA, 22 nt, Human
cagccagaaccuaggaugagcu

SEQ ID NO: 504895 - RNA, 22 nt, Human
auaaguucagguaaagaaauca

SEQ ID NO: 504896 - RNA, 22 nt, Human
gcuaggaaaggaagaacuuuga

SEQ ID NO: 504897 - RNA, 23 nt, Human
auguuauuauuagcagucuugcc

SEQ ID NO: 504898 - RNA, 22 nt, Human
cucccccuuagcucuugucuuu

SEQ ID NO: 504899 - RNA, 22 nt, Human
auguucuuugugauucugagcu

SEQ ID NO: 504900 - RNA, 22 nt, Human
agcugaguuaauucaucacuua

SEQ ID NO: 504901 - RNA, 22 nt, Human
uguaaguaguaauggaaggaca

SEQ ID NO: 504902 - RNA, 22 nt, Human
aaaguucucuaugguguaaaaa

SEQ ID NO: 504903 - RNA, 19 nt, Human
gaggcaguagucaaagcuu

SEQ ID NO: 504904 - RNA, 22 nt, Human
uacaagagacaccagggaggcu

SEQ ID NO: 504905 - RNA, 22 nt, Human
auuaauaaaauaccacuuuguu

SEQ ID NO: 504906 - RNA, 22 nt, Human
gcccucagaggacagcugacuu

SEQ ID NO: 504907 - RNA, 22 nt, Human
ggagacaguauggcuuguagcu

SEQ ID NO: 504908 - RNA, 22 nt, Human
gucccuggaucugggacagcug

SEQ ID NO: 504909 - RNA, 22 nt, Human
cugcuuuguguggucccuccag

SEQ ID NO: 504910 - RNA, 22 nt, Human
gauccugucuccgcaccguguu

SEQ ID NO: 504911 - RNA, 22 nt, Human
aaauuacagccuuggguagcuu

SEQ ID NO: 504912 - RNA, 20 nt, Human
gggcuggcgcauggggaaag

SEQ ID NO: 504913 - RNA, 22 nt, Human
aggaggccgggauucuggagau

SEQ ID NO: 504914 - RNA, 22 nt, Human
cagcugcccauccugggaaaug

SEQ ID NO: 504915 - RNA, 22 nt, Human
acucuggcuugaggaccagguc

SEQ ID NO: 504916 - RNA, 22 nt, Human
aacuagaaaacaagaugcugau

SEQ ID NO: 504917 - RNA, 22 nt, Human
cagaguguuagcgcugguuggg

SEQ ID NO: 504918 - RNA, 22 nt, Human
gcagcagagaacacaaugaugg

SEQ ID NO: 504919 - RNA, 22 nt, Human
uuacaaagcguugagacaagua

SEQ ID NO: 504920 - RNA, 22 nt, Human
ucauuuguaccauuuuuuaaga

SEQ ID NO: 504921 - RNA, 22 nt, Human
auuccuuggaacagaugcgaag

SEQ ID NO: 504922 - RNA, 22 nt, Human
cucugagcccgcugcagcccca

SEQ ID NO: 504923 - RNA, 23 nt, Human
cccugcagucagggugagauggu

SEQ ID NO: 504924 - RNA, 22 nt, Human
aggucugacucuuugccacaua

SEQ ID NO: 504925 - RNA, 22 nt, Human
ucaaaugcaggucuggucuugg

SEQ ID NO: 504926 - RNA, 22 nt, Human
cccaggcagugugugcaugcgu

SEQ ID NO: 504927 - RNA, 22 nt, Human
uuaaaauuuccccaccauguau

SEQ ID NO: 504928 - RNA, 22 nt, Human
aagauguugcaagggacucuuc

SEQ ID NO: 504929 - RNA, 22 nt, Human
agucauuacggacuaguacuac

SEQ ID NO: 504930 - RNA, 22 nt, Human
ugaggaaggaauugagguuuua

SEQ ID NO: 504931 - RNA, 22 nt, Human
uggccaggcagguagaacggcc

SEQ ID NO: 504932 - RNA, 22 nt, Human
gcuggugcauuagcugcaguuc

SEQ ID NO: 504933 - RNA, 22 nt, Human
agacaucagcuugugugcaggg

SEQ ID NO: 504934 - RNA, 22 nt, Human
ugucagggcaugcgguccagcc

SEQ ID NO: 504935 - RNA, 22 nt, Human
uauugaugcuuggauugggcca

SEQ ID NO: 504936 - RNA, 22 nt, Human
aucuuccuucacuuucucccac

SEQ ID NO: 504937 - RNA, 23 nt, Human
uccugaggguuucccagccuugg

SEQ ID NO: 504938 - RNA, 22 nt, Human
gcauucaggguucacggucaac

SEQ ID NO: 504939 - RNA, 22 nt, Human
gguuugcauucugaaaggcuca

SEQ ID NO: 504940 - RNA, 22 nt, Human
uuguacuuuggggaaauguuga

SEQ ID NO: 504941 - RNA, 21 nt, Human
augaaugauuucuacucuuaa

SEQ ID NO: 504942 - RNA, 22 nt, Human
ggccuggccuccagaugugggc

SEQ ID NO: 504943 - RNA, 22 nt, Human
cagucccaaggaggaagcaguc

SEQ ID NO: 504944 - RNA, 22 nt, Human
uuggaaggcugaauggccucuc

SEQ ID NO: 504945 - RNA, 22 nt, Human
gauggguggucucagacuugcc

SEQ ID NO: 504946 - RNA, 22 nt, Human
uuucugaagauacagcuuugcu

SEQ ID NO: 504947 - RNA, 22 nt, Human
ggucccagcugcucaagaggcu

SEQ ID NO: 504948 - RNA, 20 nt, Human
ugcuuuaugcuauacuuugu

SEQ ID NO: 504949 - RNA, 22 nt, Human
gccucugcaugcucagcaccca

SEQ ID NO: 504950 - RNA, 22 nt, Human
ggcucccugggugcuccugcuc

SEQ ID NO: 504951 - RNA, 22 nt, Human
uggcagguacccauuggcugua

SEQ ID NO: 504952 - RNA, 18 nt, Human
gggagcugggaagcuggu

SEQ ID NO: 504953 - RNA, 22 nt, Human
gcugucugcaagccaggaaaug

SEQ ID NO: 504954 - RNA, 22 nt, Human
acaguucccgucuugcacagcu

SEQ ID NO: 504955 - RNA, 22 nt, Human
ugcauauugugaaaauguagau

SEQ ID NO: 504956 - RNA, 22 nt, Human
caagagcucccagaccugggca

SEQ ID NO: 504957 - RNA, 22 nt, Human
gcagauggugccaugucuugug

SEQ ID NO: 504958 - RNA, 22 nt, Human
uggcuagguagcuuucugcugu

SEQ ID NO: 504959 - RNA, 18 nt, Human
acagacaaaauggaaaug

SEQ ID NO: 504960 - RNA, 19 nt, Human
acauauguggauauacaug

SEQ ID NO: 504961 - RNA, 23 nt, Human
agcuuuaacccuuucaggagcau

SEQ ID NO: 504962 - RNA, 22 nt, Human
auuuguuucagggccuugguau

SEQ ID NO: 504963 - RNA, 22 nt, Human
cugccacuuacuaggcauggug

SEQ ID NO: 504964 - RNA, 22 nt, Human
gggcugacuccuauuggaugaa

SEQ ID NO: 504965 - RNA, 22 nt, Human
ggcugucugugguggagcguug

SEQ ID NO: 504966 - RNA, 22 nt, Human
ugguccuggagaguguuccaua

SEQ ID NO: 504967 - RNA, 21 nt, Human
aggcucagagaucaaacagua

SEQ ID NO: 504968 - RNA, 22 nt, Human
uaaaaaguugaaaggacuuauc

SEQ ID NO: 504969 - RNA, 22 nt, Human
ugacaugcuuguuuuccuugaa

SEQ ID NO: 504970 - RNA, 21 nt, Human
acaaaggaagucucuuuuaag

SEQ ID NO: 504971 - RNA, 22 nt, Human
cagggacugagauccagacugu

SEQ ID NO: 504972 - RNA, 22 nt, Human
aggugcuggagucugggcagga

SEQ ID NO: 504973 - RNA, 23 nt, Human
uaaugagaagcuuuguuuccuga

SEQ ID NO: 504974 - RNA, 22 nt, Human
gaaaguauucucccugaauuuu

SEQ ID NO: 504975 - RNA, 22 nt, Human
gugugucagagcucagagaagu

SEQ ID NO: 504976 - RNA, 22 nt, Human
ggccagaggaccucucauagcc

SEQ ID NO: 504977 - RNA, 22 nt, Human
agcagggggaguuagacuagau

SEQ ID NO: 504978 - RNA, 22 nt, Human
ggcucagggaaugaggaagaau

SEQ ID NO: 504979 - RNA, 22 nt, Human
agaaggcuaaagaaacagauug

SEQ ID NO: 504980 - RNA, 22 nt, Human
cuagaaauauuuuacagucaag

SEQ ID NO: 504981 - RNA, 22 nt, Human
agugggagccagcagcuugggg

SEQ ID NO: 504982 - RNA, 22 nt, Human
aagaggaggauugaugugggag

SEQ ID NO: 504983 - RNA, 18 nt, Human
ccgggcuuuggugacaca

SEQ ID NO: 504984 - RNA, 20 nt, Human
cccugagaccagagagcagc

SEQ ID NO: 504985 - RNA, 22 nt, Human
aagagcuggauggaaucuggga

SEQ ID NO: 504986 - RNA, 22 nt, Human
agcugcugaaugacacugcaag

SEQ ID NO: 504987 - RNA, 22 nt, Human
caaggccaugagcagcgagugu

SEQ ID NO: 504988 - RNA, 22 nt, Human
ggugcagaaggaagggagcugg

SEQ ID NO: 504989 - RNA, 22 nt, Human
acauuuaaugauccuacuguga

SEQ ID NO: 504990 - RNA, 22 nt, Human
agcaggcuaaucuugcugaaca

SEQ ID NO: 504991 - RNA, 20 nt, Human
gggguuggcuggcacaggga

SEQ ID NO: 504992 - RNA, 22 nt, Human
cacaugcauaaggauaauuacu

SEQ ID NO: 504993 - RNA, 22 nt, Human
cuggugggaggcaagguggaag

SEQ ID NO: 504994 - RNA, 22 nt, Human
caacagcugaucuuugaugaag

SEQ ID NO: 504995 - RNA, 22 nt, Human
gcuucuggaagcugcuucugcc

SEQ ID NO: 504996 - RNA, 22 nt, Human
ucacaggguuuggaagccuccu

SEQ ID NO: 504997 - RNA, 22 nt, Human
gucagcaugagcaagggcugac

SEQ ID NO: 504998 - RNA, 22 nt, Human
gagcuggugugugcccgagcac

SEQ ID NO: 504999 - RNA, 22 nt, Human
accugccuaucagcugccugcu

SEQ ID NO: 505000 - RNA, 22 nt, Human
cagggagaucuuggcuccuggu

SEQ ID NO: 505001 - RNA, 22 nt, Human
uggcacagaaaaaugcuccauu

SEQ ID NO: 505002 - RNA, 20 nt, Human
uccuggaggcuucauccaua

SEQ ID NO: 505003 - RNA, 22 nt, Human
uuucaauaacaaagcucauuuu

SEQ ID NO: 505004 - RNA, 22 nt, Human
gggcucucaugaguguguggua

SEQ ID NO: 505005 - RNA, 19 nt, Human
uccaccccagccagcucug

SEQ ID NO: 505006 - RNA, 22 nt, Human
cugcucuguuaauuaaacuuug

SEQ ID NO: 505007 - RNA, 22 nt, Human
cuacauaaauauuuaugugucu

SEQ ID NO: 505008 - RNA, 22 nt, Human
ugcugcucaaugagaugccauc

SEQ ID NO: 505009 - RNA, 22 nt, Human
acagauccugguuacagccauu

SEQ ID NO: 505010 - RNA, 22 nt, Human
ggccacuccgcugcuacuggaa

SEQ ID NO: 505011 - RNA, 22 nt, Human
agaaaucauucccaaacccaua

SEQ ID NO: 505012 - RNA, 22 nt, Human
uucaguguucuuuucuguuagc

SEQ ID NO: 505013 - RNA, 22 nt, Human
cugugcauugucuugucuguag

SEQ ID NO: 505014 - RNA, 22 nt, Human
uuucugugguggguaguucaga

SEQ ID NO: 505015 - RNA, 22 nt, Human
cagcuucuggcguggagccuga

SEQ ID NO: 505016 - RNA, 22 nt, Human
uccucugcuccaggcuggacuu

SEQ ID NO: 505017 - RNA, 22 nt, Human
ggcuuuauuauguggccaugug

SEQ ID NO: 505018 - RNA, 22 nt, Human
cccagagaauuccacauagagg

SEQ ID NO: 505019 - RNA, 22 nt, Human
agggcagcucucaccucuggcc

SEQ ID NO: 505020 - RNA, 22 nt, Human
ugccaccaggagaaccagugca

SEQ ID NO: 505021 - RNA, 22 nt, Human
uauuuggaaaggacauguaagu

SEQ ID NO: 505022 - RNA, 22 nt, Human
aguccaaggagagacagcauuu

SEQ ID NO: 505023 - RNA, 22 nt, Human
uuuuccucugagcuuugaauaa

SEQ ID NO: 505024 - RNA, 22 nt, Human
gagauguacaauguguauuaau

SEQ ID NO: 505025 - RNA, 22 nt, Human
ccagcacucugucccagcuucc

SEQ ID NO: 505026 - RNA, 22 nt, Human
uggcucagccagcccuaggaac

SEQ ID NO: 505027 - RNA, 22 nt, Human
cccagagaaucuuucagaaagg

SEQ ID NO: 505028 - RNA, 22 nt, Human
acauuucuuagccuaguuccag

SEQ ID NO: 505029 - RNA, 22 nt, Human
aagauuucagaguuugggggaa

SEQ ID NO: 505030 - RNA, 22 nt, Human
aggcagcuggcagcacccaggg

SEQ ID NO: 505031 - RNA, 23 nt, Human
gggaucuguaaaccuggagaacc

SEQ ID NO: 505032 - RNA, 22 nt, Human
cugccucagcguuguggcccua

SEQ ID NO: 505033 - RNA, 22 nt, Human
cccuguuuggauggggacccag

SEQ ID NO: 505034 - RNA, 22 nt, Human
agggagcugacuggcugccauu

SEQ ID NO: 505035 - RNA, 22 nt, Human
gccaggugcuaucccugcgcug

SEQ ID NO: 505036 - RNA, 22 nt, Human
ucagagguaagggcugagagga

SEQ ID NO: 505037 - RNA, 22 nt, Human
uuuaauauccaguggauacaaa

SEQ ID NO: 505038 - RNA, 22 nt, Human
gacaguuaggacaacugacuuc

SEQ ID NO: 505039 - RNA, 22 nt, Human
acagagcaauaacagggagagg

SEQ ID NO: 505040 - RNA, 22 nt, Human
ggaggugaggccguagggugug

SEQ ID NO: 505041 - RNA, 22 nt, Human
ccugggccuggcgggucggcuc

SEQ ID NO: 505042 - RNA, 22 nt, Human
acugccaaugguaguuugaugg

SEQ ID NO: 505043 - RNA, 22 nt, Human
uccaggaggugaggggaccaaa

SEQ ID NO: 505044 - RNA, 22 nt, Human
gaggagggagcuggaagcucuu

SEQ ID NO: 505045 - RNA, 22 nt, Human
ccagcucuuuuggcugagugag

SEQ ID NO: 505046 - RNA, 22 nt, Human
ccucccacuucuugcugagguc

SEQ ID NO: 505047 - RNA, 22 nt, Human
uaacagaaauaguaggugaggg

SEQ ID NO: 505048 - RNA, 22 nt, Human
agaaaauaaauugaugguggaa

SEQ ID NO: 505049 - RNA, 22 nt, Human
aaagacugguguguuacauaua

SEQ ID NO: 505050 - RNA, 22 nt, Human
agaggccuaaccaagauguccu

SEQ ID NO: 505051 - RNA, 21 nt, Human
agagcugggacuugccugaga

SEQ ID NO: 505052 - RNA, 22 nt, Human
uagaacagaguuccagugauca

SEQ ID NO: 505053 - RNA, 22 nt, Human
uuucagagaggcuucaaaucuu

SEQ ID NO: 505054 - RNA, 22 nt, Human
gaggcagcucuucugaaugggg

SEQ ID NO: 505055 - RNA, 22 nt, Human
uccuggccacccgacagaaguc

SEQ ID NO: 505056 - RNA, 22 nt, Human
cuucaggauuaauuuggggccu

SEQ ID NO: 505057 - RNA, 22 nt, Human
aguaugaauggaaacuaccuau

SEQ ID NO: 505058 - RNA, 22 nt, Human
ccaggccugcaucugcugcgca

SEQ ID NO: 505059 - RNA, 22 nt, Human
gcagcuggucuggccuagagua

SEQ ID NO: 505060 - RNA, 22 nt, Human
cagguggcaugacugccuacaa

SEQ ID NO: 505061 - RNA, 22 nt, Human
uccugcagugugucuccugcac

SEQ ID NO: 505062 - RNA, 22 nt, Human
caggaacaauaucuguccuggu

SEQ ID NO: 505063 - RNA, 22 nt, Human
cagcccugccauggagccuccu

SEQ ID NO: 505064 - RNA, 22 nt, Human
gugacucacacaggccugggcu

SEQ ID NO: 505065 - RNA, 22 nt, Human
ccuuuggccgcuuuauggagga

SEQ ID NO: 505066 - RNA, 22 nt, Human
uugucugaggguuugagagaau

SEQ ID NO: 505067 - RNA, 22 nt, Human
ccugaccacccuuggacaaggu

SEQ ID NO: 505068 - RNA, 21 nt, Human
uugaaggaucacuucuguacc

SEQ ID NO: 505069 - RNA, 22 nt, Human
agccagcuggugggucagcugg

SEQ ID NO: 505070 - RNA, 22 nt, Human
aacuccugaggaaauggucuca

SEQ ID NO: 505071 - RNA, 22 nt, Human
aaagcacagggugcuagagagu

SEQ ID NO: 505072 - RNA, 22 nt, Human
ucucuguacaguacaugccgug

SEQ ID NO: 505073 - RNA, 22 nt, Human
uuugcauuguaauauuuaguuc

SEQ ID NO: 505074 - RNA, 21 nt, Human
uuacuuuugcaccaaccuaau

SEQ ID NO: 505075 - RNA, 22 nt, Human
auucaucuaugacucuaaugug

SEQ ID NO: 505076 - RNA, 22 nt, Human
aauuucagaccauuugcaauua

SEQ ID NO: 505077 - RNA, 22 nt, Human
acuggcuugaaguagauucaaa

SEQ ID NO: 505078 - RNA, 22 nt, Human
cagauggccagaggcagcugca

SEQ ID NO: 505079 - RNA, 22 nt, Human
uuucacauggaagcucucgaga

SEQ ID NO: 505080 - RNA, 22 nt, Human
cugggcuggcgcauccgacacg

SEQ ID NO: 505081 - RNA, 22 nt, Human
accuggcugguugugauuccca

SEQ ID NO: 505082 - RNA, 23 nt, Human
uauuuggaaagagggaagaagac

SEQ ID NO: 505083 - RNA, 22 nt, Human
gcuggccaggugcuuugguucu

SEQ ID NO: 505084 - RNA, 22 nt, Human
cugcauccuaaccuccaugcag

SEQ ID NO: 505085 - RNA, 22 nt, Human
acaaagucugaaaccugaggca

SEQ ID NO: 505086 - RNA, 22 nt, Human
agugucugccaacugcaugguc

SEQ ID NO: 505087 - RNA, 22 nt, Human
aggguauguuuuuaucuacugu

SEQ ID NO: 505088 - RNA, 22 nt, Human
uucuggagaggaacagaaaggu

SEQ ID NO: 505089 - RNA, 22 nt, Human
cacugaagccugggaguaagac

SEQ ID NO: 505090 - RNA, 22 nt, Human
ucaguguuggcuacaucugccu

SEQ ID NO: 505091 - RNA, 23 nt, Human
ucuguuuugcaacaugugacaag

SEQ ID NO: 505092 - RNA, 20 nt, Human
ccaggcacugucccaugcag

SEQ ID NO: 505093 - RNA, 22 nt, Human
cugagccaccggcagggacauc

SEQ ID NO: 505094 - RNA, 22 nt, Human
gccucugcaggugcgguuaucc

SEQ ID NO: 505095 - RNA, 22 nt, Human
cccagcuccgagcuccgagccg

SEQ ID NO: 505096 - RNA, 22 nt, Human
gcauuuuucaucccucuugggu

SEQ ID NO: 505097 - RNA, 22 nt, Human
cagcagcaaggugaggguggag

SEQ ID NO: 505098 - RNA, 22 nt, Human
ucuggggagggagccacagguc

SEQ ID NO: 505099 - RNA, 22 nt, Human
uacaguaaccuuauuugucauu

SEQ ID NO: 505100 - RNA, 22 nt, Human
uguaccacucuacuaaggguuc

SEQ ID NO: 505101 - RNA, 21 nt, Human
gcccccuggacuccucaucca

SEQ ID NO: 505102 - RNA, 22 nt, Human
uucuggcuccagaugcuucugu

SEQ ID NO: 505103 - RNA, 22 nt, Human
ucuggagaaggaagagucuuug

SEQ ID NO: 505104 - RNA, 20 nt, Human
agagaugggguaucaccgua

SEQ ID NO: 505105 - RNA, 23 nt, Human
ucaaaggaggcaucguucugcag

SEQ ID NO: 505106 - RNA, 22 nt, Human
agcucccagaaggcccugcgcc

SEQ ID NO: 505107 - RNA, 22 nt, Human
uccauguguuuuccuguccaca

SEQ ID NO: 505108 - RNA, 22 nt, Human
uucccagaccuguaggaucaga

SEQ ID NO: 505109 - RNA, 22 nt, Human
guagcauucugaguucgcagag

SEQ ID NO: 505110 - RNA, 20 nt, Human
cagcuuggaugagaggcuga

SEQ ID NO: 505111 - RNA, 18 nt, Human
gucacuguguuucugagc

SEQ ID NO: 505112 - RNA, 22 nt, Human
agagggcuuugauucucaguuc

SEQ ID NO: 505113 - RNA, 22 nt, Human
aaaguguaaggaauuuaaguaa

SEQ ID NO: 505114 - RNA, 22 nt, Human
gggaaagaagaagagccauuuu

SEQ ID NO: 505115 - RNA, 22 nt, Human
cauuucugugacacuuccaucu

SEQ ID NO: 505116 - RNA, 22 nt, Human
ucaggugguccuaagugccauc

SEQ ID NO: 505117 - RNA, 22 nt, Human
caaugcaagcaagauggucaca

SEQ ID NO: 505118 - RNA, 22 nt, Human
agucuucagcagccuucucagg

SEQ ID NO: 505119 - RNA, 19 nt, Human
auggaaaaugccagacuga

SEQ ID NO: 505120 - RNA, 22 nt, Human
gggcaugguggugcacaccugu

SEQ ID NO: 505121 - RNA, 22 nt, Human
auaugaaaagaagucaccauug

SEQ ID NO: 505122 - RNA, 22 nt, Human
aucugggccagccccaagagac

SEQ ID NO: 505123 - RNA, 22 nt, Human
gcuguucaagacuaggaaauuu

SEQ ID NO: 505124 - RNA, 22 nt, Human
uggcccugacacgugguacugg

SEQ ID NO: 505125 - RNA, 22 nt, Human
uuaaagcugagcccucagaagc

SEQ ID NO: 505126 - RNA, 22 nt, Human
aaguucaaggcucuagaguucc

SEQ ID NO: 505127 - RNA, 19 nt, Human
uucacaauuaugaaauuag

SEQ ID NO: 505128 - RNA, 22 nt, Human
uauuuagaaugcguguacgugu

SEQ ID NO: 505129 - RNA, 22 nt, Human
ggaugaggaagauuacugagaa

SEQ ID NO: 505130 - RNA, 22 nt, Human
aaagaucaauagauaaagcuac

SEQ ID NO: 505131 - RNA, 22 nt, Human
auuguacuuuuauuacauguag

SEQ ID NO: 505132 - RNA, 22 nt, Human
ggcuccacccugcuuccagaag

SEQ ID NO: 505133 - RNA, 22 nt, Human
acugcagccuugaacucugggc

SEQ ID NO: 505134 - RNA, 22 nt, Human
cagguccugccuugguuacccu

SEQ ID NO: 505135 - RNA, 22 nt, Human
cacagugucugugcuucagugu

SEQ ID NO: 505136 - RNA, 22 nt, Human
gagcagcuccagccgcaugacu

SEQ ID NO: 505137 - RNA, 22 nt, Human
aagagcuguaugccauaugauu

SEQ ID NO: 505138 - RNA, 22 nt, Human
ccauaagguugaaaacuguaca

SEQ ID NO: 505139 - RNA, 22 nt, Human
gcugccuguggcccuucugggu

SEQ ID NO: 505140 - RNA, 22 nt, Human
cacagaguggaggcuuggccug

SEQ ID NO: 505141 - RNA, 22 nt, Human
aggaaacuccccuacaucucaa

SEQ ID NO: 505142 - RNA, 20 nt, Human
agugaguuaucagcuacagu

SEQ ID NO: 505143 - RNA, 22 nt, Human
agaggcuguuacacucccagau

SEQ ID NO: 505144 - RNA, 22 nt, Human
aucuucucauguguaaugaggu

SEQ ID NO: 505145 - RNA, 22 nt, Human
uccaguccagggaauggcugau

SEQ ID NO: 505146 - RNA, 22 nt, Human
uuuuccuauaugcaaagaaugc

SEQ ID NO: 505147 - RNA, 22 nt, Human
auguuucugaaguuuacagaua

SEQ ID NO: 505148 - RNA, 22 nt, Human
ucaggccacuucacaggugauu

SEQ ID NO: 505149 - RNA, 22 nt, Human
ucugggcugugguuccacuccg

SEQ ID NO: 505150 - RNA, 21 nt, Human
gccuggcuucacaggcacuga

SEQ ID NO: 505151 - RNA, 22 nt, Human
uuucaggagagaccagaaauga

SEQ ID NO: 505152 - RNA, 22 nt, Human
ggcugugccucaaggcuacuca

SEQ ID NO: 505153 - RNA, 22 nt, Human
caaagugccuguaccacuuugc

SEQ ID NO: 505154 - RNA, 22 nt, Human
cuggagucuccccaggagcgug

SEQ ID NO: 505155 - RNA, 22 nt, Human
acuaggaaguggcaaaacugga

SEQ ID NO: 505156 - RNA, 22 nt, Human
ggcuauauccucacaagaugga

SEQ ID NO: 505157 - RNA, 22 nt, Human
gcauuccuacaggcugcuauga

SEQ ID NO: 505158 - RNA, 23 nt, Human
cuguuaaauuccuuaagagcagg

SEQ ID NO: 505159 - RNA, 22 nt, Human
uuccuguaguugugcaauguac

SEQ ID NO: 505160 - RNA, 22 nt, Human
acagcuguauccccagagcuca

SEQ ID NO: 505161 - RNA, 22 nt, Human
cugagggcccugaagcuuggca

SEQ ID NO: 505162 - RNA, 22 nt, Human
auggccacauuuaguaacuggu

SEQ ID NO: 505163 - RNA, 22 nt, Human
ucuguucaguuguaccuucccc

SEQ ID NO: 505164 - RNA, 22 nt, Human
acaucucagaacugaguaaccg

SEQ ID NO: 505165 - RNA, 22 nt, Human
ucuggaggcucugagggugagu

SEQ ID NO: 505166 - RNA, 22 nt, Human
gaaaguaugccaucuaccucuu

SEQ ID NO: 505167 - RNA, 22 nt, Human
uucuguuuuagaaauaaguagu

SEQ ID NO: 505168 - RNA, 22 nt, Human
ccacagggucagccacucugca

SEQ ID NO: 505169 - RNA, 22 nt, Human
guaucuuuuacaccaggaaauu

SEQ ID NO: 505170 - RNA, 22 nt, Human
cugcacagccugucugggggcc

SEQ ID NO: 505171 - RNA, 22 nt, Human
cagaauuuagcacaauguaugg

SEQ ID NO: 505172 - RNA, 20 nt, Human
acaauauguagaugaauagc

SEQ ID NO: 505173 - RNA, 22 nt, Human
ucaguccucucuggguuucuua

SEQ ID NO: 505174 - RNA, 22 nt, Human
uagccgggugugguggaacucc

SEQ ID NO: 505175 - RNA, 22 nt, Human
agagucagcuuaugacacaguc

SEQ ID NO: 505176 - RNA, 22 nt, Human
ccaccagcagugugcaaggauu

SEQ ID NO: 505177 - RNA, 22 nt, Human
auuguguaauuuucagcucaua

SEQ ID NO: 505178 - RNA, 20 nt, Human
gcugggcuuugacugacaca

SEQ ID NO: 505179 - RNA, 22 nt, Human
ucacagaagaugcuggauguug

SEQ ID NO: 505180 - RNA, 21 nt, Human
augacagaugcugcagaucgu

SEQ ID NO: 505181 - RNA, 20 nt, Human
cuccaguguucaggggagug

SEQ ID NO: 505182 - RNA, 20 nt, Human
uagauuucauacuucucuuu

SEQ ID NO: 505183 - RNA, 22 nt, Human
gccagcuggcugcaggucccag

SEQ ID NO: 505184 - RNA, 22 nt, Human
uagucacaugaucacaggaucg

SEQ ID NO: 505185 - RNA, 22 nt, Human
uccucagucacgguagcacauu

SEQ ID NO: 505186 - RNA, 22 nt, Human
auacaguauaacuaauaaaccc

SEQ ID NO: 505187 - RNA, 22 nt, Human
ccagcagagggucuuggccauu

SEQ ID NO: 505188 - RNA, 22 nt, Human
aguccugaugcucuggcaggag

SEQ ID NO: 505189 - RNA, 19 nt, Human
uagauaaggcauuuaaucu

SEQ ID NO: 505190 - RNA, 22 nt, Human
gaggaggcugaacaaugcccug

SEQ ID NO: 505191 - RNA, 22 nt, Human
agcaguaagcaacugagcuugc

SEQ ID NO: 505192 - RNA, 21 nt, Human
auucagaaagggaauaaacuc

SEQ ID NO: 505193 - RNA, 22 nt, Human
acugggccagacacugauuccc

SEQ ID NO: 505194 - RNA, 22 nt, Human
augaguucaauuguuucaguca

SEQ ID NO: 505195 - RNA, 22 nt, Human
ucagcuuucucuucuaucgaua

SEQ ID NO: 505196 - RNA, 22 nt, Human
gggucugccugcugugaaguca

SEQ ID NO: 505197 - RNA, 22 nt, Human
uccuuagcccacuaauacuuau

SEQ ID NO: 505198 - RNA, 22 nt, Human
uaaaucaagaauaucagcuugu

SEQ ID NO: 505199 - RNA, 22 nt, Human
gcugucuugaugauuggaugcu

SEQ ID NO: 505200 - RNA, 22 nt, Human
ugaaaguugcacauaagagaau

SEQ ID NO: 505201 - RNA, 22 nt, Human
gaacaauagugguaacaaagcc

SEQ ID NO: 505202 - RNA, 22 nt, Human
cuccagugagugagcaggcgac

SEQ ID NO: 505203 - RNA, 22 nt, Human
uucuuuguggcagugagcuggg

SEQ ID NO: 505204 - RNA, 22 nt, Human
cauuaucugccauugacaccau

SEQ ID NO: 505205 - RNA, 22 nt, Human
aauaaagacaaacaggggagcc

SEQ ID NO: 505206 - RNA, 22 nt, Human
ccagcccaaacaagccgccuuc

SEQ ID NO: 505207 - RNA, 22 nt, Human
ggcagugguuagaaacaugagc

SEQ ID NO: 505208 - RNA, 22 nt, Human
agcugccucagcaacacagacc

SEQ ID NO: 505209 - RNA, 22 nt, Human
cugaucuuaaguaacauuauuu

SEQ ID NO: 505210 - RNA, 22 nt, Human
uucauuaguucugaagaugucu

SEQ ID NO: 505211 - RNA, 22 nt, Human
gcucugcucuugacuuaccagg

SEQ ID NO: 505212 - RNA, 22 nt, Human
uuucucaguucucugcaaggag

SEQ ID NO: 505213 - RNA, 20 nt, Human
agaagcugauacugauggaa

SEQ ID NO: 505214 - RNA, 22 nt, Human
ucugaauguaucgaauugaggc

SEQ ID NO: 505215 - RNA, 22 nt, Human
cagggccagagagggcuggcug

SEQ ID NO: 505216 - RNA, 22 nt, Human
ccucucucuccugcacacacac

SEQ ID NO: 505217 - RNA, 22 nt, Human
guccagagauggacgagcagau

SEQ ID NO: 505218 - RNA, 22 nt, Human
cuacuucuaaguacauggugau

SEQ ID NO: 505219 - RNA, 22 nt, Human
cccuuagcucacaagcuaaagc

SEQ ID NO: 505220 - RNA, 22 nt, Human
ccagcuggagcucgcagauagg

SEQ ID NO: 505221 - RNA, 22 nt, Human
cucugcagauucaucccuucac

SEQ ID NO: 505222 - RNA, 22 nt, Human
gauuagaugacuaaugagcugu

SEQ ID NO: 505223 - RNA, 22 nt, Human
ugagaggccccagcucuuggcc

SEQ ID NO: 505224 - RNA, 22 nt, Human
uauaaagaaggcacagcaagac

SEQ ID NO: 505225 - RNA, 22 nt, Human
gccuggcuuggggcucaguggu

SEQ ID NO: 505226 - RNA, 22 nt, Human
gaguuuguaaacuauucacuaa

SEQ ID NO: 505227 - RNA, 22 nt, Human
ccuauugacaauucucuucucc

SEQ ID NO: 505228 - RNA, 22 nt, Human
ggccugggcccacugucaagag

SEQ ID NO: 505229 - RNA, 21 nt, Human
aggcccagcuuuccucuugcu

SEQ ID NO: 505230 - RNA, 22 nt, Human
cagauguaauuacucaagucaa

SEQ ID NO: 505231 - RNA, 22 nt, Human
ucacauguuaggucgggcaagg

SEQ ID NO: 505232 - RNA, 22 nt, Human
agauuucaaugugagcauuagu

SEQ ID NO: 505233 - RNA, 22 nt, Human
agcagcauauugugucuucaua

SEQ ID NO: 505234 - RNA, 22 nt, Human
cuucccagaccuuagagugcag

SEQ ID NO: 505235 - RNA, 22 nt, Human
cuuaaacugggcauucagagaa

SEQ ID NO: 505236 - RNA, 22 nt, Human
uacagcuuuucauauuuguguu

SEQ ID NO: 505237 - RNA, 22 nt, Human
uuccuguccgcaauggccuggg

SEQ ID NO: 505238 - RNA, 22 nt, Human
gcuggcucugcacccaggccuc

SEQ ID NO: 505239 - RNA, 18 nt, Human
acaguaaagaaaggaauu

SEQ ID NO: 505240 - RNA, 22 nt, Human
agggacccauagagagaccagu

SEQ ID NO: 505241 - RNA, 22 nt, Human
auuuaucaccaguuagcugacu

SEQ ID NO: 505242 - RNA, 19 nt, Human
auuuacugccuaaaaucuc

SEQ ID NO: 505243 - RNA, 16 nt, Human
gggggugagagagagu

SEQ ID NO: 505244 - RNA, 22 nt, Human
agcaggcuuuccacagaaggag

SEQ ID NO: 505245 - RNA, 20 nt, Human
ucaggaugugcugagugaag

SEQ ID NO: 505246 - RNA, 22 nt, Human
cugagaaggaagccuccacucu

SEQ ID NO: 505247 - RNA, 22 nt, Human
aaaaaugugaccacaggguguu

SEQ ID NO: 505248 - RNA, 22 nt, Human
gcaaagcauucuguggagucua

SEQ ID NO: 505249 - RNA, 22 nt, Human
gagaaguuucugguuugcauag

SEQ ID NO: 505250 - RNA, 22 nt, Human
uugucugagaaagugaguugcu

SEQ ID NO: 505251 - RNA, 22 nt, Human
agcucagggcgaucugucucgg

SEQ ID NO: 505252 - RNA, 22 nt, Human
caggcugggcuccggagauaaa

SEQ ID NO: 505253 - RNA, 22 nt, Human
uaaauuagagccagguaaguuu

SEQ ID NO: 505254 - RNA, 22 nt, Human
caggccagugugcuucccaggc

SEQ ID NO: 505255 - RNA, 22 nt, Human
uggaggcaccacuggcugcccg

SEQ ID NO: 505256 - RNA, 22 nt, Human
auuagggcuggaugcaaggaaa

SEQ ID NO: 505257 - RNA, 23 nt, Human
ucuggcuccauccuuggggaucc

SEQ ID NO: 505258 - RNA, 22 nt, Human
acucuggguucuuucacuugac

SEQ ID NO: 505259 - RNA, 22 nt, Human
ccuuugugaauaugcagaaaau

SEQ ID NO: 505260 - RNA, 22 nt, Human
uuagugucuucuucauccucug

SEQ ID NO: 505261 - RNA, 22 nt, Human
caguuuauaugucagagcugua

SEQ ID NO: 505262 - RNA, 22 nt, Human
aaauguguuccuuugcuacaga

SEQ ID NO: 505263 - RNA, 22 nt, Human
ugcagccaucuuucuuggagga

SEQ ID NO: 505264 - RNA, 22 nt, Human
ucauaaaaugcuccugauauug

SEQ ID NO: 505265 - RNA, 20 nt, Human
aucccuggccuuaaggagug

SEQ ID NO: 505266 - RNA, 22 nt, Human
ucaggcacuggcugagugaugg

SEQ ID NO: 505267 - RNA, 22 nt, Human
ugcaggugccaucgcugcucau

SEQ ID NO: 505268 - RNA, 22 nt, Human
ucaggggacuuaggagagaagu

SEQ ID NO: 505269 - RNA, 20 nt, Human
cagaaagaagguagauuuuu

SEQ ID NO: 505270 - RNA, 22 nt, Human
gcagccuguuguaccagccugu

SEQ ID NO: 505271 - RNA, 22 nt, Human
ugccaccuaguggucuuuaguc

SEQ ID NO: 505272 - RNA, 22 nt, Human
uuuaauuugaaaugaguaaccc

SEQ ID NO: 505273 - RNA, 22 nt, Human
cuggcucuucagugcuugguuc

SEQ ID NO: 505274 - RNA, 22 nt, Human
uauggaaaguguuuucuucugu

SEQ ID NO: 505275 - RNA, 22 nt, Human
uggcaugaagucagcagcuggg

SEQ ID NO: 505276 - RNA, 22 nt, Human
gcugccuguccugaggaguccg

SEQ ID NO: 505277 - RNA, 22 nt, Human
aacagcuuagaaauguugcuaa

SEQ ID NO: 505278 - RNA, 22 nt, Human
ggcucagagaccugcgaucuga

SEQ ID NO: 505279 - RNA, 20 nt, Human
cguaaggcaagugcugcauc

SEQ ID NO: 505280 - RNA, 21 nt, Human
gccugggaaaucugggaagcc

SEQ ID NO: 505281 - RNA, 22 nt, Human
uacacagaaccugguguacagu

SEQ ID NO: 505282 - RNA, 22 nt, Human
cagcaaaguaagcugacaugua

SEQ ID NO: 505283 - RNA, 22 nt, Human
ucuggcucugaauucacuucug

SEQ ID NO: 505284 - RNA, 22 nt, Human
uucugggcuuggcuguuuccau

SEQ ID NO: 505285 - RNA, 22 nt, Human
ggcagaggaggggugaauuugc

SEQ ID NO: 505286 - RNA, 22 nt, Human
cugauuaacugaacugaauuua

SEQ ID NO: 505287 - RNA, 22 nt, Human
aggggagcgacauuccgugccg

SEQ ID NO: 505288 - RNA, 18 nt, Human
cccagcccaccauuucuc

SEQ ID NO: 505289 - RNA, 20 nt, Human
cugcucugcuuugcaggugg

SEQ ID NO: 505290 - RNA, 22 nt, Human
ggaggccagggacccagucagc

SEQ ID NO: 505291 - RNA, 22 nt, Human
aaacugaaacaucaucauguug

SEQ ID NO: 505292 - RNA, 22 nt, Human
aacagccacugauacugaauag

SEQ ID NO: 505293 - RNA, 19 nt, Human
uccuuugaauaucaguuga

SEQ ID NO: 505294 - RNA, 22 nt, Human
augaaugcugggacaaauauau

SEQ ID NO: 505295 - RNA, 22 nt, Human
ggaaucuuaauggcauggaguu

SEQ ID NO: 505296 - RNA, 22 nt, Human
uaauccaaaacugaaucugugg

SEQ ID NO: 505297 - RNA, 22 nt, Human
ugcaggcugaggcuggcucaac

SEQ ID NO: 505298 - RNA, 22 nt, Human
uauagcauauacagauaagcug

SEQ ID NO: 505299 - RNA, 22 nt, Human
guaaaucccauccuuucucugg

SEQ ID NO: 505300 - RNA, 23 nt, Human
gcagagcugcccuauugccuugg

SEQ ID NO: 505301 - RNA, 22 nt, Human
cugucagcuucuccuggccaga

SEQ ID NO: 505302 - RNA, 22 nt, Human
uccugcgguucaugcucauucu

SEQ ID NO: 505303 - RNA, 22 nt, Human
ucucagggccccaaaggcuagu

SEQ ID NO: 505304 - RNA, 20 nt, Human
aggaacuggaagggaggaaa

SEQ ID NO: 505305 - RNA, 22 nt, Human
cagcuugcaguacuuguuuuug

SEQ ID NO: 505306 - RNA, 22 nt, Human
uuucuagaaacauuaucucuau

SEQ ID NO: 505307 - RNA, 22 nt, Human
agguccugacgcccuuugaaau

SEQ ID NO: 505308 - RNA, 22 nt, Human
gcacagagccugguaccgagaa

SEQ ID NO: 505309 - RNA, 22 nt, Human
ucucaggggauucacuggcacc

SEQ ID NO: 505310 - RNA, 22 nt, Human
aggaggccgauuucagaggucg

SEQ ID NO: 505311 - RNA, 22 nt, Human
auaaaguuuaaaagucaauagu

SEQ ID NO: 505312 - RNA, 19 nt, Human
acccagagcccuuugcagg

SEQ ID NO: 505313 - RNA, 22 nt, Human
uggaggcauaggccugggcccu

SEQ ID NO: 505314 - RNA, 22 nt, Human
agaauaguggcaaugacugcac

SEQ ID NO: 505315 - RNA, 21 nt, Human
aacauuucaggauccaaauug

SEQ ID NO: 505316 - RNA, 22 nt, Human
cagggcauuacuucagguccuu

SEQ ID NO: 505317 - RNA, 22 nt, Human
aggaauugagauccuagguuuu

SEQ ID NO: 505318 - RNA, 22 nt, Human
ugcaggcugccuucacagagcc

SEQ ID NO: 505319 - RNA, 22 nt, Human
gucucuggguuaagcagugcau

SEQ ID NO: 505320 - RNA, 22 nt, Human
uggugcugauaauggcaggauu

SEQ ID NO: 505321 - RNA, 17 nt, Human
uggagcugcguguguuc

SEQ ID NO: 505322 - RNA, 22 nt, Human
gacacagaauuuacucccgaua

SEQ ID NO: 505323 - RNA, 22 nt, Human
ucaggcugccuaucagacugug

SEQ ID NO: 505324 - RNA, 22 nt, Human
caggucucggguucagcaguga

SEQ ID NO: 505325 - RNA, 22 nt, Human
uccagggccaugaaguugcaca

SEQ ID NO: 505326 - RNA, 22 nt, Human
ccaggucuggcacuggccaguc

SEQ ID NO: 505327 - RNA, 22 nt, Human
gccucucucuacccaguaugau

SEQ ID NO: 505328 - RNA, 22 nt, Human
cauggcagaaaccugagcugcu

SEQ ID NO: 505329 - RNA, 22 nt, Human
auugaagaaacccaaauaaugg

SEQ ID NO: 505330 - RNA, 23 nt, Human
uggaagcagaaguuucaauaucc

SEQ ID NO: 505331 - RNA, 22 nt, Human
uguccacuuugucagugucaua

SEQ ID NO: 505332 - RNA, 22 nt, Human
cagcuccagcucugggcgccuc

SEQ ID NO: 505333 - RNA, 22 nt, Human
cugaaugacugaagucacaauu

SEQ ID NO: 505334 - RNA, 22 nt, Human
aagggcucuucuauuuauggcc

SEQ ID NO: 505335 - RNA, 20 nt, Human
aguggcugauggaaagaagc

SEQ ID NO: 505336 - RNA, 22 nt, Human
gagagcugcagccgagaggggg

SEQ ID NO: 505337 - RNA, 22 nt, Human
ccagagguccugcucacuggug

SEQ ID NO: 505338 - RNA, 22 nt, Human
uccuucuuucccccuagucauu

SEQ ID NO: 505339 - RNA, 19 nt, Human
ucuggagcugaugcaggug

SEQ ID NO: 505340 - RNA, 23 nt, Human
ucugugccaguuuccaugucugu

SEQ ID NO: 505341 - RNA, 22 nt, Human
agagcuggcugugggugacuuu

SEQ ID NO: 505342 - RNA, 22 nt, Human
uggcuggcuuguucacugacug

SEQ ID NO: 505343 - RNA, 22 nt, Human
acaguguucugaaaguugaggg

SEQ ID NO: 505344 - RNA, 22 nt, Human
uccauauuaacuaaaacuagaa

SEQ ID NO: 505345 - RNA, 22 nt, Human
ggugacugguuuaucuggcagu

SEQ ID NO: 505346 - RNA, 22 nt, Human
uguggccuugcagccuggaggu

SEQ ID NO: 505347 - RNA, 22 nt, Human
gcaaagcacacuggagaugucg

SEQ ID NO: 505348 - RNA, 22 nt, Human
cagggcucaggcucugggauuc

SEQ ID NO: 505349 - RNA, 22 nt, Human
cagagguacagccauugaagau

SEQ ID NO: 505350 - RNA, 22 nt, Human
gaugaggcaagccagaggacug

SEQ ID NO: 505351 - RNA, 22 nt, Human
uccugggacucaacuuagaagg

SEQ ID NO: 505352 - RNA, 22 nt, Human
ccaggguguagggauuccagau

SEQ ID NO: 505353 - RNA, 22 nt, Human
cuggguggcgucuggggccagu

SEQ ID NO: 505354 - RNA, 22 nt, Human
ccuguacauuagcugugaauug

SEQ ID NO: 505355 - RNA, 22 nt, Human
gcaggaaagguugagacuuugc

SEQ ID NO: 505356 - RNA, 22 nt, Human
cagagagcuuagugugcugcau

SEQ ID NO: 505357 - RNA, 22 nt, Human
cagggccagccgcagcauccac

SEQ ID NO: 505358 - RNA, 22 nt, Human
caucuuaaauuaaagcuuaagg

SEQ ID NO: 505359 - RNA, 22 nt, Human
uaaagcaaggaauagaguaguc

SEQ ID NO: 505360 - RNA, 19 nt, Human
gggguggcuggggcuccag

SEQ ID NO: 505361 - RNA, 22 nt, Human
uuuuccucuguuauuaguguga

SEQ ID NO: 505362 - RNA, 22 nt, Human
cucagggaggcccugggacccu

SEQ ID NO: 505363 - RNA, 22 nt, Human
auggagacgcaagggaccuagg

SEQ ID NO: 505364 - RNA, 21 nt, Human
agaagccaugccaguaaaauu

SEQ ID NO: 505365 - RNA, 22 nt, Human
uagggucccagauaggagccag

SEQ ID NO: 505366 - RNA, 22 nt, Human
ucauguuuuugccauaugacuc

SEQ ID NO: 505367 - RNA, 22 nt, Human
uguuccuggggaccugccuucc

SEQ ID NO: 505368 - RNA, 22 nt, Human
uuccggaagguucucuagaauu

SEQ ID NO: 505369 - RNA, 22 nt, Human
uucaggagcuggcugcgaagga

SEQ ID NO: 505370 - RNA, 20 nt, Human
ccagagcagccacugaaguu

SEQ ID NO: 505371 - RNA, 22 nt, Human
acagguguagcaggagcaucaa

SEQ ID NO: 505372 - RNA, 20 nt, Human
ggccucaguguccuuguuug

SEQ ID NO: 505373 - RNA, 22 nt, Human
gaggaggaaaggaguugaaaug

SEQ ID NO: 505374 - RNA, 22 nt, Human
ugcccagcugucaaaguagaua

SEQ ID NO: 505375 - RNA, 21 nt, Human
aaggaaaagcuuggucucuga

SEQ ID NO: 505376 - RNA, 22 nt, Human
ugaggccagccacagccacccu

SEQ ID NO: 505377 - RNA, 22 nt, Human
uggcucugcugaaccuagugca

SEQ ID NO: 505378 - RNA, 22 nt, Human
aucaaguuuucuuaguugacug

SEQ ID NO: 505379 - RNA, 22 nt, Human
aaagagccagcuaccucaguuu

SEQ ID NO: 505380 - RNA, 22 nt, Human
agugcaggagccuggccagagc

SEQ ID NO: 505381 - RNA, 22 nt, Human
accucuuaauauugcaccuucu

SEQ ID NO: 505382 - RNA, 22 nt, Human
uaugcacacaucgcagcaggaa

SEQ ID NO: 505383 - RNA, 22 nt, Human
uggcuuccaguaaucaggauuu

SEQ ID NO: 505384 - RNA, 22 nt, Human
caggaaauguauaauuuuauaa

SEQ ID NO: 505385 - RNA, 22 nt, Human
cuggagccuagguugaccuggg

SEQ ID NO: 505386 - RNA, 22 nt, Human
cccauucauccucgcuuccuuc

SEQ ID NO: 505387 - RNA, 22 nt, Human
agacaucaaugaucagagguag

SEQ ID NO: 505388 - RNA, 22 nt, Human
uaugauaugcacuuuaucagaa

SEQ ID NO: 505389 - RNA, 22 nt, Human
acacagggauauuucagguggu

SEQ ID NO: 505390 - RNA, 22 nt, Human
uguccuggacaacagccccuag

SEQ ID NO: 505391 - RNA, 22 nt, Human
agcagagcuauucuugugcaau

SEQ ID NO: 505392 - RNA, 22 nt, Human
aucauucaaaugauuuggaggu

SEQ ID NO: 505393 - RNA, 22 nt, Human
ugagcugggaagagcagccaga

SEQ ID NO: 505394 - RNA, 23 nt, Human
uccaggcacgcauuucuucuagc

SEQ ID NO: 505395 - RNA, 22 nt, Human
aaaaaucuaugacugcuucucc

SEQ ID NO: 505396 - RNA, 22 nt, Human
acucacagucccuguaggagug

SEQ ID NO: 505397 - RNA, 22 nt, Human
cagcucccgccaucgggaggca

SEQ ID NO: 505398 - RNA, 22 nt, Human
agaggcaggagguugacuugag

SEQ ID NO: 505399 - RNA, 22 nt, Human
ccucagcugcuucccuggagcc

SEQ ID NO: 505400 - RNA, 22 nt, Human
aacagcauauuucauauauuga

SEQ ID NO: 505401 - RNA, 22 nt, Human
ucacagaaagcuguguccugac

SEQ ID NO: 505402 - RNA, 22 nt, Human
ccuuuguggggcgguggguaau

SEQ ID NO: 505403 - RNA, 18 nt, Human
cuggagucacagugggga

SEQ ID NO: 505404 - RNA, 22 nt, Human
auuucaguguugguuagcaagc

SEQ ID NO: 505405 - RNA, 22 nt, Human
ucaggaugagcucauaacuaug

SEQ ID NO: 505406 - RNA, 22 nt, Human
aagagagagcauucuucuguua

SEQ ID NO: 505407 - RNA, 19 nt, Human
gggcucuggccucaguggg

SEQ ID NO: 505408 - RNA, 22 nt, Human
aauuucuugggagcucagagaa

SEQ ID NO: 505409 - RNA, 22 nt, Human
caaaugauagagccgauuauca

SEQ ID NO: 505410 - RNA, 22 nt, Human
uaccuuggguugaguucauucu

SEQ ID NO: 505411 - RNA, 22 nt, Human
uauuuguugaguuguuaugucu

SEQ ID NO: 505412 - RNA, 22 nt, Human
ccugggagcuguggaaaggcug

SEQ ID NO: 505413 - RNA, 22 nt, Human
aauagcauccuaaaacauacuu

SEQ ID NO: 505414 - RNA, 22 nt, Human
acugggcuguuuuuugagugga

SEQ ID NO: 505415 - RNA, 22 nt, Human
augcuauacucaaagaaauuca

SEQ ID NO: 505416 - RNA, 22 nt, Human
agccugguuuaagcauuuuaua

SEQ ID NO: 505417 - RNA, 22 nt, Human
ccagccaggcuggcuguggagg

SEQ ID NO: 505418 - RNA, 22 nt, Human
gugauuucuaaucaucugaaug

SEQ ID NO: 505419 - RNA, 22 nt, Human
ggcuucccuuuccgagaggaga

SEQ ID NO: 505420 - RNA, 22 nt, Human
gggccaugagagguucaucaac

SEQ ID NO: 505421 - RNA, 20 nt, Human
ucugaggcugagcucuacuu

SEQ ID NO: 505422 - RNA, 22 nt, Human
acaggucuggucugggugggac

SEQ ID NO: 505423 - RNA, 22 nt, Human
ucucugggaauuuuuuggacau

SEQ ID NO: 505424 - RNA, 22 nt, Human
ugaaagguuauuuaggucugcu

SEQ ID NO: 505425 - RNA, 22 nt, Human
aaaguuuuuaagcaagacccuu

SEQ ID NO: 505426 - RNA, 22 nt, Human
uaaguuucuccaaagcacagaa

SEQ ID NO: 505427 - RNA, 22 nt, Human
ggagccuggcccggcccuuggc

SEQ ID NO: 505428 - RNA, 22 nt, Human
ggccucagugggccgcugcagg

SEQ ID NO: 505429 - RNA, 22 nt, Human
cugugcuucagagucagugcug

SEQ ID NO: 505430 - RNA, 22 nt, Human
gaccauuugcuaguaaauugca

SEQ ID NO: 505431 - RNA, 22 nt, Human
cccagguggguuggccucuguc

SEQ ID NO: 505432 - RNA, 23 nt, Human
guuaauaaugaacacuuucuccc

SEQ ID NO: 505433 - RNA, 22 nt, Human
acauacuuuuuaaaagauugcu

SEQ ID NO: 505434 - RNA, 22 nt, Human
aggccucacauugggcuucaag

SEQ ID NO: 505435 - RNA, 22 nt, Human
cagggccuucguaaguguccgg

SEQ ID NO: 505436 - RNA, 22 nt, Human
gggugacauuucccaaugagcc

SEQ ID NO: 505437 - RNA, 22 nt, Human
aaguucaauggaaaagcuuuag

SEQ ID NO: 505438 - RNA, 22 nt, Human
uugccaggcuuguuucuaggcu

SEQ ID NO: 505439 - RNA, 21 nt, Human
cccugguuccacugucaccgc

SEQ ID NO: 505440 - RNA, 22 nt, Human
guuuuauaauugcuucauaaga

SEQ ID NO: 505441 - RNA, 22 nt, Human
ggaccaugaggagaugggccuc

SEQ ID NO: 505442 - RNA, 22 nt, Human
cagucaccuugaggacucagac

SEQ ID NO: 505443 - RNA, 19 nt, Human
ucuuuagccagagcucugg

SEQ ID NO: 505444 - RNA, 22 nt, Human
gccagcagggcccaaaugcugg

SEQ ID NO: 505445 - RNA, 22 nt, Human
uccugggccuguacuccauccg

SEQ ID NO: 505446 - RNA, 22 nt, Human
ccuggcuggcaagaucgugaag

SEQ ID NO: 505447 - RNA, 22 nt, Human
cagagccaugguaugggcuugu

SEQ ID NO: 505448 - RNA, 22 nt, Human
ugggcugcuguuacaggggcug

SEQ ID NO: 505449 - RNA, 22 nt, Human
cagauccuuaggacaaccaucc

SEQ ID NO: 505450 - RNA, 22 nt, Human
ucaaaguagggguaagccaggc

SEQ ID NO: 505451 - RNA, 23 nt, Human
uggagggcagaauaacagacuac

SEQ ID NO: 505452 - RNA, 22 nt, Human
cccuggaagguucucuggcuca

SEQ ID NO: 505453 - RNA, 22 nt, Human
agggagaagguuuagcugugag

SEQ ID NO: 505454 - RNA, 18 nt, Human
cugggccagaguuucugc

SEQ ID NO: 505455 - RNA, 22 nt, Human
gcugucuggaggcucugaggga

SEQ ID NO: 505456 - RNA, 22 nt, Human
aguccaguguguucuggcagca

SEQ ID NO: 505457 - RNA, 22 nt, Human
acacacaaaucuauuagugaau

SEQ ID NO: 505458 - RNA, 22 nt, Human
cacaggguuguucugaggauuc

SEQ ID NO: 505459 - RNA, 22 nt, Human
agguuccucuuccucuggccug

SEQ ID NO: 505460 - RNA, 22 nt, Human
gcugagagcaaggacaaagcau

SEQ ID NO: 505461 - RNA, 20 nt, Human
gauuucaaagcagaguggcc

SEQ ID NO: 505462 - RNA, 22 nt, Human
auggggagagaagggcugagcu

SEQ ID NO: 505463 - RNA, 22 nt, Human
uccagcagggaauuaguagucu

SEQ ID NO: 505464 - RNA, 22 nt, Human
uuuugugagcugagaaauguau

SEQ ID NO: 505465 - RNA, 22 nt, Human
ucaucugucccaggcuuuuuuc

SEQ ID NO: 505466 - RNA, 22 nt, Human
ucucacagcaucauugcucaug

SEQ ID NO: 505467 - RNA, 22 nt, Human
uucagagacagcaaccaggaca

SEQ ID NO: 505468 - RNA, 22 nt, Human
aagcuguuguucauccugaauu

SEQ ID NO: 505469 - RNA, 22 nt, Human
gagcacagaaucuucccaugca

SEQ ID NO: 505470 - RNA, 22 nt, Human
ggcacaagguuuaaauaacauc

SEQ ID NO: 505471 - RNA, 22 nt, Human
gauuuccuugcauauugguaau

SEQ ID NO: 505472 - RNA, 22 nt, Human
gggugggccacugagcagcgug

SEQ ID NO: 505473 - RNA, 22 nt, Human
aaagugccacaacuggacaacc

SEQ ID NO: 505474 - RNA, 22 nt, Human
gagccaggcccguacuugcugu

SEQ ID NO: 505475 - RNA, 22 nt, Human
uugugaauggugccgcaauaaa

SEQ ID NO: 505476 - RNA, 22 nt, Human
aggggcuuauguuucuccaggc

SEQ ID NO: 505477 - RNA, 23 nt, Human
uggcucuguggaucccucaggag

SEQ ID NO: 505478 - RNA, 22 nt, Human
aaugucaauuaccagaacagaa

SEQ ID NO: 505479 - RNA, 21 nt, Human
ggcuccugcuuugugaggggc

SEQ ID NO: 505480 - RNA, 22 nt, Human
caaaugcauaguuuauaagaag

SEQ ID NO: 505481 - RNA, 21 nt, Human
gcagaugggaagagacgaggc

SEQ ID NO: 505482 - RNA, 22 nt, Human
gcgagccucuggaguccucugg

SEQ ID NO: 505483 - RNA, 23 nt, Human
ggcagagagcauggcuggggccc

SEQ ID NO: 505484 - RNA, 22 nt, Human
agaaacauuuagauuauauguc

SEQ ID NO: 505485 - RNA, 22 nt, Human
ugugcaaaauaauaaaucacug

SEQ ID NO: 505486 - RNA, 22 nt, Human
cagggacccuacuagcucacac

SEQ ID NO: 505487 - RNA, 22 nt, Human
aaggcacugcuuugcugcgccc

SEQ ID NO: 505488 - RNA, 21 nt, Human
ugguuugcggccaaaguuaaa

SEQ ID NO: 505489 - RNA, 22 nt, Human
ucagcacugauagaagucaaua

SEQ ID NO: 505490 - RNA, 23 nt, Human
ggcugagacuacaggcgcuugcc

SEQ ID NO: 505491 - RNA, 22 nt, Human
uauuucuaagagauaucuguac

SEQ ID NO: 505492 - RNA, 22 nt, Human
caggcagcaggagcccugcucg

SEQ ID NO: 505493 - RNA, 22 nt, Human
ggcagggagagcaugcugauaa

SEQ ID NO: 505494 - RNA, 22 nt, Human
uguuuucucuugaaaagcaguc

SEQ ID NO: 505495 - RNA, 22 nt, Human
cucagucugucuugucuguguu

SEQ ID NO: 505496 - RNA, 22 nt, Human
aucagagauggcuccagugcuc

SEQ ID NO: 505497 - RNA, 22 nt, Human
gcagcuuucugggacagaaagg

SEQ ID NO: 505498 - RNA, 22 nt, Human
aagauacugaugauguaggcua

SEQ ID NO: 505499 - RNA, 22 nt, Human
aggagcuggccuagaaaggaga

SEQ ID NO: 505500 - RNA, 22 nt, Human
ucauugaacgaagagcuccauu

SEQ ID NO: 505501 - RNA, 22 nt, Human
cuucugggagagcuuuugcuuc

SEQ ID NO: 505502 - RNA, 17 nt, Human
gcacugaacaauccugu

SEQ ID NO: 505503 - RNA, 19 nt, Human
cuuccuugcuccccaugug

SEQ ID NO: 505504 - RNA, 22 nt, Human
uuaaacaccugucuaguguagc

SEQ ID NO: 505505 - RNA, 22 nt, Human
cucuggcugucccgaugagcag

SEQ ID NO: 505506 - RNA, 22 nt, Human
gcuaggaguggugggucaagga

SEQ ID NO: 505507 - RNA, 22 nt, Human
cuauuagguaugugguugcuau

SEQ ID NO: 505508 - RNA, 22 nt, Human
gaggggcugcccuggugucagg

SEQ ID NO: 505509 - RNA, 22 nt, Human
ucagagugggagaaugugccaa

SEQ ID NO: 505510 - RNA, 22 nt, Human
gaggcaguaauugugggcaaua

SEQ ID NO: 505511 - RNA, 22 nt, Human
ccuuucucuuggauaccgauug

SEQ ID NO: 505512 - RNA, 22 nt, Human
augucuuuggcuuugacauggc

SEQ ID NO: 505513 - RNA, 22 nt, Human
gcaaagcagucuucugugccua

SEQ ID NO: 505514 - RNA, 22 nt, Human
aggcccagcccguccucgugcu

SEQ ID NO: 505515 - RNA, 23 nt, Human
ggucagugaguucguuucucugg

SEQ ID NO: 505516 - RNA, 22 nt, Human
auauuucuccaaauguuuucaa

SEQ ID NO: 505517 - RNA, 22 nt, Human
uuaacauuguccuuagcagauu

SEQ ID NO: 505518 - RNA, 22 nt, Human
ucuugaaggggggcaguguuga

SEQ ID NO: 505519 - RNA, 22 nt, Human
aagcacaaugaacaucuuagau

SEQ ID NO: 505520 - RNA, 22 nt, Human
gacagccucaugaggagcaaaa

SEQ ID NO: 505521 - RNA, 22 nt, Human
cuauauacuuuucacagauguu

SEQ ID NO: 505522 - RNA, 22 nt, Human
gccaggcagcugggagggugcc

SEQ ID NO: 505523 - RNA, 22 nt, Human
gcuguucacauuuugggccaaa

SEQ ID NO: 505524 - RNA, 22 nt, Human
ugcagcuucuuguccugugauu

SEQ ID NO: 505525 - RNA, 22 nt, Human
ugcacaggugguccaucugcac

SEQ ID NO: 505526 - RNA, 22 nt, Human
cagcuuuauuaaugauugucuu

SEQ ID NO: 505527 - RNA, 22 nt, Human
uuugcaaauaaauaagugcucg

SEQ ID NO: 505528 - RNA, 22 nt, Human
ucuuuguuauugcuuuaucuau

SEQ ID NO: 505529 - RNA, 22 nt, Human
uauuugaaaguguacaaaaacu

SEQ ID NO: 505530 - RNA, 21 nt, Human
aagaaguuuggauuuuguccu

SEQ ID NO: 505531 - RNA, 21 nt, Human
uucaucagccagaaaucaagc

SEQ ID NO: 505532 - RNA, 22 nt, Human
gccuggagugcaguggcgugau

SEQ ID NO: 505533 - RNA, 22 nt, Human
uuccuacaucaccagggggagu

SEQ ID NO: 505534 - RNA, 22 nt, Human
cacagggcaccaguuggccauc

SEQ ID NO: 505535 - RNA, 22 nt, Human
cagguccccuccccuaccaggc

SEQ ID NO: 505536 - RNA, 22 nt, Human
acaugauauuaaugucuuauuu

SEQ ID NO: 505537 - RNA, 22 nt, Human
gcuuccucgcugggcagaggca

SEQ ID NO: 505538 - RNA, 22 nt, Human
ugucccagcacuuugggagucu

SEQ ID NO: 505539 - RNA, 22 nt, Human
gcugccuuugugagccaagggg

SEQ ID NO: 505540 - RNA, 22 nt, Human
aauagguagccagauauauaaa

SEQ ID NO: 505541 - RNA, 22 nt, Human
cacagguauauguguauauacu

SEQ ID NO: 505542 - RNA, 22 nt, Human
uccaggaggguuuucugccuuc

SEQ ID NO: 505543 - RNA, 22 nt, Human
uuagaaaaaggcuguggucuua

SEQ ID NO: 505544 - RNA, 22 nt, Human
uguacagauugaucauggagag

SEQ ID NO: 505545 - RNA, 22 nt, Human
cucacugcccugaaguuggguu

SEQ ID NO: 505546 - RNA, 22 nt, Human
gcugaguguaaugauggcagag

SEQ ID NO: 505547 - RNA, 22 nt, Human
gaugccucuuuuggcugaauua

SEQ ID NO: 505548 - RNA, 22 nt, Human
augaaucaaaguucauuugauc

SEQ ID NO: 505549 - RNA, 22 nt, Human
cacuggggugggccugguagag

SEQ ID NO: 505550 - RNA, 23 nt, Human
uccuggcucugcacuugcuaaug

SEQ ID NO: 505551 - RNA, 22 nt, Human
ugcagggaaugcuugcagcaug

SEQ ID NO: 505552 - RNA, 22 nt, Human
aggggcugggacagagccaagc

SEQ ID NO: 505553 - RNA, 22 nt, Human
cuggugguucaggagaauggcu

SEQ ID NO: 505554 - RNA, 22 nt, Human
ugcuggugauuaaauccugaag

SEQ ID NO: 505555 - RNA, 22 nt, Human
caaagccucugauuucacuugu

SEQ ID NO: 505556 - RNA, 22 nt, Human
gacaggaagucugaaggaggga

SEQ ID NO: 505557 - RNA, 22 nt, Human
aaauuucaguuaccuuuacguu

SEQ ID NO: 505558 - RNA, 22 nt, Human
uuuccucugaugcugacuugga

SEQ ID NO: 505559 - RNA, 22 nt, Human
cccuccucaacucuggcuucca

SEQ ID NO: 505560 - RNA, 22 nt, Human
cagguggagcugacugagggca

SEQ ID NO: 505561 - RNA, 22 nt, Human
ccaggcaggcgauggugcagug

SEQ ID NO: 505562 - RNA, 22 nt, Human
cucaaaagacuuaaacauaaga

SEQ ID NO: 505563 - RNA, 22 nt, Human
aggcugcaggucugggucaugu

SEQ ID NO: 505564 - RNA, 22 nt, Human
uggaacacagugauugauagcg

SEQ ID NO: 505565 - RNA, 22 nt, Human
agcaaauacuugaauaaaaaga

SEQ ID NO: 505566 - RNA, 22 nt, Human
uccuugaaaagaaugucuccau

SEQ ID NO: 505567 - RNA, 22 nt, Human
acagccaggagccaugggcagg

SEQ ID NO: 505568 - RNA, 22 nt, Human
ggagggugcauuuuacccugug

SEQ ID NO: 505569 - RNA, 22 nt, Human
cagguacacucccuugugcuga

SEQ ID NO: 505570 - RNA, 22 nt, Human
cugcccuguggcucugagucau

SEQ ID NO: 505571 - RNA, 22 nt, Human
gccaccaggagcccaguccaaa

SEQ ID NO: 505572 - RNA, 22 nt, Human
uaaaauguagcuucuaggcugg

SEQ ID NO: 505573 - RNA, 22 nt, Human
uuccugggccuuaaaucuuuug

SEQ ID NO: 505574 - RNA, 18 nt, Human
cgggcgggcgccuggccc

SEQ ID NO: 505575 - RNA, 22 nt, Human
ugucuuuagagucacaaaacca

SEQ ID NO: 505576 - RNA, 22 nt, Human
caugggggucuggacaacaggc

SEQ ID NO: 505577 - RNA, 22 nt, Human
acuguggccaaagccucuggga

SEQ ID NO: 505578 - RNA, 19 nt, Human
cuauuagcuugggcaucau

SEQ ID NO: 505579 - RNA, 18 nt, Human
gcuggcugcacuucugcu

SEQ ID NO: 505580 - RNA, 22 nt, Human
ggagccugugcccaagcccaga

SEQ ID NO: 505581 - RNA, 22 nt, Human
aggcugugauuccaccacucuc

SEQ ID NO: 505582 - RNA, 23 nt, Human
aaaguugauuugcaguuuaagag

SEQ ID NO: 505583 - RNA, 22 nt, Human
uuggcauuggagaugcaagaac

SEQ ID NO: 505584 - RNA, 22 nt, Human
gggcagagacucagaaacagaa

SEQ ID NO: 505585 - RNA, 22 nt, Human
cuggcccucagacucaugggca

SEQ ID NO: 505586 - RNA, 20 nt, Human
accauuaauguaagcuuugu

SEQ ID NO: 505587 - RNA, 23 nt, Human
agaggggagcaucugcuggcuga

SEQ ID NO: 505588 - RNA, 22 nt, Human
ucaguguuggucaagaaucagu

SEQ ID NO: 505589 - RNA, 22 nt, Human
aacaugcaaugucugaaaaucc

SEQ ID NO: 505590 - RNA, 22 nt, Human
aaagcaguauaaguaacggaag

SEQ ID NO: 505591 - RNA, 22 nt, Human
uucugcaucugaauuuaaguac

SEQ ID NO: 505592 - RNA, 23 nt, Human
caucagagguugccacucccugg

SEQ ID NO: 505593 - RNA, 22 nt, Human
uuccugggcucuggcuggccua

SEQ ID NO: 505594 - RNA, 22 nt, Human
ugggccacucuucccugggucu

SEQ ID NO: 505595 - RNA, 20 nt, Human
aucugggcaucaauuuugug

SEQ ID NO: 505596 - RNA, 20 nt, Human
ucaggcaguggggaaaggca

SEQ ID NO: 505597 - RNA, 22 nt, Human
ggcaggagcucuccaguuugcc

SEQ ID NO: 505598 - RNA, 22 nt, Human
ggucauugucagagccuguacu

SEQ ID NO: 505599 - RNA, 22 nt, Human
ucugggcuauauggucucugcu

SEQ ID NO: 505600 - RNA, 22 nt, Human
uggcucuggcgugaagcccaga

SEQ ID NO: 505601 - RNA, 22 nt, Human
aggcagguccccuggaaggcac

SEQ ID NO: 505602 - RNA, 20 nt, Human
ugagaagcuccugucuccuc

SEQ ID NO: 505603 - RNA, 22 nt, Human
ccuggguuggagagcaauggug

SEQ ID NO: 505604 - RNA, 22 nt, Human
ucuggcuccacucugugcaugc

SEQ ID NO: 505605 - RNA, 22 nt, Human
ugcauccuuaaccagcaucacu

SEQ ID NO: 505606 - RNA, 18 nt, Human
cagcauuagcagcuucca

SEQ ID NO: 505607 - RNA, 22 nt, Human
aaauguguuugauaggaauauu

SEQ ID NO: 505608 - RNA, 17 nt, Human
uccuucagugccucugc

SEQ ID NO: 505609 - RNA, 22 nt, Human
acagggccauuaucuguucuag

SEQ ID NO: 505610 - RNA, 22 nt, Human
gcucacagucugcugagugcag

SEQ ID NO: 505611 - RNA, 22 nt, Human
ugcaucuuacguuuugaaaggg

SEQ ID NO: 505612 - RNA, 22 nt, Human
agucucuggggaggaguggaaa

SEQ ID NO: 505613 - RNA, 22 nt, Human
aagugagugguaaggagcaugg

SEQ ID NO: 505614 - RNA, 22 nt, Human
ucccagggcucuagagugcugg

SEQ ID NO: 505615 - RNA, 22 nt, Human
gauaccagacagggagggagaa

SEQ ID NO: 505616 - RNA, 22 nt, Human
aguggcugugaaauacauggga

SEQ ID NO: 505617 - RNA, 22 nt, Human
cuacauggagaagaaaauucuu

SEQ ID NO: 505618 - RNA, 18 nt, Human
ucagcuggggcugcagcc

SEQ ID NO: 505619 - RNA, 22 nt, Human
aggggagaguuaaugugaaugu

SEQ ID NO: 505620 - RNA, 17 nt, Human
gagugcugguggagcuc

SEQ ID NO: 505621 - RNA, 22 nt, Human
cccaguggggagcugagguuca

SEQ ID NO: 505622 - RNA, 22 nt, Human
uguucagagacagaaauucuaa

SEQ ID NO: 505623 - RNA, 22 nt, Human
auaaugaggauuugcauauuag

SEQ ID NO: 505624 - RNA, 22 nt, Human
ccaucuccaaauaccaucacau

SEQ ID NO: 505625 - RNA, 22 nt, Human
cagcuuugccaaguaaggucuu

SEQ ID NO: 505626 - RNA, 22 nt, Human
uauuucugaggcccaggaagug

SEQ ID NO: 505627 - RNA, 23 nt, Human
uggccugcagaguuucugcuggg

SEQ ID NO: 505628 - RNA, 22 nt, Human
uuagccauuuuauucagcaggu

SEQ ID NO: 505629 - RNA, 22 nt, Human
cgguccagggaacgcccccgcc

SEQ ID NO: 505630 - RNA, 22 nt, Human
ggaggaccccagcagcucccca

SEQ ID NO: 505631 - RNA, 22 nt, Human
cacaguguuccagagcaguggu

SEQ ID NO: 505632 - RNA, 22 nt, Human
cccaggagagaggccaguuggc

SEQ ID NO: 505633 - RNA, 22 nt, Human
uauuugucuuucuuauaagaau

SEQ ID NO: 505634 - RNA, 22 nt, Human
cuggcuggucaucagcaguacg

SEQ ID NO: 505635 - RNA, 22 nt, Human
gcaggcugaguauuacccuagu

SEQ ID NO: 505636 - RNA, 22 nt, Human
uuuauguaauuucauaggugug

SEQ ID NO: 505637 - RNA, 22 nt, Human
agagcuguuuggacaucugagu

SEQ ID NO: 505638 - RNA, 22 nt, Human
aggcagguuucccggcugucaa

SEQ ID NO: 505639 - RNA, 22 nt, Human
agggaggaucugcuccuugucu

SEQ ID NO: 505640 - RNA, 22 nt, Human
gccuuggacuaccacucccaca

SEQ ID NO: 505641 - RNA, 22 nt, Human
agagcccucuucacugccccuu

SEQ ID NO: 505642 - RNA, 22 nt, Human
uaaguucaaugaacucaguucu

SEQ ID NO: 505643 - RNA, 22 nt, Human
uccccucuggaggcugcagggg

SEQ ID NO: 505644 - RNA, 22 nt, Human
agggcagauggaacuuccccga

SEQ ID NO: 505645 - RNA, 22 nt, Human
cauggccacauuggaccgaagc

SEQ ID NO: 505646 - RNA, 22 nt, Human
uguggucuccugucuuggccuu

SEQ ID NO: 505647 - RNA, 22 nt, Human
gagaguggauggagcugcgaag

SEQ ID NO: 505648 - RNA, 22 nt, Human
ucacagaagagauauugacaga

SEQ ID NO: 505649 - RNA, 22 nt, Human
ugagccagaguggagugugccu

SEQ ID NO: 505650 - RNA, 22 nt, Human
cuggagcuggcuuccuuccacu

SEQ ID NO: 505651 - RNA, 22 nt, Human
uugauauuagaguauuuguuug

SEQ ID NO: 505652 - RNA, 22 nt, Human
ugucucagaggcaggaagagcc

SEQ ID NO: 505653 - RNA, 23 nt, Human
ccagcgcucacucagagcauguu

SEQ ID NO: 505654 - RNA, 18 nt, Human
uucacaagggcuugguuu

SEQ ID NO: 505655 - RNA, 23 nt, Human
uggggcugauggagacggaccag

SEQ ID NO: 505656 - RNA, 18 nt, Human
aggcaggugcuaauauuu

SEQ ID NO: 505657 - RNA, 22 nt, Human
uugcagcuguugcaaagucucu

SEQ ID NO: 505658 - RNA, 22 nt, Human
aggaaagaaguacauucucaug

SEQ ID NO: 505659 - RNA, 22 nt, Human
uucucuuuucaccaguugcuaa

SEQ ID NO: 505660 - RNA, 23 nt, Human
aggugcagcccuggaccugcccc

SEQ ID NO: 505661 - RNA, 22 nt, Human
gagcugcugguugcuggugccu

SEQ ID NO: 505662 - RNA, 22 nt, Human
guccaagagucaagaagggggc

SEQ ID NO: 505663 - RNA, 22 nt, Human
gccacuguacuccagccugcga

SEQ ID NO: 505664 - RNA, 22 nt, Human
acacauguuuccaaaagcaccc

SEQ ID NO: 505665 - RNA, 22 nt, Human
cuuagaaaugcagauucucagg

SEQ ID NO: 505666 - RNA, 22 nt, Human
cuggcucagacagcugugcagu

SEQ ID NO: 505667 - RNA, 22 nt, Human
caaaugaaguccaaagggcuua

SEQ ID NO: 505668 - RNA, 22 nt, Human
ucaagagacaggacguguuuca

SEQ ID NO: 505669 - RNA, 22 nt, Human
gauauuuucagucuccuuucaa

SEQ ID NO: 505670 - RNA, 22 nt, Human
uggucuggggaccgaggguuac

SEQ ID NO: 505671 - RNA, 22 nt, Human
gcuggccugaccugaggcuggg

SEQ ID NO: 505672 - RNA, 22 nt, Human
acaugauuggacuccuuccccu

SEQ ID NO: 505673 - RNA, 22 nt, Human
uuuucugugauucugagguugg

SEQ ID NO: 505674 - RNA, 22 nt, Human
cucuuccuacagucugcuaugc

SEQ ID NO: 505675 - RNA, 22 nt, Human
guguuuccaguucagaaagcaa

SEQ ID NO: 505676 - RNA, 22 nt, Human
agcaaagcaccauauggcaguu

SEQ ID NO: 505677 - RNA, 22 nt, Human
aaugaaaugaagauaugaucag

SEQ ID NO: 505678 - RNA, 22 nt, Human
cuguggcucugcagucccaaca

SEQ ID NO: 505679 - RNA, 22 nt, Human
agggagcugcucugcuuccgug

SEQ ID NO: 505680 - RNA, 22 nt, Human
cuggggggcuacugacagagga

SEQ ID NO: 505681 - RNA, 22 nt, Human
guuagggagggugcauaugugu

SEQ ID NO: 505682 - RNA, 22 nt, Human
uuucaauguaacauuuccaggc

SEQ ID NO: 505683 - RNA, 22 nt, Human
uuugucuuggccaagguucuga

SEQ ID NO: 505684 - RNA, 22 nt, Human
uccuggggcucuuugaugugau

SEQ ID NO: 505685 - RNA, 22 nt, Human
ugccuggcaagaggggcuggcu

SEQ ID NO: 505686 - RNA, 22 nt, Human
aagggcucccaacucaucuuuu

SEQ ID NO: 505687 - RNA, 22 nt, Human
uccucagucguuugagccaaaa

SEQ ID NO: 505688 - RNA, 22 nt, Human
uacaaaguauauuucuagcugu

SEQ ID NO: 505689 - RNA, 22 nt, Human
gcacacaggcaguuuccagcca

SEQ ID NO: 505690 - RNA, 22 nt, Human
ggguccagaguuuucccgcccu

SEQ ID NO: 505691 - RNA, 22 nt, Human
aggugcagcugguggagucugg

SEQ ID NO: 505692 - RNA, 22 nt, Human
acaccauacucauguugguucc

SEQ ID NO: 505693 - RNA, 22 nt, Human
guucagcccacagagggggccg

SEQ ID NO: 505694 - RNA, 22 nt, Human
aggcaggugggucacuugaguc

SEQ ID NO: 505695 - RNA, 22 nt, Human
cugggcucagaugagaggaagg

SEQ ID NO: 505696 - RNA, 22 nt, Human
ccuguucaauauucuuccuugu

SEQ ID NO: 505697 - RNA, 22 nt, Human
aggagguggccugagcgugccc

SEQ ID NO: 505698 - RNA, 22 nt, Human
cugcagggcccgccugagcccu

SEQ ID NO: 505699 - RNA, 22 nt, Human
ucugcagaaguggcugggccac

SEQ ID NO: 505700 - RNA, 22 nt, Human
ucauuucuauugcuacugucug

SEQ ID NO: 505701 - RNA, 22 nt, Human
acaguuagguccuaaaauucug

SEQ ID NO: 505702 - RNA, 22 nt, Human
ggugaggguaaauauaggcaaa

SEQ ID NO: 505703 - RNA, 22 nt, Human
ucagguggcuucggggaguggc

SEQ ID NO: 505704 - RNA, 22 nt, Human
caggaaaaggagacuuuagcac

SEQ ID NO: 505705 - RNA, 22 nt, Human
gcagggucgcucuaggagauca

SEQ ID NO: 505706 - RNA, 22 nt, Human
guuagcauuuguuuaauaucag

SEQ ID NO: 505707 - RNA, 22 nt, Human
uauaagaaacaaggcaaauuuu

SEQ ID NO: 505708 - RNA, 18 nt, Human
gccucaguuuccucaccu

SEQ ID NO: 505709 - RNA, 22 nt, Human
auaaggcauauagucacuuuuu

SEQ ID NO: 505710 - RNA, 19 nt, Human
accugccaugacagccuga

SEQ ID NO: 505711 - RNA, 22 nt, Human
ucauguaaguauagaaagcagu

SEQ ID NO: 505712 - RNA, 22 nt, Human
ggagaggagcuauugggggcuc

SEQ ID NO: 505713 - RNA, 22 nt, Human
gcagcuguguaaugagcccaca

SEQ ID NO: 505714 - RNA, 22 nt, Human
gcaggccagcugugcagauggg

SEQ ID NO: 505715 - RNA, 22 nt, Human
aagauaaugugucugucuuugc

SEQ ID NO: 505716 - RNA, 22 nt, Human
guaggcagauaggagugcagcc

SEQ ID NO: 505717 - RNA, 22 nt, Human
ggcugcuggcauugagguaggu

SEQ ID NO: 505718 - RNA, 17 nt, Human
agguggcugcugcgccu

SEQ ID NO: 505719 - RNA, 22 nt, Human
cucaggccuugaagucuuuucu

SEQ ID NO: 505720 - RNA, 22 nt, Human
uaauuuaauuucaugccagccu

SEQ ID NO: 505721 - RNA, 22 nt, Human
guuagcaugacuuagaaucagg

SEQ ID NO: 505722 - RNA, 22 nt, Human
aaccaugcuagcaucaaaaugu

SEQ ID NO: 505723 - RNA, 20 nt, Human
ucucugcuguccacauuugc

SEQ ID NO: 505724 - RNA, 23 nt, Human
auaucacacccaguacagucucc

SEQ ID NO: 505725 - RNA, 20 nt, Human
ucuguucaaaucuuaguucc

SEQ ID NO: 505726 - RNA, 20 nt, Human
gccugcagagaaggucagag

SEQ ID NO: 505727 - RNA, 23 nt, Human
ucugggcaccuuguugacaugau

SEQ ID NO: 505728 - RNA, 15 nt, Human
uccaggcauucauuc

SEQ ID NO: 505729 - RNA, 22 nt, Human
agcagcaucuucuguucuccgc

SEQ ID NO: 505730 - RNA, 18 nt, Human
ggccagagggaggguccc

SEQ ID NO: 505731 - RNA, 21 nt, Human
uucugggccaugcugcuucuc

SEQ ID NO: 505732 - RNA, 22 nt, Human
aggaggcaggaagucuauggga

SEQ ID NO: 505733 - RNA, 22 nt, Human
gaaggaagucauuagugcagac

SEQ ID NO: 505734 - RNA, 18 nt, Human
agcuccaucugucagcau

SEQ ID NO: 505735 - RNA, 22 nt, Human
ucagcaggcaccggaaguguuu

SEQ ID NO: 505736 - RNA, 22 nt, Human
gaugcaaagaggaccuucagua

SEQ ID NO: 505737 - RNA, 22 nt, Human
uuuauucuugagagugagaaga

SEQ ID NO: 505738 - RNA, 22 nt, Human
ccuggcagcgccgaagcuggcc

SEQ ID NO: 505739 - RNA, 22 nt, Human
cucuggacacuggcaugggguc

SEQ ID NO: 505740 - RNA, 22 nt, Human
ucaguguuauuagaugagguuu

SEQ ID NO: 505741 - RNA, 22 nt, Human
uagaaaauagggccuguggagc

SEQ ID NO: 505742 - RNA, 22 nt, Human
agcuuuguggcuuugcaagacu

SEQ ID NO: 505743 - RNA, 22 nt, Human
agccucugcuuaugcaaaggua

SEQ ID NO: 505744 - RNA, 22 nt, Human
gaggggagacagggaaaucagu

SEQ ID NO: 505745 - RNA, 22 nt, Human
aaauacugcugcuauuccuuuu

SEQ ID NO: 505746 - RNA, 22 nt, Human
acugggcuagaguggaagcugg

SEQ ID NO: 505747 - RNA, 17 nt, Human
gcagcagagagacccuc

SEQ ID NO: 505748 - RNA, 22 nt, Human
agccugagagccaagcugugca

SEQ ID NO: 505749 - RNA, 20 nt, Human
aagaaacuugaaaguacaag

SEQ ID NO: 505750 - RNA, 22 nt, Human
aauaacaggcucaucagaugcu

SEQ ID NO: 505751 - RNA, 22 nt, Human
gcacugaaaauguuggauucca

SEQ ID NO: 505752 - RNA, 22 nt, Human
aaggagagguuguccguguugu

SEQ ID NO: 505753 - RNA, 22 nt, Human
ucugagcccagugagucucgca

SEQ ID NO: 505754 - RNA, 22 nt, Human
guggaaguagauuugagaaggu

SEQ ID NO: 505755 - RNA, 22 nt, Human
gaaucucaggaagaucucugca

SEQ ID NO: 505756 - RNA, 22 nt, Human
ucuggccauggcaagccgagug

SEQ ID NO: 505757 - RNA, 22 nt, Human
cuggggaggaugcuacgaccug

SEQ ID NO: 505758 - RNA, 22 nt, Human
agcagcaggcuguguggacuga

SEQ ID NO: 505759 - RNA, 22 nt, Human
agaagaaacugucggggauauu

SEQ ID NO: 505760 - RNA, 22 nt, Human
cuguucaugcugauucuguaug

SEQ ID NO: 505761 - RNA, 22 nt, Human
ucccagugagguccuggcuguc

SEQ ID NO: 505762 - RNA, 20 nt, Human
gaggagccaccuugagcugg

SEQ ID NO: 505763 - RNA, 21 nt, Human
aacugcuggucuuuucugucu

SEQ ID NO: 505764 - RNA, 22 nt, Human
uccuucagucuucugagccaua

SEQ ID NO: 505765 - RNA, 22 nt, Human
uggggacagggcucagcaauuu

SEQ ID NO: 505766 - RNA, 23 nt, Human
augugcacaucuccuuguccacc

SEQ ID NO: 505767 - RNA, 22 nt, Human
acaggacagucuaguaacagua

SEQ ID NO: 505768 - RNA, 18 nt, Human
guuuccugaggugaaggg

SEQ ID NO: 505769 - RNA, 22 nt, Human
ucuggagcuggagggcaaggca

SEQ ID NO: 505770 - RNA, 22 nt, Human
agggcagcuaaggugcugacug

SEQ ID NO: 505771 - RNA, 22 nt, Human
aucaacaugaauuucucugaag

SEQ ID NO: 505772 - RNA, 22 nt, Human
agacccugcaccucucgugggc

SEQ ID NO: 505773 - RNA, 22 nt, Human
agggcaguucaacuucauagug

SEQ ID NO: 505774 - RNA, 22 nt, Human
uggagcaagcuggagagaacau

SEQ ID NO: 505775 - RNA, 22 nt, Human
cacugucccuguuuccuggaaa

SEQ ID NO: 505776 - RNA, 22 nt, Human
uggccuggcccugaggcccugu

SEQ ID NO: 505777 - RNA, 22 nt, Human
agaguucugucugccacacgaa

SEQ ID NO: 505778 - RNA, 22 nt, Human
aagauacaucauucaggaguga

SEQ ID NO: 505779 - RNA, 22 nt, Human
cccagcccagcguucgaggggu

SEQ ID NO: 505780 - RNA, 22 nt, Human
acacacaacucauuguguaaua

SEQ ID NO: 505781 - RNA, 22 nt, Human
caguguggugugcacagcuuag

SEQ ID NO: 505782 - RNA, 22 nt, Human
agagcugugaaaaugagguuug

SEQ ID NO: 505783 - RNA, 22 nt, Human
agucugaagauauucuugcagg

SEQ ID NO: 505784 - RNA, 22 nt, Human
gcuggcuuugcacugggugcau

SEQ ID NO: 505785 - RNA, 22 nt, Human
uaugcuuugguagagaguugug

SEQ ID NO: 505786 - RNA, 22 nt, Human
uuggaaggagucaaccagcuga

SEQ ID NO: 505787 - RNA, 22 nt, Human
ccuguucaaguugcagggcugg

SEQ ID NO: 505788 - RNA, 22 nt, Human
caugaagcuugaagcaguccac

SEQ ID NO: 505789 - RNA, 22 nt, Human
acuacuuugggccauuuguuua

SEQ ID NO: 505790 - RNA, 22 nt, Human
gucagcugucuccccagagugg

SEQ ID NO: 505791 - RNA, 21 nt, Human
guggcccugccgcagugucca

SEQ ID NO: 505792 - RNA, 21 nt, Human
uagagaaaagaagcuguuccu

SEQ ID NO: 505793 - RNA, 20 nt, Human
caguccaggcuagaaaacaa

SEQ ID NO: 505794 - RNA, 22 nt, Human
cagcuucuagcaucggcuuuga

SEQ ID NO: 505795 - RNA, 22 nt, Human
gcagcuuggauuucuguaguuu

SEQ ID NO: 505796 - RNA, 22 nt, Human
ccucccucuuucagucccacag

SEQ ID NO: 505797 - RNA, 21 nt, Human
gcuggcugucccagggaagca

SEQ ID NO: 505798 - RNA, 22 nt, Human
cacauccuucagcugagcccag

SEQ ID NO: 505799 - RNA, 22 nt, Human
gcuucgggguccaagcgcgugu

SEQ ID NO: 505800 - RNA, 22 nt, Human
ucucuugggaggaaagagagaa

SEQ ID NO: 505801 - RNA, 22 nt, Human
uaaucacaucaggguaaauggg

SEQ ID NO: 505802 - RNA, 22 nt, Human
agguuucuucuuaggaauaugu

SEQ ID NO: 505803 - RNA, 22 nt, Human
ucaaaggaaacgugguccuggc

SEQ ID NO: 505804 - RNA, 22 nt, Human
uccuguuuccaauuuguugggu

SEQ ID NO: 505805 - RNA, 22 nt, Human
acaggcucucuauugagugcag

SEQ ID NO: 505806 - RNA, 21 nt, Human
acagaguaguugaaacagaga

SEQ ID NO: 505807 - RNA, 22 nt, Human
uuguuugaauaacagacaaauu

SEQ ID NO: 505808 - RNA, 22 nt, Human
uggccugccucccggcuucuuu

SEQ ID NO: 505809 - RNA, 18 nt, Human
uccagucccaaggccagc

SEQ ID NO: 505810 - RNA, 22 nt, Human
aggugaguuacaggaggagguc

SEQ ID NO: 505811 - RNA, 22 nt, Human
cugccuguuagucuagcaguua

SEQ ID NO: 505812 - RNA, 22 nt, Human
aaaguguaaaagcauguuaggg

SEQ ID NO: 505813 - RNA, 22 nt, Human
uuucauaauagugcaguuuguu

SEQ ID NO: 505814 - RNA, 22 nt, Human
uugcccugcguuaccaucucuu

SEQ ID NO: 505815 - RNA, 22 nt, Human
gcuuccuggagggagagagcug

SEQ ID NO: 505816 - RNA, 22 nt, Human
ugcccuggugaagugcucuccu

SEQ ID NO: 505817 - RNA, 22 nt, Human
cuuguaauuauaauguacuguu

SEQ ID NO: 505818 - RNA, 22 nt, Human
ugagccagagagguugaggcua

SEQ ID NO: 505819 - RNA, 22 nt, Human
ccacaaguuucagcacccagag

SEQ ID NO: 505820 - RNA, 22 nt, Human
gccuggcaggccucaugagggg

SEQ ID NO: 505821 - RNA, 22 nt, Human
cugcugucuuuauuucacugcu

SEQ ID NO: 505822 - RNA, 22 nt, Human
ccagcucugccaagcgucagcu

SEQ ID NO: 505823 - RNA, 22 nt, Human
acaguguguucugggaccucca

SEQ ID NO: 505824 - RNA, 22 nt, Human
uaugcacgucuauuuaugaaga

SEQ ID NO: 505825 - RNA, 22 nt, Human
caggaaagggaugggcugccac

SEQ ID NO: 505826 - RNA, 22 nt, Human
uuuuguuuucuuagaaaccugg

SEQ ID NO: 505827 - RNA, 22 nt, Human
gcucucugaggugcuggcagag

SEQ ID NO: 505828 - RNA, 22 nt, Human
acaguguucuugauauuacagu

SEQ ID NO: 505829 - RNA, 22 nt, Human
agcccugggcuguagauaagca

SEQ ID NO: 505830 - RNA, 22 nt, Human
ucccacaggaaaguagacauug

SEQ ID NO: 505831 - RNA, 22 nt, Human
cuggccacugauuccuccccug

SEQ ID NO: 505832 - RNA, 22 nt, Human
ccaggacagggagacgggagcc

SEQ ID NO: 505833 - RNA, 23 nt, Human
uccucccaaauuucagccucauu

SEQ ID NO: 505834 - RNA, 22 nt, Human
gaaaauuauugaaaauggcucu

SEQ ID NO: 505835 - RNA, 22 nt, Human
aaacaccagucccaguauacac

SEQ ID NO: 505836 - RNA, 21 nt, Human
gggccacaccuucugcagacc

SEQ ID NO: 505837 - RNA, 22 nt, Human
ugaagcacaggcauacacaacc

SEQ ID NO: 505838 - RNA, 22 nt, Human
caguguggagggagagagccug

SEQ ID NO: 505839 - RNA, 22 nt, Human
uaccaaguguauuaugcuuugu

SEQ ID NO: 505840 - RNA, 22 nt, Human
uccugccuguuuaccuguacuu

SEQ ID NO: 505841 - RNA, 22 nt, Human
aaggcugaauucaaggguaggc

SEQ ID NO: 505842 - RNA, 22 nt, Human
uguguucaucaugauaucaggu

SEQ ID NO: 505843 - RNA, 22 nt, Human
gagcacaggcuuugguggacac

SEQ ID NO: 505844 - RNA, 22 nt, Human
gaaaguauuuacauuaacaucu

SEQ ID NO: 505845 - RNA, 22 nt, Human
caggaugguggcaugaucagaa

SEQ ID NO: 505846 - RNA, 22 nt, Human
acuguggccuuguggguucagg

SEQ ID NO: 505847 - RNA, 22 nt, Human
gcagugggccugaggaagggug

SEQ ID NO: 505848 - RNA, 22 nt, Human
cagggcuugaaucaaggaaguc

SEQ ID NO: 505849 - RNA, 22 nt, Human
cugggagagccuuuccugaguc

SEQ ID NO: 505850 - RNA, 22 nt, Human
agggcugcuauguugauucaga

SEQ ID NO: 505851 - RNA, 22 nt, Human
auauacuuggagacuaucauug

SEQ ID NO: 505852 - RNA, 22 nt, Human
auuucugugcaguaaaugguga

SEQ ID NO: 505853 - RNA, 22 nt, Human
gcuuagcaucuuacaaugcuga

SEQ ID NO: 505854 - RNA, 22 nt, Human
auacagggacauccaguuuuuc

SEQ ID NO: 505855 - RNA, 22 nt, Human
gaggagguuccggguggagaag

SEQ ID NO: 505856 - RNA, 22 nt, Human
gagcugggacauggguccucuc

SEQ ID NO: 505857 - RNA, 22 nt, Human
uauuuuacagacuacuuuagau

SEQ ID NO: 505858 - RNA, 22 nt, Human
ugagauggguggggagcucagg

SEQ ID NO: 505859 - RNA, 22 nt, Human
gccugucugcgucacgcuuauu

SEQ ID NO: 505860 - RNA, 22 nt, Human
ugggcacagagucccaucugcc

SEQ ID NO: 505861 - RNA, 22 nt, Human
uggagccugagucagcggaggc

SEQ ID NO: 505862 - RNA, 22 nt, Human
uccuugaauccuagcauccuau

SEQ ID NO: 505863 - RNA, 22 nt, Human
aacaccuucuccuugcaggcca

SEQ ID NO: 505864 - RNA, 22 nt, Human
uuuauuugaaucaggggagaau

SEQ ID NO: 505865 - RNA, 22 nt, Human
auuagcauaaguguucggugca

SEQ ID NO: 505866 - RNA, 22 nt, Human
cagggccagcgcccaggcccag

SEQ ID NO: 505867 - RNA, 22 nt, Human
ccucucuguguggccucuccau

SEQ ID NO: 505868 - RNA, 22 nt, Human
aagcagcuuccccaaagugccu

SEQ ID NO: 505869 - RNA, 22 nt, Human
aggagcuggguuccuuuggugg

SEQ ID NO: 505870 - RNA, 22 nt, Human
ucagaggugguaaaggacagca

SEQ ID NO: 505871 - RNA, 22 nt, Human
uggaggaaaauuacuggggucu

SEQ ID NO: 505872 - RNA, 22 nt, Human
gaagucaugcucccaucuugcu

SEQ ID NO: 505873 - RNA, 22 nt, Human
uccugaaguauggguauggagu

SEQ ID NO: 505874 - RNA, 22 nt, Human
ggcucugggcauagaaggaagc

SEQ ID NO: 505875 - RNA, 23 nt, Human
cucugggcgggcaggucagccuc

SEQ ID NO: 505876 - RNA, 22 nt, Human
gaaugauaaauggaagcagcau

SEQ ID NO: 505877 - RNA, 22 nt, Human
auccaagucagggauaguuuga

SEQ ID NO: 505878 - RNA, 22 nt, Human
uguguccuuuggaggaucagcg

SEQ ID NO: 505879 - RNA, 22 nt, Human
uggcaggugccuguaaucucag

SEQ ID NO: 505880 - RNA, 22 nt, Human
ucagcacuuugaagcagaagga

SEQ ID NO: 505881 - RNA, 22 nt, Human
agcaaucaccaccucuauauuu

SEQ ID NO: 505882 - RNA, 23 nt, Human
uugcuuagagaccuccucaucag

SEQ ID NO: 505883 - RNA, 22 nt, Human
ugcuggcuggccuggccuggac

SEQ ID NO: 505884 - RNA, 22 nt, Human
uggcuaggcuccaagagcugga

SEQ ID NO: 505885 - RNA, 22 nt, Human
ggcugugagcaggcagaaugcu

SEQ ID NO: 505886 - RNA, 22 nt, Human
ggcaguuucucaggcaggggua

SEQ ID NO: 505887 - RNA, 22 nt, Human
acuggcugugcccauagagcuc

SEQ ID NO: 505888 - RNA, 22 nt, Human
ugagcuccggcauauggaauua

SEQ ID NO: 505889 - RNA, 22 nt, Human
aagaacagguucuagaaccauu

SEQ ID NO: 505890 - RNA, 22 nt, Human
aaguauucuggcagucauucag

SEQ ID NO: 505891 - RNA, 22 nt, Human
auggcagggaccaagcugucau

SEQ ID NO: 505892 - RNA, 22 nt, Human
gcucugagagugggugauucug

SEQ ID NO: 505893 - RNA, 20 nt, Human
aucuggcucagauccugcag

SEQ ID NO: 505894 - RNA, 22 nt, Human
uggcucaggccuacgacgccuu

SEQ ID NO: 505895 - RNA, 18 nt, Human
ucucuucuuggcagucaa

SEQ ID NO: 505896 - RNA, 22 nt, Human
ucuuucagccacuuaccugucu

SEQ ID NO: 505897 - RNA, 22 nt, Human
guuauuuucauuggcucagacu

SEQ ID NO: 505898 - RNA, 22 nt, Human
acuucucuucauagguggcaau

SEQ ID NO: 505899 - RNA, 22 nt, Human
uucauguaccguguaccaggca

SEQ ID NO: 505900 - RNA, 22 nt, Human
aauuagcuucagcuuguggggc

SEQ ID NO: 505901 - RNA, 22 nt, Human
uaaacaaggguuacugagcaug

SEQ ID NO: 505902 - RNA, 22 nt, Human
cucaggaugcaggucacaggac

SEQ ID NO: 505903 - RNA, 22 nt, Human
ucugcugcacaaauucaucucu

SEQ ID NO: 505904 - RNA, 22 nt, Human
agucacaguuccuacccaguaa

SEQ ID NO: 505905 - RNA, 22 nt, Human
gaaaaugagccucagcuacauu

SEQ ID NO: 505906 - RNA, 22 nt, Human
aggcgcagaaggccaggggccu

SEQ ID NO: 505907 - RNA, 22 nt, Human
guuucuaauuggaacuuugagg

SEQ ID NO: 505908 - RNA, 22 nt, Human
aggcuccaggcaaaauuucgga

SEQ ID NO: 505909 - RNA, 22 nt, Human
gagaggggcgcgcagcucgcga

SEQ ID NO: 505910 - RNA, 22 nt, Human
gaacugaguuuucugccuggac

SEQ ID NO: 505911 - RNA, 22 nt, Human
aauguucagaggacaauauaaa

SEQ ID NO: 505912 - RNA, 22 nt, Human
uccuugaagcaacgugcagaca

SEQ ID NO: 505913 - RNA, 22 nt, Human
cugcuggugaugucugggcaug

SEQ ID NO: 505914 - RNA, 22 nt, Human
uccagccacguauuaucucacu

SEQ ID NO: 505915 - RNA, 22 nt, Human
uucccucugcgcauugaauuuc

SEQ ID NO: 505916 - RNA, 22 nt, Human
uuucuuuuacaguguggcuauu

SEQ ID NO: 505917 - RNA, 22 nt, Human
guccuggggauacagaagugaa

SEQ ID NO: 505918 - RNA, 20 nt, Human
agguuccuuuguggagaauu

SEQ ID NO: 505919 - RNA, 18 nt, Human
uugaaguuauuuacauuc

SEQ ID NO: 505920 - RNA, 22 nt, Human
gcaggucuggagggcacugggg

SEQ ID NO: 505921 - RNA, 22 nt, Human
ccuggagggacccuggcccugu

SEQ ID NO: 505922 - RNA, 22 nt, Human
gugccugcugcagagucgcugu

SEQ ID NO: 505923 - RNA, 22 nt, Human
cagccagcugucccaagugccu

SEQ ID NO: 505924 - RNA, 22 nt, Human
cucucugggguuccagacgugg

SEQ ID NO: 505925 - RNA, 22 nt, Human
ggcaggagaaaggucucuucuu

SEQ ID NO: 505926 - RNA, 22 nt, Human
uccuuagacaaagagugggcuu

SEQ ID NO: 505927 - RNA, 22 nt, Human
gccacaggcacuuaagggcugg

SEQ ID NO: 505928 - RNA, 22 nt, Human
aauucaugaguagaaucuauau

SEQ ID NO: 505929 - RNA, 22 nt, Human
ucagugcaucacagaacuuugu

SEQ ID NO: 505930 - RNA, 22 nt, Human
auaauauaauccuacuucccau

SEQ ID NO: 505931 - RNA, 22 nt, Human
cuccugggaugacucuuucuuu

SEQ ID NO: 505932 - RNA, 22 nt, Human
uauguguaggaggaggacaggg

SEQ ID NO: 505933 - RNA, 22 nt, Human
ucagguguuagaagaaauuuca

SEQ ID NO: 505934 - RNA, 22 nt, Human
acaguguucacuuaacaaugga

SEQ ID NO: 505935 - RNA, 21 nt, Human
uaucuacuggugucuuucaga

SEQ ID NO: 505936 - RNA, 22 nt, Human
cuaugaaaggauuuggaguugu

SEQ ID NO: 505937 - RNA, 22 nt, Human
gcuguucacagacucugcucug

SEQ ID NO: 505938 - RNA, 22 nt, Human
gaaaauguuuguccggagcuga

SEQ ID NO: 505939 - RNA, 22 nt, Human
ugacucuguaccugucugccuu

SEQ ID NO: 505940 - RNA, 22 nt, Human
uaggaaauuggaaacucuucac

SEQ ID NO: 505941 - RNA, 22 nt, Human
gcucccaguucccaaagugacc

SEQ ID NO: 505942 - RNA, 22 nt, Human
aggaagcugcuaagaaacaaug

SEQ ID NO: 505943 - RNA, 22 nt, Human
gacuggccuggagaugcagcug

SEQ ID NO: 505944 - RNA, 18 nt, Human
ugugguggagcugccuuc

SEQ ID NO: 505945 - RNA, 22 nt, Human
aaguaugucuuuggguauuauu

SEQ ID NO: 505946 - RNA, 19 nt, Human
cccagagcauccugaacuu

SEQ ID NO: 505947 - RNA, 22 nt, Human
cauucacaaaaccacaugccau

SEQ ID NO: 505948 - RNA, 22 nt, Human
ccccuuccuuccucagacagcc

SEQ ID NO: 505949 - RNA, 22 nt, Human
acugcaucugaaacauggguca

SEQ ID NO: 505950 - RNA, 22 nt, Human
gcagcauuucucaaaggguggu

SEQ ID NO: 505951 - RNA, 22 nt, Human
cuuguggcagguggauggugcc

SEQ ID NO: 505952 - RNA, 22 nt, Human
caggacacuacagaugggaggg

SEQ ID NO: 505953 - RNA, 22 nt, Human
auaaggcacacauagauagggu

SEQ ID NO: 505954 - RNA, 22 nt, Human
uuuucuaaaauauccaggacag

SEQ ID NO: 505955 - RNA, 22 nt, Human
uuagaaaucugcugccaugcaa

SEQ ID NO: 505956 - RNA, 22 nt, Human
cuagugaacgugguacuaugga

SEQ ID NO: 505957 - RNA, 22 nt, Human
caugagaaguggccuucaaaaa

SEQ ID NO: 505958 - RNA, 22 nt, Human
guaguucuuucucaauguucaa

SEQ ID NO: 505959 - RNA, 22 nt, Human
cugagaggcacaaggcauuucg

SEQ ID NO: 505960 - RNA, 22 nt, Human
cagauccacccuuguagugaca

SEQ ID NO: 505961 - RNA, 22 nt, Human
cuucagagaacuugaucgcugc

SEQ ID NO: 505962 - RNA, 22 nt, Human
aggcgcaggguuuggacccagg

SEQ ID NO: 505963 - RNA, 22 nt, Human
cagcagcugaggcgcuggcgug

SEQ ID NO: 505964 - RNA, 22 nt, Human
agggcugaguggugcagucaaa

SEQ ID NO: 505965 - RNA, 22 nt, Human
aauagcauagaguuaaaaugca

SEQ ID NO: 505966 - RNA, 22 nt, Human
aggcaagugcauuagaagagca

SEQ ID NO: 505967 - RNA, 22 nt, Human
ucagugcuucggcgagcaccua

SEQ ID NO: 505968 - RNA, 22 nt, Human
aaacucuguagcuaaacauaau

SEQ ID NO: 505969 - RNA, 22 nt, Human
ucagcuggagaugagaaccgaa

SEQ ID NO: 505970 - RNA, 16 nt, Human
uugcccugaggggagg

SEQ ID NO: 505971 - RNA, 19 nt, Human
ggaaggcagaggggcugug

SEQ ID NO: 505972 - RNA, 22 nt, Human
caguggaggcucaagugugcuu

SEQ ID NO: 505973 - RNA, 22 nt, Human
aaucuguuaagaacagaaaugu

SEQ ID NO: 505974 - RNA, 22 nt, Human
ugucccugguggaggcuggcag

SEQ ID NO: 505975 - RNA, 22 nt, Human
gccugggacccuuagcucuugg

SEQ ID NO: 505976 - RNA, 22 nt, Human
ugcaggggcuugucugggccug

SEQ ID NO: 505977 - RNA, 22 nt, Human
ggaggggauuuaguagaugcua

SEQ ID NO: 505978 - RNA, 22 nt, Human
agcugcccugggucuugcugcu

SEQ ID NO: 505979 - RNA, 22 nt, Human
ugucugaacgaaguagguccac

SEQ ID NO: 505980 - RNA, 19 nt, Human
gggaucagcccagggcucu

SEQ ID NO: 505981 - RNA, 17 nt, Human
gcauguaguacauguaa

SEQ ID NO: 505982 - RNA, 22 nt, Human
cugaaggagaaggccacuguuc

SEQ ID NO: 505983 - RNA, 22 nt, Human
cagugguggaaugaggaauugu

SEQ ID NO: 505984 - RNA, 22 nt, Human
cucaggauagauuguccucuca

SEQ ID NO: 505985 - RNA, 22 nt, Human
uguggcagucucacuggagggc

SEQ ID NO: 505986 - RNA, 22 nt, Human
ugcugcucucagccaccaggaa

SEQ ID NO: 505987 - RNA, 22 nt, Human
uagcuucaguggcccuagacac

SEQ ID NO: 505988 - RNA, 22 nt, Human
aaugauggucauggcaacuuuu

SEQ ID NO: 505989 - RNA, 22 nt, Human
ugaggaagugguuguaugguuu

SEQ ID NO: 505990 - RNA, 22 nt, Human
aacaaaugauuguugguuggag

SEQ ID NO: 505991 - RNA, 22 nt, Human
ggcguggggccuucugcccgcu

SEQ ID NO: 505992 - RNA, 22 nt, Human
acagagcaauucuuggguguuu

SEQ ID NO: 505993 - RNA, 22 nt, Human
cuauuaaacacuacugugcacu

SEQ ID NO: 505994 - RNA, 22 nt, Human
cucugggcaaguuucuucauga

SEQ ID NO: 505995 - RNA, 22 nt, Human
aauuagcuaauuaauuguagcc

SEQ ID NO: 505996 - RNA, 22 nt, Human
ggagacaugcagacugagauac

SEQ ID NO: 505997 - RNA, 22 nt, Human
cuggaauguagagacagcuuag

SEQ ID NO: 505998 - RNA, 22 nt, Human
agaggagcugggaggcccucgu

SEQ ID NO: 505999 - RNA, 22 nt, Human
uggcuggcuguccagcugggca

SEQ ID NO: 506000 - RNA, 22 nt, Human
guggcugcuacagagcuggagg

SEQ ID NO: 506001 - RNA, 20 nt, Human
uuucugugauagagaggugu

SEQ ID NO: 506002 - RNA, 17 nt, Human
acaggccugcuugcacu

SEQ ID NO: 506003 - RNA, 22 nt, Human
cugaaggauuuaguucuuugcu

SEQ ID NO: 506004 - RNA, 22 nt, Human
uaauuauuaugacaacaauugc

SEQ ID NO: 506005 - RNA, 22 nt, Human
cacugcugauuucauaggcagg

SEQ ID NO: 506006 - RNA, 22 nt, Human
gguuccaccuggcgagggguau

SEQ ID NO: 506007 - RNA, 22 nt, Human
aagauuuagggccaguuuacau

SEQ ID NO: 506008 - RNA, 22 nt, Human
ggggccuguagagcuucaggga

SEQ ID NO: 506009 - RNA, 22 nt, Human
gccuguuuuugcuucguuuaag

SEQ ID NO: 506010 - RNA, 19 nt, Human
agcuggggcgguguguguu

SEQ ID NO: 506011 - RNA, 22 nt, Human
aaacauguuuagaaagcagcug

SEQ ID NO: 506012 - RNA, 17 nt, Human
gcaagggaugggagauu

SEQ ID NO: 506013 - RNA, 22 nt, Human
ugcaggcuccaggugcacauau

SEQ ID NO: 506014 - RNA, 22 nt, Human
cuccagggaggagcacggguuc

SEQ ID NO: 506015 - RNA, 22 nt, Human
agagccaggaugucuucugggg

SEQ ID NO: 506016 - RNA, 22 nt, Human
cccugcagugugaccucaccua

SEQ ID NO: 506017 - RNA, 22 nt, Human
uuggccuucugguguucauuuu

SEQ ID NO: 506018 - RNA, 22 nt, Human
auguccagagccggccugcuga

SEQ ID NO: 506019 - RNA, 22 nt, Human
uuaugagcuaaguuguggcccc

SEQ ID NO: 506020 - RNA, 22 nt, Human
guccaggucuggacccugagcc

SEQ ID NO: 506021 - RNA, 22 nt, Human
uuuccucugucaugacagcuga

SEQ ID NO: 506022 - RNA, 22 nt, Human
uaagauguaagaucagagcuug

SEQ ID NO: 506023 - RNA, 22 nt, Human
ucaggcucaggaauguguuuau

SEQ ID NO: 506024 - RNA, 22 nt, Human
acuggggaauggaacugggaau

SEQ ID NO: 506025 - RNA, 22 nt, Human
cccagcacuuugaauaugucac

SEQ ID NO: 506026 - RNA, 22 nt, Human
cauacagaaaauauauuuugau

SEQ ID NO: 506027 - RNA, 22 nt, Human
uacagcaugaucacaauggaaa

SEQ ID NO: 506028 - RNA, 22 nt, Human
uuaucaguuguguguauacacg

SEQ ID NO: 506029 - RNA, 22 nt, Human
gcucugggugaaggguaccauu

SEQ ID NO: 506030 - RNA, 22 nt, Human
auaucuuuguaugguucagcag

SEQ ID NO: 506031 - RNA, 22 nt, Human
ccugggagugucagacuugcuu

SEQ ID NO: 506032 - RNA, 22 nt, Human
uguuauugagguuacuuauaag

SEQ ID NO: 506033 - RNA, 23 nt, Human
ucacauaauccuucauccacagg

SEQ ID NO: 506034 - RNA, 22 nt, Human
ucacagaauagcacuguaagcg

SEQ ID NO: 506035 - RNA, 22 nt, Human
aucuggcucuuccuggaguucc

SEQ ID NO: 506036 - RNA, 22 nt, Human
uagggcagauucgguggaguuu

SEQ ID NO: 506037 - RNA, 22 nt, Human
gcucuggacuggggccugagaa

SEQ ID NO: 506038 - RNA, 22 nt, Human
caaggaaacaugaaaugcauug

SEQ ID NO: 506039 - RNA, 23 nt, Human
uagagcagggaaaucugucagag

SEQ ID NO: 506040 - RNA, 22 nt, Human
uuggcuucuugugaaaucugag

SEQ ID NO: 506041 - RNA, 22 nt, Human
ccaaggcuccucagcuggucuu

SEQ ID NO: 506042 - RNA, 22 nt, Human
uuagagaauuccaaaugacuac

SEQ ID NO: 506043 - RNA, 22 nt, Human
ggagccuguggcugcuugaagc

SEQ ID NO: 506044 - RNA, 22 nt, Human
agggucuguauuucuggcaagc

SEQ ID NO: 506045 - RNA, 22 nt, Human
aagugaaacauguaucucuuua

SEQ ID NO: 506046 - RNA, 22 nt, Human
gcucucuguuauuaagaucuuu

SEQ ID NO: 506047 - RNA, 22 nt, Human
accagacacugugaagacaggc

SEQ ID NO: 506048 - RNA, 22 nt, Human
ggcagcuccaaaaggaaacacu

SEQ ID NO: 506049 - RNA, 22 nt, Human
caaagugcugagauuacaggua

SEQ ID NO: 506050 - RNA, 22 nt, Human
aagagacuauggugucuaugaa

SEQ ID NO: 506051 - RNA, 22 nt, Human
ggcuucuggugggagcaugacu

SEQ ID NO: 506052 - RNA, 19 nt, Human
ucuguggccuucccugaug

SEQ ID NO: 506053 - RNA, 22 nt, Human
gaggccuggcucugcccuccug

SEQ ID NO: 506054 - RNA, 22 nt, Human
gcugagcugggacaguccuggg

SEQ ID NO: 506055 - RNA, 22 nt, Human
cuggcccuucucuugcuuccug

SEQ ID NO: 506056 - RNA, 22 nt, Human
ggucucagaucuuuauuaaggc

SEQ ID NO: 506057 - RNA, 22 nt, Human
ggggacaguuaaagaccaagac

SEQ ID NO: 506058 - RNA, 22 nt, Human
uggcugaguuccuggcacacgg

SEQ ID NO: 506059 - RNA, 22 nt, Human
cucugcaacuucuagcaguguc

SEQ ID NO: 506060 - RNA, 22 nt, Human
aacaaagaugggugggaaagag

SEQ ID NO: 506061 - RNA, 22 nt, Human
agguccuguuucuucccugggg

SEQ ID NO: 506062 - RNA, 22 nt, Human
gccuucugcgcucgugucuccg

SEQ ID NO: 506063 - RNA, 22 nt, Human
gccuugccucagccauggaaac

SEQ ID NO: 506064 - RNA, 22 nt, Human
ucccggcgcugggagguggguc

SEQ ID NO: 506065 - RNA, 22 nt, Human
gcaggugggggucggugcaucu

SEQ ID NO: 506066 - RNA, 22 nt, Human
cccaggccccagggcuugucag

SEQ ID NO: 506067 - RNA, 23 nt, Human
acugccaguuuuaccacagacgg

SEQ ID NO: 506068 - RNA, 22 nt, Human
ugaaaaggguagaucccuaagu

SEQ ID NO: 506069 - RNA, 22 nt, Human
ugccagccuggccugagucuuu

SEQ ID NO: 506070 - RNA, 22 nt, Human
cagugcagucaaggaagaacca

SEQ ID NO: 506071 - RNA, 22 nt, Human
ggcugccugaggcugaggcccg

SEQ ID NO: 506072 - RNA, 22 nt, Human
gggaaauugucaacacucucaa

SEQ ID NO: 506073 - RNA, 19 nt, Human
guaagggcuaauggacuau

SEQ ID NO: 506074 - RNA, 22 nt, Human
ugcucaucaacaugaugaucau

SEQ ID NO: 506075 - RNA, 22 nt, Human
gucaccagugcuaagaggugga

SEQ ID NO: 506076 - RNA, 22 nt, Human
cccagcauccucagggagcggg

SEQ ID NO: 506077 - RNA, 22 nt, Human
cagagguacaagcuaaguuggg

SEQ ID NO: 506078 - RNA, 21 nt, Human
auuauuauuucuguguccagc

SEQ ID NO: 506079 - RNA, 22 nt, Human
uguggaaaauuggaacguuccu

SEQ ID NO: 506080 - RNA, 22 nt, Human
gcagggcagugugucugugggg

SEQ ID NO: 506081 - RNA, 22 nt, Human
uggcugcugagaaggcagcugu

SEQ ID NO: 506082 - RNA, 22 nt, Human
agggaccugcucacugccuggc

SEQ ID NO: 506083 - RNA, 22 nt, Human
guguccugaucaauugagcugg

SEQ ID NO: 506084 - RNA, 22 nt, Human
accagagcgcucaagccuuccc

SEQ ID NO: 506085 - RNA, 22 nt, Human
gugaccaucagagaauaacaaa

SEQ ID NO: 506086 - RNA, 22 nt, Human
gcaaggaccuuugagcgugcca

SEQ ID NO: 506087 - RNA, 22 nt, Human
acaacugucaguaaagaauauu

SEQ ID NO: 506088 - RNA, 22 nt, Human
guuucuaagcacaugugagugu

SEQ ID NO: 506089 - RNA, 22 nt, Human
acuuaaaaccagacagcgucau

SEQ ID NO: 506090 - RNA, 20 nt, Human
aacacagauaccaaagguug

SEQ ID NO: 506091 - RNA, 22 nt, Human
uggcuacaucacagagaauucc

SEQ ID NO: 506092 - RNA, 22 nt, Human
uccuggagauaauugcagugaa

SEQ ID NO: 506093 - RNA, 22 nt, Human
aggggcuggcuuaucugagagu

SEQ ID NO: 506094 - RNA, 22 nt, Human
cacagcauaaugaaauauacuu

SEQ ID NO: 506095 - RNA, 22 nt, Human
uccaggcauguggccaguacuc

SEQ ID NO: 506096 - RNA, 22 nt, Human
cucucugggggccaugccaaga

SEQ ID NO: 506097 - RNA, 22 nt, Human
ucuuugcaacucccauuuccau

SEQ ID NO: 506098 - RNA, 22 nt, Human
cuagucacuguaauaaucugcu

SEQ ID NO: 506099 - RNA, 21 nt, Human
uucaaaguuugccuaaagauu

SEQ ID NO: 506100 - RNA, 22 nt, Human
ggucucagcaguugcuuugacu

SEQ ID NO: 506101 - RNA, 22 nt, Human
ugaggcaggaugcuugcacagg

SEQ ID NO: 506102 - RNA, 22 nt, Human
cucucugaggcaggccuguggg

SEQ ID NO: 506103 - RNA, 22 nt, Human
ggccucagggucacucuguaga

SEQ ID NO: 506104 - RNA, 22 nt, Human
auaaggcaagcugucaguuugu

SEQ ID NO: 506105 - RNA, 22 nt, Human
ccuuccaggagucucugcaggu

SEQ ID NO: 506106 - RNA, 22 nt, Human
cagcuggcccuuugguagccuu

SEQ ID NO: 506107 - RNA, 22 nt, Human
uuccaggaauucagcucucagu

SEQ ID NO: 506108 - RNA, 22 nt, Human
gccucccuguucuuccacaaua

SEQ ID NO: 506109 - RNA, 22 nt, Human
gccuggcucugaguuucucucc

SEQ ID NO: 506110 - RNA, 22 nt, Human
guguccugggggacuucagguu

SEQ ID NO: 506111 - RNA, 19 nt, Human
agcauuuggaauucuacac

SEQ ID NO: 506112 - RNA, 22 nt, Human
ugggaguguucuuggcuugcuu

SEQ ID NO: 506113 - RNA, 22 nt, Human
cugcagcuuuggaaaccuguuu

SEQ ID NO: 506114 - RNA, 22 nt, Human
cacagcagaaauaugaaggcag

SEQ ID NO: 506115 - RNA, 22 nt, Human
gccagggaggcuguaggguccu

SEQ ID NO: 506116 - RNA, 21 nt, Human
agcugggccucagccugcagu

SEQ ID NO: 506117 - RNA, 22 nt, Human
gagcagggccacuucuguaccu

SEQ ID NO: 506118 - RNA, 22 nt, Human
agggaagaaaauccaucgcugc

SEQ ID NO: 506119 - RNA, 22 nt, Human
uccuucagauuccugcuucugg

SEQ ID NO: 506120 - RNA, 22 nt, Human
ucuggcuccaccuccuuuacua

SEQ ID NO: 506121 - RNA, 22 nt, Human
agugaguggguuacagauggga

SEQ ID NO: 506122 - RNA, 22 nt, Human
ugggcagaguagcucagaagaa

SEQ ID NO: 506123 - RNA, 22 nt, Human
uuucuauuggcgucacuguugu

SEQ ID NO: 506124 - RNA, 22 nt, Human
uuuugcuuuuguaacacagugu

SEQ ID NO: 506125 - RNA, 22 nt, Human
aagacaauuugauacuaguugc

SEQ ID NO: 506126 - RNA, 22 nt, Human
uccugcaggggcugaggaacca

SEQ ID NO: 506127 - RNA, 22 nt, Human
acucugggagaggacaaacaaa

SEQ ID NO: 506128 - RNA, 22 nt, Human
agcuccugucucaagggagccu

SEQ ID NO: 506129 - RNA, 20 nt, Human
cuguagggugcagcaggcuc

SEQ ID NO: 506130 - RNA, 22 nt, Human
guggauggauugaggcaguggg

SEQ ID NO: 506131 - RNA, 22 nt, Human
cagcuuuaccaauauuuggaaa

SEQ ID NO: 506132 - RNA, 22 nt, Human
gagcucaggagcaucagaagaa

SEQ ID NO: 506133 - RNA, 22 nt, Human
gccagaucugacauaguggaag

SEQ ID NO: 506134 - RNA, 22 nt, Human
ggccacagagggcgggaugcug

SEQ ID NO: 506135 - RNA, 22 nt, Human
uucaagugaggcugucuuuaga

SEQ ID NO: 506136 - RNA, 22 nt, Human
aaauuagaagugcucaggaaua

SEQ ID NO: 506137 - RNA, 20 nt, Human
aauuagauguuuaaucaaua

SEQ ID NO: 506138 - RNA, 22 nt, Human
auuccuugggcugccuuauuau

SEQ ID NO: 506139 - RNA, 22 nt, Human
uugggguguuggauggagcaag

SEQ ID NO: 506140 - RNA, 22 nt, Human
uucuggcaucugggggaggccu

SEQ ID NO: 506141 - RNA, 22 nt, Human
agcugccagggacugggcaugg

SEQ ID NO: 506142 - RNA, 22 nt, Human
cagagacaggaaucagcugcag

SEQ ID NO: 506143 - RNA, 22 nt, Human
auacagcaguuugugauccuag

SEQ ID NO: 506144 - RNA, 22 nt, Human
guucuuaagaccacaauaaaaa

SEQ ID NO: 506145 - RNA, 22 nt, Human
ccagcucucuguccuccccaca

SEQ ID NO: 506146 - RNA, 22 nt, Human
ucagccuggcaggauggccugg

SEQ ID NO: 506147 - RNA, 22 nt, Human
agcaccuucacaggcucucagg

SEQ ID NO: 506148 - RNA, 22 nt, Human
cucuguccuugcacaguuccua

SEQ ID NO: 506149 - RNA, 22 nt, Human
gagguucacaggcuaucacagu

SEQ ID NO: 506150 - RNA, 22 nt, Human
acugggccuacccagauuggca

SEQ ID NO: 506151 - RNA, 22 nt, Human
agagugggugaucucuguuguc

SEQ ID NO: 506152 - RNA, 22 nt, Human
ccauuccaugugcuacacauaa

SEQ ID NO: 506153 - RNA, 22 nt, Human
agaugaaaagauaagcagcaau

SEQ ID NO: 506154 - RNA, 22 nt, Human
acggcuucuugacuguggguug

SEQ ID NO: 506155 - RNA, 22 nt, Human
agagcagcugcauucagcaccu

SEQ ID NO: 506156 - RNA, 22 nt, Human
aaggcugaaagaccuugaaccu

SEQ ID NO: 506157 - RNA, 22 nt, Human
ugggggcauggaccagccuggc

SEQ ID NO: 506158 - RNA, 22 nt, Human
uucaugaaaguguaucuugugg

SEQ ID NO: 506159 - RNA, 22 nt, Human
ugaauaugugacuuugauuuca

SEQ ID NO: 506160 - RNA, 22 nt, Human
caggccagguggcaggcaaaac

SEQ ID NO: 506161 - RNA, 22 nt, Human
gaggaaaagagacagguuauug

SEQ ID NO: 506162 - RNA, 23 nt, Human
uugcuucugugcaauucaguacu

SEQ ID NO: 506163 - RNA, 22 nt, Human
gaguaagagcuggcuuuggugu

SEQ ID NO: 506164 - RNA, 22 nt, Human
cagguucagcaggaggcauccc

SEQ ID NO: 506165 - RNA, 22 nt, Human
gaaggagcuaaagggagcccug

SEQ ID NO: 506166 - RNA, 22 nt, Human
ucucaggccccugaguuucucu

SEQ ID NO: 506167 - RNA, 22 nt, Human
uauuugugagacugacugaagu

SEQ ID NO: 506168 - RNA, 22 nt, Human
uuugaaagaaaccagugaguga

SEQ ID NO: 506169 - RNA, 22 nt, Human
gccaggcugaggcucuggaaga

SEQ ID NO: 506170 - RNA, 22 nt, Human
aaaugugugcacaaagacagcu

SEQ ID NO: 506171 - RNA, 22 nt, Human
agagcccucucauuggcuuauu

SEQ ID NO: 506172 - RNA, 22 nt, Human
ccuaggcccucaaagagcauaa

SEQ ID NO: 506173 - RNA, 19 nt, Human
ccugugugggguagagauc

SEQ ID NO: 506174 - RNA, 19 nt, Human
gagggcucauuugaacaau

SEQ ID NO: 506175 - RNA, 22 nt, Human
uuguguuucccuugcauauucc

SEQ ID NO: 506176 - RNA, 22 nt, Human
ggccacagaacagcuacaggac

SEQ ID NO: 506177 - RNA, 22 nt, Human
acagaaauauucguggugcuug

SEQ ID NO: 506178 - RNA, 22 nt, Human
ugaccaaaggugguuuauuugg

SEQ ID NO: 506179 - RNA, 22 nt, Human
ccagggcacuuaggcccagccc

SEQ ID NO: 506180 - RNA, 22 nt, Human
ccugaagagcacucuagaguug

SEQ ID NO: 506181 - RNA, 22 nt, Human
acauuucugagcagggagcugu

SEQ ID NO: 506182 - RNA, 23 nt, Human
ggcucugugcugggccugcagga

SEQ ID NO: 506183 - RNA, 22 nt, Human
ggcugggagcuggacaggccgg

SEQ ID NO: 506184 - RNA, 22 nt, Human
auaaacaguaaaugugagcagu

SEQ ID NO: 506185 - RNA, 22 nt, Human
agagaugaagggcauuccccag

SEQ ID NO: 506186 - RNA, 22 nt, Human
gacagguggggaaacuaaggua

SEQ ID NO: 506187 - RNA, 22 nt, Human
ggccuaguuuuuucugguaggu

SEQ ID NO: 506188 - RNA, 19 nt, Human
augucuguugaauuucaua

SEQ ID NO: 506189 - RNA, 22 nt, Human
ggcgugggaaguggggcuucug

SEQ ID NO: 506190 - RNA, 22 nt, Human
guguguucagcaagagguaagg

SEQ ID NO: 506191 - RNA, 22 nt, Human
caugaaaaugucaaguucugcu

SEQ ID NO: 506192 - RNA, 21 nt, Human
aacaaagggaugcucaucuuu

SEQ ID NO: 506193 - RNA, 22 nt, Human
gugcaugugucuuuauaguagc

SEQ ID NO: 506194 - RNA, 21 nt, Human
acacagaggcaucaucacuuu

SEQ ID NO: 506195 - RNA, 22 nt, Human
aaggguccaaggcuuugcguuu

SEQ ID NO: 506196 - RNA, 22 nt, Human
acuccuggggcugccaucacag

SEQ ID NO: 506197 - RNA, 22 nt, Human
caguauguacucuuaucaugua

SEQ ID NO: 506198 - RNA, 22 nt, Human
uugaaagaggcaaaguuugauc

SEQ ID NO: 506199 - RNA, 22 nt, Human
cagccagcuggugcggcagagc

SEQ ID NO: 506200 - RNA, 22 nt, Human
gugggggcuggcucguccugug

SEQ ID NO: 506201 - RNA, 22 nt, Human
cccugcagccggccagcucauu

SEQ ID NO: 506202 - RNA, 22 nt, Human
agagccccugguggagugagaa

SEQ ID NO: 506203 - RNA, 22 nt, Human
cuguccccgcgaguccagagcu

SEQ ID NO: 506204 - RNA, 20 nt, Human
uaugcuuuuuauaagauuga

SEQ ID NO: 506205 - RNA, 22 nt, Human
ugucacuuuggggagaguuuug

SEQ ID NO: 506206 - RNA, 22 nt, Human
ugccuggcaccccagucugcac

SEQ ID NO: 506207 - RNA, 22 nt, Human
uguaaacauauguauguaugua

SEQ ID NO: 506208 - RNA, 22 nt, Human
ggaggaugccaagcugugcaca

SEQ ID NO: 506209 - RNA, 22 nt, Human
auaccuuuuagacauguaguug

SEQ ID NO: 506210 - RNA, 22 nt, Human
ugucaaaaauaagagagauugu

SEQ ID NO: 506211 - RNA, 22 nt, Human
ugaggcaggacugagcgggaug

SEQ ID NO: 506212 - RNA, 22 nt, Human
ugugaauguauaguuuguauau

SEQ ID NO: 506213 - RNA, 22 nt, Human
uauuucuauuccccaggcaagu

SEQ ID NO: 506214 - RNA, 22 nt, Human
gucagaucuuuggggaugcugu

SEQ ID NO: 506215 - RNA, 19 nt, Human
ggcaccuuggucuuggacu

SEQ ID NO: 506216 - RNA, 22 nt, Human
uucuuuaucaguuacucauagg

SEQ ID NO: 506217 - RNA, 22 nt, Human
cuuaaauucuuaaugcccucau

SEQ ID NO: 506218 - RNA, 22 nt, Human
gcucuggcagcugauauuagga

SEQ ID NO: 506219 - RNA, 22 nt, Human
gaggcccuccagcugucagcug

SEQ ID NO: 506220 - RNA, 22 nt, Human
augcaccugaacuccaucagcu

SEQ ID NO: 506221 - RNA, 22 nt, Human
ugccagcccaccuuggggccuc

SEQ ID NO: 506222 - RNA, 17 nt, Human
gcuucuggagcuucugu

SEQ ID NO: 506223 - RNA, 22 nt, Human
augcuauacauaugacaucaca

SEQ ID NO: 506224 - RNA, 22 nt, Human
ggguccagaaugagaaugggcu

SEQ ID NO: 506225 - RNA, 22 nt, Human
uuguccuugugauaguuugcug

SEQ ID NO: 506226 - RNA, 22 nt, Human
cacacugucagguaaauaacac

SEQ ID NO: 506227 - RNA, 22 nt, Human
aaugauggauuuagacaagcug

SEQ ID NO: 506228 - RNA, 22 nt, Human
gccuuucaguuccaucaaagga

SEQ ID NO: 506229 - RNA, 22 nt, Human
uaaaucacccaucuccuaaucu

SEQ ID NO: 506230 - RNA, 22 nt, Human
ggcacagagcccagcuuccuag

SEQ ID NO: 506231 - RNA, 22 nt, Human
gcucugagaggaugcugagcag

SEQ ID NO: 506232 - RNA, 23 nt, Human
aacagccaacuuuagcggguggc

SEQ ID NO: 506233 - RNA, 22 nt, Human
aggacucaucccugcuugucag

SEQ ID NO: 506234 - RNA, 22 nt, Human
uggagcugauacagcuggcuuu

SEQ ID NO: 506235 - RNA, 22 nt, Human
aagccagguuccauggaggagc

SEQ ID NO: 506236 - RNA, 22 nt, Human
gaggccuggaccagccacagag

SEQ ID NO: 506237 - RNA, 22 nt, Human
guggcagcggcccaggccgucu

SEQ ID NO: 506238 - RNA, 22 nt, Human
agcugcucucacuggacgccug

SEQ ID NO: 506239 - RNA, 22 nt, Human
cugaaacauugcaauaacaaag

SEQ ID NO: 506240 - RNA, 22 nt, Human
uaugagaaagucguaugucucc

SEQ ID NO: 506241 - RNA, 21 nt, Human
uggcagguucaaaggccuauc

SEQ ID NO: 506242 - RNA, 22 nt, Human
cugaagccaugugcucacuggu

SEQ ID NO: 506243 - RNA, 22 nt, Human
cccuggagugccggaaucaaga

SEQ ID NO: 506244 - RNA, 22 nt, Human
uugcuaauaaaguuuuuaugug

SEQ ID NO: 506245 - RNA, 22 nt, Human
uuaaauugucauuugagcaaug

SEQ ID NO: 506246 - RNA, 22 nt, Human
uacauguguucuguuucaaguu

SEQ ID NO: 506247 - RNA, 22 nt, Human
gaugggggccagggccugcuuu

SEQ ID NO: 506248 - RNA, 22 nt, Human
ggacaggcccggggagccugga

SEQ ID NO: 506249 - RNA, 22 nt, Human
cucuugggagugcucuggagaa

SEQ ID NO: 506250 - RNA, 22 nt, Human
uccuuccuggggucucugcugc

SEQ ID NO: 506251 - RNA, 22 nt, Human
gccuggcuuuugccucauguuc

SEQ ID NO: 506252 - RNA, 23 nt, Human
uuacuuuugcaccaaccuaauau

SEQ ID NO: 506253 - RNA, 22 nt, Human
aggggccugguuggccucuguu

SEQ ID NO: 506254 - RNA, 22 nt, Human
cagaggcauacucccagucuug

SEQ ID NO: 506255 - RNA, 22 nt, Human
auuaaauuuucacuaggcuccc

SEQ ID NO: 506256 - RNA, 22 nt, Human
aggcucagagagcuguguccau

SEQ ID NO: 506257 - RNA, 23 nt, Human
gugcacagucaagcccagcuuag

SEQ ID NO: 506258 - RNA, 22 nt, Human
agcacagagguggaaguguaua

SEQ ID NO: 506259 - RNA, 22 nt, Human
aucuggcuauugacauguuaua

SEQ ID NO: 506260 - RNA, 22 nt, Human
ugugugccugagccgugccugg

SEQ ID NO: 506261 - RNA, 22 nt, Human
ucagcucuaccugggagcuguc

SEQ ID NO: 506262 - RNA, 22 nt, Human
agcaugcacaugacuggcuuaa

SEQ ID NO: 506263 - RNA, 22 nt, Human
ugcccuggaaccaucuacaguc

SEQ ID NO: 506264 - RNA, 22 nt, Human
cugggucucuuuagggugccgu

SEQ ID NO: 506265 - RNA, 22 nt, Human
gccuucaggaggguuccagaca

SEQ ID NO: 506266 - RNA, 22 nt, Human
ucugggagguguuuugagaacu

SEQ ID NO: 506267 - RNA, 22 nt, Human
aagggcucucugcauugaaauu

SEQ ID NO: 506268 - RNA, 22 nt, Human
ucagagaguuagugucuuagcu

SEQ ID NO: 506269 - RNA, 22 nt, Human
ccagggcaggggcuggaguuca

SEQ ID NO: 506270 - RNA, 22 nt, Human
guauuaggugguggaauuguag

SEQ ID NO: 506271 - RNA, 22 nt, Human
gaauuagacaugcuuugcuuuu

SEQ ID NO: 506272 - RNA, 22 nt, Human
ugggggugugccagggaccucc

SEQ ID NO: 506273 - RNA, 22 nt, Human
gcucagugguauucggaaacug

SEQ ID NO: 506274 - RNA, 22 nt, Human
ucccacaugugaauccucaggu

SEQ ID NO: 506275 - RNA, 22 nt, Human
gcugggcucaccaggccacuag

SEQ ID NO: 506276 - RNA, 22 nt, Human
cagcccuggugccaagguuccc

SEQ ID NO: 506277 - RNA, 19 nt, Human
uagucuuuauucuuaauuu

SEQ ID NO: 506278 - RNA, 22 nt, Human
agucaguuaaccucacagcauc

SEQ ID NO: 506279 - RNA, 22 nt, Human
auuuauaacgugcagccagggu

SEQ ID NO: 506280 - RNA, 22 nt, Human
aaaguguugggauuacaggugu

SEQ ID NO: 506281 - RNA, 22 nt, Human
uucaaaccuaucuaagaaauag

SEQ ID NO: 506282 - RNA, 22 nt, Human
gcacuaguguucuucaguaaua

SEQ ID NO: 506283 - RNA, 22 nt, Human
acucccacuccagaguagaagc

SEQ ID NO: 506284 - RNA, 22 nt, Human
ccagggccugccacuuagcaag

SEQ ID NO: 506285 - RNA, 19 nt, Human
uuacaucugcaacacuggu

SEQ ID NO: 506286 - RNA, 22 nt, Human
ggcugaggguauagcuguccca

SEQ ID NO: 506287 - RNA, 22 nt, Human
caauaguaaauuacggaggaga

SEQ ID NO: 506288 - RNA, 22 nt, Human
uggcucaguuccaucaucugga

SEQ ID NO: 506289 - RNA, 22 nt, Human
auuucccuccagggaaagcuua

SEQ ID NO: 506290 - RNA, 22 nt, Human
gcuuccuaaaugcacagggcag

SEQ ID NO: 506291 - RNA, 22 nt, Human
uuauuucauugauuucuaagac

SEQ ID NO: 506292 - RNA, 22 nt, Human
uuucuacagaagauacacugcu

SEQ ID NO: 506293 - RNA, 22 nt, Human
gccaggcagcuagcaaccccug

SEQ ID NO: 506294 - RNA, 22 nt, Human
uuguccugcagguggcugggag

SEQ ID NO: 506295 - RNA, 22 nt, Human
caagggaguuacugagggcggg

SEQ ID NO: 506296 - RNA, 22 nt, Human
acauuuuuuagagucccacauu

SEQ ID NO: 506297 - RNA, 22 nt, Human
cugccugggccggccacccucu

SEQ ID NO: 506298 - RNA, 22 nt, Human
ucuggagcuuccucauuuacag

SEQ ID NO: 506299 - RNA, 22 nt, Human
acuuuggguaagccaggugcua

SEQ ID NO: 506300 - RNA, 22 nt, Human
uccaggagaccagauguaggcc

SEQ ID NO: 506301 - RNA, 22 nt, Human
ugggcagacgcuguuggaaggc

SEQ ID NO: 506302 - RNA, 19 nt, Human
uggcaucuguaaaauggug

SEQ ID NO: 506303 - RNA, 22 nt, Human
cucaguccgucccgcuaggugc

SEQ ID NO: 506304 - RNA, 22 nt, Human
uugggcuggcccuugucucugg

SEQ ID NO: 506305 - RNA, 22 nt, Human
ugaaggagcucaggagauaguc

SEQ ID NO: 506306 - RNA, 22 nt, Human
caucucugguucagucucugug

SEQ ID NO: 506307 - RNA, 23 nt, Human
aggcccaacucugugagggcugc

SEQ ID NO: 506308 - RNA, 22 nt, Human
gcugggcccugggugcccuagc

SEQ ID NO: 506309 - RNA, 22 nt, Human
uccugguguuuaugucacauag

SEQ ID NO: 506310 - RNA, 23 nt, Human
cucccuggcccuugggagaccug

SEQ ID NO: 506311 - RNA, 22 nt, Human
uagguucaggagauauugcaca

SEQ ID NO: 506312 - RNA, 22 nt, Human
uacagcuugacccauaaugucu

SEQ ID NO: 506313 - RNA, 20 nt, Human
uuggagucuaaagacugggg

SEQ ID NO: 506314 - RNA, 22 nt, Human
aagucaaucacaugcacacuga

SEQ ID NO: 506315 - RNA, 22 nt, Human
ugcagcaccacaccuggcuaau

SEQ ID NO: 506316 - RNA, 22 nt, Human
ggcugagcuuauauaugugcug

SEQ ID NO: 506317 - RNA, 22 nt, Human
guccaggaagcaauaaauagaa

SEQ ID NO: 506318 - RNA, 22 nt, Human
cauugcugugggcauuugcugc

SEQ ID NO: 506319 - RNA, 22 nt, Human
uuauguacaauguuaauguaaa

SEQ ID NO: 506320 - RNA, 22 nt, Human
gcucaggaaaacagucuaguaa

SEQ ID NO: 506321 - RNA, 18 nt, Human
uggccccuuaucaguccu

SEQ ID NO: 506322 - RNA, 22 nt, Human
gcaaaaaccacaauuacuuuug

SEQ ID NO: 506323 - RNA, 22 nt, Human
acaggucuacuggcaagcagug

SEQ ID NO: 506324 - RNA, 20 nt, Human
agacccuguguccuguggcc

SEQ ID NO: 506325 - RNA, 22 nt, Human
ggagacacuggaaaguauuaca

SEQ ID NO: 506326 - RNA, 22 nt, Human
guucuuuaaguggagaaggaaa

SEQ ID NO: 506327 - RNA, 22 nt, Human
ugcuauugugaacagugccaca

SEQ ID NO: 506328 - RNA, 22 nt, Human
ucuggggaccauggcaucuaaa

SEQ ID NO: 506329 - RNA, 22 nt, Human
ccggcgggcgcggugacgucag

SEQ ID NO: 506330 - RNA, 21 nt, Human
acagaugugauaugcagucuu

SEQ ID NO: 506331 - RNA, 22 nt, Human
ggagccagcagggugacacuga

SEQ ID NO: 506332 - RNA, 20 nt, Human
uucacagaggacucagguca

SEQ ID NO: 506333 - RNA, 22 nt, Human
ugcaauaaggaguaauaguaaa

SEQ ID NO: 506334 - RNA, 22 nt, Human
ugaauucuuaaugaaaucuacu

SEQ ID NO: 506335 - RNA, 22 nt, Human
agccugugugcuuuggacaggg

SEQ ID NO: 506336 - RNA, 22 nt, Human
cugucagagauggggagucaga

SEQ ID NO: 506337 - RNA, 22 nt, Human
gauauuuucauucggaugcuca

SEQ ID NO: 506338 - RNA, 22 nt, Human
uccugggucugggugucugagg

SEQ ID NO: 506339 - RNA, 22 nt, Human
gugcacagagcccagggccgcg

SEQ ID NO: 506340 - RNA, 22 nt, Human
caaaaguaauugcaguuuuugc

SEQ ID NO: 506341 - RNA, 22 nt, Human
uccugccucuuuucuuauucca

SEQ ID NO: 506342 - RNA, 22 nt, Human
ucagaaagcuauaugguguguc

SEQ ID NO: 506343 - RNA, 18 nt, Human
caggucugucugccuccc

SEQ ID NO: 506344 - RNA, 22 nt, Human
ugggcuuuaucaugggucuggu

SEQ ID NO: 506345 - RNA, 22 nt, Human
uagcuuuaagaugagaugugga

SEQ ID NO: 506346 - RNA, 21 nt, Human
uauuagcuucuggugcuguuu

SEQ ID NO: 506347 - RNA, 22 nt, Human
aagcacagagagguaaaguaac

SEQ ID NO: 506348 - RNA, 22 nt, Human
aaaugaguagcgaugcacauua

SEQ ID NO: 506349 - RNA, 22 nt, Human
acucuggcgggcgggcgagcca

SEQ ID NO: 506350 - RNA, 22 nt, Human
aguuccagaacuggaaaaggac

SEQ ID NO: 506351 - RNA, 22 nt, Human
uggcccugcugggucagagcug

SEQ ID NO: 506352 - RNA, 22 nt, Human
gccugcuggcuguccauugcag

SEQ ID NO: 506353 - RNA, 22 nt, Human
cccagccuggugcacugugggg

SEQ ID NO: 506354 - RNA, 22 nt, Human
uccuucuccuccuugagugaca

SEQ ID NO: 506355 - RNA, 22 nt, Human
aggaauggugcucagcagaaau

SEQ ID NO: 506356 - RNA, 22 nt, Human
uaauguguccugaaagcuucug

SEQ ID NO: 506357 - RNA, 22 nt, Human
auguucuacagauggaaagggg

SEQ ID NO: 506358 - RNA, 17 nt, Human
uccuggcucugccacug

SEQ ID NO: 506359 - RNA, 22 nt, Human
cugucucaagacugcaggcacu

SEQ ID NO: 506360 - RNA, 22 nt, Human
uacauagaggguaauagcauca

SEQ ID NO: 506361 - RNA, 22 nt, Human
aagagccuggcugcuaggcuca

SEQ ID NO: 506362 - RNA, 22 nt, Human
ccaguccugccacccugucuau

SEQ ID NO: 506363 - RNA, 23 nt, Human
cugcagccgcguggggacgugga

SEQ ID NO: 506364 - RNA, 22 nt, Human
ccucauggaccucagacugucc

SEQ ID NO: 506365 - RNA, 22 nt, Human
uuagggcuuuucugaauaggcc

SEQ ID NO: 506366 - RNA, 22 nt, Human
gaaugcuauuauuucugugugu

SEQ ID NO: 506367 - RNA, 22 nt, Human
augggcugggaucugaguguca

SEQ ID NO: 506368 - RNA, 22 nt, Human
ucagacugcugucccugccugg

SEQ ID NO: 506369 - RNA, 19 nt, Human
uccugcagaccagaccugu

SEQ ID NO: 506370 - RNA, 22 nt, Human
ggucccaggaaucuguguucua

SEQ ID NO: 506371 - RNA, 22 nt, Human
ucagcuuucucagaggccuaac

SEQ ID NO: 506372 - RNA, 22 nt, Human
uagguccagcacgguguagcuu

SEQ ID NO: 506373 - RNA, 22 nt, Human
aggcugucugaccccagagccc

SEQ ID NO: 506374 - RNA, 22 nt, Human
ucccagggacaccaagcuguuu

SEQ ID NO: 506375 - RNA, 22 nt, Human
cuggccuuuuguuucuggagaa

SEQ ID NO: 506376 - RNA, 22 nt, Human
gcuucucucaggagcaucagcc

SEQ ID NO: 506377 - RNA, 22 nt, Human
gcugucccgcugacuuccagcu

SEQ ID NO: 506378 - RNA, 22 nt, Human
uaaauuguuuucuagaaguugu

SEQ ID NO: 506379 - RNA, 22 nt, Human
cagacuuucaaggagugaaggc

SEQ ID NO: 506380 - RNA, 22 nt, Human
gcagaggacacaggagggcaag

SEQ ID NO: 506381 - RNA, 22 nt, Human
uaaugcuuaauuuucacaagcc

SEQ ID NO: 506382 - RNA, 22 nt, Human
aaaaguauaggguuuggaguca

SEQ ID NO: 506383 - RNA, 22 nt, Human
gugggggcagugggcuucgagc

SEQ ID NO: 506384 - RNA, 22 nt, Human
agucucagcuacuugggaggcu

SEQ ID NO: 506385 - RNA, 22 nt, Human
acauucuagaagucuuugcaau

SEQ ID NO: 506386 - RNA, 22 nt, Human
uuccucagagggcgcuggggaa

SEQ ID NO: 506387 - RNA, 22 nt, Human
uauucacaggcuggagugaugu

SEQ ID NO: 506388 - RNA, 22 nt, Human
uguaugaauauguuggggaggu

SEQ ID NO: 506389 - RNA, 21 nt, Human
agcuuccugcagugggagguc

SEQ ID NO: 506390 - RNA, 22 nt, Human
gccuggcugaggccucugcuaa

SEQ ID NO: 506391 - RNA, 22 nt, Human
aauuagggaaaacauuugcuuu

SEQ ID NO: 506392 - RNA, 20 nt, Human
uucaaguugggucucuggcu

SEQ ID NO: 506393 - RNA, 22 nt, Human
auaccuguguauccacaagcgu

SEQ ID NO: 506394 - RNA, 22 nt, Human
augguccuuauggccgugauau

SEQ ID NO: 506395 - RNA, 22 nt, Human
auucagaauggcaaacuucuag

SEQ ID NO: 506396 - RNA, 20 nt, Human
uauuugaaauggccaagugu

SEQ ID NO: 506397 - RNA, 22 nt, Human
ugaagauauuuuaaaauacuga

SEQ ID NO: 506398 - RNA, 22 nt, Human
ugguuccaagauggcugccaca

SEQ ID NO: 506399 - RNA, 22 nt, Human
ugcagggccgcuggaggucaug

SEQ ID NO: 506400 - RNA, 22 nt, Human
agcagagcggggccuccggaag

SEQ ID NO: 506401 - RNA, 22 nt, Human
cuggucugcaaggccauauaga

SEQ ID NO: 506402 - RNA, 22 nt, Human
cccagggagguagcaggagaaa

SEQ ID NO: 506403 - RNA, 22 nt, Human
auucaagagcccauguuuccug

SEQ ID NO: 506404 - RNA, 22 nt, Human
uucaaacaaaacuguucccaua

SEQ ID NO: 506405 - RNA, 22 nt, Human
caggaacacaaguucagggaug

SEQ ID NO: 506406 - RNA, 22 nt, Human
acacauauaccacuguaaauga

SEQ ID NO: 506407 - RNA, 22 nt, Human
aaaugcagauuuugaugcagca

SEQ ID NO: 506408 - RNA, 23 nt, Human
gcucagaugcccuaggagguggc

SEQ ID NO: 506409 - RNA, 22 nt, Human
cagcuggcauaccugggcccgg

SEQ ID NO: 506410 - RNA, 22 nt, Human
ccagaagucaggaaugagucuu

SEQ ID NO: 506411 - RNA, 22 nt, Human
gugcccugacacaccuggugug

SEQ ID NO: 506412 - RNA, 22 nt, Human
ccagccaggcauugcaaacuga

SEQ ID NO: 506413 - RNA, 22 nt, Human
uagaaguucaugcgaauuauuu

SEQ ID NO: 506414 - RNA, 18 nt, Human
gggcccuggcguccgccc

SEQ ID NO: 506415 - RNA, 19 nt, Human
ugagagugaggaaggcuuc

SEQ ID NO: 506416 - RNA, 22 nt, Human
uugcagcuucaagcagguugac

SEQ ID NO: 506417 - RNA, 23 nt, Human
gguuccugagcagggaucuggaa

SEQ ID NO: 506418 - RNA, 22 nt, Human
cuggcucaauuuguacugcugu

SEQ ID NO: 506419 - RNA, 22 nt, Human
gucaggucuuggaagauaggcu

SEQ ID NO: 506420 - RNA, 23 nt, Human
cccuggagcuagucugagcagag

SEQ ID NO: 506421 - RNA, 22 nt, Human
agcccugguagccugcugccau

SEQ ID NO: 506422 - RNA, 22 nt, Human
uuguuuccuuucuauacaggau

SEQ ID NO: 506423 - RNA, 22 nt, Human
uuccugagaaauuuguaccugg

SEQ ID NO: 506424 - RNA, 22 nt, Human
gcucuuccauuucucuugaacu

SEQ ID NO: 506425 - RNA, 22 nt, Human
acagagauggcacagagaaggu

SEQ ID NO: 506426 - RNA, 22 nt, Human
ccuggccagcagccccuuccuc

SEQ ID NO: 506427 - RNA, 19 nt, Human
acagggcagcaauaggaua

SEQ ID NO: 506428 - RNA, 22 nt, Human
cugccugcugccuguggagggu

SEQ ID NO: 506429 - RNA, 22 nt, Human
ggcuuuauuaacucauccguaa

SEQ ID NO: 506430 - RNA, 22 nt, Human
auaaggaaugauguaucaguuu

SEQ ID NO: 506431 - RNA, 22 nt, Human
ggcugcagauagccagccacca

SEQ ID NO: 506432 - RNA, 22 nt, Human
cuacagcagagcuacacuaacu

SEQ ID NO: 506433 - RNA, 22 nt, Human
gggucuggagauccgggugaag

SEQ ID NO: 506434 - RNA, 22 nt, Human
ucagacagugugaucagucucu

SEQ ID NO: 506435 - RNA, 22 nt, Human
aguggugcugcgcgcggagcuc

SEQ ID NO: 506436 - RNA, 22 nt, Human
agcugaagcucagcccaguagu

SEQ ID NO: 506437 - RNA, 22 nt, Human
ccugucuguauugguuugcuau

SEQ ID NO: 506438 - RNA, 22 nt, Human
ugcuggcucaguuugcagacuc

SEQ ID NO: 506439 - RNA, 22 nt, Human
gccuugcuuugcuucuggacag

SEQ ID NO: 506440 - RNA, 21 nt, Human
uugaaaguaaauucagcagcu

SEQ ID NO: 506441 - RNA, 22 nt, Human
cacauacaaugguguuauuugg

SEQ ID NO: 506442 - RNA, 20 nt, Human
cucucuggaaggugggagcc

SEQ ID NO: 506443 - RNA, 22 nt, Human
cucaggguaaugaaagacgaau

SEQ ID NO: 506444 - RNA, 20 nt, Human
uccaagggcagcagaaucag

SEQ ID NO: 506445 - RNA, 22 nt, Human
acaaagucucuaauaaucuucu

SEQ ID NO: 506446 - RNA, 19 nt, Human
ucucagugccgcugaccgc

SEQ ID NO: 506447 - RNA, 17 nt, Human
gggugggcacugcuggc

SEQ ID NO: 506448 - RNA, 22 nt, Human
ccacuuugaaccacugaggugg

SEQ ID NO: 506449 - RNA, 22 nt, Human
cuggcucuuucagccgcuggag

SEQ ID NO: 506450 - RNA, 22 nt, Human
cauuugaugacucaacucauaa

SEQ ID NO: 506451 - RNA, 22 nt, Human
agggagccagaguugggagcuc

SEQ ID NO: 506452 - RNA, 22 nt, Human
uccucuggggucagggcacuac

SEQ ID NO: 506453 - RNA, 22 nt, Human
gacaugcauuaagacacacuga

SEQ ID NO: 506454 - RNA, 22 nt, Human
ugcugccaggucuugcugucca

SEQ ID NO: 506455 - RNA, 22 nt, Human
cucagaguccccacaucugggu

SEQ ID NO: 506456 - RNA, 21 nt, Human
aacauuucugggagaacucac

SEQ ID NO: 506457 - RNA, 23 nt, Human
caggcucccggaccaggauccgc

SEQ ID NO: 506458 - RNA, 22 nt, Human
ggcauagauuucuuuagguuua

SEQ ID NO: 506459 - RNA, 22 nt, Human
cccaggaccauccuucugugcc

SEQ ID NO: 506460 - RNA, 22 nt, Human
accccagguccagguuacagag

SEQ ID NO: 506461 - RNA, 18 nt, Human
ccuggagcuccacagcaa

SEQ ID NO: 506462 - RNA, 22 nt, Human
aagcugccaaugguaagcugcu

SEQ ID NO: 506463 - RNA, 22 nt, Human
uacauugaaagucauuuaaucc

SEQ ID NO: 506464 - RNA, 22 nt, Human
gccuggcugagguggggaggca

SEQ ID NO: 506465 - RNA, 22 nt, Human
cagaagaggacuggguagcuca

SEQ ID NO: 506466 - RNA, 22 nt, Human
uucagagaugacaccugguguu

SEQ ID NO: 506467 - RNA, 22 nt, Human
ucaauucuaguggagagaguuu

SEQ ID NO: 506468 - RNA, 22 nt, Human
ugcagagggacagccacagcuc

SEQ ID NO: 506469 - RNA, 22 nt, Human
ggccuuggguauagguggguau

SEQ ID NO: 506470 - RNA, 22 nt, Human
uccuuccugcaggccaaguccu

SEQ ID NO: 506471 - RNA, 22 nt, Human
guguuauuagagcauuaauuuu

SEQ ID NO: 506472 - RNA, 22 nt, Human
uccugugccuccaccugcuccg

SEQ ID NO: 506473 - RNA, 22 nt, Human
agcaggaaggucugugugaguc

SEQ ID NO: 506474 - RNA, 22 nt, Human
gccucugggcucugccccuggc

SEQ ID NO: 506475 - RNA, 22 nt, Human
acuggacagaggaaauauggag

SEQ ID NO: 506476 - RNA, 22 nt, Human
gucaaauauacuaagagguaaa

SEQ ID NO: 506477 - RNA, 22 nt, Human
uuccugggcuuuccccucuggu

SEQ ID NO: 506478 - RNA, 22 nt, Human
ugcaggcugugucauuuaguga

SEQ ID NO: 506479 - RNA, 22 nt, Human
gaggcucaccuagggagcacug

SEQ ID NO: 506480 - RNA, 22 nt, Human
uucaguguacagugaagggauu

SEQ ID NO: 506481 - RNA, 22 nt, Human
uuacauuuggcuauguccucua

SEQ ID NO: 506482 - RNA, 22 nt, Human
agccuggacagcuacggagaac

SEQ ID NO: 506483 - RNA, 22 nt, Human
acacacagaaggaagccccacu

SEQ ID NO: 506484 - RNA, 22 nt, Human
gcagcugauggaaguccuauug

SEQ ID NO: 506485 - RNA, 22 nt, Human
uuguugaauuaguugacugugu

SEQ ID NO: 506486 - RNA, 22 nt, Human
uugaaagggauauaucuuucug

SEQ ID NO: 506487 - RNA, 22 nt, Human
acuuugaaacuaaaauucauua

SEQ ID NO: 506488 - RNA, 22 nt, Human
agggcugcaggcaagauauggc

SEQ ID NO: 506489 - RNA, 22 nt, Human
cugggacagcugagacaggaga

SEQ ID NO: 506490 - RNA, 22 nt, Human
ugugaagguaaggaggggcaag

SEQ ID NO: 506491 - RNA, 21 nt, Human
ucccagagugcuugggacugc

SEQ ID NO: 506492 - RNA, 22 nt, Human
acacugaagagcacuuucaaag

SEQ ID NO: 506493 - RNA, 22 nt, Human
cugggugguucuaacuguugau

SEQ ID NO: 506494 - RNA, 22 nt, Human
caacagcuggaggcuuggcccg

SEQ ID NO: 506495 - RNA, 22 nt, Human
cagcucuguaaauuccuucauc

SEQ ID NO: 506496 - RNA, 22 nt, Human
ccugggcucugaggagggaguc

SEQ ID NO: 506497 - RNA, 22 nt, Human
cccagggauuauaaaggugaaa

SEQ ID NO: 506498 - RNA, 20 nt, Human
ugcucuggggguggagagac

SEQ ID NO: 506499 - RNA, 22 nt, Human
ggcucaggccagaccacgacuc

SEQ ID NO: 506500 - RNA, 22 nt, Human
cauuugugcuuuuauaaaauag

SEQ ID NO: 506501 - RNA, 22 nt, Human
cagcgcugugggaacagggcua

SEQ ID NO: 506502 - RNA, 22 nt, Human
agggcuuuugcaauccaagucu

SEQ ID NO: 506503 - RNA, 20 nt, Human
uuuuuccuucucuacaggca

SEQ ID NO: 506504 - RNA, 20 nt, Human
ucauuccaaauaguucagca

SEQ ID NO: 506505 - RNA, 22 nt, Human
augauacaucuucaugucagug

SEQ ID NO: 506506 - RNA, 22 nt, Human
gaggagagaagcuaacggugcu

SEQ ID NO: 506507 - RNA, 22 nt, Human
uguuuuaaagccauugccuuuc

SEQ ID NO: 506508 - RNA, 22 nt, Human
aggucauuuuugccuucuauuu

SEQ ID NO: 506509 - RNA, 22 nt, Human
ccuuagcagggagucuguccag

SEQ ID NO: 506510 - RNA, 17 nt, Human
gagaguguauuggaugc

SEQ ID NO: 506511 - RNA, 22 nt, Human
auucagcaaugagcuuggauuu

SEQ ID NO: 506512 - RNA, 22 nt, Human
uauguguauugagcauuguuac

SEQ ID NO: 506513 - RNA, 22 nt, Human
gucucccacuuucuggccucuu

SEQ ID NO: 506514 - RNA, 22 nt, Human
cacugccugugagcugugugcc

SEQ ID NO: 506515 - RNA, 22 nt, Human
ccuggggaaucuugcaggggaa

SEQ ID NO: 506516 - RNA, 22 nt, Human
acaaagugcugacauuacaggc

SEQ ID NO: 506517 - RNA, 22 nt, Human
gguuuucucccccucuucucag

SEQ ID NO: 506518 - RNA, 22 nt, Human
cccaccaguacagaugguagau

SEQ ID NO: 506519 - RNA, 22 nt, Human
aaaucgguugguucaagguaau

SEQ ID NO: 506520 - RNA, 22 nt, Human
ccuccagggccccucucacugg

SEQ ID NO: 506521 - RNA, 22 nt, Human
ggcugccaggagggaggccagu

SEQ ID NO: 506522 - RNA, 22 nt, Human
ucagagaguccuggucauuugc

SEQ ID NO: 506523 - RNA, 22 nt, Human
ccugccugcggcccgcggggag

SEQ ID NO: 506524 - RNA, 22 nt, Human
ucuuggagacucuuguauauuu

SEQ ID NO: 506525 - RNA, 22 nt, Human
ccagugggugcugggcucugcc

SEQ ID NO: 506526 - RNA, 21 nt, Human
ccugagggugguugugaagau

SEQ ID NO: 506527 - RNA, 22 nt, Human
uggcagcaaaaccagaaucaga

SEQ ID NO: 506528 - RNA, 22 nt, Human
aagaggagaaaggcuggcuuug

SEQ ID NO: 506529 - RNA, 22 nt, Human
uaaagcauguuucaguaagguu

SEQ ID NO: 506530 - RNA, 22 nt, Human
cuucaucaacucuaacaaaugu

SEQ ID NO: 506531 - RNA, 22 nt, Human
ucaaaguuuuugagaauuacau

SEQ ID NO: 506532 - RNA, 22 nt, Human
cauugcccaguaggaucaccag

SEQ ID NO: 506533 - RNA, 22 nt, Human
auuauuuggaauaggcauugca

SEQ ID NO: 506534 - RNA, 22 nt, Human
cugcaggguuuuucaaggacaa

SEQ ID NO: 506535 - RNA, 22 nt, Human
agcuucaguuuucuauuguuaa

SEQ ID NO: 506536 - RNA, 22 nt, Human
agcagcaacuuauuuuucuuau

SEQ ID NO: 506537 - RNA, 17 nt, Human
gagagcugcugcuuccg

SEQ ID NO: 506538 - RNA, 22 nt, Human
ccuggagcuuggucacgcugcg

SEQ ID NO: 506539 - RNA, 22 nt, Human
cugcaggcucgaagacacggau

SEQ ID NO: 506540 - RNA, 22 nt, Human
aguuuuauuccaaugugcagca

SEQ ID NO: 506541 - RNA, 22 nt, Human
agggcuccgggccaccggccug

SEQ ID NO: 506542 - RNA, 22 nt, Human
ccagcaggacuuuggaaauaug

SEQ ID NO: 506543 - RNA, 22 nt, Human
uucucaggugaggcugaggcug

SEQ ID NO: 506544 - RNA, 22 nt, Human
uuucuacagcuggugcaacuuu

SEQ ID NO: 506545 - RNA, 20 nt, Human
uacuugaauguugcagcagu

SEQ ID NO: 506546 - RNA, 22 nt, Human
cuggagcccaggccuggugucu

SEQ ID NO: 506547 - RNA, 22 nt, Human
cuccugggcucaagugauccuc

SEQ ID NO: 506548 - RNA, 22 nt, Human
aggcaacauaacacgaaagucu

SEQ ID NO: 506549 - RNA, 22 nt, Human
uucauguaggcugcaaugcaca

SEQ ID NO: 506550 - RNA, 22 nt, Human
ucucugggaucguuuugggcuc

SEQ ID NO: 506551 - RNA, 22 nt, Human
cgaggcucagagagggugacuu

SEQ ID NO: 506552 - RNA, 22 nt, Human
uguuaggguccugugcaggggc

SEQ ID NO: 506553 - RNA, 22 nt, Human
ugagcaguaacagcucacaggg

SEQ ID NO: 506554 - RNA, 22 nt, Human
uaauacaucauucaucuaagga

SEQ ID NO: 506555 - RNA, 22 nt, Human
ugggccuggaguuuguccagag

SEQ ID NO: 506556 - RNA, 22 nt, Human
ucacaugcccuaccuaaucuua

SEQ ID NO: 506557 - RNA, 22 nt, Human
agcugggacucaacugucuggg

SEQ ID NO: 506558 - RNA, 22 nt, Human
cuccuggaggauagugacuggg

SEQ ID NO: 506559 - RNA, 19 nt, Human
ccuagagcaguaccuggua

SEQ ID NO: 506560 - RNA, 22 nt, Human
ucuaugaaaagucuauucauuc

SEQ ID NO: 506561 - RNA, 22 nt, Human
ugcaucuguucagagcugucga

SEQ ID NO: 506562 - RNA, 23 nt, Human
gggggcugguugacucucugcag

SEQ ID NO: 506563 - RNA, 22 nt, Human
ggggagaguccuuuccaguucc

SEQ ID NO: 506564 - RNA, 22 nt, Human
cacuggaauggauagagcagag

SEQ ID NO: 506565 - RNA, 20 nt, Human
uacaggaaucaagacugcau

SEQ ID NO: 506566 - RNA, 22 nt, Human
ggccccagauucugggcugggu

SEQ ID NO: 506567 - RNA, 22 nt, Human
gaaacagccccugugugaagca

SEQ ID NO: 506568 - RNA, 22 nt, Human
ucccagaguucaaugggaaggu

SEQ ID NO: 506569 - RNA, 22 nt, Human
auuugcauaauagugauuugua

SEQ ID NO: 506570 - RNA, 22 nt, Human
gagauuucuuuugaugccuguc

SEQ ID NO: 506571 - RNA, 22 nt, Human
agggcaucuaguucccucucuu

SEQ ID NO: 506572 - RNA, 18 nt, Human
gccugccuagagcuugcc

SEQ ID NO: 506573 - RNA, 22 nt, Human
guucugaguccuccuuugaagg

SEQ ID NO: 506574 - RNA, 22 nt, Human
aaauagauuuccuagcauugga

SEQ ID NO: 506575 - RNA, 22 nt, Human
ugcuucuguuucauugaucuua

SEQ ID NO: 506576 - RNA, 22 nt, Human
ucccacauaugcaauccugaau

SEQ ID NO: 506577 - RNA, 22 nt, Human
acagaacaggcugagaaaaaca

SEQ ID NO: 506578 - RNA, 22 nt, Human
uagguucaaguucaggcucuau

SEQ ID NO: 506579 - RNA, 22 nt, Human
uaggaaaugaaugcaggcuccc

SEQ ID NO: 506580 - RNA, 22 nt, Human
uuacuucuuacaaaagaaauau

SEQ ID NO: 506581 - RNA, 22 nt, Human
cucaaggacuuauucaugccug

SEQ ID NO: 506582 - RNA, 22 nt, Human
agcccaagcuaugaggugaccu

SEQ ID NO: 506583 - RNA, 22 nt, Human
cagcuucuucaguccuggagcu

SEQ ID NO: 506584 - RNA, 22 nt, Human
cuuacacagucuggcacuucuu

SEQ ID NO: 506585 - RNA, 22 nt, Human
aggugggaacccagcagggccc

SEQ ID NO: 506586 - RNA, 22 nt, Human
acagaccaaguuuccagcaggu

SEQ ID NO: 506587 - RNA, 22 nt, Human
cuguuuaucccuuuggucagca

SEQ ID NO: 506588 - RNA, 22 nt, Human
gucccucugccugugguucucu

SEQ ID NO: 506589 - RNA, 21 nt, Human
aaguuugggauucaguuucca

SEQ ID NO: 506590 - RNA, 20 nt, Human
gccugcagguuggaugggau

SEQ ID NO: 506591 - RNA, 22 nt, Human
ccuucagccuagaacuugagag

SEQ ID NO: 506592 - RNA, 22 nt, Human
uugauuaaacaggcauauucaa

SEQ ID NO: 506593 - RNA, 22 nt, Human
uauugguguacuuauagcagag

SEQ ID NO: 506594 - RNA, 22 nt, Human
cuguggcugaguuccuuauguu

SEQ ID NO: 506595 - RNA, 22 nt, Human
ggcccugugguuuugcaaaguc

SEQ ID NO: 506596 - RNA, 22 nt, Human
gagggccagaucccaggaggaa

SEQ ID NO: 506597 - RNA, 22 nt, Human
ucuugcacuucaugaauauguu

SEQ ID NO: 506598 - RNA, 22 nt, Human
uucuacaugguugcucagaggg

SEQ ID NO: 506599 - RNA, 22 nt, Human
cuuuacaaagcaauuuugucuc

SEQ ID NO: 506600 - RNA, 22 nt, Human
cugaagaggacgcagcagcaag

SEQ ID NO: 506601 - RNA, 22 nt, Human
caugcaaagcguuuugaccagc

SEQ ID NO: 506602 - RNA, 22 nt, Human
agugggcagcccaggaggucuu

SEQ ID NO: 506603 - RNA, 22 nt, Human
ggguggagccaguugacucugu

SEQ ID NO: 506604 - RNA, 22 nt, Human
cugccugcacugccuggcucca

SEQ ID NO: 506605 - RNA, 22 nt, Human
aaccaggacaauuuugaaagua

SEQ ID NO: 506606 - RNA, 20 nt, Human
ucagagucaucaaagauggu

SEQ ID NO: 506607 - RNA, 22 nt, Human
cacaguaaccccaggacuggga

SEQ ID NO: 506608 - RNA, 22 nt, Human
gccaccauguagcccauuagag

SEQ ID NO: 506609 - RNA, 22 nt, Human
gccuuggaaagcuggagcaguu

SEQ ID NO: 506610 - RNA, 22 nt, Human
ucucagucagccuugauguccc

SEQ ID NO: 506611 - RNA, 22 nt, Human
aaguuuuccuguguccaagaug

SEQ ID NO: 506612 - RNA, 22 nt, Human
ugggauaguagcugagagacaa

SEQ ID NO: 506613 - RNA, 22 nt, Human
uagucucuggagacucuagggg

SEQ ID NO: 506614 - RNA, 22 nt, Human
ucucuggcagaggcccuauccc

SEQ ID NO: 506615 - RNA, 22 nt, Human
cuguaugaacccauauacuuau

SEQ ID NO: 506616 - RNA, 22 nt, Human
gccaggcagccacccucugcga

SEQ ID NO: 506617 - RNA, 22 nt, Human
gaagcccagggcguggccgggc

SEQ ID NO: 506618 - RNA, 20 nt, Human
ccuggagccuggaaggaguc

SEQ ID NO: 506619 - RNA, 22 nt, Human
uagcagagcagggaucagagcc

SEQ ID NO: 506620 - RNA, 20 nt, Human
ccagacagcaccugccuggu

SEQ ID NO: 506621 - RNA, 22 nt, Human
aauuagaagcuguuagcaaaau

SEQ ID NO: 506622 - RNA, 22 nt, Human
cucagagauauagucccugcuu

SEQ ID NO: 506623 - RNA, 22 nt, Human
ugcauuauuugcaugugccugu

SEQ ID NO: 506624 - RNA, 22 nt, Human
uuggaauucaaguuguagcuua

SEQ ID NO: 506625 - RNA, 22 nt, Human
gcaggagcucguuuccaggcug

SEQ ID NO: 506626 - RNA, 23 nt, Human
gaggcagcuccugcagugcccug

SEQ ID NO: 506627 - RNA, 22 nt, Human
uccugggagaguuugauucauu

SEQ ID NO: 506628 - RNA, 22 nt, Human
ucugcucagugcuuaucucuaa

SEQ ID NO: 506629 - RNA, 23 nt, Human
ugacacauuuccuuuccacugca

SEQ ID NO: 506630 - RNA, 22 nt, Human
gaguccagcagaaugagccaag

SEQ ID NO: 506631 - RNA, 22 nt, Human
agacccagaaagcagcugcauu

SEQ ID NO: 506632 - RNA, 22 nt, Human
aggcaacaaggguagucaguga

SEQ ID NO: 506633 - RNA, 22 nt, Human
gccagggagucugggccacaga

SEQ ID NO: 506634 - RNA, 22 nt, Human
aagcagcugaaggauucagggu

SEQ ID NO: 506635 - RNA, 22 nt, Human
gucuuuuuuacaccuuacauca

SEQ ID NO: 506636 - RNA, 22 nt, Human
uggccuggggaagaccaugggc

SEQ ID NO: 506637 - RNA, 22 nt, Human
ugcaguggaggccgugagacag

SEQ ID NO: 506638 - RNA, 22 nt, Human
uuuauuuggcaucucugccaag

SEQ ID NO: 506639 - RNA, 17 nt, Human
aucuggcugcuucuaga

SEQ ID NO: 506640 - RNA, 22 nt, Human
gcagggugauagugaggcucag

SEQ ID NO: 506641 - RNA, 22 nt, Human
cugcucugcaaggcacagugau

SEQ ID NO: 506642 - RNA, 22 nt, Human
ugggcucucacacauguucuga

SEQ ID NO: 506643 - RNA, 22 nt, Human
cugggcaguucgcuuucguuuu

SEQ ID NO: 506644 - RNA, 22 nt, Human
agcuucucucuuugcacucaca

SEQ ID NO: 506645 - RNA, 22 nt, Human
cccagccugucuuucccaauga

SEQ ID NO: 506646 - RNA, 21 nt, Human
ucaccuggcuucugaccuggc

SEQ ID NO: 506647 - RNA, 20 nt, Human
uucugggcagccauguacuu

SEQ ID NO: 506648 - RNA, 22 nt, Human
ggccuggcauggggacuaaggg

SEQ ID NO: 506649 - RNA, 22 nt, Human
acccaggguagaaccucagagc

SEQ ID NO: 506650 - RNA, 22 nt, Human
gcaguguuccuucuacuggggc

SEQ ID NO: 506651 - RNA, 22 nt, Human
ccuggcucccugcacagggcuc

SEQ ID NO: 506652 - RNA, 22 nt, Human
cugggaggcggagguuguagug

SEQ ID NO: 506653 - RNA, 22 nt, Human
cucaucaccacauauaacaaag

SEQ ID NO: 506654 - RNA, 22 nt, Human
ccaagugauacacccgccucgg

SEQ ID NO: 506655 - RNA, 22 nt, Human
gaggaagaaagcauaggugggg

SEQ ID NO: 506656 - RNA, 22 nt, Human
aaagccuuuucuguuuaacaca

SEQ ID NO: 506657 - RNA, 19 nt, Human
agcacagacaagaccagca

SEQ ID NO: 506658 - RNA, 22 nt, Human
cauuuguacagaacagcuuuau

SEQ ID NO: 506659 - RNA, 21 nt, Human
gcagcaaaugacaacagugag

SEQ ID NO: 506660 - RNA, 22 nt, Human
gccugcagccccucugcaguag

SEQ ID NO: 506661 - RNA, 22 nt, Human
cauaauuagagaauucauguua

SEQ ID NO: 506662 - RNA, 22 nt, Human
ucagugcuaaaagagcuggugu

SEQ ID NO: 506663 - RNA, 22 nt, Human
uagggcuauaagagaauaagac

SEQ ID NO: 506664 - RNA, 23 nt, Human
cauguacagaguuugauaaagug

SEQ ID NO: 506665 - RNA, 22 nt, Human
agugaggcuaauaggcaauggu

SEQ ID NO: 506666 - RNA, 22 nt, Human
gcaggagcagucaggggcagcu

SEQ ID NO: 506667 - RNA, 23 nt, Human
ugucuggcucauggugggucuca

SEQ ID NO: 506668 - RNA, 22 nt, Human
acuaaaaacuacugccaauagc

SEQ ID NO: 506669 - RNA, 18 nt, Human
gccugggaggaggaaaug

SEQ ID NO: 506670 - RNA, 22 nt, Human
gguaacaguauguagaguaaga

SEQ ID NO: 506671 - RNA, 22 nt, Human
auccacccugugguggcuuucu

SEQ ID NO: 506672 - RNA, 22 nt, Human
agccucuguagaaagcagugug

SEQ ID NO: 506673 - RNA, 22 nt, Human
acaggaaagagcuaggcauagg

SEQ ID NO: 506674 - RNA, 20 nt, Human
aggccccaggaaacucucag

SEQ ID NO: 506675 - RNA, 22 nt, Human
cauaucccauuggccaggacau

SEQ ID NO: 506676 - RNA, 22 nt, Human
ucagcuuggacagcuugguuga

SEQ ID NO: 506677 - RNA, 22 nt, Human
aauauaaugcuguuuuaugcca

SEQ ID NO: 506678 - RNA, 22 nt, Human
acacaggagauauguaauggcu

SEQ ID NO: 506679 - RNA, 22 nt, Human
ggcucuggcguccaauggagcg

SEQ ID NO: 506680 - RNA, 22 nt, Human
ucuguggaaauuuccugaggca

SEQ ID NO: 506681 - RNA, 22 nt, Human
ccaugccuuucacugaaccagu

SEQ ID NO: 506682 - RNA, 22 nt, Human
cagcuauuggcaagaaguggug

SEQ ID NO: 506683 - RNA, 22 nt, Human
uaaaugcaguuaguacuugcca

SEQ ID NO: 506684 - RNA, 22 nt, Human
ggugcugguucaggguggcugu

SEQ ID NO: 506685 - RNA, 22 nt, Human
acacacaugguauuguucagaa

SEQ ID NO: 506686 - RNA, 22 nt, Human
ccuuccaggugcaggcaagccu

SEQ ID NO: 506687 - RNA, 22 nt, Human
cccuccucucccuaagagucac

SEQ ID NO: 506688 - RNA, 22 nt, Human
uccuuggggacgcugacaucgu

SEQ ID NO: 506689 - RNA, 22 nt, Human
auagucacugccuuccauuugu

SEQ ID NO: 506690 - RNA, 22 nt, Human
aaagcaaugcuuguggaaugua

SEQ ID NO: 506691 - RNA, 22 nt, Human
ugcagguggacacgggagacgg

SEQ ID NO: 506692 - RNA, 22 nt, Human
ugaaagggguugaguuacagcu

SEQ ID NO: 506693 - RNA, 22 nt, Human
cccuuagccaggaaaucgaccu

SEQ ID NO: 506694 - RNA, 22 nt, Human
ggagaccuuaaggugcuuccua

SEQ ID NO: 506695 - RNA, 22 nt, Human
aucuacagugcacaggacagcc

SEQ ID NO: 506696 - RNA, 22 nt, Human
ucccacugugaauccaaggccu

SEQ ID NO: 506697 - RNA, 22 nt, Human
cagcuacagaggccacauggcu

SEQ ID NO: 506698 - RNA, 22 nt, Human
auguuacauaguccuuauuugu

SEQ ID NO: 506699 - RNA, 22 nt, Human
ugaaagguagcuggccucauag

SEQ ID NO: 506700 - RNA, 22 nt, Human
auuuguagugaagugaaaauaa

SEQ ID NO: 506701 - RNA, 22 nt, Human
aaaguggucaccuucucauuuc

SEQ ID NO: 506702 - RNA, 22 nt, Human
cacucugacuggcccugcagga

SEQ ID NO: 506703 - RNA, 22 nt, Human
cacagcuuaugccacugauugg

SEQ ID NO: 506704 - RNA, 20 nt, Human
cucaguguggccugaguguu

SEQ ID NO: 506705 - RNA, 22 nt, Human
gaagcagcuuucuggugaggag

SEQ ID NO: 506706 - RNA, 22 nt, Human
gaugauuuuaugucuugucauu

SEQ ID NO: 506707 - RNA, 22 nt, Human
ccaggaucugauauugggcucc

SEQ ID NO: 506708 - RNA, 22 nt, Human
aauuucaagucuugaagaagua

SEQ ID NO: 506709 - RNA, 22 nt, Human
uaccauuucauucuuuccucau

SEQ ID NO: 506710 - RNA, 21 nt, Human
ucuccaguauccuucucugag

SEQ ID NO: 506711 - RNA, 22 nt, Human
uacuuacagagcuuauaaguua

SEQ ID NO: 506712 - RNA, 22 nt, Human
agggcugagacuaaggccagau

SEQ ID NO: 506713 - RNA, 22 nt, Human
ccucuggguaucuguggaagua

SEQ ID NO: 506714 - RNA, 22 nt, Human
agggcagcauugccuuucucca

SEQ ID NO: 506715 - RNA, 22 nt, Human
ugcugugcuggcggcagaggcc

SEQ ID NO: 506716 - RNA, 22 nt, Human
ugacacagauuagagacauacc

SEQ ID NO: 506717 - RNA, 22 nt, Human
aauaugcauuaacuguguacau

SEQ ID NO: 506718 - RNA, 22 nt, Human
gcaggcuggaggcuguucuggg

SEQ ID NO: 506719 - RNA, 22 nt, Human
ugcaugucaaggcacucaggau

SEQ ID NO: 506720 - RNA, 22 nt, Human
ccugccucaucaacuugucgug

SEQ ID NO: 506721 - RNA, 22 nt, Human
cauuuauucucagauccuuguc

SEQ ID NO: 506722 - RNA, 22 nt, Human
uucucacacuuuccacugaggu

SEQ ID NO: 506723 - RNA, 22 nt, Human
gagucacaaagccuuucuuauu

SEQ ID NO: 506724 - RNA, 22 nt, Human
ccaaguaguugagacuacaggu

SEQ ID NO: 506725 - RNA, 22 nt, Human
ccuggggaauagagucaagggg

SEQ ID NO: 506726 - RNA, 22 nt, Human
cugccacuuuggagugcucaga

SEQ ID NO: 506727 - RNA, 22 nt, Human
uccaagaagucaucuaaacugu

SEQ ID NO: 506728 - RNA, 22 nt, Human
agagcacagaagaauaggugcu

SEQ ID NO: 506729 - RNA, 22 nt, Human
gcaggcccuccucuagcaaggc

SEQ ID NO: 506730 - RNA, 22 nt, Human
cuugugcaauugacauugaauc

SEQ ID NO: 506731 - RNA, 22 nt, Human
caggaggccaacugugggacuu

SEQ ID NO: 506732 - RNA, 22 nt, Human
ugagaagcccacacucuuuccu

SEQ ID NO: 506733 - RNA, 22 nt, Human
ucuucacaccgggcagcaggaa

SEQ ID NO: 506734 - RNA, 22 nt, Human
cagcccagcagggucuggcccu

SEQ ID NO: 506735 - RNA, 19 nt, Human
acuuugcaugugugucuaa

SEQ ID NO: 506736 - RNA, 22 nt, Human
gcaggagucacugacuuggucc

SEQ ID NO: 506737 - RNA, 22 nt, Human
ucaugccaaaauccaguggcuu

SEQ ID NO: 506738 - RNA, 22 nt, Human
ucuugccucuuccccuuuccau

SEQ ID NO: 506739 - RNA, 22 nt, Human
agcucugacugaagagaugcaa

SEQ ID NO: 506740 - RNA, 22 nt, Human
cugugccuggggggcagagcug

SEQ ID NO: 506741 - RNA, 22 nt, Human
agggccugacacccuugccagc

SEQ ID NO: 506742 - RNA, 22 nt, Human
ugcuugggcggccagcauggcg

SEQ ID NO: 506743 - RNA, 22 nt, Human
ucauuuccucaaauucaagguu

SEQ ID NO: 506744 - RNA, 22 nt, Human
agcaaagccgagacagccagug

SEQ ID NO: 506745 - RNA, 22 nt, Human
ucagggcauguauguuucuuua

SEQ ID NO: 506746 - RNA, 22 nt, Human
auaugaguuucccacuucugga

SEQ ID NO: 506747 - RNA, 23 nt, Human
uuccaagugcuuuacuuaauccu

SEQ ID NO: 506748 - RNA, 22 nt, Human
acauagaacuucccagugagca

SEQ ID NO: 506749 - RNA, 22 nt, Human
gaaaucuuuuccaauuguuuag

SEQ ID NO: 506750 - RNA, 18 nt, Human
uccucucuuuccccaggg

SEQ ID NO: 506751 - RNA, 22 nt, Human
acaugcuuucuagguccuucug

SEQ ID NO: 506752 - RNA, 22 nt, Human
ggaagaggcugaggccaugcug

SEQ ID NO: 506753 - RNA, 22 nt, Human
ugaggaaauugaggcucacaga

SEQ ID NO: 506754 - RNA, 22 nt, Human
aaacuguaaauacuaguaagug

SEQ ID NO: 506755 - RNA, 22 nt, Human
guguccacggcugagaaugauu

SEQ ID NO: 506756 - RNA, 22 nt, Human
gucaggaucaaauugaaguuau

SEQ ID NO: 506757 - RNA, 22 nt, Human
uuuuugaaggcugaugugauua

SEQ ID NO: 506758 - RNA, 22 nt, Human
ucagcccuagccucaguccagg

SEQ ID NO: 506759 - RNA, 22 nt, Human
ccuguggcugccacuuggguga

SEQ ID NO: 506760 - RNA, 22 nt, Human
gugucccacucuggaggugaag

SEQ ID NO: 506761 - RNA, 22 nt, Human
uuggcauucaugggacaacaaa

SEQ ID NO: 506762 - RNA, 22 nt, Human
ugucugaacugcacugaaagac

SEQ ID NO: 506763 - RNA, 22 nt, Human
uuauuccauuauuucacuuagg

SEQ ID NO: 506764 - RNA, 19 nt, Human
caggagagcaugcacuuug

SEQ ID NO: 506765 - RNA, 21 nt, Human
ugcagcagauuugggggaaga

SEQ ID NO: 506766 - RNA, 22 nt, Human
ucugggagguaaccaugcugau

SEQ ID NO: 506767 - RNA, 22 nt, Human
ugggauggcauccugggccuug

SEQ ID NO: 506768 - RNA, 22 nt, Human
ucucuacauaaccucaauacuc

SEQ ID NO: 506769 - RNA, 22 nt, Human
acugucacuccaacugagucgu

SEQ ID NO: 506770 - RNA, 22 nt, Human
uggggaaggcggagcuugcagc

SEQ ID NO: 506771 - RNA, 22 nt, Human
uuccuggggacuuaccgucauu

SEQ ID NO: 506772 - RNA, 22 nt, Human
gcugcagcccggcgcgccugag

SEQ ID NO: 506773 - RNA, 22 nt, Human
aaauuaguacauugcaaagucc

SEQ ID NO: 506774 - RNA, 22 nt, Human
uggcagaguucgcugugccuuu

SEQ ID NO: 506775 - RNA, 22 nt, Human
auaaggcagucacuggaauguu

SEQ ID NO: 506776 - RNA, 22 nt, Human
cuguucacacacuuguacucuc

SEQ ID NO: 506777 - RNA, 22 nt, Human
uuugccugauucuaagagcuca

SEQ ID NO: 506778 - RNA, 21 nt, Human
cugggcucaagcaauccuuuc

SEQ ID NO: 506779 - RNA, 22 nt, Human
ucuuugcaugugcuucuuggcc

SEQ ID NO: 506780 - RNA, 22 nt, Human
ggacugggauucuggaucugcu

SEQ ID NO: 506781 - RNA, 22 nt, Human
cccauucccuuuacuguugcau

SEQ ID NO: 506782 - RNA, 22 nt, Human
uccugucagugaggcagaugaa

SEQ ID NO: 506783 - RNA, 22 nt, Human
ggaggagacaguaaaaagcacg

SEQ ID NO: 506784 - RNA, 22 nt, Human
accaguccgcggagcuccgggg

SEQ ID NO: 506785 - RNA, 22 nt, Human
gaggccacgguuuuccuugggg

SEQ ID NO: 506786 - RNA, 22 nt, Human
ucuggcaccacugagucugcag

SEQ ID NO: 506787 - RNA, 22 nt, Human
cuguggcuuugugucuauugua

SEQ ID NO: 506788 - RNA, 22 nt, Human
ggaggccaggaaggcucggaga

SEQ ID NO: 506789 - RNA, 22 nt, Human
aguggggaagagcaugggcccu

SEQ ID NO: 506790 - RNA, 22 nt, Human
uccucagggcggccuccgucuu

SEQ ID NO: 506791 - RNA, 22 nt, Human
aggcuccacggucacuggcucu

SEQ ID NO: 506792 - RNA, 22 nt, Human
gccuuugccugcgacguggcug

SEQ ID NO: 506793 - RNA, 22 nt, Human
cccuggcaaaacacucucuuga

SEQ ID NO: 506794 - RNA, 22 nt, Human
gcagcugcagguggucccaugc

SEQ ID NO: 506795 - RNA, 22 nt, Human
uccaggagagguguggggacug

SEQ ID NO: 506796 - RNA, 22 nt, Human
ugacacaguugucgacucuaca

SEQ ID NO: 506797 - RNA, 22 nt, Human
auaaucagaauucaugaaagau

SEQ ID NO: 506798 - RNA, 22 nt, Human
cuggaaagaccugcuugcuuuu

SEQ ID NO: 506799 - RNA, 22 nt, Human
gggucugggcaggcgcuuccuc

SEQ ID NO: 506800 - RNA, 22 nt, Human
caaagugcugggauuauaggca

SEQ ID NO: 506801 - RNA, 22 nt, Human
ccuggcucaggcacgcauggcu

SEQ ID NO: 506802 - RNA, 22 nt, Human
uggagggaacccaggcugcucu

SEQ ID NO: 506803 - RNA, 22 nt, Human
ucauggagacuuugagccuguu

SEQ ID NO: 506804 - RNA, 22 nt, Human
ggcuccugaaagacuaugggaa

SEQ ID NO: 506805 - RNA, 22 nt, Human
uuacacaguugguaggggcaga

SEQ ID NO: 506806 - RNA, 22 nt, Human
ccucuuugagauucaguuuucc

SEQ ID NO: 506807 - RNA, 22 nt, Human
ggugcucaagagggcauccucu

SEQ ID NO: 506808 - RNA, 22 nt, Human
acugucuuccaggucuggaggu

SEQ ID NO: 506809 - RNA, 22 nt, Human
gcauaugaucacgugugucggu

SEQ ID NO: 506810 - RNA, 22 nt, Human
ccaguguuuccgucaguacacg

SEQ ID NO: 506811 - RNA, 22 nt, Human
uuugaaauaugaggcauuauga

SEQ ID NO: 506812 - RNA, 17 nt, Human
gcauccaguaacaugcc

SEQ ID NO: 506813 - RNA, 18 nt, Human
agucucagcggaggagua

SEQ ID NO: 506814 - RNA, 22 nt, Human
gcucccagggcagcgcagaaga

SEQ ID NO: 506815 - RNA, 23 nt, Human
ugguggcagaaguagcagaugac

SEQ ID NO: 506816 - RNA, 22 nt, Human
uggcauuuaguugcguauugca

SEQ ID NO: 506817 - RNA, 22 nt, Human
gcacugaaugccaaaguguagg

SEQ ID NO: 506818 - RNA, 22 nt, Human
cgaggcagaggcugaaacggcu

SEQ ID NO: 506819 - RNA, 22 nt, Human
aaauggucacuggugaguguca

SEQ ID NO: 506820 - RNA, 22 nt, Human
gauuuccucacuaacauccauc

SEQ ID NO: 506821 - RNA, 22 nt, Human
uccaggcaagggaggagcaugg

SEQ ID NO: 506822 - RNA, 21 nt, Human
ccuggcagaagccugauaugc

SEQ ID NO: 506823 - RNA, 22 nt, Human
agaaacagcauuagcaucaauu

SEQ ID NO: 506824 - RNA, 22 nt, Human
ugaaaucuacccuauucagggu

SEQ ID NO: 506825 - RNA, 22 nt, Human
ccucugugucagggaagagacu

SEQ ID NO: 506826 - RNA, 22 nt, Human
ucuucaaacccuggcucuuccu

SEQ ID NO: 506827 - RNA, 22 nt, Human
aaagauuauggcauugaaauac

SEQ ID NO: 506828 - RNA, 22 nt, Human
uaacacugguauuucauuuagu

SEQ ID NO: 506829 - RNA, 22 nt, Human
aagucauuaucucuucuaaucu

SEQ ID NO: 506830 - RNA, 18 nt, Human
auccuugaugagaggucu

SEQ ID NO: 506831 - RNA, 22 nt, Human
uauuugcaggcuuuugucaugg

SEQ ID NO: 506832 - RNA, 22 nt, Human
ucugcaggaaaaaagugccugg

SEQ ID NO: 506833 - RNA, 22 nt, Human
caaagggcucuagacucagcag

SEQ ID NO: 506834 - RNA, 22 nt, Human
cagguaggauggaagggcucaa

SEQ ID NO: 506835 - RNA, 22 nt, Human
cuuccaggguccaggaagagcc

SEQ ID NO: 506836 - RNA, 22 nt, Human
auuaauuuccaggcacugugcu

SEQ ID NO: 506837 - RNA, 22 nt, Human
auggauaauggugauaguugca

SEQ ID NO: 506838 - RNA, 20 nt, Human
gacagcuuggggugucaccu

SEQ ID NO: 506839 - RNA, 22 nt, Human
cagaguguuucuuugggugggu

SEQ ID NO: 506840 - RNA, 22 nt, Human
cccugcagagaccacugaccuu

SEQ ID NO: 506841 - RNA, 22 nt, Human
uccaagcuguauguuccuagag

SEQ ID NO: 506842 - RNA, 22 nt, Human
acaggccugacacacagagggc

SEQ ID NO: 506843 - RNA, 22 nt, Human
cugagggagcugcuggccuugg

SEQ ID NO: 506844 - RNA, 22 nt, Human
agccuguccagaggacagggcu

SEQ ID NO: 506845 - RNA, 22 nt, Human
uugaaaguuuauggagucugca

SEQ ID NO: 506846 - RNA, 22 nt, Human
agcuggcuccagaaggagucgu

SEQ ID NO: 506847 - RNA, 22 nt, Human
uccugcagguggaugauucucu

SEQ ID NO: 506848 - RNA, 22 nt, Human
cccaggucugugccagcucuga

SEQ ID NO: 506849 - RNA, 18 nt, Human
ucugcugcugcguccugc

SEQ ID NO: 506850 - RNA, 22 nt, Human
ucuggcucucaacaaauauuua

SEQ ID NO: 506851 - RNA, 22 nt, Human
cuggccaacuugcuuguuggca

SEQ ID NO: 506852 - RNA, 22 nt, Human
aauucuauaggcaagcuauuuu

SEQ ID NO: 506853 - RNA, 22 nt, Human
ugccuugggagccagcaugcca

SEQ ID NO: 506854 - RNA, 22 nt, Human
acagccuggacuggcucucugc

SEQ ID NO: 506855 - RNA, 22 nt, Human
gcacccagaauaaggacaggac

SEQ ID NO: 506856 - RNA, 22 nt, Human
ccugggcucaagugauccuccu

SEQ ID NO: 506857 - RNA, 22 nt, Human
ugucaaaaugacuuuacuacag

SEQ ID NO: 506858 - RNA, 22 nt, Human
cacugcaguuccccagugcgca

SEQ ID NO: 506859 - RNA, 22 nt, Human
gaugcaaagauaaaacagacgc

SEQ ID NO: 506860 - RNA, 23 nt, Human
ugcaggcuaggaagagagccuuc

SEQ ID NO: 506861 - RNA, 22 nt, Human
aagaggaauggguguguuuaug

SEQ ID NO: 506862 - RNA, 22 nt, Human
aaauacagaguugcuuaaaagc

SEQ ID NO: 506863 - RNA, 22 nt, Human
acagaguaggugcucaguaaau

SEQ ID NO: 506864 - RNA, 23 nt, Human
aaguccagaaggagaacugggag

SEQ ID NO: 506865 - RNA, 22 nt, Human
cucugcauuuuaacagaugauu

SEQ ID NO: 506866 - RNA, 19 nt, Human
ucaguuuuagucaucaguu

SEQ ID NO: 506867 - RNA, 21 nt, Human
ucagucccuggguguguccca

SEQ ID NO: 506868 - RNA, 22 nt, Human
gaguccaguuguucacagaggc

SEQ ID NO: 506869 - RNA, 22 nt, Human
uggccugauuuugcuaagagaa

SEQ ID NO: 506870 - RNA, 22 nt, Human
aaggagcuuguucgccuuccuc

SEQ ID NO: 506871 - RNA, 22 nt, Human
acaaaauuguguuaaacuuuau

SEQ ID NO: 506872 - RNA, 22 nt, Human
ggugggugagcccugggagcug

SEQ ID NO: 506873 - RNA, 22 nt, Human
ucccuggggauguuggccugcc

SEQ ID NO: 506874 - RNA, 22 nt, Human
ucugggucaugacucagcguga

SEQ ID NO: 506875 - RNA, 22 nt, Human
uaaagaugcccacauugcaggu

SEQ ID NO: 506876 - RNA, 22 nt, Human
cuuugaaaacuuaaauaacagc

SEQ ID NO: 506877 - RNA, 22 nt, Human
uguguguguccucauuugcaga

SEQ ID NO: 506878 - RNA, 22 nt, Human
ucacuuuugaucccuaugcagu

SEQ ID NO: 506879 - RNA, 22 nt, Human
auaaggcagaaauagggaaagu

SEQ ID NO: 506880 - RNA, 22 nt, Human
agcagcaggcuuaaggaaaagu

SEQ ID NO: 506881 - RNA, 22 nt, Human
cauuugucucuaggaagugagg

SEQ ID NO: 506882 - RNA, 22 nt, Human
aacuguacgauaauaaauuugu

SEQ ID NO: 506883 - RNA, 22 nt, Human
cccuggccagcucaugucugag

SEQ ID NO: 506884 - RNA, 22 nt, Human
acaacaggguaaggcaggccau

SEQ ID NO: 506885 - RNA, 20 nt, Human
aauuuacucacagaaugaau

SEQ ID NO: 506886 - RNA, 22 nt, Human
agcugguuagcaaucuaaguga

SEQ ID NO: 506887 - RNA, 22 nt, Human
cuguggcucaauugccuacuga

SEQ ID NO: 506888 - RNA, 22 nt, Human
ugcaggcugggaagagggacaa

SEQ ID NO: 506889 - RNA, 22 nt, Human
acuuuggaucugauguaaucag

SEQ ID NO: 506890 - RNA, 22 nt, Human
auccaaagcccuaaguuaacug

SEQ ID NO: 506891 - RNA, 21 nt, Human
ugcaggagucugugagucagg

SEQ ID NO: 506892 - RNA, 19 nt, Human
uagaaugcccacuuaaaaa

SEQ ID NO: 506893 - RNA, 22 nt, Human
uaaaugugcacagguuagaagg

SEQ ID NO: 506894 - RNA, 19 nt, Human
cagaguccuugaccagucc

SEQ ID NO: 506895 - RNA, 22 nt, Human
ugcccaggaucuggcgaugcuc

SEQ ID NO: 506896 - RNA, 22 nt, Human
auguagcagauauuugugcaca

SEQ ID NO: 506897 - RNA, 22 nt, Human
aagggcugccagggggugccag

SEQ ID NO: 506898 - RNA, 22 nt, Human
ugcaaaaauugcuggaaucuuu

SEQ ID NO: 506899 - RNA, 22 nt, Human
ugugacuggaguccagcccacu

SEQ ID NO: 506900 - RNA, 22 nt, Human
cuuauguauaauguuccacaua

SEQ ID NO: 506901 - RNA, 21 nt, Human
ucuuguccuugcucucccacu

SEQ ID NO: 506902 - RNA, 22 nt, Human
agccagggagguggagguugca

SEQ ID NO: 506903 - RNA, 22 nt, Human
cagcauugaucccaggcugugg

SEQ ID NO: 506904 - RNA, 22 nt, Human
agguaagggucacaguucauau

SEQ ID NO: 506905 - RNA, 22 nt, Human
uuagauauguuuuugcuaaugc

SEQ ID NO: 506906 - RNA, 22 nt, Human
gggaucugaguugucaggaagg

SEQ ID NO: 506907 - RNA, 22 nt, Human
aaugauuuggcaaaggaaucca

SEQ ID NO: 506908 - RNA, 22 nt, Human
ucuggcucaucucuccagguaa

SEQ ID NO: 506909 - RNA, 22 nt, Human
acugggcuguggacacccagcg

SEQ ID NO: 506910 - RNA, 22 nt, Human
cuucuuaaauuggauugcuauu

SEQ ID NO: 506911 - RNA, 22 nt, Human
ccacagaaaguugucuagagua

SEQ ID NO: 506912 - RNA, 22 nt, Human
ugagagcacacagaaauauuuu

SEQ ID NO: 506913 - RNA, 20 nt, Human
gagcuucaacucagcaaaca

SEQ ID NO: 506914 - RNA, 22 nt, Human
agcugcugcaaguggugcuaac

SEQ ID NO: 506915 - RNA, 22 nt, Human
cagcuggccugaucccuguggc

SEQ ID NO: 506916 - RNA, 22 nt, Human
ucaggauaaaauguaauggcaa

SEQ ID NO: 506917 - RNA, 22 nt, Human
caggcucccgaaaucacccaug

SEQ ID NO: 506918 - RNA, 22 nt, Human
uuaacaaaguaacgggaaaaga

SEQ ID NO: 506919 - RNA, 22 nt, Human
uucucaagaacauauguagggu

SEQ ID NO: 506920 - RNA, 22 nt, Human
gcucagagauguucaguagcuu

SEQ ID NO: 506921 - RNA, 22 nt, Human
uccucagcaaacacuucacucu

SEQ ID NO: 506922 - RNA, 22 nt, Human
uuguuacacauaauaacauuuu

SEQ ID NO: 506923 - RNA, 22 nt, Human
acccaggccugagagacaggag

SEQ ID NO: 506924 - RNA, 22 nt, Human
cucuggguggucucacugagug

SEQ ID NO: 506925 - RNA, 22 nt, Human
uccccugcagaugagggcagug

SEQ ID NO: 506926 - RNA, 22 nt, Human
gccaccuguaagccauuaggcc

SEQ ID NO: 506927 - RNA, 22 nt, Human
agaauguagucuuggagauuua

SEQ ID NO: 506928 - RNA, 22 nt, Human
uggcugcugcuuggucuucuuc

SEQ ID NO: 506929 - RNA, 22 nt, Human
ggcagcugagaucaugcuguug

SEQ ID NO: 506930 - RNA, 22 nt, Human
gucuggaggcacuuucucauga

SEQ ID NO: 506931 - RNA, 22 nt, Human
gucccuaguggaaagacaugau

SEQ ID NO: 506932 - RNA, 22 nt, Human
augggaggcagcagagcccagc

SEQ ID NO: 506933 - RNA, 21 nt, Human
caggaaaagcggaagucuagc

SEQ ID NO: 506934 - RNA, 22 nt, Human
ugaaagaacuagcaucuucaag

SEQ ID NO: 506935 - RNA, 22 nt, Human
guuuauaaugucugugccaaaa

SEQ ID NO: 506936 - RNA, 22 nt, Human
agucauaauuauaaacaucagu

SEQ ID NO: 506937 - RNA, 22 nt, Human
uaggacugauaaggggccagag

SEQ ID NO: 506938 - RNA, 22 nt, Human
ccacagaaugaugacacuucag

SEQ ID NO: 506939 - RNA, 22 nt, Human
ucaaaguuuguggcaauuuauu

SEQ ID NO: 506940 - RNA, 22 nt, Human
ucucaguggaucucagaauuuu

SEQ ID NO: 506941 - RNA, 22 nt, Human
uuuugugagcuccuuggaggua

SEQ ID NO: 506942 - RNA, 22 nt, Human
ugaauaaucuuggguauuaaua

SEQ ID NO: 506943 - RNA, 20 nt, Human
gucagaggacccuagagcga

SEQ ID NO: 506944 - RNA, 23 nt, Human
ugcaggugugcagagggcucuug

SEQ ID NO: 506945 - RNA, 22 nt, Human
gaaagugcuuagagugugguau

SEQ ID NO: 506946 - RNA, 22 nt, Human
aaggccagacaggaccacaucu

SEQ ID NO: 506947 - RNA, 22 nt, Human
uggacucagugcugccauuccc

SEQ ID NO: 506948 - RNA, 18 nt, Human
uucacaggaaaugucuuu

SEQ ID NO: 506949 - RNA, 22 nt, Human
ugucacaaacauacauuauaga

SEQ ID NO: 506950 - RNA, 22 nt, Human
acagagucuuacguggugauaa

SEQ ID NO: 506951 - RNA, 22 nt, Human
gcagcaaggaugaagcacuugg

SEQ ID NO: 506952 - RNA, 22 nt, Human
aagggcugaaugaaggguugaa

SEQ ID NO: 506953 - RNA, 22 nt, Human
ucugggagauccaagcagaacu

SEQ ID NO: 506954 - RNA, 21 nt, Human
aagagcugucaggaaggcugc

SEQ ID NO: 506955 - RNA, 18 nt, Human
cccuuagccuuuccucuc

SEQ ID NO: 506956 - RNA, 22 nt, Human
uuuguuagagugugggaggcug

SEQ ID NO: 506957 - RNA, 22 nt, Human
aggucugguguugaugaauucc

SEQ ID NO: 506958 - RNA, 22 nt, Human
aagggacccuggaucaaaugga

SEQ ID NO: 506959 - RNA, 22 nt, Human
cccuuagcuggugagcccagcg

SEQ ID NO: 506960 - RNA, 22 nt, Human
caaagacacgggaaacaacguu

SEQ ID NO: 506961 - RNA, 22 nt, Human
acauuucucauucuccccuaac

SEQ ID NO: 506962 - RNA, 19 nt, Human
gcuggcagauguggccgug

SEQ ID NO: 506963 - RNA, 22 nt, Human
aagacaauuuugaguaugcaca

SEQ ID NO: 506964 - RNA, 20 nt, Human
aggagggaccuggauuggcg

SEQ ID NO: 506965 - RNA, 22 nt, Human
uguggcucggccagcugcugaa

SEQ ID NO: 506966 - RNA, 22 nt, Human
ggcaggguaaaccgagguaagu

SEQ ID NO: 506967 - RNA, 22 nt, Human
gaaaugugugacaaguuucaau

SEQ ID NO: 506968 - RNA, 22 nt, Human
cccuggagcaucucugcugucu

SEQ ID NO: 506969 - RNA, 22 nt, Human
aagaggagggcagauucaaggc

SEQ ID NO: 506970 - RNA, 22 nt, Human
uucuuucccagaagauauguuu

SEQ ID NO: 506971 - RNA, 22 nt, Human
gcugagguggagauugcaguga

SEQ ID NO: 506972 - RNA, 22 nt, Human
ugucaugccaggaaauaguccc

SEQ ID NO: 506973 - RNA, 22 nt, Human
auugaaaaaugacuauugcuua

SEQ ID NO: 506974 - RNA, 22 nt, Human
uccacgugagcuucgugugcag

SEQ ID NO: 506975 - RNA, 22 nt, Human
ccgggcgggggcucucgucacc

SEQ ID NO: 506976 - RNA, 22 nt, Human
cugggcuguuuguucuggucuc

SEQ ID NO: 506977 - RNA, 22 nt, Human
acuuuauuuccuauugcaucca

SEQ ID NO: 506978 - RNA, 22 nt, Human
uuacaagacacugcugacacag

SEQ ID NO: 506979 - RNA, 22 nt, Human
ucuggagcgaggucccugucug

SEQ ID NO: 506980 - RNA, 22 nt, Human
ucaucccuaaggacagcucugc

SEQ ID NO: 506981 - RNA, 22 nt, Human
agugcuggagggaggcagguuc

SEQ ID NO: 506982 - RNA, 22 nt, Human
uucucuggagggcugcccggcc

SEQ ID NO: 506983 - RNA, 22 nt, Human
gagcuuggaagcagauccucac

SEQ ID NO: 506984 - RNA, 22 nt, Human
uaaagguaguuuuaaaggugcu

SEQ ID NO: 506985 - RNA, 22 nt, Human
ucuuuucuggacucugcaugga

SEQ ID NO: 506986 - RNA, 22 nt, Human
cuauacagcagcuuacuaguua

SEQ ID NO: 506987 - RNA, 22 nt, Human
gucaggauuauaauccccaugg

SEQ ID NO: 506988 - RNA, 22 nt, Human
gucuuguuugggauguggaugg

SEQ ID NO: 506989 - RNA, 22 nt, Human
aguggcagagcugugucuugaa

SEQ ID NO: 506990 - RNA, 22 nt, Human
acacagaguuauuaugugaacu

SEQ ID NO: 506991 - RNA, 22 nt, Human
auggcagaauuaggauuucaag

SEQ ID NO: 506992 - RNA, 22 nt, Human
ggcuucccaaggagccaggaug

SEQ ID NO: 506993 - RNA, 22 nt, Human
gagcccuccauggagccaggca

SEQ ID NO: 506994 - RNA, 22 nt, Human
gccaggcuggugucacaacucu

SEQ ID NO: 506995 - RNA, 21 nt, Human
uguuuaauacauauuugugga

SEQ ID NO: 506996 - RNA, 22 nt, Human
uagaauaugugguaggaucugg

SEQ ID NO: 506997 - RNA, 23 nt, Human
aaagcaaggaauuggcaacagag

SEQ ID NO: 506998 - RNA, 22 nt, Human
agggagcuuccgaacuacagcu

SEQ ID NO: 506999 - RNA, 22 nt, Human
uggacccccucaaggcagagcu

SEQ ID NO: 507000 - RNA, 22 nt, Human
gcaaaugaguuguaacauaaaa

SEQ ID NO: 507001 - RNA, 22 nt, Human
guggcucuaggugagcauggag

SEQ ID NO: 507002 - RNA, 22 nt, Human
ggcaggcuccguguuccauucc

SEQ ID NO: 507003 - RNA, 21 nt, Human
ccacucugaguguugaacaga

SEQ ID NO: 507004 - RNA, 22 nt, Human
auuucacagcugucaguguuac

SEQ ID NO: 507005 - RNA, 22 nt, Human
gcagggacgcagcacucuccgu

SEQ ID NO: 507006 - RNA, 21 nt, Human
uguuuauggaaaagagacaaa

SEQ ID NO: 507007 - RNA, 17 nt, Human
ccugggaggaguuauga

SEQ ID NO: 507008 - RNA, 22 nt, Human
aagggacuuugucagcuuucca

SEQ ID NO: 507009 - RNA, 17 nt, Human
cugggccuccccugucc

SEQ ID NO: 507010 - RNA, 22 nt, Human
guaucuuucccaccaaucacaa

SEQ ID NO: 507011 - RNA, 22 nt, Human
caagggugguauugggagcaua

SEQ ID NO: 507012 - RNA, 22 nt, Human
aaaaucuugugacuuaggaagg

SEQ ID NO: 507013 - RNA, 23 nt, Human
uuuauauuccuaaugucuugagc

SEQ ID NO: 507014 - RNA, 22 nt, Human
uucagagagaaaccagugggaa

SEQ ID NO: 507015 - RNA, 21 nt, Human
ccugggccaaauucccuggac

SEQ ID NO: 507016 - RNA, 22 nt, Human
gaaaggccagcucacagaugag

SEQ ID NO: 507017 - RNA, 22 nt, Human
agggcuuuaaugauuauuuucu

SEQ ID NO: 507018 - RNA, 20 nt, Human
ccaccuggccaaggcugugc

SEQ ID NO: 507019 - RNA, 22 nt, Human
gcccugcugcuggcagaggcgc

SEQ ID NO: 507020 - RNA, 22 nt, Human
gaaguugauagaguacaugauu

SEQ ID NO: 507021 - RNA, 22 nt, Human
ggcuccuggcaucuggugggua

SEQ ID NO: 507022 - RNA, 22 nt, Human
gcagcugccgugagcucacgcc

SEQ ID NO: 507023 - RNA, 22 nt, Human
gcagcuuggugaaaggugaugg

SEQ ID NO: 507024 - RNA, 22 nt, Human
auguccugggcuggguuauguu

SEQ ID NO: 507025 - RNA, 22 nt, Human
cugggagcuagcucugagcuga

SEQ ID NO: 507026 - RNA, 22 nt, Human
aggucauuguuaagucaccaua

SEQ ID NO: 507027 - RNA, 22 nt, Human
caagggccuccaccuugcucgu

SEQ ID NO: 507028 - RNA, 22 nt, Human
ccuggcugcuauagcagcaugu

SEQ ID NO: 507029 - RNA, 22 nt, Human
caaugacauggauaaucauauu

SEQ ID NO: 507030 - RNA, 22 nt, Human
ccucuuccacugggccccaucc

SEQ ID NO: 507031 - RNA, 22 nt, Human
ucacagaaacagaauggcacag

SEQ ID NO: 507032 - RNA, 22 nt, Human
uucaagaucuggguuuucagcu

SEQ ID NO: 507033 - RNA, 18 nt, Human
aggaaagacgaagagggc

SEQ ID NO: 507034 - RNA, 22 nt, Human
cccaggcucccaggugggacaa

SEQ ID NO: 507035 - RNA, 22 nt, Human
agagacuggaguuacgaguuca

SEQ ID NO: 507036 - RNA, 22 nt, Human
uuaaaguauagaggacaaaaac

SEQ ID NO: 507037 - RNA, 22 nt, Human
gagucccaugaugauagccaca

SEQ ID NO: 507038 - RNA, 19 nt, Human
ucaaaugccaaugucacag

SEQ ID NO: 507039 - RNA, 22 nt, Human
cacacagaugguaagggaggga

SEQ ID NO: 507040 - RNA, 22 nt, Human
ggaucuguuuugccucugaggg

SEQ ID NO: 507041 - RNA, 22 nt, Human
aagagcuggaagugaagauaac

SEQ ID NO: 507042 - RNA, 22 nt, Human
aacuuaaacccacucauguaga

SEQ ID NO: 507043 - RNA, 22 nt, Human
gaauuucagagguaacaucauc

SEQ ID NO: 507044 - RNA, 22 nt, Human
uuccugggauuauugucaagca

SEQ ID NO: 507045 - RNA, 20 nt, Human
ggcugccuccuuccuuuccu

SEQ ID NO: 507046 - RNA, 22 nt, Human
agagaacaaauuaaaggugguu

SEQ ID NO: 507047 - RNA, 22 nt, Human
cuaguccacuguccugccucca

SEQ ID NO: 507048 - RNA, 20 nt, Human
uggguccugcuucuuccuga

SEQ ID NO: 507049 - RNA, 22 nt, Human
uuugcauuaguuuagauuucaa

SEQ ID NO: 507050 - RNA, 22 nt, Human
uggccagcccuucagccaugcc

SEQ ID NO: 507051 - RNA, 22 nt, Human
agauguggaaagaaguuagaag

SEQ ID NO: 507052 - RNA, 22 nt, Human
accagguggccccagcgugguu

SEQ ID NO: 507053 - RNA, 22 nt, Human
uagcauuucccaaaugcauuug

SEQ ID NO: 507054 - RNA, 22 nt, Human
agaauauugaaaguucuugaca

SEQ ID NO: 507055 - RNA, 22 nt, Human
cuugaaagucacaugcagcccu

SEQ ID NO: 507056 - RNA, 19 nt, Human
aggcaggugcagagguccc

SEQ ID NO: 507057 - RNA, 22 nt, Human
gauuuaaaguagaccuuuguuu

SEQ ID NO: 507058 - RNA, 22 nt, Human
agaggagguggugaugcuuuaa

SEQ ID NO: 507059 - RNA, 22 nt, Human
cauuccaaguauauacaugaua

SEQ ID NO: 507060 - RNA, 22 nt, Human
agccacaccuguccugccagcu

SEQ ID NO: 507061 - RNA, 22 nt, Human
ucuucaaaaaauauccaucagu

SEQ ID NO: 507062 - RNA, 22 nt, Human
cuccaggacucaggccccuggg

SEQ ID NO: 507063 - RNA, 22 nt, Human
ggggaaacauguuguucagacc

SEQ ID NO: 507064 - RNA, 22 nt, Human
ucagcugccuuucccaugcuag

SEQ ID NO: 507065 - RNA, 22 nt, Human
gucaugccuggcuucuuagaca

SEQ ID NO: 507066 - RNA, 22 nt, Human
ugggugggagcgcccugucugg

SEQ ID NO: 507067 - RNA, 22 nt, Human
gaggcagcaaaauauaucauaa

SEQ ID NO: 507068 - RNA, 22 nt, Human
cuugaaagcacuccuuugacug

SEQ ID NO: 507069 - RNA, 22 nt, Human
gccuaggaguggggauggcggu

SEQ ID NO: 507070 - RNA, 23 nt, Human
ucugucacuuucugcuguggagu

SEQ ID NO: 507071 - RNA, 22 nt, Human
cuuuggcaaugaaacacaagaa

SEQ ID NO: 507072 - RNA, 22 nt, Human
uucuuuccaaccagauauuggu

SEQ ID NO: 507073 - RNA, 22 nt, Human
gcauagucaguaggauucucaa

SEQ ID NO: 507074 - RNA, 22 nt, Human
uugcacuccagcccgagcaaca

SEQ ID NO: 507075 - RNA, 23 nt, Human
cagcaggagggugccugggcugc

SEQ ID NO: 507076 - RNA, 21 nt, Human
gcagugcagcuuggaggguag

SEQ ID NO: 507077 - RNA, 22 nt, Human
agggaagaaucacugggauguu

SEQ ID NO: 507078 - RNA, 22 nt, Human
cuggggcuguaggaggacuuau

SEQ ID NO: 507079 - RNA, 22 nt, Human
guggcugguuuccugcaugcaa

SEQ ID NO: 507080 - RNA, 22 nt, Human
ucagggcaaaagggaaaccauu

SEQ ID NO: 507081 - RNA, 22 nt, Human
ugcaggccggcccuaggccuca

SEQ ID NO: 507082 - RNA, 22 nt, Human
gccucaguuuauacaccuguaa

SEQ ID NO: 507083 - RNA, 22 nt, Human
gggaucuguguugcgauggauu

SEQ ID NO: 507084 - RNA, 22 nt, Human
acaggcugacuuccugccaugu

SEQ ID NO: 507085 - RNA, 22 nt, Human
cugagcagccccaccagccauu

SEQ ID NO: 507086 - RNA, 22 nt, Human
ugaaauguuaaacaaguggcuc

SEQ ID NO: 507087 - RNA, 22 nt, Human
uccuggggaggguucuggcucc

SEQ ID NO: 507088 - RNA, 22 nt, Human
uucucuggacagugaagagagg

SEQ ID NO: 507089 - RNA, 22 nt, Human
ucucagagcuucaguuauuuuc

SEQ ID NO: 507090 - RNA, 22 nt, Human
agguccagcuguugcagccucc

SEQ ID NO: 507091 - RNA, 22 nt, Human
uggagaugaauauguguaccug

SEQ ID NO: 507092 - RNA, 22 nt, Human
cucccucuguccgaggccggcu

SEQ ID NO: 507093 - RNA, 22 nt, Human
ggaaaaauagaguauacuuuaa

SEQ ID NO: 507094 - RNA, 22 nt, Human
uuagauaauguuauuguaauuu

SEQ ID NO: 507095 - RNA, 21 nt, Human
aaagugguaaggauuauuuug

SEQ ID NO: 507096 - RNA, 22 nt, Human
ccagcuuuaucaagucugagcu

SEQ ID NO: 507097 - RNA, 22 nt, Human
auauaaagagcuuaguauagug

SEQ ID NO: 507098 - RNA, 22 nt, Human
ccuuagagaguacugggcugcc

SEQ ID NO: 507099 - RNA, 22 nt, Human
gcuagcuuuauaaugcugggcg

SEQ ID NO: 507100 - RNA, 22 nt, Human
guggcugggcuccgagcggcuu

SEQ ID NO: 507101 - RNA, 22 nt, Human
gggacagaaggaagugagcaca

SEQ ID NO: 507102 - RNA, 22 nt, Human
cuguggcuucuagguccccgau

SEQ ID NO: 507103 - RNA, 22 nt, Human
cuugggaggagaacaaagcucc

SEQ ID NO: 507104 - RNA, 19 nt, Human
agccagaguggcccagggg

SEQ ID NO: 507105 - RNA, 22 nt, Human
auccaggguguggagagagcuc

SEQ ID NO: 507106 - RNA, 22 nt, Human
augagcagaugcuccugccucu

SEQ ID NO: 507107 - RNA, 22 nt, Human
acauguguacuuuuaaggaugu

SEQ ID NO: 507108 - RNA, 22 nt, Human
ccuggguggcagagguugcagu

SEQ ID NO: 507109 - RNA, 22 nt, Human
ugaggagcgggcagggaugcag

SEQ ID NO: 507110 - RNA, 22 nt, Human
ugcugccaccccucaccagagc

SEQ ID NO: 507111 - RNA, 18 nt, Human
acauuucuccuucugacc

SEQ ID NO: 507112 - RNA, 22 nt, Human
uggugcugacaguucugagugc

SEQ ID NO: 507113 - RNA, 22 nt, Human
ggcuuuaucaaaugagacccug

SEQ ID NO: 507114 - RNA, 22 nt, Human
aaaugcucuccaaaaugaaagu

SEQ ID NO: 507115 - RNA, 17 nt, Human
ugaaggaaggaugaugu

SEQ ID NO: 507116 - RNA, 22 nt, Human
ucccagccugacagugcaucaa

SEQ ID NO: 507117 - RNA, 22 nt, Human
gcagaggagcaagcuggacacc

SEQ ID NO: 507118 - RNA, 22 nt, Human
caucaaauggcaagugaaagcu

SEQ ID NO: 507119 - RNA, 22 nt, Human
agggcuuugauguccaugagga

SEQ ID NO: 507120 - RNA, 19 nt, Human
uucuggggccuggccuugg

SEQ ID NO: 507121 - RNA, 21 nt, Human
ucacaucuauguuaagcaaac

SEQ ID NO: 507122 - RNA, 22 nt, Human
cacccagcuuuugcauccuccg

SEQ ID NO: 507123 - RNA, 22 nt, Human
caggaguccagagugucauuuu

SEQ ID NO: 507124 - RNA, 22 nt, Human
cugagcagugguucuugagcgc

SEQ ID NO: 507125 - RNA, 22 nt, Human
ugcccugcccaucuacccuguc

SEQ ID NO: 507126 - RNA, 22 nt, Human
uccugugucucagcgugaagca

SEQ ID NO: 507127 - RNA, 19 nt, Human
uccaauuucuauucauguu

SEQ ID NO: 507128 - RNA, 22 nt, Human
uagcugccuuugggcuccugcu

SEQ ID NO: 507129 - RNA, 22 nt, Human
cuccagggaggucugcaggacu

SEQ ID NO: 507130 - RNA, 22 nt, Human
auuagugucugugaauaauucu

SEQ ID NO: 507131 - RNA, 22 nt, Human
auuucuguggcuucauucuccu

SEQ ID NO: 507132 - RNA, 22 nt, Human
agcugagccagcagcaacagga

SEQ ID NO: 507133 - RNA, 22 nt, Human
gaaugugugacucuauugagca

SEQ ID NO: 507134 - RNA, 22 nt, Human
caggaaagagcugccaggcagg

SEQ ID NO: 507135 - RNA, 22 nt, Human
ccuggccagcgccggcugcucg

SEQ ID NO: 507136 - RNA, 22 nt, Human
aaauugcugugaggugguagua

SEQ ID NO: 507137 - RNA, 22 nt, Human
ugcacaaacacagagaauagau

SEQ ID NO: 507138 - RNA, 22 nt, Human
ugggcugaacuucaucugauga

SEQ ID NO: 507139 - RNA, 22 nt, Human
ugcaggugcagcgauacuguga

SEQ ID NO: 507140 - RNA, 22 nt, Human
gggaaacucaggcauuuccacu

SEQ ID NO: 507141 - RNA, 22 nt, Human
uggcagggccugcucaucaucc

SEQ ID NO: 507142 - RNA, 22 nt, Human
aaaacauguccauacagaaacu

SEQ ID NO: 507143 - RNA, 22 nt, Human
acagagccuccaggagugcugg

SEQ ID NO: 507144 - RNA, 22 nt, Human
aauggccauaucauugcagagc

SEQ ID NO: 507145 - RNA, 22 nt, Human
aggaaucccgcaccagcugcug

SEQ ID NO: 507146 - RNA, 22 nt, Human
ccacccuuggguucggaggccg

SEQ ID NO: 507147 - RNA, 22 nt, Human
augcauuuuugaguaugaauga

SEQ ID NO: 507148 - RNA, 22 nt, Human
ucaaauauuggcuauuucacau

SEQ ID NO: 507149 - RNA, 22 nt, Human
aaccaggugacucauggugagc

SEQ ID NO: 507150 - RNA, 22 nt, Human
ccuuaaaagaacuaucucuucu

SEQ ID NO: 507151 - RNA, 22 nt, Human
auguggaggaaaugaguguaca

SEQ ID NO: 507152 - RNA, 22 nt, Human
aaugucugccugaacuuuauau

SEQ ID NO: 507153 - RNA, 22 nt, Human
acagaugauuuuuaugaaaaca

SEQ ID NO: 507154 - RNA, 22 nt, Human
ccaggcugugguuuagauagag

SEQ ID NO: 507155 - RNA, 23 nt, Human
acucagugaagcaaacagauagu

SEQ ID NO: 507156 - RNA, 22 nt, Human
aacccuggggcagcugcuaggg

SEQ ID NO: 507157 - RNA, 22 nt, Human
uugcauaaaagaguauaucuua

SEQ ID NO: 507158 - RNA, 22 nt, Human
cuguggcuaauaauuaguauuu

SEQ ID NO: 507159 - RNA, 22 nt, Human
ucuuuacaucacaauuguaugg

SEQ ID NO: 507160 - RNA, 22 nt, Human
gccagccccuuagggcucuccc

SEQ ID NO: 507161 - RNA, 22 nt, Human
ugcuuccugcuaaggcugccug

SEQ ID NO: 507162 - RNA, 22 nt, Human
uacagaguuuuccugccaagaa

SEQ ID NO: 507163 - RNA, 22 nt, Human
cugggagagaagcgaagcuggg

SEQ ID NO: 507164 - RNA, 22 nt, Human
uucuggggccaauugccacugc

SEQ ID NO: 507165 - RNA, 22 nt, Human
aauaagacacacaacugucaag

SEQ ID NO: 507166 - RNA, 22 nt, Human
uggaaucucugguaucugggga

SEQ ID NO: 507167 - RNA, 22 nt, Human
cucuggagguggagguugcagu

SEQ ID NO: 507168 - RNA, 22 nt, Human
aaauacuguagauaauagaguu

SEQ ID NO: 507169 - RNA, 22 nt, Human
ugucauaaaacacaagcuguug

SEQ ID NO: 507170 - RNA, 22 nt, Human
uugggcaaaguguuucuggagc

SEQ ID NO: 507171 - RNA, 22 nt, Human
uccagggacagcgcuggagcua

SEQ ID NO: 507172 - RNA, 22 nt, Human
uauuaauucuugccaauucucc

SEQ ID NO: 507173 - RNA, 22 nt, Human
ccucucccgggugccgcugggc

SEQ ID NO: 507174 - RNA, 22 nt, Human
aagguagauucuggaucgaagg

SEQ ID NO: 507175 - RNA, 22 nt, Human
aaagcaauaguaaugguaauag

SEQ ID NO: 507176 - RNA, 22 nt, Human
uggagccaaggccaguucucag

SEQ ID NO: 507177 - RNA, 22 nt, Human
ugggcacaaacaucugccuguu

SEQ ID NO: 507178 - RNA, 22 nt, Human
ucugagaguagagcugccucuu

SEQ ID NO: 507179 - RNA, 22 nt, Human
cucuggaggccuaaggaagugg

SEQ ID NO: 507180 - RNA, 22 nt, Human
auugcuuuagaaagaaaaauau

SEQ ID NO: 507181 - RNA, 22 nt, Human
cagagcuggacuuaaauauauu

SEQ ID NO: 507182 - RNA, 22 nt, Human
cuggggcugcagcgaucuucau

SEQ ID NO: 507183 - RNA, 22 nt, Human
auggcagauggcuggagcaggu

SEQ ID NO: 507184 - RNA, 18 nt, Human
ugagaauguaagaaaugg

SEQ ID NO: 507185 - RNA, 22 nt, Human
aauaagcuggagcuauauugag

SEQ ID NO: 507186 - RNA, 21 nt, Human
uggccagcuggagucuccaca

SEQ ID NO: 507187 - RNA, 22 nt, Human
ugugugaauggauuauucuauu

SEQ ID NO: 507188 - RNA, 22 nt, Human
agauggggcugaaaguuccaau

SEQ ID NO: 507189 - RNA, 22 nt, Human
uggcucugucgccguuuggaau

SEQ ID NO: 507190 - RNA, 22 nt, Human
uagcagggucucaggagucagg

SEQ ID NO: 507191 - RNA, 22 nt, Human
guuuucagccaggagcacauuu

SEQ ID NO: 507192 - RNA, 22 nt, Human
gccugugcauagcagcggacuc

SEQ ID NO: 507193 - RNA, 22 nt, Human
aagagcuggcucuugcagcagc

SEQ ID NO: 507194 - RNA, 22 nt, Human
cugcccugagggccuguguguu

SEQ ID NO: 507195 - RNA, 22 nt, Human
ggacagcccauacacaugucug

SEQ ID NO: 507196 - RNA, 22 nt, Human
uuauuuucuccucagaaagugg

SEQ ID NO: 507197 - RNA, 20 nt, Human
acagaauaugcugguugugg

SEQ ID NO: 507198 - RNA, 22 nt, Human
ccagcucucugcagaaaggacu

SEQ ID NO: 507199 - RNA, 22 nt, Human
ggagacagugacuuagagacug

SEQ ID NO: 507200 - RNA, 22 nt, Human
aaauguagaccuauagggaccu

SEQ ID NO: 507201 - RNA, 22 nt, Human
aagucucagaaaacuagugugg

SEQ ID NO: 507202 - RNA, 22 nt, Human
cucaggaucgcuugcccuaggg

SEQ ID NO: 507203 - RNA, 23 nt, Human
gagagcccauuggcagggguacc

SEQ ID NO: 507204 - RNA, 22 nt, Human
cccuggagucagguuggccugg

SEQ ID NO: 507205 - RNA, 22 nt, Human
ccacuguaaguuugaaaauaac

SEQ ID NO: 507206 - RNA, 22 nt, Human
gucccuggguagcucaguggcu

SEQ ID NO: 507207 - RNA, 22 nt, Human
gugcauuugacgaauacucacu

SEQ ID NO: 507208 - RNA, 22 nt, Human
acuguacaacugcugagcagaa

SEQ ID NO: 507209 - RNA, 22 nt, Human
acugccuggccuggccucacug

SEQ ID NO: 507210 - RNA, 22 nt, Human
uucuguuuugcacagacuugaa

SEQ ID NO: 507211 - RNA, 22 nt, Human
acauuucuuuucaucucuauau

SEQ ID NO: 507212 - RNA, 22 nt, Human
ucccaaaguauuagcauuucaa

SEQ ID NO: 507213 - RNA, 22 nt, Human
cagccagggucaggcagcuucu

SEQ ID NO: 507214 - RNA, 23 nt, Human
uguaaacaucacccccuggaguu

SEQ ID NO: 507215 - RNA, 22 nt, Human
agcagcauagaagcugggagga

SEQ ID NO: 507216 - RNA, 22 nt, Human
auugcagcuggucaggguaauu

SEQ ID NO: 507217 - RNA, 22 nt, Human
caggcagcugaggacuuugcua

SEQ ID NO: 507218 - RNA, 22 nt, Human
guucugaguggcccaagcccug

SEQ ID NO: 507219 - RNA, 22 nt, Human
ucuguccucuuugaagcugcuc

SEQ ID NO: 507220 - RNA, 22 nt, Human
uaggcacaaaaugaaaauggca

SEQ ID NO: 507221 - RNA, 22 nt, Human
gguaugaaaugauuccauguua

SEQ ID NO: 507222 - RNA, 22 nt, Human
guuacucuuccccggggucugg

SEQ ID NO: 507223 - RNA, 22 nt, Human
ugagcuuccucccugcauccau

SEQ ID NO: 507224 - RNA, 22 nt, Human
cuucaggauuuaggaagaugaa

SEQ ID NO: 507225 - RNA, 22 nt, Human
ugcucuggguccugggccuccu

SEQ ID NO: 507226 - RNA, 22 nt, Human
ggcugggagccccacagaguca

SEQ ID NO: 507227 - RNA, 23 nt, Human
acaccugugcuguagucacuaca

SEQ ID NO: 507228 - RNA, 22 nt, Human
guacacacaaucucuggucagu

SEQ ID NO: 507229 - RNA, 22 nt, Human
gcuggagccauuggcuuggccu

SEQ ID NO: 507230 - RNA, 22 nt, Human
cuggcuccucaggacugcggga

SEQ ID NO: 507231 - RNA, 22 nt, Human
uuuacaagucagggacuguucu

SEQ ID NO: 507232 - RNA, 22 nt, Human
ugggaccucucuugagagagca

SEQ ID NO: 507233 - RNA, 22 nt, Human
gggacccugggaggcuggcgca

SEQ ID NO: 507234 - RNA, 22 nt, Human
uguccagggggcuuaccuggag

SEQ ID NO: 507235 - RNA, 22 nt, Human
uuuuaccugaaccacacaguau

SEQ ID NO: 507236 - RNA, 22 nt, Human
ugguccagugacagauaggcac

SEQ ID NO: 507237 - RNA, 22 nt, Human
ccacuguauuuuggaagcagau

SEQ ID NO: 507238 - RNA, 22 nt, Human
uuaaaaugaauauugauuagca

SEQ ID NO: 507239 - RNA, 22 nt, Human
ucucagugggaagggcacaguu

SEQ ID NO: 507240 - RNA, 22 nt, Human
gaauauauuggugaaaauaguu

SEQ ID NO: 507241 - RNA, 22 nt, Human
agggcuggagccacagcuggga

SEQ ID NO: 507242 - RNA, 18 nt, Human
ugguccaguucagauaua

SEQ ID NO: 507243 - RNA, 18 nt, Human
gaugggagcaagagaaga

SEQ ID NO: 507244 - RNA, 22 nt, Human
uucuuucucuguaaaaggaaaa

SEQ ID NO: 507245 - RNA, 23 nt, Human
uucaaagcuuaagcucuuuccac

SEQ ID NO: 507246 - RNA, 22 nt, Human
aaacuuguucucuugugccuau

SEQ ID NO: 507247 - RNA, 22 nt, Human
ugaggcaaagacaaagcagcau

SEQ ID NO: 507248 - RNA, 22 nt, Human
uggccuggaaccuggcagggac

SEQ ID NO: 507249 - RNA, 22 nt, Human
ggccuguguccuccuugcccug

SEQ ID NO: 507250 - RNA, 20 nt, Human
ggucccugcccucugucauc

SEQ ID NO: 507251 - RNA, 20 nt, Human
gucucaaguaucucacaguc

SEQ ID NO: 507252 - RNA, 22 nt, Human
cuguaugaaauugucauuuuua

SEQ ID NO: 507253 - RNA, 22 nt, Human
caguccugcuggccuucccugg

SEQ ID NO: 507254 - RNA, 23 nt, Human
uuuagcuucccuuuaguuagggg

SEQ ID NO: 507255 - RNA, 22 nt, Human
cuggcugccagcauuuggggga

SEQ ID NO: 507256 - RNA, 22 nt, Human
ccagcugggauuaagggaaaau

SEQ ID NO: 507257 - RNA, 22 nt, Human
uccuggcuccugaucugucacu

SEQ ID NO: 507258 - RNA, 22 nt, Human
gagcagcucagaggacuagugu

SEQ ID NO: 507259 - RNA, 22 nt, Human
acacagggucuagaguuaggcc

SEQ ID NO: 507260 - RNA, 22 nt, Human
ggugaaggcacaagagggcaag

SEQ ID NO: 507261 - RNA, 22 nt, Human
auucacaacaaaaggauaugag

SEQ ID NO: 507262 - RNA, 19 nt, Human
ccugcagggaugagagguu

SEQ ID NO: 507263 - RNA, 22 nt, Human
ccucccacauugaggacaugcu

SEQ ID NO: 507264 - RNA, 22 nt, Human
uccuuucccuuuccauccuggc

SEQ ID NO: 507265 - RNA, 19 nt, Human
gagcagcugcacccauuga

SEQ ID NO: 507266 - RNA, 20 nt, Human
cuuagcuaguaagaagcugu

SEQ ID NO: 507267 - RNA, 22 nt, Human
cacaggaggaggccagagcgua

SEQ ID NO: 507268 - RNA, 20 nt, Human
cacaacuguccacaugcucc

SEQ ID NO: 507269 - RNA, 22 nt, Human
uggcucuguugagguauggauu

SEQ ID NO: 507270 - RNA, 22 nt, Human
cugggcucuucccagauccaga

SEQ ID NO: 507271 - RNA, 22 nt, Human
ugaaggagcugauguaaggggu

SEQ ID NO: 507272 - RNA, 22 nt, Human
cugaaugaaugguuugucuuau

SEQ ID NO: 507273 - RNA, 22 nt, Human
cugugcuggcagaccuggaguu

SEQ ID NO: 507274 - RNA, 22 nt, Human
aucucuggccccugggguccga

SEQ ID NO: 507275 - RNA, 22 nt, Human
ucacagccuggucacucugccc

SEQ ID NO: 507276 - RNA, 22 nt, Human
cucugagagcggucuguggcuu

SEQ ID NO: 507277 - RNA, 22 nt, Human
gagcuggaggaccaggacuggg

SEQ ID NO: 507278 - RNA, 22 nt, Human
gcugaggccaguuuaaugagga

SEQ ID NO: 507279 - RNA, 22 nt, Human
uccacccccagacagcugguga

SEQ ID NO: 507280 - RNA, 22 nt, Human
agaaaaggauugauggaucaga

SEQ ID NO: 507281 - RNA, 22 nt, Human
ccagacuguggaguuccuggug

SEQ ID NO: 507282 - RNA, 22 nt, Human
guccugguuuucacagaccuuu

SEQ ID NO: 507283 - RNA, 22 nt, Human
cuggagucacucauguagcugc

SEQ ID NO: 507284 - RNA, 22 nt, Human
ugcacacagaugguacaugcau

SEQ ID NO: 507285 - RNA, 22 nt, Human
ggaugcuggggaccaaucucug

SEQ ID NO: 507286 - RNA, 22 nt, Human
uugcagagaucagcagguuuga

SEQ ID NO: 507287 - RNA, 22 nt, Human
uccuuagccagggcagcucaaa

SEQ ID NO: 507288 - RNA, 22 nt, Human
cagggcucgcucuugcccuucg

SEQ ID NO: 507289 - RNA, 21 nt, Human
cagcaaaucauugggcagacu

SEQ ID NO: 507290 - RNA, 22 nt, Human
uuuggucucugugcauccuccu

SEQ ID NO: 507291 - RNA, 22 nt, Human
ggcucuggggaagcucucuuca

SEQ ID NO: 507292 - RNA, 22 nt, Human
cugccucuccccagaguggccc

SEQ ID NO: 507293 - RNA, 22 nt, Human
cagugcuguuguaagcucauug

SEQ ID NO: 507294 - RNA, 22 nt, Human
ucuggggagucaaagagaccug

SEQ ID NO: 507295 - RNA, 22 nt, Human
augcccugcugcuggggcagug

SEQ ID NO: 507296 - RNA, 22 nt, Human
acagggcagugucuugaaaaau

SEQ ID NO: 507297 - RNA, 23 nt, Human
uuuagcaugaagcagcuggagaa

SEQ ID NO: 507298 - RNA, 22 nt, Human
aaugugguuaacccauuuaaga

SEQ ID NO: 507299 - RNA, 22 nt, Human
uuauuccauucaguucaacaag

SEQ ID NO: 507300 - RNA, 22 nt, Human
cccagccaaggugcugguguug

SEQ ID NO: 507301 - RNA, 22 nt, Human
gcucaggaccgaggggugggaa

SEQ ID NO: 507302 - RNA, 22 nt, Human
auuucugauacccggucacccu

SEQ ID NO: 507303 - RNA, 21 nt, Human
guccucagcugaugggagcug

SEQ ID NO: 507304 - RNA, 22 nt, Human
uuggguuuucccuugaaacuga

SEQ ID NO: 507305 - RNA, 21 nt, Human
cagaggcaggcucugugugug

SEQ ID NO: 507306 - RNA, 22 nt, Human
aaacagugacugguacauaaua

SEQ ID NO: 507307 - RNA, 22 nt, Human
aaaucaguucacguucugaggu

SEQ ID NO: 507308 - RNA, 22 nt, Human
gaaggaaaggucucaugccuuu

SEQ ID NO: 507309 - RNA, 22 nt, Human
gcucagccgaacuucagagcag

SEQ ID NO: 507310 - RNA, 17 nt, Human
gcaggcacugcugccug

SEQ ID NO: 507311 - RNA, 22 nt, Human
ugccucagagugggcuugcuau

SEQ ID NO: 507312 - RNA, 22 nt, Human
caguccugcuagugugaaaagc

SEQ ID NO: 507313 - RNA, 22 nt, Human
cugaaggagcauagucaguuuu

SEQ ID NO: 507314 - RNA, 22 nt, Human
aguguuuaaugccuuuuccagc

SEQ ID NO: 507315 - RNA, 22 nt, Human
acauuuuuacugggcaucugca

SEQ ID NO: 507316 - RNA, 20 nt, Human
acaguggguggggagcacug

SEQ ID NO: 507317 - RNA, 22 nt, Human
gcugccuccaaucugugccccg

SEQ ID NO: 507318 - RNA, 22 nt, Human
uuugaaaggagcuuuauccaga

SEQ ID NO: 507319 - RNA, 20 nt, Human
gacaggagaguuagguaggu

SEQ ID NO: 507320 - RNA, 22 nt, Human
cugccuugaggagguuguggga

SEQ ID NO: 507321 - RNA, 22 nt, Human
gccuccccugcaauuguccuug

SEQ ID NO: 507322 - RNA, 22 nt, Human
uagggcagaguccaggaugggc

SEQ ID NO: 507323 - RNA, 22 nt, Human
cagggcuccccgcaccgcagcc

SEQ ID NO: 507324 - RNA, 22 nt, Human
agaccaugggcuccugggacau

SEQ ID NO: 507325 - RNA, 22 nt, Human
cccaggguggaugcaagcagca

SEQ ID NO: 507326 - RNA, 22 nt, Human
ucagggcaagauugguuaauaa

SEQ ID NO: 507327 - RNA, 22 nt, Human
cccagcuugcgggcggcaggag

SEQ ID NO: 507328 - RNA, 22 nt, Human
aagagcaucuauuucacagugg

SEQ ID NO: 507329 - RNA, 22 nt, Human
gcuuuauuuugugagggauuac

SEQ ID NO: 507330 - RNA, 20 nt, Human
gcuuccagaggaggccccgu

SEQ ID NO: 507331 - RNA, 22 nt, Human
cagaagaguagcugaacaaguu

SEQ ID NO: 507332 - RNA, 22 nt, Human
ugcuuuauucccuucugaugug

SEQ ID NO: 507333 - RNA, 22 nt, Human
ccagagaguaaacauuuuccgg

SEQ ID NO: 507334 - RNA, 22 nt, Human
cagcacagggacaauagcagau

SEQ ID NO: 507335 - RNA, 22 nt, Human
cacaggagaaaggggaagcucg

SEQ ID NO: 507336 - RNA, 19 nt, Human
uggcucuguuucucuggag

SEQ ID NO: 507337 - RNA, 22 nt, Human
ucucagggagggcgagucagcg

SEQ ID NO: 507338 - RNA, 22 nt, Human
caugggcuacagaagcaugcug

SEQ ID NO: 507339 - RNA, 22 nt, Human
ucacaggguaucugggauggau

SEQ ID NO: 507340 - RNA, 22 nt, Human
ggcugcagaaguacuuccggau

SEQ ID NO: 507341 - RNA, 23 nt, Human
cccagcagagaugaggagggguc

SEQ ID NO: 507342 - RNA, 22 nt, Human
ugagucugggcauguucacuuu

SEQ ID NO: 507343 - RNA, 20 nt, Human
acaggggcagcacaauaaug

SEQ ID NO: 507344 - RNA, 22 nt, Human
gggcucucgauuagacccuggg

SEQ ID NO: 507345 - RNA, 23 nt, Human
gagagcugacugucaagacuguu

SEQ ID NO: 507346 - RNA, 22 nt, Human
uagaaaucauuuagaaguauug

SEQ ID NO: 507347 - RNA, 22 nt, Human
cugugacugggugacaguccuc

SEQ ID NO: 507348 - RNA, 22 nt, Human
guggcagguuccguagacagca

SEQ ID NO: 507349 - RNA, 22 nt, Human
uagaaguugcucaauaaauguu

SEQ ID NO: 507350 - RNA, 22 nt, Human
aagacagagggaagcaaugaug

SEQ ID NO: 507351 - RNA, 21 nt, Human
ugucagagcuuguaggacauu

SEQ ID NO: 507352 - RNA, 22 nt, Human
agccagccgggggaccacagug

SEQ ID NO: 507353 - RNA, 22 nt, Human
uggccaggaggcugcuucugac

SEQ ID NO: 507354 - RNA, 22 nt, Human
uugggcuggcagagguggucuu

SEQ ID NO: 507355 - RNA, 22 nt, Human
aaggggaagagaccgcagaguc

SEQ ID NO: 507356 - RNA, 22 nt, Human
ggcucccuggaaaucccgaggc

SEQ ID NO: 507357 - RNA, 22 nt, Human
aaagaugucacaagaugugaug

SEQ ID NO: 507358 - RNA, 22 nt, Human
auuucuguaguccacauucuuu

SEQ ID NO: 507359 - RNA, 22 nt, Human
cagggcaguaacgggaacaucu

SEQ ID NO: 507360 - RNA, 22 nt, Human
ggcagcugucucugaguuagca

SEQ ID NO: 507361 - RNA, 22 nt, Human
cucaggaguuggaggcuacagu

SEQ ID NO: 507362 - RNA, 22 nt, Human
cccaguguuccuugaggggcug

SEQ ID NO: 507363 - RNA, 19 nt, Human
ggcugucucggcccagcca

SEQ ID NO: 507364 - RNA, 22 nt, Human
cauguacauucuguagauggag

SEQ ID NO: 507365 - RNA, 22 nt, Human
gauugaaacauaggcagucgag

SEQ ID NO: 507366 - RNA, 22 nt, Human
ugguaaaguguacugaauauga

SEQ ID NO: 507367 - RNA, 22 nt, Human
uguacacugcaggaugcauugc

SEQ ID NO: 507368 - RNA, 18 nt, Human
ugacucacccugucagug

SEQ ID NO: 507369 - RNA, 22 nt, Human
ucagcaggcucugguugaccau

SEQ ID NO: 507370 - RNA, 22 nt, Human
cauucucaauaguagaugagua

SEQ ID NO: 507371 - RNA, 22 nt, Human
cagcuuuguggccuugaccucg

SEQ ID NO: 507372 - RNA, 22 nt, Human
uugcuauuuugagagucauagu

SEQ ID NO: 507373 - RNA, 22 nt, Human
cagcucugguuccugggcccag

SEQ ID NO: 507374 - RNA, 22 nt, Human
uccucagcuuugguuuacucau

SEQ ID NO: 507375 - RNA, 22 nt, Human
ugguuccuacgcacauugaauu

SEQ ID NO: 507376 - RNA, 20 nt, Human
uccaggcccacucagcugaa

SEQ ID NO: 507377 - RNA, 22 nt, Human
cucugagguccuucccagcucu

SEQ ID NO: 507378 - RNA, 22 nt, Human
cacauaauaaauguuccugaug

SEQ ID NO: 507379 - RNA, 22 nt, Human
aaaggcagagugcucagcuggc

SEQ ID NO: 507380 - RNA, 22 nt, Human
cacagugugggcauggugccug

SEQ ID NO: 507381 - RNA, 22 nt, Human
uccugcagcugcagaccugggg

SEQ ID NO: 507382 - RNA, 22 nt, Human
gggcagcucucacagcagccaa

SEQ ID NO: 507383 - RNA, 22 nt, Human
uaccaaauguaaucauucuaau

SEQ ID NO: 507384 - RNA, 23 nt, Human
agcuucauugaccuccgcagggg

SEQ ID NO: 507385 - RNA, 22 nt, Human
ucugggagagucuaacuuguuu

SEQ ID NO: 507386 - RNA, 22 nt, Human
cccaugagauucugaauuuggc

SEQ ID NO: 507387 - RNA, 22 nt, Human
ucugcagcuucuugccagagag

SEQ ID NO: 507388 - RNA, 22 nt, Human
uaaaugcaaugugcuuuaccag

SEQ ID NO: 507389 - RNA, 22 nt, Human
ugcacuggggucccagcgcacg

SEQ ID NO: 507390 - RNA, 22 nt, Human
auuagcuucaaagccaucaacc

SEQ ID NO: 507391 - RNA, 22 nt, Human
aggguccuaagccucagauaag

SEQ ID NO: 507392 - RNA, 22 nt, Human
cagcucugcugggaggaugcag

SEQ ID NO: 507393 - RNA, 20 nt, Human
cugagcccccagccugcagg

SEQ ID NO: 507394 - RNA, 22 nt, Human
ugcugggggcuuucuggauacc

SEQ ID NO: 507395 - RNA, 22 nt, Human
augaguaagaccauaauuuuug

SEQ ID NO: 507396 - RNA, 22 nt, Human
uuuuaaucaugcuucuaugucc

SEQ ID NO: 507397 - RNA, 22 nt, Human
cccuggaggagcuuagagcuug

SEQ ID NO: 507398 - RNA, 22 nt, Human
aggcuccaccccgccagaccuu

SEQ ID NO: 507399 - RNA, 22 nt, Human
gaaggaggucugauacaauaug

SEQ ID NO: 507400 - RNA, 22 nt, Human
gccuggagcagacgugucccgg

SEQ ID NO: 507401 - RNA, 22 nt, Human
acagggcauuuccucuaugugu

SEQ ID NO: 507402 - RNA, 22 nt, Human
cuguuaaaugagaaagcagacu

SEQ ID NO: 507403 - RNA, 22 nt, Human
gccugagauucugcauuucuaa

SEQ ID NO: 507404 - RNA, 22 nt, Human
ucaucacauguguagucauccc

SEQ ID NO: 507405 - RNA, 22 nt, Human
gcucuggagauggagccuugag

SEQ ID NO: 507406 - RNA, 20 nt, Human
agcacagcgcgguguuccuu

SEQ ID NO: 507407 - RNA, 21 nt, Human
ccaggucuugguccuuggacu

SEQ ID NO: 507408 - RNA, 22 nt, Human
ucuuugcagaauuuaacuuugc

SEQ ID NO: 507409 - RNA, 22 nt, Human
cugugcaagcccaagauaaaac

SEQ ID NO: 507410 - RNA, 22 nt, Human
aucaacagugaagagaucaaga

SEQ ID NO: 507411 - RNA, 22 nt, Human
cuccagaagacccauccucaug

SEQ ID NO: 507412 - RNA, 22 nt, Human
gccuagagaaaaagccucugca

SEQ ID NO: 507413 - RNA, 22 nt, Human
gagcagagcuucucaaaguaaa

SEQ ID NO: 507414 - RNA, 22 nt, Human
gcagcucucuggccugcccugg

SEQ ID NO: 507415 - RNA, 22 nt, Human
auuuuucucuccacuccauuaa

SEQ ID NO: 507416 - RNA, 22 nt, Human
cuccugggcugucggcgcucug

SEQ ID NO: 507417 - RNA, 22 nt, Human
acauauugagcucuaaaaguac

SEQ ID NO: 507418 - RNA, 22 nt, Human
ugaaauaucauuuucaucuccc

SEQ ID NO: 507419 - RNA, 22 nt, Human
aaugaacacagcccucuacuuu

SEQ ID NO: 507420 - RNA, 21 nt, Human
acagucuccccagaucucucc

SEQ ID NO: 507421 - RNA, 22 nt, Human
gucagggcuccacucacccucc

SEQ ID NO: 507422 - RNA, 22 nt, Human
accugccucagugcagcuggau

SEQ ID NO: 507423 - RNA, 22 nt, Human
ucugggcugggagcguguggac

SEQ ID NO: 507424 - RNA, 17 nt, Human
guccugggaggagagag

SEQ ID NO: 507425 - RNA, 22 nt, Human
gcagcuuuagaaacaagggcug

SEQ ID NO: 507426 - RNA, 22 nt, Human
gggaaacuguccaguucucccc

SEQ ID NO: 507427 - RNA, 22 nt, Human
cggcagcuccgcgccguaggac

SEQ ID NO: 507428 - RNA, 22 nt, Human
aggagcagaacuguuguggagg

SEQ ID NO: 507429 - RNA, 22 nt, Human
cuugaaagcacuuaguaaauua

SEQ ID NO: 507430 - RNA, 22 nt, Human
gucccacugggcaacuagaaaa

SEQ ID NO: 507431 - RNA, 22 nt, Human
gcaguguuacuugguuugcaga

SEQ ID NO: 507432 - RNA, 22 nt, Human
uuguggaagcccuaugagagac

SEQ ID NO: 507433 - RNA, 22 nt, Human
ugggcugcuucuauuggugguc

SEQ ID NO: 507434 - RNA, 22 nt, Human
aaagccuggguuccucacuauc

SEQ ID NO: 507435 - RNA, 22 nt, Human
auugugaauagugccgcaguaa

SEQ ID NO: 507436 - RNA, 22 nt, Human
ucagcccuuccuggagcuuuua

SEQ ID NO: 507437 - RNA, 22 nt, Human
aaagauuuaugaaguucaauua

SEQ ID NO: 507438 - RNA, 22 nt, Human
aaaaaugaauucuucaguggca

SEQ ID NO: 507439 - RNA, 22 nt, Human
gccaagcucaccuucugaugga

SEQ ID NO: 507440 - RNA, 22 nt, Human
uggaagccaggcccgcuccuaa

SEQ ID NO: 507441 - RNA, 22 nt, Human
augcagaaagcggcaaacaggu

SEQ ID NO: 507442 - RNA, 22 nt, Human
agcagcagauucagcaggaaug

SEQ ID NO: 507443 - RNA, 22 nt, Human
gaaacauucagucaacaguguu

SEQ ID NO: 507444 - RNA, 22 nt, Human
uauguacauaacaugaaaugca

SEQ ID NO: 507445 - RNA, 22 nt, Human
ugggagagaauucuggugacug

SEQ ID NO: 507446 - RNA, 22 nt, Human
gagcagagacaguacaacuggc

SEQ ID NO: 507447 - RNA, 22 nt, Human
guuugccugugauguacauuuc

SEQ ID NO: 507448 - RNA, 22 nt, Human
ugugggcucccccucacucugu

SEQ ID NO: 507449 - RNA, 22 nt, Human
cagcucuggcuauugaggacca

SEQ ID NO: 507450 - RNA, 22 nt, Human
cuccagggagcuguggagguuu

SEQ ID NO: 507451 - RNA, 22 nt, Human
ucugagcuucugcauuuccaac

SEQ ID NO: 507452 - RNA, 22 nt, Human
uaugaaauuucuaguucugcuu

SEQ ID NO: 507453 - RNA, 22 nt, Human
aaaucuggccccuugccuauuu

SEQ ID NO: 507454 - RNA, 22 nt, Human
ugcucuggaaauaaaugauuua

SEQ ID NO: 507455 - RNA, 22 nt, Human
agugugagccuacaggccaaag

SEQ ID NO: 507456 - RNA, 22 nt, Human
uauagaaguaagcauugugaug

SEQ ID NO: 507457 - RNA, 22 nt, Human
uggcugugcggccucgggcaga

SEQ ID NO: 507458 - RNA, 22 nt, Human
cucucugggaauauuuuauucu

SEQ ID NO: 507459 - RNA, 22 nt, Human
aaucucuugggaggaaugaauu

SEQ ID NO: 507460 - RNA, 22 nt, Human
agcugccaucugaagaacugca

SEQ ID NO: 507461 - RNA, 22 nt, Human
uccugagggacugguuccucgc

SEQ ID NO: 507462 - RNA, 22 nt, Human
agagaggcugggcguagggcuu

SEQ ID NO: 507463 - RNA, 21 nt, Human
uccauuguuuucccaggguuu

SEQ ID NO: 507464 - RNA, 22 nt, Human
aaugcaaagcucuuuaauccuu

SEQ ID NO: 507465 - RNA, 22 nt, Human
ggcagggugccuggcuccuguu

SEQ ID NO: 507466 - RNA, 22 nt, Human
uuccuugaccacugcauaauga

SEQ ID NO: 507467 - RNA, 22 nt, Human
ggggauggauuccgggucccug

SEQ ID NO: 507468 - RNA, 22 nt, Human
gggcugacaaccaucugacaag

SEQ ID NO: 507469 - RNA, 22 nt, Human
ugggggugcugagaagacagga

SEQ ID NO: 507470 - RNA, 22 nt, Human
aauaagcugcuaggaacuuagu

SEQ ID NO: 507471 - RNA, 22 nt, Human
auuagcuuaucacacaagcugc

SEQ ID NO: 507472 - RNA, 22 nt, Human
ugggcuuaggucggaggcggcc

SEQ ID NO: 507473 - RNA, 21 nt, Human
aucucgggcuucucgcccagc

SEQ ID NO: 507474 - RNA, 22 nt, Human
uacauacacaaauauacuguuu

SEQ ID NO: 507475 - RNA, 22 nt, Human
ccuggcuccgugucacgugccc

SEQ ID NO: 507476 - RNA, 22 nt, Human
cugagcagugcuuugcaguggg

SEQ ID NO: 507477 - RNA, 22 nt, Human
ugugacagugccagcuucauag

SEQ ID NO: 507478 - RNA, 22 nt, Human
cugagggcuggagcugaggccu

SEQ ID NO: 507479 - RNA, 22 nt, Human
gcacccagcccagggcgugaug

SEQ ID NO: 507480 - RNA, 22 nt, Human
agaagccagauuguagugggac

SEQ ID NO: 507481 - RNA, 22 nt, Human
agucucugccagcuuguccucu

SEQ ID NO: 507482 - RNA, 22 nt, Human
ggaaagauuugucacaugaaug

SEQ ID NO: 507483 - RNA, 22 nt, Human
uccugggcgauuuucugaauau

SEQ ID NO: 507484 - RNA, 22 nt, Human
acaggacagguaggauucgcag

SEQ ID NO: 507485 - RNA, 22 nt, Human
gccaaaucuugcacacucuugu

SEQ ID NO: 507486 - RNA, 22 nt, Human
auaaugcauuuagaauaauuca

SEQ ID NO: 507487 - RNA, 21 nt, Human
cugugcuucuuccuaagccag

SEQ ID NO: 507488 - RNA, 22 nt, Human
uucaacuuuggagauuuaauaa

SEQ ID NO: 507489 - RNA, 22 nt, Human
aagggcucugcugucucucccc

SEQ ID NO: 507490 - RNA, 22 nt, Human
cuguggcucucagaggcugcug

SEQ ID NO: 507491 - RNA, 22 nt, Human
gaaguucucagcuaggugaugu

SEQ ID NO: 507492 - RNA, 22 nt, Human
guccucuguguaggcugcagac

SEQ ID NO: 507493 - RNA, 22 nt, Human
gcagagcuucuguccuucagga

SEQ ID NO: 507494 - RNA, 22 nt, Human
uuccuuccgggcaccaggcacu

SEQ ID NO: 507495 - RNA, 22 nt, Human
agcugcugcgccucacccuggc

SEQ ID NO: 507496 - RNA, 22 nt, Human
gagguagcaugcuggaagggac

SEQ ID NO: 507497 - RNA, 22 nt, Human
gcaguggcuaagcucgcaugca

SEQ ID NO: 507498 - RNA, 23 nt, Human
ccaagacuguuaggaguggggag

SEQ ID NO: 507499 - RNA, 19 nt, Human
ugaucuggaaggaaccagg

SEQ ID NO: 507500 - RNA, 22 nt, Human
auaugaagucagacaaacuggg

SEQ ID NO: 507501 - RNA, 22 nt, Human
uucauggaucaugccuuuugug

SEQ ID NO: 507502 - RNA, 22 nt, Human
uugaacagcuguuacauuguua

SEQ ID NO: 507503 - RNA, 22 nt, Human
agaaaauaauuucuuggcuggu

SEQ ID NO: 507504 - RNA, 20 nt, Human
aggcucagcugagcucuugg

SEQ ID NO: 507505 - RNA, 22 nt, Human
auuauucuuaugucaucauggc

SEQ ID NO: 507506 - RNA, 22 nt, Human
ccacugggggcugcucccaggu

SEQ ID NO: 507507 - RNA, 22 nt, Human
uagcuuuagugaaaaauaucag

SEQ ID NO: 507508 - RNA, 22 nt, Human
augucccagcugagagacaacu

SEQ ID NO: 507509 - RNA, 22 nt, Human
ucacauuuucuacuacuguacg

SEQ ID NO: 507510 - RNA, 22 nt, Human
aaucuggcauguaagcuuagag

SEQ ID NO: 507511 - RNA, 22 nt, Human
uuggcuucugauguauuccuga

SEQ ID NO: 507512 - RNA, 22 nt, Human
gaugaagccccaguguaaguaa

SEQ ID NO: 507513 - RNA, 22 nt, Human
ugagaauuacaaaugagucaca

SEQ ID NO: 507514 - RNA, 22 nt, Human
acauucuguuuccccaaagaga

SEQ ID NO: 507515 - RNA, 22 nt, Human
ugugucuguuuugcucaccauu

SEQ ID NO: 507516 - RNA, 22 nt, Human
uccugcagccuugggcuggagc

SEQ ID NO: 507517 - RNA, 22 nt, Human
ugguccaguucugugauauugc

SEQ ID NO: 507518 - RNA, 22 nt, Human
ggaugcacgaaggcgccucgga

SEQ ID NO: 507519 - RNA, 22 nt, Human
gcaggagcuggaaagugauguu

SEQ ID NO: 507520 - RNA, 22 nt, Human
uucuacaucacuuaacaugcua

SEQ ID NO: 507521 - RNA, 22 nt, Human
ggcuccagcccuggcucuucac

SEQ ID NO: 507522 - RNA, 22 nt, Human
gggugggaucuguggagccuca

SEQ ID NO: 507523 - RNA, 20 nt, Human
gauacacagcacagagggcc

SEQ ID NO: 507524 - RNA, 22 nt, Human
ucagguccucugggucccagcc

SEQ ID NO: 507525 - RNA, 22 nt, Human
uaggguccaagccuuauaauua

SEQ ID NO: 507526 - RNA, 22 nt, Human
uggcccugacagguccugggca

SEQ ID NO: 507527 - RNA, 22 nt, Human
accuucaacucaaaguguccca

SEQ ID NO: 507528 - RNA, 22 nt, Human
aaguucaaggaagccuccaguu

SEQ ID NO: 507529 - RNA, 22 nt, Human
uuaaacagguuuuugaauggcc

SEQ ID NO: 507530 - RNA, 22 nt, Human
uucugguucucaggaaugcuaa

SEQ ID NO: 507531 - RNA, 22 nt, Human
cagcacuaggauauacauuucc

SEQ ID NO: 507532 - RNA, 22 nt, Human
ucccaggcuaggccucugcguu

SEQ ID NO: 507533 - RNA, 22 nt, Human
aacagcuugcugcaccuuaaua

SEQ ID NO: 507534 - RNA, 22 nt, Human
gagagcuguaauagucaugucu

SEQ ID NO: 507535 - RNA, 22 nt, Human
uggcucuguuuguuaacuagac

SEQ ID NO: 507536 - RNA, 22 nt, Human
aggugggcccagugggcuccag

SEQ ID NO: 507537 - RNA, 22 nt, Human
caggcagaagaaguggaaggac

SEQ ID NO: 507538 - RNA, 22 nt, Human
ugcugucuguuuacuggcuaua

SEQ ID NO: 507539 - RNA, 22 nt, Human
aaaauauuuuagggccaggaga

SEQ ID NO: 507540 - RNA, 22 nt, Human
agacucaagacugcagaagacg

SEQ ID NO: 507541 - RNA, 22 nt, Human
ugguccugccccgugcacagag

SEQ ID NO: 507542 - RNA, 22 nt, Human
caggggccggcuguccgugccc

SEQ ID NO: 507543 - RNA, 22 nt, Human
ugaaaucuuauacuuugguagu

SEQ ID NO: 507544 - RNA, 22 nt, Human
ucaguguuuacaugcauccuug

SEQ ID NO: 507545 - RNA, 22 nt, Human
uguuuuuccaugugcagaacaa

SEQ ID NO: 507546 - RNA, 22 nt, Human
caggcaggcugcuuuuuguuca

SEQ ID NO: 507547 - RNA, 22 nt, Human
uccugccugagcguggaggagg

SEQ ID NO: 507548 - RNA, 22 nt, Human
uuaaauaguaggucuauuuugg

SEQ ID NO: 507549 - RNA, 21 nt, Human
agaaaauggcguuuuagauuu

SEQ ID NO: 507550 - RNA, 23 nt, Human
uccugagaugagacagugcugcc

SEQ ID NO: 507551 - RNA, 22 nt, Human
ccagagcugaugggcccagggu

SEQ ID NO: 507552 - RNA, 22 nt, Human
gagggguccaggaggcacuuac

SEQ ID NO: 507553 - RNA, 22 nt, Human
guucacauccuugugaggauuu

SEQ ID NO: 507554 - RNA, 22 nt, Human
cauguuuuguguacagaauauu

SEQ ID NO: 507555 - RNA, 22 nt, Human
ggguuccuccaguuccuagagc

SEQ ID NO: 507556 - RNA, 22 nt, Human
gcagcuggcccugacacgcaga

SEQ ID NO: 507557 - RNA, 22 nt, Human
aaagugcugggauuacaagugu

SEQ ID NO: 507558 - RNA, 22 nt, Human
auguccuggucuagcuuccggg

SEQ ID NO: 507559 - RNA, 22 nt, Human
uugcagcuuagugauguuaucu

SEQ ID NO: 507560 - RNA, 18 nt, Human
gaagugaagugacucaau

SEQ ID NO: 507561 - RNA, 22 nt, Human
ucugcagauuuaucagcagcug

SEQ ID NO: 507562 - RNA, 22 nt, Human
ggcagcaggcgacuucccuauu

SEQ ID NO: 507563 - RNA, 22 nt, Human
guccagggggcuuaagcaaacu

SEQ ID NO: 507564 - RNA, 22 nt, Human
uguaaaaccaaaucaaucuagu

SEQ ID NO: 507565 - RNA, 22 nt, Human
cacauuucugugagucaauauu

SEQ ID NO: 507566 - RNA, 22 nt, Human
aaguguauauaugacuuauaaa

SEQ ID NO: 507567 - RNA, 18 nt, Human
uggcucagauggcuuuaa

SEQ ID NO: 507568 - RNA, 22 nt, Human
gauacauuuuaucuccuaacag

SEQ ID NO: 507569 - RNA, 22 nt, Human
agacacaguauaagcacaacaa

SEQ ID NO: 507570 - RNA, 22 nt, Human
cacaguaagaaaugaagaggua

SEQ ID NO: 507571 - RNA, 22 nt, Human
uugggggcagagggagcaucug

SEQ ID NO: 507572 - RNA, 22 nt, Human
uuucauaaugucacagucaaaa

SEQ ID NO: 507573 - RNA, 22 nt, Human
cuuccagagauagggccucaag

SEQ ID NO: 507574 - RNA, 22 nt, Human
aggcagagcuaggaagaauugu

SEQ ID NO: 507575 - RNA, 22 nt, Human
ggccccaggaccuccacggucc

SEQ ID NO: 507576 - RNA, 22 nt, Human
ugggcaugaguggacagagaag

SEQ ID NO: 507577 - RNA, 22 nt, Human
guccugggggcagcugugucca

SEQ ID NO: 507578 - RNA, 22 nt, Human
cccaggauggggcugcaguuau

SEQ ID NO: 507579 - RNA, 22 nt, Human
uagaagaacaugucaaacuaua

SEQ ID NO: 507580 - RNA, 22 nt, Human
cccuucagcugagugggacagc

SEQ ID NO: 507581 - RNA, 22 nt, Human
guuuuauaggugaaauauuacu

SEQ ID NO: 507582 - RNA, 22 nt, Human
cucuggcuuugcucaugcaucc

SEQ ID NO: 507583 - RNA, 22 nt, Human
aaauccuaaaaguuugacuuaa

SEQ ID NO: 507584 - RNA, 22 nt, Human
uuuauugacccaaagcgagagu

SEQ ID NO: 507585 - RNA, 23 nt, Human
agguuacaguuguuaaguugcaa

SEQ ID NO: 507586 - RNA, 22 nt, Human
gcaguccauugacagaggucuu

SEQ ID NO: 507587 - RNA, 22 nt, Human
auucacaugugcuucuuaucac

SEQ ID NO: 507588 - RNA, 22 nt, Human
ggcagguacagcaagaggacaa

SEQ ID NO: 507589 - RNA, 22 nt, Human
cacugccuccccaggcuccaca

SEQ ID NO: 507590 - RNA, 22 nt, Human
augaaggauggcuggcugcccu

SEQ ID NO: 507591 - RNA, 22 nt, Human
aucuggaaaacacaguguagac

SEQ ID NO: 507592 - RNA, 22 nt, Human
gcugucacaagcaucuggggca

SEQ ID NO: 507593 - RNA, 22 nt, Human
caaugauggcuaggcagcugcu

SEQ ID NO: 507594 - RNA, 22 nt, Human
augacagaugcuguggggaggu

SEQ ID NO: 507595 - RNA, 19 nt, Human
gcuucccaccagccagccc

SEQ ID NO: 507596 - RNA, 22 nt, Human
ugggcaggaugcguugauucuu

SEQ ID NO: 507597 - RNA, 22 nt, Human
agccugagccccauccagcuga

SEQ ID NO: 507598 - RNA, 20 nt, Human
auacacauucauagaaaaau

SEQ ID NO: 507599 - RNA, 22 nt, Human
uguugaguauauaccuacaagu

SEQ ID NO: 507600 - RNA, 22 nt, Human
uccugaggugcucagccaggaa

SEQ ID NO: 507601 - RNA, 22 nt, Human
guacauuuuacuuuguuugaau

SEQ ID NO: 507602 - RNA, 22 nt, Human
ccacccagcagaggaggcaaga

SEQ ID NO: 507603 - RNA, 22 nt, Human
ggcuucugccacgagagggaag

SEQ ID NO: 507604 - RNA, 22 nt, Human
aggucugaguauggccugagaa

SEQ ID NO: 507605 - RNA, 22 nt, Human
caggccaggugcucuagaauca

SEQ ID NO: 507606 - RNA, 22 nt, Human
ccaggccauucccagaguugcu

SEQ ID NO: 507607 - RNA, 22 nt, Human
gagucuggacuauucuggucuu

SEQ ID NO: 507608 - RNA, 22 nt, Human
ggagucuucagauagaguauuu

SEQ ID NO: 507609 - RNA, 22 nt, Human
ucacacaugaguaaauacaggg

SEQ ID NO: 507610 - RNA, 22 nt, Human
ucaggcagagcuguggagcucu

SEQ ID NO: 507611 - RNA, 22 nt, Human
agucacaugggauuagaaccca

SEQ ID NO: 507612 - RNA, 22 nt, Human
aaagaggaaccaagagcacgug

SEQ ID NO: 507613 - RNA, 22 nt, Human
uacacacagaggccaugggauu

SEQ ID NO: 507614 - RNA, 22 nt, Human
guaggcagaccaguggaugggu

SEQ ID NO: 507615 - RNA, 22 nt, Human
uccuggccuugcgucuugggag

SEQ ID NO: 507616 - RNA, 22 nt, Human
gugcugggcccugagaccaggg

SEQ ID NO: 507617 - RNA, 22 nt, Human
cacccaggcuagagugcagugg

SEQ ID NO: 507618 - RNA, 22 nt, Human
ucuucucaguuucucuaggaug

SEQ ID NO: 507619 - RNA, 22 nt, Human
agcaaguaguaccaaguagcuc

SEQ ID NO: 507620 - RNA, 22 nt, Human
caguagcauguaauaaagacag

SEQ ID NO: 507621 - RNA, 22 nt, Human
agagccugggaauuugcauguu

SEQ ID NO: 507622 - RNA, 22 nt, Human
agagaucaguuaaaaucuuuuu

SEQ ID NO: 507623 - RNA, 22 nt, Human
uauacagcuauggcaagacaaa

SEQ ID NO: 507624 - RNA, 22 nt, Human
ucagguggcuuggagggggacg

SEQ ID NO: 507625 - RNA, 22 nt, Human
ugagcccaggaguuggaggcug

SEQ ID NO: 507626 - RNA, 22 nt, Human
aacagcuauucacuacuauggg

SEQ ID NO: 507627 - RNA, 22 nt, Human
cuccaggacacuaacccaggcu

SEQ ID NO: 507628 - RNA, 22 nt, Human
auauuugucaauucacuguuca

SEQ ID NO: 507629 - RNA, 22 nt, Human
ucaaaaauguuuuauauuggua

SEQ ID NO: 507630 - RNA, 22 nt, Human
ugaaggaaugagggaguggguc

SEQ ID NO: 507631 - RNA, 22 nt, Human
augccagucaaagaagaugaca

SEQ ID NO: 507632 - RNA, 22 nt, Human
gcaaaugcuaaaguguagagac

SEQ ID NO: 507633 - RNA, 22 nt, Human
gagccuggggacccuccugagu

SEQ ID NO: 507634 - RNA, 22 nt, Human
uuguuuuaucuuucuacagacu

SEQ ID NO: 507635 - RNA, 22 nt, Human
ggugggcaacauuuggccugag

SEQ ID NO: 507636 - RNA, 22 nt, Human
accuucaaacuagauagaaguu

SEQ ID NO: 507637 - RNA, 22 nt, Human
gucugggcaccuggccugggaa

SEQ ID NO: 507638 - RNA, 23 nt, Human
ccuucagaagaaguaacaggggc

SEQ ID NO: 507639 - RNA, 22 nt, Human
cugacccauauaagaguggagg

SEQ ID NO: 507640 - RNA, 22 nt, Human
augcagaacguuugugaaacuu

SEQ ID NO: 507641 - RNA, 23 nt, Human
agaaggguccuuggcagcgacag

SEQ ID NO: 507642 - RNA, 22 nt, Human
ugugccauuucuauucugcagc

SEQ ID NO: 507643 - RNA, 22 nt, Human
ccuggcugggguagaagugagg

SEQ ID NO: 507644 - RNA, 22 nt, Human
uaagauguacaaccacuucucu

SEQ ID NO: 507645 - RNA, 22 nt, Human
aguuagagacacaugcacaugc

SEQ ID NO: 507646 - RNA, 22 nt, Human
uggcccucagucuugcuccugc

SEQ ID NO: 507647 - RNA, 20 nt, Human
uggaaggcaucugcauuauu

SEQ ID NO: 507648 - RNA, 22 nt, Human
uggcucagagcagggacucugg

SEQ ID NO: 507649 - RNA, 22 nt, Human
uucaggauggcggauguugggg

SEQ ID NO: 507650 - RNA, 22 nt, Human
aaauccuaagcagaggaauuua

SEQ ID NO: 507651 - RNA, 20 nt, Human
ugcugcaguuucaugggacu

SEQ ID NO: 507652 - RNA, 22 nt, Human
cuguuuguuggcuauugacagu

SEQ ID NO: 507653 - RNA, 22 nt, Human
ugaaacuuuugagguucuucca

SEQ ID NO: 507654 - RNA, 22 nt, Human
uccagaccuagggcaccccagu

SEQ ID NO: 507655 - RNA, 22 nt, Human
guuucuaagggagagcugccag

SEQ ID NO: 507656 - RNA, 22 nt, Human
gguggguuuggaagagcaggcu

SEQ ID NO: 507657 - RNA, 23 nt, Human
guuuucaacacaauaaauguaac

SEQ ID NO: 507658 - RNA, 22 nt, Human
gguuucaacuaaaucaagaagg

SEQ ID NO: 507659 - RNA, 22 nt, Human
ucugagcuuuagcugggauuuu

SEQ ID NO: 507660 - RNA, 22 nt, Human
cucagacacagccccacgaagu

SEQ ID NO: 507661 - RNA, 22 nt, Human
cccagccucuggguucugccgg

SEQ ID NO: 507662 - RNA, 22 nt, Human
cuaugagaagaaaacaagauua

SEQ ID NO: 507663 - RNA, 22 nt, Human
ugacagagcauguagugacagc

SEQ ID NO: 507664 - RNA, 22 nt, Human
auuagcuuaucccauuucugaa

SEQ ID NO: 507665 - RNA, 22 nt, Human
uggcucaggccacuucuuuuau

SEQ ID NO: 507666 - RNA, 22 nt, Human
uccaggaauagaucagagauuu

SEQ ID NO: 507667 - RNA, 22 nt, Human
caaaguauauuucauagucuca

SEQ ID NO: 507668 - RNA, 22 nt, Human
agauaacucauuuuguauaucc

SEQ ID NO: 507669 - RNA, 22 nt, Human
uccugggaagagaccugagcau

SEQ ID NO: 507670 - RNA, 22 nt, Human
ugagaaagugggugccuagcaa

SEQ ID NO: 507671 - RNA, 19 nt, Human
ggcugggucuggcagguuc

SEQ ID NO: 507672 - RNA, 22 nt, Human
uggucaacaggcagggaugaaa

SEQ ID NO: 507673 - RNA, 22 nt, Human
agguucagaugacuuuuaugcu

SEQ ID NO: 507674 - RNA, 22 nt, Human
gugaaaauaaggcugguucuug

SEQ ID NO: 507675 - RNA, 22 nt, Human
uucacaguggcccucucugagu

SEQ ID NO: 507676 - RNA, 22 nt, Human
aaucuggcauuugagaguagga

SEQ ID NO: 507677 - RNA, 22 nt, Human
uaaaugagauguacauaacuca

SEQ ID NO: 507678 - RNA, 22 nt, Human
aagcagaauuucccacuaguug

SEQ ID NO: 507679 - RNA, 19 nt, Human
ggcggguggacuggagccc

SEQ ID NO: 507680 - RNA, 22 nt, Human
ugcccucucaaguugagucaga

SEQ ID NO: 507681 - RNA, 22 nt, Human
aaaggucauugaaaaggaggaa

SEQ ID NO: 507682 - RNA, 22 nt, Human
uuagcauuguacauuugugcuu

SEQ ID NO: 507683 - RNA, 22 nt, Human
cucuccagccacagaagcugcu

SEQ ID NO: 507684 - RNA, 22 nt, Human
uguccagggauggggucaggga

SEQ ID NO: 507685 - RNA, 22 nt, Human
aagcagagaaaagcuuagguuc

SEQ ID NO: 507686 - RNA, 22 nt, Human
uccuggcuuccacaccugucau

SEQ ID NO: 507687 - RNA, 22 nt, Human
agccacagucaaccuguccaua

SEQ ID NO: 507688 - RNA, 18 nt, Human
guccacagcccucacagc

SEQ ID NO: 507689 - RNA, 22 nt, Human
ccaaggcaggggaucaaaguuu

SEQ ID NO: 507690 - RNA, 22 nt, Human
gaggguccccaugcagagcuca

SEQ ID NO: 507691 - RNA, 22 nt, Human
cagaagccugccucagaugcac

SEQ ID NO: 507692 - RNA, 22 nt, Human
ugcaggcuuggaucacaucucc

SEQ ID NO: 507693 - RNA, 22 nt, Human
aagggagccaagaaagcagggc

SEQ ID NO: 507694 - RNA, 19 nt, Human
gccagcagaaugaugaggc

SEQ ID NO: 507695 - RNA, 22 nt, Human
cucaucugauaaaucacucuua

SEQ ID NO: 507696 - RNA, 22 nt, Human
cuggccuuggugcuugcagaca

SEQ ID NO: 507697 - RNA, 22 nt, Human
uuugucuuguaaguuaaauuca

SEQ ID NO: 507698 - RNA, 22 nt, Human
uagcacaucuggcgcuuauagg

SEQ ID NO: 507699 - RNA, 22 nt, Human
uuugucaucccuuuugaaacug

SEQ ID NO: 507700 - RNA, 22 nt, Human
cccagcauggagugaggacuca

SEQ ID NO: 507701 - RNA, 22 nt, Human
aaagugcacuagaauccagauu

SEQ ID NO: 507702 - RNA, 22 nt, Human
gucaauauauucugucucuuug

SEQ ID NO: 507703 - RNA, 22 nt, Human
cccaggagguagagguugcagu

SEQ ID NO: 507704 - RNA, 22 nt, Human
agacucugugcuccuugcuuuc

SEQ ID NO: 507705 - RNA, 22 nt, Human
augcugaaaauuggauuugaau

SEQ ID NO: 507706 - RNA, 22 nt, Human
cagcagcuuuugcauucucauu

SEQ ID NO: 507707 - RNA, 22 nt, Human
ccugggugacccgugagcgucc

SEQ ID NO: 507708 - RNA, 22 nt, Human
gaggccugggagccuguccucc

SEQ ID NO: 507709 - RNA, 22 nt, Human
agauuuguauagaugugguuga

SEQ ID NO: 507710 - RNA, 22 nt, Human
cuuuuuccagcuucaggguggg

SEQ ID NO: 507711 - RNA, 22 nt, Human
gcugucuccauagcuguguguc

SEQ ID NO: 507712 - RNA, 22 nt, Human
ugaguccaccuuaguauauggg

SEQ ID NO: 507713 - RNA, 22 nt, Human
gaaggagggugcggaucugagc

SEQ ID NO: 507714 - RNA, 22 nt, Human
aguuucucuagagucuuugaaa

SEQ ID NO: 507715 - RNA, 22 nt, Human
aguaugaagcugaaugauuuua

SEQ ID NO: 507716 - RNA, 22 nt, Human
caaguccaggugggcaaauaaa

SEQ ID NO: 507717 - RNA, 22 nt, Human
ugagagucuguuccucuugcag

SEQ ID NO: 507718 - RNA, 22 nt, Human
ccaggccuucugaggacacucu

SEQ ID NO: 507719 - RNA, 22 nt, Human
agucugggugugaaugaacuug

SEQ ID NO: 507720 - RNA, 22 nt, Human
ucacuguauuugcugaugcaua

SEQ ID NO: 507721 - RNA, 22 nt, Human
aagccuuccugagugcaaggcc

SEQ ID NO: 507722 - RNA, 22 nt, Human
agcagaaucuguccuuggaaga

SEQ ID NO: 507723 - RNA, 22 nt, Human
caagacaagaucuaagcaugcu

SEQ ID NO: 507724 - RNA, 22 nt, Human
gugggccucuugaggguggcua

SEQ ID NO: 507725 - RNA, 22 nt, Human
cagaguaaaccugucaucaaga

SEQ ID NO: 507726 - RNA, 22 nt, Human
ucccuggccauuccucuaggcc

SEQ ID NO: 507727 - RNA, 22 nt, Human
ccagcuucucucugaugcagcu

SEQ ID NO: 507728 - RNA, 22 nt, Human
gugcagggcagccgaaugggcu

SEQ ID NO: 507729 - RNA, 22 nt, Human
auacauguugagaaaauaucug

SEQ ID NO: 507730 - RNA, 22 nt, Human
uugucugaaaagguaaauauuu

SEQ ID NO: 507731 - RNA, 22 nt, Human
uguggcucucaugcacucccag

SEQ ID NO: 507732 - RNA, 21 nt, Human
agaugcaguuugcaggugggu

SEQ ID NO: 507733 - RNA, 22 nt, Human
uuagccauuugaggucuucauu

SEQ ID NO: 507734 - RNA, 22 nt, Human
ggucucgagccaggcagcugca

SEQ ID NO: 507735 - RNA, 22 nt, Human
agcagcugagaugguaagauuc

SEQ ID NO: 507736 - RNA, 21 nt, Human
ugggggagaauugguugcuuu

SEQ ID NO: 507737 - RNA, 22 nt, Human
cucucagugccacacagccauu

SEQ ID NO: 507738 - RNA, 22 nt, Human
aguaaaugaaagcaauuuuaga

SEQ ID NO: 507739 - RNA, 22 nt, Human
acagaacugggaaaugcacaua

SEQ ID NO: 507740 - RNA, 22 nt, Human
acugggccuguacagagaaaac

SEQ ID NO: 507741 - RNA, 22 nt, Human
cccuggcacuagcgacggccau

SEQ ID NO: 507742 - RNA, 22 nt, Human
ggagcagccgcgucucagggca

SEQ ID NO: 507743 - RNA, 22 nt, Human
aaagugggaacaauggagagug

SEQ ID NO: 507744 - RNA, 22 nt, Human
ccaggacuucgaggcuacagug

SEQ ID NO: 507745 - RNA, 22 nt, Human
ccagcuggugacauccccaacc

SEQ ID NO: 507746 - RNA, 20 nt, Human
caguccugucccugcugccc

SEQ ID NO: 507747 - RNA, 22 nt, Human
ucaaggugcugugcugugcuag

SEQ ID NO: 507748 - RNA, 22 nt, Human
ucccacaccugucuauuccuag

SEQ ID NO: 507749 - RNA, 18 nt, Human
uggcagccagcugcuccu

SEQ ID NO: 507750 - RNA, 22 nt, Human
uucagcacaagacuagacaggu

SEQ ID NO: 507751 - RNA, 22 nt, Human
cuccucccugcgauugcucugc

SEQ ID NO: 507752 - RNA, 22 nt, Human
aaguaacaucugaacaugaugu

SEQ ID NO: 507753 - RNA, 22 nt, Human
acauguuuugugccuugacuag

SEQ ID NO: 507754 - RNA, 19 nt, Human
cuccaagugccaaggacag

SEQ ID NO: 507755 - RNA, 22 nt, Human
gcagggcaaauguggaaaggag

SEQ ID NO: 507756 - RNA, 22 nt, Human
aagucuuuugcuaagaguaaug

SEQ ID NO: 507757 - RNA, 23 nt, Human
uggagaauguguuuacuucgugu

SEQ ID NO: 507758 - RNA, 22 nt, Human
aagcagccaccucaucuccacu

SEQ ID NO: 507759 - RNA, 20 nt, Human
agccucugcccuucccacug

SEQ ID NO: 507760 - RNA, 18 nt, Human
uucuggcucacucaugcu

SEQ ID NO: 507761 - RNA, 22 nt, Human
ucacagaaugucuagcauaauu

SEQ ID NO: 507762 - RNA, 22 nt, Human
auguggcuaguccucugcggca

SEQ ID NO: 507763 - RNA, 22 nt, Human
uuuauuugucuugccauuuagu

SEQ ID NO: 507764 - RNA, 22 nt, Human
cccugggacccgcugcagaggc

SEQ ID NO: 507765 - RNA, 17 nt, Human
aguguggcccugguuaa

SEQ ID NO: 507766 - RNA, 22 nt, Human
cagagcacugcuuggaggauuu

SEQ ID NO: 507767 - RNA, 22 nt, Human
agagucccagggacacuccaga

SEQ ID NO: 507768 - RNA, 22 nt, Human
aauugcuaaagauuauguuuuc

SEQ ID NO: 507769 - RNA, 22 nt, Human
uuucugcagguauugcauaagu

SEQ ID NO: 507770 - RNA, 22 nt, Human
gugcagguuuaggaagcagcuc

SEQ ID NO: 507771 - RNA, 20 nt, Human
cucacagucaaugcagaggu

SEQ ID NO: 507772 - RNA, 22 nt, Human
uguguucauuuaacuguucuuu

SEQ ID NO: 507773 - RNA, 22 nt, Human
aggcacugaagaacucuuuuug

SEQ ID NO: 507774 - RNA, 22 nt, Human
ucugauuagagcauucuugagu

SEQ ID NO: 507775 - RNA, 22 nt, Human
ugggggugacuaucucgggaau

SEQ ID NO: 507776 - RNA, 22 nt, Human
gaaaaaugagcugaugucaggg

SEQ ID NO: 507777 - RNA, 22 nt, Human
cccucccagaugggcuugaggu

SEQ ID NO: 507778 - RNA, 17 nt, Human
agguauaaaaugguagc

SEQ ID NO: 507779 - RNA, 22 nt, Human
gagaagguggaccugaaggagc

SEQ ID NO: 507780 - RNA, 22 nt, Human
aaacucugcacugcgguaaggu

SEQ ID NO: 507781 - RNA, 22 nt, Human
ucuguggccuccuuccacuuac

SEQ ID NO: 507782 - RNA, 22 nt, Human
augagagacuguguguugggag

SEQ ID NO: 507783 - RNA, 22 nt, Human
cucugggccaugcuacugcucu

SEQ ID NO: 507784 - RNA, 22 nt, Human
agcagcauuccuggcuucuauc

SEQ ID NO: 507785 - RNA, 21 nt, Human
agugaaaugaaguguaugcuc

SEQ ID NO: 507786 - RNA, 22 nt, Human
ugagguagaagccuggguugag

SEQ ID NO: 507787 - RNA, 22 nt, Human
uuacaagacagugugguaaaua

SEQ ID NO: 507788 - RNA, 22 nt, Human
gacccugacucuaaugcuuggc

SEQ ID NO: 507789 - RNA, 22 nt, Human
gcugagagcaaagcaugucuag

SEQ ID NO: 507790 - RNA, 21 nt, Human
ugucagaaauaagcaugugau

SEQ ID NO: 507791 - RNA, 22 nt, Human
cucaguuucuucauauuguagg

SEQ ID NO: 507792 - RNA, 22 nt, Human
ugaaaucaauugcaauguuuau

SEQ ID NO: 507793 - RNA, 22 nt, Human
aaauagcuucuaagccuuuuga

SEQ ID NO: 507794 - RNA, 22 nt, Human
agacccucuccaugcccacugc

SEQ ID NO: 507795 - RNA, 22 nt, Human
cagccuucgacaguuggaguag

SEQ ID NO: 507796 - RNA, 22 nt, Human
ccacaggaccagaggagaucac

SEQ ID NO: 507797 - RNA, 22 nt, Human
uaaacauggauucugaucacag

SEQ ID NO: 507798 - RNA, 22 nt, Human
gagcucagcacuaaaaucaugu

SEQ ID NO: 507799 - RNA, 19 nt, Human
gcacacccugcaccaccau

SEQ ID NO: 507800 - RNA, 22 nt, Human
ucagaaacacucuucuucuguc

SEQ ID NO: 507801 - RNA, 22 nt, Human
agccuguggaucccugcacugg

SEQ ID NO: 507802 - RNA, 21 nt, Human
gagccuucccucugcccuuuc

SEQ ID NO: 507803 - RNA, 22 nt, Human
uaaauuacccuuuagggaauug

SEQ ID NO: 507804 - RNA, 22 nt, Human
caaagcaaggcucaguuugaac

SEQ ID NO: 507805 - RNA, 22 nt, Human
gguaaacuaaccauuuuaauuu

SEQ ID NO: 507806 - RNA, 22 nt, Human
uugcugaaugcaaguuggauag

SEQ ID NO: 507807 - RNA, 22 nt, Human
aucuacagcugucugcacagua

SEQ ID NO: 507808 - RNA, 22 nt, Human
aaaugucuuugaguauuucugc

SEQ ID NO: 507809 - RNA, 22 nt, Human
cugggggucuugaaagggagag

SEQ ID NO: 507810 - RNA, 20 nt, Human
cuuuagaagaacccaagcau

SEQ ID NO: 507811 - RNA, 22 nt, Human
aggcagguguuaccucugguuu

SEQ ID NO: 507812 - RNA, 22 nt, Human
cauuucuagggaucauaaagua

SEQ ID NO: 507813 - RNA, 22 nt, Human
gugugucugaaguugaguagac

SEQ ID NO: 507814 - RNA, 22 nt, Human
ccacagggauaggaauggggcu

SEQ ID NO: 507815 - RNA, 22 nt, Human
cuguggcucagcacggggucag

SEQ ID NO: 507816 - RNA, 22 nt, Human
uagucccauuuugagguauuug

SEQ ID NO: 507817 - RNA, 22 nt, Human
gaaauuuauuaucuacaucauu

SEQ ID NO: 507818 - RNA, 22 nt, Human
uggaacaacaugcuggaaaauu

SEQ ID NO: 507819 - RNA, 22 nt, Human
ucugaaggaaaaggguagauau

SEQ ID NO: 507820 - RNA, 22 nt, Human
acagcuguggccacuugcaucc

SEQ ID NO: 507821 - RNA, 22 nt, Human
ccugucugaggaggugcucuuu

SEQ ID NO: 507822 - RNA, 22 nt, Human
gugaccauuugacauauccuug

SEQ ID NO: 507823 - RNA, 22 nt, Human
acaaagucuuuuacaacaguca

SEQ ID NO: 507824 - RNA, 22 nt, Human
uccuggaggcaaaugagcacau

SEQ ID NO: 507825 - RNA, 22 nt, Human
ccuccaaguuugacucaggaca

SEQ ID NO: 507826 - RNA, 23 nt, Human
cagagcugauuaaacuuaaucuc

SEQ ID NO: 507827 - RNA, 22 nt, Human
aaguucaaguaguguuacaugg

SEQ ID NO: 507828 - RNA, 22 nt, Human
aaggguccagcaccucggcucc

SEQ ID NO: 507829 - RNA, 22 nt, Human
ucugggauaagaccacagauuu

SEQ ID NO: 507830 - RNA, 22 nt, Human
ccagggugugagaaggaaguag

SEQ ID NO: 507831 - RNA, 22 nt, Human
agaaugugaagauuuugaauua

SEQ ID NO: 507832 - RNA, 22 nt, Human
augggggcggcugaagcccagg

SEQ ID NO: 507833 - RNA, 20 nt, Human
gcucugggagggaugugaug

SEQ ID NO: 507834 - RNA, 22 nt, Human
agggcucuuccuuugccucuca

SEQ ID NO: 507835 - RNA, 19 nt, Human
aaagcagaggagcaucuga

SEQ ID NO: 507836 - RNA, 22 nt, Human
acuuaguggcuaugugaccuua

SEQ ID NO: 507837 - RNA, 22 nt, Human
ccucaggcugggcugccccugg

SEQ ID NO: 507838 - RNA, 22 nt, Human
cagccagagaaagggcacugcc

SEQ ID NO: 507839 - RNA, 22 nt, Human
caugagauuugggaggggccag

SEQ ID NO: 507840 - RNA, 22 nt, Human
uuauauaucuugauuuguucca

SEQ ID NO: 507841 - RNA, 22 nt, Human
cugcccugggaguaccuguccu

SEQ ID NO: 507842 - RNA, 22 nt, Human
augcacaagaggcuagaaaaga

SEQ ID NO: 507843 - RNA, 22 nt, Human
ccuggccuggcacucccucugc

SEQ ID NO: 507844 - RNA, 22 nt, Human
uacuuaaaacugauagaaucuc

SEQ ID NO: 507845 - RNA, 22 nt, Human
caaugucaaggagaccaaaacg

SEQ ID NO: 507846 - RNA, 22 nt, Human
ggguccaggcguggcccagaug

SEQ ID NO: 507847 - RNA, 20 nt, Human
acuggagccaucucagccua

SEQ ID NO: 507848 - RNA, 22 nt, Human
gaaguuuauuucaaucuauuca

SEQ ID NO: 507849 - RNA, 22 nt, Human
ccauaaggagccagacauucca

SEQ ID NO: 507850 - RNA, 22 nt, Human
aucauaaagugcuaucugauug

SEQ ID NO: 507851 - RNA, 22 nt, Human
guggcugcagagccagcaagcu

SEQ ID NO: 507852 - RNA, 22 nt, Human
aaugcacagcguuccaugcuug

SEQ ID NO: 507853 - RNA, 20 nt, Human
ccagcauguacacaugugga

SEQ ID NO: 507854 - RNA, 22 nt, Human
agccuggcacugccccauccau

SEQ ID NO: 507855 - RNA, 22 nt, Human
auuuucaguugaaaaaguuggu

SEQ ID NO: 507856 - RNA, 22 nt, Human
auuguauacaagcuuaauuguu

SEQ ID NO: 507857 - RNA, 22 nt, Human
gccucagugauaugugggacaa

SEQ ID NO: 507858 - RNA, 22 nt, Human
uuuuuaucuacagauucucagc

SEQ ID NO: 507859 - RNA, 22 nt, Human
ucccacacuugaaacaaggcug

SEQ ID NO: 507860 - RNA, 22 nt, Human
gggagagaugcugauugccaau

SEQ ID NO: 507861 - RNA, 22 nt, Human
agugaaauuccuggucuuuguu

SEQ ID NO: 507862 - RNA, 22 nt, Human
acuggccaggcagcaguagcuu

SEQ ID NO: 507863 - RNA, 22 nt, Human
cugugugccuagaggguggccg

SEQ ID NO: 507864 - RNA, 22 nt, Human
gcaggaguguggugggacaucc

SEQ ID NO: 507865 - RNA, 22 nt, Human
agggagaaaauuggaugcacaa

SEQ ID NO: 507866 - RNA, 22 nt, Human
gagguuucuuaucaagaaagcu

SEQ ID NO: 507867 - RNA, 21 nt, Human
aggagcuguguuagcuggucg

SEQ ID NO: 507868 - RNA, 22 nt, Human
cuguguccucccgcugcaccca

SEQ ID NO: 507869 - RNA, 22 nt, Human
ggccacuguccucuagcccaga

SEQ ID NO: 507870 - RNA, 22 nt, Human
cccuaggggcaaugauggugcu

SEQ ID NO: 507871 - RNA, 22 nt, Human
agcccugggucccaguccuggc

SEQ ID NO: 507872 - RNA, 22 nt, Human
agcuguggggcaggcagcgagg

SEQ ID NO: 507873 - RNA, 22 nt, Human
cugcagagcaaguucucuguug

SEQ ID NO: 507874 - RNA, 22 nt, Human
cucugagaggugagaagcagca

SEQ ID NO: 507875 - RNA, 22 nt, Human
guccagcuccagggaggcaggc

SEQ ID NO: 507876 - RNA, 23 nt, Human
acagagaucuugacuuguaugga

SEQ ID NO: 507877 - RNA, 22 nt, Human
ggucugaguagagggcuggcga

SEQ ID NO: 507878 - RNA, 22 nt, Human
uccagggccacagaggaugcua

SEQ ID NO: 507879 - RNA, 19 nt, Human
ucccaggaagcaaauguca

SEQ ID NO: 507880 - RNA, 22 nt, Human
uucucuugugccaaguuguugc

SEQ ID NO: 507881 - RNA, 22 nt, Human
aucuagaaguggcaugaauuac

SEQ ID NO: 507882 - RNA, 22 nt, Human
uugugucccccuuugagagcca

SEQ ID NO: 507883 - RNA, 22 nt, Human
ugcauaaagugccauaguauua

SEQ ID NO: 507884 - RNA, 22 nt, Human
agggaccucauguaaguggauu

SEQ ID NO: 507885 - RNA, 22 nt, Human
uaaguucagaguucucauuugu

SEQ ID NO: 507886 - RNA, 22 nt, Human
ccagcuggugggucuuucucug

SEQ ID NO: 507887 - RNA, 22 nt, Human
ccagcuccugggucuuagucag

SEQ ID NO: 507888 - RNA, 22 nt, Human
uccugagugagagcugggaggu

SEQ ID NO: 507889 - RNA, 22 nt, Human
ggguccagcgacagcaggcuca

SEQ ID NO: 507890 - RNA, 22 nt, Human
uguacaauagcuauuaucucca

SEQ ID NO: 507891 - RNA, 22 nt, Human
aggcuggggaauugaauuugcu

SEQ ID NO: 507892 - RNA, 22 nt, Human
ugaggccacuuccccacagccc

SEQ ID NO: 507893 - RNA, 22 nt, Human
cucagagaggcaguggaaguca

SEQ ID NO: 507894 - RNA, 22 nt, Human
uuuaaauaggacuccugggggu

SEQ ID NO: 507895 - RNA, 21 nt, Human
cagaggcagguccugggacgg

SEQ ID NO: 507896 - RNA, 22 nt, Human
gacagcuugccugguacugcaa

SEQ ID NO: 507897 - RNA, 22 nt, Human
agagccagauggagccgugugu

SEQ ID NO: 507898 - RNA, 22 nt, Human
gcuccuucaggugguagcuguu

SEQ ID NO: 507899 - RNA, 23 nt, Human
ggaaagagaggaguugugcauag

SEQ ID NO: 507900 - RNA, 22 nt, Human
ucagaaccagcccagcagauga

SEQ ID NO: 507901 - RNA, 22 nt, Human
acugggccugauugggucggag

SEQ ID NO: 507902 - RNA, 22 nt, Human
ccacagggacuguuaaaacccu

SEQ ID NO: 507903 - RNA, 22 nt, Human
ccaucacaguccccaucgugau

SEQ ID NO: 507904 - RNA, 22 nt, Human
gggcgcaucaccugaggucagg

SEQ ID NO: 507905 - RNA, 22 nt, Human
aguuagaauauaauuauguuaa

SEQ ID NO: 507906 - RNA, 22 nt, Human
uucugucacuuaggaggucaua

SEQ ID NO: 507907 - RNA, 22 nt, Human
cagggcuuuuuauuagcugccu

SEQ ID NO: 507908 - RNA, 22 nt, Human
guuguugaugaagaucugacug

SEQ ID NO: 507909 - RNA, 22 nt, Human
aguuucuauguaagcuacguga

SEQ ID NO: 507910 - RNA, 22 nt, Human
agggggcuccuccggugcuucc

SEQ ID NO: 507911 - RNA, 22 nt, Human
gaucucuguggacucuuagcac

SEQ ID NO: 507912 - RNA, 22 nt, Human
ucaagcaucuuggucuacgauc

SEQ ID NO: 507913 - RNA, 22 nt, Human
ucucugggacacugggucaguu

SEQ ID NO: 507914 - RNA, 23 nt, Human
aaagaugugaguauucauauggc

SEQ ID NO: 507915 - RNA, 22 nt, Human
guuuccugacccuggcccagca

SEQ ID NO: 507916 - RNA, 22 nt, Human
gggggacaggaugaauaucugu

SEQ ID NO: 507917 - RNA, 21 nt, Human
ucagaguggaagacaguuuga

SEQ ID NO: 507918 - RNA, 22 nt, Human
cugcucuggcuguguacuucag

SEQ ID NO: 507919 - RNA, 23 nt, Human
agucucagcuggaaacauguguc

SEQ ID NO: 507920 - RNA, 22 nt, Human
gugagcagaauaaggguugaga

SEQ ID NO: 507921 - RNA, 22 nt, Human
auguaguguagagauuagucuc

SEQ ID NO: 507922 - RNA, 22 nt, Human
uccuucaagaugccacagcuuu

SEQ ID NO: 507923 - RNA, 18 nt, Human
agaauugcugcuucuucu

SEQ ID NO: 507924 - RNA, 22 nt, Human
ugcuuccuucccguucuucucc

SEQ ID NO: 507925 - RNA, 22 nt, Human
cagucacauagguauacacaua

SEQ ID NO: 507926 - RNA, 22 nt, Human
gcagccaggguuaauuauauuu

SEQ ID NO: 507927 - RNA, 23 nt, Human
gcucagagguuuuucucuggaug

SEQ ID NO: 507928 - RNA, 22 nt, Human
guacacauuaugcuucucuaaa

SEQ ID NO: 507929 - RNA, 22 nt, Human
ugcauuaagggccuggagauac

SEQ ID NO: 507930 - RNA, 18 nt, Human
ugucucaggcugaaacag

SEQ ID NO: 507931 - RNA, 22 nt, Human
cacagguguucuugcagugaaa

SEQ ID NO: 507932 - RNA, 22 nt, Human
uguggcagagagagcuuccuug

SEQ ID NO: 507933 - RNA, 17 nt, Human
gucagcagcuugcuugu

SEQ ID NO: 507934 - RNA, 22 nt, Human
uguuucuuuguagauauucuuu

SEQ ID NO: 507935 - RNA, 22 nt, Human
agcaguuuggaaaauacuagaa

SEQ ID NO: 507936 - RNA, 22 nt, Human
acacugaauguuuaagaacuug

SEQ ID NO: 507937 - RNA, 22 nt, Human
uaaggcacuucaauguuuagaa

SEQ ID NO: 507938 - RNA, 22 nt, Human
gcagccacucucauuccacgug

SEQ ID NO: 507939 - RNA, 22 nt, Human
uucagcagucguccaggaaaag

SEQ ID NO: 507940 - RNA, 22 nt, Human
ccuggagcacagcccaguccca

SEQ ID NO: 507941 - RNA, 22 nt, Human
ucaugacaacuauauuauucca

SEQ ID NO: 507942 - RNA, 22 nt, Human
auugcugacuuuaauauuauau

SEQ ID NO: 507943 - RNA, 22 nt, Human
gaagccaguacugugcucugca

SEQ ID NO: 507944 - RNA, 22 nt, Human
caagucaaugauuauaagaguc

SEQ ID NO: 507945 - RNA, 20 nt, Human
acauaugaaugauagagcca

SEQ ID NO: 507946 - RNA, 22 nt, Human
aaacaugcauucaagaaaaucu

SEQ ID NO: 507947 - RNA, 22 nt, Human
uacuaggaagcagcugcauugg

SEQ ID NO: 507948 - RNA, 17 nt, Human
ugcuccuguggcagccu

SEQ ID NO: 507949 - RNA, 22 nt, Human
aaggcacugaacuuaaauucug

SEQ ID NO: 507950 - RNA, 22 nt, Human
uuccaguucccaugaggauuaa

SEQ ID NO: 507951 - RNA, 22 nt, Human
ugcuuaaacacauacauacaua

SEQ ID NO: 507952 - RNA, 22 nt, Human
uggcuucuggccaggcacagga

SEQ ID NO: 507953 - RNA, 22 nt, Human
ggcagcagggcugucucccuac

SEQ ID NO: 507954 - RNA, 22 nt, Human
gggcucuguccauuccuucaua

SEQ ID NO: 507955 - RNA, 22 nt, Human
ggacaggugacugcccagagug

SEQ ID NO: 507956 - RNA, 22 nt, Human
cauaacuagagugaaauguuga

SEQ ID NO: 507957 - RNA, 22 nt, Human
ggucccagguugacagggagac

SEQ ID NO: 507958 - RNA, 20 nt, Human
ugugcccugcagacuucuuu

SEQ ID NO: 507959 - RNA, 19 nt, Human
ugagugggccccugcagac

SEQ ID NO: 507960 - RNA, 22 nt, Human
ugggcuggcugaggcauucacu

SEQ ID NO: 507961 - RNA, 21 nt, Human
aagcuucccugcucuccaggg

SEQ ID NO: 507962 - RNA, 22 nt, Human
cauaaucagauguguacauaag

SEQ ID NO: 507963 - RNA, 22 nt, Human
uucacagugugaucuaugggca

SEQ ID NO: 507964 - RNA, 22 nt, Human
ugcacagcugccuccucucugc

SEQ ID NO: 507965 - RNA, 22 nt, Human
aggugccagaugcacagcugaa

SEQ ID NO: 507966 - RNA, 22 nt, Human
cugcagaggucuugcugauggu

SEQ ID NO: 507967 - RNA, 22 nt, Human
ugcaggcaggggaugagcagcc

SEQ ID NO: 507968 - RNA, 22 nt, Human
ccaggaaugaaauguagauaaa

SEQ ID NO: 507969 - RNA, 22 nt, Human
ugcccucuuaggucugcgcagc

SEQ ID NO: 507970 - RNA, 22 nt, Human
uggcagguuuccuccucauagu

SEQ ID NO: 507971 - RNA, 22 nt, Human
uuuguaaagucuguucugaguu

SEQ ID NO: 507972 - RNA, 22 nt, Human
aguaugaagaauacauagauga

SEQ ID NO: 507973 - RNA, 22 nt, Human
uuucaaggugcaggaggguuuu

SEQ ID NO: 507974 - RNA, 22 nt, Human
agguaccauaugcgggagcaac

SEQ ID NO: 507975 - RNA, 22 nt, Human
agcuuaggaggaugaugaacau

SEQ ID NO: 507976 - RNA, 22 nt, Human
ggaggcggagcuugcagugagc

SEQ ID NO: 507977 - RNA, 22 nt, Human
aucacuguuaucuagaagcaca

SEQ ID NO: 507978 - RNA, 22 nt, Human
uccuggggcugcaaggccuguc

SEQ ID NO: 507979 - RNA, 22 nt, Human
gagauguuaacuacauagcuac

SEQ ID NO: 507980 - RNA, 23 nt, Human
cuugcagggcuggaggcuuagaa

SEQ ID NO: 507981 - RNA, 22 nt, Human
agccuguguuuuuucuauugca

SEQ ID NO: 507982 - RNA, 22 nt, Human
ucauggauggccgggaggugau

SEQ ID NO: 507983 - RNA, 22 nt, Human
agggccaccagagcagggcagu

SEQ ID NO: 507984 - RNA, 22 nt, Human
ucugugcaggaagucauuauga

SEQ ID NO: 507985 - RNA, 22 nt, Human
ugggaaauauucuaaaagucuu

SEQ ID NO: 507986 - RNA, 22 nt, Human
gaggaaugucagcacaggccuc

SEQ ID NO: 507987 - RNA, 22 nt, Human
ucuuauuuuuuaaugacagaga

SEQ ID NO: 507988 - RNA, 22 nt, Human
cugagggagggacuuugagacu

SEQ ID NO: 507989 - RNA, 22 nt, Human
aaauguauccuacuuccugagu

SEQ ID NO: 507990 - RNA, 22 nt, Human
ucucagagaugucaagagucua

SEQ ID NO: 507991 - RNA, 22 nt, Human
ccuguucacgguguguuguuag

SEQ ID NO: 507992 - RNA, 22 nt, Human
ccagagaggggaagggcuugcc

SEQ ID NO: 507993 - RNA, 18 nt, Human
auauucaagaagacagag

SEQ ID NO: 507994 - RNA, 22 nt, Human
agaugauggccauguccucucc

SEQ ID NO: 507995 - RNA, 22 nt, Human
cucagcucugacaggaggcauc

SEQ ID NO: 507996 - RNA, 22 nt, Human
caagaugaucccugaaggcagc

SEQ ID NO: 507997 - RNA, 22 nt, Human
ugcaaugagaauauauuaacca

SEQ ID NO: 507998 - RNA, 22 nt, Human
gacacagagacuugcaguugua

SEQ ID NO: 507999 - RNA, 22 nt, Human
agcagcucuuaacaaagcaugg

SEQ ID NO: 508000 - RNA, 22 nt, Human
ucucuggcagcuugugcuguug

SEQ ID NO: 508001 - RNA, 22 nt, Human
auuguugggucucacuccuaga

SEQ ID NO: 508002 - RNA, 22 nt, Human
agcugccauccuguucagcacc

SEQ ID NO: 508003 - RNA, 22 nt, Human
aaucuggcucagaagaagauga

SEQ ID NO: 508004 - RNA, 22 nt, Human
uccaggauugucagccagaagg

SEQ ID NO: 508005 - RNA, 22 nt, Human
aacagcaauagcacuauucauu

SEQ ID NO: 508006 - RNA, 22 nt, Human
ggaggagcugcugugggggccc

SEQ ID NO: 508007 - RNA, 22 nt, Human
acagagguguguguaggacagu

SEQ ID NO: 508008 - RNA, 20 nt, Human
ugggcucugcuuccuggagu

SEQ ID NO: 508009 - RNA, 22 nt, Human
ugcuucugacuaagcugcauga

SEQ ID NO: 508010 - RNA, 22 nt, Human
ucuguuuuguaccagauacagc

SEQ ID NO: 508011 - RNA, 22 nt, Human
uggaaggcugugauuacugugc

SEQ ID NO: 508012 - RNA, 22 nt, Human
guuuucugauuagcaaaucuga

SEQ ID NO: 508013 - RNA, 22 nt, Human
uugaauaguuuuggauagcaua

SEQ ID NO: 508014 - RNA, 22 nt, Human
aacauguagcagaaacgacuaa

SEQ ID NO: 508015 - RNA, 22 nt, Human
aagcuuccugaaugcucauuua

SEQ ID NO: 508016 - RNA, 22 nt, Human
uuacuaguauaugucaagcaac

SEQ ID NO: 508017 - RNA, 22 nt, Human
auuguugauaaucguguuguca

SEQ ID NO: 508018 - RNA, 22 nt, Human
uguuuugugcauuuacaacaug

SEQ ID NO: 508019 - RNA, 22 nt, Human
aagcuucaguucuggggcaaug

SEQ ID NO: 508020 - RNA, 20 nt, Human
ucccaaggaugccugggugu

SEQ ID NO: 508021 - RNA, 22 nt, Human
acagcucagacaucacugcucu

SEQ ID NO: 508022 - RNA, 22 nt, Human
uugcauaaagauuuuauugcau

SEQ ID NO: 508023 - RNA, 22 nt, Human
ucuguacaaaggcuauuuggag

SEQ ID NO: 508024 - RNA, 22 nt, Human
uugcaucuaccauaucaaagau

SEQ ID NO: 508025 - RNA, 22 nt, Human
ugcagcugcugguggcugaaag

SEQ ID NO: 508026 - RNA, 22 nt, Human
cacuuggaggaaggccuauuca

SEQ ID NO: 508027 - RNA, 22 nt, Human
ucugucugagggagugacauuu

SEQ ID NO: 508028 - RNA, 22 nt, Human
agcagacaacccagaugaccca

SEQ ID NO: 508029 - RNA, 19 nt, Human
aucccaaggagcugggacu

SEQ ID NO: 508030 - RNA, 22 nt, Human
uaaggucauggugaauaauaag

SEQ ID NO: 508031 - RNA, 22 nt, Human
gcuggacucaggggacucaggg

SEQ ID NO: 508032 - RNA, 22 nt, Human
gagagcuguccggcugagcagc

SEQ ID NO: 508033 - RNA, 22 nt, Human
uagaaaggcaagcgugaaauau

SEQ ID NO: 508034 - RNA, 22 nt, Human
ugucugaauucaagaaauucaa

SEQ ID NO: 508035 - RNA, 22 nt, Human
caugcuccaaaaacaagagaau

SEQ ID NO: 508036 - RNA, 22 nt, Human
ucaaugauagacaagaucuaag

SEQ ID NO: 508037 - RNA, 22 nt, Human
cagggugcgccacucagaugua

SEQ ID NO: 508038 - RNA, 20 nt, Human
ccuucagaacuuacauagua

SEQ ID NO: 508039 - RNA, 22 nt, Human
guggcagggcuuugcuguucuu

SEQ ID NO: 508040 - RNA, 17 nt, Human
agcagcuggcacaggag

SEQ ID NO: 508041 - RNA, 18 nt, Human
ucagucuauuguauaaga

SEQ ID NO: 508042 - RNA, 22 nt, Human
acuaggaaggcauaugggcaga

SEQ ID NO: 508043 - RNA, 22 nt, Human
accauguguuuuacacauggua

SEQ ID NO: 508044 - RNA, 22 nt, Human
acaaaaguguaggaauuccuua

SEQ ID NO: 508045 - RNA, 17 nt, Human
ugagacagggcaggccc

SEQ ID NO: 508046 - RNA, 22 nt, Human
uuguaaacugcugcaggagugc

SEQ ID NO: 508047 - RNA, 22 nt, Human
caguccagagcccaccagagga

SEQ ID NO: 508048 - RNA, 22 nt, Human
uuccaguucuggcuuugccacu

SEQ ID NO: 508049 - RNA, 21 nt, Human
ccugccaggaaacugaguguc

SEQ ID NO: 508050 - RNA, 22 nt, Human
agcaggcaggaaggcagcacug

SEQ ID NO: 508051 - RNA, 22 nt, Human
guuccugaugcuuugaaauuca

SEQ ID NO: 508052 - RNA, 22 nt, Human
agggagcuaggauccugaaggu

SEQ ID NO: 508053 - RNA, 22 nt, Human
gagggcugcugccagauaugcc

SEQ ID NO: 508054 - RNA, 21 nt, Human
gaugaagcaaucuuucuguug

SEQ ID NO: 508055 - RNA, 22 nt, Human
uuguugcaaggguuaaaugaga

SEQ ID NO: 508056 - RNA, 22 nt, Human
cagcucuggguaggaggaaucu

SEQ ID NO: 508057 - RNA, 22 nt, Human
aaaauacacauacuaggggaaa

SEQ ID NO: 508058 - RNA, 22 nt, Human
cucagugugagugagaagugca

SEQ ID NO: 508059 - RNA, 22 nt, Human
aggucacauggauaaugaucag

SEQ ID NO: 508060 - RNA, 22 nt, Human
acaguguuuauguacagauugu

SEQ ID NO: 508061 - RNA, 22 nt, Human
auuguugacuugauuacucaac

SEQ ID NO: 508062 - RNA, 22 nt, Human
gcuugaaaauucauagguauuu

SEQ ID NO: 508063 - RNA, 22 nt, Human
uucagcauagcagcuucaggac

SEQ ID NO: 508064 - RNA, 22 nt, Human
aagggcucacccaacucacuuc

SEQ ID NO: 508065 - RNA, 19 nt, Human
agcaccugugagagccugg

SEQ ID NO: 508066 - RNA, 22 nt, Human
uuguaacagcuguuuauauagu

SEQ ID NO: 508067 - RNA, 22 nt, Human
ugucuuuuuacuauguucaauc

SEQ ID NO: 508068 - RNA, 23 nt, Human
acucacaaagcaggaucauguug

SEQ ID NO: 508069 - RNA, 22 nt, Human
auuuaguguguauugcuauuau

SEQ ID NO: 508070 - RNA, 22 nt, Human
gagccauacaaccuauaaagug

SEQ ID NO: 508071 - RNA, 22 nt, Human
uuuuucucuucuguaaaguggu

SEQ ID NO: 508072 - RNA, 22 nt, Human
uuuauaaaauagacugggucua

SEQ ID NO: 508073 - RNA, 19 nt, Human
ccaggccaucccaguuccc

SEQ ID NO: 508074 - RNA, 22 nt, Human
gcccuuaggcaagcagaagccc

SEQ ID NO: 508075 - RNA, 22 nt, Human
ugacacacagggggauggaguu

SEQ ID NO: 508076 - RNA, 21 nt, Human
agcucagccgggcacaguggc

SEQ ID NO: 508077 - RNA, 22 nt, Human
gaaauacagaaagggcugaaug

SEQ ID NO: 508078 - RNA, 22 nt, Human
ugggagucaacccucacgagca

SEQ ID NO: 508079 - RNA, 17 nt, Human
caggcuccuuccagauu

SEQ ID NO: 508080 - RNA, 22 nt, Human
cugggcacugcagcaggcauca

SEQ ID NO: 508081 - RNA, 22 nt, Human
gaagcucucaaacucuccccuu

SEQ ID NO: 508082 - RNA, 19 nt, Human
cccagcuugaccaccugcu

SEQ ID NO: 508083 - RNA, 19 nt, Human
ggccugaggccacagaucc

SEQ ID NO: 508084 - RNA, 22 nt, Human
uaucuacaggugucagguaaga

SEQ ID NO: 508085 - RNA, 22 nt, Human
agccaagcugaucuccugcuga

SEQ ID NO: 508086 - RNA, 19 nt, Human
cagcaauaaugccagaugg

SEQ ID NO: 508087 - RNA, 22 nt, Human
aaaugcacacaccaggaaacua

SEQ ID NO: 508088 - RNA, 22 nt, Human
ugggagcucagaaagggagguc

SEQ ID NO: 508089 - RNA, 22 nt, Human
ucaggaugguccuuuaugagaa

SEQ ID NO: 508090 - RNA, 22 nt, Human
gugggcuuuggccucuuucucc

SEQ ID NO: 508091 - RNA, 22 nt, Human
ccaggcucugcaaaaucaggcu

SEQ ID NO: 508092 - RNA, 22 nt, Human
aggacaggauugagcugaacug

SEQ ID NO: 508093 - RNA, 22 nt, Human
aucauucagucucugggacagu

SEQ ID NO: 508094 - RNA, 22 nt, Human
aaagcaguauaguggaagggcu

SEQ ID NO: 508095 - RNA, 22 nt, Human
aaaugaacucuuccugcauccc

SEQ ID NO: 508096 - RNA, 19 nt, Human
ccccaggguaggcuagggg

SEQ ID NO: 508097 - RNA, 22 nt, Human
cucuggccagagccugcgggaa

SEQ ID NO: 508098 - RNA, 22 nt, Human
uccaguccuagaaacuggagag

SEQ ID NO: 508099 - RNA, 22 nt, Human
ggccccaguucacuccuggccg

SEQ ID NO: 508100 - RNA, 22 nt, Human
guguggcuagaagugucuuguu

SEQ ID NO: 508101 - RNA, 23 nt, Human
agcugggaauuuucugaagcuuu

SEQ ID NO: 508102 - RNA, 22 nt, Human
aggcagcugugaggacuggauu

SEQ ID NO: 508103 - RNA, 22 nt, Human
caguguuuguggaauucaggug

SEQ ID NO: 508104 - RNA, 22 nt, Human
gcccucuggcagccuuggcugg

SEQ ID NO: 508105 - RNA, 22 nt, Human
caggugggcguggcgagaaggc

SEQ ID NO: 508106 - RNA, 22 nt, Human
aauuagggaggacaaagguaca

SEQ ID NO: 508107 - RNA, 22 nt, Human
ucauugcaguagggagagaccc

SEQ ID NO: 508108 - RNA, 22 nt, Human
ucucagagcaucauuuucuuag

SEQ ID NO: 508109 - RNA, 22 nt, Human
cacaguggcagguguggguugu

SEQ ID NO: 508110 - RNA, 22 nt, Human
uuuauauagagauuugugcaug

SEQ ID NO: 508111 - RNA, 22 nt, Human
cacuggaauucaagauacugag

SEQ ID NO: 508112 - RNA, 22 nt, Human
gaacacaugauuauaaaugcua

SEQ ID NO: 508113 - RNA, 22 nt, Human
cugacccuugcucgggcccugu

SEQ ID NO: 508114 - RNA, 18 nt, Human
acucaggaaaugaugaca

SEQ ID NO: 508115 - RNA, 22 nt, Human
cuauucuagauuacaguauaaa

SEQ ID NO: 508116 - RNA, 22 nt, Human
auuuaaaugcuuaagaggguuu

SEQ ID NO: 508117 - RNA, 22 nt, Human
aaacucuggagauguuuaugca

SEQ ID NO: 508118 - RNA, 22 nt, Human
gaugggcguggcgcguuuggug

SEQ ID NO: 508119 - RNA, 22 nt, Human
acuggcagagguuggacaccau

SEQ ID NO: 508120 - RNA, 22 nt, Human
agagcuaagaaacagaauugcu

SEQ ID NO: 508121 - RNA, 22 nt, Human
cacauguaguaagcaggcaaug

SEQ ID NO: 508122 - RNA, 22 nt, Human
caggcucaaggcugacuuccau

SEQ ID NO: 508123 - RNA, 22 nt, Human
aagaguuugaccugugccaucc

SEQ ID NO: 508124 - RNA, 22 nt, Human
ggcagcucaccucugguccagg

SEQ ID NO: 508125 - RNA, 22 nt, Human
cuaggaggcgggggcugcagua

SEQ ID NO: 508126 - RNA, 22 nt, Human
uaagcaaauagcuagaucagag

SEQ ID NO: 508127 - RNA, 22 nt, Human
uccaaaggcccuaauaagcuug

SEQ ID NO: 508128 - RNA, 22 nt, Human
uuguagcugaaaguaaagaagu

SEQ ID NO: 508129 - RNA, 22 nt, Human
ugcagagaagaggacaguucua

SEQ ID NO: 508130 - RNA, 22 nt, Human
cuagagcuguucugugcacuca

SEQ ID NO: 508131 - RNA, 22 nt, Human
ccugcccuguguuuggggacua

SEQ ID NO: 508132 - RNA, 22 nt, Human
aagaauggugguggggccagca

SEQ ID NO: 508133 - RNA, 23 nt, Human
agucugaauugagaugugcugug

SEQ ID NO: 508134 - RNA, 22 nt, Human
uuccuguggccuuacaucugug

SEQ ID NO: 508135 - RNA, 22 nt, Human
uuguuaaagaugcagauuccau

SEQ ID NO: 508136 - RNA, 20 nt, Human
cacaggccuugugagcagac

SEQ ID NO: 508137 - RNA, 22 nt, Human
agcaccugugugguagggaggu

SEQ ID NO: 508138 - RNA, 22 nt, Human
aaaaaauuaucauaguuccuga

SEQ ID NO: 508139 - RNA, 22 nt, Human
ucucaccauggugcuugcuuau

SEQ ID NO: 508140 - RNA, 22 nt, Human
agauacauagcugugagcacac

SEQ ID NO: 508141 - RNA, 22 nt, Human
caggcccagcccuuagccaggu

SEQ ID NO: 508142 - RNA, 22 nt, Human
aauauguuccacuuaaagcugg

SEQ ID NO: 508143 - RNA, 22 nt, Human
ccagacuggggcuccuugaggg

SEQ ID NO: 508144 - RNA, 22 nt, Human
ccaggcugcuuagccuuaucuu

SEQ ID NO: 508145 - RNA, 22 nt, Human
acacaugcugauaagaauauaa

SEQ ID NO: 508146 - RNA, 22 nt, Human
uccuguggcguuaucaugugau

SEQ ID NO: 508147 - RNA, 22 nt, Human
gugaggugguacaauauuaacu

SEQ ID NO: 508148 - RNA, 22 nt, Human
gagagugucgggggccccagga

SEQ ID NO: 508149 - RNA, 20 nt, Human
cccaggagugagcagcuuua

SEQ ID NO: 508150 - RNA, 22 nt, Human
gcaggcagagguggaggagaca

SEQ ID NO: 508151 - RNA, 20 nt, Human
aggcagcuggccaggcaggu

SEQ ID NO: 508152 - RNA, 23 nt, Human
ugugucugaggauauaugugcau

SEQ ID NO: 508153 - RNA, 22 nt, Human
gauucuuacuucuaagcaagcu

SEQ ID NO: 508154 - RNA, 22 nt, Human
caggggcuuuuccucuauaagg

SEQ ID NO: 508155 - RNA, 22 nt, Human
uagaaauggggaaguaguuagg

SEQ ID NO: 508156 - RNA, 22 nt, Human
aaaggccucuguccuagugccu

SEQ ID NO: 508157 - RNA, 22 nt, Human
aaaguccuuuuugccaugcaag

SEQ ID NO: 508158 - RNA, 22 nt, Human
agggccugcaucaggagcuugg

SEQ ID NO: 508159 - RNA, 22 nt, Human
aaacucugaugcuuauugggaa

SEQ ID NO: 508160 - RNA, 17 nt, Human
cugucugcgcaugaggu

SEQ ID NO: 508161 - RNA, 22 nt, Human
aaaagagagcugaggagcucca

SEQ ID NO: 508162 - RNA, 22 nt, Human
ucagcaaugagaacuggcauuu

SEQ ID NO: 508163 - RNA, 18 nt, Human
guguccuggcugcggcgc

SEQ ID NO: 508164 - RNA, 22 nt, Human
ugcugccuuagcagccaggcaa

SEQ ID NO: 508165 - RNA, 22 nt, Human
uugugucugggggagugacauc

SEQ ID NO: 508166 - RNA, 22 nt, Human
gcacccagaggucagcagugcu

SEQ ID NO: 508167 - RNA, 22 nt, Human
aaugaacaaaauaugcuuugca

SEQ ID NO: 508168 - RNA, 22 nt, Human
gccugcaguucugugcuaggca

SEQ ID NO: 508169 - RNA, 22 nt, Human
uuccugggaggcuguguacuug

SEQ ID NO: 508170 - RNA, 22 nt, Human
gaaagauaaucaauuacuccuu

SEQ ID NO: 508171 - RNA, 22 nt, Human
cugcccaggcugaaggaacauc

SEQ ID NO: 508172 - RNA, 22 nt, Human
ugaagcagcaccauuuuagagc

SEQ ID NO: 508173 - RNA, 22 nt, Human
cagcucagacgcaggucgagca

SEQ ID NO: 508174 - RNA, 22 nt, Human
cuaauacucauuucuguaacuc

SEQ ID NO: 508175 - RNA, 21 nt, Human
aaggcuggagaugcaggucug

SEQ ID NO: 508176 - RNA, 22 nt, Human
ggcacugauuccauucaugaag

SEQ ID NO: 508177 - RNA, 22 nt, Human
cauggccaaggaugcucaacca

SEQ ID NO: 508178 - RNA, 22 nt, Human
uguagcagugucuaccacauua

SEQ ID NO: 508179 - RNA, 22 nt, Human
uuuuauuggagugauaccaagc

SEQ ID NO: 508180 - RNA, 21 nt, Human
uucugccuucgaggucucagg

SEQ ID NO: 508181 - RNA, 22 nt, Human
aucugccuccaaguccaugugu

SEQ ID NO: 508182 - RNA, 22 nt, Human
gagggcugccacguugggcgag

SEQ ID NO: 508183 - RNA, 22 nt, Human
cuccugggcugggaacucagcc

SEQ ID NO: 508184 - RNA, 23 nt, Human
uguaacuucuuaaauucuucacu

SEQ ID NO: 508185 - RNA, 22 nt, Human
uuccugagggacuuuugagauu

SEQ ID NO: 508186 - RNA, 22 nt, Human
aaguggacuaauacaaggacua

SEQ ID NO: 508187 - RNA, 22 nt, Human
agagggcugcugcacagugcuc

SEQ ID NO: 508188 - RNA, 22 nt, Human
cuacugaguccuucagcugcca

SEQ ID NO: 508189 - RNA, 21 nt, Human
gcugggcuccagucugccgcu

SEQ ID NO: 508190 - RNA, 22 nt, Human
ucagaaauagucuuuaaaauga

SEQ ID NO: 508191 - RNA, 22 nt, Human
caggccacaaguuggguucaag

SEQ ID NO: 508192 - RNA, 22 nt, Human
gaacagcuucuugggagcuggg

SEQ ID NO: 508193 - RNA, 22 nt, Human
uaagcugugggagauuggcaua

SEQ ID NO: 508194 - RNA, 22 nt, Human
aaagguuaguucuuagaagugc

SEQ ID NO: 508195 - RNA, 22 nt, Human
ugggcucucaaagugcggcuug

SEQ ID NO: 508196 - RNA, 22 nt, Human
caggcugggcagccuccccggc

SEQ ID NO: 508197 - RNA, 21 nt, Human
gcuccuggugcugcguggcgc

SEQ ID NO: 508198 - RNA, 21 nt, Human
agaggccuuacaggauagacc

SEQ ID NO: 508199 - RNA, 22 nt, Human
uuuucauuagaaugacugagaa

SEQ ID NO: 508200 - RNA, 22 nt, Human
caaaauguucuggcaccuuuaa

SEQ ID NO: 508201 - RNA, 22 nt, Human
gggcagguaggugaaauaauga

SEQ ID NO: 508202 - RNA, 22 nt, Human
aucugccucuucuucauugcga

SEQ ID NO: 508203 - RNA, 22 nt, Human
ccaucccugccauuauagccca

SEQ ID NO: 508204 - RNA, 20 nt, Human
agguauaagaaaugugauuu

SEQ ID NO: 508205 - RNA, 22 nt, Human
ccugggcaucucaugcaccugc

SEQ ID NO: 508206 - RNA, 17 nt, Human
uuccuggaagucauucc

SEQ ID NO: 508207 - RNA, 22 nt, Human
cagcaugacagucugcagcaga

SEQ ID NO: 508208 - RNA, 22 nt, Human
cagagccccuggguugggagcu

SEQ ID NO: 508209 - RNA, 22 nt, Human
ggccagguuggguggaaguggc

SEQ ID NO: 508210 - RNA, 22 nt, Human
ccagggcauguaacuaauggug

SEQ ID NO: 508211 - RNA, 22 nt, Human
cgggcacacacuugacagguuc

SEQ ID NO: 508212 - RNA, 22 nt, Human
ugagcccuaagggucaagcagg

SEQ ID NO: 508213 - RNA, 22 nt, Human
gagcuuggacaccuuggcaggu

SEQ ID NO: 508214 - RNA, 22 nt, Human
ucaggagauguaaccuuagcug

SEQ ID NO: 508215 - RNA, 22 nt, Human
aaggccagauucacuuuacaau

SEQ ID NO: 508216 - RNA, 23 nt, Human
acacaauagaguacuauucagcc

SEQ ID NO: 508217 - RNA, 23 nt, Human
ggucccaguggagaggccucacc

SEQ ID NO: 508218 - RNA, 22 nt, Human
gcugagagugggugcagugcuu

SEQ ID NO: 508219 - RNA, 22 nt, Human
gcuggccacauugugccguccu

SEQ ID NO: 508220 - RNA, 22 nt, Human
ccuggcaggcaagaggaaggga

SEQ ID NO: 508221 - RNA, 22 nt, Human
gggcacaggagaaggaucuggc

SEQ ID NO: 508222 - RNA, 22 nt, Human
ccugaguagcuggaauuaaagg

SEQ ID NO: 508223 - RNA, 22 nt, Human
cuuuagaaggguaacggaauua

SEQ ID NO: 508224 - RNA, 22 nt, Human
cccaggucuccugcuucccagg

SEQ ID NO: 508225 - RNA, 21 nt, Human
guauucuuuaugaagugaaaa

SEQ ID NO: 508226 - RNA, 22 nt, Human
acucugggcuguuaggagcugu

SEQ ID NO: 508227 - RNA, 22 nt, Human
uggaccugcguaggugcugggc

SEQ ID NO: 508228 - RNA, 22 nt, Human
auguccagaggugagucagagc

SEQ ID NO: 508229 - RNA, 22 nt, Human
ggaggccaucagggagggcauu

SEQ ID NO: 508230 - RNA, 19 nt, Human
cugggcugaggucugccuu

SEQ ID NO: 508231 - RNA, 22 nt, Human
uucuggagaucugccuauggga

SEQ ID NO: 508232 - RNA, 22 nt, Human
uccucagacuucccuuugugua

SEQ ID NO: 508233 - RNA, 22 nt, Human
ugaggcaggagaaucacaugaa

SEQ ID NO: 508234 - RNA, 22 nt, Human
cugugggcucccagcuucucuc

SEQ ID NO: 508235 - RNA, 22 nt, Human
ggcccugggcagaggagugggc

SEQ ID NO: 508236 - RNA, 22 nt, Human
gccuggagcuacuggacacuga

SEQ ID NO: 508237 - RNA, 22 nt, Human
uagggcagccuuauagcuccca

SEQ ID NO: 508238 - RNA, 22 nt, Human
aaagauugaaagagaauuuguc

SEQ ID NO: 508239 - RNA, 22 nt, Human
uggcagagcccagacuccaguc

SEQ ID NO: 508240 - RNA, 22 nt, Human
gggaugagagcugggacagaag

SEQ ID NO: 508241 - RNA, 22 nt, Human
gugugcagugagcaaaagaucu

SEQ ID NO: 508242 - RNA, 22 nt, Human
cccucaguuuuccagugugggc

SEQ ID NO: 508243 - RNA, 19 nt, Human
accaggaguaucagagcug

SEQ ID NO: 508244 - RNA, 22 nt, Human
guucuucaccaaggucagaggc

SEQ ID NO: 508245 - RNA, 22 nt, Human
uugaagcaugguacuuguucaa

SEQ ID NO: 508246 - RNA, 22 nt, Human
uggccucuggcugaggacuaac

SEQ ID NO: 508247 - RNA, 19 nt, Human
ucaaugcaugaaaucagcc

SEQ ID NO: 508248 - RNA, 17 nt, Human
ugaaaucagcacccagg

SEQ ID NO: 508249 - RNA, 22 nt, Human
cauuacaaccccaaauuacaaa

SEQ ID NO: 508250 - RNA, 22 nt, Human
cuuacauugugugcaugagggg

SEQ ID NO: 508251 - RNA, 22 nt, Human
uauguguuugacacccugcaag

SEQ ID NO: 508252 - RNA, 22 nt, Human
cauaauuacugauaugcugauu

SEQ ID NO: 508253 - RNA, 22 nt, Human
ccuggcuccugcacagaucuuu

SEQ ID NO: 508254 - RNA, 22 nt, Human
auggcuagcaccgcguugcugg

SEQ ID NO: 508255 - RNA, 22 nt, Human
ugucugguggguugacaggcag

SEQ ID NO: 508256 - RNA, 22 nt, Human
gccucugcgccucagccgaccu

SEQ ID NO: 508257 - RNA, 21 nt, Human
aaagagguuaauauuguaagu

SEQ ID NO: 508258 - RNA, 22 nt, Human
ucugucugagugguguuagagu

SEQ ID NO: 508259 - RNA, 22 nt, Human
cagaagcagugagagaugugca

SEQ ID NO: 508260 - RNA, 22 nt, Human
ggcaguuuuaacagagguagua

SEQ ID NO: 508261 - RNA, 22 nt, Human
ucauugcagaaauaaaggugaa

SEQ ID NO: 508262 - RNA, 22 nt, Human
gcuggguuuucuuccgggccua

SEQ ID NO: 508263 - RNA, 22 nt, Human
aaaaauacuucacuucugggug

SEQ ID NO: 508264 - RNA, 19 nt, Human
auagaaaggguuaaagaca

SEQ ID NO: 508265 - RNA, 18 nt, Human
ggucugagaucguuuuuc

SEQ ID NO: 508266 - RNA, 22 nt, Human
aguaaugugccugaaauacuug

SEQ ID NO: 508267 - RNA, 22 nt, Human
guuuccaaccccaccaaagugc

SEQ ID NO: 508268 - RNA, 22 nt, Human
uggagguacauaaugagagggu

SEQ ID NO: 508269 - RNA, 22 nt, Human
ugaagcagagugaaggugaauu

SEQ ID NO: 508270 - RNA, 22 nt, Human
uggugcaauauuaugaaaggua

SEQ ID NO: 508271 - RNA, 22 nt, Human
uagcccagagucccaauuccag

SEQ ID NO: 508272 - RNA, 22 nt, Human
uaucuuugcaaauaucucuaag

SEQ ID NO: 508273 - RNA, 22 nt, Human
acagagucucagggaugaaagc

SEQ ID NO: 508274 - RNA, 22 nt, Human
ucuuggcuacuuaggaggauuc

SEQ ID NO: 508275 - RNA, 22 nt, Human
caaaguauaguguaggauggca

SEQ ID NO: 508276 - RNA, 22 nt, Human
aaguguuuauuuauaacgaucu

SEQ ID NO: 508277 - RNA, 23 nt, Human
cagguggcuccacgagggguggg

SEQ ID NO: 508278 - RNA, 21 nt, Human
ccagcuuucccaagucccuuu

SEQ ID NO: 508279 - RNA, 22 nt, Human
cugggcucuaggaaccauuccu

SEQ ID NO: 508280 - RNA, 18 nt, Human
uugagggaggggcagagu

SEQ ID NO: 508281 - RNA, 22 nt, Human
agcauuccacacugaagucugc

SEQ ID NO: 508282 - RNA, 22 nt, Human
uuauguaauuuguuugcucuuc

SEQ ID NO: 508283 - RNA, 19 nt, Human
ccagucccauacaggagau

SEQ ID NO: 508284 - RNA, 22 nt, Human
cacuguacugugaauaaggagg

SEQ ID NO: 508285 - RNA, 22 nt, Human
caaagcaggcuugucaaauugc

SEQ ID NO: 508286 - RNA, 22 nt, Human
agcuucuccaucugcccagaga

SEQ ID NO: 508287 - RNA, 22 nt, Human
ggggcagcucccgagggcagga

SEQ ID NO: 508288 - RNA, 22 nt, Human
ccaaagagcuagaauuauaggc

SEQ ID NO: 508289 - RNA, 22 nt, Human
caugaagcauguuuugucauga

SEQ ID NO: 508290 - RNA, 22 nt, Human
agggugccuggaagccacucac

SEQ ID NO: 508291 - RNA, 22 nt, Human
uucuaguuaaaguauguauuag

SEQ ID NO: 508292 - RNA, 22 nt, Human
agaaggccagauggacggggcu

SEQ ID NO: 508293 - RNA, 22 nt, Human
gccaggcuggcaaaaggaaacc

SEQ ID NO: 508294 - RNA, 22 nt, Human
aucuggcugagcgaggcccaca

SEQ ID NO: 508295 - RNA, 22 nt, Human
ucagguccccaacucuucucac

SEQ ID NO: 508296 - RNA, 22 nt, Human
cagcagcccacgcgugcugucc

SEQ ID NO: 508297 - RNA, 22 nt, Human
uccucugcuguucugguucuuu

SEQ ID NO: 508298 - RNA, 22 nt, Human
auuauuugaguuccucucuacc

SEQ ID NO: 508299 - RNA, 21 nt, Human
aguguccuugaucuugccuug

SEQ ID NO: 508300 - RNA, 22 nt, Human
ccagagcccgggaccuggacuu

SEQ ID NO: 508301 - RNA, 22 nt, Human
ggccucgcggcuucugguggcu

SEQ ID NO: 508302 - RNA, 22 nt, Human
aggcaguuuaggcagcgauuua

SEQ ID NO: 508303 - RNA, 22 nt, Human
uggggcagcagaccuuucuugg

SEQ ID NO: 508304 - RNA, 22 nt, Human
uacagagacccacaagagacug

SEQ ID NO: 508305 - RNA, 22 nt, Human
ucacuguaauagguuugaagau

SEQ ID NO: 508306 - RNA, 22 nt, Human
cagaggcugggaccucaggcau

SEQ ID NO: 508307 - RNA, 22 nt, Human
cuguggcuaggaagcuguggga

SEQ ID NO: 508308 - RNA, 22 nt, Human
ucagaaaccagcucucucaauu

SEQ ID NO: 508309 - RNA, 22 nt, Human
cagugcauagauccugaggccu

SEQ ID NO: 508310 - RNA, 22 nt, Human
ucuauuuaccaaauguaguucc

SEQ ID NO: 508311 - RNA, 22 nt, Human
ucuggcccagccccugauccca

SEQ ID NO: 508312 - RNA, 22 nt, Human
ucugccuggauuccauucucca

SEQ ID NO: 508313 - RNA, 22 nt, Human
ggccuugggaggagggucagaa

SEQ ID NO: 508314 - RNA, 17 nt, Human
aggcagcucagaacauc

SEQ ID NO: 508315 - RNA, 19 nt, Human
cuguccuuggcugcacugu

SEQ ID NO: 508316 - RNA, 22 nt, Human
ugaaagguuaaaaguaguauug

SEQ ID NO: 508317 - RNA, 19 nt, Human
ggaugagggucaggcauag

SEQ ID NO: 508318 - RNA, 22 nt, Human
cuuccaggugcuggccuggccu

SEQ ID NO: 508319 - RNA, 22 nt, Human
cauggcaggaaaaugaacaggc

SEQ ID NO: 508320 - RNA, 19 nt, Human
uguggccaugguucagcug

SEQ ID NO: 508321 - RNA, 21 nt, Human
ggcagcccgcccucuccuggc

SEQ ID NO: 508322 - RNA, 22 nt, Human
ugaauaagaauuauuauaauga

SEQ ID NO: 508323 - RNA, 22 nt, Human
ucagcuuugcaaguuagaaaau

SEQ ID NO: 508324 - RNA, 22 nt, Human
agcugucuuucugccuccugau

SEQ ID NO: 508325 - RNA, 20 nt, Human
cacaggcuauaugagagcca

SEQ ID NO: 508326 - RNA, 22 nt, Human
cuccucucaggcuggauggcgc

SEQ ID NO: 508327 - RNA, 19 nt, Human
uuugucucugaauaauauu

SEQ ID NO: 508328 - RNA, 22 nt, Human
cacacauuucagaugcuacaau

SEQ ID NO: 508329 - RNA, 16 nt, Human
agcagggcgggaagga

SEQ ID NO: 508330 - RNA, 22 nt, Human
aaagccuugcccgucacuggga

SEQ ID NO: 508331 - RNA, 22 nt, Human
ccagagaggccaaggucguggu

SEQ ID NO: 508332 - RNA, 22 nt, Human
gugggagcuuuggcaucaggcu

SEQ ID NO: 508333 - RNA, 22 nt, Human
ugauuacacagcaguaauuuca

SEQ ID NO: 508334 - RNA, 22 nt, Human
gggcagguacaagaugcuucuu

SEQ ID NO: 508335 - RNA, 22 nt, Human
uuuggugauagugcagagaaau

SEQ ID NO: 508336 - RNA, 22 nt, Human
aagggagguaaagcuauuuaaa

SEQ ID NO: 508337 - RNA, 22 nt, Human
caaauacuaaacauaagauuuu

SEQ ID NO: 508338 - RNA, 23 nt, Human
agggaaaguaguaauggccuuug

SEQ ID NO: 508339 - RNA, 22 nt, Human
auuagggaaacugacuugucuc

SEQ ID NO: 508340 - RNA, 22 nt, Human
ccagggcagaaaaagagggaau

SEQ ID NO: 508341 - RNA, 22 nt, Human
caggcagauuugcugcccucca

SEQ ID NO: 508342 - RNA, 22 nt, Human
ugugcugcucucagugacagcc

SEQ ID NO: 508343 - RNA, 22 nt, Human
ugagugugcagggaaguggcgg

SEQ ID NO: 508344 - RNA, 21 nt, Human
ugugaguccaucugagcagaa

SEQ ID NO: 508345 - RNA, 22 nt, Human
cuggugagacgguugacaggag

SEQ ID NO: 508346 - RNA, 22 nt, Human
gaggccugguagccgagcccca

SEQ ID NO: 508347 - RNA, 22 nt, Human
uucaaaccuucacuugcagagu

SEQ ID NO: 508348 - RNA, 22 nt, Human
cauuuauugaguggccacagug

SEQ ID NO: 508349 - RNA, 22 nt, Human
agcuucucagaagaguccugua

SEQ ID NO: 508350 - RNA, 23 nt, Human
ugaaucaauuaugggauucaaug

SEQ ID NO: 508351 - RNA, 22 nt, Human
cagagagaggccacugcuauua

SEQ ID NO: 508352 - RNA, 22 nt, Human
uuucucuuugacaggaaucaga

SEQ ID NO: 508353 - RNA, 22 nt, Human
aucaggaucagggcuagcagag

SEQ ID NO: 508354 - RNA, 23 nt, Human
aggugccaacugagagcugagag

SEQ ID NO: 508355 - RNA, 22 nt, Human
acacuaguagaauaguguuugc

SEQ ID NO: 508356 - RNA, 22 nt, Human
augaauugaaagaagaauaucu

SEQ ID NO: 508357 - RNA, 22 nt, Human
gugcagcugugugagagcucca

SEQ ID NO: 508358 - RNA, 22 nt, Human
caaaugcuaacuucuuuccaaa

SEQ ID NO: 508359 - RNA, 22 nt, Human
gcagaauguaggccuucagugu

SEQ ID NO: 508360 - RNA, 22 nt, Human
cucucuucccgugaguguugca

SEQ ID NO: 508361 - RNA, 22 nt, Human
gcagccuccgcacugcgagucc

SEQ ID NO: 508362 - RNA, 22 nt, Human
acaguguuuugucuggcagggc

SEQ ID NO: 508363 - RNA, 18 nt, Human
agggccagcugugaguag

SEQ ID NO: 508364 - RNA, 22 nt, Human
gucaauaauugauagauauugg

SEQ ID NO: 508365 - RNA, 22 nt, Human
ccuggcagucaggggaguccuu

SEQ ID NO: 508366 - RNA, 22 nt, Human
ggcugcugguagggguaggaag

SEQ ID NO: 508367 - RNA, 22 nt, Human
aagaaaacaaugacuugccagc

SEQ ID NO: 508368 - RNA, 22 nt, Human
uguaacaguaagccugugagcu

SEQ ID NO: 508369 - RNA, 22 nt, Human
agcagcauguaugagggugaac

SEQ ID NO: 508370 - RNA, 22 nt, Human
uucuaguuuucaguccaccagg

SEQ ID NO: 508371 - RNA, 22 nt, Human
uuucagaggaggaaggcaguua

SEQ ID NO: 508372 - RNA, 22 nt, Human
cagcccuggccucuucgcuuuc

SEQ ID NO: 508373 - RNA, 22 nt, Human
guacaaaguggaccugauagua

SEQ ID NO: 508374 - RNA, 22 nt, Human
cucucaguccugcgcgccucug

SEQ ID NO: 508375 - RNA, 22 nt, Human
gcucaggaaauaguuuaguguu

SEQ ID NO: 508376 - RNA, 22 nt, Human
aagauucagccaaauuguucau

SEQ ID NO: 508377 - RNA, 22 nt, Human
auauguguauuugguuagccua

SEQ ID NO: 508378 - RNA, 21 nt, Human
agacagcuuuaaagacacagg

SEQ ID NO: 508379 - RNA, 22 nt, Human
caccucuuugauuugaggcaag

SEQ ID NO: 508380 - RNA, 22 nt, Human
ccucaggggugcccacagcugc

SEQ ID NO: 508381 - RNA, 22 nt, Human
acaggacaggcugggcuagacu

SEQ ID NO: 508382 - RNA, 22 nt, Human
cagguucccuagcagcaaagcc

SEQ ID NO: 508383 - RNA, 22 nt, Human
acacacacaagcagguugugga

SEQ ID NO: 508384 - RNA, 22 nt, Human
caggggcgguggcucacgccug

SEQ ID NO: 508385 - RNA, 22 nt, Human
aagaguuucugauucaguaggu

SEQ ID NO: 508386 - RNA, 21 nt, Human
gcugucuccuccuugcaccag

SEQ ID NO: 508387 - RNA, 22 nt, Human
uggccuuguguuuuagagaaag

SEQ ID NO: 508388 - RNA, 22 nt, Human
ugucacagucucgugagcaucu

SEQ ID NO: 508389 - RNA, 22 nt, Human
auaagagcuagucuuuuccuug

SEQ ID NO: 508390 - RNA, 22 nt, Human
ucccaggguccucuucuggaau

SEQ ID NO: 508391 - RNA, 22 nt, Human
uucuuugcccuuaaugaaauaa

SEQ ID NO: 508392 - RNA, 22 nt, Human
agcagcucaaagccugcaagga

SEQ ID NO: 508393 - RNA, 22 nt, Human
uguguccuguccccuugcugcu

SEQ ID NO: 508394 - RNA, 22 nt, Human
aggcuccagcagccagaggaag

SEQ ID NO: 508395 - RNA, 22 nt, Human
gcugaggcucaagucauggguc

SEQ ID NO: 508396 - RNA, 22 nt, Human
ggccucugcccucacuccuguc

SEQ ID NO: 508397 - RNA, 21 nt, Human
aaaaagcuggggcaugcaugc

SEQ ID NO: 508398 - RNA, 22 nt, Human
aagauuuucagcuaauggugca

SEQ ID NO: 508399 - RNA, 22 nt, Human
aggcucagagaugaguaagcac

SEQ ID NO: 508400 - RNA, 22 nt, Human
aaucagucauuagcucugaccu

SEQ ID NO: 508401 - RNA, 22 nt, Human
acugggcuucacuuggcacauc

SEQ ID NO: 508402 - RNA, 22 nt, Human
accugggaggcggagguugcag

SEQ ID NO: 508403 - RNA, 22 nt, Human
ccugagaccaaguugcagccau

SEQ ID NO: 508404 - RNA, 22 nt, Human
ucuguucagacacuuuacaugu

SEQ ID NO: 508405 - RNA, 23 nt, Human
agccuucaggcaaugucaguaga

SEQ ID NO: 508406 - RNA, 21 nt, Human
gccugcagaccccaccaggcu

SEQ ID NO: 508407 - RNA, 22 nt, Human
uggcugaauaaaauaugguguu

SEQ ID NO: 508408 - RNA, 18 nt, Human
gugacagcugcuagcuca

SEQ ID NO: 508409 - RNA, 22 nt, Human
ugaugaaauguugaggcaguga

SEQ ID NO: 508410 - RNA, 22 nt, Human
cacagcuggggaagcugaggcc

SEQ ID NO: 508411 - RNA, 23 nt, Human
aguggcuggacagacuuuccugg

SEQ ID NO: 508412 - RNA, 22 nt, Human
ccugccagggccuuggaagaaa

SEQ ID NO: 508413 - RNA, 22 nt, Human
acucaggaagaaagcagcuggu

SEQ ID NO: 508414 - RNA, 22 nt, Human
uuauuagcugggcuucagggug

SEQ ID NO: 508415 - RNA, 22 nt, Human
ccaggcucugcgcuggacaugg

SEQ ID NO: 508416 - RNA, 22 nt, Human
cauagagugauguaagguaugu

SEQ ID NO: 508417 - RNA, 20 nt, Human
uaaggcuguuuuguauuccu

SEQ ID NO: 508418 - RNA, 22 nt, Human
agcagggaggucuagcacgugg

SEQ ID NO: 508419 - RNA, 22 nt, Human
uuccugccuacaugccuuaugc

SEQ ID NO: 508420 - RNA, 22 nt, Human
gagcucuggcagggcaggucug

SEQ ID NO: 508421 - RNA, 22 nt, Human
ucagccucagguguucagauuu

SEQ ID NO: 508422 - RNA, 22 nt, Human
agcaggcuuucaagagucuucu

SEQ ID NO: 508423 - RNA, 23 nt, Human
uggccuggagagaaaagaugagu

SEQ ID NO: 508424 - RNA, 22 nt, Human
gcagcuuucugcaaugucaucc

SEQ ID NO: 508425 - RNA, 22 nt, Human
uaaggcacgcauaagagggggc

SEQ ID NO: 508426 - RNA, 22 nt, Human
gagcucagccugaggccuggcu

SEQ ID NO: 508427 - RNA, 22 nt, Human
agacaggacacaagcugcauaa

SEQ ID NO: 508428 - RNA, 22 nt, Human
agaugggcgcccuggacugagg

SEQ ID NO: 508429 - RNA, 22 nt, Human
ugccagcucccuuuucuccucc

SEQ ID NO: 508430 - RNA, 22 nt, Human
uccuggcccucugcaaacgcca

SEQ ID NO: 508431 - RNA, 22 nt, Human
auuuauuaccucggaguuucug

SEQ ID NO: 508432 - RNA, 22 nt, Human
cugucuccuccacugcauggga

SEQ ID NO: 508433 - RNA, 22 nt, Human
ugcugaauuccagggccccacu

SEQ ID NO: 508434 - RNA, 22 nt, Human
guuauguacuuuuuaaaucuug

SEQ ID NO: 508435 - RNA, 22 nt, Human
uagacagauuucuuguuagaca

SEQ ID NO: 508436 - RNA, 17 nt, Human
cugagcauccgugcucu

SEQ ID NO: 508437 - RNA, 22 nt, Human
gaaauaacagcucuggaagagu

SEQ ID NO: 508438 - RNA, 22 nt, Human
cuauuugucacaacugguguuu

SEQ ID NO: 508439 - RNA, 17 nt, Human
gcuaggagagggaggag

SEQ ID NO: 508440 - RNA, 22 nt, Human
gggccucugugcagaggggccu

SEQ ID NO: 508441 - RNA, 22 nt, Human
aaaucuguaagcaauugcucag

SEQ ID NO: 508442 - RNA, 22 nt, Human
gccaccuguuucagaugugguu

SEQ ID NO: 508443 - RNA, 22 nt, Human
ccuaguccccaggaggucagug

SEQ ID NO: 508444 - RNA, 19 nt, Human
uuuacaaguucuuuguaug

SEQ ID NO: 508445 - RNA, 22 nt, Human
agagccugaggccaggaaaaug

SEQ ID NO: 508446 - RNA, 23 nt, Human
gggagccauggguggucauggag

SEQ ID NO: 508447 - RNA, 22 nt, Human
uaggaacauaugcagugcuuuu

SEQ ID NO: 508448 - RNA, 22 nt, Human
aaagaaauagauggcauuuaaa

SEQ ID NO: 508449 - RNA, 22 nt, Human
auugacaagaaagauauuuuua

SEQ ID NO: 508450 - RNA, 22 nt, Human
gggccagagcuuggcagcuggg

SEQ ID NO: 508451 - RNA, 22 nt, Human
uuccugggcaggacgagagucu

SEQ ID NO: 508452 - RNA, 22 nt, Human
cauggacucugguuuggggagc

SEQ ID NO: 508453 - RNA, 22 nt, Human
uccugccugcaaucccagcacu

SEQ ID NO: 508454 - RNA, 22 nt, Human
uuucugcugugcuuucuugcgu

SEQ ID NO: 508455 - RNA, 19 nt, Human
ugaccccacgcuccagagc

SEQ ID NO: 508456 - RNA, 22 nt, Human
uuugcuuguucaagauuucugu

SEQ ID NO: 508457 - RNA, 22 nt, Human
agcaaaguagcugcuguucuua

SEQ ID NO: 508458 - RNA, 22 nt, Human
ucagugcauucauggguggcug

SEQ ID NO: 508459 - RNA, 22 nt, Human
aagugacuauuugaguacauca

SEQ ID NO: 508460 - RNA, 22 nt, Human
ugaugcugagccugggacugac

SEQ ID NO: 508461 - RNA, 22 nt, Human
cauuuguauagugcuuagacca

SEQ ID NO: 508462 - RNA, 22 nt, Human
aauuccacagaugucuaucugu

SEQ ID NO: 508463 - RNA, 22 nt, Human
uucucugggaucuggcaaaagg

SEQ ID NO: 508464 - RNA, 22 nt, Human
uccucucagugugguuguggga

SEQ ID NO: 508465 - RNA, 22 nt, Human
cucugcuggccaugaagagaga

SEQ ID NO: 508466 - RNA, 22 nt, Human
ggcucugcccagguggacagca

SEQ ID NO: 508467 - RNA, 17 nt, Human
agcagaagucagaggga

SEQ ID NO: 508468 - RNA, 22 nt, Human
auguuuuauguuccacucaagg

SEQ ID NO: 508469 - RNA, 22 nt, Human
cccugcaguccuuucuuggcuc

SEQ ID NO: 508470 - RNA, 22 nt, Human
uucuggcugaaaguuuauuuga

SEQ ID NO: 508471 - RNA, 22 nt, Human
caggcugcagaggccuuucaug

SEQ ID NO: 508472 - RNA, 22 nt, Human
ucacaggagggagagacaccca

SEQ ID NO: 508473 - RNA, 22 nt, Human
ugaaacaaaccaguaauuuugu

SEQ ID NO: 508474 - RNA, 22 nt, Human
agaguucugcucuucucaguga

SEQ ID NO: 508475 - RNA, 22 nt, Human
augaguaaaaccacuauuuaca

SEQ ID NO: 508476 - RNA, 22 nt, Human
cuguuuaucuaggaguugcagg

SEQ ID NO: 508477 - RNA, 22 nt, Human
gcugggagcaaagccaugcaua

SEQ ID NO: 508478 - RNA, 22 nt, Human
cugagagccuccuguuggcuag

SEQ ID NO: 508479 - RNA, 22 nt, Human
ugccugggggacuaaggccaaa

SEQ ID NO: 508480 - RNA, 22 nt, Human
ggcuagaauaauugacuucauu

SEQ ID NO: 508481 - RNA, 22 nt, Human
ccugagagcauuccacacugaa

SEQ ID NO: 508482 - RNA, 22 nt, Human
auauaaguuaguggucauguuu

SEQ ID NO: 508483 - RNA, 22 nt, Human
gguggggcccuggcacugguau

SEQ ID NO: 508484 - RNA, 19 nt, Human
cucugggcugcaucuuggu

SEQ ID NO: 508485 - RNA, 22 nt, Human
uggaucugacuggcuuuucuuc

SEQ ID NO: 508486 - RNA, 22 nt, Human
aucaggaacguucauggacugu

SEQ ID NO: 508487 - RNA, 22 nt, Human
agagacugcaaugagugguagg

SEQ ID NO: 508488 - RNA, 22 nt, Human
auggcccaggccuccuguggcu

SEQ ID NO: 508489 - RNA, 22 nt, Human
aguccugguucugauucugaca

SEQ ID NO: 508490 - RNA, 22 nt, Human
ucauaagcuagcugcaccauau

SEQ ID NO: 508491 - RNA, 19 nt, Human
ucagggaaguucaaagcuc

SEQ ID NO: 508492 - RNA, 22 nt, Human
cugccuuggaaaaugugguaau

SEQ ID NO: 508493 - RNA, 22 nt, Human
uggcaugggcaaaccagggaaa

SEQ ID NO: 508494 - RNA, 22 nt, Human
cucacagaugcugugggucagg

SEQ ID NO: 508495 - RNA, 23 nt, Human
aggauccugguacaggagcagag

SEQ ID NO: 508496 - RNA, 22 nt, Human
ucaucaguuuagaaaaaauaug

SEQ ID NO: 508497 - RNA, 22 nt, Human
ucugucuuggccagccaucugg

SEQ ID NO: 508498 - RNA, 22 nt, Human
uccagggagagccgcugcucca

SEQ ID NO: 508499 - RNA, 22 nt, Human
uuuugucuaagaacuuugcaaa

SEQ ID NO: 508500 - RNA, 22 nt, Human
ugcaggcuguuugguggaucuc

SEQ ID NO: 508501 - RNA, 20 nt, Human
ugggcagcacugcuggcugg

SEQ ID NO: 508502 - RNA, 22 nt, Human
agagugaagguugacacuucac

SEQ ID NO: 508503 - RNA, 22 nt, Human
gcagcuguggguuccaagucua

SEQ ID NO: 508504 - RNA, 22 nt, Human
ccagcaugagacgaugaugaag

SEQ ID NO: 508505 - RNA, 18 nt, Human
aaggccuagucccucucu

SEQ ID NO: 508506 - RNA, 22 nt, Human
gucaccaggucugaugcagcca

SEQ ID NO: 508507 - RNA, 22 nt, Human
auuaaauuagcaaacugugaaa

SEQ ID NO: 508508 - RNA, 22 nt, Human
ccauggccaggaaagccaaggu

SEQ ID NO: 508509 - RNA, 22 nt, Human
cagcccuggccccagguggucu

SEQ ID NO: 508510 - RNA, 22 nt, Human
agcagcauccccggccuccacc

SEQ ID NO: 508511 - RNA, 22 nt, Human
cccuccagagccuggacauucu

SEQ ID NO: 508512 - RNA, 18 nt, Human
uaaaugcauguuaauaac

SEQ ID NO: 508513 - RNA, 22 nt, Human
ugaucuggaauucccuguggua

SEQ ID NO: 508514 - RNA, 22 nt, Human
agccuucaguaagggcuuagca

SEQ ID NO: 508515 - RNA, 22 nt, Human
gcacuaaaccaacauguaauaa

SEQ ID NO: 508516 - RNA, 22 nt, Human
guucucuaucauuagugaauuu

SEQ ID NO: 508517 - RNA, 17 nt, Human
aagagaggcugagcugg

SEQ ID NO: 508518 - RNA, 22 nt, Human
cagcuuuaccuuuaggaguaac

SEQ ID NO: 508519 - RNA, 22 nt, Human
cccaggcacauccacucuguga

SEQ ID NO: 508520 - RNA, 22 nt, Human
ucucuggaauuggcugaggcaa

SEQ ID NO: 508521 - RNA, 22 nt, Human
auacagaaaaugaugcagaguu

SEQ ID NO: 508522 - RNA, 22 nt, Human
ugagccaggcccagugggguca

SEQ ID NO: 508523 - RNA, 17 nt, Human
cgggcauggagggcagg

SEQ ID NO: 508524 - RNA, 20 nt, Human
gccugagcuauugccaggau

SEQ ID NO: 508525 - RNA, 22 nt, Human
uucuaaagacucauggaagugg

SEQ ID NO: 508526 - RNA, 22 nt, Human
gccugggauucucaaaggggug

SEQ ID NO: 508527 - RNA, 22 nt, Human
uuauccaaacuggugaaucauu

SEQ ID NO: 508528 - RNA, 22 nt, Human
cagagccccucagcucucuccc

SEQ ID NO: 508529 - RNA, 22 nt, Human
cuccucuggaaauuccucugcc

SEQ ID NO: 508530 - RNA, 22 nt, Human
cuagauaagguggcuuggaauu

SEQ ID NO: 508531 - RNA, 22 nt, Human
ggucccaggcugcgggcuggug

SEQ ID NO: 508532 - RNA, 22 nt, Human
gcuuccaggucauucucacccu

SEQ ID NO: 508533 - RNA, 22 nt, Human
agggcacaagacucugagcccc

SEQ ID NO: 508534 - RNA, 22 nt, Human
auugguggugaggacaugccag

SEQ ID NO: 508535 - RNA, 22 nt, Human
cugacugucucuucucccauga

SEQ ID NO: 508536 - RNA, 22 nt, Human
aggccugcagcaggagcaaacc

SEQ ID NO: 508537 - RNA, 22 nt, Human
gaaugugucacccugucccaug

SEQ ID NO: 508538 - RNA, 22 nt, Human
gugaggggaguaaagccauguu

SEQ ID NO: 508539 - RNA, 22 nt, Human
auguguagaacuguaaugccca

SEQ ID NO: 508540 - RNA, 22 nt, Human
auguaucaacaaauuguacagu

SEQ ID NO: 508541 - RNA, 22 nt, Human
guggcuucaucaacugugcuua

SEQ ID NO: 508542 - RNA, 22 nt, Human
gcucagagggaacaaggggcug

SEQ ID NO: 508543 - RNA, 22 nt, Human
uugaaggaggcuccuuuuuaaa

SEQ ID NO: 508544 - RNA, 22 nt, Human
gguucacauauugagaguauuc

SEQ ID NO: 508545 - RNA, 22 nt, Human
ugggcucugcugcguaccaguu

SEQ ID NO: 508546 - RNA, 22 nt, Human
uuuccacugggcacggggccag

SEQ ID NO: 508547 - RNA, 22 nt, Human
aauuuucacagugcugugagau

SEQ ID NO: 508548 - RNA, 22 nt, Human
acagagcuguacaugugccaug

SEQ ID NO: 508549 - RNA, 20 nt, Human
gaguccaggggccuguagca

SEQ ID NO: 508550 - RNA, 22 nt, Human
cugcccaggaaggagaggaugg

SEQ ID NO: 508551 - RNA, 22 nt, Human
gaggagagaugguagauugggu

SEQ ID NO: 508552 - RNA, 22 nt, Human
uagaaugagaaaguguagcagg

SEQ ID NO: 508553 - RNA, 22 nt, Human
agaggcaagauuaucagggcau

SEQ ID NO: 508554 - RNA, 22 nt, Human
cagguccucgggggaggccggc

SEQ ID NO: 508555 - RNA, 22 nt, Human
gaagaacaagcagugcuuuccu

SEQ ID NO: 508556 - RNA, 22 nt, Human
ccacagggcacagacaggaagc

SEQ ID NO: 508557 - RNA, 22 nt, Human
cauuagcaggcacuaagaaggu

SEQ ID NO: 508558 - RNA, 22 nt, Human
gcugugugacugagagccuggc

SEQ ID NO: 508559 - RNA, 22 nt, Human
caauuucucuuuauaucucaca

SEQ ID NO: 508560 - RNA, 22 nt, Human
caguccagccaguagggugugg

SEQ ID NO: 508561 - RNA, 22 nt, Human
uccccaccccagaacuacuagg

SEQ ID NO: 508562 - RNA, 23 nt, Human
uguaccaggaguuucagcagacu

SEQ ID NO: 508563 - RNA, 22 nt, Human
caagcuccuuacauccacaggg

SEQ ID NO: 508564 - RNA, 22 nt, Human
ucugaaaugcaggcaauuugcu

SEQ ID NO: 508565 - RNA, 22 nt, Human
cugggcuuuugagucacaaggg

SEQ ID NO: 508566 - RNA, 22 nt, Human
cugucaguucuuccagauagag

SEQ ID NO: 508567 - RNA, 22 nt, Human
gcaggcaccggguugcuccccu

SEQ ID NO: 508568 - RNA, 22 nt, Human
gggggcaggucuggaacuuuga

SEQ ID NO: 508569 - RNA, 22 nt, Human
cacagcaagagcuaaaugacca

SEQ ID NO: 508570 - RNA, 22 nt, Human
ccugugugcugaugacgacaga

SEQ ID NO: 508571 - RNA, 22 nt, Human
ccagagcagaaccggaacacca

SEQ ID NO: 508572 - RNA, 22 nt, Human
uccuugggaaaucacuagcacu

SEQ ID NO: 508573 - RNA, 22 nt, Human
agggaucagcagaggguguggu

SEQ ID NO: 508574 - RNA, 22 nt, Human
uucuccaguuucucccuucagu

SEQ ID NO: 508575 - RNA, 22 nt, Human
uauguacacacacaugcaugua

SEQ ID NO: 508576 - RNA, 20 nt, Human
ugguccaggaccuggugucc

SEQ ID NO: 508577 - RNA, 22 nt, Human
guccagugcuaacagguugagg

SEQ ID NO: 508578 - RNA, 22 nt, Human
uagcauuauuuccucuuuuugu

SEQ ID NO: 508579 - RNA, 22 nt, Human
uugaauaguguuuucaguauac

SEQ ID NO: 508580 - RNA, 22 nt, Human
aggggaggagcuuuucuugccu

SEQ ID NO: 508581 - RNA, 22 nt, Human
uuauuuauuguguaccuacugu

SEQ ID NO: 508582 - RNA, 22 nt, Human
uuggcuuccugcacuugaguuu

SEQ ID NO: 508583 - RNA, 22 nt, Human
ccagccuggguguuagaagaca

SEQ ID NO: 508584 - RNA, 22 nt, Human
uucacaggcuuggagguggggg

SEQ ID NO: 508585 - RNA, 17 nt, Human
gccaaaggguuccaauc

SEQ ID NO: 508586 - RNA, 17 nt, Human
ucuguucaagugagagg

SEQ ID NO: 508587 - RNA, 22 nt, Human
uggcagagaauaaaucuugacu

SEQ ID NO: 508588 - RNA, 22 nt, Human
agagccagccuucucagcuuac

SEQ ID NO: 508589 - RNA, 22 nt, Human
ucccagcauaacaaacugcccg

SEQ ID NO: 508590 - RNA, 22 nt, Human
cagcuuggauuuuggcacgugu

SEQ ID NO: 508591 - RNA, 22 nt, Human
uaaugugugucaucaguagagu

SEQ ID NO: 508592 - RNA, 22 nt, Human
ggaggccaucuggcuggaggcu

SEQ ID NO: 508593 - RNA, 22 nt, Human
gcuguacaaggccucugccauc

SEQ ID NO: 508594 - RNA, 22 nt, Human
gaggcuggugguuaguuccauu

SEQ ID NO: 508595 - RNA, 22 nt, Human
agugugcugcuuaaacaguugu

SEQ ID NO: 508596 - RNA, 22 nt, Human
augggaggcagacacuaaguuc

SEQ ID NO: 508597 - RNA, 22 nt, Human
cccaugccuucugacucacagg

SEQ ID NO: 508598 - RNA, 17 nt, Human
uggcuucaggcugagca

SEQ ID NO: 508599 - RNA, 18 nt, Human
uggcagguccagcugugg

SEQ ID NO: 508600 - RNA, 22 nt, Human
uccuggguccauggcagccgaa

SEQ ID NO: 508601 - RNA, 22 nt, Human
uagaagauaagacaagugcugc

SEQ ID NO: 508602 - RNA, 20 nt, Human
ugcugcuuugccacuaguug

SEQ ID NO: 508603 - RNA, 22 nt, Human
uuuggcauagcucuuuguuccu

SEQ ID NO: 508604 - RNA, 22 nt, Human
ugccacacauugucagguuagu

SEQ ID NO: 508605 - RNA, 19 nt, Human
acagagggcaacugagaaa

SEQ ID NO: 508606 - RNA, 22 nt, Human
aaguccauagguuucaugaggg

SEQ ID NO: 508607 - RNA, 22 nt, Human
accuucaagaaacauuuccuug

SEQ ID NO: 508608 - RNA, 22 nt, Human
cagaaagaccugggcucaagag

SEQ ID NO: 508609 - RNA, 22 nt, Human
uaauuuuuccacguacacuggg

SEQ ID NO: 508610 - RNA, 22 nt, Human
uguauuuucagaguggcauuuc

SEQ ID NO: 508611 - RNA, 22 nt, Human
uccaggcaaagugcugggcugc

SEQ ID NO: 508612 - RNA, 22 nt, Human
aagggcucgguagcaguccuga

SEQ ID NO: 508613 - RNA, 22 nt, Human
ccuuuuucccuggagggacagc

SEQ ID NO: 508614 - RNA, 22 nt, Human
ucaggauguccaaaauccagcc

SEQ ID NO: 508615 - RNA, 22 nt, Human
aguuuuuccguggcuacgauaa

SEQ ID NO: 508616 - RNA, 22 nt, Human
uuugugaauggaauccacagac

SEQ ID NO: 508617 - RNA, 22 nt, Human
cugggagucaccaggagcaagg

SEQ ID NO: 508618 - RNA, 22 nt, Human
ccucugcaccauagccuucagc

SEQ ID NO: 508619 - RNA, 22 nt, Human
acucugaggcaggucagggcag

SEQ ID NO: 508620 - RNA, 20 nt, Human
ucucagcauaagaacccuuc

SEQ ID NO: 508621 - RNA, 22 nt, Human
uugugaauagugccgcaauaaa

SEQ ID NO: 508622 - RNA, 22 nt, Human
uggcugccuuucaccucaucuc

SEQ ID NO: 508623 - RNA, 22 nt, Human
uaggcugagguugaugccaggg

SEQ ID NO: 508624 - RNA, 23 nt, Human
aggcugcagaagaauagggucau

SEQ ID NO: 508625 - RNA, 22 nt, Human
uccaggugugcucugugcccug

SEQ ID NO: 508626 - RNA, 22 nt, Human
uccaguggcaccuuggcccuca

SEQ ID NO: 508627 - RNA, 21 nt, Human
agcaggcaaaggugaagucuu

SEQ ID NO: 508628 - RNA, 22 nt, Human
ugaggcagguggauuacaaggu

SEQ ID NO: 508629 - RNA, 22 nt, Human
uuuagggaagaagcccauggcc

SEQ ID NO: 508630 - RNA, 20 nt, Human
auguuuuauaaaagaacggg

SEQ ID NO: 508631 - RNA, 22 nt, Human
caggcaggagacauuugguugg

SEQ ID NO: 508632 - RNA, 22 nt, Human
uguaugaagccagaaucuguuu

SEQ ID NO: 508633 - RNA, 22 nt, Human
ugaugaaacugagguuccaaga

SEQ ID NO: 508634 - RNA, 22 nt, Human
aaaaguaauugaugcaaucgua

SEQ ID NO: 508635 - RNA, 21 nt, Human
gccuggcuagaagcuccuagc

SEQ ID NO: 508636 - RNA, 19 nt, Human
aaaagucuauucaauuaca

SEQ ID NO: 508637 - RNA, 22 nt, Human
auguacagccacuucacaguua

SEQ ID NO: 508638 - RNA, 22 nt, Human
uggccacccagcugacgccuuc

SEQ ID NO: 508639 - RNA, 22 nt, Human
uccuucagcuacucaguuucca

SEQ ID NO: 508640 - RNA, 22 nt, Human
ucucugggccucaguuuucuca

SEQ ID NO: 508641 - RNA, 22 nt, Human
acagagcugggugcccccugga

SEQ ID NO: 508642 - RNA, 22 nt, Human
uucacagacauugcagacugaa

SEQ ID NO: 508643 - RNA, 22 nt, Human
ugucucaguauacgaaacacuu

SEQ ID NO: 508644 - RNA, 22 nt, Human
ccuguccagggacugagggaga

SEQ ID NO: 508645 - RNA, 22 nt, Human
aauguguagcauuuaaugcagu

SEQ ID NO: 508646 - RNA, 22 nt, Human
acaaugcaauaggagcuagaaa

SEQ ID NO: 508647 - RNA, 22 nt, Human
ugucuuuuggagcaucuuucuu

SEQ ID NO: 508648 - RNA, 22 nt, Human
agucauuacagcaggcagaagg

SEQ ID NO: 508649 - RNA, 22 nt, Human
cagagccagaacuagaccuugu

SEQ ID NO: 508650 - RNA, 22 nt, Human
gccucgaggcugagaaggcaca

SEQ ID NO: 508651 - RNA, 22 nt, Human
gguuuauuaaugugaacuguau

SEQ ID NO: 508652 - RNA, 22 nt, Human
caucaaaguugauauccaauua

SEQ ID NO: 508653 - RNA, 19 nt, Human
ggcugucuggcguguggau

SEQ ID NO: 508654 - RNA, 22 nt, Human
uggcuccacaggccagggugug

SEQ ID NO: 508655 - RNA, 22 nt, Human
auaugcacauacauacauaggu

SEQ ID NO: 508656 - RNA, 22 nt, Human
gugccuuccccgguggucuguu

SEQ ID NO: 508657 - RNA, 22 nt, Human
cuuucauucuuagauauuagug

SEQ ID NO: 508658 - RNA, 20 nt, Human
acugcuucuuucucugaccu

SEQ ID NO: 508659 - RNA, 22 nt, Human
auggcucauuuaucuugcagcc

SEQ ID NO: 508660 - RNA, 22 nt, Human
uuguaaacuggauagaccuauu

SEQ ID NO: 508661 - RNA, 22 nt, Human
uugucuuuggaaauuuaauguu

SEQ ID NO: 508662 - RNA, 22 nt, Human
ggcaggcuccaagcauccuaug

SEQ ID NO: 508663 - RNA, 22 nt, Human
cuagcacagcccauucagucua

SEQ ID NO: 508664 - RNA, 22 nt, Human
acagaagcucaagagagcagug

SEQ ID NO: 508665 - RNA, 22 nt, Human
uuguccuuaccucaaucuggaa

SEQ ID NO: 508666 - RNA, 22 nt, Human
uuacaguuuauccaggaagagc

SEQ ID NO: 508667 - RNA, 22 nt, Human
agguccugaggguucgucugca

SEQ ID NO: 508668 - RNA, 22 nt, Human
agaaagacgugaugaagaagua

SEQ ID NO: 508669 - RNA, 22 nt, Human
uacacuuuuuacuacagauucu

SEQ ID NO: 508670 - RNA, 22 nt, Human
ugagggaggcccuuugagcaga

SEQ ID NO: 508671 - RNA, 22 nt, Human
agcaggagcccuuaucaccagg

SEQ ID NO: 508672 - RNA, 22 nt, Human
guuauaaauaccuaauaggauu

SEQ ID NO: 508673 - RNA, 22 nt, Human
cugggcucuguguuucaguuuc

SEQ ID NO: 508674 - RNA, 22 nt, Human
uuuauuuaaagucguguguuaa

SEQ ID NO: 508675 - RNA, 22 nt, Human
agagcugcaggguggacccagg

SEQ ID NO: 508676 - RNA, 22 nt, Human
aaacaucaccauuuuaccuaau

SEQ ID NO: 508677 - RNA, 22 nt, Human
cacaggaaugaacagggaaaga

SEQ ID NO: 508678 - RNA, 22 nt, Human
cugauaugaugggugauuuuca

SEQ ID NO: 508679 - RNA, 22 nt, Human
cugcugguaccaguggccguca

SEQ ID NO: 508680 - RNA, 22 nt, Human
caugcaaaugguggcuaaaugg

SEQ ID NO: 508681 - RNA, 22 nt, Human
auguaucacagcaauguaguca

SEQ ID NO: 508682 - RNA, 22 nt, Human
uccagccuuucuacucacugag

SEQ ID NO: 508683 - RNA, 22 nt, Human
gccaggcucucagugacugccc

SEQ ID NO: 508684 - RNA, 22 nt, Human
aauccagcacauggacacaguc

SEQ ID NO: 508685 - RNA, 22 nt, Human
ucaggaaggcacuugguguguu

SEQ ID NO: 508686 - RNA, 22 nt, Human
aucuaaaguguuucaugaaaga

SEQ ID NO: 508687 - RNA, 22 nt, Human
cagagcagccuccagggggagc

SEQ ID NO: 508688 - RNA, 22 nt, Human
cucuggagugcagccugguggc

SEQ ID NO: 508689 - RNA, 22 nt, Human
gagaggcugugugccauuguug

SEQ ID NO: 508690 - RNA, 22 nt, Human
auuuacagaugaugcuauuuga

SEQ ID NO: 508691 - RNA, 22 nt, Human
uuuugugacagaaagauuaagu

SEQ ID NO: 508692 - RNA, 22 nt, Human
ucuguucaucucaugggagaau

SEQ ID NO: 508693 - RNA, 22 nt, Human
ugccugggccucugaggaaggc

SEQ ID NO: 508694 - RNA, 22 nt, Human
acuguucacagauuagucgaug

SEQ ID NO: 508695 - RNA, 22 nt, Human
ccagaccacccuggccaugcac

SEQ ID NO: 508696 - RNA, 22 nt, Human
aauaauuuuagcucagaguugu

SEQ ID NO: 508697 - RNA, 22 nt, Human
acaggagugaaucuggcacuua

SEQ ID NO: 508698 - RNA, 22 nt, Human
gccuccugagaagccacaggcu

SEQ ID NO: 508699 - RNA, 22 nt, Human
agacacugauguucagcucaau

SEQ ID NO: 508700 - RNA, 22 nt, Human
gcagcgagugcggcugccacag

SEQ ID NO: 508701 - RNA, 22 nt, Human
aaagggcugaugugacauagcu

SEQ ID NO: 508702 - RNA, 22 nt, Human
ucagagccccuccgcuguccca

SEQ ID NO: 508703 - RNA, 22 nt, Human
aaaguauucuugacuguuuuuc

SEQ ID NO: 508704 - RNA, 22 nt, Human
agaggccaggcugcagagggau

SEQ ID NO: 508705 - RNA, 22 nt, Human
uagcagcuccuaaacaguggug

SEQ ID NO: 508706 - RNA, 23 nt, Human
aauuacaaccaagaacuggaagg

SEQ ID NO: 508707 - RNA, 22 nt, Human
ugcaauaacccaguaucuguga

SEQ ID NO: 508708 - RNA, 22 nt, Human
aaggcugguuuccuugauguuu

SEQ ID NO: 508709 - RNA, 22 nt, Human
ccagggugggguccaggaacca

SEQ ID NO: 508710 - RNA, 22 nt, Human
aggaccugaaauucuugcuuuu

SEQ ID NO: 508711 - RNA, 20 nt, Human
ucccauguccauaucagccc

SEQ ID NO: 508712 - RNA, 22 nt, Human
aggaccugagaguuggaaaucc

SEQ ID NO: 508713 - RNA, 22 nt, Human
guuugcauuucuugaacuauau

SEQ ID NO: 508714 - RNA, 22 nt, Human
caggagacaauggcuguggggc

SEQ ID NO: 508715 - RNA, 22 nt, Human
ggcucucugaggaaacccuucc

SEQ ID NO: 508716 - RNA, 22 nt, Human
caggagugaguuggggucuaca

SEQ ID NO: 508717 - RNA, 22 nt, Human
gcuggagaaacugcagcugagg

SEQ ID NO: 508718 - RNA, 22 nt, Human
augauggaauauuauucaggca

SEQ ID NO: 508719 - RNA, 22 nt, Human
uucaaaagacucagauguagcg

SEQ ID NO: 508720 - RNA, 22 nt, Human
gauuucuguaacacuucagaua

SEQ ID NO: 508721 - RNA, 18 nt, Human
cuccuuggagaagaggcc

SEQ ID NO: 508722 - RNA, 22 nt, Human
acccaggguagagugcaguggc

SEQ ID NO: 508723 - RNA, 22 nt, Human
uccagccaugcaugacaaucac

SEQ ID NO: 508724 - RNA, 18 nt, Human
uucuccagaaaacauagc

SEQ ID NO: 508725 - RNA, 22 nt, Human
aguacuuuacuucuuacaguuu

SEQ ID NO: 508726 - RNA, 22 nt, Human
ggcacugagcgggcucugagcg

SEQ ID NO: 508727 - RNA, 23 nt, Human
ucugucaccuauggcugcucuuc

SEQ ID NO: 508728 - RNA, 22 nt, Human
caugcuuugggucagaaaugcc

SEQ ID NO: 508729 - RNA, 20 nt, Human
acugugaaugcugaauuagc

SEQ ID NO: 508730 - RNA, 22 nt, Human
gaucugguacaggccugcagcc

SEQ ID NO: 508731 - RNA, 22 nt, Human
gaagagcuauguccagggagca

SEQ ID NO: 508732 - RNA, 22 nt, Human
acaugacuuuucucuuccagag

SEQ ID NO: 508733 - RNA, 22 nt, Human
ucucacaggugcacguggcugu

SEQ ID NO: 508734 - RNA, 22 nt, Human
ugggcugcagggguugagagcu

SEQ ID NO: 508735 - RNA, 22 nt, Human
ucacagaaucucugauaagucu

SEQ ID NO: 508736 - RNA, 22 nt, Human
cacuuagucucaccaguucagu

SEQ ID NO: 508737 - RNA, 22 nt, Human
acuuguuuuaucugucaauaga

SEQ ID NO: 508738 - RNA, 22 nt, Human
auuaaagacagcagauggaugg

SEQ ID NO: 508739 - RNA, 22 nt, Human
aagcacagggacucaggaccgg

SEQ ID NO: 508740 - RNA, 22 nt, Human
uucaggaucacuaaacccucca

SEQ ID NO: 508741 - RNA, 22 nt, Human
cugguggaggugccaggauuug

SEQ ID NO: 508742 - RNA, 17 nt, Human
uuuagaauacaauguuu

SEQ ID NO: 508743 - RNA, 22 nt, Human
uaugaagcucucacuguguguc

SEQ ID NO: 508744 - RNA, 19 nt, Human
augaagauugguaaauuca

SEQ ID NO: 508745 - RNA, 22 nt, Human
uuucagaggaaaucucauugag

SEQ ID NO: 508746 - RNA, 22 nt, Human
ccuguucagagcuaagcaucau

SEQ ID NO: 508747 - RNA, 22 nt, Human
cucucuggcacuucauugcugu

SEQ ID NO: 508748 - RNA, 22 nt, Human
cagugugucucuuguccuggcu

SEQ ID NO: 508749 - RNA, 22 nt, Human
gccuguccuggaugcucugcaa

SEQ ID NO: 508750 - RNA, 22 nt, Human
ucagaggauugccucagcgagc

SEQ ID NO: 508751 - RNA, 22 nt, Human
caaagugcuggaauuauagggg

SEQ ID NO: 508752 - RNA, 22 nt, Human
gggcuaggcuuggccagcacug

SEQ ID NO: 508753 - RNA, 23 nt, Human
uggcucugagagguucagaugcu

SEQ ID NO: 508754 - RNA, 20 nt, Human
uuuacauuuugaaacaguga

SEQ ID NO: 508755 - RNA, 22 nt, Human
ucucagcugacugcuuuccucg

SEQ ID NO: 508756 - RNA, 23 nt, Human
agccucuuuucuccugcccugca

SEQ ID NO: 508757 - RNA, 22 nt, Human
gucccagaggcuuuggccacag

SEQ ID NO: 508758 - RNA, 22 nt, Human
ugcagggaagcaaggguggcuc

SEQ ID NO: 508759 - RNA, 22 nt, Human
caguugcuacaguucaagugug

SEQ ID NO: 508760 - RNA, 22 nt, Human
gcaggagaacaaagcaagcugc

SEQ ID NO: 508761 - RNA, 23 nt, Human
agcaggcugcuucuccacagcug

SEQ ID NO: 508762 - RNA, 22 nt, Human
accccagaggcggaggcugcag

SEQ ID NO: 508763 - RNA, 22 nt, Human
accagagcagacuacuggaggu

SEQ ID NO: 508764 - RNA, 22 nt, Human
cucuggucaagcaaagagguuu

SEQ ID NO: 508765 - RNA, 22 nt, Human
uuccugagcaccagacacugca

SEQ ID NO: 508766 - RNA, 23 nt, Human
ugacaguguauuugacuauaugg

SEQ ID NO: 508767 - RNA, 22 nt, Human
gaagccagauuaucacaagcca

SEQ ID NO: 508768 - RNA, 22 nt, Human
ugccaggcauuugacagacacu

SEQ ID NO: 508769 - RNA, 22 nt, Human
guccagccccugacucccaggc

SEQ ID NO: 508770 - RNA, 22 nt, Human
aggcagaggagaaugaucuucc

SEQ ID NO: 508771 - RNA, 22 nt, Human
ucuggcucuuugggugauugua

SEQ ID NO: 508772 - RNA, 22 nt, Human
cagcagaaauggauuuugagau

SEQ ID NO: 508773 - RNA, 22 nt, Human
ugcccacauggugccauggcca

SEQ ID NO: 508774 - RNA, 22 nt, Human
ccucaguguuaggauaagagaa

SEQ ID NO: 508775 - RNA, 22 nt, Human
uggucaguugcaucagagaagu

SEQ ID NO: 508776 - RNA, 22 nt, Human
ccagcaggaaagugacguuuga

SEQ ID NO: 508777 - RNA, 22 nt, Human
cucccaagcugugcugaacugu

SEQ ID NO: 508778 - RNA, 22 nt, Human
ugcuucugcuuuacuugguuca

SEQ ID NO: 508779 - RNA, 22 nt, Human
ugggagaaucuugcucugcuac

SEQ ID NO: 508780 - RNA, 22 nt, Human
acaaaauagaguucuccccugg

SEQ ID NO: 508781 - RNA, 21 nt, Human
agguuucucuuuuauggaggg

SEQ ID NO: 508782 - RNA, 22 nt, Human
uguguucaaucaccaaagguau

SEQ ID NO: 508783 - RNA, 22 nt, Human
uguuuuguuuaugagagcacag

SEQ ID NO: 508784 - RNA, 22 nt, Human
cugggcagagcuaacaccugag

SEQ ID NO: 508785 - RNA, 22 nt, Human
auaaugagcuuuugaauacuga

SEQ ID NO: 508786 - RNA, 22 nt, Human
cuaaaugcccuacaaugacugg

SEQ ID NO: 508787 - RNA, 22 nt, Human
cagcuucucagaaagcugaggu

SEQ ID NO: 508788 - RNA, 22 nt, Human
uacacagauaugugaucaauca

SEQ ID NO: 508789 - RNA, 22 nt, Human
gaaccaaguaggauacaaggag

SEQ ID NO: 508790 - RNA, 22 nt, Human
uugcugaaggccucuugggguu

SEQ ID NO: 508791 - RNA, 23 nt, Human
cugaggucugcaauucuaguagu

SEQ ID NO: 508792 - RNA, 22 nt, Human
aggccaucaaaucauguagugc

SEQ ID NO: 508793 - RNA, 22 nt, Human
uuucauaaccucaagcuacagu

SEQ ID NO: 508794 - RNA, 22 nt, Human
ggcagguguuuuuauauuaaag

SEQ ID NO: 508795 - RNA, 22 nt, Human
agcugaggccacgagugaaggg

SEQ ID NO: 508796 - RNA, 22 nt, Human
ugauucacagacuucacaaggc

SEQ ID NO: 508797 - RNA, 17 nt, Human
ggagagugggaauggcc

SEQ ID NO: 508798 - RNA, 22 nt, Human
aucugggcauggaggaaagaga

SEQ ID NO: 508799 - RNA, 21 nt, Human
ugggagagcguugcuguccuc

SEQ ID NO: 508800 - RNA, 22 nt, Human
augugcuguaauccauugaagg

SEQ ID NO: 508801 - RNA, 22 nt, Human
aggcacuggguaauuaguagcu

SEQ ID NO: 508802 - RNA, 22 nt, Human
guauuaggagguggagccuuug

SEQ ID NO: 508803 - RNA, 22 nt, Human
uagauguuaagcuucuagaagg

SEQ ID NO: 508804 - RNA, 22 nt, Human
cagguggggcagcugugggagc

SEQ ID NO: 508805 - RNA, 22 nt, Human
cugggcuucucccccuggcaga

SEQ ID NO: 508806 - RNA, 22 nt, Human
ccuggcucuucugugucagccc

SEQ ID NO: 508807 - RNA, 22 nt, Human
aauaauguuaugucauucuucu

SEQ ID NO: 508808 - RNA, 22 nt, Human
acauagaaggaagaguaguagg

SEQ ID NO: 508809 - RNA, 22 nt, Human
ugaaauguuugaagaccacuga

SEQ ID NO: 508810 - RNA, 22 nt, Human
auauaauacaaccugcuaagug

SEQ ID NO: 508811 - RNA, 22 nt, Human
cucucugggcccaguuggcacc

SEQ ID NO: 508812 - RNA, 22 nt, Human
acagaacugagaauucucuauc

SEQ ID NO: 508813 - RNA, 22 nt, Human
ugcuucucccaaccagggccug

SEQ ID NO: 508814 - RNA, 22 nt, Human
aucagagacaaaaccagcacuu

SEQ ID NO: 508815 - RNA, 22 nt, Human
accuguuuuccuaucuagauug

SEQ ID NO: 508816 - RNA, 22 nt, Human
agguccaggcauuuggguuggg

SEQ ID NO: 508817 - RNA, 22 nt, Human
caguuucuuaagacugagaucu

SEQ ID NO: 508818 - RNA, 20 nt, Human
gcccaagguccagaaggggg

SEQ ID NO: 508819 - RNA, 22 nt, Human
uaggagaggugaauggcacacu

SEQ ID NO: 508820 - RNA, 22 nt, Human
ggggaggcugaugugggcaaag

SEQ ID NO: 508821 - RNA, 22 nt, Human
ugagaguauuuuggcauuauca

SEQ ID NO: 508822 - RNA, 22 nt, Human
uuggcugcugaaauauguucug

SEQ ID NO: 508823 - RNA, 22 nt, Human
gagaccaggaaguacagcagcc

SEQ ID NO: 508824 - RNA, 18 nt, Human
gaggccugagaaccaggu

SEQ ID NO: 508825 - RNA, 22 nt, Human
aaugaugguauugaugagcuaa

SEQ ID NO: 508826 - RNA, 23 nt, Human
ccucuaauaaacuugaccuugug

SEQ ID NO: 508827 - RNA, 22 nt, Human
uuugacaguaauaaagcacaag

SEQ ID NO: 508828 - RNA, 19 nt, Human
agaaucaggucaggugaca

SEQ ID NO: 508829 - RNA, 17 nt, Human
ucagcaggggccaagcu

SEQ ID NO: 508830 - RNA, 22 nt, Human
aggcaggucuguaucuagucuc

SEQ ID NO: 508831 - RNA, 22 nt, Human
ucucuucuuguguuuuccugcc

SEQ ID NO: 508832 - RNA, 20 nt, Human
aaagcaguaugcaaguagag

SEQ ID NO: 508833 - RNA, 22 nt, Human
agugaaauaaagcugccuaugg

SEQ ID NO: 508834 - RNA, 22 nt, Human
acccagcucuuugauggucuug

SEQ ID NO: 508835 - RNA, 22 nt, Human
uuggaagggaacaccauuugac

SEQ ID NO: 508836 - RNA, 22 nt, Human
aucuaauuuucacucauuugcu

SEQ ID NO: 508837 - RNA, 22 nt, Human
agcugguucagaaauuagaugg

SEQ ID NO: 508838 - RNA, 22 nt, Human
gccugagauucccggagccgug

SEQ ID NO: 508839 - RNA, 23 nt, Human
agggguggucaguacccgcagug

SEQ ID NO: 508840 - RNA, 22 nt, Human
ucagcacuuuuuaaagcagcau

SEQ ID NO: 508841 - RNA, 22 nt, Human
cucucagacugaagggccugug

SEQ ID NO: 508842 - RNA, 22 nt, Human
caguaaauauaggaacguggaa

SEQ ID NO: 508843 - RNA, 22 nt, Human
ucucaaggacuuugggcacuaa

SEQ ID NO: 508844 - RNA, 22 nt, Human
gcucccagcauugcuucccagg

SEQ ID NO: 508845 - RNA, 22 nt, Human
agagccugugauugucaucacc

SEQ ID NO: 508846 - RNA, 23 nt, Human
uagcagcauuuuuagccucuguc

SEQ ID NO: 508847 - RNA, 22 nt, Human
ugccacacagcuguaugaggga

SEQ ID NO: 508848 - RNA, 22 nt, Human
agcaaagucaguggaaccaucc

SEQ ID NO: 508849 - RNA, 22 nt, Human
ggcaggugccuucugugcuagc

SEQ ID NO: 508850 - RNA, 22 nt, Human
gccuggagaggaagccggugga

SEQ ID NO: 508851 - RNA, 22 nt, Human
uguaaagaaauagcauuuguag

SEQ ID NO: 508852 - RNA, 22 nt, Human
gaagucuucauucucucugaga

SEQ ID NO: 508853 - RNA, 22 nt, Human
aaaagaguguuucaacuuuggc

SEQ ID NO: 508854 - RNA, 22 nt, Human
ugccugcccacgacuacagcag

SEQ ID NO: 508855 - RNA, 22 nt, Human
guaucuuuccacaucuucagua

SEQ ID NO: 508856 - RNA, 22 nt, Human
aagauuucucuccuggaaagca

SEQ ID NO: 508857 - RNA, 22 nt, Human
uuccucucaacaugccugccgg

SEQ ID NO: 508858 - RNA, 22 nt, Human
agcaguggccuggggcucugug

SEQ ID NO: 508859 - RNA, 22 nt, Human
gugcaaugugcuucgugccaug

SEQ ID NO: 508860 - RNA, 22 nt, Human
gcucucuggaagguaucauuau

SEQ ID NO: 508861 - RNA, 22 nt, Human
uucuaaguccuaccugaaagca

SEQ ID NO: 508862 - RNA, 22 nt, Human
cugggucccacagccugcuggg

SEQ ID NO: 508863 - RNA, 22 nt, Human
auugcacaaacacagucagacu

SEQ ID NO: 508864 - RNA, 22 nt, Human
auuuucagaacauucauucacu

SEQ ID NO: 508865 - RNA, 22 nt, Human
auuuuucucuuuccacugagau

SEQ ID NO: 508866 - RNA, 22 nt, Human
caggaggacauacuggcucaca

SEQ ID NO: 508867 - RNA, 22 nt, Human
aaaaugcuauuucauggaggag

SEQ ID NO: 508868 - RNA, 22 nt, Human
ggccuugggauguggcugcagc

SEQ ID NO: 508869 - RNA, 22 nt, Human
aggaaggacugcagcauuuggu

SEQ ID NO: 508870 - RNA, 22 nt, Human
gccugccuuuuggaggcacauu

SEQ ID NO: 508871 - RNA, 22 nt, Human
ccucacugcuauguguuugcuc

SEQ ID NO: 508872 - RNA, 22 nt, Human
uguuaaaugagauuggaauuug

SEQ ID NO: 508873 - RNA, 22 nt, Human
ugaauaaacuaugaggaggaau

SEQ ID NO: 508874 - RNA, 22 nt, Human
agacuguaauuuguggccuccu

SEQ ID NO: 508875 - RNA, 22 nt, Human
gugcccuggcucacagugucuc

SEQ ID NO: 508876 - RNA, 22 nt, Human
cccuuagcuccaagggguuugg

SEQ ID NO: 508877 - RNA, 22 nt, Human
ggcugaaacagauuucaagaca

SEQ ID NO: 508878 - RNA, 22 nt, Human
ugaaggugucuuugugaacauc

SEQ ID NO: 508879 - RNA, 22 nt, Human
cuuacauuaaguaagagauuga

SEQ ID NO: 508880 - RNA, 22 nt, Human
gagcugcuucugugugccgggu

SEQ ID NO: 508881 - RNA, 22 nt, Human
ugcauuaaaaugauggagaaau

SEQ ID NO: 508882 - RNA, 22 nt, Human
cagccagcuucagauccaagcc

SEQ ID NO: 508883 - RNA, 22 nt, Human
cacagcuuguuuagugacucac

SEQ ID NO: 508884 - RNA, 22 nt, Human
ucuggccagugaaaugcagaau

SEQ ID NO: 508885 - RNA, 22 nt, Human
aaucuacauagagaucaaauga

SEQ ID NO: 508886 - RNA, 22 nt, Human
gcagagugaggaagagcuucca

SEQ ID NO: 508887 - RNA, 22 nt, Human
uuggcagggccaggcucucucu

SEQ ID NO: 508888 - RNA, 22 nt, Human
auaaaauuugcuacuguuaaau

SEQ ID NO: 508889 - RNA, 22 nt, Human
acagacaaguaguucagacaag

SEQ ID NO: 508890 - RNA, 22 nt, Human
uagaaauguugguauuaacauu

SEQ ID NO: 508891 - RNA, 20 nt, Human
caggccucugggggcccugg

SEQ ID NO: 508892 - RNA, 22 nt, Human
ugggcucuggggaaacugugau

SEQ ID NO: 508893 - RNA, 19 nt, Human
aggugagugugggaaaggg

SEQ ID NO: 508894 - RNA, 22 nt, Human
gcucuuuguauuuuggaaucaa

SEQ ID NO: 508895 - RNA, 22 nt, Human
acugaaggguaaugugggagcc

SEQ ID NO: 508896 - RNA, 22 nt, Human
cuucauuaaccaaaaugcaaua

SEQ ID NO: 508897 - RNA, 18 nt, Human
ggccucagccuggccgga

SEQ ID NO: 508898 - RNA, 22 nt, Human
cagggcccauggcucagguagg

SEQ ID NO: 508899 - RNA, 22 nt, Human
agucucagcaagcauggcuagu

SEQ ID NO: 508900 - RNA, 22 nt, Human
ucuucuuugaaucauagugacc

SEQ ID NO: 508901 - RNA, 22 nt, Human
aagaaaacguuuugaggaguuu

SEQ ID NO: 508902 - RNA, 19 nt, Human
ggcuggaguggccaucugu

SEQ ID NO: 508903 - RNA, 22 nt, Human
acagagaugggaacauucaggu

SEQ ID NO: 508904 - RNA, 22 nt, Human
gaacuguauaggagcaguguuu

SEQ ID NO: 508905 - RNA, 22 nt, Human
ugugugucacugaaagaaaucu

SEQ ID NO: 508906 - RNA, 22 nt, Human
gugagaagauaaguauugcaaa

SEQ ID NO: 508907 - RNA, 22 nt, Human
aaaugguguuucuaaugcuaga

SEQ ID NO: 508908 - RNA, 18 nt, Human
cuguucagcugaacuaca

SEQ ID NO: 508909 - RNA, 22 nt, Human
gcuguacaggguuauccuuucc

SEQ ID NO: 508910 - RNA, 21 nt, Human
auggaaauuggcaaaugcuac

SEQ ID NO: 508911 - RNA, 21 nt, Human
uagaaaucagcuggugccucu

SEQ ID NO: 508912 - RNA, 22 nt, Human
gguuuuaacuacagaauugcaa

SEQ ID NO: 508913 - RNA, 22 nt, Human
uuuaaucaggcaaagcauaaua

SEQ ID NO: 508914 - RNA, 22 nt, Human
cuaggaaugguaccucuuacaa

SEQ ID NO: 508915 - RNA, 22 nt, Human
agggagaguuugauguuuccuc

SEQ ID NO: 508916 - RNA, 22 nt, Human
ccagggcagcgccccuccacgc

SEQ ID NO: 508917 - RNA, 22 nt, Human
uaaggccaauuacauauguuca

SEQ ID NO: 508918 - RNA, 22 nt, Human
cugggccaagaaguuguguaug

SEQ ID NO: 508919 - RNA, 22 nt, Human
ugccagggagcccugcugacca

SEQ ID NO: 508920 - RNA, 22 nt, Human
cauuuauucauuugcuagggcu

SEQ ID NO: 508921 - RNA, 21 nt, Human
ggcuaggaugcugggguuucc

SEQ ID NO: 508922 - RNA, 22 nt, Human
cugcccuguuuggacagcccgg

SEQ ID NO: 508923 - RNA, 22 nt, Human
ugguuccuucugcauuuucagc

SEQ ID NO: 508924 - RNA, 22 nt, Human
aggguccugagccuggggcgca

SEQ ID NO: 508925 - RNA, 22 nt, Human
aucagcaagacuaggggaauac

SEQ ID NO: 508926 - RNA, 20 nt, Human
gacaucauguacacauugcc

SEQ ID NO: 508927 - RNA, 22 nt, Human
uucacagagcuuguucauggcc

SEQ ID NO: 508928 - RNA, 22 nt, Human
aggcauggacauuucggcagcu

SEQ ID NO: 508929 - RNA, 22 nt, Human
uuuaucuggacugugauauaaa

SEQ ID NO: 508930 - RNA, 22 nt, Human
guuauuagaagugaaggauugu

SEQ ID NO: 508931 - RNA, 22 nt, Human
agaguguuauuugcucuguauu

SEQ ID NO: 508932 - RNA, 22 nt, Human
auggauaagaacaaauaucuga

SEQ ID NO: 508933 - RNA, 22 nt, Human
ucuuccaguguagacaucugcc

SEQ ID NO: 508934 - RNA, 22 nt, Human
agggguuggauuuggccuagag

SEQ ID NO: 508935 - RNA, 22 nt, Human
cuaguagacagaaauguccagu

SEQ ID NO: 508936 - RNA, 22 nt, Human
ugacagcauaacacuggucuug

SEQ ID NO: 508937 - RNA, 22 nt, Human
gcacagggcccugugcguaggu

SEQ ID NO: 508938 - RNA, 22 nt, Human
uucuuuggggaauauucugguu

SEQ ID NO: 508939 - RNA, 22 nt, Human
ccucugcacuucaccuuagcuc

SEQ ID NO: 508940 - RNA, 22 nt, Human
aaaucaaaagacauguguuuua

SEQ ID NO: 508941 - RNA, 22 nt, Human
aagguccagaggucccgucacc

SEQ ID NO: 508942 - RNA, 22 nt, Human
aacuccagggggucaauauuua

SEQ ID NO: 508943 - RNA, 22 nt, Human
uguggaggauucugaugccagc

SEQ ID NO: 508944 - RNA, 22 nt, Human
ugaaugugaugcuaaacauaug

SEQ ID NO: 508945 - RNA, 22 nt, Human
ugccauccaacaguuccaucuu

SEQ ID NO: 508946 - RNA, 22 nt, Human
uugccaggcucugguuccagcc

SEQ ID NO: 508947 - RNA, 22 nt, Human
uugcugaauugaauccuuuggu

SEQ ID NO: 508948 - RNA, 22 nt, Human
ccuguacagugaaugaauguga

SEQ ID NO: 508949 - RNA, 22 nt, Human
agcaugcugguguucauggcag

SEQ ID NO: 508950 - RNA, 22 nt, Human
aggagcugggcugcugcuggga

SEQ ID NO: 508951 - RNA, 22 nt, Human
ugugcccaucccucuggagugu

SEQ ID NO: 508952 - RNA, 22 nt, Human
gcagcaucuguacauagacgcu

SEQ ID NO: 508953 - RNA, 22 nt, Human
gccacccccaaguagguggucu

SEQ ID NO: 508954 - RNA, 22 nt, Human
caguccuguguuaaacaagagc

SEQ ID NO: 508955 - RNA, 22 nt, Human
cuggcucauuuuagcaucaggu

SEQ ID NO: 508956 - RNA, 22 nt, Human
guguccuguuucccugucuaua

SEQ ID NO: 508957 - RNA, 22 nt, Human
ccaggagcgggaaaaggaagaa

SEQ ID NO: 508958 - RNA, 22 nt, Human
ggagugugggauggagcucagg

SEQ ID NO: 508959 - RNA, 22 nt, Human
gaaggaaaacagaucugccuga

SEQ ID NO: 508960 - RNA, 22 nt, Human
acccagcaaagauaaacuuaug

SEQ ID NO: 508961 - RNA, 22 nt, Human
aagaauguuaguuucugauaca

SEQ ID NO: 508962 - RNA, 22 nt, Human
agaugacaaaucaggggacggg

SEQ ID NO: 508963 - RNA, 22 nt, Human
gugugaaaugguucucuuuguu

SEQ ID NO: 508964 - RNA, 22 nt, Human
agaccuggaugugagggaagua

SEQ ID NO: 508965 - RNA, 19 nt, Human
accaggagacagugagcuu

SEQ ID NO: 508966 - RNA, 21 nt, Human
ccaggguccagcugccauggu

SEQ ID NO: 508967 - RNA, 22 nt, Human
gaagauuucaguuaaguaucua

SEQ ID NO: 508968 - RNA, 22 nt, Human
ugcugaaucccacccuccagug

SEQ ID NO: 508969 - RNA, 22 nt, Human
agacagugauggacaggcagac

SEQ ID NO: 508970 - RNA, 22 nt, Human
auacaguagacaaucucaugaa

SEQ ID NO: 508971 - RNA, 22 nt, Human
cagagccaggucuaggagucuc

SEQ ID NO: 508972 - RNA, 22 nt, Human
cucagaguccauaguuuacagu

SEQ ID NO: 508973 - RNA, 21 nt, Human
gcagcagaggcuugacagaca

SEQ ID NO: 508974 - RNA, 22 nt, Human
gggcaaguugagaagaaugcua

SEQ ID NO: 508975 - RNA, 22 nt, Human
ugaaggucaugguaauauuuuu

SEQ ID NO: 508976 - RNA, 22 nt, Human
uccaggucugguuggacagguu

SEQ ID NO: 508977 - RNA, 22 nt, Human
auuguauuagcacaauacaauu

SEQ ID NO: 508978 - RNA, 22 nt, Human
ucucagugcagcuugacagaga

SEQ ID NO: 508979 - RNA, 22 nt, Human
ggcagaggugacagugucuuuu

SEQ ID NO: 508980 - RNA, 22 nt, Human
caaacauuugacuucucucagg

SEQ ID NO: 508981 - RNA, 22 nt, Human
uacugugugauuccauuuacgu

SEQ ID NO: 508982 - RNA, 18 nt, Human
uguuccaaggaaggaauc

SEQ ID NO: 508983 - RNA, 22 nt, Human
ggcugcuuuaucggcugcugaa

SEQ ID NO: 508984 - RNA, 19 nt, Human
cagauguuuucaguucauu

SEQ ID NO: 508985 - RNA, 22 nt, Human
aucauaagacccagccaguauu

SEQ ID NO: 508986 - RNA, 22 nt, Human
cugcccugggauggucugugcg

SEQ ID NO: 508987 - RNA, 22 nt, Human
uguaugcagggcuuguaugcag

SEQ ID NO: 508988 - RNA, 22 nt, Human
uuagucaauagugaauauagag

SEQ ID NO: 508989 - RNA, 22 nt, Human
cagugaguaaguagacagcuua

SEQ ID NO: 508990 - RNA, 22 nt, Human
uuuaguagaaugauacagggca

SEQ ID NO: 508991 - RNA, 22 nt, Human
ucuguucauaguaguguauaug

SEQ ID NO: 508992 - RNA, 22 nt, Human
aagcauuuuaguaaugaacuug

SEQ ID NO: 508993 - RNA, 22 nt, Human
gccugggagauuaauuaggaag

SEQ ID NO: 508994 - RNA, 22 nt, Human
gugcccugucucuugucuccag

SEQ ID NO: 508995 - RNA, 19 nt, Human
gcugggcuuggguuuguag

SEQ ID NO: 508996 - RNA, 22 nt, Human
uguuuugucuaaucuaaauucu

SEQ ID NO: 508997 - RNA, 22 nt, Human
aguacuucagaggcugcccagg

SEQ ID NO: 508998 - RNA, 22 nt, Human
uugcuuccaguccaagucuguu

SEQ ID NO: 508999 - RNA, 22 nt, Human
ugcauuaugcuugugcuguaua

SEQ ID NO: 509000 - RNA, 22 nt, Human
gccuggaaugcaaugugacgaa

SEQ ID NO: 509001 - RNA, 22 nt, Human
gucucugggugugugaugccaa

SEQ ID NO: 509002 - RNA, 20 nt, Human
augugagggguugaaguggg

SEQ ID NO: 509003 - RNA, 23 nt, Human
uccaggcaugagcucuggaugga

SEQ ID NO: 509004 - RNA, 22 nt, Human
cuggccccaggcagccugcugg

SEQ ID NO: 509005 - RNA, 22 nt, Human
auggauaagucaaagaguaucc

SEQ ID NO: 509006 - RNA, 22 nt, Human
cagcuucuccauucuucuggcu

SEQ ID NO: 509007 - RNA, 22 nt, Human
aaauuucuggaagugucagagu

SEQ ID NO: 509008 - RNA, 22 nt, Human
ucagugcaaaaaaugggcuaga

SEQ ID NO: 509009 - RNA, 22 nt, Human
uguccucaaggagcuucagucu

SEQ ID NO: 509010 - RNA, 22 nt, Human
agcucccagaagccagagucgg

SEQ ID NO: 509011 - RNA, 22 nt, Human
agccuugcaugauuucauucau

SEQ ID NO: 509012 - RNA, 21 nt, Human
aggugggcagguggaguggcc

SEQ ID NO: 509013 - RNA, 21 nt, Human
uauacagcaaagucuggagca

SEQ ID NO: 509014 - RNA, 22 nt, Human
ggcaggugcaccugagccaucu

SEQ ID NO: 509015 - RNA, 22 nt, Human
gaggcugacggcaccaucuucu

SEQ ID NO: 509016 - RNA, 22 nt, Human
ccccagcugcauacuugccaag

SEQ ID NO: 509017 - RNA, 22 nt, Human
gguggccucgguggugcacagg

SEQ ID NO: 509018 - RNA, 22 nt, Human
ugcccagguuugagugcccaag

SEQ ID NO: 509019 - RNA, 22 nt, Human
uauucacauucucaggccuggu

SEQ ID NO: 509020 - RNA, 22 nt, Human
gccuggcacauugcaguggauu

SEQ ID NO: 509021 - RNA, 22 nt, Human
uccaggcaggguuaaggguccu

SEQ ID NO: 509022 - RNA, 22 nt, Human
aguuucuuuagauagaaaguuc

SEQ ID NO: 509023 - RNA, 22 nt, Human
ucuuggcugcagagccggcaag

SEQ ID NO: 509024 - RNA, 22 nt, Human
cacugaagguaggaccaaggcu

SEQ ID NO: 509025 - RNA, 22 nt, Human
gagauuggccuggcuugccaac

SEQ ID NO: 509026 - RNA, 20 nt, Human
acagccagaggaggcagaca

SEQ ID NO: 509027 - RNA, 22 nt, Human
aggugccauugcuugccaguuu

SEQ ID NO: 509028 - RNA, 22 nt, Human
aaggcccuaauagagcacauau

SEQ ID NO: 509029 - RNA, 22 nt, Human
ccugagcuggcagugaccugga

SEQ ID NO: 509030 - RNA, 22 nt, Human
aagggcagaauagagaagaugg

SEQ ID NO: 509031 - RNA, 22 nt, Human
auucucaauggcuacuuucaua

SEQ ID NO: 509032 - RNA, 22 nt, Human
uagagagguuugaauuggcugc

SEQ ID NO: 509033 - RNA, 22 nt, Human
aggucucaaguugagaaggcag

SEQ ID NO: 509034 - RNA, 22 nt, Human
gagagcugggggacuguggaug

SEQ ID NO: 509035 - RNA, 22 nt, Human
ggcuggagugggcuccagaguu

SEQ ID NO: 509036 - RNA, 22 nt, Human
uuugaaagucaaccuuccaguu

SEQ ID NO: 509037 - RNA, 22 nt, Human
ucuucuuuggaugaaagaauau

SEQ ID NO: 509038 - RNA, 22 nt, Human
uucaggccuaauuucuagcccc

SEQ ID NO: 509039 - RNA, 22 nt, Human
ugacugaaauugcauuuuaaaa

SEQ ID NO: 509040 - RNA, 22 nt, Human
ccucuggcucacagcaccaacu

SEQ ID NO: 509041 - RNA, 22 nt, Human
ggggccuuggaucugugccccg

SEQ ID NO: 509042 - RNA, 22 nt, Human
caaauucagaaaauugguagag

SEQ ID NO: 509043 - RNA, 22 nt, Human
cccugcagaccaaugccauaga

SEQ ID NO: 509044 - RNA, 18 nt, Human
uccuuagcugagcuuguc

SEQ ID NO: 509045 - RNA, 22 nt, Human
aggguggcaguuacuggagcaa

SEQ ID NO: 509046 - RNA, 22 nt, Human
ugcugccagagagacagggacu

SEQ ID NO: 509047 - RNA, 22 nt, Human
agcaccugcuugugacuaggga

SEQ ID NO: 509048 - RNA, 22 nt, Human
ugcccugguuacacuggagucc

SEQ ID NO: 509049 - RNA, 22 nt, Human
ucugguccucucugugaugcua

SEQ ID NO: 509050 - RNA, 22 nt, Human
agugaaauccuggucaacaggu

SEQ ID NO: 509051 - RNA, 19 nt, Human
uggggcuguguuuugaccc

SEQ ID NO: 509052 - RNA, 22 nt, Human
cuggagcugucuucacaggccu

SEQ ID NO: 509053 - RNA, 22 nt, Human
uuccuccagccuggagcacuuc

SEQ ID NO: 509054 - RNA, 22 nt, Human
aacaugaagguaggaugguuuu

SEQ ID NO: 509055 - RNA, 22 nt, Human
uacauaaugagcuaguuaaguu

SEQ ID NO: 509056 - RNA, 22 nt, Human
aguggcugccaagagcaaugcu

SEQ ID NO: 509057 - RNA, 17 nt, Human
acagaggcaggagugga

SEQ ID NO: 509058 - RNA, 22 nt, Human
ucaguguucgcucagggacucc

SEQ ID NO: 509059 - RNA, 22 nt, Human
caguccugaauacuggacggug

SEQ ID NO: 509060 - RNA, 18 nt, Human
cucugggagaggcauaca

SEQ ID NO: 509061 - RNA, 22 nt, Human
uggugccuugggccuacagcgc

SEQ ID NO: 509062 - RNA, 22 nt, Human
cuuucuaauucucccauagucu

SEQ ID NO: 509063 - RNA, 22 nt, Human
ucacagaagcccucgcaaacua

SEQ ID NO: 509064 - RNA, 22 nt, Human
uccaauuugaaaugguauaugu

SEQ ID NO: 509065 - RNA, 22 nt, Human
ucuccaggaagcccucccugac

SEQ ID NO: 509066 - RNA, 22 nt, Human
aguauaauuagauaucaaaagu

SEQ ID NO: 509067 - RNA, 22 nt, Human
aucuguaaaugcaaauguagcu

SEQ ID NO: 509068 - RNA, 22 nt, Human
augcccugaggaaugucacgcu

SEQ ID NO: 509069 - RNA, 22 nt, Human
uugcuuuugucucggguuugga

SEQ ID NO: 509070 - RNA, 22 nt, Human
ucugucaccgagggcauccaaa

SEQ ID NO: 509071 - RNA, 22 nt, Human
cagaacauuccaugugcccugc

SEQ ID NO: 509072 - RNA, 22 nt, Human
gcaaaaaaugcuuguugcuuag

SEQ ID NO: 509073 - RNA, 22 nt, Human
ccccuucuggucuucaauggug

SEQ ID NO: 509074 - RNA, 22 nt, Human
uaugugcauuauuaccagugga

SEQ ID NO: 509075 - RNA, 22 nt, Human
uuccuuggaguuaagacccugg

SEQ ID NO: 509076 - RNA, 22 nt, Human
uuuguguuuguacaaugcacua

SEQ ID NO: 509077 - RNA, 22 nt, Human
caggaaggggcucacucuggcc

SEQ ID NO: 509078 - RNA, 20 nt, Human
gcugcucuccacggucugca

SEQ ID NO: 509079 - RNA, 22 nt, Human
auguuacaauucaaaaugcugc

SEQ ID NO: 509080 - RNA, 22 nt, Human
agaagcagggcagggaaaagca

SEQ ID NO: 509081 - RNA, 22 nt, Human
ugacagaaugugacucucagau

SEQ ID NO: 509082 - RNA, 22 nt, Human
ugcaguggaagagguggagauc

SEQ ID NO: 509083 - RNA, 21 nt, Human
agcugccugcucuggaccugg

SEQ ID NO: 509084 - RNA, 22 nt, Human
ggccugaggcgucccagcugug

SEQ ID NO: 509085 - RNA, 22 nt, Human
aagacaagcaucaaaucaggca

SEQ ID NO: 509086 - RNA, 22 nt, Human
accuuucauuaaagucuguagu

SEQ ID NO: 509087 - RNA, 22 nt, Human
gccaccccaaccucccuaaguu

SEQ ID NO: 509088 - RNA, 22 nt, Human
gcaaagucucaagacccaagug

SEQ ID NO: 509089 - RNA, 22 nt, Human
caccaggcacauaguaggcacu

SEQ ID NO: 509090 - RNA, 21 nt, Human
aguccccuguccuuacuucua

SEQ ID NO: 509091 - RNA, 22 nt, Human
agguccagacuguguacccuag

SEQ ID NO: 509092 - RNA, 22 nt, Human
caggcccugggcaggcacagag

SEQ ID NO: 509093 - RNA, 22 nt, Human
ggcuuugguagacacagauuga

SEQ ID NO: 509094 - RNA, 22 nt, Human
uucaaugaggauagaacuggau

SEQ ID NO: 509095 - RNA, 22 nt, Human
ucccagcacgucugcuguuucu

SEQ ID NO: 509096 - RNA, 22 nt, Human
uccugccucacaguugaaguuu

SEQ ID NO: 509097 - RNA, 22 nt, Human
ugaggaggcccagguuggggcu

SEQ ID NO: 509098 - RNA, 17 nt, Human
cccucuggggagggagg

SEQ ID NO: 509099 - RNA, 22 nt, Human
ucugucacucuagagauggcag

SEQ ID NO: 509100 - RNA, 22 nt, Human
aaggccugggaguacugggaca

SEQ ID NO: 509101 - RNA, 22 nt, Human
ugguggcaauguccuggagaag

SEQ ID NO: 509102 - RNA, 22 nt, Human
uuuccucuccaccaggaggucu

SEQ ID NO: 509103 - RNA, 22 nt, Human
uaagauaaggaacauucuguga

SEQ ID NO: 509104 - RNA, 22 nt, Human
agggagaggagggucuuguuga

SEQ ID NO: 509105 - RNA, 22 nt, Human
augaaguuccaguauaugcagu

SEQ ID NO: 509106 - RNA, 22 nt, Human
cagaggcagaggucaucucugg

SEQ ID NO: 509107 - RNA, 22 nt, Human
gcugccuggagcucagccugcc

SEQ ID NO: 509108 - RNA, 22 nt, Human
uaugaaauugccauuuuuaugg

SEQ ID NO: 509109 - RNA, 22 nt, Human
uggcagaggcucugugauguug

SEQ ID NO: 509110 - RNA, 22 nt, Human
aaacaguuuucucauuuagugu

SEQ ID NO: 509111 - RNA, 22 nt, Human
ccugucuguccucucaugagcc

SEQ ID NO: 509112 - RNA, 22 nt, Human
auguccagccaaccacuggauu

SEQ ID NO: 509113 - RNA, 22 nt, Human
aaggaaagacauauaaaugacu

SEQ ID NO: 509114 - RNA, 22 nt, Human
agcuuccacaucugucuucagu

SEQ ID NO: 509115 - RNA, 22 nt, Human
guccugagcccucagcacagca

SEQ ID NO: 509116 - RNA, 19 nt, Human
caacaguacugguuugucc

SEQ ID NO: 509117 - RNA, 22 nt, Human
gcuguacauucugcacaggccc

SEQ ID NO: 509118 - RNA, 22 nt, Human
aaaagcaaguugccuagguuga

SEQ ID NO: 509119 - RNA, 22 nt, Human
uaauuucacugauaugaaguca

SEQ ID NO: 509120 - RNA, 22 nt, Human
cccagcaucccagugggcagca

SEQ ID NO: 509121 - RNA, 22 nt, Human
agaggccagcagugccuaucug

SEQ ID NO: 509122 - RNA, 22 nt, Human
guccuucaaguaaccugggacc

SEQ ID NO: 509123 - RNA, 19 nt, Human
uguuuucaagugggauuau

SEQ ID NO: 509124 - RNA, 22 nt, Human
agcucugggccaggaacccuaa

SEQ ID NO: 509125 - RNA, 22 nt, Human
caguacuuguccucagguguua

SEQ ID NO: 509126 - RNA, 22 nt, Human
cugcucuggcguacucggcauc

SEQ ID NO: 509127 - RNA, 21 nt, Human
ugucuuuggccucauucccag

SEQ ID NO: 509128 - RNA, 22 nt, Human
ccuggcagguggagguugcagu

SEQ ID NO: 509129 - RNA, 22 nt, Human
gcucuguguccacagcuggaaa

SEQ ID NO: 509130 - RNA, 22 nt, Human
aggggccauuguucugcccgcu

SEQ ID NO: 509131 - RNA, 22 nt, Human
caggcugccuggaagaggacug

SEQ ID NO: 509132 - RNA, 21 nt, Human
cuaagcaaggagcagggguag

SEQ ID NO: 509133 - RNA, 22 nt, Human
aggagggugauccgggcugguc

SEQ ID NO: 509134 - RNA, 20 nt, Human
ucagugcagauuguccaagu

SEQ ID NO: 509135 - RNA, 22 nt, Human
uuacaugggcuugugaguccuu

SEQ ID NO: 509136 - RNA, 22 nt, Human
aguggcugucuuccaaaaucug

SEQ ID NO: 509137 - RNA, 22 nt, Human
aggcucuguuauucuagagggc

SEQ ID NO: 509138 - RNA, 22 nt, Human
acagguccuuauaagagcacuc

SEQ ID NO: 509139 - RNA, 22 nt, Human
ugggcugaguggcagccagagu

SEQ ID NO: 509140 - RNA, 22 nt, Human
gcccagcuccucugcagacccu

SEQ ID NO: 509141 - RNA, 22 nt, Human
uucuagaugauaaaccagcagc

SEQ ID NO: 509142 - RNA, 22 nt, Human
gggcacagagaagguuuuagug

SEQ ID NO: 509143 - RNA, 22 nt, Human
cuggaaugccucccugucagag

SEQ ID NO: 509144 - RNA, 22 nt, Human
ccaaguacucucaccaaagcuu

SEQ ID NO: 509145 - RNA, 22 nt, Human
gccugaugagcuuccagcugag

SEQ ID NO: 509146 - RNA, 22 nt, Human
aguguguacucauauacuucca

SEQ ID NO: 509147 - RNA, 22 nt, Human
aggaagaauguuuacauaucaa

SEQ ID NO: 509148 - RNA, 22 nt, Human
cucugcgccacccucgccugcu

SEQ ID NO: 509149 - RNA, 22 nt, Human
gugugccacugccugaggaccc

SEQ ID NO: 509150 - RNA, 22 nt, Human
auguuuuauuaccaacuuguac

SEQ ID NO: 509151 - RNA, 22 nt, Human
gcugucccgaaccccugguaau

SEQ ID NO: 509152 - RNA, 18 nt, Human
uccagcgugcuccagggc

SEQ ID NO: 509153 - RNA, 19 nt, Human
guguacagcucagugaauu

SEQ ID NO: 509154 - RNA, 22 nt, Human
gaguccaggcuguugcucaucu

SEQ ID NO: 509155 - RNA, 22 nt, Human
agugcuguccaguuucacaggu

SEQ ID NO: 509156 - RNA, 22 nt, Human
uagcaaagggaaagaagggccu

SEQ ID NO: 509157 - RNA, 22 nt, Human
ccuguucauuuguauuugucuu

SEQ ID NO: 509158 - RNA, 23 nt, Human
uguagcaucucuuauuucucagc

SEQ ID NO: 509159 - RNA, 21 nt, Human
uuuguucaggggcaaaguuaa

SEQ ID NO: 509160 - RNA, 22 nt, Human
gcagagcagugcuugcccagcg

SEQ ID NO: 509161 - RNA, 22 nt, Human
agagggcauuaacucugucuug

SEQ ID NO: 509162 - RNA, 19 nt, Human
gaggcgaggcgugcaggag

SEQ ID NO: 509163 - RNA, 22 nt, Human
acugggcugccugguucuucua

SEQ ID NO: 509164 - RNA, 22 nt, Human
aagaguuuccaguuguggcuca

SEQ ID NO: 509165 - RNA, 22 nt, Human
gcaguguugacuaugguaugag

SEQ ID NO: 509166 - RNA, 22 nt, Human
ggcugggucccagcugggagga

SEQ ID NO: 509167 - RNA, 22 nt, Human
acagcuuuaguguggguggugc

SEQ ID NO: 509168 - RNA, 22 nt, Human
guggagacuucuacuagagacc

SEQ ID NO: 509169 - RNA, 22 nt, Human
uuccaagugcugaggacaguag

SEQ ID NO: 509170 - RNA, 18 nt, Human
agcagcugucagaaugcc

SEQ ID NO: 509171 - RNA, 22 nt, Human
cagagcuggcggugagaagaca

SEQ ID NO: 509172 - RNA, 22 nt, Human
uaaaugauuuauguaugugaaa

SEQ ID NO: 509173 - RNA, 19 nt, Human
uggagacugagagugagca

SEQ ID NO: 509174 - RNA, 22 nt, Human
uccuucaguucaauuaguccgu

SEQ ID NO: 509175 - RNA, 23 nt, Human
uccugccagaugacuccuuucuu

SEQ ID NO: 509176 - RNA, 22 nt, Human
ccuggcaggccccuccuggauu

SEQ ID NO: 509177 - RNA, 22 nt, Human
aagaaaugugaauauugaauag

SEQ ID NO: 509178 - RNA, 22 nt, Human
uuggaaauacagcaguuacuuu

SEQ ID NO: 509179 - RNA, 19 nt, Human
ggagccuggagcacgugcc

SEQ ID NO: 509180 - RNA, 22 nt, Human
ccaaugauggugcccacgauga

SEQ ID NO: 509181 - RNA, 22 nt, Human
ggaguuggugagcaccaggcuu

SEQ ID NO: 509182 - RNA, 19 nt, Human
gcugucugaugcugagguc

SEQ ID NO: 509183 - RNA, 22 nt, Human
uuauuuguaaggcagggccagu

SEQ ID NO: 509184 - RNA, 22 nt, Human
ccuguguguaggccaggggagu

SEQ ID NO: 509185 - RNA, 20 nt, Human
ugaggcaggagaauggcaug

SEQ ID NO: 509186 - RNA, 22 nt, Human
gggcugggcaugguguucccuc

SEQ ID NO: 509187 - RNA, 22 nt, Human
gugcuuccugccuggugccuuu

SEQ ID NO: 509188 - RNA, 22 nt, Human
cagcuucuaccaucaggaaauu

SEQ ID NO: 509189 - RNA, 22 nt, Human
gcucuguccagcgugcacagaa

SEQ ID NO: 509190 - RNA, 22 nt, Human
uacaugcucaguaacuuucagu

SEQ ID NO: 509191 - RNA, 22 nt, Human
gaaaucugcggugaggccugag

SEQ ID NO: 509192 - RNA, 17 nt, Human
ugcauuguaggcuagcc

SEQ ID NO: 509193 - RNA, 22 nt, Human
agcaggcuacuccuguguucgu

SEQ ID NO: 509194 - RNA, 22 nt, Human
gcaagcuggcuguuagaggaug

SEQ ID NO: 509195 - RNA, 22 nt, Human
ugagccagccuugcagcugugc

SEQ ID NO: 509196 - RNA, 22 nt, Human
ucaggagaaucagggcuguccu

SEQ ID NO: 509197 - RNA, 18 nt, Human
aaggucugucugguaggu

SEQ ID NO: 509198 - RNA, 22 nt, Human
uuucacaauuuuaaggagcaaa

SEQ ID NO: 509199 - RNA, 22 nt, Human
augccaaauucucagccucuuu

SEQ ID NO: 509200 - RNA, 22 nt, Human
agcuggguggagggcccacggu

SEQ ID NO: 509201 - RNA, 15 nt, Human
auuauuugugcucag

SEQ ID NO: 509202 - RNA, 22 nt, Human
aggagacauaacuaugaugaga

SEQ ID NO: 509203 - RNA, 22 nt, Human
uaauacuuaccuugcagagucu

SEQ ID NO: 509204 - RNA, 22 nt, Human
agagacaggguuuugucguguu

SEQ ID NO: 509205 - RNA, 22 nt, Human
gcaaacauuccacagaaggaag

SEQ ID NO: 509206 - RNA, 22 nt, Human
ccaggaguuggagguugcagug

SEQ ID NO: 509207 - RNA, 21 nt, Human
gccagccuguuuaccuguggu

SEQ ID NO: 509208 - RNA, 22 nt, Human
uggcagcugucuguggggucuc

SEQ ID NO: 509209 - RNA, 22 nt, Human
cuaaagcaacugagacacauag

SEQ ID NO: 509210 - RNA, 22 nt, Human
aggcagugagcagggugucaug

SEQ ID NO: 509211 - RNA, 18 nt, Human
cagcagagacauucaaaa

SEQ ID NO: 509212 - RNA, 22 nt, Human
gcucaaggcaggcagacaugag

SEQ ID NO: 509213 - RNA, 18 nt, Human
gagcagcaggaucaagaa

SEQ ID NO: 509214 - RNA, 22 nt, Human
ccagaggagcaggcuggcucca

SEQ ID NO: 509215 - RNA, 22 nt, Human
caucacugucaccaucuuuccu

SEQ ID NO: 509216 - RNA, 22 nt, Human
cucuggaauuaaggaagccugu

SEQ ID NO: 509217 - RNA, 17 nt, Human
ucugucugugguccacu

SEQ ID NO: 509218 - RNA, 22 nt, Human
acccaggagcaggcugggcagu

SEQ ID NO: 509219 - RNA, 22 nt, Human
aguggcaauugacaacaaagga

SEQ ID NO: 509220 - RNA, 22 nt, Human
aaacuucagugaaugacuuaug

SEQ ID NO: 509221 - RNA, 22 nt, Human
gcugagugagguccagagcuug

SEQ ID NO: 509222 - RNA, 22 nt, Human
gggagagcgcgcuagggccgag

SEQ ID NO: 509223 - RNA, 23 nt, Human
uguugaaguaacuguuacauaga

SEQ ID NO: 509224 - RNA, 22 nt, Human
uuacaguagauuuugaaugugg

SEQ ID NO: 509225 - RNA, 23 nt, Human
uugucugugcuuuuccaguugcu

SEQ ID NO: 509226 - RNA, 22 nt, Human
ccuggggcuuucuuuguaucau

SEQ ID NO: 509227 - RNA, 22 nt, Human
gcaguccucucauuggccuccu

SEQ ID NO: 509228 - RNA, 22 nt, Human
agcuggagcuucaagcagguaa

SEQ ID NO: 509229 - RNA, 22 nt, Human
gcaaagcaucaguagaaauguu

SEQ ID NO: 509230 - RNA, 22 nt, Human
ccuggcaguuuugcccaggauu

SEQ ID NO: 509231 - RNA, 22 nt, Human
auauaaaguguuuagaaagcug

SEQ ID NO: 509232 - RNA, 22 nt, Human
gggaccuggucuagcacugagc

SEQ ID NO: 509233 - RNA, 22 nt, Human
aguggcugccaagauauaauuc

SEQ ID NO: 509234 - RNA, 22 nt, Human
ggucucaaggaauauaaugagu

SEQ ID NO: 509235 - RNA, 22 nt, Human
uggguggcggccugguucugag

SEQ ID NO: 509236 - RNA, 22 nt, Human
gcauuuaaauuugaacuucaga

SEQ ID NO: 509237 - RNA, 21 nt, Human
ggagucagggucuggcugggg

SEQ ID NO: 509238 - RNA, 22 nt, Human
ggcugcugugaccucaggugau

SEQ ID NO: 509239 - RNA, 22 nt, Human
cuuugggcaaagggccaauucg

SEQ ID NO: 509240 - RNA, 22 nt, Human
ugcaugcagcuggugauaagaa

SEQ ID NO: 509241 - RNA, 22 nt, Human
uaaagugcagauugugauucag

SEQ ID NO: 509242 - RNA, 22 nt, Human
gaaggcuggggccuucucaucu

SEQ ID NO: 509243 - RNA, 22 nt, Human
uucuccucuguuggccuucccu

SEQ ID NO: 509244 - RNA, 22 nt, Human
gacauucacaguuuccgauggu

SEQ ID NO: 509245 - RNA, 22 nt, Human
ugugacagaucuuuaaauaaug

SEQ ID NO: 509246 - RNA, 22 nt, Human
acugggcucccaggcuugucau

SEQ ID NO: 509247 - RNA, 22 nt, Human
agcagcuggugagcaagcucag

SEQ ID NO: 509248 - RNA, 22 nt, Human
uggggccuggucagagcugcac

SEQ ID NO: 509249 - RNA, 17 nt, Human
acucaggaucugggagu

SEQ ID NO: 509250 - RNA, 22 nt, Human
augaaagaugauuuaaaguacu

SEQ ID NO: 509251 - RNA, 22 nt, Human
uggcagcugauuagauggugcc

SEQ ID NO: 509252 - RNA, 22 nt, Human
ggcacagagcuuugucccaguu

SEQ ID NO: 509253 - RNA, 22 nt, Human
gccucugcugacaagauggaca

SEQ ID NO: 509254 - RNA, 22 nt, Human
gccaggcugccuuaucucuagc

SEQ ID NO: 509255 - RNA, 22 nt, Human
agugucaacugucuacagggag

SEQ ID NO: 509256 - RNA, 22 nt, Human
gaggccuggcugucagucccca

SEQ ID NO: 509257 - RNA, 22 nt, Human
cagguccacagcccaucacugc

SEQ ID NO: 509258 - RNA, 21 nt, Human
ugccuuggcaaaugaccauga

SEQ ID NO: 509259 - RNA, 20 nt, Human
ggaagcagagaacuguuuuc

SEQ ID NO: 509260 - RNA, 22 nt, Human
ggcuucuguccucuggaucugu

SEQ ID NO: 509261 - RNA, 17 nt, Human
gggagaugaagggauau

SEQ ID NO: 509262 - RNA, 22 nt, Human
ccagaaagaaugaacugaaccc

SEQ ID NO: 509263 - RNA, 18 nt, Human
gccucccuggcuacacuu

SEQ ID NO: 509264 - RNA, 22 nt, Human
uuacaaagcaggucagcugaaa

SEQ ID NO: 509265 - RNA, 22 nt, Human
aacuguucuucauuuucaguau

SEQ ID NO: 509266 - RNA, 22 nt, Human
cugugccuuggcgcugugccac

SEQ ID NO: 509267 - RNA, 22 nt, Human
acaaagucacaauaauuaaccu

SEQ ID NO: 509268 - RNA, 22 nt, Human
uacacccuucuccugagugugu

SEQ ID NO: 509269 - RNA, 22 nt, Human
ccuggcucgcugaccucagggg

SEQ ID NO: 509270 - RNA, 22 nt, Human
cuccugggcucauaucauucag

SEQ ID NO: 509271 - RNA, 23 nt, Human
gcuguacaggaaccaguuuggag

SEQ ID NO: 509272 - RNA, 22 nt, Human
caggcugccgugaagcaggccu

SEQ ID NO: 509273 - RNA, 22 nt, Human
cucuuaaagaauguuccagcug

SEQ ID NO: 509274 - RNA, 22 nt, Human
uguuuuaagagcgcacuuuaua

SEQ ID NO: 509275 - RNA, 22 nt, Human
uacaguaaagcugcuaugaauu

SEQ ID NO: 509276 - RNA, 22 nt, Human
gcacagagcuggcccuccaggc

SEQ ID NO: 509277 - RNA, 22 nt, Human
agauguuuuggagacacuaacc

SEQ ID NO: 509278 - RNA, 22 nt, Human
uugggccaaggcagaucuccaa

SEQ ID NO: 509279 - RNA, 22 nt, Human
uccagggacacagaguccuucu

SEQ ID NO: 509280 - RNA, 22 nt, Human
caguauagaaaguuuuaaauug

SEQ ID NO: 509281 - RNA, 22 nt, Human
uaugcacaauaugaucuauuug

SEQ ID NO: 509282 - RNA, 22 nt, Human
gcaccuuucuauauucaguggc

SEQ ID NO: 509283 - RNA, 22 nt, Human
ucaaaggaguuuaaguuacugg

SEQ ID NO: 509284 - RNA, 21 nt, Human
acccuggguucuccauacccu

SEQ ID NO: 509285 - RNA, 22 nt, Human
uaagaacauuuucggaaagaua

SEQ ID NO: 509286 - RNA, 22 nt, Human
ggaggccaaggagggcggauca

SEQ ID NO: 509287 - RNA, 22 nt, Human
guguucauugcuagugaggugu

SEQ ID NO: 509288 - RNA, 22 nt, Human
aaaagguaguugccaaauaagg

SEQ ID NO: 509289 - RNA, 22 nt, Human
auaauauuuggauaggacagua

SEQ ID NO: 509290 - RNA, 22 nt, Human
gcuaggagccgcugcacuaggu

SEQ ID NO: 509291 - RNA, 22 nt, Human
ugaagaucugucaaccccauau

SEQ ID NO: 509292 - RNA, 22 nt, Human
uguguuuuacaaauucucuuaa

SEQ ID NO: 509293 - RNA, 22 nt, Human
acccugggcuuggccugcucag

SEQ ID NO: 509294 - RNA, 20 nt, Human
gucuuuauguuuuaugaccu

SEQ ID NO: 509295 - RNA, 22 nt, Human
ugcucuggggagcuccucugcg

SEQ ID NO: 509296 - RNA, 22 nt, Human
gagcugaauugaagcaaggagc

SEQ ID NO: 509297 - RNA, 22 nt, Human
gcucaggccucggacacacaau

SEQ ID NO: 509298 - RNA, 22 nt, Human
gaguggggcguggauccagcgu

SEQ ID NO: 509299 - RNA, 22 nt, Human
uuuaagaugguauuuuauaaag

SEQ ID NO: 509300 - RNA, 22 nt, Human
ccaaggucuuggacagcuaaug

SEQ ID NO: 509301 - RNA, 22 nt, Human
ucuguucuuggugcagcuggga

SEQ ID NO: 509302 - RNA, 22 nt, Human
ucaggccuccagguuaccauuu

SEQ ID NO: 509303 - RNA, 22 nt, Human
gcagcagaaguagaaguacagg

SEQ ID NO: 509304 - RNA, 22 nt, Human
uguagaaagcucuucugaaauc

SEQ ID NO: 509305 - RNA, 22 nt, Human
ucucuucuagcuucuugugguu

SEQ ID NO: 509306 - RNA, 18 nt, Human
uccagucccagcucugcc

SEQ ID NO: 509307 - RNA, 22 nt, Human
augccacugacauggacaauuu

SEQ ID NO: 509308 - RNA, 22 nt, Human
ccugggcugcucauggggauga

SEQ ID NO: 509309 - RNA, 19 nt, Human
augaggaacugaggcucag

SEQ ID NO: 509310 - RNA, 22 nt, Human
ggcugcagggcagcuggugugg

SEQ ID NO: 509311 - RNA, 18 nt, Human
uggagcagguaggcauga

SEQ ID NO: 509312 - RNA, 22 nt, Human
aggguccauguuuccaguuaau

SEQ ID NO: 509313 - RNA, 19 nt, Human
guuucauuaagauaggaaa

SEQ ID NO: 509314 - RNA, 22 nt, Human
cagcugaggucaaagaagcagg

SEQ ID NO: 509315 - RNA, 19 nt, Human
ucauaaggagagaggaaau

SEQ ID NO: 509316 - RNA, 22 nt, Human
aggcuucuaggguuggcagcgg

SEQ ID NO: 509317 - RNA, 22 nt, Human
uacagucuuuggaaagagauag

SEQ ID NO: 509318 - RNA, 22 nt, Human
aucccagauagugacccucagg

SEQ ID NO: 509319 - RNA, 22 nt, Human
ugaguccaauaggggccuggaa

SEQ ID NO: 509320 - RNA, 22 nt, Human
guggccuggaugagcuucgaca

SEQ ID NO: 509321 - RNA, 22 nt, Human
ggccucugguucguggugaccu

SEQ ID NO: 509322 - RNA, 22 nt, Human
acagagcaugcucaguguguga

SEQ ID NO: 509323 - RNA, 23 nt, Human
guccuagugcuuggugcccaggc

SEQ ID NO: 509324 - RNA, 22 nt, Human
uauuucuugaguggucaguuuc

SEQ ID NO: 509325 - RNA, 22 nt, Human
cgcaggcuuuagaaucugcuac

SEQ ID NO: 509326 - RNA, 22 nt, Human
caguggggaggccaggauagaa

SEQ ID NO: 509327 - RNA, 22 nt, Human
ugaacagauggcccagcagagg

SEQ ID NO: 509328 - RNA, 22 nt, Human
gccuccagcuggggcauuucag

SEQ ID NO: 509329 - RNA, 22 nt, Human
ugggccagcugaagugccgccc

SEQ ID NO: 509330 - RNA, 22 nt, Human
ugguggcacaagggagagaauc

SEQ ID NO: 509331 - RNA, 22 nt, Human
gugcagugaaaaaagaaugucc

SEQ ID NO: 509332 - RNA, 22 nt, Human
cagccaucaguaaagacagcuu

SEQ ID NO: 509333 - RNA, 22 nt, Human
cagaaauauuuauugagugaca

SEQ ID NO: 509334 - RNA, 22 nt, Human
gcuguacaguuuacuagguggg

SEQ ID NO: 509335 - RNA, 22 nt, Human
cagggacaauggcagagccuga

SEQ ID NO: 509336 - RNA, 22 nt, Human
acaguggugagugacugauagg

SEQ ID NO: 509337 - RNA, 19 nt, Human
aguccaugaauggaggaug

SEQ ID NO: 509338 - RNA, 22 nt, Human
ggaggggccggcugccugccac

SEQ ID NO: 509339 - RNA, 22 nt, Human
uagcauuuauggucaugugucc

SEQ ID NO: 509340 - RNA, 22 nt, Human
ugccagcacaaguuaagagauc

SEQ ID NO: 509341 - RNA, 22 nt, Human
uuacauaguuaaauaguacagc

SEQ ID NO: 509342 - RNA, 22 nt, Human
cuggcuuucucugugguguuca

SEQ ID NO: 509343 - RNA, 22 nt, Human
gccugggagagggauagugcag

SEQ ID NO: 509344 - RNA, 22 nt, Human
cugugaugacaggcagggccaa

SEQ ID NO: 509345 - RNA, 22 nt, Human
acagggcaugugcaagagacau

SEQ ID NO: 509346 - RNA, 22 nt, Human
aauguuacaguuuuaauucuga

SEQ ID NO: 509347 - RNA, 22 nt, Human
aauuucaauuacuuuugcacca

SEQ ID NO: 509348 - RNA, 22 nt, Human
ucaguguuuguggcaaauguua

SEQ ID NO: 509349 - RNA, 22 nt, Human
cugaccugcuaagccccugucc

SEQ ID NO: 509350 - RNA, 22 nt, Human
uguggcuuaagaaugccuuuaa

SEQ ID NO: 509351 - RNA, 22 nt, Human
uuacaagauugauuugcuuggc

SEQ ID NO: 509352 - RNA, 22 nt, Human
ugcucuguugugcaugugggau

SEQ ID NO: 509353 - RNA, 22 nt, Human
ggcuccugccgucuuuucugag

SEQ ID NO: 509354 - RNA, 22 nt, Human
agcaggagcugugggaagaugg

SEQ ID NO: 509355 - RNA, 22 nt, Human
ucaggaagacaaucuuuggcuc

SEQ ID NO: 509356 - RNA, 22 nt, Human
accugggagucacaccugagaa

SEQ ID NO: 509357 - RNA, 22 nt, Human
uauccaauucaccauugauggg

SEQ ID NO: 509358 - RNA, 22 nt, Human
cuggccugcugggugagguccu

SEQ ID NO: 509359 - RNA, 22 nt, Human
cccaguggcuuuugcccagguu

SEQ ID NO: 509360 - RNA, 22 nt, Human
ccugggucuugguucaugcucu

SEQ ID NO: 509361 - RNA, 22 nt, Human
uguggggugugguccaggcauc

SEQ ID NO: 509362 - RNA, 22 nt, Human
ucucaggguuuccugggggcug

SEQ ID NO: 509363 - RNA, 20 nt, Human
auucuacaagaauaagcaug

SEQ ID NO: 509364 - RNA, 22 nt, Human
ccucccaccguaucucaguggc

SEQ ID NO: 509365 - RNA, 22 nt, Human
uuaagucauuucugauuauaga

SEQ ID NO: 509366 - RNA, 22 nt, Human
gccuguggccacugcgucugca

SEQ ID NO: 509367 - RNA, 22 nt, Human
auggacagugugaagcagauag

SEQ ID NO: 509368 - RNA, 22 nt, Human
guccugagaugucacaagguuu

SEQ ID NO: 509369 - RNA, 22 nt, Human
uggccuuggacagagcgcuccu

SEQ ID NO: 509370 - RNA, 21 nt, Human
gcagaggcacggcaccaaggg

SEQ ID NO: 509371 - RNA, 22 nt, Human
acuuucuauucccacagagaua

SEQ ID NO: 509372 - RNA, 22 nt, Human
uuuccauauuuggucuuuggga

SEQ ID NO: 509373 - RNA, 23 nt, Human
aucuuagcauagacuugaguccc

SEQ ID NO: 509374 - RNA, 22 nt, Human
uuuuaacuuaaaauacauagau

SEQ ID NO: 509375 - RNA, 22 nt, Human
aauauuuguuaguguuuuaaug

SEQ ID NO: 509376 - RNA, 23 nt, Human
gccuggccaccccagggcugcuu

SEQ ID NO: 509377 - RNA, 22 nt, Human
aagggcagagggaaucccacau

SEQ ID NO: 509378 - RNA, 22 nt, Human
ccagggcuggguuugucggugu

SEQ ID NO: 509379 - RNA, 22 nt, Human
ucuggaaguuagaggaggaaag

SEQ ID NO: 509380 - RNA, 22 nt, Human
uggcuccugcagaccaucugga

SEQ ID NO: 509381 - RNA, 22 nt, Human
uagauucaaguauucaguuugg

SEQ ID NO: 509382 - RNA, 22 nt, Human
aaagaucuccccuucaaagagu

SEQ ID NO: 509383 - RNA, 22 nt, Human
gggcaugccugagccugccacu

SEQ ID NO: 509384 - RNA, 22 nt, Human
gcagcuggggccacacuuaggc

SEQ ID NO: 509385 - RNA, 22 nt, Human
ucucuggcagggauaucuggcu

SEQ ID NO: 509386 - RNA, 22 nt, Human
cauggccagcccccaguuccuc

SEQ ID NO: 509387 - RNA, 22 nt, Human
cagaccugagguugaguaccag

SEQ ID NO: 509388 - RNA, 22 nt, Human
augcagguugggcaaguguggg

SEQ ID NO: 509389 - RNA, 20 nt, Human
agucacaggccuggaacaug

SEQ ID NO: 509390 - RNA, 22 nt, Human
caggucccguuccccagagauu

SEQ ID NO: 509391 - RNA, 22 nt, Human
gcauugucaaaagugguaugac

SEQ ID NO: 509392 - RNA, 22 nt, Human
gccaaaucacagggccaaaagc

SEQ ID NO: 509393 - RNA, 22 nt, Human
ccccaccugugcgucugccgca

SEQ ID NO: 509394 - RNA, 22 nt, Human
cccuggagugugacgaggcauu

SEQ ID NO: 509395 - RNA, 22 nt, Human
cuucacagucuuuauuuccucc

SEQ ID NO: 509396 - RNA, 22 nt, Human
augucugcggcccaggccaggg

SEQ ID NO: 509397 - RNA, 22 nt, Human
uaaguuuucuggaauaacuugg

SEQ ID NO: 509398 - RNA, 22 nt, Human
gaggcacuggaggaaaggagaa

SEQ ID NO: 509399 - RNA, 22 nt, Human
uagguucagagaacugaaaaua

SEQ ID NO: 509400 - RNA, 22 nt, Human
acguguucaauuuccaucugac

SEQ ID NO: 509401 - RNA, 22 nt, Human
aggucccaggcauagcuggucu

SEQ ID NO: 509402 - RNA, 22 nt, Human
uacgaauccuguggaugaaugu

SEQ ID NO: 509403 - RNA, 22 nt, Human
uaaauguggagacucaggaguc

SEQ ID NO: 509404 - RNA, 20 nt, Human
gucugaggagcagugggaaa

SEQ ID NO: 509405 - RNA, 22 nt, Human
gcaggggcaggagaucucaggc

SEQ ID NO: 509406 - RNA, 22 nt, Human
gauuuuucaguauaaaauauau

SEQ ID NO: 509407 - RNA, 22 nt, Human
uccaagggcagccauagaacuu

SEQ ID NO: 509408 - RNA, 22 nt, Human
cuauuuguaaagugccuggugu

SEQ ID NO: 509409 - RNA, 20 nt, Human
ccccuucaucuacagccuga

SEQ ID NO: 509410 - RNA, 20 nt, Human
cugagcgucuaagaggugag

SEQ ID NO: 509411 - RNA, 22 nt, Human
uccaggcuccccugcgugcucc

SEQ ID NO: 509412 - RNA, 22 nt, Human
cugcugaaaacaauaaugauga

SEQ ID NO: 509413 - RNA, 22 nt, Human
cugugcuuaccugcccagguga

SEQ ID NO: 509414 - RNA, 22 nt, Human
cuggcagcgugagcagcaucca

SEQ ID NO: 509415 - RNA, 22 nt, Human
ccagggcagugggagaaggugc

SEQ ID NO: 509416 - RNA, 22 nt, Human
gagccugcccagcccuguccac

SEQ ID NO: 509417 - RNA, 22 nt, Human
aggggagguguccccaaaucuc

SEQ ID NO: 509418 - RNA, 22 nt, Human
gagggaugugccugaaggcagg

SEQ ID NO: 509419 - RNA, 22 nt, Human
gaagaaagauuggcaugcuuca

SEQ ID NO: 509420 - RNA, 22 nt, Human
aggcacugcagauuacaggcgc

SEQ ID NO: 509421 - RNA, 22 nt, Human
caggugcucccagagaagugcu

SEQ ID NO: 509422 - RNA, 22 nt, Human
auuucuuuucaagagggugcuu

SEQ ID NO: 509423 - RNA, 22 nt, Human
cuuguucaguugccucuccugc

SEQ ID NO: 509424 - RNA, 21 nt, Human
acaggcucuggggaugcuggg

SEQ ID NO: 509425 - RNA, 22 nt, Human
auuauguaacugugguucagca

SEQ ID NO: 509426 - RNA, 22 nt, Human
aaagguuaagguguucaagaaa

SEQ ID NO: 509427 - RNA, 22 nt, Human
caggcucacuuucucagucaca

SEQ ID NO: 509428 - RNA, 22 nt, Human
ugccuggcaucuagcccuggga

SEQ ID NO: 509429 - RNA, 22 nt, Human
gaaggagagagacaucgucccu

SEQ ID NO: 509430 - RNA, 22 nt, Human
ugcaccauacccauuccccucu

SEQ ID NO: 509431 - RNA, 22 nt, Human
ugagggaggccuccaucugcca

SEQ ID NO: 509432 - RNA, 22 nt, Human
uaaaucagggagucaucugcga

SEQ ID NO: 509433 - RNA, 22 nt, Human
ucaaaugcuucuacuccuaaga

SEQ ID NO: 509434 - RNA, 22 nt, Human
gcaggguaggugacagguaguc

SEQ ID NO: 509435 - RNA, 21 nt, Human
gaaggagaaagcaagugcugc

SEQ ID NO: 509436 - RNA, 22 nt, Human
cccuggagcugcuugcauguug

SEQ ID NO: 509437 - RNA, 22 nt, Human
uauuugauagagauaaaugaua

SEQ ID NO: 509438 - RNA, 22 nt, Human
aguaucaaggaucuccagcacc

SEQ ID NO: 509439 - RNA, 22 nt, Human
auccuugaacuuagacacuagg

SEQ ID NO: 509440 - RNA, 22 nt, Human
gagucuguaugucuuccaugca

SEQ ID NO: 509441 - RNA, 22 nt, Human
auccccagaaaauaggugccua

SEQ ID NO: 509442 - RNA, 20 nt, Human
uccugcaguuccuaggaggg

SEQ ID NO: 509443 - RNA, 22 nt, Human
uucugggccuccuaggacaggc

SEQ ID NO: 509444 - RNA, 22 nt, Human
aagcagcacgcuuugccaacaa

SEQ ID NO: 509445 - RNA, 22 nt, Human
cuggcucacaggugagaugcau

SEQ ID NO: 509446 - RNA, 22 nt, Human
gcucccagacugaccagaggug

SEQ ID NO: 509447 - RNA, 22 nt, Human
ggaggccaaggcagguggauca

SEQ ID NO: 509448 - RNA, 22 nt, Human
ugggcugcugagaaugagagag

SEQ ID NO: 509449 - RNA, 22 nt, Human
cuguccagaaagggggcaacaa

SEQ ID NO: 509450 - RNA, 22 nt, Human
aggucucacuuuguggaaguga

SEQ ID NO: 509451 - RNA, 18 nt, Human
cuucauuuguagaguucc

SEQ ID NO: 509452 - RNA, 22 nt, Human
ccacccugagccgcaagagcag

SEQ ID NO: 509453 - RNA, 22 nt, Human
augcccgauaccuaguuaacuc

SEQ ID NO: 509454 - RNA, 22 nt, Human
cugcccaguuugggagccuuuc

SEQ ID NO: 509455 - RNA, 22 nt, Human
aaaguaugauuggggauuauuu

SEQ ID NO: 509456 - RNA, 22 nt, Human
uagcagcuguggaggggcugug

SEQ ID NO: 509457 - RNA, 22 nt, Human
ggucugagauauuuguucagcu

SEQ ID NO: 509458 - RNA, 22 nt, Human
cccugagcccauaguugacauu

SEQ ID NO: 509459 - RNA, 22 nt, Human
ugaaggaaugaguauacuguuu

SEQ ID NO: 509460 - RNA, 22 nt, Human
cagcaggacguccaagugcuau

SEQ ID NO: 509461 - RNA, 22 nt, Human
gaggagaaauuuggggaccuga

SEQ ID NO: 509462 - RNA, 22 nt, Human
aagccaaauaauguagguacau

SEQ ID NO: 509463 - RNA, 22 nt, Human
auuuggaaaugcaucucuugag

SEQ ID NO: 509464 - RNA, 22 nt, Human
agccccaggcccggacgccucu

SEQ ID NO: 509465 - RNA, 22 nt, Human
aagcagcugugugacauaaucu

SEQ ID NO: 509466 - RNA, 22 nt, Human
agcccccaaaagugcuuaugau

SEQ ID NO: 509467 - RNA, 22 nt, Human
gugcuggcccuguccucgagcu

SEQ ID NO: 509468 - RNA, 22 nt, Human
auagcuguuagauuggggucga

SEQ ID NO: 509469 - RNA, 22 nt, Human
cagcccugcuuccccgcuaguu

SEQ ID NO: 509470 - RNA, 22 nt, Human
gcugggagccguaccugucacg

SEQ ID NO: 509471 - RNA, 22 nt, Human
ggagggagagugacccuaccaa

SEQ ID NO: 509472 - RNA, 22 nt, Human
aagagcauauuaauaguggaga

SEQ ID NO: 509473 - RNA, 22 nt, Human
uugaaagugccaaguccuagug

SEQ ID NO: 509474 - RNA, 22 nt, Human
ccagggccucguguucugagug

SEQ ID NO: 509475 - RNA, 22 nt, Human
gugcccaggugucccugagaag

SEQ ID NO: 509476 - RNA, 22 nt, Human
agaaaagguugaaaguaggauu

SEQ ID NO: 509477 - RNA, 22 nt, Human
guagggacuuguuuuacuagua

SEQ ID NO: 509478 - RNA, 22 nt, Human
uguaugaauauguauuuucaua

SEQ ID NO: 509479 - RNA, 22 nt, Human
ucuguuuaggcaaaauagcuac

SEQ ID NO: 509480 - RNA, 22 nt, Human
caaaauaccacgacuuguuuua

SEQ ID NO: 509481 - RNA, 22 nt, Human
gccuuggccuuccuaggccuga

SEQ ID NO: 509482 - RNA, 22 nt, Human
augggagugacagggccacugg

SEQ ID NO: 509483 - RNA, 22 nt, Human
cauuggaaugcauuugaagaga

SEQ ID NO: 509484 - RNA, 22 nt, Human
ugugaagcuggauccuggagcu

SEQ ID NO: 509485 - RNA, 22 nt, Human
ucauuacagagauauaaucuac

SEQ ID NO: 509486 - RNA, 22 nt, Human
ggcggggguccaggagccugca

SEQ ID NO: 509487 - RNA, 22 nt, Human
uccucaggcugccuggaagacu

SEQ ID NO: 509488 - RNA, 22 nt, Human
cagagucuggacugcaggcucc

SEQ ID NO: 509489 - RNA, 22 nt, Human
ucaguuuuguauguuguaaguc

SEQ ID NO: 509490 - RNA, 22 nt, Human
agauuuguugugagcaggaaua

SEQ ID NO: 509491 - RNA, 23 nt, Human
cuuuccuuucuuugacacccagc

SEQ ID NO: 509492 - RNA, 22 nt, Human
ucucagugauggcccauuugga

SEQ ID NO: 509493 - RNA, 22 nt, Human
guuucccaaauuguucacaggg

SEQ ID NO: 509494 - RNA, 22 nt, Human
uauuauguagaguaaggguuaa

SEQ ID NO: 509495 - RNA, 22 nt, Human
uucaggagaauuccaagaagua

SEQ ID NO: 509496 - RNA, 22 nt, Human
ugguccuguguucuuccugccu

SEQ ID NO: 509497 - RNA, 22 nt, Human
ucugggcugucuacagguuggc

SEQ ID NO: 509498 - RNA, 22 nt, Human
uggcucuguggauguucugacc

SEQ ID NO: 509499 - RNA, 22 nt, Human
uuaauuuuuauguauagugugu

SEQ ID NO: 509500 - RNA, 22 nt, Human
cacugcuuuaaggcugaguaac

SEQ ID NO: 509501 - RNA, 22 nt, Human
ucauuucaaguucugacagcua

SEQ ID NO: 509502 - RNA, 21 nt, Human
ugcuggcugaaaggcacagag

SEQ ID NO: 509503 - RNA, 22 nt, Human
cagcagugucuccagcaucaca

SEQ ID NO: 509504 - RNA, 22 nt, Human
uuucacagucaauuuggaguca

SEQ ID NO: 509505 - RNA, 17 nt, Human
gccuggcccagccuggc

SEQ ID NO: 509506 - RNA, 22 nt, Human
auugaaagcauggauuuggauu

SEQ ID NO: 509507 - RNA, 22 nt, Human
gccaggccugcaagugcuggug

SEQ ID NO: 509508 - RNA, 22 nt, Human
agagcagucaggcuaggacacu

SEQ ID NO: 509509 - RNA, 22 nt, Human
auaaguaggaaaauuugaauau

SEQ ID NO: 509510 - RNA, 22 nt, Human
aaauuagaccagggcuccugga

SEQ ID NO: 509511 - RNA, 22 nt, Human
ucaggaagggugguccacaggg

SEQ ID NO: 509512 - RNA, 22 nt, Human
ucuccaagaaaagaucucagcu

SEQ ID NO: 509513 - RNA, 22 nt, Human
uuuugccugugaauacuaucuu

SEQ ID NO: 509514 - RNA, 22 nt, Human
accuguuuguuaagaaagcuuc

SEQ ID NO: 509515 - RNA, 22 nt, Human
uccucacacuauagaugaggau

SEQ ID NO: 509516 - RNA, 22 nt, Human
aagaugcuuauugcuccugcag

SEQ ID NO: 509517 - RNA, 17 nt, Human
uggaaggcuucaauauu

SEQ ID NO: 509518 - RNA, 22 nt, Human
auucuaaagcuuguggagcuua

SEQ ID NO: 509519 - RNA, 22 nt, Human
guguaaggccccagguucuuua

SEQ ID NO: 509520 - RNA, 22 nt, Human
ccuuagugaaacagaggcaauu

SEQ ID NO: 509521 - RNA, 22 nt, Human
agacagggucuugaucagagcu

SEQ ID NO: 509522 - RNA, 22 nt, Human
aagccuucaguccguugcagag

SEQ ID NO: 509523 - RNA, 22 nt, Human
ugggaccaagucauuucuuuag

SEQ ID NO: 509524 - RNA, 22 nt, Human
aaaguuuuauaugcugcagcga

SEQ ID NO: 509525 - RNA, 22 nt, Human
uucucuggguuaggggaacuau

SEQ ID NO: 509526 - RNA, 22 nt, Human
caggaaagguagucacaaugua

SEQ ID NO: 509527 - RNA, 22 nt, Human
ucuucaaaugcuaguaauauca

SEQ ID NO: 509528 - RNA, 22 nt, Human
gcagugggcaacaagagcugga

SEQ ID NO: 509529 - RNA, 22 nt, Human
gcucuggcuuggggcacucguc

SEQ ID NO: 509530 - RNA, 22 nt, Human
gcagaggggaagcugaggaauu

SEQ ID NO: 509531 - RNA, 18 nt, Human
aagaggaggagcagguug

SEQ ID NO: 509532 - RNA, 22 nt, Human
gugccuggaacuggguaggcug

SEQ ID NO: 509533 - RNA, 22 nt, Human
ucagaggcaucauucauaguua

SEQ ID NO: 509534 - RNA, 22 nt, Human
aaggagucucagcugggccuga

SEQ ID NO: 509535 - RNA, 22 nt, Human
ucccuccuggugagcaggggcu

SEQ ID NO: 509536 - RNA, 20 nt, Human
aaaaucucccagaaacuuau

SEQ ID NO: 509537 - RNA, 22 nt, Human
agcacagguacggagaugcuac

SEQ ID NO: 509538 - RNA, 22 nt, Human
augaggcaggagugcaguggca

SEQ ID NO: 509539 - RNA, 22 nt, Human
uugaaaggaauacagaggccua

SEQ ID NO: 509540 - RNA, 22 nt, Human
ccucacagggccaggccccuca

SEQ ID NO: 509541 - RNA, 22 nt, Human
aagagcuggagcugcuacagga

SEQ ID NO: 509542 - RNA, 22 nt, Human
aaaucugggagcagcucggcca

SEQ ID NO: 509543 - RNA, 22 nt, Human
cugaguggguuucugcuuguca

SEQ ID NO: 509544 - RNA, 22 nt, Human
ugcauguggaccccuggugccu

SEQ ID NO: 509545 - RNA, 23 nt, Human
cugcccugaucuugaucuauugu

SEQ ID NO: 509546 - RNA, 22 nt, Human
uuuucucuacaaaauaaccagc

SEQ ID NO: 509547 - RNA, 22 nt, Human
aaggauuuuuggaaugagaugg

SEQ ID NO: 509548 - RNA, 22 nt, Human
uuaagaauggaaugaggaauuu

SEQ ID NO: 509549 - RNA, 22 nt, Human
uaguguucuaagaacauccaug

SEQ ID NO: 509550 - RNA, 21 nt, Human
auugaaagucaacaaucaguu

SEQ ID NO: 509551 - RNA, 22 nt, Human
uauuagaggaaccaagguggag

SEQ ID NO: 509552 - RNA, 22 nt, Human
cagcagaggaaagcaaaucuaa

SEQ ID NO: 509553 - RNA, 22 nt, Human
uggcuggggccacaguuuuccu

SEQ ID NO: 509554 - RNA, 22 nt, Human
caugcagucaauaaacaugugu

SEQ ID NO: 509555 - RNA, 22 nt, Human
gcagcaaucuucacagugucau

SEQ ID NO: 509556 - RNA, 22 nt, Human
cagaagcacuaggaggaaacgu

SEQ ID NO: 509557 - RNA, 22 nt, Human
caaaugaagggagcugaagucu

SEQ ID NO: 509558 - RNA, 22 nt, Human
agaugcugcuccacaggccagg

SEQ ID NO: 509559 - RNA, 22 nt, Human
uccuuuccaugcuucuagaggc

SEQ ID NO: 509560 - RNA, 23 nt, Human
ugccucugccucccuagucugca

SEQ ID NO: 509561 - RNA, 22 nt, Human
aggcacugaaagguggccagag

SEQ ID NO: 509562 - RNA, 19 nt, Human
ccagagagcuagguacaga

SEQ ID NO: 509563 - RNA, 22 nt, Human
gaaggccuagggaugcucugcg

SEQ ID NO: 509564 - RNA, 21 nt, Human
guggcccugguguggcugcac

SEQ ID NO: 509565 - RNA, 22 nt, Human
ggaugcaggacggcauggaugu

SEQ ID NO: 509566 - RNA, 22 nt, Human
ugaguagagaauucagcuaagg

SEQ ID NO: 509567 - RNA, 21 nt, Human
ggcagccucuguggaagggga

SEQ ID NO: 509568 - RNA, 22 nt, Human
cagaaacuucuggugucaaaua

SEQ ID NO: 509569 - RNA, 22 nt, Human
cuggucacuggucucauccagc

SEQ ID NO: 509570 - RNA, 21 nt, Human
agcagagugcuuugacuuugu

SEQ ID NO: 509571 - RNA, 22 nt, Human
uccuggcuccuggagaccugcu

SEQ ID NO: 509572 - RNA, 22 nt, Human
ucuaccuauuucuucuauuggu

SEQ ID NO: 509573 - RNA, 22 nt, Human
aguguccccuccaagggccugg

SEQ ID NO: 509574 - RNA, 19 nt, Human
gagcccucuccauggccac

SEQ ID NO: 509575 - RNA, 22 nt, Human
cagcuugggaguuugguuuuau

SEQ ID NO: 509576 - RNA, 22 nt, Human
agaauaauacugaaaugcugaa

SEQ ID NO: 509577 - RNA, 22 nt, Human
agugucugaugcacaguugucc

SEQ ID NO: 509578 - RNA, 22 nt, Human
aggucugguauuuuucuauacu

SEQ ID NO: 509579 - RNA, 22 nt, Human
ccagugcagucccccugaacug

SEQ ID NO: 509580 - RNA, 22 nt, Human
agguucuugacucuaccuucca

SEQ ID NO: 509581 - RNA, 22 nt, Human
uguguacaucucuucucacauu

SEQ ID NO: 509582 - RNA, 22 nt, Human
cacagaggcaaccuucuggggu

SEQ ID NO: 509583 - RNA, 22 nt, Human
cauuugcugaggccuucagagg

SEQ ID NO: 509584 - RNA, 20 nt, Human
uguauauuuucugguguaaa

SEQ ID NO: 509585 - RNA, 22 nt, Human
cauaaauucaguucugccucuu

SEQ ID NO: 509586 - RNA, 22 nt, Human
uggaggcauuugauguucauaa

SEQ ID NO: 509587 - RNA, 22 nt, Human
ggaccaggccagccucccugcg

SEQ ID NO: 509588 - RNA, 23 nt, Human
cuauggaauaccaaugauucuca

SEQ ID NO: 509589 - RNA, 22 nt, Human
uuuagggaauagaagaucugaa

SEQ ID NO: 509590 - RNA, 22 nt, Human
auucuccaucaccacuggcacu

SEQ ID NO: 509591 - RNA, 22 nt, Human
augaaauguauucagauaugua

SEQ ID NO: 509592 - RNA, 23 nt, Human
gggaccagcuagggcugugaccu

SEQ ID NO: 509593 - RNA, 22 nt, Human
aggcucugggaagcagugaguu

SEQ ID NO: 509594 - RNA, 22 nt, Human
uuauuuaggagaaggaacccug

SEQ ID NO: 509595 - RNA, 22 nt, Human
auauggaaauagcaauaugguu

SEQ ID NO: 509596 - RNA, 22 nt, Human
ggcucccugccuguccucaguc

SEQ ID NO: 509597 - RNA, 22 nt, Human
uaauuucuagggacuaaggugc

SEQ ID NO: 509598 - RNA, 22 nt, Human
cuggagucuucagcuugcugcc

SEQ ID NO: 509599 - RNA, 22 nt, Human
agaccauggccauccuaggaaa

SEQ ID NO: 509600 - RNA, 22 nt, Human
aauagugcuuacauuaucauga

SEQ ID NO: 509601 - RNA, 22 nt, Human
aggaagcucggagagggcaaau

SEQ ID NO: 509602 - RNA, 22 nt, Human
ugggcucucuggcaggaaggcu

SEQ ID NO: 509603 - RNA, 19 nt, Human
gcuggggccugaccagaca

SEQ ID NO: 509604 - RNA, 22 nt, Human
ugcugccucagcuuccugggcu

SEQ ID NO: 509605 - RNA, 22 nt, Human
aaccagagagucuucuucauug

SEQ ID NO: 509606 - RNA, 22 nt, Human
aggccagcccucaccuguguuc

SEQ ID NO: 509607 - RNA, 17 nt, Human
agcuccuggggucuuua

SEQ ID NO: 509608 - RNA, 22 nt, Human
ucugggcugcuucagccuucgc

SEQ ID NO: 509609 - RNA, 22 nt, Human
ugugucccuuggaaccucagcu

SEQ ID NO: 509610 - RNA, 21 nt, Human
gcugucucuggcuccugggaa

SEQ ID NO: 509611 - RNA, 22 nt, Human
uccuggcucuaaguccugagug

SEQ ID NO: 509612 - RNA, 22 nt, Human
uaaugcacagaauugacauggg

SEQ ID NO: 509613 - RNA, 22 nt, Human
ccagggcaacgcugucucagag

SEQ ID NO: 509614 - RNA, 22 nt, Human
gcuucagcuuugucuccuuggg

SEQ ID NO: 509615 - RNA, 22 nt, Human
uaaagccacgcuggaaaucagg

SEQ ID NO: 509616 - RNA, 22 nt, Human
gcuugggauaugcugauguaaa

SEQ ID NO: 509617 - RNA, 22 nt, Human
ggcaggaggaagaguuagcacc

SEQ ID NO: 509618 - RNA, 22 nt, Human
ggcggggucugagcgccgcgcc

SEQ ID NO: 509619 - RNA, 22 nt, Human
gaugaagcuauuugguuggcac

SEQ ID NO: 509620 - RNA, 22 nt, Human
uacuguacucaacaugugaguu

SEQ ID NO: 509621 - RNA, 22 nt, Human
uggcaaggccacaggugcaguu

SEQ ID NO: 509622 - RNA, 20 nt, Human
acaauagauuugagcaaagu

SEQ ID NO: 509623 - RNA, 22 nt, Human
ucugucuuagccaucucaggcu

SEQ ID NO: 509624 - RNA, 22 nt, Human
gggagauggcucagaggccgcg

SEQ ID NO: 509625 - RNA, 22 nt, Human
agggcuuuguuuaggugaccac

SEQ ID NO: 509626 - RNA, 21 nt, Human
ugacuaauugugauaaagugc

SEQ ID NO: 509627 - RNA, 22 nt, Human
cuggaucuaaagguggauguag

SEQ ID NO: 509628 - RNA, 22 nt, Human
augccaaauucuacuuucagca

SEQ ID NO: 509629 - RNA, 19 nt, Human
uguuuuguuaaagcagucc

SEQ ID NO: 509630 - RNA, 22 nt, Human
ucugaggcuauguucaggcuaa

SEQ ID NO: 509631 - RNA, 22 nt, Human
gcaguguucuaaauugggugug

SEQ ID NO: 509632 - RNA, 22 nt, Human
caggaaauuuauguucuacuua

SEQ ID NO: 509633 - RNA, 23 nt, Human
auaagccuuuucuuucugcccca

SEQ ID NO: 509634 - RNA, 22 nt, Human
uacugacacaaagccaaucccu

SEQ ID NO: 509635 - RNA, 22 nt, Human
agucuucagagaaauuaacucu

SEQ ID NO: 509636 - RNA, 22 nt, Human
uaguuaaagcccuaaauugaua

SEQ ID NO: 509637 - RNA, 22 nt, Human
cugucugcuagaacaucuauac

SEQ ID NO: 509638 - RNA, 22 nt, Human
aaagaacuuauccuagaauuug

SEQ ID NO: 509639 - RNA, 22 nt, Human
ucucucagaggaagaggcagug

SEQ ID NO: 509640 - RNA, 21 nt, Human
ucagggcagcugcucuucaga

SEQ ID NO: 509641 - RNA, 22 nt, Human
ucuuacagaaaauagauaacau

SEQ ID NO: 509642 - RNA, 22 nt, Human
cugugcugauucagcacaggcc

SEQ ID NO: 509643 - RNA, 23 nt, Human
auguuuuaugucucuagcugcca

SEQ ID NO: 509644 - RNA, 22 nt, Human
ggaguggccucuccugugcagg

SEQ ID NO: 509645 - RNA, 22 nt, Human
agugccuggcacauggaaggug

SEQ ID NO: 509646 - RNA, 22 nt, Human
uuuauuuggcauccagggagaa

SEQ ID NO: 509647 - RNA, 22 nt, Human
cuggcucccucgcugaggugcu

SEQ ID NO: 509648 - RNA, 22 nt, Human
ccagcuggcaggagagucaggg

SEQ ID NO: 509649 - RNA, 22 nt, Human
guaggcagguggaggagugaag

SEQ ID NO: 509650 - RNA, 22 nt, Human
uggcugaguuacgaacagagca

SEQ ID NO: 509651 - RNA, 22 nt, Human
ucagggcagccuaaggcaccuc

SEQ ID NO: 509652 - RNA, 20 nt, Human
accucugcaucaauccuuug

SEQ ID NO: 509653 - RNA, 22 nt, Human
aucuuuuacauuacugcccaga

SEQ ID NO: 509654 - RNA, 22 nt, Human
ugccugagugauguggcagcca

SEQ ID NO: 509655 - RNA, 22 nt, Human
ucucugguuauuaacuaacucc

SEQ ID NO: 509656 - RNA, 22 nt, Human
cugaagaugucugagaugcuca

SEQ ID NO: 509657 - RNA, 22 nt, Human
gcugggcuggaaggccaaggca

SEQ ID NO: 509658 - RNA, 22 nt, Human
uuugcauugcagugguuuacag

SEQ ID NO: 509659 - RNA, 22 nt, Human
gcaggaagggaaagguugacuc

SEQ ID NO: 509660 - RNA, 22 nt, Human
aauagaggagcuuuggacuccc

SEQ ID NO: 509661 - RNA, 19 nt, Human
agccaggguccagacaugu

SEQ ID NO: 509662 - RNA, 22 nt, Human
ucauccaguuguggagagggaa

SEQ ID NO: 509663 - RNA, 19 nt, Human
uucuaccuuacuguaggcu

SEQ ID NO: 509664 - RNA, 22 nt, Human
acagccagguaaaggcauggca

SEQ ID NO: 509665 - RNA, 19 nt, Human
guggccucggagcgcgcgg

SEQ ID NO: 509666 - RNA, 22 nt, Human
cauguuaaugaauuuuugcagu

SEQ ID NO: 509667 - RNA, 22 nt, Human
cagucccacaagaucuccacaa

SEQ ID NO: 509668 - RNA, 22 nt, Human
aucaguuuuuauuaauguagcu

SEQ ID NO: 509669 - RNA, 22 nt, Human
agaggaaaaugaguuccagaau

SEQ ID NO: 509670 - RNA, 22 nt, Human
gagguaacaacugaaaugagaa

SEQ ID NO: 509671 - RNA, 22 nt, Human
cuggaaagugucuccauccugg

SEQ ID NO: 509672 - RNA, 22 nt, Human
gggcagguguuuccaaggugag

SEQ ID NO: 509673 - RNA, 22 nt, Human
agaccacagucaggcuccuggu

SEQ ID NO: 509674 - RNA, 22 nt, Human
guuauaaaugacugcaaaaguu

SEQ ID NO: 509675 - RNA, 21 nt, Human
uggcucuggguaggagagugc

SEQ ID NO: 509676 - RNA, 22 nt, Human
gggggcuaccgucucuggagcu

SEQ ID NO: 509677 - RNA, 21 nt, Human
uuucuaagugcuugguuuggg

SEQ ID NO: 509678 - RNA, 22 nt, Human
gaaagggagugaagaugguaua

SEQ ID NO: 509679 - RNA, 22 nt, Human
gaaggacccucuggggucucag

SEQ ID NO: 509680 - RNA, 22 nt, Human
ucacaacuugaagcugauuuaa

SEQ ID NO: 509681 - RNA, 22 nt, Human
acuuagaacaggcagaauucca

SEQ ID NO: 509682 - RNA, 22 nt, Human
ugauucaacuuucauaacaaaa

SEQ ID NO: 509683 - RNA, 22 nt, Human
uauuuaauuagugauuguagag

SEQ ID NO: 509684 - RNA, 22 nt, Human
uaauagaauaguggaaacauug

SEQ ID NO: 509685 - RNA, 22 nt, Human
uugaagauuauucuauuaaaag

SEQ ID NO: 509686 - RNA, 22 nt, Human
agggaggauaguagucaguuua

SEQ ID NO: 509687 - RNA, 22 nt, Human
ggcucuggcuacuccacccugu

SEQ ID NO: 509688 - RNA, 22 nt, Human
ggccucucuggcauggcugccc

SEQ ID NO: 509689 - RNA, 22 nt, Human
uucaaaaguaaucaguauuaga

SEQ ID NO: 509690 - RNA, 22 nt, Human
agguuuauguuuggugcaggag

SEQ ID NO: 509691 - RNA, 22 nt, Human
cccuggcugcuuguagucuggc

SEQ ID NO: 509692 - RNA, 22 nt, Human
gagucagguccguggacaguua

SEQ ID NO: 509693 - RNA, 22 nt, Human
ugaagcaggaaacuucuuguuu

SEQ ID NO: 509694 - RNA, 22 nt, Human
ucagggacauuuagacacugau

SEQ ID NO: 509695 - RNA, 22 nt, Human
gguuucaacuucaaccucucca

SEQ ID NO: 509696 - RNA, 22 nt, Human
ccucugggagacugcuacugag

SEQ ID NO: 509697 - RNA, 22 nt, Human
ucauugcacuccagccugggca

SEQ ID NO: 509698 - RNA, 22 nt, Human
ugcaggugcguuuucaagccuc

SEQ ID NO: 509699 - RNA, 22 nt, Human
cucuucaaaagucuaauccuua

SEQ ID NO: 509700 - RNA, 22 nt, Human
cguggcuggggaggucagccag

SEQ ID NO: 509701 - RNA, 17 nt, Human
uuacaacgucaucucug

SEQ ID NO: 509702 - RNA, 22 nt, Human
ugagaaucauccagaggcuucu

SEQ ID NO: 509703 - RNA, 22 nt, Human
agucacauuugggggugucaaa

SEQ ID NO: 509704 - RNA, 22 nt, Human
ccagccacagcuuccagcuccu

SEQ ID NO: 509705 - RNA, 22 nt, Human
aggacuggugccagacaaggua

SEQ ID NO: 509706 - RNA, 22 nt, Human
auagacauggucuuuugucauu

SEQ ID NO: 509707 - RNA, 22 nt, Human
gccugccugaaggcuguaccag

SEQ ID NO: 509708 - RNA, 22 nt, Human
ggaggggaggauuaaugacaaa

SEQ ID NO: 509709 - RNA, 22 nt, Human
caaugaaaaugaggacuccugu

SEQ ID NO: 509710 - RNA, 22 nt, Human
cuggcccuauuccaggccuucc

SEQ ID NO: 509711 - RNA, 22 nt, Human
aucuaagaguuaacaucaagaa

SEQ ID NO: 509712 - RNA, 22 nt, Human
agcccagcaaagggagguucag

SEQ ID NO: 509713 - RNA, 22 nt, Human
uccaggaguggggcagaggucu

SEQ ID NO: 509714 - RNA, 22 nt, Human
ugugcagagcccacaggcagcu

SEQ ID NO: 509715 - RNA, 22 nt, Human
agaaucaauuagauucuaugag

SEQ ID NO: 509716 - RNA, 22 nt, Human
ccuggagccccucuggccagcc

SEQ ID NO: 509717 - RNA, 22 nt, Human
gcugccuuuugcuccucccacc

SEQ ID NO: 509718 - RNA, 22 nt, Human
ugggccuguugggguugaguua

SEQ ID NO: 509719 - RNA, 22 nt, Human
gacaggcuuugagucccagaac

SEQ ID NO: 509720 - RNA, 22 nt, Human
aaggcugaccaguuuacacuuu

SEQ ID NO: 509721 - RNA, 22 nt, Human
cauguguguccaugugacuaag

SEQ ID NO: 509722 - RNA, 22 nt, Human
uugcuuucccaaggcagaacau

SEQ ID NO: 509723 - RNA, 22 nt, Human
caaggaaaaagcgagcucgggg

SEQ ID NO: 509724 - RNA, 22 nt, Human
ggcucuggggccuccucccuug

SEQ ID NO: 509725 - RNA, 22 nt, Human
acacuagcuaaaugcugauuaa

SEQ ID NO: 509726 - RNA, 22 nt, Human
cuucucuaucuuuggcacauca

SEQ ID NO: 509727 - RNA, 22 nt, Human
uagcugccagaccauucuuacu

SEQ ID NO: 509728 - RNA, 22 nt, Human
uccuuccucggggacccagauc

SEQ ID NO: 509729 - RNA, 22 nt, Human
caaagacugcauaacacaugaa

SEQ ID NO: 509730 - RNA, 22 nt, Human
ugguccaggguguaguacagag

SEQ ID NO: 509731 - RNA, 22 nt, Human
ggugggcacauucagucucugu

SEQ ID NO: 509732 - RNA, 22 nt, Human
cugucucagcaggaagucauca

SEQ ID NO: 509733 - RNA, 22 nt, Human
ccauaaucguguguuaaauaau

SEQ ID NO: 509734 - RNA, 22 nt, Human
acucuggccaggugcgguaugu

SEQ ID NO: 509735 - RNA, 22 nt, Human
ccuggcagcuaagugcuuugag

SEQ ID NO: 509736 - RNA, 22 nt, Human
acagcagagacacucaggaggc

SEQ ID NO: 509737 - RNA, 22 nt, Human
ucagccuugcuucuggacuggu

SEQ ID NO: 509738 - RNA, 22 nt, Human
gaagccuuaucagucacuuaua

SEQ ID NO: 509739 - RNA, 22 nt, Human
ccagccagucccgcaugaccgc

SEQ ID NO: 509740 - RNA, 22 nt, Human
ucccuggacagccuugccuggg

SEQ ID NO: 509741 - RNA, 22 nt, Human
gcugcccauuccacuggauggu

SEQ ID NO: 509742 - RNA, 22 nt, Human
ucccugggaccggcagcucaca

SEQ ID NO: 509743 - RNA, 22 nt, Human
guccugugugagugcaccaccu

SEQ ID NO: 509744 - RNA, 22 nt, Human
cgguccagagcuaguucauugc

SEQ ID NO: 509745 - RNA, 22 nt, Human
cugggcucaagaagucuucccu

SEQ ID NO: 509746 - RNA, 22 nt, Human
gcuucccacagcuggacugggg

SEQ ID NO: 509747 - RNA, 22 nt, Human
gccaaaucuggauuuagcaaga

SEQ ID NO: 509748 - RNA, 19 nt, Human
gccaggcucuuauucugug

SEQ ID NO: 509749 - RNA, 22 nt, Human
cuccagggagcuuggaaagacc

SEQ ID NO: 509750 - RNA, 22 nt, Human
ccuuuugcucucccauccagaa

SEQ ID NO: 509751 - RNA, 22 nt, Human
ggcuuccuggagaaggucugag

SEQ ID NO: 509752 - RNA, 22 nt, Human
ucaggggacagccagcuggagg

SEQ ID NO: 509753 - RNA, 22 nt, Human
ucaggaggccaccaggaccugu

SEQ ID NO: 509754 - RNA, 22 nt, Human
ccagagccucgcccggagccuc

SEQ ID NO: 509755 - RNA, 22 nt, Human
acagcagccugcagcccugugu

SEQ ID NO: 509756 - RNA, 20 nt, Human
ugcauuaaguggcauugagc

SEQ ID NO: 509757 - RNA, 22 nt, Human
uuuauuagauuaucaaagaggu

SEQ ID NO: 509758 - RNA, 22 nt, Human
uuccuacagcccugaaucucua

SEQ ID NO: 509759 - RNA, 22 nt, Human
cuugaauccaaaugggagauga

SEQ ID NO: 509760 - RNA, 22 nt, Human
ggcccuuccucuugugcuggca

SEQ ID NO: 509761 - RNA, 22 nt, Human
acaguguugaggugcuuguuuc

SEQ ID NO: 509762 - RNA, 22 nt, Human
aaugucugagucucuguauccc

SEQ ID NO: 509763 - RNA, 22 nt, Human
cuggcccuguggaggcaggaac

SEQ ID NO: 509764 - RNA, 22 nt, Human
agaggucagaacaggaaagugu

SEQ ID NO: 509765 - RNA, 22 nt, Human
ugauauggaaggaagauguaca

SEQ ID NO: 509766 - RNA, 22 nt, Human
auauuguguguacaaguaguua

SEQ ID NO: 509767 - RNA, 22 nt, Human
uggcuggcguuggggccaguga

SEQ ID NO: 509768 - RNA, 22 nt, Human
accuuuuuguucuguucucagc

SEQ ID NO: 509769 - RNA, 21 nt, Human
uagggcucuauuuuuauuuca

SEQ ID NO: 509770 - RNA, 22 nt, Human
gggacaauggaggccucucucc

SEQ ID NO: 509771 - RNA, 22 nt, Human
aguggcaggcggagauguagga

SEQ ID NO: 509772 - RNA, 22 nt, Human
cuccaggggccagaagccuggc

SEQ ID NO: 509773 - RNA, 22 nt, Human
uccuagaagauggaucagagaa

SEQ ID NO: 509774 - RNA, 22 nt, Human
auuauaggcuugagccaccgug

SEQ ID NO: 509775 - RNA, 22 nt, Human
ccugacgaaaggcgugcuggag

SEQ ID NO: 509776 - RNA, 20 nt, Human
aagcaauauagugcaaaugu

SEQ ID NO: 509777 - RNA, 22 nt, Human
cugcccugugguuguggguucu

SEQ ID NO: 509778 - RNA, 22 nt, Human
cuuuggaagugaccacaauccu

SEQ ID NO: 509779 - RNA, 22 nt, Human
aguuuuguaauucucaaaaaua

SEQ ID NO: 509780 - RNA, 22 nt, Human
acaguuugcacuguucaucaaa

SEQ ID NO: 509781 - RNA, 22 nt, Human
auugacaaauggauguugacau

SEQ ID NO: 509782 - RNA, 22 nt, Human
acagucucuccacacugcaggg

SEQ ID NO: 509783 - RNA, 20 nt, Human
agcuuugguuaagccagugg

SEQ ID NO: 509784 - RNA, 22 nt, Human
uuucuaaguaaacacagcauac

SEQ ID NO: 509785 - RNA, 22 nt, Human
auucucaaacaagugguuugau

SEQ ID NO: 509786 - RNA, 18 nt, Human
ugaggccagagugggcau

SEQ ID NO: 509787 - RNA, 22 nt, Human
acuugauuuugaaccuuucuac

SEQ ID NO: 509788 - RNA, 22 nt, Human
ggcugagcaauuuugaugacau

SEQ ID NO: 509789 - RNA, 22 nt, Human
cagcagcucacucagguggcuc

SEQ ID NO: 509790 - RNA, 22 nt, Human
cacauacaugcacaccuaaaua

SEQ ID NO: 509791 - RNA, 22 nt, Human
aaggaaggaauugaucaugcgc

SEQ ID NO: 509792 - RNA, 22 nt, Human
accugggaguaugcagugguga

SEQ ID NO: 509793 - RNA, 22 nt, Human
ggagccccaauugagcaguacg

SEQ ID NO: 509794 - RNA, 22 nt, Human
uagagcaguggguaccauggca

SEQ ID NO: 509795 - RNA, 22 nt, Human
ugggagaagcagcagccaagug

SEQ ID NO: 509796 - RNA, 22 nt, Human
ugguuuauuucucugaaagguu

SEQ ID NO: 509797 - RNA, 22 nt, Human
caggccuggggcuggcuuccag

SEQ ID NO: 509798 - RNA, 22 nt, Human
ugguuucugcccucagagcuca

SEQ ID NO: 509799 - RNA, 22 nt, Human
ugaggauggaaugcugugcaag

SEQ ID NO: 509800 - RNA, 22 nt, Human
cccacacauuuuucacuuaccg

SEQ ID NO: 509801 - RNA, 22 nt, Human
uucuuucucuacuagcagagcu

SEQ ID NO: 509802 - RNA, 22 nt, Human
ucuuuacacaagacaagaauaa

SEQ ID NO: 509803 - RNA, 22 nt, Human
gccaggcauguccucugcagaa

SEQ ID NO: 509804 - RNA, 22 nt, Human
gaccauuuuuacagagcauuca

SEQ ID NO: 509805 - RNA, 22 nt, Human
aguucucagaauugcaccucaa

SEQ ID NO: 509806 - RNA, 22 nt, Human
ucuguccauucagccauccauc

SEQ ID NO: 509807 - RNA, 22 nt, Human
cucuggcuccauuucccuaugu

SEQ ID NO: 509808 - RNA, 22 nt, Human
ugccccucagggaacggguauc

SEQ ID NO: 509809 - RNA, 21 nt, Human
gagugcaggucugaugccauc

SEQ ID NO: 509810 - RNA, 22 nt, Human
uuagcuaaacuguaacuagaau

SEQ ID NO: 509811 - RNA, 22 nt, Human
uugcauugcuuggucuucaaga

SEQ ID NO: 509812 - RNA, 22 nt, Human
uacaugaacaaaauagcagaaa

SEQ ID NO: 509813 - RNA, 22 nt, Human
ugcuuuaucugugagaaccuga

SEQ ID NO: 509814 - RNA, 22 nt, Human
acaguucaagucuuagacaaca

SEQ ID NO: 509815 - RNA, 22 nt, Human
gaacagaagaggcuggugccac

SEQ ID NO: 509816 - RNA, 22 nt, Human
augcccugcugccaucuggccg

SEQ ID NO: 509817 - RNA, 22 nt, Human
aguagcauaaauagugguagua

SEQ ID NO: 509818 - RNA, 19 nt, Human
cucucuggcggugucugcg

SEQ ID NO: 509819 - RNA, 22 nt, Human
uccuggaggggacagcaugggc

SEQ ID NO: 509820 - RNA, 22 nt, Human
cuuauuagaaagaaaagacaug

SEQ ID NO: 509821 - RNA, 22 nt, Human
aaguauuauuuaacaaauuugu

SEQ ID NO: 509822 - RNA, 20 nt, Human
gaagcagcuucauguagaca

SEQ ID NO: 509823 - RNA, 20 nt, Human
ggcuccuucuuucauggccc

SEQ ID NO: 509824 - RNA, 22 nt, Human
uauuccuauggccacugcuacu

SEQ ID NO: 509825 - RNA, 22 nt, Human
cucagagaguuaagugaauuac

SEQ ID NO: 509826 - RNA, 22 nt, Human
uggccccugaggagcgucagcc

SEQ ID NO: 509827 - RNA, 22 nt, Human
agccuggccaggccugcccagg

SEQ ID NO: 509828 - RNA, 22 nt, Human
aggagcugagucagcccgacag

SEQ ID NO: 509829 - RNA, 22 nt, Human
ggagaucuugcuugaaggcaug

SEQ ID NO: 509830 - RNA, 22 nt, Human
gccucugcccuccugggacugc

SEQ ID NO: 509831 - RNA, 22 nt, Human
caggcacuggccagucagcaca

SEQ ID NO: 509832 - RNA, 22 nt, Human
agugaaaugauaguguaaauac

SEQ ID NO: 509833 - RNA, 22 nt, Human
uauuaggguuuugaagguuugu

SEQ ID NO: 509834 - RNA, 22 nt, Human
gcagcuggccccuuuccuuguu

SEQ ID NO: 509835 - RNA, 22 nt, Human
agccccuugcugcccucuagag

SEQ ID NO: 509836 - RNA, 22 nt, Human
ccuggaugauccaugucaugga

SEQ ID NO: 509837 - RNA, 22 nt, Human
guagcugauccugaggacaggg

SEQ ID NO: 509838 - RNA, 22 nt, Human
ucugggcuuuugcacuggccau

SEQ ID NO: 509839 - RNA, 22 nt, Human
cuggaaggagaaggaggcugug

SEQ ID NO: 509840 - RNA, 22 nt, Human
caggaaauaucuccuggcagag

SEQ ID NO: 509841 - RNA, 21 nt, Human
gggaaacucugcuuaacagag

SEQ ID NO: 509842 - RNA, 16 nt, Human
gaggggagcaguaggc

SEQ ID NO: 509843 - RNA, 22 nt, Human
uagaaguggcaacacucagaaa

SEQ ID NO: 509844 - RNA, 22 nt, Human
acguuuucuagagaauaugcag

SEQ ID NO: 509845 - RNA, 22 nt, Human
caggguggaagcuguagagugg

SEQ ID NO: 509846 - RNA, 22 nt, Human
cucuugcagauaccuugaagga

SEQ ID NO: 509847 - RNA, 22 nt, Human
gaauaauagcagaaauuagcag

SEQ ID NO: 509848 - RNA, 22 nt, Human
ugggcugcugucugcacaugcu

SEQ ID NO: 509849 - RNA, 22 nt, Human
gcaggaugagugaguacauuua

SEQ ID NO: 509850 - RNA, 22 nt, Human
aacagcuagaauucuacuggcu

SEQ ID NO: 509851 - RNA, 22 nt, Human
uugcugaaguuaaugcuugcaa

SEQ ID NO: 509852 - RNA, 22 nt, Human
ggagcuguugcgcaugcgcucg

SEQ ID NO: 509853 - RNA, 19 nt, Human
auuagcaugcuugaggaug

SEQ ID NO: 509854 - RNA, 22 nt, Human
agucccagcuucccccaugcag

SEQ ID NO: 509855 - RNA, 22 nt, Human
auggcagggcccuuggcuccca

SEQ ID NO: 509856 - RNA, 22 nt, Human
uuucuaagaaaguaaugguuau

SEQ ID NO: 509857 - RNA, 22 nt, Human
aaugagaaaacacagaggaggu

SEQ ID NO: 509858 - RNA, 22 nt, Human
ggaccuggcaauuugcaucucu

SEQ ID NO: 509859 - RNA, 22 nt, Human
uuucagaguuaguagagcaugu

SEQ ID NO: 509860 - RNA, 22 nt, Human
ggcguuucaccauguugaccag

SEQ ID NO: 509861 - RNA, 22 nt, Human
uagaauaugauuaauuuucuua

SEQ ID NO: 509862 - RNA, 22 nt, Human
uucagacaauaagagucaucuc

SEQ ID NO: 509863 - RNA, 22 nt, Human
aaugcacaugccacauguggua

SEQ ID NO: 509864 - RNA, 22 nt, Human
caugucagggaagagagucagu

SEQ ID NO: 509865 - RNA, 18 nt, Human
ccuaggaaagggaggcaa

SEQ ID NO: 509866 - RNA, 17 nt, Human
ccuuagggcaguguggu

SEQ ID NO: 509867 - RNA, 22 nt, Human
caggaaaggugugucaugaugg

SEQ ID NO: 509868 - RNA, 22 nt, Human
uugauauucugagaagcugaag

SEQ ID NO: 509869 - RNA, 22 nt, Human
ugccugggguuggcaaacugcu

SEQ ID NO: 509870 - RNA, 22 nt, Human
aaccaggaauugcagggcugca

SEQ ID NO: 509871 - RNA, 22 nt, Human
cagugcaguuucccagaugcug

SEQ ID NO: 509872 - RNA, 19 nt, Human
ccaaaggaaguuucccucc

SEQ ID NO: 509873 - RNA, 22 nt, Human
cucugagggcucgagggacgcg

SEQ ID NO: 509874 - RNA, 22 nt, Human
cagcucccaguggcagcuccuu

SEQ ID NO: 509875 - RNA, 22 nt, Human
ugcucccaaacgaccuacugug

SEQ ID NO: 509876 - RNA, 22 nt, Human
cagggcugagaauuuagagaca

SEQ ID NO: 509877 - RNA, 22 nt, Human
gugggggcaggcagugcuagga

SEQ ID NO: 509878 - RNA, 22 nt, Human
aaagcugccaaggagaauacua

SEQ ID NO: 509879 - RNA, 22 nt, Human
ccaucuccacugucccugucaa

SEQ ID NO: 509880 - RNA, 22 nt, Human
uaugcacaguuacaagaauauc

SEQ ID NO: 509881 - RNA, 22 nt, Human
uggggagagguaucauugagau

SEQ ID NO: 509882 - RNA, 22 nt, Human
acaggucugcaguaacugggaa

SEQ ID NO: 509883 - RNA, 21 nt, Human
ggucagggggugccuccaggu

SEQ ID NO: 509884 - RNA, 22 nt, Human
ugaggggcagagagguguccag

SEQ ID NO: 509885 - RNA, 22 nt, Human
ucauuuguggaagugauugugg

SEQ ID NO: 509886 - RNA, 22 nt, Human
guaggcagugguuggaagagaa

SEQ ID NO: 509887 - RNA, 22 nt, Human
cagggugccucccgcucgccgg

SEQ ID NO: 509888 - RNA, 22 nt, Human
auuuucugguugagguuuaaca

SEQ ID NO: 509889 - RNA, 20 nt, Human
aaaaacaguaaugcugaaga

SEQ ID NO: 509890 - RNA, 23 nt, Human
ggaagcucacguaguccugcacu

SEQ ID NO: 509891 - RNA, 22 nt, Human
ugcaccugagaggucucugagg

SEQ ID NO: 509892 - RNA, 22 nt, Human
ugaguucuaguggcugcagauu

SEQ ID NO: 509893 - RNA, 22 nt, Human
gccucaguggcuuuaggaguuc

SEQ ID NO: 509894 - RNA, 22 nt, Human
gccucuggaguugcuuguaaau

SEQ ID NO: 509895 - RNA, 22 nt, Human
cacaucccuggaguuacccagu

SEQ ID NO: 509896 - RNA, 22 nt, Human
accuuagcuguuaaaacuaagu

SEQ ID NO: 509897 - RNA, 22 nt, Human
cucccucugucuuguccagaaa

SEQ ID NO: 509898 - RNA, 17 nt, Human
cagugaggccuuuccuc

SEQ ID NO: 509899 - RNA, 22 nt, Human
ucauaaaacacaccagguaguu

SEQ ID NO: 509900 - RNA, 22 nt, Human
aagaaauguagagccuaguaaa

SEQ ID NO: 509901 - RNA, 22 nt, Human
ccucuggccaucccccauuaag

SEQ ID NO: 509902 - RNA, 22 nt, Human
uggccugacugucaggcuguau

SEQ ID NO: 509903 - RNA, 19 nt, Human
uuuuccugccucauuguuu

SEQ ID NO: 509904 - RNA, 22 nt, Human
ccucuggcuguaccacuggcac

SEQ ID NO: 509905 - RNA, 22 nt, Human
ugugucagaaggcaauggggau

SEQ ID NO: 509906 - RNA, 22 nt, Human
ucugccugagggagcugaggaa

SEQ ID NO: 509907 - RNA, 22 nt, Human
cacacaugguagcagguacaag

SEQ ID NO: 509908 - RNA, 22 nt, Human
augcaguacugauacaugccac

SEQ ID NO: 509909 - RNA, 22 nt, Human
cugccagcaaugugaccaugcu

SEQ ID NO: 509910 - RNA, 22 nt, Human
gcuggcuguguuccuucugcca

SEQ ID NO: 509911 - RNA, 22 nt, Human
uggacuggaaugcugauccucu

SEQ ID NO: 509912 - RNA, 22 nt, Human
ccucagugaccuauugcauuca

SEQ ID NO: 509913 - RNA, 22 nt, Human
ugucugaguggugcaaggcuga

SEQ ID NO: 509914 - RNA, 20 nt, Human
cuugauucuuugaugaggua

SEQ ID NO: 509915 - RNA, 22 nt, Human
cugucauuuaagacauucugga

SEQ ID NO: 509916 - RNA, 22 nt, Human
uggcagggugggcuucagcccc

SEQ ID NO: 509917 - RNA, 22 nt, Human
cuuguccagauguuuguuaggu

SEQ ID NO: 509918 - RNA, 22 nt, Human
cacacacuggagcaaggagaug

SEQ ID NO: 509919 - RNA, 22 nt, Human
uggccaguuugcucaggcaguc

SEQ ID NO: 509920 - RNA, 22 nt, Human
gcaggggcugagcaccagcggg

SEQ ID NO: 509921 - RNA, 18 nt, Human
aucucccauuggccaagg

SEQ ID NO: 509922 - RNA, 22 nt, Human
cugcucugaguauuaacggagg

SEQ ID NO: 509923 - RNA, 22 nt, Human
ccaggaccuggagcucuaugaa

SEQ ID NO: 509924 - RNA, 22 nt, Human
gcagcaucagguucacugcgug

SEQ ID NO: 509925 - RNA, 22 nt, Human
aggaaagaaaggaggugcauuu

SEQ ID NO: 509926 - RNA, 22 nt, Human
augcagcugugggcaagaaaug

SEQ ID NO: 509927 - RNA, 22 nt, Human
guuauguaucuugauugggugg

SEQ ID NO: 509928 - RNA, 19 nt, Human
aggguccagggagcggcuc

SEQ ID NO: 509929 - RNA, 22 nt, Human
cugggcugucccaaccccaucc

SEQ ID NO: 509930 - RNA, 22 nt, Human
ucugggucuggcugcuggugca

SEQ ID NO: 509931 - RNA, 22 nt, Human
gcuggaccaggugugcacaggc

SEQ ID NO: 509932 - RNA, 22 nt, Human
acagguguacaaugcaugacag

SEQ ID NO: 509933 - RNA, 22 nt, Human
aagacauuacuggaaucugacu

SEQ ID NO: 509934 - RNA, 22 nt, Human
agagcacaaauuaguuggucuu

SEQ ID NO: 509935 - RNA, 22 nt, Human
gcuggcagguaaagccccgggg

SEQ ID NO: 509936 - RNA, 22 nt, Human
caagaauauaaauacuuucaaa

SEQ ID NO: 509937 - RNA, 22 nt, Human
ccaaggcuggagugcaguggcg

SEQ ID NO: 509938 - RNA, 22 nt, Human
aagccaggggcugcuuaggaga

SEQ ID NO: 509939 - RNA, 22 nt, Human
cugugcuggagaugggccagag

SEQ ID NO: 509940 - RNA, 18 nt, Human
cccucuccugcuaguggg

SEQ ID NO: 509941 - RNA, 22 nt, Human
gagagggagccagccaggaacc

SEQ ID NO: 509942 - RNA, 22 nt, Human
uuccaggaugggcuguccuacu

SEQ ID NO: 509943 - RNA, 22 nt, Human
ugcccuuacacauggaaaggga

SEQ ID NO: 509944 - RNA, 22 nt, Human
ccggcgggcagcggcagugagc

SEQ ID NO: 509945 - RNA, 22 nt, Human
uuacauuuuaguuaaccuguga

SEQ ID NO: 509946 - RNA, 22 nt, Human
gguggcuggaggagcugaugga

SEQ ID NO: 509947 - RNA, 22 nt, Human
auaagcuuugcuggagagaccu

SEQ ID NO: 509948 - RNA, 22 nt, Human
gcugguccacucccuggaggcu

SEQ ID NO: 509949 - RNA, 22 nt, Human
uggcagcagacaaaaggccauu

SEQ ID NO: 509950 - RNA, 22 nt, Human
cucuuccuuaagacuauaaaga

SEQ ID NO: 509951 - RNA, 22 nt, Human
aggaaacuguccccucauccua

SEQ ID NO: 509952 - RNA, 22 nt, Human
cagaggccucacuuccagccag

SEQ ID NO: 509953 - RNA, 22 nt, Human
uggaaggcaacggagugagcug

SEQ ID NO: 509954 - RNA, 20 nt, Human
caggugagcagaucugggug

SEQ ID NO: 509955 - RNA, 19 nt, Human
auccuggguccuccagcug

SEQ ID NO: 509956 - RNA, 22 nt, Human
ucuuuacaaucuaagcauaguu

SEQ ID NO: 509957 - RNA, 22 nt, Human
caggcacacugucuacacugag

SEQ ID NO: 509958 - RNA, 22 nt, Human
agcaagcuaccuagauagucua

SEQ ID NO: 509959 - RNA, 22 nt, Human
cugugggcgccugucagccuca

SEQ ID NO: 509960 - RNA, 22 nt, Human
ccagcccugucaccaacuggag

SEQ ID NO: 509961 - RNA, 22 nt, Human
uggaaggagcuaaggaccuggg

SEQ ID NO: 509962 - RNA, 22 nt, Human
caaguauauuugaacauguaaa

SEQ ID NO: 509963 - RNA, 22 nt, Human
ucccagcauuaaugccugucag

SEQ ID NO: 509964 - RNA, 22 nt, Human
agcagcucggccagucaccagg

SEQ ID NO: 509965 - RNA, 18 nt, Human
gagcugccauauuuaguu

SEQ ID NO: 509966 - RNA, 22 nt, Human
gcucugagacaguagagauggc

SEQ ID NO: 509967 - RNA, 22 nt, Human
gaggcugcugagagcccuguuu

SEQ ID NO: 509968 - RNA, 22 nt, Human
acaugcaaaaauauauuuauga

SEQ ID NO: 509969 - RNA, 22 nt, Human
agguccagcucuauugaaaaga

SEQ ID NO: 509970 - RNA, 22 nt, Human
augauucaagaaaauaggaugg

SEQ ID NO: 509971 - RNA, 22 nt, Human
ugggcacagggguaggaaugag

SEQ ID NO: 509972 - RNA, 22 nt, Human
aucaguuuguauaugaaacacu

SEQ ID NO: 509973 - RNA, 22 nt, Human
agcauuaauaagaaauggcucc

SEQ ID NO: 509974 - RNA, 22 nt, Human
ugaagacagaccaaggagaaug

SEQ ID NO: 509975 - RNA, 22 nt, Human
acuuguuuacaagcaguucuga

SEQ ID NO: 509976 - RNA, 22 nt, Human
uccgggagcugaacgucuugcg

SEQ ID NO: 509977 - RNA, 22 nt, Human
uggccugaauuauggcagaucu

SEQ ID NO: 509978 - RNA, 22 nt, Human
cacccuggcuggaggugcagug

SEQ ID NO: 509979 - RNA, 22 nt, Human
uuaacagauguuuauggagcau

SEQ ID NO: 509980 - RNA, 22 nt, Human
uagucacaggaaguuucaaugu

SEQ ID NO: 509981 - RNA, 22 nt, Human
aggguagggcccggagacagac

SEQ ID NO: 509982 - RNA, 22 nt, Human
uaguaaaucucagaaaaagauc

SEQ ID NO: 509983 - RNA, 22 nt, Human
uguagaaaauuggagcauucau

SEQ ID NO: 509984 - RNA, 19 nt, Human
gccugagccagccaugcaa

SEQ ID NO: 509985 - RNA, 22 nt, Human
agugggcagugcgcucggaugc

SEQ ID NO: 509986 - RNA, 22 nt, Human
aaggucauuuuuuccucuguug

SEQ ID NO: 509987 - RNA, 22 nt, Human
cuggcagcagcuucuggaucga

SEQ ID NO: 509988 - RNA, 22 nt, Human
agaggcuuggccucaguucugu

SEQ ID NO: 509989 - RNA, 22 nt, Human
augaaggcaguuaaacgucauc

SEQ ID NO: 509990 - RNA, 22 nt, Human
uucaaagcaagacacaauuccu

SEQ ID NO: 509991 - RNA, 22 nt, Human
caggcagccuucucgucucaca

SEQ ID NO: 509992 - RNA, 22 nt, Human
guggcugcuaagucuccuuccu

SEQ ID NO: 509993 - RNA, 22 nt, Human
aagggagcaaauggacagacgg

SEQ ID NO: 509994 - RNA, 22 nt, Human
acacacuguugcucauccaggc

SEQ ID NO: 509995 - RNA, 22 nt, Human
uccugggucccgcacaucuguc

SEQ ID NO: 509996 - RNA, 22 nt, Human
guccucagagugggcagguccu

SEQ ID NO: 509997 - RNA, 22 nt, Human
uccuggcugaguucccaagucg

SEQ ID NO: 509998 - RNA, 22 nt, Human
ggacaaaauccaaacuucuuag

SEQ ID NO: 509999 - RNA, 22 nt, Human
cauauuugguauaacuuaagca

SEQ ID NO: 510000 - RNA, 22 nt, Human
aaaauggucucagcuggcacca

SEQ ID NO: 510001 - RNA, 22 nt, Human
ccaggcucuguuccccgaggag

SEQ ID NO: 510002 - RNA, 22 nt, Human
uggagagaacagugucugaaag

SEQ ID NO: 510003 - RNA, 18 nt, Human
agggagagaccgcggguc

SEQ ID NO: 510004 - RNA, 22 nt, Human
ucagagucucccccaguuuggg

SEQ ID NO: 510005 - RNA, 22 nt, Human
aaugagaaccuugaaaggaacu

SEQ ID NO: 510006 - RNA, 22 nt, Human
uaccuggcuggggaauagccag

SEQ ID NO: 510007 - RNA, 22 nt, Human
uuaaacagucccagaggcugac

SEQ ID NO: 510008 - RNA, 22 nt, Human
accaagcuagaacauuacaggc

SEQ ID NO: 510009 - RNA, 22 nt, Human
cucagaguggggcucccugagg

SEQ ID NO: 510010 - RNA, 22 nt, Human
cucccugguguccccuccagga

SEQ ID NO: 510011 - RNA, 22 nt, Human
ccagagcugauuccugggacuu

SEQ ID NO: 510012 - RNA, 22 nt, Human
ugucuucaucuccaugcacaga

SEQ ID NO: 510013 - RNA, 22 nt, Human
ucuggcucacuucaggcuucac

SEQ ID NO: 510014 - RNA, 22 nt, Human
agagcacaguaucugcacauca

SEQ ID NO: 510015 - RNA, 22 nt, Human
uguggcugacuccuggucccca

SEQ ID NO: 510016 - RNA, 22 nt, Human
cucacuguuuaauagcuggauc

SEQ ID NO: 510017 - RNA, 22 nt, Human
agggccagcugcagaauuagca

SEQ ID NO: 510018 - RNA, 22 nt, Human
gccugucaauuuuguguacaau

SEQ ID NO: 510019 - RNA, 22 nt, Human
uggcagaggagaauuaagauua

SEQ ID NO: 510020 - RNA, 22 nt, Human
gcccuggccuucaucucagaca

SEQ ID NO: 510021 - RNA, 22 nt, Human
uuugcauuccugccugcauuca

SEQ ID NO: 510022 - RNA, 22 nt, Human
aggccagguuccucaaucuuga

SEQ ID NO: 510023 - RNA, 19 nt, Human
uguguccuagcagccaguc

SEQ ID NO: 510024 - RNA, 22 nt, Human
uacauggugguggcacuugacu

SEQ ID NO: 510025 - RNA, 22 nt, Human
cuguccuccagacgacaguccc

SEQ ID NO: 510026 - RNA, 22 nt, Human
aaauccuaccaagaaauucccu

SEQ ID NO: 510027 - RNA, 22 nt, Human
ucuguucagaagaggugaaagu

SEQ ID NO: 510028 - RNA, 22 nt, Human
agcagccaagguaaccugugcu

SEQ ID NO: 510029 - RNA, 22 nt, Human
uguggcugcaaaggaaggcugc

SEQ ID NO: 510030 - RNA, 22 nt, Human
gcagggccagguacaagaagca

SEQ ID NO: 510031 - RNA, 22 nt, Human
uaaggcacccgugagcugccag

SEQ ID NO: 510032 - RNA, 22 nt, Human
ugacagugcggguacaucauag

SEQ ID NO: 510033 - RNA, 22 nt, Human
caggccuggguucaaaucccuu

SEQ ID NO: 510034 - RNA, 22 nt, Human
aguuucuaccgguacauucagg

SEQ ID NO: 510035 - RNA, 22 nt, Human
cuuccaggacaccaggguagua

SEQ ID NO: 510036 - RNA, 22 nt, Human
cugggaggacaacuuggagcuc

SEQ ID NO: 510037 - RNA, 22 nt, Human
uuccuugaaaguuugaacugac

SEQ ID NO: 510038 - RNA, 21 nt, Human
agcugcuuucagcuccuagag

SEQ ID NO: 510039 - RNA, 22 nt, Human
cuucuccucugaguccugggag

SEQ ID NO: 510040 - RNA, 22 nt, Human
uccuggauucugcccugaaggc

SEQ ID NO: 510041 - RNA, 22 nt, Human
uaugaagcugauaaucacugau

SEQ ID NO: 510042 - RNA, 22 nt, Human
cagcaggauaugguggagagag

SEQ ID NO: 510043 - RNA, 22 nt, Human
gcaaagcaagauucagauguag

SEQ ID NO: 510044 - RNA, 22 nt, Human
aguagaaucccuugcaaugucc

SEQ ID NO: 510045 - RNA, 22 nt, Human
gaacagcccuguuaagucuguu

SEQ ID NO: 510046 - RNA, 22 nt, Human
guacacacuauguauuguacac

SEQ ID NO: 510047 - RNA, 22 nt, Human
aggcucagauucacauuugguu

SEQ ID NO: 510048 - RNA, 22 nt, Human
cagguggggagaguguggagca

SEQ ID NO: 510049 - RNA, 22 nt, Human
cagcucaggaaggaaggccggc

SEQ ID NO: 510050 - RNA, 22 nt, Human
gguggagagcuggaugagaggu

SEQ ID NO: 510051 - RNA, 22 nt, Human
cuccuggcccugagcucccagg

SEQ ID NO: 510052 - RNA, 22 nt, Human
ugaaaccacugaugguaccaag

SEQ ID NO: 510053 - RNA, 22 nt, Human
gcagagcuccccaagacaccaa

SEQ ID NO: 510054 - RNA, 22 nt, Human
aggcacugguccauuuucugca

SEQ ID NO: 510055 - RNA, 22 nt, Human
ccaggaggcagagguuacagug

SEQ ID NO: 510056 - RNA, 22 nt, Human
acagagaaagugggcugaagau

SEQ ID NO: 510057 - RNA, 22 nt, Human
gugcccugaaagaguuaauuca

SEQ ID NO: 510058 - RNA, 22 nt, Human
gucccaggugggcuccaccucu

SEQ ID NO: 510059 - RNA, 22 nt, Human
uucucaggccccugccuggacu

SEQ ID NO: 510060 - RNA, 20 nt, Human
cagagacccaggcuucagcu

SEQ ID NO: 510061 - RNA, 19 nt, Human
ccagugcaagguaagauag

SEQ ID NO: 510062 - RNA, 22 nt, Human
agccugcuucccuuugugcccc

SEQ ID NO: 510063 - RNA, 22 nt, Human
caugagaaccaggucuguguuu

SEQ ID NO: 510064 - RNA, 22 nt, Human
ccugggugcccggcccuucucu

SEQ ID NO: 510065 - RNA, 22 nt, Human
agggccagggaaacgaucagca

SEQ ID NO: 510066 - RNA, 22 nt, Human
gacaggaggcagagcucaggug

SEQ ID NO: 510067 - RNA, 22 nt, Human
cagaauuuaaguggauuauucu

SEQ ID NO: 510068 - RNA, 22 nt, Human
uugcuuuucccugucucugauu

SEQ ID NO: 510069 - RNA, 23 nt, Human
uaugugugggucuacuagaaguc

SEQ ID NO: 510070 - RNA, 22 nt, Human
gggcaggugcccagggccagag

SEQ ID NO: 510071 - RNA, 22 nt, Human
gugccuggcacacagaaggcaa

SEQ ID NO: 510072 - RNA, 22 nt, Human
gcagggcucauucuaguacaau

SEQ ID NO: 510073 - RNA, 22 nt, Human
guuuauaaggcccaauauuucu

SEQ ID NO: 510074 - RNA, 22 nt, Human
ccuaugccugucacucugcgcu

SEQ ID NO: 510075 - RNA, 22 nt, Human
gcugucuguucgagcguguguu

SEQ ID NO: 510076 - RNA, 22 nt, Human
cucugcugaucucagcugggcu

SEQ ID NO: 510077 - RNA, 22 nt, Human
auucuggauuaucaguccacca

SEQ ID NO: 510078 - RNA, 22 nt, Human
aaggaaauuagguuauuuugcu

SEQ ID NO: 510079 - RNA, 22 nt, Human
aaacacuagcaggaagcacuga

SEQ ID NO: 510080 - RNA, 22 nt, Human
caguuuaggucauccuugcuuu

SEQ ID NO: 510081 - RNA, 22 nt, Human
aaaucagugcucauuugaaagg

SEQ ID NO: 510082 - RNA, 22 nt, Human
ugucaaacugugacuucuaaug

SEQ ID NO: 510083 - RNA, 22 nt, Human
ugcaggcugcuggcaguagcuu

SEQ ID NO: 510084 - RNA, 22 nt, Human
uaaaagauaucuuagggauuug

SEQ ID NO: 510085 - RNA, 22 nt, Human
gcccagcuuuucacuuccacac

SEQ ID NO: 510086 - RNA, 22 nt, Human
agauacauugaguuuccuccug

SEQ ID NO: 510087 - RNA, 22 nt, Human
aucuucaauugaaaacuagccu

SEQ ID NO: 510088 - RNA, 19 nt, Human
agguuucuaacuauucaag

SEQ ID NO: 510089 - RNA, 22 nt, Human
cucugcugcccaggccugcuag

SEQ ID NO: 510090 - RNA, 22 nt, Human
uuugugaacacugcgcagaacu

SEQ ID NO: 510091 - RNA, 22 nt, Human
uggagacugugcuaagggaguu

SEQ ID NO: 510092 - RNA, 22 nt, Human
augguacagauaauacaugcug

SEQ ID NO: 510093 - RNA, 21 nt, Human
auggagucaggggaaugggcc

SEQ ID NO: 510094 - RNA, 22 nt, Human
uccagagcugagggucaguaga

SEQ ID NO: 510095 - RNA, 19 nt, Human
uggggaugcugaugaccaa

SEQ ID NO: 510096 - RNA, 22 nt, Human
gacagggcauggugcagaguuc

SEQ ID NO: 510097 - RNA, 22 nt, Human
uaugugcauaugcauacacaca

SEQ ID NO: 510098 - RNA, 22 nt, Human
aguuuuucugcuggucucacua

SEQ ID NO: 510099 - RNA, 22 nt, Human
acagagauggcuuuucagaggc

SEQ ID NO: 510100 - RNA, 22 nt, Human
aaugagcugcugcuguuccacc

SEQ ID NO: 510101 - RNA, 22 nt, Human
acaaaggacugaaacuggcugu

SEQ ID NO: 510102 - RNA, 22 nt, Human
ucacugcagacaaccucaguca

SEQ ID NO: 510103 - RNA, 22 nt, Human
uggguccucuggagcagcagca

SEQ ID NO: 510104 - RNA, 20 nt, Human
gugcaauggcgcaaucucgg

SEQ ID NO: 510105 - RNA, 22 nt, Human
gaggcugggaaguccaagacca

SEQ ID NO: 510106 - RNA, 22 nt, Human
uugauacaggcucuauuucauc

SEQ ID NO: 510107 - RNA, 22 nt, Human
cauguugaauggccuugauuuu

SEQ ID NO: 510108 - RNA, 22 nt, Human
cccaggguugccugccucugcu

SEQ ID NO: 510109 - RNA, 19 nt, Human
cucuggagaacaauagugc

SEQ ID NO: 510110 - RNA, 22 nt, Human
cccagcucucgcacuuacuagc

SEQ ID NO: 510111 - RNA, 22 nt, Human
acuucuucuucagcugggggau

SEQ ID NO: 510112 - RNA, 19 nt, Human
agaaaucucgagauuuguu

SEQ ID NO: 510113 - RNA, 20 nt, Human
gcacugaagguuccagggga

SEQ ID NO: 510114 - RNA, 22 nt, Human
uuguaacagguacuaaauaacu

SEQ ID NO: 510115 - RNA, 22 nt, Human
cacaugaugguggaagccauag

SEQ ID NO: 510116 - RNA, 22 nt, Human
ucuucacauucacguaacauag

SEQ ID NO: 510117 - RNA, 22 nt, Human
ugggggagauuagagcuucuua

SEQ ID NO: 510118 - RNA, 22 nt, Human
aagaaagggagaaggauggugu

SEQ ID NO: 510119 - RNA, 22 nt, Human
auuggaaauacaguagaaaaau

SEQ ID NO: 510120 - RNA, 22 nt, Human
aguggcuguucauuuuacacaa

SEQ ID NO: 510121 - RNA, 22 nt, Human
uugcaaaagcaauugcaguuuu

SEQ ID NO: 510122 - RNA, 22 nt, Human
gggcaggugugcagagcuguug

SEQ ID NO: 510123 - RNA, 22 nt, Human
gcugggcuuguggccagcuggg

SEQ ID NO: 510124 - RNA, 22 nt, Human
gacaaaggaucagagguuggga

SEQ ID NO: 510125 - RNA, 22 nt, Human
ucuucuggaugagagcggaggc

SEQ ID NO: 510126 - RNA, 22 nt, Human
aggaggcacucacucucagggu

SEQ ID NO: 510127 - RNA, 22 nt, Human
cuuagaaaucgaacucagguua

SEQ ID NO: 510128 - RNA, 22 nt, Human
aguaugaagauuauaauuuuuc

SEQ ID NO: 510129 - RNA, 22 nt, Human
cagcuucauugccugaugucuu

SEQ ID NO: 510130 - RNA, 22 nt, Human
ugcuuuauguuaucagaagggu

SEQ ID NO: 510131 - RNA, 22 nt, Human
uaaagugcuuccuaacccagag

SEQ ID NO: 510132 - RNA, 22 nt, Human
gggcugcugccaccagguggau

SEQ ID NO: 510133 - RNA, 22 nt, Human
cuguguggccucaagccagccu

SEQ ID NO: 510134 - RNA, 22 nt, Human
agggcucugagcuggaccaccu

SEQ ID NO: 510135 - RNA, 22 nt, Human
ggugggagagcucugucuccag

SEQ ID NO: 510136 - RNA, 22 nt, Human
caucuucugggacuucucaguu

SEQ ID NO: 510137 - RNA, 22 nt, Human
ugaacagaugccuucucccaug

SEQ ID NO: 510138 - RNA, 22 nt, Human
ugaggcaggagguugagaacug

SEQ ID NO: 510139 - RNA, 22 nt, Human
gaugaagcuaaaucuaagguuu

SEQ ID NO: 510140 - RNA, 22 nt, Human
acaggcacuuugacaugccauc

SEQ ID NO: 510141 - RNA, 22 nt, Human
gggccuccggggugagcugugg

SEQ ID NO: 510142 - RNA, 22 nt, Human
uguggaaugcuccuaagugaau

SEQ ID NO: 510143 - RNA, 23 nt, Human
ugagacacucauucauggaguau

SEQ ID NO: 510144 - RNA, 22 nt, Human
agauuucagguuggggcagaag

SEQ ID NO: 510145 - RNA, 22 nt, Human
cucccugcuuguuucccuucag

SEQ ID NO: 510146 - RNA, 22 nt, Human
ucccagagacagagccuccucc

SEQ ID NO: 510147 - RNA, 22 nt, Human
cagagggcucaguccugcugga

SEQ ID NO: 510148 - RNA, 22 nt, Human
gucuguggcaggggagaaguuu

SEQ ID NO: 510149 - RNA, 22 nt, Human
gaaaguuuauagguuauauaau

SEQ ID NO: 510150 - RNA, 22 nt, Human
agaaggcucauuugacugcauu

SEQ ID NO: 510151 - RNA, 22 nt, Human
uucucugguuugcuguuucuga

SEQ ID NO: 510152 - RNA, 22 nt, Human
acagacuggccugucucgcacc

SEQ ID NO: 510153 - RNA, 22 nt, Human
auuccaaagguuaaugcccauu

SEQ ID NO: 510154 - RNA, 22 nt, Human
ccuguggcucucuuuggagguc

SEQ ID NO: 510155 - RNA, 22 nt, Human
ccugggcaacauagggagaccc

SEQ ID NO: 510156 - RNA, 22 nt, Human
agccuauuccaggaugagcuca

SEQ ID NO: 510157 - RNA, 22 nt, Human
gaaugauauauuagcagauuuu

SEQ ID NO: 510158 - RNA, 22 nt, Human
uacauuugcuuugauuuucagc

SEQ ID NO: 510159 - RNA, 22 nt, Human
aaaggccaugguuggaguguuu

SEQ ID NO: 510160 - RNA, 22 nt, Human
uuacaucuaaacugugaacaau

SEQ ID NO: 510161 - RNA, 22 nt, Human
ugagcaucuuuuuacagguuua

SEQ ID NO: 510162 - RNA, 22 nt, Human
gggcugacagcacgccuucugu

SEQ ID NO: 510163 - RNA, 22 nt, Human
aggagucauugagagggguccu

SEQ ID NO: 510164 - RNA, 22 nt, Human
ugcaggcugcaccccugcccug

SEQ ID NO: 510165 - RNA, 22 nt, Human
gcucuggguucugauuuaugag

SEQ ID NO: 510166 - RNA, 19 nt, Human
ucccucagucugccaggcc

SEQ ID NO: 510167 - RNA, 22 nt, Human
guguccagcguggaaugagggu

SEQ ID NO: 510168 - RNA, 22 nt, Human
uacuuucuagcucuccccaguu

SEQ ID NO: 510169 - RNA, 22 nt, Human
ggcuccuggaggcaccacuggu

SEQ ID NO: 510170 - RNA, 22 nt, Human
ggaaggggagcuggaaagggua

SEQ ID NO: 510171 - RNA, 22 nt, Human
aggcucaggucucaggucuggc

SEQ ID NO: 510172 - RNA, 22 nt, Human
gaagguccagcguggccaaguc

SEQ ID NO: 510173 - RNA, 22 nt, Human
uuuccacuguagagauguugaa

SEQ ID NO: 510174 - RNA, 22 nt, Human
ccagagccggcucccucagcuu

SEQ ID NO: 510175 - RNA, 19 nt, Human
ccaggccuccugggagguc

SEQ ID NO: 510176 - RNA, 22 nt, Human
ucaagaauuuggauaagaaaug

SEQ ID NO: 510177 - RNA, 22 nt, Human
ucugguaaccuuuaucccuccu

SEQ ID NO: 510178 - RNA, 22 nt, Human
cacugaagaugcgacuagugcu

SEQ ID NO: 510179 - RNA, 23 nt, Human
agcacaaaguguuuuccuuguag

SEQ ID NO: 510180 - RNA, 22 nt, Human
gacagggcgcccagccuguuuc

SEQ ID NO: 510181 - RNA, 22 nt, Human
cugagcugggaguagagacucu

SEQ ID NO: 510182 - RNA, 21 nt, Human
ucaaagcacauauuugcacau

SEQ ID NO: 510183 - RNA, 22 nt, Human
ucaugccacuuacaaaauaaug

SEQ ID NO: 510184 - RNA, 22 nt, Human
aggggagcuaacaccagagccc

SEQ ID NO: 510185 - RNA, 22 nt, Human
accaggcagcaccaaagccggu

SEQ ID NO: 510186 - RNA, 23 nt, Human
cagcccugaaaucgaggugacac

SEQ ID NO: 510187 - RNA, 22 nt, Human
ccugggucuggucacuaaguca

SEQ ID NO: 510188 - RNA, 21 nt, Human
cuuuagugaaaaggggcuaac

SEQ ID NO: 510189 - RNA, 22 nt, Human
acugugcaugaaccgaaacaaa

SEQ ID NO: 510190 - RNA, 22 nt, Human
gcauuuagcuuuaaaauauuuc

SEQ ID NO: 510191 - RNA, 22 nt, Human
gggagccuugggagugccagcc

SEQ ID NO: 510192 - RNA, 22 nt, Human
aagcaugggaaucccacagggu

SEQ ID NO: 510193 - RNA, 22 nt, Human
acuguucaucucuuagaaagua

SEQ ID NO: 510194 - RNA, 20 nt, Human
uguuucuuuuaaugagcggc

SEQ ID NO: 510195 - RNA, 22 nt, Human
gagggaggggagcuccacccuc

SEQ ID NO: 510196 - RNA, 22 nt, Human
gauaagcuaacccaagcccuuu

SEQ ID NO: 510197 - RNA, 20 nt, Human
ccuccuggucaggugugcag

SEQ ID NO: 510198 - RNA, 23 nt, Human
augguccagccagcugcacagga

SEQ ID NO: 510199 - RNA, 22 nt, Human
aaaaugaagcaaaggcauucag

SEQ ID NO: 510200 - RNA, 22 nt, Human
ucagaaccugcaagucuaaccu

SEQ ID NO: 510201 - RNA, 22 nt, Human
auggaaggcuuuaugacucaaa

SEQ ID NO: 510202 - RNA, 22 nt, Human
uuaaagggccgauuuccaggcc

SEQ ID NO: 510203 - RNA, 22 nt, Human
uuuagcuugaaaguuuuggagg

SEQ ID NO: 510204 - RNA, 22 nt, Human
caugggcucuucuggacugcac

SEQ ID NO: 510205 - RNA, 22 nt, Human
guccagugacaaguagcuggcc

SEQ ID NO: 510206 - RNA, 22 nt, Human
gagcugguucuguccagggaau

SEQ ID NO: 510207 - RNA, 22 nt, Human
gcugucugcugggucgcucagg

SEQ ID NO: 510208 - RNA, 22 nt, Human
agccaggggagucagcugcugg

SEQ ID NO: 510209 - RNA, 22 nt, Human
cuuagcuucucugcaucugugu

SEQ ID NO: 510210 - RNA, 22 nt, Human
aggagagagaacacuugggucc

SEQ ID NO: 510211 - RNA, 19 nt, Human
caggucuucuuggaggacu

SEQ ID NO: 510212 - RNA, 22 nt, Human
cagcuugaaauauuaggagaug

SEQ ID NO: 510213 - RNA, 22 nt, Human
uacagcauugcauuuuccuuug

SEQ ID NO: 510214 - RNA, 22 nt, Human
uuaggaauauuuucugaguagu

SEQ ID NO: 510215 - RNA, 23 nt, Human
ggccucuguguucugcccacaug

SEQ ID NO: 510216 - RNA, 22 nt, Human
cccauuuaucccaagguuacuc

SEQ ID NO: 510217 - RNA, 22 nt, Human
aggaaccagacagaacugaaug

SEQ ID NO: 510218 - RNA, 22 nt, Human
gcccuucacgaugguaucuuag

SEQ ID NO: 510219 - RNA, 22 nt, Human
aggggaauggguagacuguuga

SEQ ID NO: 510220 - RNA, 22 nt, Human
ugaguggacaccugcuucuuua

SEQ ID NO: 510221 - RNA, 22 nt, Human
uucuuucugaauacaguugagu

SEQ ID NO: 510222 - RNA, 22 nt, Human
auuguacaaugccuggaacauu

SEQ ID NO: 510223 - RNA, 22 nt, Human
cgaaaucagcaucuugaggcaa

SEQ ID NO: 510224 - RNA, 22 nt, Human
cccagcaggucggugcugccug

SEQ ID NO: 510225 - RNA, 21 nt, Human
ggcagcugaccgcgcggugca

SEQ ID NO: 510226 - RNA, 22 nt, Human
caguggccaugguggcaggggu

SEQ ID NO: 510227 - RNA, 22 nt, Human
cagaugaacugugacugaaaau

SEQ ID NO: 510228 - RNA, 22 nt, Human
gugaaauauuuaacguccaggu

SEQ ID NO: 510229 - RNA, 22 nt, Human
cugcacagagcagggcagacac

SEQ ID NO: 510230 - RNA, 22 nt, Human
gggcucugggauucagagcaag

SEQ ID NO: 510231 - RNA, 21 nt, Human
ccacucaugacuccacucacc

SEQ ID NO: 510232 - RNA, 22 nt, Human
aagagggagggcaaaggcacug

SEQ ID NO: 510233 - RNA, 22 nt, Human
ccugguggaaggugagugaggc

SEQ ID NO: 510234 - RNA, 22 nt, Human
cagcauggggaucacuguaggc

SEQ ID NO: 510235 - RNA, 22 nt, Human
ccuguggcugccccgcuguugg

SEQ ID NO: 510236 - RNA, 22 nt, Human
ugggccacacacagaagaauca

SEQ ID NO: 510237 - RNA, 22 nt, Human
acagcuuuguuuucccugcuga

SEQ ID NO: 510238 - RNA, 22 nt, Human
cuccaaguauguuaaaaucuaa

SEQ ID NO: 510239 - RNA, 22 nt, Human
aagcugucaauguaucuagucu

SEQ ID NO: 510240 - RNA, 22 nt, Human
ucucugggcccagaccuuccuu

SEQ ID NO: 510241 - RNA, 19 nt, Human
agauggggaagagugugag

SEQ ID NO: 510242 - RNA, 22 nt, Human
cagggcuguggcuuugugcugu

SEQ ID NO: 510243 - RNA, 22 nt, Human
caggguacagaguuuucuaaac

SEQ ID NO: 510244 - RNA, 22 nt, Human
ucccagagucagagguggggcc

SEQ ID NO: 510245 - RNA, 22 nt, Human
aucuguggcgcaaacaaaggcu

SEQ ID NO: 510246 - RNA, 22 nt, Human
cucuuaaaaacuugauauauuu

SEQ ID NO: 510247 - RNA, 17 nt, Human
uuugaaaggaugucagu

SEQ ID NO: 510248 - RNA, 22 nt, Human
uucucaguuucauagcugagca

SEQ ID NO: 510249 - RNA, 22 nt, Human
caggaaaugggucguuuuauaa

SEQ ID NO: 510250 - RNA, 22 nt, Human
cucugugauuuugugagccaga

SEQ ID NO: 510251 - RNA, 22 nt, Human
gggcagguggcagggucucugg

SEQ ID NO: 510252 - RNA, 22 nt, Human
aaaugugcuaaaguauuaacau

SEQ ID NO: 510253 - RNA, 22 nt, Human
auauuuguuagagucuaugugu

SEQ ID NO: 510254 - RNA, 22 nt, Human
acaguguguuggaggagacugu

SEQ ID NO: 510255 - RNA, 22 nt, Human
auccuugagccaaugacugauu

SEQ ID NO: 510256 - RNA, 22 nt, Human
ugccuuccuggagcugaaggcu

SEQ ID NO: 510257 - RNA, 21 nt, Human
ugccagcauuaaacagucauu

SEQ ID NO: 510258 - RNA, 22 nt, Human
gcccucagaugggaaaggaggg

SEQ ID NO: 510259 - RNA, 22 nt, Human
ugggaauggaugcuaagugcua

SEQ ID NO: 510260 - RNA, 22 nt, Human
uacauaauaaggggcauggugu

SEQ ID NO: 510261 - RNA, 22 nt, Human
ucugagccagacaagacagcca

SEQ ID NO: 510262 - RNA, 22 nt, Human
ugaagcuuuaggauggguucau

SEQ ID NO: 510263 - RNA, 23 nt, Human
uggcucagcuaguuuuccauuuc

SEQ ID NO: 510264 - RNA, 21 nt, Human
gaggaaaugcucugguguuca

SEQ ID NO: 510265 - RNA, 19 nt, Human
cugcagggaugugcagagu

SEQ ID NO: 510266 - RNA, 22 nt, Human
gaggcaguuccugagugacaag

SEQ ID NO: 510267 - RNA, 22 nt, Human
agucagggccuggccugcugaa

SEQ ID NO: 510268 - RNA, 22 nt, Human
uggcugggccgggccuugugcc

SEQ ID NO: 510269 - RNA, 22 nt, Human
cugaggcuuugugugcaugccu

SEQ ID NO: 510270 - RNA, 22 nt, Human
gugcaugucggggugcauguca

SEQ ID NO: 510271 - RNA, 22 nt, Human
aaagcacaugaguaguguagua

SEQ ID NO: 510272 - RNA, 22 nt, Human
ggugaauaagcugaacacuugg

SEQ ID NO: 510273 - RNA, 22 nt, Human
gcgggggcggcgcagaccucag

SEQ ID NO: 510274 - RNA, 22 nt, Human
cauggccaggcacgcgcauagc

SEQ ID NO: 510275 - RNA, 22 nt, Human
guggaggagaggcgccuugcgg

SEQ ID NO: 510276 - RNA, 22 nt, Human
ucacacacauggauaguauuuu

SEQ ID NO: 510277 - RNA, 22 nt, Human
agucuucugaauaagaaucacu

SEQ ID NO: 510278 - RNA, 23 nt, Human
ggguccagagacaggcaugggug

SEQ ID NO: 510279 - RNA, 23 nt, Human
ugauggccgcccuuugcccuguc

SEQ ID NO: 510280 - RNA, 22 nt, Human
auccugggggcagcuggaaaca

SEQ ID NO: 510281 - RNA, 22 nt, Human
ggcccucuuuuauccaucauaa

SEQ ID NO: 510282 - RNA, 22 nt, Human
aaggccaugcacauccuaggca

SEQ ID NO: 510283 - RNA, 19 nt, Human
auaaggcaauuggauuugg

SEQ ID NO: 510284 - RNA, 22 nt, Human
gaggcagccucaguggaccucg

SEQ ID NO: 510285 - RNA, 22 nt, Human
agcucacagaaauccugcagga

SEQ ID NO: 510286 - RNA, 20 nt, Human
gagagcuggggaugaggcug

SEQ ID NO: 510287 - RNA, 22 nt, Human
cucaggacccgguccagguggg

SEQ ID NO: 510288 - RNA, 22 nt, Human
uauacagauggaaagauacaca

SEQ ID NO: 510289 - RNA, 22 nt, Human
aucaagaguauugacaagacca

SEQ ID NO: 510290 - RNA, 22 nt, Human
uagggcucagagaaguggggcc

SEQ ID NO: 510291 - RNA, 22 nt, Human
uccuugggaaacaucauguaau

SEQ ID NO: 510292 - RNA, 23 nt, Human
aagugcaagugaaaggcacaguu

SEQ ID NO: 510293 - RNA, 22 nt, Human
acagagacaggcagacagucuu

SEQ ID NO: 510294 - RNA, 19 nt, Human
cuggugcuugagugaguca

SEQ ID NO: 510295 - RNA, 19 nt, Human
acauucccaucagcaaugu

SEQ ID NO: 510296 - RNA, 22 nt, Human
agagggcaugcuugguggccug

SEQ ID NO: 510297 - RNA, 23 nt, Human
uguaugaauaugccacaguuuaa

SEQ ID NO: 510298 - RNA, 22 nt, Human
uggcucagaguucaucuuuuag

SEQ ID NO: 510299 - RNA, 22 nt, Human
aaugcagauucuuauucuguag

SEQ ID NO: 510300 - RNA, 22 nt, Human
ccuggauucaagucuuucuuuc

SEQ ID NO: 510301 - RNA, 22 nt, Human
acagcagagugugagauagcca

SEQ ID NO: 510302 - RNA, 20 nt, Human
ugacaguuucauaugguuca

SEQ ID NO: 510303 - RNA, 22 nt, Human
auauuuacugcuguggugaagg

SEQ ID NO: 510304 - RNA, 22 nt, Human
cagcugccccauaaaucacagu

SEQ ID NO: 510305 - RNA, 22 nt, Human
ugggcccaagagagucuccaac

SEQ ID NO: 510306 - RNA, 22 nt, Human
agagguauuagguaauucagua

SEQ ID NO: 510307 - RNA, 22 nt, Human
uuuugugagaugcguaugaaug

SEQ ID NO: 510308 - RNA, 22 nt, Human
ucuggcucaggucagacaggga

SEQ ID NO: 510309 - RNA, 22 nt, Human
ugcuaauguuucauuuuuagau

SEQ ID NO: 510310 - RNA, 22 nt, Human
gccuaggaguacagaaugguuu

SEQ ID NO: 510311 - RNA, 22 nt, Human
auuccacacaguaauacucaau

SEQ ID NO: 510312 - RNA, 22 nt, Human
uauaacacucagaaagaaucau

SEQ ID NO: 510313 - RNA, 23 nt, Human
uccugcugaaagcuccagcuggc

SEQ ID NO: 510314 - RNA, 22 nt, Human
cagagcugcgcuuuuuccuggu

SEQ ID NO: 510315 - RNA, 22 nt, Human
ccugagcuuuaaaagccaugua

SEQ ID NO: 510316 - RNA, 23 nt, Human
ucuguacacaucagcaucuccca

SEQ ID NO: 510317 - RNA, 22 nt, Human
uggcagcuacagacagagguga

SEQ ID NO: 510318 - RNA, 17 nt, Human
aggcagguaagaguuau

SEQ ID NO: 510319 - RNA, 22 nt, Human
aggugccagugcuguggucccc

SEQ ID NO: 510320 - RNA, 22 nt, Human
gcucugcuggaaguucucugga

SEQ ID NO: 510321 - RNA, 22 nt, Human
ggcuucaccaggugcaugcaug

SEQ ID NO: 510322 - RNA, 22 nt, Human
agcccagaggcugggcgugcau

SEQ ID NO: 510323 - RNA, 21 nt, Human
uucuuucugaaucugaaguau

SEQ ID NO: 510324 - RNA, 22 nt, Human
gaugaaaaaagacgagcauaua

SEQ ID NO: 510325 - RNA, 22 nt, Human
cuuggucauuuggggcugcuau

SEQ ID NO: 510326 - RNA, 22 nt, Human
ggcucuucuguuucacaggcca

SEQ ID NO: 510327 - RNA, 22 nt, Human
uuagagagaaccaucaggaucu

SEQ ID NO: 510328 - RNA, 19 nt, Human
caucuggaugauucuccug

SEQ ID NO: 510329 - RNA, 22 nt, Human
ucucuaaagccuggaagaggag

SEQ ID NO: 510330 - RNA, 22 nt, Human
gcagaugaaguuuacaggaaac

SEQ ID NO: 510331 - RNA, 22 nt, Human
cagcagcaugaauucgagccac

SEQ ID NO: 510332 - RNA, 18 nt, Human
ugaucuuugaguauaaug

SEQ ID NO: 510333 - RNA, 22 nt, Human
ccaugcagugcuggagcugauu

SEQ ID NO: 510334 - RNA, 22 nt, Human
ucucuggguccuggcaagcuca

SEQ ID NO: 510335 - RNA, 20 nt, Human
uugcaaagugaauagcaauu

SEQ ID NO: 510336 - RNA, 22 nt, Human
ggcugagcacuuuaggcaggag

SEQ ID NO: 510337 - RNA, 22 nt, Human
cucugggcaaagaugccucauc

SEQ ID NO: 510338 - RNA, 22 nt, Human
ggacuucuaagugccagacacu

SEQ ID NO: 510339 - RNA, 23 nt, Human
agcuccagcugacgugggcagcc

SEQ ID NO: 510340 - RNA, 22 nt, Human
ugugucugaacuaguugcucuc

SEQ ID NO: 510341 - RNA, 22 nt, Human
cagcuuuauugagguauaauug

SEQ ID NO: 510342 - RNA, 22 nt, Human
gagagucacugucugcauuucc

SEQ ID NO: 510343 - RNA, 22 nt, Human
ugucagcacaucuguaaucaca

SEQ ID NO: 510344 - RNA, 20 nt, Human
ccugccugccucggcucauu

SEQ ID NO: 510345 - RNA, 22 nt, Human
cagggacauugguggccagguu

SEQ ID NO: 510346 - RNA, 22 nt, Human
aauaagauccugaagauauguu

SEQ ID NO: 510347 - RNA, 22 nt, Human
cauuuugugcuagacacuaugg

SEQ ID NO: 510348 - RNA, 23 nt, Human
uggcucugagcuuccugguggcc

SEQ ID NO: 510349 - RNA, 22 nt, Human
guuauaaaaugcacaguuguuu

SEQ ID NO: 510350 - RNA, 22 nt, Human
gcuccaggcugcucugucccau

SEQ ID NO: 510351 - RNA, 22 nt, Human
uuauucugcacuuuuaaaauau

SEQ ID NO: 510352 - RNA, 22 nt, Human
ccaggguggggcaggcccacug

SEQ ID NO: 510353 - RNA, 22 nt, Human
ucaucacauaugucaugauuug

SEQ ID NO: 510354 - RNA, 22 nt, Human
cugccuggucucaggcaugggg

SEQ ID NO: 510355 - RNA, 23 nt, Human
cuggccuccgacacuggccaaga

SEQ ID NO: 510356 - RNA, 22 nt, Human
cagcuucuccggccuggugcgg

SEQ ID NO: 510357 - RNA, 22 nt, Human
auaguauuuccagaaauagucu

SEQ ID NO: 510358 - RNA, 22 nt, Human
gcagcagaggcccuacucuuug

SEQ ID NO: 510359 - RNA, 22 nt, Human
auggaagcugaaaaagacacgg

SEQ ID NO: 510360 - RNA, 22 nt, Human
auuaagugacuaaaguaaugcu

SEQ ID NO: 510361 - RNA, 22 nt, Human
aucaaagugauuuguaaacagg

SEQ ID NO: 510362 - RNA, 22 nt, Human
uggcagagcuggcugcggauga

SEQ ID NO: 510363 - RNA, 22 nt, Human
aaucagcuaaauaaacuaguca

SEQ ID NO: 510364 - RNA, 22 nt, Human
ucagguccagcuccugugccuc

SEQ ID NO: 510365 - RNA, 22 nt, Human
uugaggagucaggggcacggaa

SEQ ID NO: 510366 - RNA, 22 nt, Human
auuucuguaacuuaugaaaguu

SEQ ID NO: 510367 - RNA, 22 nt, Human
cuauaaaucuacccagcauugg

SEQ ID NO: 510368 - RNA, 22 nt, Human
gaagcagcgaaguggaagggac

SEQ ID NO: 510369 - RNA, 22 nt, Human
cuggggcuggugaggcaggcuc

SEQ ID NO: 510370 - RNA, 16 nt, Human
uccaggcauaucugag

SEQ ID NO: 510371 - RNA, 19 nt, Human
caguggagauuggaggagg

SEQ ID NO: 510372 - RNA, 22 nt, Human
caaauagacucuagaauuuauu

SEQ ID NO: 510373 - RNA, 22 nt, Human
cucacaggcaucucaucaggcu

SEQ ID NO: 510374 - RNA, 22 nt, Human
gggaaagacccugagucuuauu

SEQ ID NO: 510375 - RNA, 22 nt, Human
aucauuccacauguaccacuag

SEQ ID NO: 510376 - RNA, 21 nt, Human
cuguccaguaauuccuggcac

SEQ ID NO: 510377 - RNA, 22 nt, Human
cagcccaggucucucuuccagu

SEQ ID NO: 510378 - RNA, 22 nt, Human
gugggguguccagcagcgagcu

SEQ ID NO: 510379 - RNA, 22 nt, Human
ugucccagguccuagaugacca

SEQ ID NO: 510380 - RNA, 22 nt, Human
uaaguagaugcaaaauggaguu

SEQ ID NO: 510381 - RNA, 22 nt, Human
gcugcaggcgccugcggucucu

SEQ ID NO: 510382 - RNA, 22 nt, Human
ucugggagcacacgcagugauc

SEQ ID NO: 510383 - RNA, 22 nt, Human
acugggcccagugguguggcug

SEQ ID NO: 510384 - RNA, 22 nt, Human
accccagcgcauauggucugcg

SEQ ID NO: 510385 - RNA, 18 nt, Human
ccagggagcuuauuagga

SEQ ID NO: 510386 - RNA, 22 nt, Human
caaauggauacaggcaaacauu

SEQ ID NO: 510387 - RNA, 22 nt, Human
uggcagcaguggagguagaaag

SEQ ID NO: 510388 - RNA, 22 nt, Human
cuccuguauguugggcuucaca

SEQ ID NO: 510389 - RNA, 22 nt, Human
gugagcaggauuucauggugua

SEQ ID NO: 510390 - RNA, 22 nt, Human
uugcauugaugucuauacgcug

SEQ ID NO: 510391 - RNA, 22 nt, Human
ugaaguuuuacauccucuccaa

SEQ ID NO: 510392 - RNA, 22 nt, Human
auucccaucgucaacuucacug

SEQ ID NO: 510393 - RNA, 22 nt, Human
agcacagaaaguauugacugaa

SEQ ID NO: 510394 - RNA, 22 nt, Human
acugggcuccagaugugauacg

SEQ ID NO: 510395 - RNA, 22 nt, Human
auaaauuuauaauuguuuccug

SEQ ID NO: 510396 - RNA, 19 nt, Human
ucugucacuggggguauuc

SEQ ID NO: 510397 - RNA, 22 nt, Human
aaugaucuggcucaggauauca

SEQ ID NO: 510398 - RNA, 20 nt, Human
acaggagaucugaggaaagg

SEQ ID NO: 510399 - RNA, 22 nt, Human
uauguacaucguugaauucaaa

SEQ ID NO: 510400 - RNA, 18 nt, Human
gggcucugauccuucacc

SEQ ID NO: 510401 - RNA, 22 nt, Human
gggcacuguggggcccaugcug

SEQ ID NO: 510402 - RNA, 22 nt, Human
ccaggcuccucaugaucuuguu

SEQ ID NO: 510403 - RNA, 22 nt, Human
auuagcuucugaagcccuugaa

SEQ ID NO: 510404 - RNA, 22 nt, Human
ggaaggaaauuggggcaguugu

SEQ ID NO: 510405 - RNA, 22 nt, Human
aggcaaauagauaguccauaca

SEQ ID NO: 510406 - RNA, 22 nt, Human
uccucaggauguggaguagaau

SEQ ID NO: 510407 - RNA, 17 nt, Human
cucuccuuccucugagg

SEQ ID NO: 510408 - RNA, 22 nt, Human
uucuggaguauuccuggcaccu

SEQ ID NO: 510409 - RNA, 22 nt, Human
aaacagcuaaguacauucaagg

SEQ ID NO: 510410 - RNA, 22 nt, Human
ucacuguaaaguaauacuguca

SEQ ID NO: 510411 - RNA, 22 nt, Human
augggcugacccagucguggca

SEQ ID NO: 510412 - RNA, 22 nt, Human
cagcuggcagcccuggcccugc

SEQ ID NO: 510413 - RNA, 22 nt, Human
ugggcucuccuggaggacaaca

SEQ ID NO: 510414 - RNA, 22 nt, Human
ggagucaggagcaggcugggcu

SEQ ID NO: 510415 - RNA, 22 nt, Human
aagaaugucguugguauuuuaa

SEQ ID NO: 510416 - RNA, 22 nt, Human
gcuggcauuacaggagagaacc

SEQ ID NO: 510417 - RNA, 22 nt, Human
auuuguugcuagcagcacugau

SEQ ID NO: 510418 - RNA, 22 nt, Human
cagggucuuauaaggccaauuu

SEQ ID NO: 510419 - RNA, 22 nt, Human
ucugucugcaccuaagcacagu

SEQ ID NO: 510420 - RNA, 20 nt, Human
ggccuuggccucuuugcagc

SEQ ID NO: 510421 - RNA, 22 nt, Human
caguagcaggcaggugcuuuug

SEQ ID NO: 510422 - RNA, 22 nt, Human
ggcucaggacugcagcguagag

SEQ ID NO: 510423 - RNA, 22 nt, Human
cuuucacagcugugcuuaugau

SEQ ID NO: 510424 - RNA, 22 nt, Human
agagcuagaaggaagcauuucu

SEQ ID NO: 510425 - RNA, 22 nt, Human
aggguccuucuguuccugagca

SEQ ID NO: 510426 - RNA, 22 nt, Human
cugucuguuucugauucaaccu

SEQ ID NO: 510427 - RNA, 22 nt, Human
ggccucuggucaagacaagcau

SEQ ID NO: 510428 - RNA, 22 nt, Human
gcucugcucuaacauuccugac

SEQ ID NO: 510429 - RNA, 22 nt, Human
cugggcagugcagcuauagaac

SEQ ID NO: 510430 - RNA, 22 nt, Human
agcugguggaagggagcccaaa

SEQ ID NO: 510431 - RNA, 22 nt, Human
acagcuugcaauggcuuucaac

SEQ ID NO: 510432 - RNA, 22 nt, Human
gggaguaaacuauggugaggau

SEQ ID NO: 510433 - RNA, 18 nt, Human
ccucggagccuccguguc

SEQ ID NO: 510434 - RNA, 22 nt, Human
cagaaagcccuauguacagugg

SEQ ID NO: 510435 - RNA, 22 nt, Human
caggccuggagugcaauggcac

SEQ ID NO: 510436 - RNA, 22 nt, Human
gagagugagauaauuucacaua

SEQ ID NO: 510437 - RNA, 22 nt, Human
guuggcuuugcucucuguccua

SEQ ID NO: 510438 - RNA, 22 nt, Human
acagaggucauggagaguucuc

SEQ ID NO: 510439 - RNA, 22 nt, Human
gcuccaggagagggaagcagau

SEQ ID NO: 510440 - RNA, 22 nt, Human
cauuagggucucucagcugaau

SEQ ID NO: 510441 - RNA, 22 nt, Human
gccugcagccucagagaauuuu

SEQ ID NO: 510442 - RNA, 21 nt, Human
cacucaggguaugugccaggc

SEQ ID NO: 510443 - RNA, 22 nt, Human
gcugggccuuccgauucucaag

SEQ ID NO: 510444 - RNA, 20 nt, Human
gaggcugaaguguuuuugcu

SEQ ID NO: 510445 - RNA, 22 nt, Human
aaggccuggauuuagguuguga

SEQ ID NO: 510446 - RNA, 22 nt, Human
ugcagggcuuccucuuggaguu

SEQ ID NO: 510447 - RNA, 22 nt, Human
aacaaacaaacauuuugucauc

SEQ ID NO: 510448 - RNA, 22 nt, Human
uguaugaaccuuuaauauagug

SEQ ID NO: 510449 - RNA, 22 nt, Human
ccacauuucuucacuuguccca

SEQ ID NO: 510450 - RNA, 22 nt, Human
uguccugggaaugggaugcagu

SEQ ID NO: 510451 - RNA, 22 nt, Human
cacagaaaaaggcuugaaaauc

SEQ ID NO: 510452 - RNA, 22 nt, Human
uauaaagaaaugauuuccagaa

SEQ ID NO: 510453 - RNA, 22 nt, Human
gggcugacauauuuggugcucu

SEQ ID NO: 510454 - RNA, 22 nt, Human
uaugcacauucacacaaaaaug

SEQ ID NO: 510455 - RNA, 22 nt, Human
uccaugagggacacuggaugcu

SEQ ID NO: 510456 - RNA, 22 nt, Human
agugacucacuagcucucagug

SEQ ID NO: 510457 - RNA, 22 nt, Human
gccagcuggagugagagugggc

SEQ ID NO: 510458 - RNA, 22 nt, Human
uccaggauggugacgguggcca

SEQ ID NO: 510459 - RNA, 22 nt, Human
aggcagcuggaggcagagacua

SEQ ID NO: 510460 - RNA, 22 nt, Human
aggaccuguagggccugcaucc

SEQ ID NO: 510461 - RNA, 22 nt, Human
uggaggcaucagagugcuuggc

SEQ ID NO: 510462 - RNA, 22 nt, Human
ccaaggaguagagcaggaagcu

SEQ ID NO: 510463 - RNA, 22 nt, Human
uuaccugugucaguauaugaga

SEQ ID NO: 510464 - RNA, 22 nt, Human
aggugggggcuguguccuugac

SEQ ID NO: 510465 - RNA, 20 nt, Human
cuggguggcaagcaaggggg

SEQ ID NO: 510466 - RNA, 22 nt, Human
uggggugccgacagggagggca

SEQ ID NO: 510467 - RNA, 22 nt, Human
caggggcuguuugccucaggcc

SEQ ID NO: 510468 - RNA, 21 nt, Human
auccauccaucuuggccuaac

SEQ ID NO: 510469 - RNA, 22 nt, Human
gagggguguggagccaucaguu

SEQ ID NO: 510470 - RNA, 22 nt, Human
aggccuccuggcuccaggccuu

SEQ ID NO: 510471 - RNA, 22 nt, Human
ccacccuggacaggccucugag

SEQ ID NO: 510472 - RNA, 22 nt, Human
aaagcaauagguuaggucaaga

SEQ ID NO: 510473 - RNA, 22 nt, Human
uauuucugaauccaaaagguca

SEQ ID NO: 510474 - RNA, 22 nt, Human
cagcugaguuacucugaggucu

SEQ ID NO: 510475 - RNA, 22 nt, Human
uauuuuacuauuuggcaaaguc

SEQ ID NO: 510476 - RNA, 22 nt, Human
gggaacagagugccagacugac

SEQ ID NO: 510477 - RNA, 22 nt, Human
uggggugggcaugcgcuguccu

SEQ ID NO: 510478 - RNA, 22 nt, Human
aagcugccuagaguugaauguc

SEQ ID NO: 510479 - RNA, 22 nt, Human
ccagcaggagacuagcaacaua

SEQ ID NO: 510480 - RNA, 22 nt, Human
cagaggccaggcugccugacug

SEQ ID NO: 510481 - RNA, 22 nt, Human
ccugaguggagggauucugcag

SEQ ID NO: 510482 - RNA, 20 nt, Human
uacagaaugcaauaaaaugg

SEQ ID NO: 510483 - RNA, 22 nt, Human
agaaaugugaauuucauuuccu

SEQ ID NO: 510484 - RNA, 21 nt, Human
gugcagaggaauguagggggc

SEQ ID NO: 510485 - RNA, 22 nt, Human
aucaggaucaugcuggguggga

SEQ ID NO: 510486 - RNA, 22 nt, Human
auaagcuuuugauucacuucag

SEQ ID NO: 510487 - RNA, 22 nt, Human
uucacauuaucaggauuguuuc

SEQ ID NO: 510488 - RNA, 20 nt, Human
aaguccugaccuagucuaaa

SEQ ID NO: 510489 - RNA, 22 nt, Human
cuuguuuuggaacagagugaau

SEQ ID NO: 510490 - RNA, 21 nt, Human
ugcuggccaugugcugggcau

SEQ ID NO: 510491 - RNA, 22 nt, Human
auuucuguuauaccuuucucag

SEQ ID NO: 510492 - RNA, 22 nt, Human
gagacugauggggcucccagaa

SEQ ID NO: 510493 - RNA, 22 nt, Human
agaucaaaaacuuaauggcuuu

SEQ ID NO: 510494 - RNA, 22 nt, Human
gccuggagagcacugugcgcuu

SEQ ID NO: 510495 - RNA, 22 nt, Human
cuguagccagaagcagaaggcc

SEQ ID NO: 510496 - RNA, 20 nt, Human
uacagaaacaggacuuuugg

SEQ ID NO: 510497 - RNA, 22 nt, Human
gcuccagaugaaaggccagagg

SEQ ID NO: 510498 - RNA, 22 nt, Human
uauuucaugugcaccauaauuc

SEQ ID NO: 510499 - RNA, 22 nt, Human
gggcacuggaaggcucucaggc

SEQ ID NO: 510500 - RNA, 22 nt, Human
agcuuccuuggcgcugaggccu

SEQ ID NO: 510501 - RNA, 22 nt, Human
agccaaggacacggagccuccu

SEQ ID NO: 510502 - RNA, 22 nt, Human
aaagauuugaguucugcuuaua

SEQ ID NO: 510503 - RNA, 22 nt, Human
uaguucuugguucuuaguucuu

SEQ ID NO: 510504 - RNA, 22 nt, Human
aggccagugcagcuggaacaga

SEQ ID NO: 510505 - RNA, 22 nt, Human
uuauuccagcuaagaguccugg

SEQ ID NO: 510506 - RNA, 23 nt, Human
gcugucugucaucucugcgggag

SEQ ID NO: 510507 - RNA, 22 nt, Human
uucucuggggacugucucuauu

SEQ ID NO: 510508 - RNA, 22 nt, Human
guagcuuauuagggauaauagu

SEQ ID NO: 510509 - RNA, 22 nt, Human
cagagcaggcccacugcccucc

SEQ ID NO: 510510 - RNA, 22 nt, Human
auuuaauuuauagauguggaua

SEQ ID NO: 510511 - RNA, 22 nt, Human
augcaucuauucccaagggcag

SEQ ID NO: 510512 - RNA, 22 nt, Human
ugucaugccaccguuucccaga

SEQ ID NO: 510513 - RNA, 22 nt, Human
aagggcuggccacauucugggu

SEQ ID NO: 510514 - RNA, 22 nt, Human
acacaggggcucggcugggugc

SEQ ID NO: 510515 - RNA, 22 nt, Human
gccuggagcucaugugggcauu

SEQ ID NO: 510516 - RNA, 22 nt, Human
agcuguggaagacugucagggu

SEQ ID NO: 510517 - RNA, 22 nt, Human
guuuucauuacugcugugauuu

SEQ ID NO: 510518 - RNA, 22 nt, Human
cauugucacccaaagcucauag

SEQ ID NO: 510519 - RNA, 22 nt, Human
agugggcaugaucuggugucug

SEQ ID NO: 510520 - RNA, 22 nt, Human
gaggcaguggucugaugcaagg

SEQ ID NO: 510521 - RNA, 22 nt, Human
uuacaugguuguuggaaaugcu

SEQ ID NO: 510522 - RNA, 22 nt, Human
gcagcauccccaggcagcaggg

SEQ ID NO: 510523 - RNA, 23 nt, Human
uauacacauguggcaguauagug

SEQ ID NO: 510524 - RNA, 22 nt, Human
uugugcaauuuaaaaucuuccu

SEQ ID NO: 510525 - RNA, 22 nt, Human
uucuacuuuggacauaaaggac

SEQ ID NO: 510526 - RNA, 22 nt, Human
uaggauaggauggagacagaau

SEQ ID NO: 510527 - RNA, 22 nt, Human
ucagcagggcauacugagccua

SEQ ID NO: 510528 - RNA, 22 nt, Human
cccacacaaaucauggggagaa

SEQ ID NO: 510529 - RNA, 20 nt, Human
aguguuccggaagacuggca

SEQ ID NO: 510530 - RNA, 22 nt, Human
guccucugggcuuugagcaguc

SEQ ID NO: 510531 - RNA, 18 nt, Human
uauucuguccuaugaagc

SEQ ID NO: 510532 - RNA, 22 nt, Human
agggaagagcuugcaagaaacc

SEQ ID NO: 510533 - RNA, 22 nt, Human
agcugcugguuuaagggauggg

SEQ ID NO: 510534 - RNA, 22 nt, Human
cuaaauaaucccucuggucuua

SEQ ID NO: 510535 - RNA, 22 nt, Human
ucaccagggcuccagccagccu

SEQ ID NO: 510536 - RNA, 22 nt, Human
uauuccagaugaaaucauucag

SEQ ID NO: 510537 - RNA, 22 nt, Human
cuggggggagcugcguccagca

SEQ ID NO: 510538 - RNA, 22 nt, Human
uggcaggaaauacccugccuag

SEQ ID NO: 510539 - RNA, 22 nt, Human
ucucagggugaggaaagaauuu

SEQ ID NO: 510540 - RNA, 22 nt, Human
ggugcagaggagccagcugggg

SEQ ID NO: 510541 - RNA, 22 nt, Human
ugugugcuaauguaugcucuaa

SEQ ID NO: 510542 - RNA, 22 nt, Human
cagcaauauacacagucuaugg

SEQ ID NO: 510543 - RNA, 22 nt, Human
cucugagaaagcugugagcuaa

SEQ ID NO: 510544 - RNA, 21 nt, Human
uuuaauuugcauguaugacgc

SEQ ID NO: 510545 - RNA, 22 nt, Human
gccagggcucgcggucccucgu

SEQ ID NO: 510546 - RNA, 22 nt, Human
aaaauaucagcaaagggugaca

SEQ ID NO: 510547 - RNA, 22 nt, Human
aaggagaguacaggaguuggua

SEQ ID NO: 510548 - RNA, 22 nt, Human
ccugggagugugccaucucugu

SEQ ID NO: 510549 - RNA, 22 nt, Human
uuuugauaucaugaugaacaga

SEQ ID NO: 510550 - RNA, 22 nt, Human
cucaguccuuauuugccucuac

SEQ ID NO: 510551 - RNA, 20 nt, Human
uaugauaauuacaaaauagu

SEQ ID NO: 510552 - RNA, 22 nt, Human
cucaacaugccuacucagucug

SEQ ID NO: 510553 - RNA, 22 nt, Human
accaucuuaaggggacuucuua

SEQ ID NO: 510554 - RNA, 17 nt, Human
gccucugcuugugucau

SEQ ID NO: 510555 - RNA, 22 nt, Human
cagguccaauugcgcuaaaauc

SEQ ID NO: 510556 - RNA, 22 nt, Human
gcagaguucucuuccagcuaac

SEQ ID NO: 510557 - RNA, 22 nt, Human
aaagcacuucaggagcaguuug

SEQ ID NO: 510558 - RNA, 22 nt, Human
acacucacccucccacugccug

SEQ ID NO: 510559 - RNA, 22 nt, Human
acaggcagcacuaaucucuggu

SEQ ID NO: 510560 - RNA, 22 nt, Human
aggcuucugauaccaugagaga

SEQ ID NO: 510561 - RNA, 20 nt, Human
agccagaagaaggcuggaga

SEQ ID NO: 510562 - RNA, 22 nt, Human
auuuucaugacuaccuuaaaua

SEQ ID NO: 510563 - RNA, 22 nt, Human
ucaaauaugugauagaagcuaa

SEQ ID NO: 510564 - RNA, 20 nt, Human
uucaaagacccucaggucca

SEQ ID NO: 510565 - RNA, 22 nt, Human
gaggugaguggaucacgagguc

SEQ ID NO: 510566 - RNA, 22 nt, Human
cccaggcuagaaaggccaacaa

SEQ ID NO: 510567 - RNA, 22 nt, Human
ugauaaauccauguaaauggua

SEQ ID NO: 510568 - RNA, 22 nt, Human
ugggccugacucaccugccucc

SEQ ID NO: 510569 - RNA, 21 nt, Human
uguucacauggagcagaaugu

SEQ ID NO: 510570 - RNA, 22 nt, Human
uccagucucuacucugagauaa

SEQ ID NO: 510571 - RNA, 22 nt, Human
uucuuacagauuuggugaauga

SEQ ID NO: 510572 - RNA, 22 nt, Human
agagaaucuagaauguuuauac

SEQ ID NO: 510573 - RNA, 22 nt, Human
cagggagggacaauugucaccu

SEQ ID NO: 510574 - RNA, 22 nt, Human
uucaagaugccagggacgcggc

SEQ ID NO: 510575 - RNA, 22 nt, Human
ucccagagcccaaguuggagag

SEQ ID NO: 510576 - RNA, 22 nt, Human
agccccucuccgcccugagucg

SEQ ID NO: 510577 - RNA, 22 nt, Human
agugggagagaagcaaguagua

SEQ ID NO: 510578 - RNA, 22 nt, Human
uccucagcauggaaucuggacu

SEQ ID NO: 510579 - RNA, 22 nt, Human
cugucuguuuuaccuucuccag

SEQ ID NO: 510580 - RNA, 22 nt, Human
ggccccaggccuuuggucuggc

SEQ ID NO: 510581 - RNA, 22 nt, Human
ccugcaguuuguugugaccccg

SEQ ID NO: 510582 - RNA, 22 nt, Human
cuuccuggccauugccauggca

SEQ ID NO: 510583 - RNA, 22 nt, Human
acuuguugcccuccugaaaauu

SEQ ID NO: 510584 - RNA, 22 nt, Human
ggugcaggacgaaguggggguu

SEQ ID NO: 510585 - RNA, 22 nt, Human
aaucuugaguguuacucucauu

SEQ ID NO: 510586 - RNA, 22 nt, Human
cccaggcacucuuggucauuuu

SEQ ID NO: 510587 - RNA, 22 nt, Human
ucuggcucuaacuaggcaucag

SEQ ID NO: 510588 - RNA, 22 nt, Human
gcucuguacgcaggaugagggg

SEQ ID NO: 510589 - RNA, 22 nt, Human
ucucugagcccaauguagcaau

SEQ ID NO: 510590 - RNA, 22 nt, Human
cuaggaauccuuuuagaguugg

SEQ ID NO: 510591 - RNA, 22 nt, Human
ucagcaaugugauacugugcaa

SEQ ID NO: 510592 - RNA, 22 nt, Human
cucuuugucacucauacaguca

SEQ ID NO: 510593 - RNA, 22 nt, Human
aggcuuccuggaggaagaggua

SEQ ID NO: 510594 - RNA, 22 nt, Human
ucucagagggaaacaugaguga

SEQ ID NO: 510595 - RNA, 22 nt, Human
cugugagcuggguggccaggac

SEQ ID NO: 510596 - RNA, 22 nt, Human
agaucuggaacugagguuuauu

SEQ ID NO: 510597 - RNA, 22 nt, Human
uccugucugucuuuggucccuu

SEQ ID NO: 510598 - RNA, 22 nt, Human
cacugcuuaguugguaaaugug

SEQ ID NO: 510599 - RNA, 21 nt, Human
ccugcagcaccagaaggagau

SEQ ID NO: 510600 - RNA, 22 nt, Human
caggauggucuucauuuggcuc

SEQ ID NO: 510601 - RNA, 22 nt, Human
auggcuucuagcauugucacaa

SEQ ID NO: 510602 - RNA, 22 nt, Human
gcugagugauugauauuuuagu

SEQ ID NO: 510603 - RNA, 22 nt, Human
cagacccugggccacagaggag

SEQ ID NO: 510604 - RNA, 22 nt, Human
augaagucuagcaagcauugaa

SEQ ID NO: 510605 - RNA, 22 nt, Human
cucuggccugcuuccucaggua

SEQ ID NO: 510606 - RNA, 22 nt, Human
ccuaaguaaguugacuuucaga

SEQ ID NO: 510607 - RNA, 21 nt, Human
ugccaggccugagcugggguc

SEQ ID NO: 510608 - RNA, 19 nt, Human
ggagucugagcccagguau

SEQ ID NO: 510609 - RNA, 22 nt, Human
uuugcaaagugcuugcagagua

SEQ ID NO: 510610 - RNA, 22 nt, Human
uggccagccuugucaucgcuuu

SEQ ID NO: 510611 - RNA, 21 nt, Human
cagagcuguccaaacccugac

SEQ ID NO: 510612 - RNA, 22 nt, Human
aagcugccagcugagcugaggc

SEQ ID NO: 510613 - RNA, 22 nt, Human
ugcugcauuuaucuucucaaac

SEQ ID NO: 510614 - RNA, 22 nt, Human
cagggccucauccucagagauu

SEQ ID NO: 510615 - RNA, 22 nt, Human
gcugcucugugacagccuccgg

SEQ ID NO: 510616 - RNA, 22 nt, Human
agagcccuuucuccaggcaccu

SEQ ID NO: 510617 - RNA, 21 nt, Human
cccucaggaaacagaaugcac

SEQ ID NO: 510618 - RNA, 22 nt, Human
aucaguuuggugcuuucaguga

SEQ ID NO: 510619 - RNA, 22 nt, Human
auaagcucuggacagccacauu

SEQ ID NO: 510620 - RNA, 18 nt, Human
ucugagggugcgggagcu

SEQ ID NO: 510621 - RNA, 22 nt, Human
caguccuggggaccaggcugag

SEQ ID NO: 510622 - RNA, 22 nt, Human
auggaaauaucuuuagagcuua

SEQ ID NO: 510623 - RNA, 22 nt, Human
cuccuucagcugaaucccugcu

SEQ ID NO: 510624 - RNA, 18 nt, Human
uuuauauggauagagacc

SEQ ID NO: 510625 - RNA, 22 nt, Human
uuuauucacuucagugccaaag

SEQ ID NO: 510626 - RNA, 22 nt, Human
cagaugagcaugggcacaagca

SEQ ID NO: 510627 - RNA, 22 nt, Human
gauaauauuagaagauacaaau

SEQ ID NO: 510628 - RNA, 22 nt, Human
auucuuuucccaacugcuuuaa

SEQ ID NO: 510629 - RNA, 22 nt, Human
agcuucauaauuccuugacuca

SEQ ID NO: 510630 - RNA, 22 nt, Human
gagccccuucugcagucagguu

SEQ ID NO: 510631 - RNA, 22 nt, Human
augaaaacuuuagccucauuag

SEQ ID NO: 510632 - RNA, 22 nt, Human
acagugcaggucucaacaauua

SEQ ID NO: 510633 - RNA, 21 nt, Human
gcagggacaaagcuucaggag

SEQ ID NO: 510634 - RNA, 22 nt, Human
uuacuuuagaucauacugugug

SEQ ID NO: 510635 - RNA, 23 nt, Human
uauuugcuacugguaauucugga

SEQ ID NO: 510636 - RNA, 22 nt, Human
aagcagacagagaauggguuug

SEQ ID NO: 510637 - RNA, 22 nt, Human
accaggcagucaccguccagga

SEQ ID NO: 510638 - RNA, 22 nt, Human
cagggagaagucuggucagucc

SEQ ID NO: 510639 - RNA, 22 nt, Human
uuuggccaugcucaaggguaua

SEQ ID NO: 510640 - RNA, 20 nt, Human
guggagaggcuggcgggacu

SEQ ID NO: 510641 - RNA, 22 nt, Human
uuuugccuaggguugacccguu

SEQ ID NO: 510642 - RNA, 22 nt, Human
gcugccuccugaaagcgcucug

SEQ ID NO: 510643 - RNA, 22 nt, Human
uacaacaggaauuucaacuuug

SEQ ID NO: 510644 - RNA, 22 nt, Human
agcagcagggacaaaggaacag

SEQ ID NO: 510645 - RNA, 22 nt, Human
gacaauugcuuuugccgaauaa

SEQ ID NO: 510646 - RNA, 20 nt, Human
agugaauagagacauugccc

SEQ ID NO: 510647 - RNA, 22 nt, Human
ggcuggcaagugucugcucaug

SEQ ID NO: 510648 - RNA, 22 nt, Human
aaacaauguagauuaccauuua

SEQ ID NO: 510649 - RNA, 22 nt, Human
ugacagugacagccaaaggcuu

SEQ ID NO: 510650 - RNA, 22 nt, Human
ccacaggggcccacgagccgcu

SEQ ID NO: 510651 - RNA, 19 nt, Human
agcagagcccugaagaucc

SEQ ID NO: 510652 - RNA, 22 nt, Human
gaauacauggcagggagucauc

SEQ ID NO: 510653 - RNA, 18 nt, Human
ugcucuguuuaaugauuu

SEQ ID NO: 510654 - RNA, 22 nt, Human
acuaagaccuagauacuagggg

SEQ ID NO: 510655 - RNA, 22 nt, Human
ucucacucauuuccuaggucuu

SEQ ID NO: 510656 - RNA, 22 nt, Human
ggccacugaccuacaucugggg

SEQ ID NO: 510657 - RNA, 22 nt, Human
aucuuucagagcuccaucaggg

SEQ ID NO: 510658 - RNA, 22 nt, Human
ucuggcucaggagcuguguuca

SEQ ID NO: 510659 - RNA, 22 nt, Human
gcuccucuauuccccacauuuu

SEQ ID NO: 510660 - RNA, 22 nt, Human
ugaauucuuuuagaauucagug

SEQ ID NO: 510661 - RNA, 22 nt, Human
uugcuuuacaaaaauugauggu

SEQ ID NO: 510662 - RNA, 22 nt, Human
aauauaugacuccacugcauga

SEQ ID NO: 510663 - RNA, 22 nt, Human
agguccugucuaucacccucgc

SEQ ID NO: 510664 - RNA, 22 nt, Human
ucagagaggcaauacuguuuaa

SEQ ID NO: 510665 - RNA, 22 nt, Human
ggcucuggugggaagguuagau

SEQ ID NO: 510666 - RNA, 22 nt, Human
ccaguccacgucaagaagaggu

SEQ ID NO: 510667 - RNA, 22 nt, Human
uugaaugauccuaucuagcaca

SEQ ID NO: 510668 - RNA, 22 nt, Human
ucccagagacaucauuucuccg

SEQ ID NO: 510669 - RNA, 22 nt, Human
ucucugggauaaacugggccag

SEQ ID NO: 510670 - RNA, 21 nt, Human
ggcacagccugaaaugccuca

SEQ ID NO: 510671 - RNA, 22 nt, Human
ccugccagcccgcguucaugcc

SEQ ID NO: 510672 - RNA, 21 nt, Human
ucacagacuggucagugaggc

SEQ ID NO: 510673 - RNA, 22 nt, Human
uuaugcuaaaugaaucaaguca

SEQ ID NO: 510674 - RNA, 22 nt, Human
cugucugucaaguucaucucca

SEQ ID NO: 510675 - RNA, 22 nt, Human
aagauucucagagugaaagaau

SEQ ID NO: 510676 - RNA, 22 nt, Human
gggaaggcauaccugagggaga

SEQ ID NO: 510677 - RNA, 22 nt, Human
cauuaggguaauugaacacuua

SEQ ID NO: 510678 - RNA, 22 nt, Human
cuguagcaaguuauucaauaaa

SEQ ID NO: 510679 - RNA, 22 nt, Human
ugggcucuagacuuuagugugg

SEQ ID NO: 510680 - RNA, 22 nt, Human
uuaauaaguaguaguuauuguu

SEQ ID NO: 510681 - RNA, 22 nt, Human
ugcauuauacuuuuagaaauuu

SEQ ID NO: 510682 - RNA, 22 nt, Human
ggagucugauacugaguuccuc

SEQ ID NO: 510683 - RNA, 22 nt, Human
guccucugauuucuagguauau

SEQ ID NO: 510684 - RNA, 22 nt, Human
auguacaaaaugccacugaauu

SEQ ID NO: 510685 - RNA, 22 nt, Human
acaaaugcaaguuuuaugucaa

SEQ ID NO: 510686 - RNA, 22 nt, Human
acaccagggccuagccagggcg

SEQ ID NO: 510687 - RNA, 22 nt, Human
guacauuuugagguuaaaacaa

SEQ ID NO: 510688 - RNA, 22 nt, Human
gaugguuuaugauagaugggaa

SEQ ID NO: 510689 - RNA, 22 nt, Human
gccuggagcucuccacuugggg

SEQ ID NO: 510690 - RNA, 22 nt, Human
ccccaugaaguagggucucuga

SEQ ID NO: 510691 - RNA, 22 nt, Human
gagcuucccucugcagucccug

SEQ ID NO: 510692 - RNA, 22 nt, Human
acugcagccuuugggcucauaa

SEQ ID NO: 510693 - RNA, 22 nt, Human
uuuauguacauauccacaagga

SEQ ID NO: 510694 - RNA, 22 nt, Human
cagggcaggacagauacauuac

SEQ ID NO: 510695 - RNA, 22 nt, Human
acaguguuguauuuaguuugau

SEQ ID NO: 510696 - RNA, 22 nt, Human
gcccucugcacagcucugagca

SEQ ID NO: 510697 - RNA, 22 nt, Human
gcagaggugaccagcagcaggg

SEQ ID NO: 510698 - RNA, 22 nt, Human
uuucuguagugugguauguagg

SEQ ID NO: 510699 - RNA, 22 nt, Human
agggcuuuugagcgcacgucug

SEQ ID NO: 510700 - RNA, 20 nt, Human
ugucauuguuucuaggaccu

SEQ ID NO: 510701 - RNA, 22 nt, Human
cugagccaaggggacagugaca

SEQ ID NO: 510702 - RNA, 22 nt, Human
ccaguguuuuccaguuugccca

SEQ ID NO: 510703 - RNA, 22 nt, Human
ugcaccauguaaguggccacgu

SEQ ID NO: 510704 - RNA, 22 nt, Human
auuguacaugcagugagucauc

SEQ ID NO: 510705 - RNA, 18 nt, Human
uggcagggaggaaauaua

SEQ ID NO: 510706 - RNA, 22 nt, Human
ccagucacagguguguuuauau

SEQ ID NO: 510707 - RNA, 22 nt, Human
agagaaaacucauugagguguc

SEQ ID NO: 510708 - RNA, 22 nt, Human
aagugccugggcaacauagcaa

SEQ ID NO: 510709 - RNA, 22 nt, Human
ucuggcuucccacucugccggg

SEQ ID NO: 510710 - RNA, 22 nt, Human
agcugcugagccauguccugcu

SEQ ID NO: 510711 - RNA, 22 nt, Human
cagaacugggcagggagcagag

SEQ ID NO: 510712 - RNA, 22 nt, Human
gcugagagugugagaucagauu

SEQ ID NO: 510713 - RNA, 19 nt, Human
ucugaaugggaugaguugg

SEQ ID NO: 510714 - RNA, 22 nt, Human
ucaggagacuuaugucacagug

SEQ ID NO: 510715 - RNA, 22 nt, Human
aaacaguauuaucaauauauuu

SEQ ID NO: 510716 - RNA, 22 nt, Human
uugauucagagaagauuggccc

SEQ ID NO: 510717 - RNA, 22 nt, Human
uugucaaguaaggcugacauuu

SEQ ID NO: 510718 - RNA, 17 nt, Human
gauuuccugaaguucuu

SEQ ID NO: 510719 - RNA, 22 nt, Human
ucagcaucagguugucugaauu

SEQ ID NO: 510720 - RNA, 22 nt, Human
ggccaccuuccaguugccugca

SEQ ID NO: 510721 - RNA, 21 nt, Human
uaaaagaugacaagacagcuc

SEQ ID NO: 510722 - RNA, 22 nt, Human
agcugacucuggccucuggucc

SEQ ID NO: 510723 - RNA, 22 nt, Human
cugagagguaagcagcgcagug

SEQ ID NO: 510724 - RNA, 22 nt, Human
aagauuuccuucaguagagcua

SEQ ID NO: 510725 - RNA, 22 nt, Human
uaaaugaaaggguuuaauuuau

SEQ ID NO: 510726 - RNA, 22 nt, Human
cuguggagcuuguggcaguggg

SEQ ID NO: 510727 - RNA, 22 nt, Human
cucucagaaguagcacgugggc

SEQ ID NO: 510728 - RNA, 20 nt, Human
cagucccaauccagggccag

SEQ ID NO: 510729 - RNA, 22 nt, Human
uuccuugguacagaguagcuuu

SEQ ID NO: 510730 - RNA, 22 nt, Human
cucaggaugcaauuccaucaag

SEQ ID NO: 510731 - RNA, 22 nt, Human
gaaaugcagaaccugagaccau

SEQ ID NO: 510732 - RNA, 22 nt, Human
agcagugggggaguguuaguuu

SEQ ID NO: 510733 - RNA, 22 nt, Human
ucuguucaugucuuuuuaagug

SEQ ID NO: 510734 - RNA, 22 nt, Human
gcagggcugggugggagacaga

SEQ ID NO: 510735 - RNA, 22 nt, Human
gcagcuuuguggagaggcccau

SEQ ID NO: 510736 - RNA, 22 nt, Human
guggugcaggccagcaggggcg

SEQ ID NO: 510737 - RNA, 22 nt, Human
aggagagggguaggauuaauuu

SEQ ID NO: 510738 - RNA, 22 nt, Human
gcagccccaggagacgcccagg

SEQ ID NO: 510739 - RNA, 22 nt, Human
agucuguguauauucacugccc

SEQ ID NO: 510740 - RNA, 22 nt, Human
gguggccucugcaggccucgac

SEQ ID NO: 510741 - RNA, 23 nt, Human
aaucuggcugauguuuuuucucu

SEQ ID NO: 510742 - RNA, 22 nt, Human
accaaggagccacauacaaccu

SEQ ID NO: 510743 - RNA, 22 nt, Human
uaggaacaaguuuccuugcugu

SEQ ID NO: 510744 - RNA, 22 nt, Human
ugaaaucuccucuuuauauauc

SEQ ID NO: 510745 - RNA, 22 nt, Human
cuguguuuggacaacuuuucag

SEQ ID NO: 510746 - RNA, 22 nt, Human
cuggaggaccacagaagcuggu

SEQ ID NO: 510747 - RNA, 22 nt, Human
ucuacuuuucccuauacaguuu

SEQ ID NO: 510748 - RNA, 22 nt, Human
guugacagcuggugagcugcua

SEQ ID NO: 510749 - RNA, 22 nt, Human
auugaaaguccuaucuaaggga

SEQ ID NO: 510750 - RNA, 22 nt, Human
uugaaauggcagcagcugaccu

SEQ ID NO: 510751 - RNA, 22 nt, Human
ugucaccucuuuggcugcagcu

SEQ ID NO: 510752 - RNA, 22 nt, Human
uccuggaggcaaaugaagacuc

SEQ ID NO: 510753 - RNA, 22 nt, Human
aucucugggcuuugaguuuguu

SEQ ID NO: 510754 - RNA, 22 nt, Human
ugcaggcuggauuugcuuuugu

SEQ ID NO: 510755 - RNA, 22 nt, Human
uuguucaugguuguaaguuuga

SEQ ID NO: 510756 - RNA, 22 nt, Human
uccucuggcccagcugccucug

SEQ ID NO: 510757 - RNA, 22 nt, Human
uuaauuaugagaaagggaaaag

SEQ ID NO: 510758 - RNA, 22 nt, Human
uucucuucccacuuucuguauu

SEQ ID NO: 510759 - RNA, 22 nt, Human
ggcaggugcucugugggccugg

SEQ ID NO: 510760 - RNA, 22 nt, Human
uccaggucuuccuauuccaggu

SEQ ID NO: 510761 - RNA, 22 nt, Human
auugacaagugagcugggcugc

SEQ ID NO: 510762 - RNA, 22 nt, Human
caaagugcuggaauuacaggug

SEQ ID NO: 510763 - RNA, 22 nt, Human
gugaggugggcuggccagagac

SEQ ID NO: 510764 - RNA, 22 nt, Human
gcugcugcgcuugucuacuguu

SEQ ID NO: 510765 - RNA, 22 nt, Human
agccccucuguagcuaauagua

SEQ ID NO: 510766 - RNA, 22 nt, Human
ucccacucccaggcaggccucu

SEQ ID NO: 510767 - RNA, 22 nt, Human
cagagccacugucugccaggca

SEQ ID NO: 510768 - RNA, 22 nt, Human
cagucacacaaguggacuuggg

SEQ ID NO: 510769 - RNA, 22 nt, Human
uggccuggaaaaaugcagaugg

SEQ ID NO: 510770 - RNA, 22 nt, Human
uagcuauuguugguaguuaccc

SEQ ID NO: 510771 - RNA, 22 nt, Human
gggcagaggcucuggcccaucc

SEQ ID NO: 510772 - RNA, 22 nt, Human
gacagggcaagacucugucuaa

SEQ ID NO: 510773 - RNA, 22 nt, Human
caggucagagucccccuguccu

SEQ ID NO: 510774 - RNA, 22 nt, Human
acucugggccccagguggagcu

SEQ ID NO: 510775 - RNA, 22 nt, Human
cagguggcuucucccuaggcca

SEQ ID NO: 510776 - RNA, 22 nt, Human
augaauaugagacugagagccu

SEQ ID NO: 510777 - RNA, 22 nt, Human
ugaaugaucuaguuuuguagac

SEQ ID NO: 510778 - RNA, 21 nt, Human
cugugcuuuuuaagugugaug

SEQ ID NO: 510779 - RNA, 22 nt, Human
gugggacucuucuuuggcagug

SEQ ID NO: 510780 - RNA, 22 nt, Human
aucugaagggaaguggaaggca

SEQ ID NO: 510781 - RNA, 22 nt, Human
cugggcugucccagggcggcag

SEQ ID NO: 510782 - RNA, 22 nt, Human
aaaauuuugcccuauccuucau

SEQ ID NO: 510783 - RNA, 22 nt, Human
uggcucaguggcagccgcagcu

SEQ ID NO: 510784 - RNA, 22 nt, Human
gcugaggcaguccacccuugug

SEQ ID NO: 510785 - RNA, 22 nt, Human
agggccagaaucccucagucua

SEQ ID NO: 510786 - RNA, 22 nt, Human
caggcaggagaggaggauuucu

SEQ ID NO: 510787 - RNA, 22 nt, Human
aggagucauaaaugugaacaaa

SEQ ID NO: 510788 - RNA, 22 nt, Human
gcuggagguggugagaaaaggu

SEQ ID NO: 510789 - RNA, 22 nt, Human
uagguccacaagaucaaugcag

SEQ ID NO: 510790 - RNA, 22 nt, Human
auuuauuauugugguuacuucu

SEQ ID NO: 510791 - RNA, 22 nt, Human
ccaaggcuucccagagaugcuc

SEQ ID NO: 510792 - RNA, 19 nt, Human
auggcugcugauuggggau

SEQ ID NO: 510793 - RNA, 22 nt, Human
gaugcgggcccgcuccacugcc

SEQ ID NO: 510794 - RNA, 22 nt, Human
ugguaauuaauuugauagguuc

SEQ ID NO: 510795 - RNA, 18 nt, Human
gcagagugcgucucugug

SEQ ID NO: 510796 - RNA, 22 nt, Human
guuuccugggccccaacccaga

SEQ ID NO: 510797 - RNA, 22 nt, Human
uacaaugcugugcauguaaugg

SEQ ID NO: 510798 - RNA, 22 nt, Human
acuguacauauggauucuaaga

SEQ ID NO: 510799 - RNA, 22 nt, Human
cuuuaagagaucaccaaucaca

SEQ ID NO: 510800 - RNA, 22 nt, Human
cucacugugccuuuucccaaac

SEQ ID NO: 510801 - RNA, 22 nt, Human
cuuguagaauugaaauggucuc

SEQ ID NO: 510802 - RNA, 22 nt, Human
uagcuuuacaaagugcugcacc

SEQ ID NO: 510803 - RNA, 22 nt, Human
ugcccaggguggagugcagcgg

SEQ ID NO: 510804 - RNA, 22 nt, Human
cagcccugcagagggcgcuccu

SEQ ID NO: 510805 - RNA, 22 nt, Human
ucuuuggggcaucugggagauu

SEQ ID NO: 510806 - RNA, 22 nt, Human
caaaguaugaaccaguuucucu

SEQ ID NO: 510807 - RNA, 22 nt, Human
aguggcuguccuggcucuaacu

SEQ ID NO: 510808 - RNA, 22 nt, Human
ucagaggcuacagucugggagu

SEQ ID NO: 510809 - RNA, 22 nt, Human
aggcagcuucugauuagcagcg

SEQ ID NO: 510810 - RNA, 22 nt, Human
cagugucuccagaugcuccaau

SEQ ID NO: 510811 - RNA, 22 nt, Human
auaugcacacucugcccacaga

SEQ ID NO: 510812 - RNA, 22 nt, Human
uuaaguaagaccuuaugucuug

SEQ ID NO: 510813 - RNA, 20 nt, Human
aaagugcacagauacagcuc

SEQ ID NO: 510814 - RNA, 22 nt, Human
uacauucucuucccauugucuc

SEQ ID NO: 510815 - RNA, 22 nt, Human
ucauguuauugacucauaauau

SEQ ID NO: 510816 - RNA, 22 nt, Human
cucuggaguggguggccgggag

SEQ ID NO: 510817 - RNA, 22 nt, Human
auuuugcugugguacauuagga

SEQ ID NO: 510818 - RNA, 22 nt, Human
ucaagagauugaauaauaacug

SEQ ID NO: 510819 - RNA, 23 nt, Human
cuggcuccgaagacuccaggauc

SEQ ID NO: 510820 - RNA, 22 nt, Human
ucuccaagcagggcugcaaggc

SEQ ID NO: 510821 - RNA, 22 nt, Human
guaaacaucgacccaacagggg

SEQ ID NO: 510822 - RNA, 22 nt, Human
ucuccacucugagugccuuuca

SEQ ID NO: 510823 - RNA, 22 nt, Human
uccuugaauugugccacuuacc

SEQ ID NO: 510824 - RNA, 22 nt, Human
ugcagcccuuccuuccucuggg

SEQ ID NO: 510825 - RNA, 17 nt, Human
ucugccgacugccagcu

SEQ ID NO: 510826 - RNA, 22 nt, Human
uagaaucauugagaauaacagg

SEQ ID NO: 510827 - RNA, 23 nt, Human
gguccaggaaaggcagcagcacc

SEQ ID NO: 510828 - RNA, 19 nt, Human
cgcaggcuucgggucgcuc

SEQ ID NO: 510829 - RNA, 22 nt, Human
aucucagacauguuguccauga

SEQ ID NO: 510830 - RNA, 22 nt, Human
agggagguaggagcuucuagcu

SEQ ID NO: 510831 - RNA, 22 nt, Human
gcaggcucacucuguuuggcuc

SEQ ID NO: 510832 - RNA, 19 nt, Human
ucuaacagaagugucgucc

SEQ ID NO: 510833 - RNA, 22 nt, Human
ugcuccagugagcuggccaucc

SEQ ID NO: 510834 - RNA, 21 nt, Human
uccacaaguuagaaggaaauu

SEQ ID NO: 510835 - RNA, 22 nt, Human
ggcuucuuaaucaugagaguga

SEQ ID NO: 510836 - RNA, 22 nt, Human
uuagcauuucauuucaagagga

SEQ ID NO: 510837 - RNA, 22 nt, Human
guccucuguagggcugggccac

SEQ ID NO: 510838 - RNA, 22 nt, Human
uaguccaguaaaacagcuaacg

SEQ ID NO: 510839 - RNA, 22 nt, Human
aggugccaauuuucagugaaca

SEQ ID NO: 510840 - RNA, 22 nt, Human
caggccaggcugcauuugcccc

SEQ ID NO: 510841 - RNA, 20 nt, Human
gcacugaaauucaauguuug

SEQ ID NO: 510842 - RNA, 22 nt, Human
cucuaaauccaaauaagugucc

SEQ ID NO: 510843 - RNA, 22 nt, Human
uccauuuuucaugacuccucaa

SEQ ID NO: 510844 - RNA, 22 nt, Human
aaagcagugcaccuuaauugau

SEQ ID NO: 510845 - RNA, 22 nt, Human
ccaggaguuugaggcugcagug

SEQ ID NO: 510846 - RNA, 22 nt, Human
aaugacaugcuuuuuaauuaua

SEQ ID NO: 510847 - RNA, 22 nt, Human
agagggccauaggugcauaguu

SEQ ID NO: 510848 - RNA, 21 nt, Human
gccaccucgucucggagcagc

SEQ ID NO: 510849 - RNA, 22 nt, Human
cuggccacuggagguggcaccc

SEQ ID NO: 510850 - RNA, 22 nt, Human
aguaaaaucuuaagcacagugg

SEQ ID NO: 510851 - RNA, 22 nt, Human
ugcugaauaauaagauuacuca

SEQ ID NO: 510852 - RNA, 22 nt, Human
cagagcuguauuuaucuuucca

SEQ ID NO: 510853 - RNA, 22 nt, Human
ggagaauggccaucuuuucaga

SEQ ID NO: 510854 - RNA, 22 nt, Human
uggcaguguauagguggcuccu

SEQ ID NO: 510855 - RNA, 22 nt, Human
aagcagaucugauagggcccug

SEQ ID NO: 510856 - RNA, 22 nt, Human
caggaaauggcugaauaaauuc

SEQ ID NO: 510857 - RNA, 22 nt, Human
agagggcugccucagucagcua

SEQ ID NO: 510858 - RNA, 22 nt, Human
agcacaaauauaaaaaugucug

SEQ ID NO: 510859 - RNA, 18 nt, Human
ggguucaccugccuuugg

SEQ ID NO: 510860 - RNA, 22 nt, Human
aagauguugucguuagugauga

SEQ ID NO: 510861 - RNA, 22 nt, Human
gcagcuuuggagguggaacucu

SEQ ID NO: 510862 - RNA, 22 nt, Human
ccucucuguaagggucccuccc

SEQ ID NO: 510863 - RNA, 22 nt, Human
aagaauguucauuaaacuguug

SEQ ID NO: 510864 - RNA, 22 nt, Human
gcugcagcagaaguucucagag

SEQ ID NO: 510865 - RNA, 22 nt, Human
gaauauuuucaguacagauggu

SEQ ID NO: 510866 - RNA, 22 nt, Human
uguuuugucuaauagggcaggu

SEQ ID NO: 510867 - RNA, 22 nt, Human
caccaggcugaaccagagggga

SEQ ID NO: 510868 - RNA, 22 nt, Human
uuagcauuuucugggcugaaau

SEQ ID NO: 510869 - RNA, 22 nt, Human
caggcuccuucccagggauggu

SEQ ID NO: 510870 - RNA, 22 nt, Human
uccaagcacuguuaauuaaacu

SEQ ID NO: 510871 - RNA, 22 nt, Human
gccacagucacugcugcagggg

SEQ ID NO: 510872 - RNA, 22 nt, Human
cuccagcugccaccagauguuu

SEQ ID NO: 510873 - RNA, 22 nt, Human
cagcaaaagccagcauaagcuc

SEQ ID NO: 510874 - RNA, 20 nt, Human
auacaaagagauugauguau

SEQ ID NO: 510875 - RNA, 22 nt, Human
guccuggcugguucuguggggc

SEQ ID NO: 510876 - RNA, 22 nt, Human
uuguagaaucauuauuucuagu

SEQ ID NO: 510877 - RNA, 22 nt, Human
uucucuggaacugaaacaagau

SEQ ID NO: 510878 - RNA, 22 nt, Human
aacauuaauuacagucaaacau

SEQ ID NO: 510879 - RNA, 22 nt, Human
aaaaaugaaacggcugguuggc

SEQ ID NO: 510880 - RNA, 22 nt, Human
agagcugggugguggugacuca

SEQ ID NO: 510881 - RNA, 22 nt, Human
agucacaguuucccugagagag

SEQ ID NO: 510882 - RNA, 22 nt, Human
aaggcuuuugggaauuuucaac

SEQ ID NO: 510883 - RNA, 22 nt, Human
ucacagaaguguagugaggaaa

SEQ ID NO: 510884 - RNA, 22 nt, Human
cccagagaucuuguccuuucca

SEQ ID NO: 510885 - RNA, 22 nt, Human
aaacagcuggucucaaauguuc

SEQ ID NO: 510886 - RNA, 22 nt, Human
uucaguguggcccaugaagagg

SEQ ID NO: 510887 - RNA, 22 nt, Human
ggcucagacucccaggcccucu

SEQ ID NO: 510888 - RNA, 22 nt, Human
ugcuccuguuucaucagcuaua

SEQ ID NO: 510889 - RNA, 22 nt, Human
aaugaagcaagcugcuguguuu

SEQ ID NO: 510890 - RNA, 22 nt, Human
gaggcacaguguuuggucagug

SEQ ID NO: 510891 - RNA, 22 nt, Human
cagucucuuuauccaccaagcc

SEQ ID NO: 510892 - RNA, 22 nt, Human
ucugaggcuaagagacagaggc

SEQ ID NO: 510893 - RNA, 22 nt, Human
augcaaagcacacacagaaucc

SEQ ID NO: 510894 - RNA, 22 nt, Human
aucaggauucaguaucuccagc

SEQ ID NO: 510895 - RNA, 22 nt, Human
acuuccugggcaugcagagucc

SEQ ID NO: 510896 - RNA, 22 nt, Human
gcugucucauacaaggcccugc

SEQ ID NO: 510897 - RNA, 22 nt, Human
gaggcacaucacuuggugcauu

SEQ ID NO: 510898 - RNA, 20 nt, Human
auuuguuucuacucucugac

SEQ ID NO: 510899 - RNA, 21 nt, Human
agcugccacccuagcuucuga

SEQ ID NO: 510900 - RNA, 22 nt, Human
ugucccaguuuugcagguuaga

SEQ ID NO: 510901 - RNA, 22 nt, Human
accauuuuggguauuuucagag

SEQ ID NO: 510902 - RNA, 22 nt, Human
ccacugggcguuucuguccaau

SEQ ID NO: 510903 - RNA, 22 nt, Human
cccagagcuccgguccugccca

SEQ ID NO: 510904 - RNA, 22 nt, Human
ugaaaucugcaugcaaaguccu

SEQ ID NO: 510905 - RNA, 22 nt, Human
gcucaggagcucuugguggcgc

SEQ ID NO: 510906 - RNA, 23 nt, Human
uaauuagauguugauuccugaga

SEQ ID NO: 510907 - RNA, 22 nt, Human
caguucuaauuaauaggaguaa

SEQ ID NO: 510908 - RNA, 22 nt, Human
gcacacauucggauucuuaacc

SEQ ID NO: 510909 - RNA, 22 nt, Human
uuacaaucugauugucucaucu

SEQ ID NO: 510910 - RNA, 22 nt, Human
uucuugcaggucacucacugag

SEQ ID NO: 510911 - RNA, 22 nt, Human
ccagcuccgggaguugcugcug

SEQ ID NO: 510912 - RNA, 22 nt, Human
cucugggugggcagcagaugga

SEQ ID NO: 510913 - RNA, 22 nt, Human
aaggcagccgugugacugcaug

SEQ ID NO: 510914 - RNA, 19 nt, Human
uuucugcagcccagcagca

SEQ ID NO: 510915 - RNA, 18 nt, Human
ugaauagggguuugcaga

SEQ ID NO: 510916 - RNA, 22 nt, Human
cagcagcugguugaauccuucu

SEQ ID NO: 510917 - RNA, 22 nt, Human
aggcaugugacccuggacucag

SEQ ID NO: 510918 - RNA, 22 nt, Human
auuugccuuacugaagaaggag

SEQ ID NO: 510919 - RNA, 22 nt, Human
aaaugaguuugccucuagauag

SEQ ID NO: 510920 - RNA, 22 nt, Human
uagucacaaccuucaaguuguc

SEQ ID NO: 510921 - RNA, 22 nt, Human
uagcauuucacugaucuucacu

SEQ ID NO: 510922 - RNA, 20 nt, Human
auuauucauacaugugugac

SEQ ID NO: 510923 - RNA, 22 nt, Human
ugggaccugaagcagguuggca

SEQ ID NO: 510924 - RNA, 22 nt, Human
cugaggccucucuccugggcuu

SEQ ID NO: 510925 - RNA, 22 nt, Human
agaauucuguucuucgggugug

SEQ ID NO: 510926 - RNA, 22 nt, Human
aaggcuggucagauguggugaa

SEQ ID NO: 510927 - RNA, 22 nt, Human
cuagagaggcagauguccugug

SEQ ID NO: 510928 - RNA, 22 nt, Human
agucucagggccacccggggaa

SEQ ID NO: 510929 - RNA, 22 nt, Human
agguccuguccuuggucucuga

SEQ ID NO: 510930 - RNA, 22 nt, Human
uuuacaugaguagcagauguuc

SEQ ID NO: 510931 - RNA, 22 nt, Human
ccuggaggcucugggagggcag

SEQ ID NO: 510932 - RNA, 22 nt, Human
uuuccuuguucauuugcccuau

SEQ ID NO: 510933 - RNA, 22 nt, Human
ugggcagagaguagaggcaacg

SEQ ID NO: 510934 - RNA, 22 nt, Human
gcaaagcacacccucagaguuu

SEQ ID NO: 510935 - RNA, 22 nt, Human
ugcuuuauaggggauugcaggc

SEQ ID NO: 510936 - RNA, 22 nt, Human
agcuggaggggccagcaggugu

SEQ ID NO: 510937 - RNA, 22 nt, Human
ucccagaggcaguugguaacuu

SEQ ID NO: 510938 - RNA, 22 nt, Human
guaugaaguaagauauuguuca

SEQ ID NO: 510939 - RNA, 22 nt, Human
aaucaaagaaugggcuaguugg

SEQ ID NO: 510940 - RNA, 22 nt, Human
ugaaguuuucugguugauuaag

SEQ ID NO: 510941 - RNA, 22 nt, Human
ucuccucaccaccagcagcaga

SEQ ID NO: 510942 - RNA, 22 nt, Human
ucagagugaccuuacauggucu

SEQ ID NO: 510943 - RNA, 22 nt, Human
gcaaacauguugugagauacca

SEQ ID NO: 510944 - RNA, 22 nt, Human
cagcucuguucauagauggugc

SEQ ID NO: 510945 - RNA, 22 nt, Human
aaguguuuggggaucauuuuaa

SEQ ID NO: 510946 - RNA, 22 nt, Human
uuguuucauggggauguuuauu

SEQ ID NO: 510947 - RNA, 17 nt, Human
ugcuucuguauugcugg

SEQ ID NO: 510948 - RNA, 22 nt, Human
cucccagagagcaggugggccg

SEQ ID NO: 510949 - RNA, 22 nt, Human
cauuucuauggcaaugggaaaa

SEQ ID NO: 510950 - RNA, 22 nt, Human
caccccagucuaaaaccagccu

SEQ ID NO: 510951 - RNA, 20 nt, Human
gcuucaaagccauccuuuua

SEQ ID NO: 510952 - RNA, 22 nt, Human
ccagcagagucuaggaaggagg

SEQ ID NO: 510953 - RNA, 23 nt, Human
agagcuuagggaauucacaugag

SEQ ID NO: 510954 - RNA, 22 nt, Human
aaacugaauucccaagggcaug

SEQ ID NO: 510955 - RNA, 20 nt, Human
auagauaucaucuuuagaag

SEQ ID NO: 510956 - RNA, 22 nt, Human
accaggagccauagagucaggc

SEQ ID NO: 510957 - RNA, 22 nt, Human
uagcagaaccagcagucaauuu

SEQ ID NO: 510958 - RNA, 23 nt, Human
gccucuggagccccagugcucag

SEQ ID NO: 510959 - RNA, 22 nt, Human
gguggccaggccagcucuggcc

SEQ ID NO: 510960 - RNA, 22 nt, Human
aggaggcccuagagcucuagag

SEQ ID NO: 510961 - RNA, 22 nt, Human
gcaggcacuccuaggaccauca

SEQ ID NO: 510962 - RNA, 22 nt, Human
auguguaaaaagugcuuaauau

SEQ ID NO: 510963 - RNA, 22 nt, Human
auguccuuugcuucucuggucc

SEQ ID NO: 510964 - RNA, 22 nt, Human
agcugugguguuuucaagcccu

SEQ ID NO: 510965 - RNA, 22 nt, Human
cuggguucucugcuuagggccu

SEQ ID NO: 510966 - RNA, 22 nt, Human
ggaggccauaguuugggaguca

SEQ ID NO: 510967 - RNA, 22 nt, Human
uuguggcucgugagauguuagg

SEQ ID NO: 510968 - RNA, 22 nt, Human
ucagcuuucucaaagaagcugg

SEQ ID NO: 510969 - RNA, 20 nt, Human
aagcagaagcugcucucagc

SEQ ID NO: 510970 - RNA, 22 nt, Human
agucccagcuacucaagaggcu

SEQ ID NO: 510971 - RNA, 22 nt, Human
ucagcucuguguacaguuagca

SEQ ID NO: 510972 - RNA, 22 nt, Human
gccacacuuauucucaugcaca

SEQ ID NO: 510973 - RNA, 22 nt, Human
aggccuccugcagggaugagug

SEQ ID NO: 510974 - RNA, 22 nt, Human
aagacuguacauuuuccagucu

SEQ ID NO: 510975 - RNA, 22 nt, Human
ugguacacauguccaaggucag

SEQ ID NO: 510976 - RNA, 22 nt, Human
cagauagcaauuugggcagggg

SEQ ID NO: 510977 - RNA, 22 nt, Human
aagaaagguguguuugcagaug

SEQ ID NO: 510978 - RNA, 22 nt, Human
uuagcuuaauuaaauaaucagu

SEQ ID NO: 510979 - RNA, 22 nt, Human
uggcuucuugacuucuuggcug

SEQ ID NO: 510980 - RNA, 22 nt, Human
acaugauuuuuaaagagauaau

SEQ ID NO: 510981 - RNA, 22 nt, Human
guguccagagaaacucacagcu

SEQ ID NO: 510982 - RNA, 22 nt, Human
uaucagcaucuccucaaagaua

SEQ ID NO: 510983 - RNA, 22 nt, Human
aguucacuuucuguaguggaag

SEQ ID NO: 510984 - RNA, 22 nt, Human
aggggagaaaaaugccuucugu

SEQ ID NO: 510985 - RNA, 20 nt, Human
uugauucaagggcugaugga

SEQ ID NO: 510986 - RNA, 23 nt, Human
gcauugucuccccacuucugggc

SEQ ID NO: 510987 - RNA, 22 nt, Human
cuggcccagagagcagagcuua

SEQ ID NO: 510988 - RNA, 22 nt, Human
uccauggguagcccugguugag

SEQ ID NO: 510989 - RNA, 22 nt, Human
ccuccaggaacuugagagacac

SEQ ID NO: 510990 - RNA, 22 nt, Human
cccagacauaacagcagagagg

SEQ ID NO: 510991 - RNA, 22 nt, Human
cuuuagaaaucuggauguauuu

SEQ ID NO: 510992 - RNA, 22 nt, Human
ucaguguuugguuucagaauug

SEQ ID NO: 510993 - RNA, 22 nt, Human
uuaguuuucccaucuuuauggu

SEQ ID NO: 510994 - RNA, 22 nt, Human
cagggcuugcaggagaaaguuu

SEQ ID NO: 510995 - RNA, 22 nt, Human
gggucccaggaaggagcagugu

SEQ ID NO: 510996 - RNA, 22 nt, Human
agcuuuaugggagcuuagauaa

SEQ ID NO: 510997 - RNA, 22 nt, Human
guuuggauagugagagauacuu

SEQ ID NO: 510998 - RNA, 22 nt, Human
ucucagaguuuuuuuccaggac

SEQ ID NO: 510999 - RNA, 22 nt, Human
aguguuuggggugauuguaacc

SEQ ID NO: 511000 - RNA, 22 nt, Human
uaagaacagauaaaguuucccc

SEQ ID NO: 511001 - RNA, 23 nt, Human
ugaaggccuggaggacgcguugu

SEQ ID NO: 511002 - RNA, 22 nt, Human
gcagauggugggggaggaguac

SEQ ID NO: 511003 - RNA, 22 nt, Human
ccuucucuacuccugaugcaug

SEQ ID NO: 511004 - RNA, 17 nt, Human
uuccaaggagcauuuga

SEQ ID NO: 511005 - RNA, 22 nt, Human
aucaggauagucuguaaauugu

SEQ ID NO: 511006 - RNA, 22 nt, Human
agggggugcuacuuccagaguu

SEQ ID NO: 511007 - RNA, 22 nt, Human
gucuggagccugggucccugcu

SEQ ID NO: 511008 - RNA, 22 nt, Human
ggagagguuauccguguuaugu

SEQ ID NO: 511009 - RNA, 22 nt, Human
ucacacagcuccuuuccuuagu

SEQ ID NO: 511010 - RNA, 22 nt, Human
cacauuuaaagguugaagcuga

SEQ ID NO: 511011 - RNA, 21 nt, Human
uccauaagagaccaucuccua

SEQ ID NO: 511012 - RNA, 22 nt, Human
aagauacagacagagccaaaau

SEQ ID NO: 511013 - RNA, 22 nt, Human
uggccucuuaggacauccucua

SEQ ID NO: 511014 - RNA, 22 nt, Human
ggucaugcugugaaucagugcu

SEQ ID NO: 511015 - RNA, 22 nt, Human
cucugugcuuaugcuccauggg

SEQ ID NO: 511016 - RNA, 22 nt, Human
aaacagcuaauggccaggaaua

SEQ ID NO: 511017 - RNA, 22 nt, Human
ugcaaaauaaugaacgauuuuu

SEQ ID NO: 511018 - RNA, 22 nt, Human
aauacuuuccuauauaaggugc

SEQ ID NO: 511019 - RNA, 22 nt, Human
acacagaaccucauagccucuc

SEQ ID NO: 511020 - RNA, 22 nt, Human
aagcaagacagaaguuacugcc

SEQ ID NO: 511021 - RNA, 22 nt, Human
ucaaguauuuauuucugcuggc

SEQ ID NO: 511022 - RNA, 22 nt, Human
ugauucuguucuccuugagaau

SEQ ID NO: 511023 - RNA, 21 nt, Human
ucugucugguuuuagaguggc

SEQ ID NO: 511024 - RNA, 22 nt, Human
cuggucugagggcucuugaggc

SEQ ID NO: 511025 - RNA, 20 nt, Human
ucugugugccaucaccuaac

SEQ ID NO: 511026 - RNA, 22 nt, Human
ucucuucuugauuuucacugga

SEQ ID NO: 511027 - RNA, 22 nt, Human
ucaggcucuacacuugacacac

SEQ ID NO: 511028 - RNA, 22 nt, Human
aauuaggggaggacguaucaua

SEQ ID NO: 511029 - RNA, 22 nt, Human
cuacauuucccagcugccuucc

SEQ ID NO: 511030 - RNA, 22 nt, Human
uggcuguggacucagauggcuc

SEQ ID NO: 511031 - RNA, 22 nt, Human
ugagagagccugaaucucuuac

SEQ ID NO: 511032 - RNA, 22 nt, Human
ccugagagcagcuuccugcuua

SEQ ID NO: 511033 - RNA, 22 nt, Human
cuguaugaguugggaauagaau

SEQ ID NO: 511034 - RNA, 22 nt, Human
ccagggcaauuauuuggagggu

SEQ ID NO: 511035 - RNA, 22 nt, Human
ugccaaguggagcucaggaauc

SEQ ID NO: 511036 - RNA, 22 nt, Human
acucugggaugagaaaaggguu

SEQ ID NO: 511037 - RNA, 22 nt, Human
auuagcuucugugcauggacuu

SEQ ID NO: 511038 - RNA, 22 nt, Human
acacuguagcugagggcaugcg

SEQ ID NO: 511039 - RNA, 22 nt, Human
uggcagcacuagguacugagcu

SEQ ID NO: 511040 - RNA, 22 nt, Human
ggcugcuguuucagagacuguu

SEQ ID NO: 511041 - RNA, 22 nt, Human
uggagcugagagccaggcuggc

SEQ ID NO: 511042 - RNA, 22 nt, Human
cuguccuccggccaccuacagu

SEQ ID NO: 511043 - RNA, 22 nt, Human
ccucuggccauucuuugaugga

SEQ ID NO: 511044 - RNA, 22 nt, Human
ugcugauauauucuaguuuucu

SEQ ID NO: 511045 - RNA, 22 nt, Human
aaugaacuggagaacaaugacc

SEQ ID NO: 511046 - RNA, 22 nt, Human
gacaucauagggugggaggaaa

SEQ ID NO: 511047 - RNA, 22 nt, Human
aggcaggcacuccggaaguguc

SEQ ID NO: 511048 - RNA, 22 nt, Human
cuggugcaggaaggagcuggca

SEQ ID NO: 511049 - RNA, 22 nt, Human
uuuucauuuuuguagaugcaag

SEQ ID NO: 511050 - RNA, 22 nt, Human
ucagaggacagcagcuaaauaa

SEQ ID NO: 511051 - RNA, 22 nt, Human
agauguggaacacuagacugcu

SEQ ID NO: 511052 - RNA, 22 nt, Human
aaaguaucaagggaagcauuuu

SEQ ID NO: 511053 - RNA, 22 nt, Human
uagucaaaccucagaauacccc

SEQ ID NO: 511054 - RNA, 22 nt, Human
ccuggcugcauuuugcuggaug

SEQ ID NO: 511055 - RNA, 22 nt, Human
caugugugugagggaaacaugu

SEQ ID NO: 511056 - RNA, 22 nt, Human
cuauuuguaagagccccacacc

SEQ ID NO: 511057 - RNA, 22 nt, Human
ggagauuuauagcacacuucag

SEQ ID NO: 511058 - RNA, 22 nt, Human
uggaagagaaaauccacccuua

SEQ ID NO: 511059 - RNA, 22 nt, Human
uuagauaaaaguguucaauaaa

SEQ ID NO: 511060 - RNA, 22 nt, Human
ugcuacacuuaaaucagucacc

SEQ ID NO: 511061 - RNA, 22 nt, Human
cagagcuggagaaguggauuua

SEQ ID NO: 511062 - RNA, 22 nt, Human
auuguacauaugauguauguaa

SEQ ID NO: 511063 - RNA, 22 nt, Human
ccccacacucuuuacauucaua

SEQ ID NO: 511064 - RNA, 22 nt, Human
ccuucaaaacacuaguuuuuga

SEQ ID NO: 511065 - RNA, 22 nt, Human
cuggagagggagcccuggcagu

SEQ ID NO: 511066 - RNA, 22 nt, Human
auggcugcuuucccuuagcacc

SEQ ID NO: 511067 - RNA, 22 nt, Human
aagaugauagaucugucaaugu

SEQ ID NO: 511068 - RNA, 22 nt, Human
gucuggcauucuuccuggagaa

SEQ ID NO: 511069 - RNA, 22 nt, Human
accucaguucaauucaguuaga

SEQ ID NO: 511070 - RNA, 22 nt, Human
gucccuggagcugagcagugcu

SEQ ID NO: 511071 - RNA, 22 nt, Human
uuuaacacuaguuucuuuaacu

SEQ ID NO: 511072 - RNA, 22 nt, Human
uuucacagauguuuuggagucu

SEQ ID NO: 511073 - RNA, 22 nt, Human
aauauugagaaccagcauguuu

SEQ ID NO: 511074 - RNA, 22 nt, Human
ugagccuggcggaagcagcgug

SEQ ID NO: 511075 - RNA, 22 nt, Human
ggcagcuccucucagcaaaaga

SEQ ID NO: 511076 - RNA, 22 nt, Human
cccauuuagauaacaguucaaa

SEQ ID NO: 511077 - RNA, 22 nt, Human
cagcugagcucccaggccauca

SEQ ID NO: 511078 - RNA, 22 nt, Human
aaggccagccugagagcuaaca

SEQ ID NO: 511079 - RNA, 22 nt, Human
agcucucaagauaagaaagaac

SEQ ID NO: 511080 - RNA, 22 nt, Human
ugaaaucuuuaguuucuguccc

SEQ ID NO: 511081 - RNA, 18 nt, Human
cugcugcaggcacucagg

SEQ ID NO: 511082 - RNA, 22 nt, Human
uccagagccccagucuaguggg

SEQ ID NO: 511083 - RNA, 22 nt, Human
gagacugguguuugcugggcug

SEQ ID NO: 511084 - RNA, 22 nt, Human
ccucuggccuaggccgggagag

SEQ ID NO: 511085 - RNA, 22 nt, Human
ccugucauacuaacguaguggg

SEQ ID NO: 511086 - RNA, 22 nt, Human
agaccuggugauagcuguccua

SEQ ID NO: 511087 - RNA, 22 nt, Human
cuucuugcugggggccucagug

SEQ ID NO: 511088 - RNA, 22 nt, Human
gugguaauuuaauccuacacug

SEQ ID NO: 511089 - RNA, 22 nt, Human
ucuguccauuuuccauuuuggc

SEQ ID NO: 511090 - RNA, 22 nt, Human
gcagggacaaggcagguguucu

SEQ ID NO: 511091 - RNA, 22 nt, Human
accucugccacuuucuaacucu

SEQ ID NO: 511092 - RNA, 22 nt, Human
uauggcuucugcuuucuugacu

SEQ ID NO: 511093 - RNA, 22 nt, Human
cuuauaguaugauguugagaau

SEQ ID NO: 511094 - RNA, 22 nt, Human
uuuggccucaugaauuucuugc

SEQ ID NO: 511095 - RNA, 22 nt, Human
uggcuagcccuuguggggagag

SEQ ID NO: 511096 - RNA, 22 nt, Human
aggucaaggccaaaagaguggu

SEQ ID NO: 511097 - RNA, 22 nt, Human
ugcugccacugguagucucauu

SEQ ID NO: 511098 - RNA, 22 nt, Human
ucccacauuacccugacugaca

SEQ ID NO: 511099 - RNA, 22 nt, Human
cuggcuccaggucaugcacuca

SEQ ID NO: 511100 - RNA, 22 nt, Human
uucucuggccugaggcgaggcc

SEQ ID NO: 511101 - RNA, 22 nt, Human
gcagauggcucagacacugggg

SEQ ID NO: 511102 - RNA, 22 nt, Human
aggcccugggcaguucuguagc

SEQ ID NO: 511103 - RNA, 23 nt, Human
aagcugccagucugaagccuggg

SEQ ID NO: 511104 - RNA, 20 nt, Human
cagagaccaggccagguguc

SEQ ID NO: 511105 - RNA, 17 nt, Human
ccucacagggaccagac

SEQ ID NO: 511106 - RNA, 22 nt, Human
cagcagcaacaacggaagccuu

SEQ ID NO: 511107 - RNA, 22 nt, Human
aauguauuugauguauuagccu

SEQ ID NO: 511108 - RNA, 22 nt, Human
cuucuggcguuggaggucugag

SEQ ID NO: 511109 - RNA, 23 nt, Human
ggcagcucucaucugaugacuga

SEQ ID NO: 511110 - RNA, 22 nt, Human
aggaaacagugaacuuggcagg

SEQ ID NO: 511111 - RNA, 22 nt, Human
aaggcccuggccccagcuucuu

SEQ ID NO: 511112 - RNA, 22 nt, Human
caaauuuagguaacagucugua

SEQ ID NO: 511113 - RNA, 22 nt, Human
gaagaaagaucaaauaguuucc

SEQ ID NO: 511114 - RNA, 22 nt, Human
gcugugugcuaggauauguuuu

SEQ ID NO: 511115 - RNA, 22 nt, Human
gaaauauucuugucuuguuuuc

SEQ ID NO: 511116 - RNA, 22 nt, Human
ugcacuuuauuuccucucacac

SEQ ID NO: 511117 - RNA, 22 nt, Human
gcugcuccgucugagcucuggu

SEQ ID NO: 511118 - RNA, 22 nt, Human
acugggcugcuugagugccuuc

SEQ ID NO: 511119 - RNA, 22 nt, Human
agugcuggguacuguucccauu

SEQ ID NO: 511120 - RNA, 22 nt, Human
gagaacuuucuguguuuuuauc

SEQ ID NO: 511121 - RNA, 22 nt, Human
ugggcacuauggcucugugcac

SEQ ID NO: 511122 - RNA, 22 nt, Human
ugguuucucugaacucuacgac

SEQ ID NO: 511123 - RNA, 22 nt, Human
aggaagcaaaaggcagggucua

SEQ ID NO: 511124 - RNA, 22 nt, Human
cagaaggcuggcagauugagau

SEQ ID NO: 511125 - RNA, 22 nt, Human
cacaggcuugucagcaugaggc

SEQ ID NO: 511126 - RNA, 22 nt, Human
ccuggcagcauugguagagauu

SEQ ID NO: 511127 - RNA, 22 nt, Human
aauguguauacuggcaauuaag

SEQ ID NO: 511128 - RNA, 20 nt, Human
auacacaugcagacagaugc

SEQ ID NO: 511129 - RNA, 22 nt, Human
uaaauucugaucaaguuccuuc

SEQ ID NO: 511130 - RNA, 22 nt, Human
auggccaccauuuaaugaagcu

SEQ ID NO: 511131 - RNA, 22 nt, Human
ccagcucucuuugaagcauaaa

SEQ ID NO: 511132 - RNA, 22 nt, Human
uaccucaaguuccaggaaagcg

SEQ ID NO: 511133 - RNA, 22 nt, Human
gcacaaaagguacuucauguag

SEQ ID NO: 511134 - RNA, 22 nt, Human
cauacauuuugcauauuuacca

SEQ ID NO: 511135 - RNA, 22 nt, Human
caaugugugcuuacaggccagu

SEQ ID NO: 511136 - RNA, 22 nt, Human
uucugggacaucuggacaguuu

SEQ ID NO: 511137 - RNA, 22 nt, Human
uucagcacuggacagcgagucu

SEQ ID NO: 511138 - RNA, 22 nt, Human
uggcagcacaagguggcccaug

SEQ ID NO: 511139 - RNA, 22 nt, Human
cuagaaaaauacuuuauuguga

SEQ ID NO: 511140 - RNA, 22 nt, Human
aauucacaaaaccagauugcuu

SEQ ID NO: 511141 - RNA, 22 nt, Human
aaaacacugcaaagcugauugg

SEQ ID NO: 511142 - RNA, 22 nt, Human
gagguccucuguguccgcgggc

SEQ ID NO: 511143 - RNA, 22 nt, Human
augugacaguguuugacagaug

SEQ ID NO: 511144 - RNA, 20 nt, Human
cccucugcuacacugggagc

SEQ ID NO: 511145 - RNA, 19 nt, Human
agggcugcucuggccuggg

SEQ ID NO: 511146 - RNA, 22 nt, Human
gagcugggaguuauagcauguu

SEQ ID NO: 511147 - RNA, 23 nt, Human
uugaauaggguggcaacaaacug

SEQ ID NO: 511148 - RNA, 22 nt, Human
ccagagacgucggucagggcgc

SEQ ID NO: 511149 - RNA, 22 nt, Human
aaugcacagcuaaagugguucc

SEQ ID NO: 511150 - RNA, 21 nt, Human
ugugugcauaugcauguacau

SEQ ID NO: 511151 - RNA, 22 nt, Human
uuuuugcaccaaccuaauagaa

SEQ ID NO: 511152 - RNA, 21 nt, Human
uucauaaaccauucucaugca

SEQ ID NO: 511153 - RNA, 22 nt, Human
uaaauuagggacuuuaguuaau

SEQ ID NO: 511154 - RNA, 22 nt, Human
acguuuucagccuuaauguaga

SEQ ID NO: 511155 - RNA, 22 nt, Human
uuggcugaagguuaagugcugg

SEQ ID NO: 511156 - RNA, 22 nt, Human
ccuguguggccaggcuggaguc

SEQ ID NO: 511157 - RNA, 22 nt, Human
cccaggaggcagagguugcagu

SEQ ID NO: 511158 - RNA, 22 nt, Human
uccccaguaagccugcacugug

SEQ ID NO: 511159 - RNA, 22 nt, Human
gcuuccaaaucuguucaaaaug

SEQ ID NO: 511160 - RNA, 22 nt, Human
caugucugaguagagugugauu

SEQ ID NO: 511161 - RNA, 22 nt, Human
agcaugaaaacaugaaacagca

SEQ ID NO: 511162 - RNA, 22 nt, Human
ugaaggccagcucuuuaucagc

SEQ ID NO: 511163 - RNA, 22 nt, Human
agcagaaccacagcacuguuga

SEQ ID NO: 511164 - RNA, 22 nt, Human
ccaggccuggacggguggccug

SEQ ID NO: 511165 - RNA, 22 nt, Human
aggccagaugucgggcuagaag

SEQ ID NO: 511166 - RNA, 22 nt, Human
gggcaagcucuucagaagcucu

SEQ ID NO: 511167 - RNA, 22 nt, Human
uagcagcucacuaacucugcgu

SEQ ID NO: 511168 - RNA, 18 nt, Human
uccauuguucuacuguga

SEQ ID NO: 511169 - RNA, 19 nt, Human
caaggguugggucugucau

SEQ ID NO: 511170 - RNA, 22 nt, Human
cccagcccugaccuauuggaaa

SEQ ID NO: 511171 - RNA, 22 nt, Human
ccagugugguagguccacaggu

SEQ ID NO: 511172 - RNA, 22 nt, Human
agaaggccuaacuugggggcaa

SEQ ID NO: 511173 - RNA, 21 nt, Human
aagagcuggaucaaggauaag

SEQ ID NO: 511174 - RNA, 22 nt, Human
agcugguaugaacaggauagga

SEQ ID NO: 511175 - RNA, 22 nt, Human
cucucuggcuuggcacggagau

SEQ ID NO: 511176 - RNA, 22 nt, Human
uuauggcauauuccucauugua

SEQ ID NO: 511177 - RNA, 22 nt, Human
uuucuacaugucaauccaaacc

SEQ ID NO: 511178 - RNA, 22 nt, Human
uuauuuacuggauggccuuggg

SEQ ID NO: 511179 - RNA, 19 nt, Human
cuguggcugaccucuggcc

SEQ ID NO: 511180 - RNA, 22 nt, Human
uagauuuuacuucugucauuac

SEQ ID NO: 511181 - RNA, 22 nt, Human
aggcugaggcagguggaucauu

SEQ ID NO: 511182 - RNA, 22 nt, Human
agucaguguagaaagcccaggc

SEQ ID NO: 511183 - RNA, 22 nt, Human
auguguuuauaauuacucaauc

SEQ ID NO: 511184 - RNA, 22 nt, Human
uggcucugcgucuguucguggg

SEQ ID NO: 511185 - RNA, 22 nt, Human
ucagauggcacacagagccugc

SEQ ID NO: 511186 - RNA, 22 nt, Human
cucaacagcucugccauacucc

SEQ ID NO: 511187 - RNA, 22 nt, Human
ggcaggugcugggagcaucuca

SEQ ID NO: 511188 - RNA, 19 nt, Human
ggcucucuuaaagcuguuu

SEQ ID NO: 511189 - RNA, 21 nt, Human
aaauuuucuuggcuguagugu

SEQ ID NO: 511190 - RNA, 22 nt, Human
caggcuuaggagucagccugcu

SEQ ID NO: 511191 - RNA, 22 nt, Human
ucaaagucucugcuucuguaac

SEQ ID NO: 511192 - RNA, 22 nt, Human
cauguacaaaaggcaaaugccu

SEQ ID NO: 511193 - RNA, 22 nt, Human
gcagagccaggcuggggcaggu

SEQ ID NO: 511194 - RNA, 22 nt, Human
uacauguuauuucacuauuggu

SEQ ID NO: 511195 - RNA, 19 nt, Human
gcccaggggcccgaugcug

SEQ ID NO: 511196 - RNA, 22 nt, Human
ucuuuuagagcauuucugauuc

SEQ ID NO: 511197 - RNA, 22 nt, Human
agaguggcuucuuugacaugcu

SEQ ID NO: 511198 - RNA, 22 nt, Human
ggagccugggcauuaguaauuu

SEQ ID NO: 511199 - RNA, 22 nt, Human
gguguccgcgcuguagaagguc

SEQ ID NO: 511200 - RNA, 22 nt, Human
gagggcugaagauuguggcccc

SEQ ID NO: 511201 - RNA, 22 nt, Human
agcacagagcucggggaaugga

SEQ ID NO: 511202 - RNA, 22 nt, Human
uggcccugccacucacugcuga

SEQ ID NO: 511203 - RNA, 22 nt, Human
agauguggccggcuagggagag

SEQ ID NO: 511204 - RNA, 22 nt, Human
ucuguagcaagugagaggcauu

SEQ ID NO: 511205 - RNA, 22 nt, Human
cagccugcauuuguaucuguau

SEQ ID NO: 511206 - RNA, 22 nt, Human
gggccacacagaaccuccuggu

SEQ ID NO: 511207 - RNA, 22 nt, Human
uuaaaugaugcauaucauuuag

SEQ ID NO: 511208 - RNA, 21 nt, Human
uuacaaagcuacagauguugc

SEQ ID NO: 511209 - RNA, 22 nt, Human
aaggucuggaugaugggugugc

SEQ ID NO: 511210 - RNA, 22 nt, Human
ugaccaaagaguugcuuguauu

SEQ ID NO: 511211 - RNA, 22 nt, Human
aacacagcuaauuucugucaau

SEQ ID NO: 511212 - RNA, 22 nt, Human
cccugccugugggcaucaacau

SEQ ID NO: 511213 - RNA, 22 nt, Human
uacaaauggguuaaaauauagu

SEQ ID NO: 511214 - RNA, 22 nt, Human
uuucgagggccuuaaguauucc

SEQ ID NO: 511215 - RNA, 22 nt, Human
cauaauuucuguaucagcacca

SEQ ID NO: 511216 - RNA, 22 nt, Human
agcugcccuggcggagcugcuc

SEQ ID NO: 511217 - RNA, 22 nt, Human
gggcuggagccagcuguggcug

SEQ ID NO: 511218 - RNA, 22 nt, Human
ugaaggagggaagaaggcucug

SEQ ID NO: 511219 - RNA, 22 nt, Human
agggcagagaaauguaguugag

SEQ ID NO: 511220 - RNA, 22 nt, Human
aagcccaguuucacacugagac

SEQ ID NO: 511221 - RNA, 22 nt, Human
gcaggcucagagcagauuagca

SEQ ID NO: 511222 - RNA, 22 nt, Human
ugucugaaagaggacgagcugg

SEQ ID NO: 511223 - RNA, 22 nt, Human
guccucugucccuggggcacgg

SEQ ID NO: 511224 - RNA, 22 nt, Human
uuagucuucuuccuuauauguu

SEQ ID NO: 511225 - RNA, 22 nt, Human
uaaagcaggccacauaugugau

SEQ ID NO: 511226 - RNA, 22 nt, Human
gccuggagggucccucucugga

SEQ ID NO: 511227 - RNA, 22 nt, Human
ccugggcuugguuguugagaac

SEQ ID NO: 511228 - RNA, 22 nt, Human
guuuacauauuuuaauugguga

SEQ ID NO: 511229 - RNA, 22 nt, Human
gaggcacugcaguacagugacu

SEQ ID NO: 511230 - RNA, 22 nt, Human
ccagagcuccagggcuacagaa

SEQ ID NO: 511231 - RNA, 22 nt, Human
auacaucuuccuuuuaaaaugc

SEQ ID NO: 511232 - RNA, 22 nt, Human
acauuuaaauaugccuuauauu

SEQ ID NO: 511233 - RNA, 22 nt, Human
aacacuguggucuuuucaguaa

SEQ ID NO: 511234 - RNA, 22 nt, Human
uagcauuuggcaccaguuauuu

SEQ ID NO: 511235 - RNA, 22 nt, Human
aguuuuaugcaguguucugaua

SEQ ID NO: 511236 - RNA, 22 nt, Human
aaggaaaucuuuguaacaucuu

SEQ ID NO: 511237 - RNA, 22 nt, Human
caaaugaugcauggcuagugag

SEQ ID NO: 511238 - RNA, 20 nt, Human
ccuccaggcacacccaugug

SEQ ID NO: 511239 - RNA, 22 nt, Human
gagggcugauaacaggaauaca

SEQ ID NO: 511240 - RNA, 22 nt, Human
cuggaggcacccuuagagaggc

SEQ ID NO: 511241 - RNA, 22 nt, Human
uugugguuaaccgcacauuuuu

SEQ ID NO: 511242 - RNA, 22 nt, Human
ucaccagucuuucuuaccauug

SEQ ID NO: 511243 - RNA, 22 nt, Human
caggcagccaggggaccugucc

SEQ ID NO: 511244 - RNA, 22 nt, Human
ugcucacugaacucuugcuguc

SEQ ID NO: 511245 - RNA, 22 nt, Human
cagagccaggccugcccucuuu

SEQ ID NO: 511246 - RNA, 22 nt, Human
aaccuguucccugguccuugac

SEQ ID NO: 511247 - RNA, 22 nt, Human
cacacaugugugcagcuuagaa

SEQ ID NO: 511248 - RNA, 22 nt, Human
uccucagucagcuccguucuug

SEQ ID NO: 511249 - RNA, 22 nt, Human
guggcagggguauuccagcuga

SEQ ID NO: 511250 - RNA, 22 nt, Human
aaagcauagaauuagaguuagg

SEQ ID NO: 511251 - RNA, 22 nt, Human
ggcagcagaacuggcccuguau

SEQ ID NO: 511252 - RNA, 22 nt, Human
aggcucagauccuuguguccug

SEQ ID NO: 511253 - RNA, 17 nt, Human
cagcuuuaugcuacugu

SEQ ID NO: 511254 - RNA, 22 nt, Human
uucuaguucccucuggaaugua

SEQ ID NO: 511255 - RNA, 22 nt, Human
caaggagauaaaauguugagcu

SEQ ID NO: 511256 - RNA, 20 nt, Human
aggaagcugagauguagagg

SEQ ID NO: 511257 - RNA, 22 nt, Human
gccuggugguauccuggcaaga

SEQ ID NO: 511258 - RNA, 22 nt, Human
agucucugcaugaugcagcaca

SEQ ID NO: 511259 - RNA, 22 nt, Human
aauaaaugaacaaagcagguug

SEQ ID NO: 511260 - RNA, 20 nt, Human
aggcagcugggaaaugaggg

SEQ ID NO: 511261 - RNA, 22 nt, Human
agggcuggcaagggauugaaau

SEQ ID NO: 511262 - RNA, 22 nt, Human
ccaggucuuugacuaauaugcu

SEQ ID NO: 511263 - RNA, 22 nt, Human
gcgcagaguagcagagugcuga

SEQ ID NO: 511264 - RNA, 22 nt, Human
agcaaagacagggacgaccaag

SEQ ID NO: 511265 - RNA, 23 nt, Human
uccagcagagccuuccaggaggg

SEQ ID NO: 511266 - RNA, 22 nt, Human
cugugaauugaauaugacuaug

SEQ ID NO: 511267 - RNA, 22 nt, Human
gaaaagggcaagagagagggca

SEQ ID NO: 511268 - RNA, 22 nt, Human
cagagguauugcaaaagccuag

SEQ ID NO: 511269 - RNA, 22 nt, Human
gccaggcacaguucuaggugcu

SEQ ID NO: 511270 - RNA, 22 nt, Human
uuccaaaggaauggggagcuau

SEQ ID NO: 511271 - RNA, 22 nt, Human
uccugcaggccuguucccagua

SEQ ID NO: 511272 - RNA, 22 nt, Human
ggcagaggagcuggaaacaugg

SEQ ID NO: 511273 - RNA, 22 nt, Human
cugcugggaaggucugcucagu

SEQ ID NO: 511274 - RNA, 20 nt, Human
auuagcuuggagacaguggc

SEQ ID NO: 511275 - RNA, 22 nt, Human
uguccuggagacacaagguggu

SEQ ID NO: 511276 - RNA, 22 nt, Human
augggaugaacuugaucugcuu

SEQ ID NO: 511277 - RNA, 22 nt, Human
ucaaagucuaucuguaauuacu

SEQ ID NO: 511278 - RNA, 18 nt, Human
uguacaguuaugagcauu

SEQ ID NO: 511279 - RNA, 22 nt, Human
caugaguucaucugcuucucuu

SEQ ID NO: 511280 - RNA, 22 nt, Human
agacuguagggauagaggucuu

SEQ ID NO: 511281 - RNA, 22 nt, Human
guguccugggucucugauucuu

SEQ ID NO: 511282 - RNA, 22 nt, Human
cagacagaaggcuccuugaggu

SEQ ID NO: 511283 - RNA, 22 nt, Human
uuuuccugggcuuucuguguaa

SEQ ID NO: 511284 - RNA, 22 nt, Human
uacacauguuuggcaaguaugu

SEQ ID NO: 511285 - RNA, 22 nt, Human
ggcuuucuagaucuagcucugu

SEQ ID NO: 511286 - RNA, 22 nt, Human
uuccuggguugugcauuguaca

SEQ ID NO: 511287 - RNA, 22 nt, Human
uccaguggugguuugaagggca

SEQ ID NO: 511288 - RNA, 22 nt, Human
gcugauuauuacaugucugugg

SEQ ID NO: 511289 - RNA, 22 nt, Human
gaugguuugguaaaaguauguu

SEQ ID NO: 511290 - RNA, 22 nt, Human
cacacaugagucuccccauugg

SEQ ID NO: 511291 - RNA, 22 nt, Human
cugggguggugcaggccucaug

SEQ ID NO: 511292 - RNA, 22 nt, Human
acaggucugugugcacagugcu

SEQ ID NO: 511293 - RNA, 19 nt, Human
cuucagcaucuccggagcu

SEQ ID NO: 511294 - RNA, 22 nt, Human
cucuccuggggagcacacacac

SEQ ID NO: 511295 - RNA, 22 nt, Human
cgccucagccguggucaucuuc

SEQ ID NO: 511296 - RNA, 22 nt, Human
uccugagcccuguaggacccug

SEQ ID NO: 511297 - RNA, 22 nt, Human
aagggcaggugggcauuucugg

SEQ ID NO: 511298 - RNA, 22 nt, Human
ucccugugucuuccucuugccc

SEQ ID NO: 511299 - RNA, 22 nt, Human
gucccuggggaaucagcuggag

SEQ ID NO: 511300 - RNA, 22 nt, Human
uugcagcuucuugcaucagaaa

SEQ ID NO: 511301 - RNA, 22 nt, Human
caggagugcagguggugaggca

SEQ ID NO: 511302 - RNA, 22 nt, Human
aguguggcugcguagggcucuc

SEQ ID NO: 511303 - RNA, 22 nt, Human
ugcagagagauccucaggguuu

SEQ ID NO: 511304 - RNA, 22 nt, Human
accugggaggcagagguugcag

SEQ ID NO: 511305 - RNA, 22 nt, Human
aaaguucugggggagaagaacg

SEQ ID NO: 511306 - RNA, 22 nt, Human
uuagaaaugucacagaucugau

SEQ ID NO: 511307 - RNA, 22 nt, Human
gagcaggcauucuaguggcuga

SEQ ID NO: 511308 - RNA, 22 nt, Human
uugguuuacuaggauucaaauu

SEQ ID NO: 511309 - RNA, 22 nt, Human
ucuagagacaaaggaaggaggg

SEQ ID NO: 511310 - RNA, 22 nt, Human
gaccagagaaaggcacuggaag

SEQ ID NO: 511311 - RNA, 22 nt, Human
uggcuucuuuccacuguccugu

SEQ ID NO: 511312 - RNA, 22 nt, Human
guguggcccugcguccugaguc

SEQ ID NO: 511313 - RNA, 22 nt, Human
ggcagcugggucacaccgaucu

SEQ ID NO: 511314 - RNA, 22 nt, Human
ugccuggguugacucuuagcug

SEQ ID NO: 511315 - RNA, 22 nt, Human
ucuuguuuugaacucaucagga

SEQ ID NO: 511316 - RNA, 22 nt, Human
auguagcaucuauccugauaaa

SEQ ID NO: 511317 - RNA, 22 nt, Human
agcauuuaggagaauuugagaa

SEQ ID NO: 511318 - RNA, 21 nt, Human
ucuguucaaggaacuacggau

SEQ ID NO: 511319 - RNA, 22 nt, Human
cagucucucugaaguauuaaga

SEQ ID NO: 511320 - RNA, 22 nt, Human
ugcuuauuaaacaugcauauuc

SEQ ID NO: 511321 - RNA, 22 nt, Human
ugccacccagccaggaguggga

SEQ ID NO: 511322 - RNA, 22 nt, Human
uauggcaguuacccuugaugau

SEQ ID NO: 511323 - RNA, 22 nt, Human
cagagaaaaaauccugcucuca

SEQ ID NO: 511324 - RNA, 22 nt, Human
uauuuagaugcauuuggauugc

SEQ ID NO: 511325 - RNA, 22 nt, Human
ccuuucagaugggcauggaccg

SEQ ID NO: 511326 - RNA, 20 nt, Human
ccagcugagccaaggggaga

SEQ ID NO: 511327 - RNA, 22 nt, Human
uguaggaaaaacaaugaucugc

SEQ ID NO: 511328 - RNA, 22 nt, Human
uuccugggggcagcagucuuga

SEQ ID NO: 511329 - RNA, 22 nt, Human
cagccagguucaaguccuuaua

SEQ ID NO: 511330 - RNA, 22 nt, Human
ugucuguacaaauuuucugugu

SEQ ID NO: 511331 - RNA, 19 nt, Human
ccacacagugugcaauuua

SEQ ID NO: 511332 - RNA, 22 nt, Human
ccaguguugcauaggaugggga

SEQ ID NO: 511333 - RNA, 22 nt, Human
cccagcaggcauguugggagga

SEQ ID NO: 511334 - RNA, 22 nt, Human
gugcuuccccaagccacagccu

SEQ ID NO: 511335 - RNA, 22 nt, Human
acugucugcuggccccugguua

SEQ ID NO: 511336 - RNA, 21 nt, Human
acacaggaguuucuucuuucu

SEQ ID NO: 511337 - RNA, 22 nt, Human
uuucuaguccucaugcaucauu

SEQ ID NO: 511338 - RNA, 22 nt, Human
acaucucaugaaugauaaauca

SEQ ID NO: 511339 - RNA, 22 nt, Human
cugagagucagcuucuccuccu

SEQ ID NO: 511340 - RNA, 22 nt, Human
augaaugaaugagaguagguca

SEQ ID NO: 511341 - RNA, 22 nt, Human
uucacagggcagcagcugagcc

SEQ ID NO: 511342 - RNA, 22 nt, Human
uccaggcuaauuuugcauuguu

SEQ ID NO: 511343 - RNA, 22 nt, Human
cuguacagaguucugaguguac

SEQ ID NO: 511344 - RNA, 22 nt, Human
gccaagcuuggaaggaucaugg

SEQ ID NO: 511345 - RNA, 22 nt, Human
aaaagcucuuucugcuguagau

SEQ ID NO: 511346 - RNA, 22 nt, Human
cagcagcagagauacugguuuc

SEQ ID NO: 511347 - RNA, 22 nt, Human
aagauggaguaguguaaugguu

SEQ ID NO: 511348 - RNA, 22 nt, Human
uggacagcgaaagugccuggga

SEQ ID NO: 511349 - RNA, 22 nt, Human
cagagccaggguugcaccccug

SEQ ID NO: 511350 - RNA, 22 nt, Human
aggcccagacucagcggggcgg

SEQ ID NO: 511351 - RNA, 21 nt, Human
agacagcagauagucgaaagg

SEQ ID NO: 511352 - RNA, 22 nt, Human
aggcacugagaggcuguguugc

SEQ ID NO: 511353 - RNA, 22 nt, Human
ucucuggguugagaacuaggac

SEQ ID NO: 511354 - RNA, 22 nt, Human
ccugcacuaccuggggcugcug

SEQ ID NO: 511355 - RNA, 22 nt, Human
gcuccccagcuuagcccuggcu

SEQ ID NO: 511356 - RNA, 22 nt, Human
uagccgcuuaauuauuugguga

SEQ ID NO: 511357 - RNA, 22 nt, Human
ccuggcagguggcgcccucggc

SEQ ID NO: 511358 - RNA, 22 nt, Human
augugugccccuuuuacucuuu

SEQ ID NO: 511359 - RNA, 22 nt, Human
uggagggcgcuuagauggaggg

SEQ ID NO: 511360 - RNA, 22 nt, Human
aaauugcuauaugugaauguga

SEQ ID NO: 511361 - RNA, 22 nt, Human
augugucaauuuucaaaugcuu

SEQ ID NO: 511362 - RNA, 22 nt, Human
gggagccaaggagagaggccuu

SEQ ID NO: 511363 - RNA, 18 nt, Human
uggugaaggguggaggag

SEQ ID NO: 511364 - RNA, 22 nt, Human
cauaauaucuccgauuacuugc

SEQ ID NO: 511365 - RNA, 19 nt, Human
gggcuucugggaucaagag

SEQ ID NO: 511366 - RNA, 22 nt, Human
aggguauaaagagcaagcagaa

SEQ ID NO: 511367 - RNA, 22 nt, Human
gagggaaagguuaauacaugau

SEQ ID NO: 511368 - RNA, 22 nt, Human
gccugagagacccauggggcaa

SEQ ID NO: 511369 - RNA, 22 nt, Human
uuuccuaugauauucuaugugu

SEQ ID NO: 511370 - RNA, 22 nt, Human
aagcuggcaauuaucaaaacug

SEQ ID NO: 511371 - RNA, 22 nt, Human
gaggggcugggcagucccugga

SEQ ID NO: 511372 - RNA, 22 nt, Human
aauguacaucucaguguaguac

SEQ ID NO: 511373 - RNA, 22 nt, Human
caaaagaagcucuuggggcuag

SEQ ID NO: 511374 - RNA, 22 nt, Human
uaacaucuuuagcagcucgaac

SEQ ID NO: 511375 - RNA, 22 nt, Human
gaggaggaguauauauuagaau

SEQ ID NO: 511376 - RNA, 22 nt, Human
aauauagaaucacuuuccuuca

SEQ ID NO: 511377 - RNA, 21 nt, Human
ucacuuauaauguauuugcug

SEQ ID NO: 511378 - RNA, 22 nt, Human
ggggaccugggcuucaaggguu

SEQ ID NO: 511379 - RNA, 22 nt, Human
acagagcuaaauuucaauccca

SEQ ID NO: 511380 - RNA, 22 nt, Human
gcugggcucuuaucaccuguac

SEQ ID NO: 511381 - RNA, 22 nt, Human
uagcaguuaaucugagccaaga

SEQ ID NO: 511382 - RNA, 22 nt, Human
ucucuaguugaggacugagcag

SEQ ID NO: 511383 - RNA, 22 nt, Human
augagcugggccauccagugau

SEQ ID NO: 511384 - RNA, 22 nt, Human
aaaggaaaauaaguaguuccau

SEQ ID NO: 511385 - RNA, 22 nt, Human
ugaucagucccaugaucuucca

SEQ ID NO: 511386 - RNA, 22 nt, Human
ccugagccgagcgcucuuucuc

SEQ ID NO: 511387 - RNA, 20 nt, Human
acacaugugcguguucagua

SEQ ID NO: 511388 - RNA, 22 nt, Human
uuuauuauagugguggggacug

SEQ ID NO: 511389 - RNA, 22 nt, Human
cagggcuuggaucuguggucag

SEQ ID NO: 511390 - RNA, 23 nt, Human
ugggaccuguuugcccacagaug

SEQ ID NO: 511391 - RNA, 22 nt, Human
aagggcuggcccugggaagagu

SEQ ID NO: 511392 - RNA, 22 nt, Human
ccagagaguaucauggagagua

SEQ ID NO: 511393 - RNA, 22 nt, Human
augcccugggagugcuguacca

SEQ ID NO: 511394 - RNA, 22 nt, Human
ucaaaguaaaaguauagaguuu

SEQ ID NO: 511395 - RNA, 22 nt, Human
ccacagaauucugucuccagga

SEQ ID NO: 511396 - RNA, 22 nt, Human
gaauuugucccuugauauaaaa

SEQ ID NO: 511397 - RNA, 22 nt, Human
ggcaucuguccaucucuccagc

SEQ ID NO: 511398 - RNA, 22 nt, Human
ggcaggguggcagaggcucaga

SEQ ID NO: 511399 - RNA, 23 nt, Human
agcuccaggugauuguaaugugu

SEQ ID NO: 511400 - RNA, 22 nt, Human
agagcagcguuuguggaacacu

SEQ ID NO: 511401 - RNA, 22 nt, Human
agcuuaaacucuuugaaguuau

SEQ ID NO: 511402 - RNA, 22 nt, Human
uagggacacugcucaugaguuc

SEQ ID NO: 511403 - RNA, 21 nt, Human
ugcccacagcaaaugcagagg

SEQ ID NO: 511404 - RNA, 22 nt, Human
aaaagucugcucucauuucaga

SEQ ID NO: 511405 - RNA, 22 nt, Human
uugaaucucuugaaucucuguu

SEQ ID NO: 511406 - RNA, 22 nt, Human
uuuaauuuuccucuuccuggag

SEQ ID NO: 511407 - RNA, 22 nt, Human
acaggccucaagacacccaggu

SEQ ID NO: 511408 - RNA, 22 nt, Human
aguguucacucuguggagccca

SEQ ID NO: 511409 - RNA, 22 nt, Human
gcugggcugagaaguuaagcaa

SEQ ID NO: 511410 - RNA, 22 nt, Human
cagagccaacgccaccugccca

SEQ ID NO: 511411 - RNA, 21 nt, Human
aagcaggacauaugaugcccu

SEQ ID NO: 511412 - RNA, 22 nt, Human
uuucacaaagcauagcacuuua

SEQ ID NO: 511413 - RNA, 22 nt, Human
ggcucugggugugaccuugggu

SEQ ID NO: 511414 - RNA, 22 nt, Human
ggguccagacacuccagaggaa

SEQ ID NO: 511415 - RNA, 17 nt, Human
cgagggcuugcuggcuc

SEQ ID NO: 511416 - RNA, 22 nt, Human
uagaaucaagcaguagagcaga

SEQ ID NO: 511417 - RNA, 22 nt, Human
uugugaaauguuucaaaauagu

SEQ ID NO: 511418 - RNA, 22 nt, Human
guauccuuugcggaaauuucua

SEQ ID NO: 511419 - RNA, 22 nt, Human
ugggccacugcuccaaguagcu

SEQ ID NO: 511420 - RNA, 22 nt, Human
acacacuugcagagaggaggga

SEQ ID NO: 511421 - RNA, 22 nt, Human
augcccuggacuagcuauacuu

SEQ ID NO: 511422 - RNA, 22 nt, Human
uccuggcuucugucuccuuauu

SEQ ID NO: 511423 - RNA, 22 nt, Human
agagacaggguuuugccauguu

SEQ ID NO: 511424 - RNA, 22 nt, Human
ucacgagaggcacagaauagag

SEQ ID NO: 511425 - RNA, 22 nt, Human
aaguaugacauuuaagacaauu

SEQ ID NO: 511426 - RNA, 22 nt, Human
uacaguagucgucuuauuuuga

SEQ ID NO: 511427 - RNA, 22 nt, Human
cccucccaagcacucugacaua

SEQ ID NO: 511428 - RNA, 22 nt, Human
uuuucugccugcguguuuagga

SEQ ID NO: 511429 - RNA, 22 nt, Human
uccagaguuguaaguguugaca

SEQ ID NO: 511430 - RNA, 22 nt, Human
gcccagcaggggauggcagcuc

SEQ ID NO: 511431 - RNA, 22 nt, Human
ucaggucuugagccaucaggau

SEQ ID NO: 511432 - RNA, 22 nt, Human
gagggcugcuggaaaaaugcag

SEQ ID NO: 511433 - RNA, 22 nt, Human
acagagccacuuuggugccuac

SEQ ID NO: 511434 - RNA, 22 nt, Human
agagcagcuggggcagagacca

SEQ ID NO: 511435 - RNA, 20 nt, Human
caaaagcaaugaaguuauga

SEQ ID NO: 511436 - RNA, 22 nt, Human
gcucagagcuugaaguuccacu

SEQ ID NO: 511437 - RNA, 22 nt, Human
cugggccuugccuugcccacag

SEQ ID NO: 511438 - RNA, 22 nt, Human
cccuccaugagugugcugcugg

SEQ ID NO: 511439 - RNA, 22 nt, Human
cuggucccugcagugugcuggg

SEQ ID NO: 511440 - RNA, 22 nt, Human
ugccugccaaugaugcuugugu

SEQ ID NO: 511441 - RNA, 22 nt, Human
ucaaaaguuucacauagagaua

SEQ ID NO: 511442 - RNA, 22 nt, Human
guuuacaguggcuucauuggau

SEQ ID NO: 511443 - RNA, 22 nt, Human
uuucuuuugcccuguggguuag

SEQ ID NO: 511444 - RNA, 22 nt, Human
ccuggcucuguccucgcgcaaa

SEQ ID NO: 511445 - RNA, 22 nt, Human
uccagaggcaaaaagguaugga

SEQ ID NO: 511446 - RNA, 22 nt, Human
ccugaggcaaggacuugguggc

SEQ ID NO: 511447 - RNA, 22 nt, Human
cugcccuguccuucccgccggc

SEQ ID NO: 511448 - RNA, 22 nt, Human
ccuuccuggagcccaugcagau

SEQ ID NO: 511449 - RNA, 22 nt, Human
uugggguacgcaggucugggag

SEQ ID NO: 511450 - RNA, 22 nt, Human
uugcauaaaugcuuaaaauuug

SEQ ID NO: 511451 - RNA, 22 nt, Human
gagcucagcccaaagagcagug

SEQ ID NO: 511452 - RNA, 22 nt, Human
ugcaauaaagugcuauaaaucc

SEQ ID NO: 511453 - RNA, 22 nt, Human
ccugcucugguuuagucagucu

SEQ ID NO: 511454 - RNA, 17 nt, Human
ucuguucaugcauaccu

SEQ ID NO: 511455 - RNA, 22 nt, Human
uucaguuuugcuuuuaaucaug

SEQ ID NO: 511456 - RNA, 18 nt, Human
agcagcugugccacacug

SEQ ID NO: 511457 - RNA, 22 nt, Human
agaguuucuugugagcacugac

SEQ ID NO: 511458 - RNA, 22 nt, Human
agaauccugaugaaaaggagag

SEQ ID NO: 511459 - RNA, 22 nt, Human
uguaaagagaaugguauaugga

SEQ ID NO: 511460 - RNA, 22 nt, Human
cauggccacaugauaaucaagu

SEQ ID NO: 511461 - RNA, 22 nt, Human
aggagccaugagugacaucaca

SEQ ID NO: 511462 - RNA, 22 nt, Human
ugccuccuucaggagggcccgg

SEQ ID NO: 511463 - RNA, 22 nt, Human
caaauucacaugauugcuucug

SEQ ID NO: 511464 - RNA, 19 nt, Human
ucaucucacagggccuggc

SEQ ID NO: 511465 - RNA, 22 nt, Human
gaggcagugucgguggcaggau

SEQ ID NO: 511466 - RNA, 22 nt, Human
cccuggcagaaugucucugggc

SEQ ID NO: 511467 - RNA, 21 nt, Human
ugcauaaagaaauacaaauac

SEQ ID NO: 511468 - RNA, 22 nt, Human
acguuugcuuucuuuggccugg

SEQ ID NO: 511469 - RNA, 22 nt, Human
cuggcugguucccugcuccagg

SEQ ID NO: 511470 - RNA, 22 nt, Human
caucagcagucacaugaugcug

SEQ ID NO: 511471 - RNA, 22 nt, Human
acuuucucaggaauucacagac

SEQ ID NO: 511472 - RNA, 22 nt, Human
aucuggcuauuucuggucgggg

SEQ ID NO: 511473 - RNA, 22 nt, Human
cugggaggauucauugagguga

SEQ ID NO: 511474 - RNA, 22 nt, Human
aauuagggaaguauuuaguagu

SEQ ID NO: 511475 - RNA, 23 nt, Human
cagugugacgaggugaggcaggc

SEQ ID NO: 511476 - RNA, 22 nt, Human
gucucagagagcuacucucuua

SEQ ID NO: 511477 - RNA, 22 nt, Human
uggcaggugccaugggcucaga

SEQ ID NO: 511478 - RNA, 22 nt, Human
aucugacaaccuauugacuuga

SEQ ID NO: 511479 - RNA, 18 nt, Human
agugugugcccuuucagg

SEQ ID NO: 511480 - RNA, 19 nt, Human
caagugaagccugggaugg

SEQ ID NO: 511481 - RNA, 22 nt, Human
uuaugggagcaauuggggaggu

SEQ ID NO: 511482 - RNA, 22 nt, Human
ugcuggcauuucaggacucacc

SEQ ID NO: 511483 - RNA, 22 nt, Human
cauuucugauuacagaauacua

SEQ ID NO: 511484 - RNA, 22 nt, Human
ggaggggaugguuugacccugg

SEQ ID NO: 511485 - RNA, 22 nt, Human
uggccuggcagagcaaggccug

SEQ ID NO: 511486 - RNA, 22 nt, Human
caggugccucaggaugagacaa

SEQ ID NO: 511487 - RNA, 22 nt, Human
uacagcuuuagcaaauuaccua

SEQ ID NO: 511488 - RNA, 22 nt, Human
aauuagagaucaguucuuugac

SEQ ID NO: 511489 - RNA, 22 nt, Human
uauagagguggaaacugagguu

SEQ ID NO: 511490 - RNA, 22 nt, Human
uggaaggggccaggcgcggagu

SEQ ID NO: 511491 - RNA, 22 nt, Human
uguaugaaguuacugagccucu

SEQ ID NO: 511492 - RNA, 22 nt, Human
aaagacauggaacuagagaugg

SEQ ID NO: 511493 - RNA, 20 nt, Human
uuucagugguuugugccuag

SEQ ID NO: 511494 - RNA, 22 nt, Human
gccaggcaugggcuucugggcg

SEQ ID NO: 511495 - RNA, 22 nt, Human
cagaccaucuugaagcaaacug

SEQ ID NO: 511496 - RNA, 22 nt, Human
auguguucacgugcacaugugc

SEQ ID NO: 511497 - RNA, 22 nt, Human
gaauuguagagggaacagaagc

SEQ ID NO: 511498 - RNA, 22 nt, Human
ccagcuaggcuugcacucuugu

SEQ ID NO: 511499 - RNA, 22 nt, Human
gcacuaguucuacugccagcaa

SEQ ID NO: 511500 - RNA, 22 nt, Human
ccagccuggggaggcagcuucu

SEQ ID NO: 511501 - RNA, 22 nt, Human
gcuguucauuagaaauagaaug

SEQ ID NO: 511502 - RNA, 22 nt, Human
acuguacaugcaucuugucuau

SEQ ID NO: 511503 - RNA, 22 nt, Human
ucuauaaauuaugcagucucag

SEQ ID NO: 511504 - RNA, 22 nt, Human
ccugggaggcuguuuccagccu

SEQ ID NO: 511505 - RNA, 18 nt, Human
acaggccucaguccugca

SEQ ID NO: 511506 - RNA, 19 nt, Human
cuccaaguuaagagggagg

SEQ ID NO: 511507 - RNA, 22 nt, Human
cuuccucuguguccugggcuug

SEQ ID NO: 511508 - RNA, 22 nt, Human
uggagcugccuggcaccuacag

SEQ ID NO: 511509 - RNA, 22 nt, Human
aaagaaggaccuggaggaggau

SEQ ID NO: 511510 - RNA, 22 nt, Human
cuucugcaauaaguuuuggucc

SEQ ID NO: 511511 - RNA, 22 nt, Human
aagaacagauucagccugaacu

SEQ ID NO: 511512 - RNA, 22 nt, Human
guuucuuuugugaucaccaacc

SEQ ID NO: 511513 - RNA, 22 nt, Human
cuuccuaaaagcuucaagagaa

SEQ ID NO: 511514 - RNA, 22 nt, Human
aucaggaugcugucaguuacca

SEQ ID NO: 511515 - RNA, 22 nt, Human
gaggggcucuuuaauaguaaca

SEQ ID NO: 511516 - RNA, 22 nt, Human
uggcgucucucauaaguaugug

SEQ ID NO: 511517 - RNA, 22 nt, Human
ccuuuggcugcauagggaaggg

SEQ ID NO: 511518 - RNA, 22 nt, Human
cuguguuucugagaagugggga

SEQ ID NO: 511519 - RNA, 20 nt, Human
cuucaggacccauccucccc

SEQ ID NO: 511520 - RNA, 22 nt, Human
cgggcuggcugcagcugcugga

SEQ ID NO: 511521 - RNA, 22 nt, Human
uuugcauuucucguaaggaaac

SEQ ID NO: 511522 - RNA, 22 nt, Human
agaguucacacucagugcaccc

SEQ ID NO: 511523 - RNA, 22 nt, Human
ucucagggcagcaaggaagcau

SEQ ID NO: 511524 - RNA, 22 nt, Human
gcagugccuugcuucucugucu

SEQ ID NO: 511525 - RNA, 22 nt, Human
gaagagagagcccugggguccg

SEQ ID NO: 511526 - RNA, 22 nt, Human
gaaauaaccucaugcaccauga

SEQ ID NO: 511527 - RNA, 22 nt, Human
ucucacugcaaauauuauguau

SEQ ID NO: 511528 - RNA, 22 nt, Human
uuaugacauaugaguacaagua

SEQ ID NO: 511529 - RNA, 22 nt, Human
caggccucuuccaugcagcagc

SEQ ID NO: 511530 - RNA, 22 nt, Human
caaaaguaauuaugguuuuugc

SEQ ID NO: 511531 - RNA, 22 nt, Human
ucugccagugguuuggcccuga

SEQ ID NO: 511532 - RNA, 22 nt, Human
uuaugacaggaaaaucacagaa

SEQ ID NO: 511533 - RNA, 22 nt, Human
gcugucuggguugagggcccug

SEQ ID NO: 511534 - RNA, 22 nt, Human
aaauuuucucucuaagacuuaa

SEQ ID NO: 511535 - RNA, 22 nt, Human
uagagcugcuggacuguaacag

SEQ ID NO: 511536 - RNA, 22 nt, Human
aggcacuguggguguggccgga

SEQ ID NO: 511537 - RNA, 22 nt, Human
uuucaguggguuuauuucaugu

SEQ ID NO: 511538 - RNA, 22 nt, Human
gcuggccucuggagaagggcuu

SEQ ID NO: 511539 - RNA, 20 nt, Human
aaacauucauguacaaguga

SEQ ID NO: 511540 - RNA, 22 nt, Human
acacacaugccuuuccuaagua

SEQ ID NO: 511541 - RNA, 22 nt, Human
cugugcuugcggguguggagcc

SEQ ID NO: 511542 - RNA, 22 nt, Human
cucucuggaauuaaagcccaau

SEQ ID NO: 511543 - RNA, 22 nt, Human
cugggggcagcaagaagccaug

SEQ ID NO: 511544 - RNA, 22 nt, Human
ccugccugcaccuucucugggg

SEQ ID NO: 511545 - RNA, 22 nt, Human
ggauggagguucucagaugcuc

SEQ ID NO: 511546 - RNA, 22 nt, Human
gggaucugauuuaggaugggag

SEQ ID NO: 511547 - RNA, 22 nt, Human
acucaggaaaugaagacugguu

SEQ ID NO: 511548 - RNA, 22 nt, Human
cccagcuugucugauucagccu

SEQ ID NO: 511549 - RNA, 21 nt, Human
aaaaaugaaguuguucaggaa

SEQ ID NO: 511550 - RNA, 22 nt, Human
cugggccacaucagaugaagac

SEQ ID NO: 511551 - RNA, 22 nt, Human
cugcccugauaugauuuagaac

SEQ ID NO: 511552 - RNA, 22 nt, Human
cuccugggcuaugucugcuugg

SEQ ID NO: 511553 - RNA, 22 nt, Human
aaagagaaaaagaucccggcuc

SEQ ID NO: 511554 - RNA, 22 nt, Human
gggcuacagacaugcucuaagc

SEQ ID NO: 511555 - RNA, 22 nt, Human
uggaacacuguggaugagaaga

SEQ ID NO: 511556 - RNA, 22 nt, Human
aguguucaggaucugaggccag

SEQ ID NO: 511557 - RNA, 22 nt, Human
auuaaauuggaucugcauaguu

SEQ ID NO: 511558 - RNA, 21 nt, Human
aggcagaaagagcccaggcug

SEQ ID NO: 511559 - RNA, 22 nt, Human
gcugcucugggucugcccagcu

SEQ ID NO: 511560 - RNA, 22 nt, Human
agguggggugagcugcagacua

SEQ ID NO: 511561 - RNA, 22 nt, Human
caggaacaacucccagcaucuc

SEQ ID NO: 511562 - RNA, 22 nt, Human
cauaauuauaaacgcaaguuca

SEQ ID NO: 511563 - RNA, 20 nt, Human
cugaaccaaggcuuucucag

SEQ ID NO: 511564 - RNA, 23 nt, Human
agacuggggcauaagaagauggc

SEQ ID NO: 511565 - RNA, 22 nt, Human
aagaaguuagguguaacaauau

SEQ ID NO: 511566 - RNA, 22 nt, Human
gaagccucaacaucucugcguc

SEQ ID NO: 511567 - RNA, 22 nt, Human
uauuugucacugcacuugaaau

SEQ ID NO: 511568 - RNA, 22 nt, Human
uacaaauguauuuuauuuuggu

SEQ ID NO: 511569 - RNA, 22 nt, Human
ugcacacauguuuacaagcauc

SEQ ID NO: 511570 - RNA, 22 nt, Human
uggcucagagagggagugugga

SEQ ID NO: 511571 - RNA, 21 nt, Human
uggagcugccacuuguccucc

SEQ ID NO: 511572 - RNA, 22 nt, Human
aaacaucaauugcaucucccaa

SEQ ID NO: 511573 - RNA, 22 nt, Human
uggccucagauuucaggggugg

SEQ ID NO: 511574 - RNA, 23 nt, Human
aguacauucgaaaaauucuguga

SEQ ID NO: 511575 - RNA, 22 nt, Human
uagagcuggccgggacagcugg

SEQ ID NO: 511576 - RNA, 22 nt, Human
acaaggaccaugaggcagaccc

SEQ ID NO: 511577 - RNA, 22 nt, Human
cuggcagguuuggugucuggug

SEQ ID NO: 511578 - RNA, 22 nt, Human
gcucccuguucucagccaugau

SEQ ID NO: 511579 - RNA, 22 nt, Human
ccuuggcccuagccucaggcaa

SEQ ID NO: 511580 - RNA, 22 nt, Human
gacauaaaccuugagauauuaa

SEQ ID NO: 511581 - RNA, 22 nt, Human
auucaguucuaaggucagugcc

SEQ ID NO: 511582 - RNA, 22 nt, Human
uuaacagagaacauagaaguag

SEQ ID NO: 511583 - RNA, 17 nt, Human
aagauuucauuagcuga

SEQ ID NO: 511584 - RNA, 22 nt, Human
gcucccagauuucagccuugug

SEQ ID NO: 511585 - RNA, 22 nt, Human
uggcagggucuugcuguguugc

SEQ ID NO: 511586 - RNA, 22 nt, Human
cugaaggaagcagguggccugu

SEQ ID NO: 511587 - RNA, 22 nt, Human
ggagcagagcauuucacagccu

SEQ ID NO: 511588 - RNA, 22 nt, Human
gccacaugcaauugcagcacgu

SEQ ID NO: 511589 - RNA, 22 nt, Human
gccaggcauucuagaaguagug

SEQ ID NO: 511590 - RNA, 22 nt, Human
aagaccuugucuaaacauguag

SEQ ID NO: 511591 - RNA, 22 nt, Human
aucuguguguucaggaaguccu

SEQ ID NO: 511592 - RNA, 22 nt, Human
agcagcucuguuuaccuggagg

SEQ ID NO: 511593 - RNA, 22 nt, Human
gcucaagagagaugcaguucuu

SEQ ID NO: 511594 - RNA, 22 nt, Human
guuugcauguguacuuaauugg

SEQ ID NO: 511595 - RNA, 22 nt, Human
cccugcagaucagugagaacuu

SEQ ID NO: 511596 - RNA, 22 nt, Human
uuggcuucaaugucagagacag

SEQ ID NO: 511597 - RNA, 22 nt, Human
caguaaauaguggagauguggg

SEQ ID NO: 511598 - RNA, 22 nt, Human
ggaggagcacuucugagcucag

SEQ ID NO: 511599 - RNA, 22 nt, Human
uucuuuuuaaaguguguaugca

SEQ ID NO: 511600 - RNA, 22 nt, Human
aaacaucauaggcaugcaugau

SEQ ID NO: 511601 - RNA, 22 nt, Human
ccucggagaaaggcagcuccac

SEQ ID NO: 511602 - RNA, 22 nt, Human
ucagugcuuuugagaagcuccu

SEQ ID NO: 511603 - RNA, 23 nt, Human
ucccuggaggcagguccagggcc

SEQ ID NO: 511604 - RNA, 22 nt, Human
guccuucagcaccucccucggc

SEQ ID NO: 511605 - RNA, 22 nt, Human
ccucuggucccagcucugcugc

SEQ ID NO: 511606 - RNA, 22 nt, Human
acucuggggugaugucucugag

SEQ ID NO: 511607 - RNA, 22 nt, Human
acuguaaauuuugguugcaggu

SEQ ID NO: 511608 - RNA, 22 nt, Human
ccugggcuuucggcggcuuccu

SEQ ID NO: 511609 - RNA, 22 nt, Human
ucacagaauaaauugagaagac

SEQ ID NO: 511610 - RNA, 22 nt, Human
aucuggcucgcuaggcucuggg

SEQ ID NO: 511611 - RNA, 22 nt, Human
uuugcauuugcaaauaaugaaa

SEQ ID NO: 511612 - RNA, 17 nt, Human
uugcccugauuuuuaac

SEQ ID NO: 511613 - RNA, 18 nt, Human
gccugccagccgagggac

SEQ ID NO: 511614 - RNA, 22 nt, Human
ccuggagcacucucccuggcug

SEQ ID NO: 511615 - RNA, 19 nt, Human
ugaagcagcaaacucucag

SEQ ID NO: 511616 - RNA, 22 nt, Human
aguggcugagugacugugacuc

SEQ ID NO: 511617 - RNA, 22 nt, Human
gcuccugcaggacccaggagac

SEQ ID NO: 511618 - RNA, 22 nt, Human
ccugggcaacauagugagaccc

SEQ ID NO: 511619 - RNA, 22 nt, Human
gccaccuggacucagagccagg

SEQ ID NO: 511620 - RNA, 22 nt, Human
agccucugauggcucccaagga

SEQ ID NO: 511621 - RNA, 22 nt, Human
agaaagggagcguggaucaauu

SEQ ID NO: 511622 - RNA, 22 nt, Human
uugguuccuucugaaaguauug

SEQ ID NO: 511623 - RNA, 22 nt, Human
agagccugcuaccucauuccag

SEQ ID NO: 511624 - RNA, 22 nt, Human
ccacccagaccagggaucuggg

SEQ ID NO: 511625 - RNA, 22 nt, Human
auuguauuuccagcuugaaugu

SEQ ID NO: 511626 - RNA, 22 nt, Human
agggcuccuccccggccuccac

SEQ ID NO: 511627 - RNA, 21 nt, Human
gugcccuguucccacaugccc

SEQ ID NO: 511628 - RNA, 20 nt, Human
gagcagcuguuugcauugca

SEQ ID NO: 511629 - RNA, 22 nt, Human
uuugugacuugcuucucagaau

SEQ ID NO: 511630 - RNA, 22 nt, Human
gguguucaaaugaacacaugca

SEQ ID NO: 511631 - RNA, 22 nt, Human
gccugggauucccagaggggca

SEQ ID NO: 511632 - RNA, 22 nt, Human
uggcucaggguccccaaauggu

SEQ ID NO: 511633 - RNA, 22 nt, Human
aaguuuuaacaaguacuuacua

SEQ ID NO: 511634 - RNA, 22 nt, Human
agcuggaggauaacucacuucu

SEQ ID NO: 511635 - RNA, 22 nt, Human
ccagugugggcccggccuccuc

SEQ ID NO: 511636 - RNA, 19 nt, Human
uggcaugaugauggauggg

SEQ ID NO: 511637 - RNA, 22 nt, Human
ugcuuuauagacaaggaaguag

SEQ ID NO: 511638 - RNA, 22 nt, Human
augggggccugaacaggcaaaa

SEQ ID NO: 511639 - RNA, 22 nt, Human
aguuucacauagcucagugcuc

SEQ ID NO: 511640 - RNA, 22 nt, Human
caugaaagcaggaaugguuuua

SEQ ID NO: 511641 - RNA, 22 nt, Human
ugguccugcaguaauagacauc

SEQ ID NO: 511642 - RNA, 20 nt, Human
ucacacaugguaagcuauga

SEQ ID NO: 511643 - RNA, 22 nt, Human
aaagcuuuucaguauguucaug

SEQ ID NO: 511644 - RNA, 22 nt, Human
ggcugcaggcaggguauccacu

SEQ ID NO: 511645 - RNA, 22 nt, Human
uauugaguuacagaaaauacuu

SEQ ID NO: 511646 - RNA, 22 nt, Human
agaacagaggccuuauguuuca

SEQ ID NO: 511647 - RNA, 17 nt, Human
ucaggcugggugcagug

SEQ ID NO: 511648 - RNA, 22 nt, Human
aagcuguucucuaaguuucaug

SEQ ID NO: 511649 - RNA, 22 nt, Human
augacuucugcaaggucauuug

SEQ ID NO: 511650 - RNA, 22 nt, Human
uugcccugucucacuauguuaa

SEQ ID NO: 511651 - RNA, 22 nt, Human
uucagugucacaagagcaagcc

SEQ ID NO: 511652 - RNA, 22 nt, Human
accaggguugagucagcugcgu

SEQ ID NO: 511653 - RNA, 22 nt, Human
gccagagcugagacacgagucc

SEQ ID NO: 511654 - RNA, 22 nt, Human
caaguccuuuucuuggcucagg

SEQ ID NO: 511655 - RNA, 22 nt, Human
uggcuucagacuucugcuacgu

SEQ ID NO: 511656 - RNA, 22 nt, Human
uccagcucagaugcagggauca

SEQ ID NO: 511657 - RNA, 22 nt, Human
cuccauugaacauccucucaga

SEQ ID NO: 511658 - RNA, 22 nt, Human
ucuccucuccuuucauguuguu

SEQ ID NO: 511659 - RNA, 22 nt, Human
uaaggcauucucaugcugugaa

SEQ ID NO: 511660 - RNA, 22 nt, Human
caguauuuucaggauuuggaag

SEQ ID NO: 511661 - RNA, 22 nt, Human
agggucuguuguuuguucugga

SEQ ID NO: 511662 - RNA, 22 nt, Human
aaaaucaguacacuuuauuuug

SEQ ID NO: 511663 - RNA, 22 nt, Human
gggagcuguaguccagauaccg

SEQ ID NO: 511664 - RNA, 22 nt, Human
uggcagcacuugaacuugagcc

SEQ ID NO: 511665 - RNA, 22 nt, Human
uuuaaagaaauuccucaucuuu

SEQ ID NO: 511666 - RNA, 22 nt, Human
ugcagcugguaucccauggauu

SEQ ID NO: 511667 - RNA, 19 nt, Human
ccucugcgcuguccugcuc

SEQ ID NO: 511668 - RNA, 22 nt, Human
gcccagaaguugaggcugcagu

SEQ ID NO: 511669 - RNA, 22 nt, Human
acaggcugccuaccaaguauca

SEQ ID NO: 511670 - RNA, 22 nt, Human
gguggggccagggcuccaaccu

SEQ ID NO: 511671 - RNA, 22 nt, Human
ugacuucaaaggcucuacuccu

SEQ ID NO: 511672 - RNA, 22 nt, Human
uuggguaggagaaagaacagau

SEQ ID NO: 511673 - RNA, 17 nt, Human
ccagagcuacugagacu

SEQ ID NO: 511674 - RNA, 22 nt, Human
uccuagaauaaucuuugacugc

SEQ ID NO: 511675 - RNA, 22 nt, Human
caggccugacccugagcuucac

SEQ ID NO: 511676 - RNA, 20 nt, Human
uuugucuguuaaguguuucu

SEQ ID NO: 511677 - RNA, 23 nt, Human
uuuuaauuuggacauaagaagau

SEQ ID NO: 511678 - RNA, 18 nt, Human
aauuucuuugacaacuua

SEQ ID NO: 511679 - RNA, 22 nt, Human
ugcacacaguucucaggaaaga

SEQ ID NO: 511680 - RNA, 22 nt, Human
uggcagcagccauggaaggccc

SEQ ID NO: 511681 - RNA, 22 nt, Human
cuacagaggacacaaagaucuu

SEQ ID NO: 511682 - RNA, 22 nt, Human
uaaauagagaaucagcuuggag

SEQ ID NO: 511683 - RNA, 22 nt, Human
uggcuucucagaauacucugga

SEQ ID NO: 511684 - RNA, 21 nt, Human
ucuuuccugcccaguugcccu

SEQ ID NO: 511685 - RNA, 22 nt, Human
agggcuuuggcccccugcugca

SEQ ID NO: 511686 - RNA, 22 nt, Human
ccagcuccucuucccaguguca

SEQ ID NO: 511687 - RNA, 22 nt, Human
ugggagaggcugccaucuugca

SEQ ID NO: 511688 - RNA, 22 nt, Human
ucucagugguggcauuccagac

SEQ ID NO: 511689 - RNA, 22 nt, Human
aagugugauuuguagaaugccu

SEQ ID NO: 511690 - RNA, 22 nt, Human
gcgggcggggguucccaggucu

SEQ ID NO: 511691 - RNA, 22 nt, Human
ggcagcugauuagcaucaagga

SEQ ID NO: 511692 - RNA, 22 nt, Human
gcugaagcccacguggcuugua

SEQ ID NO: 511693 - RNA, 22 nt, Human
ugcauaaacagauacuucaugu

SEQ ID NO: 511694 - RNA, 22 nt, Human
caggcuggagugcagugucgcc

SEQ ID NO: 511695 - RNA, 22 nt, Human
gaaaauacuucaguguucuggc

SEQ ID NO: 511696 - RNA, 22 nt, Human
acagugucuccugguacccagu

SEQ ID NO: 511697 - RNA, 19 nt, Human
gcucagugaugccagacca

SEQ ID NO: 511698 - RNA, 22 nt, Human
agugggggccaacgagggcagc

SEQ ID NO: 511699 - RNA, 22 nt, Human
gggagggaucugcuaggcaaug

SEQ ID NO: 511700 - RNA, 22 nt, Human
ccuggccacccagccuuggcca

SEQ ID NO: 511701 - RNA, 22 nt, Human
ccagcccuugcugaaggguggc

SEQ ID NO: 511702 - RNA, 18 nt, Human
ucacagugcucuugccua

SEQ ID NO: 511703 - RNA, 22 nt, Human
uccuguuuuuguaaucgacucu

SEQ ID NO: 511704 - RNA, 22 nt, Human
uacauaguuccauuuacaggaa

SEQ ID NO: 511705 - RNA, 22 nt, Human
gccaggcacugcucuaagcccu

SEQ ID NO: 511706 - RNA, 22 nt, Human
aggcugggaaaccugaaguugu

SEQ ID NO: 511707 - RNA, 22 nt, Human
uuccaggaugcugcugcuuuuu

SEQ ID NO: 511708 - RNA, 22 nt, Human
caggaaggcgcggcugugccug

SEQ ID NO: 511709 - RNA, 22 nt, Human
gcugccaccguggagaugagug

SEQ ID NO: 511710 - RNA, 22 nt, Human
gucagugcuugaagggcagaga

SEQ ID NO: 511711 - RNA, 18 nt, Human
ccucagggagagagacgc

SEQ ID NO: 511712 - RNA, 22 nt, Human
ugcacagaucugguggcaagga

SEQ ID NO: 511713 - RNA, 22 nt, Human
acagguggaggcuuuaggaggu

SEQ ID NO: 511714 - RNA, 22 nt, Human
acacaggaagucagcacugaug

SEQ ID NO: 511715 - RNA, 22 nt, Human
cuguggcuuuuccggggagccu

SEQ ID NO: 511716 - RNA, 22 nt, Human
cugggccacaaaaaacuccugu

SEQ ID NO: 511717 - RNA, 22 nt, Human
uagaaacugauagucuugugcu

SEQ ID NO: 511718 - RNA, 22 nt, Human
uuuuuagaguguuaccaguaua

SEQ ID NO: 511719 - RNA, 22 nt, Human
uguccugugcacuguagcaugu

SEQ ID NO: 511720 - RNA, 22 nt, Human
uaacagaagagcaggcagcccu

SEQ ID NO: 511721 - RNA, 22 nt, Human
guuagggaucaggaacaagagc

SEQ ID NO: 511722 - RNA, 22 nt, Human
ugagagaggggacugccugcuu

SEQ ID NO: 511723 - RNA, 22 nt, Human
cccccuggcaggcuggccucuc

SEQ ID NO: 511724 - RNA, 22 nt, Human
gaaagaaugagcaucaugacuu

SEQ ID NO: 511725 - RNA, 22 nt, Human
agugaaauugcuguaagaggaa

SEQ ID NO: 511726 - RNA, 22 nt, Human
uuuauuauguacaggcacuaua

SEQ ID NO: 511727 - RNA, 22 nt, Human
cuggugaauggauaaacuguug

SEQ ID NO: 511728 - RNA, 22 nt, Human
gccaggcuccccggaucccugg

SEQ ID NO: 511729 - RNA, 22 nt, Human
cuuuaagacucugcucuuggug

SEQ ID NO: 511730 - RNA, 20 nt, Human
ucucccaggcucagggaaga

SEQ ID NO: 511731 - RNA, 22 nt, Human
aggcuggcuggcaggggacaca

SEQ ID NO: 511732 - RNA, 22 nt, Human
uaauuacagguccaaaacaauc

SEQ ID NO: 511733 - RNA, 22 nt, Human
uggcucagagccuugagagcug

SEQ ID NO: 511734 - RNA, 22 nt, Human
guuuccugaaauagaguacugg

SEQ ID NO: 511735 - RNA, 22 nt, Human
aaagugcuaggauuacaagcgu

SEQ ID NO: 511736 - RNA, 22 nt, Human
aagaguuuucuauaaucuuggc

SEQ ID NO: 511737 - RNA, 22 nt, Human
aacaaucaaguuucuaaaugac

SEQ ID NO: 511738 - RNA, 22 nt, Human
uuuccuucaucaucugagagcu

SEQ ID NO: 511739 - RNA, 22 nt, Human
aguauuuguggauuuguauugg

SEQ ID NO: 511740 - RNA, 22 nt, Human
uggccagauucaugcauguauc

SEQ ID NO: 511741 - RNA, 22 nt, Human
gcuggcaucacuggcuucggug

SEQ ID NO: 511742 - RNA, 22 nt, Human
gcacugccaucaaugcaugaca

SEQ ID NO: 511743 - RNA, 21 nt, Human
ugggcagauggcaguguggcu

SEQ ID NO: 511744 - RNA, 23 nt, Human
uuuauuuauuuaggcugagggau

SEQ ID NO: 511745 - RNA, 22 nt, Human
aaggagguuaucccaguggacu

SEQ ID NO: 511746 - RNA, 22 nt, Human
caucacagggggcuagaagucu

SEQ ID NO: 511747 - RNA, 22 nt, Human
aagcagagaccggcuaauggag

SEQ ID NO: 511748 - RNA, 22 nt, Human
uuguaaaguucuuaggaagcuc

SEQ ID NO: 511749 - RNA, 22 nt, Human
cugcccugucugcagccuggcu

SEQ ID NO: 511750 - RNA, 22 nt, Human
cagcacuggggggauucggagc

SEQ ID NO: 511751 - RNA, 22 nt, Human
ucuggcaucacucgcaagagca

SEQ ID NO: 511752 - RNA, 21 nt, Human
gggcagaggggccuccugggu

SEQ ID NO: 511753 - RNA, 22 nt, Human
uguccaaugcccuuuccacaug

SEQ ID NO: 511754 - RNA, 22 nt, Human
ucagugcuugacagcucuggga

SEQ ID NO: 511755 - RNA, 22 nt, Human
ggggcagagucuggacuguugu

SEQ ID NO: 511756 - RNA, 22 nt, Human
gaguaaggcugcugauggagug

SEQ ID NO: 511757 - RNA, 22 nt, Human
cuuccugcaggacagccaucug

SEQ ID NO: 511758 - RNA, 22 nt, Human
cugcagggcagaagggcauaga

SEQ ID NO: 511759 - RNA, 22 nt, Human
gcucuggggaugcuucugccgu

SEQ ID NO: 511760 - RNA, 22 nt, Human
aacuaaaucuggcauuuagagc

SEQ ID NO: 511761 - RNA, 22 nt, Human
ugaggccagcuucagcagugga

SEQ ID NO: 511762 - RNA, 22 nt, Human
ucaaagcacacuuagugguaga

SEQ ID NO: 511763 - RNA, 22 nt, Human
ugcagaagcagagaguugccaa

SEQ ID NO: 511764 - RNA, 22 nt, Human
ugaagguggcauaggagagaug

SEQ ID NO: 511765 - RNA, 22 nt, Human
uaugugaauacagcaguggaug

SEQ ID NO: 511766 - RNA, 22 nt, Human
ucuccucucuuaccugguacaa

SEQ ID NO: 511767 - RNA, 21 nt, Human
gcaggggauagaaauggucug

SEQ ID NO: 511768 - RNA, 22 nt, Human
accuucaaugaaaauaauaguc

SEQ ID NO: 511769 - RNA, 22 nt, Human
agauuuagacugccuuaaucau

SEQ ID NO: 511770 - RNA, 22 nt, Human
gcuguauuuaacaacuggcuca

SEQ ID NO: 511771 - RNA, 21 nt, Human
uucagcuuaugugucacuugc

SEQ ID NO: 511772 - RNA, 22 nt, Human
ggggcagaaguagugccccuga

SEQ ID NO: 511773 - RNA, 22 nt, Human
uggcuuccaaaggaaugggccu

SEQ ID NO: 511774 - RNA, 23 nt, Human
uggagaauuuagagucucuagga

SEQ ID NO: 511775 - RNA, 22 nt, Human
uaggcagggauuaggguugauu

SEQ ID NO: 511776 - RNA, 20 nt, Human
uacauucaaaacaaacucug

SEQ ID NO: 511777 - RNA, 22 nt, Human
ggccucugcaacuggcuguggc

SEQ ID NO: 511778 - RNA, 22 nt, Human
ggagugucagaaacaguguccu

SEQ ID NO: 511779 - RNA, 22 nt, Human
cugaggcucccucgggucugcu

SEQ ID NO: 511780 - RNA, 22 nt, Human
auaugagagaggaaagauuuua

SEQ ID NO: 511781 - RNA, 22 nt, Human
gccugcagaacugugaggcaau

SEQ ID NO: 511782 - RNA, 22 nt, Human
agcaauauaaauguuggguaga

SEQ ID NO: 511783 - RNA, 22 nt, Human
acccagccuacaaagcucaccu

SEQ ID NO: 511784 - RNA, 19 nt, Human
cgcagguggaaggagccgc

SEQ ID NO: 511785 - RNA, 22 nt, Human
ggagcuguuggcagcuaucuug

SEQ ID NO: 511786 - RNA, 22 nt, Human
acuguacacauucgucaagacu

SEQ ID NO: 511787 - RNA, 22 nt, Human
gguuugguuuuggccaucuucc

SEQ ID NO: 511788 - RNA, 17 nt, Human
ccucagcuucuuuccuc

SEQ ID NO: 511789 - RNA, 22 nt, Human
ucuuugaaguugaaguaguugg

SEQ ID NO: 511790 - RNA, 22 nt, Human
agggagcaugggugaagcaggc

SEQ ID NO: 511791 - RNA, 21 nt, Human
aguguguucuuggcauuaccu

SEQ ID NO: 511792 - RNA, 22 nt, Human
agaguuuacagaaauaagcugu

SEQ ID NO: 511793 - RNA, 22 nt, Human
aaagauucgagcgauguauaaa

SEQ ID NO: 511794 - RNA, 22 nt, Human
ggguccaggucuucaggcagag

SEQ ID NO: 511795 - RNA, 22 nt, Human
cuggggcugcggacgggagccc

SEQ ID NO: 511796 - RNA, 22 nt, Human
agagcuucacuggagagcacau

SEQ ID NO: 511797 - RNA, 20 nt, Human
cccuggagagaagcuccacg

SEQ ID NO: 511798 - RNA, 22 nt, Human
gggccugugcacaguucuguua

SEQ ID NO: 511799 - RNA, 22 nt, Human
gaauccaggguuguuugagcua

SEQ ID NO: 511800 - RNA, 22 nt, Human
caggagcuacucagguuggguu

SEQ ID NO: 511801 - RNA, 22 nt, Human
uauucacagcugccgcacucag

SEQ ID NO: 511802 - RNA, 22 nt, Human
ccugagucuguguuuuccuaag

SEQ ID NO: 511803 - RNA, 22 nt, Human
ucagcacugucuuuuauuugaa

SEQ ID NO: 511804 - RNA, 22 nt, Human
agccaugggcucccaguccuuu

SEQ ID NO: 511805 - RNA, 19 nt, Human
cacauacagaaaagaguaa

SEQ ID NO: 511806 - RNA, 22 nt, Human
gacagcagggacauguaggaag

SEQ ID NO: 511807 - RNA, 22 nt, Human
ugugaaggagaugaagggagug

SEQ ID NO: 511808 - RNA, 22 nt, Human
cuggccaggcuugggacagaca

SEQ ID NO: 511809 - RNA, 22 nt, Human
agaauguguuuuaacaugggaa

SEQ ID NO: 511810 - RNA, 22 nt, Human
acagcuggaggucugugagcac

SEQ ID NO: 511811 - RNA, 22 nt, Human
aaaauuuccaccaucuuugugu

SEQ ID NO: 511812 - RNA, 17 nt, Human
uuccucucacauuuuuu

SEQ ID NO: 511813 - RNA, 22 nt, Human
caguaaauuuuauuugugggug

SEQ ID NO: 511814 - RNA, 22 nt, Human
gucauuccuauccauuugauac

SEQ ID NO: 511815 - RNA, 22 nt, Human
acagucuugcuguauggucagg

SEQ ID NO: 511816 - RNA, 22 nt, Human
cucucugcuguauccuuaggcu

SEQ ID NO: 511817 - RNA, 22 nt, Human
gaagcagcagcuggggacaguu

SEQ ID NO: 511818 - RNA, 21 nt, Human
ucagcuuugcaacugcacauc

SEQ ID NO: 511819 - RNA, 22 nt, Human
gcuggccaguguggugaccacc

SEQ ID NO: 511820 - RNA, 22 nt, Human
uggcugagccuuuggggcuuuc

SEQ ID NO: 511821 - RNA, 22 nt, Human
ccauuugucaccucugcacucc

SEQ ID NO: 511822 - RNA, 22 nt, Human
uuuauuccaugugucuaugacc

SEQ ID NO: 511823 - RNA, 22 nt, Human
ugcucuggacgcugagugguuu

SEQ ID NO: 511824 - RNA, 22 nt, Human
ugaggcaguauucuccauucca

SEQ ID NO: 511825 - RNA, 22 nt, Human
uuguuucugaguuuucauguau

SEQ ID NO: 511826 - RNA, 22 nt, Human
caguccugaggaagagcugcug

SEQ ID NO: 511827 - RNA, 22 nt, Human
agcugccaucagccuuuggaug

SEQ ID NO: 511828 - RNA, 22 nt, Human
agccucucuccagcuuggcaga

SEQ ID NO: 511829 - RNA, 22 nt, Human
agggucccgaaggagacagcaa

SEQ ID NO: 511830 - RNA, 22 nt, Human
cuucucucccuggcacucagac

SEQ ID NO: 511831 - RNA, 22 nt, Human
cuuggcugucuauaggaaagag

SEQ ID NO: 511832 - RNA, 22 nt, Human
uccucagucucucaaaugaggc

SEQ ID NO: 511833 - RNA, 22 nt, Human
gcaggauggguguagcccagca

SEQ ID NO: 511834 - RNA, 17 nt, Human
ggcucugggugucacau

SEQ ID NO: 511835 - RNA, 22 nt, Human
acauaccauacauggugagaug

SEQ ID NO: 511836 - RNA, 22 nt, Human
guaaaugugcuucuuuuaacuu

SEQ ID NO: 511837 - RNA, 22 nt, Human
agaaucaaggugaagcccacag

SEQ ID NO: 511838 - RNA, 22 nt, Human
aaugaugguuaaacacuggagg

SEQ ID NO: 511839 - RNA, 22 nt, Human
uggaggaugccuggggaggccu

SEQ ID NO: 511840 - RNA, 22 nt, Human
ucauugucuugauaugauuguc

SEQ ID NO: 511841 - RNA, 20 nt, Human
ccaggcuggcaaaugggggc

SEQ ID NO: 511842 - RNA, 22 nt, Human
ugacagaaauaguucuuaauuu

SEQ ID NO: 511843 - RNA, 22 nt, Human
cugagccagagggagucggguc

SEQ ID NO: 511844 - RNA, 17 nt, Human
cccagcuggcagugccg

SEQ ID NO: 511845 - RNA, 21 nt, Human
aucuggaagaacugguaagug

SEQ ID NO: 511846 - RNA, 22 nt, Human
aagcccagcaucccugcaccag

SEQ ID NO: 511847 - RNA, 22 nt, Human
acugaguguaggacuuugaguu

SEQ ID NO: 511848 - RNA, 20 nt, Human
agagccuugaggaagaugau

SEQ ID NO: 511849 - RNA, 22 nt, Human
ccuguugucucuuccuguugac

SEQ ID NO: 511850 - RNA, 22 nt, Human
ugcucagggacaauggagaggg

SEQ ID NO: 511851 - RNA, 22 nt, Human
agggucuguggaugcaucuggg

SEQ ID NO: 511852 - RNA, 22 nt, Human
uucugggcaccaccacagacuu

SEQ ID NO: 511853 - RNA, 22 nt, Human
aacagcuugagacuggauaugc

SEQ ID NO: 511854 - RNA, 22 nt, Human
ggaggagacccugugucaguuu

SEQ ID NO: 511855 - RNA, 22 nt, Human
aggccucagcucagugugacag

SEQ ID NO: 511856 - RNA, 22 nt, Human
uucaucuugauggcuuccuaau

SEQ ID NO: 511857 - RNA, 22 nt, Human
aaaaugaggucaauauccuuuu

SEQ ID NO: 511858 - RNA, 22 nt, Human
ggagaaggguauguguggcgga

SEQ ID NO: 511859 - RNA, 22 nt, Human
agauggguaacuggagucugcu

SEQ ID NO: 511860 - RNA, 22 nt, Human
gccaccuguuucgcuugcccag

SEQ ID NO: 511861 - RNA, 22 nt, Human
aaggagacauuugcagagcacc

SEQ ID NO: 511862 - RNA, 22 nt, Human
uggcuccuuuccgggucuccag

SEQ ID NO: 511863 - RNA, 22 nt, Human
uggaaagaaaaacaggccauga

SEQ ID NO: 511864 - RNA, 22 nt, Human
caucaucaaaagugacagagaa

SEQ ID NO: 511865 - RNA, 20 nt, Human
agucucuguagugccugaga

SEQ ID NO: 511866 - RNA, 22 nt, Human
augugugugugcgcgcgcagga

SEQ ID NO: 511867 - RNA, 22 nt, Human
cagcuucuguuuauugugugcc

SEQ ID NO: 511868 - RNA, 22 nt, Human
ugaugacaaacuuuccugaugc

SEQ ID NO: 511869 - RNA, 22 nt, Human
uuucaaugacacaaaagagaaa

SEQ ID NO: 511870 - RNA, 22 nt, Human
uccugggguccugacugcuucc

SEQ ID NO: 511871 - RNA, 22 nt, Human
gucaacauuuacugcccuggcc

SEQ ID NO: 511872 - RNA, 22 nt, Human
agugacugacaccuguaauccc

SEQ ID NO: 511873 - RNA, 22 nt, Human
uuggaaggaagaaccgcgguag

SEQ ID NO: 511874 - RNA, 22 nt, Human
ugugcugguacaugugaggaug

SEQ ID NO: 511875 - RNA, 22 nt, Human
cacagcuucaguuucugacuug

SEQ ID NO: 511876 - RNA, 22 nt, Human
aaguucuuucuggaaggucugc

SEQ ID NO: 511877 - RNA, 22 nt, Human
caggcugcggucggcucugguc

SEQ ID NO: 511878 - RNA, 20 nt, Human
uggguccugcacauucucca

SEQ ID NO: 511879 - RNA, 20 nt, Human
aggcugggguguuuugccca

SEQ ID NO: 511880 - RNA, 22 nt, Human
augaaacaugagaaauggagag

SEQ ID NO: 511881 - RNA, 22 nt, Human
uucacaucuauaacuuagauaa

SEQ ID NO: 511882 - RNA, 22 nt, Human
uacuuugucauucuaaccuucc

SEQ ID NO: 511883 - RNA, 22 nt, Human
agagcccugaagcagagcuaaa

SEQ ID NO: 511884 - RNA, 22 nt, Human
uagggccagauaggcuucuuga

SEQ ID NO: 511885 - RNA, 22 nt, Human
ggccagaaaguuaagcuguggc

SEQ ID NO: 511886 - RNA, 22 nt, Human
caaugugucaggaaaagggcca

SEQ ID NO: 511887 - RNA, 22 nt, Human
agguucagaguuguugauguuu

SEQ ID NO: 511888 - RNA, 22 nt, Human
cacagaaauuauuaggaugcuu

SEQ ID NO: 511889 - RNA, 22 nt, Human
cuguuauuuagaacauggaauc

SEQ ID NO: 511890 - RNA, 22 nt, Human
auacaaguugugauaauguaaa

SEQ ID NO: 511891 - RNA, 20 nt, Human
ggaccagguggggcgguggc

SEQ ID NO: 511892 - RNA, 22 nt, Human
auuuaugauuagccuauuguug

SEQ ID NO: 511893 - RNA, 22 nt, Human
uucuaccagaccccagacuugu

SEQ ID NO: 511894 - RNA, 22 nt, Human
gccaccugguggcaucuucugg

SEQ ID NO: 511895 - RNA, 20 nt, Human
aacacugugcgugguaggug

SEQ ID NO: 511896 - RNA, 23 nt, Human
ucucaagaggaagcagggcucau

SEQ ID NO: 511897 - RNA, 22 nt, Human
ugcuggcccuggcucagggaac

SEQ ID NO: 511898 - RNA, 20 nt, Human
ggggaagaaaaggaugugau

SEQ ID NO: 511899 - RNA, 22 nt, Human
cacacccuugcuaacacuuguu

SEQ ID NO: 511900 - RNA, 22 nt, Human
aaacagcuuguaagguguaauu

SEQ ID NO: 511901 - RNA, 22 nt, Human
gagauuuagcugcuuaacuccu

SEQ ID NO: 511902 - RNA, 22 nt, Human
aaaugucuuuaucucauguaac

SEQ ID NO: 511903 - RNA, 22 nt, Human
cuguccucuguccucagcagga

SEQ ID NO: 511904 - RNA, 22 nt, Human
cugagcugcggcaggcaccugg

SEQ ID NO: 511905 - RNA, 22 nt, Human
gcaaggagacuguagggccaag

SEQ ID NO: 511906 - RNA, 22 nt, Human
gugcacagauucagagguuuug

SEQ ID NO: 511907 - RNA, 21 nt, Human
ccccucauacacucuccuugc

SEQ ID NO: 511908 - RNA, 22 nt, Human
cagcacugcugcuguacacaca

SEQ ID NO: 511909 - RNA, 22 nt, Human
uggcucagugaagagauaacuu

SEQ ID NO: 511910 - RNA, 22 nt, Human
ucucuggcacucccuuauggcu

SEQ ID NO: 511911 - RNA, 22 nt, Human
aggaagcucaaagccaugaugu

SEQ ID NO: 511912 - RNA, 22 nt, Human
aacaucuuuuuguuugcugaaa

SEQ ID NO: 511913 - RNA, 22 nt, Human
cagagguguacagagggaggcc

SEQ ID NO: 511914 - RNA, 22 nt, Human
cccugcagaaccacagacaaac

SEQ ID NO: 511915 - RNA, 22 nt, Human
ugcuucuggaguaacaggguga

SEQ ID NO: 511916 - RNA, 22 nt, Human
gcugcugguccucagagcucau

SEQ ID NO: 511917 - RNA, 22 nt, Human
uuggaagggaaccgaguuugcu

SEQ ID NO: 511918 - RNA, 22 nt, Human
cuccugcugaauggccaggagc

SEQ ID NO: 511919 - RNA, 22 nt, Human
acauagcuuaaaugagaagaua

SEQ ID NO: 511920 - RNA, 22 nt, Human
agaccagcugccucccagggcc

SEQ ID NO: 511921 - RNA, 22 nt, Human
augauugcagcccuacagcugu

SEQ ID NO: 511922 - RNA, 22 nt, Human
agguccaaauguugagacugau

SEQ ID NO: 511923 - RNA, 22 nt, Human
auuagcauugcuacucucaaga

SEQ ID NO: 511924 - RNA, 22 nt, Human
gcacagaagagcuuuggaauga

SEQ ID NO: 511925 - RNA, 22 nt, Human
caguccuguuccuggaguaguu

SEQ ID NO: 511926 - RNA, 22 nt, Human
cucuucaauagauuguugaggg

SEQ ID NO: 511927 - RNA, 22 nt, Human
uucucauggugucuuuauacau

SEQ ID NO: 511928 - RNA, 19 nt, Human
gugggacagacauuacaua

SEQ ID NO: 511929 - RNA, 18 nt, Human
caguuuuuauaucuggca

SEQ ID NO: 511930 - RNA, 22 nt, Human
cuguccugcaguugggggcagg

SEQ ID NO: 511931 - RNA, 22 nt, Human
uaugcacagaaguuugcugaau

SEQ ID NO: 511932 - RNA, 22 nt, Human
auaaauucucugauguauagua

SEQ ID NO: 511933 - RNA, 22 nt, Human
gaaaacuaacggaaaaguuagg

SEQ ID NO: 511934 - RNA, 22 nt, Human
ccugccugucaucgccugcgcc

SEQ ID NO: 511935 - RNA, 21 nt, Human
uaagaacauuaucuucuuccu

SEQ ID NO: 511936 - RNA, 20 nt, Human
gagcugugcucucaggagcc

SEQ ID NO: 511937 - RNA, 19 nt, Human
agacacacuugauaugugu

SEQ ID NO: 511938 - RNA, 22 nt, Human
cuacauaaauuuaucacagacu

SEQ ID NO: 511939 - RNA, 22 nt, Human
gacccaggguuucugcacaggg

SEQ ID NO: 511940 - RNA, 21 nt, Human
ugguccuucuuuacugccucc

SEQ ID NO: 511941 - RNA, 22 nt, Human
ggccugugucugugccuguccu

SEQ ID NO: 511942 - RNA, 22 nt, Human
aagagggaaauuguuggcugcu

SEQ ID NO: 511943 - RNA, 22 nt, Human
ggagaccagaaggaagcuucga

SEQ ID NO: 511944 - RNA, 22 nt, Human
uggccacacccaccuagaggag

SEQ ID NO: 511945 - RNA, 22 nt, Human
ugcaggugucuccagggcaggu

SEQ ID NO: 511946 - RNA, 22 nt, Human
ucauucacugcccagcagugua

SEQ ID NO: 511947 - RNA, 22 nt, Human
agagcuuagaauuucagaugau

SEQ ID NO: 511948 - RNA, 22 nt, Human
ucuccuugcuacccaguauguc

SEQ ID NO: 511949 - RNA, 22 nt, Human
gcagugaaacaauaggaucaaa

SEQ ID NO: 511950 - RNA, 22 nt, Human
ucaaauagguaugaguagaaau

SEQ ID NO: 511951 - RNA, 22 nt, Human
gaccacagcagugcaagaggag

SEQ ID NO: 511952 - RNA, 22 nt, Human
gccuuggcugaugugcgaauga

SEQ ID NO: 511953 - RNA, 22 nt, Human
gucuggagggaagagaugucag

SEQ ID NO: 511954 - RNA, 22 nt, Human
uggcaggcugaguuggccuggu

SEQ ID NO: 511955 - RNA, 23 nt, Human
ucugagagaacaaugccuccuau

SEQ ID NO: 511956 - RNA, 22 nt, Human
ucaguuuucaauuucaucagag

SEQ ID NO: 511957 - RNA, 22 nt, Human
aaagcauuacuagacuggauuu

SEQ ID NO: 511958 - RNA, 22 nt, Human
caggaacaggguguccuggcag

SEQ ID NO: 511959 - RNA, 22 nt, Human
ggucugaggcuccaaggaggug

SEQ ID NO: 511960 - RNA, 20 nt, Human
agaaguggcugcagacacua

SEQ ID NO: 511961 - RNA, 22 nt, Human
ugguuaaguccagaaaggaagc

SEQ ID NO: 511962 - RNA, 22 nt, Human
agugaauucuccacccaguagg

SEQ ID NO: 511963 - RNA, 20 nt, Human
ggggggcuucagggccugug

SEQ ID NO: 511964 - RNA, 22 nt, Human
acuuagcagguacuuucauauu

SEQ ID NO: 511965 - RNA, 22 nt, Human
acaucugaggagaccagccucu

SEQ ID NO: 511966 - RNA, 22 nt, Human
agauaugacuagaagcucauuu

SEQ ID NO: 511967 - RNA, 22 nt, Human
uggcacuggaaucguagccuug

SEQ ID NO: 511968 - RNA, 22 nt, Human
cugccuguuuccucuugcuccc

SEQ ID NO: 511969 - RNA, 22 nt, Human
cuuuacaaauagggagggagug

SEQ ID NO: 511970 - RNA, 22 nt, Human
caggaagggggauccuuggaag

SEQ ID NO: 511971 - RNA, 22 nt, Human
uaauuucaauagcuugcauaau

SEQ ID NO: 511972 - RNA, 22 nt, Human
ggugaguugggguucacagguc

SEQ ID NO: 511973 - RNA, 22 nt, Human
gugccacuuaccugggaggagu

SEQ ID NO: 511974 - RNA, 22 nt, Human
auacaguauguaggcuuuucag

SEQ ID NO: 511975 - RNA, 22 nt, Human
cuuccucuagccuaguaaugcc

SEQ ID NO: 511976 - RNA, 22 nt, Human
uguccugugaccuggcaccaca

SEQ ID NO: 511977 - RNA, 22 nt, Human
ucagcaguuuuauaugcagcuu

SEQ ID NO: 511978 - RNA, 22 nt, Human
uugcccugaagaacgucccaga

SEQ ID NO: 511979 - RNA, 22 nt, Human
ucugggucacugugggagggca

SEQ ID NO: 511980 - RNA, 22 nt, Human
aagggaggaggauuuauuguac

SEQ ID NO: 511981 - RNA, 22 nt, Human
gaaggggacuggcagcugcaga

SEQ ID NO: 511982 - RNA, 22 nt, Human
uggcucugaucagauguccagu

SEQ ID NO: 511983 - RNA, 22 nt, Human
auauuacauaaacaugagugaa

SEQ ID NO: 511984 - RNA, 22 nt, Human
acucuacuguaguaugggcacu

SEQ ID NO: 511985 - RNA, 22 nt, Human
ucaggaagugccuaggcuggcc

SEQ ID NO: 511986 - RNA, 22 nt, Human
gggagagguuacccgagcaacu

SEQ ID NO: 511987 - RNA, 22 nt, Human
ucucucagaggccaggguccug

SEQ ID NO: 511988 - RNA, 22 nt, Human
uuagaaagaacuuuagauauca

SEQ ID NO: 511989 - RNA, 22 nt, Human
gaggggcugggguugacuccaa

SEQ ID NO: 511990 - RNA, 22 nt, Human
acuccaggcaucugcuucugcu

SEQ ID NO: 511991 - RNA, 22 nt, Human
ucagcucucugggcucgaaccu

SEQ ID NO: 511992 - RNA, 22 nt, Human
uugucugaaagaucauuacauu

SEQ ID NO: 511993 - RNA, 22 nt, Human
ucacacacauuugcugucugau

SEQ ID NO: 511994 - RNA, 23 nt, Human
caugccaguuugugcaggcagau

SEQ ID NO: 511995 - RNA, 22 nt, Human
uggccaccccuuucucugcacu

SEQ ID NO: 511996 - RNA, 22 nt, Human
ugcaggcucugugugugccugg

SEQ ID NO: 511997 - RNA, 22 nt, Human
acauuucucuuagaguuggacu

SEQ ID NO: 511998 - RNA, 22 nt, Human
uugcagcuucuaacagcuucag

SEQ ID NO: 511999 - RNA, 22 nt, Human
agugcugggauugcaggcauga

SEQ ID NO: 512000 - RNA, 22 nt, Human
gaucauuugcaggaaacauuaa

SEQ ID NO: 512001 - RNA, 22 nt, Human
agugcugggauuacaggcauaa

SEQ ID NO: 512002 - RNA, 22 nt, Human
gcuggugagcaaaggagaagga

SEQ ID NO: 512003 - RNA, 22 nt, Human
gccaggaacacaaugccaagcu

SEQ ID NO: 512004 - RNA, 22 nt, Human
cauuuaaugccuuugccaucca

SEQ ID NO: 512005 - RNA, 22 nt, Human
cauuuucagcacccaucugaaa

SEQ ID NO: 512006 - RNA, 22 nt, Human
uccucaggaucuaggagugcuu

SEQ ID NO: 512007 - RNA, 22 nt, Human
uguaaauaaugcauguaaauca

SEQ ID NO: 512008 - RNA, 21 nt, Human
uggcucugaaagagugcugca

SEQ ID NO: 512009 - RNA, 22 nt, Human
gcagagcugggucuguauccaa

SEQ ID NO: 512010 - RNA, 22 nt, Human
cuacagguaugugcaugacauc

SEQ ID NO: 512011 - RNA, 22 nt, Human
aaaguccuguuugaaggaccug

SEQ ID NO: 512012 - RNA, 22 nt, Human
cuuucagagguuacucaggaaa

SEQ ID NO: 512013 - RNA, 22 nt, Human
aauguacaaggguuccaguuuu

SEQ ID NO: 512014 - RNA, 22 nt, Human
agauuucagaugcucggcaguu

SEQ ID NO: 512015 - RNA, 22 nt, Human
agauggggcucaguguggaggc

SEQ ID NO: 512016 - RNA, 22 nt, Human
caggcuccacuguaggcagcuc

SEQ ID NO: 512017 - RNA, 22 nt, Human
cuccaggcucguccaagaucga

SEQ ID NO: 512018 - RNA, 22 nt, Human
gaaaucugucuuuguuugaaua

SEQ ID NO: 512019 - RNA, 22 nt, Human
uuuagugauucauuuagaaaaa

SEQ ID NO: 512020 - RNA, 22 nt, Human
aacucagcauccugcacagaga

SEQ ID NO: 512021 - RNA, 22 nt, Human
cccuggcaugcaugucccuggc

SEQ ID NO: 512022 - RNA, 22 nt, Human
ggagcuggcuacagagaacucc

SEQ ID NO: 512023 - RNA, 22 nt, Human
gcacauguugcuaguuacuugc

SEQ ID NO: 512024 - RNA, 22 nt, Human
uucuggaauucuugcagccacu

SEQ ID NO: 512025 - RNA, 22 nt, Human
gccuggagaagauggaacuagc

SEQ ID NO: 512026 - RNA, 22 nt, Human
cuguccuggccgcccuugugag

SEQ ID NO: 512027 - RNA, 22 nt, Human
uggccugcuuucauuugaugcu

SEQ ID NO: 512028 - RNA, 22 nt, Human
uuucacauaucaacucuauccu

SEQ ID NO: 512029 - RNA, 22 nt, Human
ucuguucagaaauggaagugcc

SEQ ID NO: 512030 - RNA, 22 nt, Human
gggcagucacagugcuggagca

SEQ ID NO: 512031 - RNA, 22 nt, Human
cacauacauacguauguauaca

SEQ ID NO: 512032 - RNA, 22 nt, Human
gggcaugguggcaggcaccugu

SEQ ID NO: 512033 - RNA, 22 nt, Human
uugaaaggccuguuuauccagc

SEQ ID NO: 512034 - RNA, 22 nt, Human
augggcuggggaagcucacucc

SEQ ID NO: 512035 - RNA, 22 nt, Human
ugcuuuaucugacuuggcgcug

SEQ ID NO: 512036 - RNA, 22 nt, Human
ugggaggagcccucugggaagg

SEQ ID NO: 512037 - RNA, 18 nt, Human
acaaauguagugucuuaa

SEQ ID NO: 512038 - RNA, 22 nt, Human
aggaaggaagagacaccauuug

SEQ ID NO: 512039 - RNA, 22 nt, Human
aggaagcauguuggauccacuu

SEQ ID NO: 512040 - RNA, 22 nt, Human
aggucacaggguugaaguacuu

SEQ ID NO: 512041 - RNA, 22 nt, Human
gucuggaggaggaagaaggcac

SEQ ID NO: 512042 - RNA, 22 nt, Human
ggccccugcggacugccuagag

SEQ ID NO: 512043 - RNA, 22 nt, Human
ucccacacagcccgcucaccgg

SEQ ID NO: 512044 - RNA, 22 nt, Human
uagauuucaggcuggcuugcgg

SEQ ID NO: 512045 - RNA, 22 nt, Human
aguggcuggagccccaggcugg

SEQ ID NO: 512046 - RNA, 22 nt, Human
gagauuagaguuguuucauugu

SEQ ID NO: 512047 - RNA, 22 nt, Human
ucuugggauugcccugcaguuc

SEQ ID NO: 512048 - RNA, 22 nt, Human
acucugccuuucagcagaugaa

SEQ ID NO: 512049 - RNA, 22 nt, Human
gcuuccaccuacuaaaugccac

SEQ ID NO: 512050 - RNA, 22 nt, Human
ucuggggagcagcccuggugag

SEQ ID NO: 512051 - RNA, 21 nt, Human
gcucucugcaugguggcucag

SEQ ID NO: 512052 - RNA, 22 nt, Human
ugugugaaucuauugaauauau

SEQ ID NO: 512053 - RNA, 16 nt, Human
uccuggccuuuggaag

SEQ ID NO: 512054 - RNA, 22 nt, Human
uggcugccuagucccucagccu

SEQ ID NO: 512055 - RNA, 22 nt, Human
gcagagccaggagagacccuug

SEQ ID NO: 512056 - RNA, 22 nt, Human
caguguuucugaguuccagcuc

SEQ ID NO: 512057 - RNA, 22 nt, Human
gggagggaaagcuugaucuguc

SEQ ID NO: 512058 - RNA, 22 nt, Human
cuccugggagcuguggcagagc

SEQ ID NO: 512059 - RNA, 22 nt, Human
aucugggcguauaggugcaagu

SEQ ID NO: 512060 - RNA, 22 nt, Human
caagugucuauaucagugcuug

SEQ ID NO: 512061 - RNA, 22 nt, Human
agcacagaauggcuuggaagcc

SEQ ID NO: 512062 - RNA, 22 nt, Human
ugggaaggaacugccuuuagcu

SEQ ID NO: 512063 - RNA, 22 nt, Human
cacucaggcugugucaggagga

SEQ ID NO: 512064 - RNA, 22 nt, Human
cuggagaggccccaagauauuu

SEQ ID NO: 512065 - RNA, 22 nt, Human
aaacauugcuaaauaaugcugc

SEQ ID NO: 512066 - RNA, 22 nt, Human
uccagggaaggugugaggcugg

SEQ ID NO: 512067 - RNA, 22 nt, Human
cuucuggggauggagcccagaa

SEQ ID NO: 512068 - RNA, 22 nt, Human
uguccugggaacucacagucca

SEQ ID NO: 512069 - RNA, 22 nt, Human
gugaaggacugaaugaaaaugu

SEQ ID NO: 512070 - RNA, 22 nt, Human
gggcugacucaaccuugcaaag

SEQ ID NO: 512071 - RNA, 22 nt, Human
ggcacagcccucucuguggaca

SEQ ID NO: 512072 - RNA, 22 nt, Human
ggcaccuggagguuuacuggau

SEQ ID NO: 512073 - RNA, 22 nt, Human
aggugacugguuuaucuggcag

SEQ ID NO: 512074 - RNA, 22 nt, Human
ccugccagcauggcuuaucucc

SEQ ID NO: 512075 - RNA, 22 nt, Human
gaggcugcccaacuggagugga

SEQ ID NO: 512076 - RNA, 22 nt, Human
auuuccauacacccauuucuga

SEQ ID NO: 512077 - RNA, 22 nt, Human
aaaucaguuggaacacaagcag

SEQ ID NO: 512078 - RNA, 23 nt, Human
ucucagugaaucucagaauucgc

SEQ ID NO: 512079 - RNA, 22 nt, Human
cucucuggacuugaguaucagc

SEQ ID NO: 512080 - RNA, 22 nt, Human
ugccaggcccucccacagauua

SEQ ID NO: 512081 - RNA, 22 nt, Human
ggccuugggcagacacgucaca

SEQ ID NO: 512082 - RNA, 22 nt, Human
ucuuaaaaguaugccaauugga

SEQ ID NO: 512083 - RNA, 22 nt, Human
uccuggccugucuggaguagcu

SEQ ID NO: 512084 - RNA, 22 nt, Human
ccucuggccagagaaaggccag

SEQ ID NO: 512085 - RNA, 22 nt, Human
gguccugaggggagcugaaggu

SEQ ID NO: 512086 - RNA, 22 nt, Human
caaaugaauauuuccauggguu

SEQ ID NO: 512087 - RNA, 22 nt, Human
cuuucuuauaccugucagggcc

SEQ ID NO: 512088 - RNA, 22 nt, Human
gcacugaaauuauaugcauuug

SEQ ID NO: 512089 - RNA, 22 nt, Human
cuacaagauuuuuaaaacugua

SEQ ID NO: 512090 - RNA, 22 nt, Human
aagaguuuuuggagugugaguu

SEQ ID NO: 512091 - RNA, 22 nt, Human
agcugcagauucuaucuagaag

SEQ ID NO: 512092 - RNA, 22 nt, Human
auuugcagagcucugaauuuug

SEQ ID NO: 512093 - RNA, 22 nt, Human
agguucuuggugagcauuuggu

SEQ ID NO: 512094 - RNA, 22 nt, Human
cucugggcacuguauggguucu

SEQ ID NO: 512095 - RNA, 23 nt, Human
cugugucuaugcagccauaucca

SEQ ID NO: 512096 - RNA, 19 nt, Human
ggcuggcaagugacagugu

SEQ ID NO: 512097 - RNA, 22 nt, Human
uuagcaucugcuguaagcuuau

SEQ ID NO: 512098 - RNA, 22 nt, Human
gugcugcucacaucuggaggua

SEQ ID NO: 512099 - RNA, 22 nt, Human
uacauaguauucacauuguuuu

SEQ ID NO: 512100 - RNA, 22 nt, Human
uucugugugccagaguugugcu

SEQ ID NO: 512101 - RNA, 22 nt, Human
cagaggcccagugagagggcug

SEQ ID NO: 512102 - RNA, 22 nt, Human
gaggccuggcugggaggaggug

SEQ ID NO: 512103 - RNA, 22 nt, Human
cugaccuggccuuggugggcca

SEQ ID NO: 512104 - RNA, 22 nt, Human
aaucacaucucauucaacagcc

SEQ ID NO: 512105 - RNA, 22 nt, Human
uccuggcucucuacaaaccaga

SEQ ID NO: 512106 - RNA, 22 nt, Human
ucagugucuucucuuuccuacc

SEQ ID NO: 512107 - RNA, 22 nt, Human
ggaagagaaaugagucaagacu

SEQ ID NO: 512108 - RNA, 22 nt, Human
cagcagcuguuuacggaacacc

SEQ ID NO: 512109 - RNA, 22 nt, Human
cucagagucccuucccucgugg

SEQ ID NO: 512110 - RNA, 22 nt, Human
cuagcaucagaugagaagcugu

SEQ ID NO: 512111 - RNA, 22 nt, Human
ggcucaggaugagccuucucau

SEQ ID NO: 512112 - RNA, 22 nt, Human
gaguguggugaacaggagcacc

SEQ ID NO: 512113 - RNA, 22 nt, Human
cagcccucaucucagcuucuuu

SEQ ID NO: 512114 - RNA, 22 nt, Human
uguuucauuaguacugacaaua

SEQ ID NO: 512115 - RNA, 17 nt, Human
gcucccugaggacagcu

SEQ ID NO: 512116 - RNA, 22 nt, Human
aggagccuccuucucaugugca

SEQ ID NO: 512117 - RNA, 22 nt, Human
aaggaagacacagaugaaguga

SEQ ID NO: 512118 - RNA, 22 nt, Human
ugagugccugaacauagaguag

SEQ ID NO: 512119 - RNA, 22 nt, Human
ugcaaagaagccuuugccuucu

SEQ ID NO: 512120 - RNA, 22 nt, Human
ugggucuccaguucagggcagg

SEQ ID NO: 512121 - RNA, 22 nt, Human
ggggagcaauaguugaggugug

SEQ ID NO: 512122 - RNA, 18 nt, Human
cccagccucuccuuucua

SEQ ID NO: 512123 - RNA, 22 nt, Human
gcugucccaugguugcaagaug

SEQ ID NO: 512124 - RNA, 22 nt, Human
uucuuuuaauagagauccugug

SEQ ID NO: 512125 - RNA, 22 nt, Human
ggccuagggaguggccaugccu

SEQ ID NO: 512126 - RNA, 22 nt, Human
agugaaauggaugcugcuacug

SEQ ID NO: 512127 - RNA, 22 nt, Human
gagagcaggaggcagcgggacg

SEQ ID NO: 512128 - RNA, 22 nt, Human
uagggcuucaggugugaggcag

SEQ ID NO: 512129 - RNA, 22 nt, Human
cuggccuuggaagggagcccgu

SEQ ID NO: 512130 - RNA, 22 nt, Human
agauaacuuuuggguauucaug

SEQ ID NO: 512131 - RNA, 22 nt, Human
gaaggaaaucugugauuuaugc

SEQ ID NO: 512132 - RNA, 22 nt, Human
gaacccaggcuuuugaggcugu

SEQ ID NO: 512133 - RNA, 22 nt, Human
guuaaauaaccucauguccguu

SEQ ID NO: 512134 - RNA, 22 nt, Human
uacacagggaaaggucucagag

SEQ ID NO: 512135 - RNA, 22 nt, Human
ucaugccaauuucugcauggcu

SEQ ID NO: 512136 - RNA, 22 nt, Human
ggaaccuuaguguucuuuuacc

SEQ ID NO: 512137 - RNA, 22 nt, Human
agagcugggaccgucuggaagu

SEQ ID NO: 512138 - RNA, 17 nt, Human
ucuguccagggagugug

SEQ ID NO: 512139 - RNA, 22 nt, Human
aacuuguuuagaagagguuacu

SEQ ID NO: 512140 - RNA, 22 nt, Human
cagcuucuccagaugacccuca

SEQ ID NO: 512141 - RNA, 22 nt, Human
cugccucuggccucaggcccag

SEQ ID NO: 512142 - RNA, 22 nt, Human
ggagggggaauucagccccagc

SEQ ID NO: 512143 - RNA, 22 nt, Human
gcuucagccucacacugauauc

SEQ ID NO: 512144 - RNA, 22 nt, Human
aaagauuagauaagauagauuu

SEQ ID NO: 512145 - RNA, 22 nt, Human
uuaaaagaccuguugagguuag

SEQ ID NO: 512146 - RNA, 22 nt, Human
aucacauuguuagcauagacug

SEQ ID NO: 512147 - RNA, 22 nt, Human
ccucaaaguagagggagaugag

SEQ ID NO: 512148 - RNA, 22 nt, Human
cagggugccuguccucagcaaa

SEQ ID NO: 512149 - RNA, 22 nt, Human
ucauuuguugcuguuaccugag

SEQ ID NO: 512150 - RNA, 22 nt, Human
cccuuggaagguagcuggcagu

SEQ ID NO: 512151 - RNA, 22 nt, Human
uucuaguuuugccuuaucaaca

SEQ ID NO: 512152 - RNA, 21 nt, Human
ucuugaaaauuguagcaguuu

SEQ ID NO: 512153 - RNA, 22 nt, Human
uguaugcuuguguauaauauaa

SEQ ID NO: 512154 - RNA, 22 nt, Human
ggcucugcgcgguaaagugacu

SEQ ID NO: 512155 - RNA, 22 nt, Human
aguggcaguggcugggcagagc

SEQ ID NO: 512156 - RNA, 22 nt, Human
ccaggcguggcuucagcagccc

SEQ ID NO: 512157 - RNA, 22 nt, Human
cucuuuccucagccacagucua

SEQ ID NO: 512158 - RNA, 22 nt, Human
gccaccucuuugucucugccgc

SEQ ID NO: 512159 - RNA, 22 nt, Human
aaggggagaugucaugggcccu

SEQ ID NO: 512160 - RNA, 22 nt, Human
agcagcauuuaaggauccaagu

SEQ ID NO: 512161 - RNA, 22 nt, Human
ccaaggacuggacacacagguu

SEQ ID NO: 512162 - RNA, 22 nt, Human
gccuggcacucacugaagaggc

SEQ ID NO: 512163 - RNA, 23 nt, Human
gcagagguuuuucaguaugguuu

SEQ ID NO: 512164 - RNA, 22 nt, Human
ugcacacacaggagucuccucc

SEQ ID NO: 512165 - RNA, 22 nt, Human
gccugcagacguguuuuccuca

SEQ ID NO: 512166 - RNA, 22 nt, Human
cuguuuuugugcugugucuccc

SEQ ID NO: 512167 - RNA, 22 nt, Human
gggcugugugcccacuucccau

SEQ ID NO: 512168 - RNA, 22 nt, Human
uaagaagcuucugcuaaugccu

SEQ ID NO: 512169 - RNA, 22 nt, Human
ucugagagauacaaggaggcaa

SEQ ID NO: 512170 - RNA, 22 nt, Human
uuaaugcagaaaucaaacugac

SEQ ID NO: 512171 - RNA, 22 nt, Human
uucuucaaccaucuacauaaac

SEQ ID NO: 512172 - RNA, 21 nt, Human
agcagaggcagaauguaugca

SEQ ID NO: 512173 - RNA, 22 nt, Human
aaagaauagccuuuguccaaau

SEQ ID NO: 512174 - RNA, 22 nt, Human
ccagcuuguuugaagcucguca

SEQ ID NO: 512175 - RNA, 21 nt, Human
uccuccuucaaguccuggccu

SEQ ID NO: 512176 - RNA, 22 nt, Human
gcucccagcauugcugcugaau

SEQ ID NO: 512177 - RNA, 18 nt, Human
aguuccuuaaauuggugu

SEQ ID NO: 512178 - RNA, 22 nt, Human
ggcugccacgucgaggguccaa

SEQ ID NO: 512179 - RNA, 17 nt, Human
uaaauacacaaggguau

SEQ ID NO: 512180 - RNA, 22 nt, Human
ggaaggaaagcagcuuggcccu

SEQ ID NO: 512181 - RNA, 20 nt, Human
ucacuguaauugccuacauu

SEQ ID NO: 512182 - RNA, 22 nt, Human
ucccuggagauaacuucuggga

SEQ ID NO: 512183 - RNA, 22 nt, Human
uuuggcuuaacuuacaugauau

SEQ ID NO: 512184 - RNA, 22 nt, Human
ggcaggguuuacaauagcaaua

SEQ ID NO: 512185 - RNA, 22 nt, Human
aguggcuguuccaggugaggac

SEQ ID NO: 512186 - RNA, 22 nt, Human
aggcaagggggcgccaccuucc

SEQ ID NO: 512187 - RNA, 22 nt, Human
aaaugucugagacuucugaacu

SEQ ID NO: 512188 - RNA, 22 nt, Human
uccuucaagugcaguaccugag

SEQ ID NO: 512189 - RNA, 22 nt, Human
ucucuggggccuuucuacauca

SEQ ID NO: 512190 - RNA, 22 nt, Human
ugaaagcacucacuucugcucu

SEQ ID NO: 512191 - RNA, 22 nt, Human
gccuggaggguugagguuuugu

SEQ ID NO: 512192 - RNA, 20 nt, Human
ugcuuccuggccacugcggg

SEQ ID NO: 512193 - RNA, 20 nt, Human
uccugagauuuaagggguuc

SEQ ID NO: 512194 - RNA, 18 nt, Human
ucacagaauauugagugg

SEQ ID NO: 512195 - RNA, 22 nt, Human
acuuucuuaggcuguauaaaug

SEQ ID NO: 512196 - RNA, 22 nt, Human
cucacaggagaaagucaugguc

SEQ ID NO: 512197 - RNA, 22 nt, Human
uuuaccaagcuuuaauuacaua

SEQ ID NO: 512198 - RNA, 22 nt, Human
aagugcaaauuuaagaaggcau

SEQ ID NO: 512199 - RNA, 20 nt, Human
uggagcuccagcguccaugu

SEQ ID NO: 512200 - RNA, 22 nt, Human
uagcaucaugaucagaacuguu

SEQ ID NO: 512201 - RNA, 22 nt, Human
ggagccagcucccuccuuguga

SEQ ID NO: 512202 - RNA, 22 nt, Human
gauucaagaccuagcucagcca

SEQ ID NO: 512203 - RNA, 22 nt, Human
cauagugucugguaacauagua

SEQ ID NO: 512204 - RNA, 22 nt, Human
ggcagccaugucccagggcuuc

SEQ ID NO: 512205 - RNA, 22 nt, Human
aaguucuugcugugugucagau

SEQ ID NO: 512206 - RNA, 22 nt, Human
cagagcagcagagcuuccaugg

SEQ ID NO: 512207 - RNA, 22 nt, Human
uugaucaucuugugcugacggc

SEQ ID NO: 512208 - RNA, 17 nt, Human
gguggccugcaguggcu

SEQ ID NO: 512209 - RNA, 19 nt, Human
ugcaggaggacugagcaga

SEQ ID NO: 512210 - RNA, 22 nt, Human
cuguggcuggccugucugacau

SEQ ID NO: 512211 - RNA, 20 nt, Human
aaaaugaugggcagggcagg

SEQ ID NO: 512212 - RNA, 22 nt, Human
ccuggcugggccugauuucuca

SEQ ID NO: 512213 - RNA, 22 nt, Human
ggugcccaccugucuuccugga

SEQ ID NO: 512214 - RNA, 21 nt, Human
acagaacuguauagugauaaa

SEQ ID NO: 512215 - RNA, 22 nt, Human
gggagccaugcuggucuucuuu

SEQ ID NO: 512216 - RNA, 22 nt, Human
ggccugagucccaccuggcugu

SEQ ID NO: 512217 - RNA, 22 nt, Human
uggaacacaagucauugagggg

SEQ ID NO: 512218 - RNA, 22 nt, Human
ugggccacagagugagaaaugu

SEQ ID NO: 512219 - RNA, 22 nt, Human
gccacagggcagaugcgcagag

SEQ ID NO: 512220 - RNA, 22 nt, Human
ucagcucuaaguuuuaugcaaa

SEQ ID NO: 512221 - RNA, 22 nt, Human
agagugucugguagcugcucug

SEQ ID NO: 512222 - RNA, 22 nt, Human
guauucuugguuaucaaaauac

SEQ ID NO: 512223 - RNA, 22 nt, Human
ggcagcaggagccaucugguag

SEQ ID NO: 512224 - RNA, 22 nt, Human
ugguccugcuacaggggauuag

SEQ ID NO: 512225 - RNA, 22 nt, Human
caagucaaagacuagaacuagu

SEQ ID NO: 512226 - RNA, 22 nt, Human
gaugugagugguagcugggauu

SEQ ID NO: 512227 - RNA, 19 nt, Human
ugugugcccucaccacaua

SEQ ID NO: 512228 - RNA, 22 nt, Human
uuccaagaguaaauucaaauug

SEQ ID NO: 512229 - RNA, 17 nt, Human
agcugagcuggccaggg

SEQ ID NO: 512230 - RNA, 22 nt, Human
ggagccagaaaugcugugguug

SEQ ID NO: 512231 - RNA, 22 nt, Human
ugcagcagguuccaaaggguua

SEQ ID NO: 512232 - RNA, 22 nt, Human
ugccacacuccccugcugcagu

SEQ ID NO: 512233 - RNA, 22 nt, Human
agcagaagaaagccacaugacu

SEQ ID NO: 512234 - RNA, 20 nt, Human
agccugccagcuggcccaga

SEQ ID NO: 512235 - RNA, 22 nt, Human
auaauguuucaguacugucugu

SEQ ID NO: 512236 - RNA, 22 nt, Human
aacacaaagaagcugcaggauc

SEQ ID NO: 512237 - RNA, 22 nt, Human
gaugcagggaacuuagugggcu

SEQ ID NO: 512238 - RNA, 22 nt, Human
uuuauuauucucuggagaaugu

SEQ ID NO: 512239 - RNA, 22 nt, Human
uccucacagucaacacuuugag

SEQ ID NO: 512240 - RNA, 22 nt, Human
ucucugggagcaauuguuugcu

SEQ ID NO: 512241 - RNA, 22 nt, Human
gcagggcagcugaagcuaggug

SEQ ID NO: 512242 - RNA, 22 nt, Human
aagagcuggcccaaucugagca

SEQ ID NO: 512243 - RNA, 22 nt, Human
gcugcugucagcaggccuuguu

SEQ ID NO: 512244 - RNA, 22 nt, Human
aagaugcagcuuuacaauaagg

SEQ ID NO: 512245 - RNA, 22 nt, Human
gaauucugggagagaucugaca

SEQ ID NO: 512246 - RNA, 22 nt, Human
gcccugugccagucacgcugug

SEQ ID NO: 512247 - RNA, 22 nt, Human
aaaagaggagugguuuaugaca

SEQ ID NO: 512248 - RNA, 22 nt, Human
acagggucaagggugcuacaag

SEQ ID NO: 512249 - RNA, 22 nt, Human
ucauccaguucacauggugagu

SEQ ID NO: 512250 - RNA, 22 nt, Human
ugauuucuuccuugucauuaga

SEQ ID NO: 512251 - RNA, 22 nt, Human
ccagcucaucucagugaaaugc

SEQ ID NO: 512252 - RNA, 22 nt, Human
ggcacagcacuguaggccuggg

SEQ ID NO: 512253 - RNA, 22 nt, Human
uauuucagcaagaagaaugugg

SEQ ID NO: 512254 - RNA, 22 nt, Human
uaaacagccuccccuuucacuc

SEQ ID NO: 512255 - RNA, 22 nt, Human
cagggccuccuaaggcaucuaa

SEQ ID NO: 512256 - RNA, 22 nt, Human
ugacaaacccugcaaauagcuc

SEQ ID NO: 512257 - RNA, 22 nt, Human
ucaagucuugaugagacaaacc

SEQ ID NO: 512258 - RNA, 20 nt, Human
gcagagcuguucugugggga

SEQ ID NO: 512259 - RNA, 22 nt, Human
uuauuuaaaagugguaagauuc

SEQ ID NO: 512260 - RNA, 19 nt, Human
agagaaagaauugagucua

SEQ ID NO: 512261 - RNA, 22 nt, Human
ccagggaggagcauuucauggu

SEQ ID NO: 512262 - RNA, 22 nt, Human
agcagcagauccaaaaaaugug

SEQ ID NO: 512263 - RNA, 22 nt, Human
uguucauuuggcccuuuuguau

SEQ ID NO: 512264 - RNA, 22 nt, Human
ugggcugcggauaggccucgga

SEQ ID NO: 512265 - RNA, 19 nt, Human
ggcucagggcgcugccgcc

SEQ ID NO: 512266 - RNA, 22 nt, Human
uucacagggccacuggcaggag

SEQ ID NO: 512267 - RNA, 22 nt, Human
augcucugggcaggagcccugg

SEQ ID NO: 512268 - RNA, 22 nt, Human
cuucuugcaauuuucaucuuau

SEQ ID NO: 512269 - RNA, 22 nt, Human
agugcaggccccaggccaggcc

SEQ ID NO: 512270 - RNA, 22 nt, Human
ucauuucuccuaagugaaauau

SEQ ID NO: 512271 - RNA, 22 nt, Human
ucccuucaagauuuggggaaau

SEQ ID NO: 512272 - RNA, 22 nt, Human
gccacugucauacccuggcaau

SEQ ID NO: 512273 - RNA, 22 nt, Human
gaucauuuugaugcccuuuuag

SEQ ID NO: 512274 - RNA, 22 nt, Human
aggcagagcuggguuuugaaau

SEQ ID NO: 512275 - RNA, 22 nt, Human
gggcugcugcccaggaggcacc

SEQ ID NO: 512276 - RNA, 22 nt, Human
gcugccaguuccuucuuacucc

SEQ ID NO: 512277 - RNA, 22 nt, Human
cagggagaaaucuccaggaggu

SEQ ID NO: 512278 - RNA, 22 nt, Human
agaggcugucccuugcuauucc

SEQ ID NO: 512279 - RNA, 22 nt, Human
gaggaagcagggcuuggcugag

SEQ ID NO: 512280 - RNA, 22 nt, Human
uugcuauaaaugguuucauauu

SEQ ID NO: 512281 - RNA, 22 nt, Human
agggacugagcuaggaucuagu

SEQ ID NO: 512282 - RNA, 22 nt, Human
uagauuucgcugcaucucaauc

SEQ ID NO: 512283 - RNA, 22 nt, Human
uugauuuuuccagcuucuagag

SEQ ID NO: 512284 - RNA, 22 nt, Human
aguuuggaagaauuuggucugu

SEQ ID NO: 512285 - RNA, 22 nt, Human
gggugcagcagagcuccucugu

SEQ ID NO: 512286 - RNA, 18 nt, Human
agaagcagguucucccag

SEQ ID NO: 512287 - RNA, 22 nt, Human
cuggaagguaacaaggccauua

SEQ ID NO: 512288 - RNA, 22 nt, Human
acagaggccccgugggagagcc

SEQ ID NO: 512289 - RNA, 22 nt, Human
auugaaagguuuugagcagaua

SEQ ID NO: 512290 - RNA, 22 nt, Human
aagaagaugguuaacuuucagu

SEQ ID NO: 512291 - RNA, 22 nt, Human
aagguccaguggaaacuagagu

SEQ ID NO: 512292 - RNA, 19 nt, Human
cuggucugucaugcucccc

SEQ ID NO: 512293 - RNA, 22 nt, Human
cagguggaucucuaaggacuga

SEQ ID NO: 512294 - RNA, 22 nt, Human
cuggggugagcagaaacagggg

SEQ ID NO: 512295 - RNA, 22 nt, Human
gccugcagcugcuuccacacac

SEQ ID NO: 512296 - RNA, 22 nt, Human
gcccagaguucaaggcugcagu

SEQ ID NO: 512297 - RNA, 22 nt, Human
ucccagagcagaugugcuaaag

SEQ ID NO: 512298 - RNA, 22 nt, Human
ccuuggcugaggagggagcuga

SEQ ID NO: 512299 - RNA, 22 nt, Human
acagggcagaaauguugcaucu

SEQ ID NO: 512300 - RNA, 22 nt, Human
uccuuggagguguucaucugcc

SEQ ID NO: 512301 - RNA, 18 nt, Human
ggugagggagcuggaagc

SEQ ID NO: 512302 - RNA, 22 nt, Human
ggcuccaaagggcagugugagg

SEQ ID NO: 512303 - RNA, 22 nt, Human
ggaucauuaacacauccaucac

SEQ ID NO: 512304 - RNA, 22 nt, Human
cugcuuuagacaacugcuggga

SEQ ID NO: 512305 - RNA, 22 nt, Human
ccaagaugaucuuuacaguguu

SEQ ID NO: 512306 - RNA, 17 nt, Human
aaguccagaguugagca

SEQ ID NO: 512307 - RNA, 22 nt, Human
acagcaggauuuggcgauguug

SEQ ID NO: 512308 - RNA, 22 nt, Human
gacaucauaucaggaggcaugu

SEQ ID NO: 512309 - RNA, 20 nt, Human
ugccaggcacggagugcaug

SEQ ID NO: 512310 - RNA, 22 nt, Human
acucucucacagcuuggcugau

SEQ ID NO: 512311 - RNA, 22 nt, Human
agauacaaguuaagagaaagga

SEQ ID NO: 512312 - RNA, 22 nt, Human
gagcagugacuggagcaugaga

SEQ ID NO: 512313 - RNA, 19 nt, Human
cacuagucuagaugggaug

SEQ ID NO: 512314 - RNA, 19 nt, Human
aucuuacagagcagaguac

SEQ ID NO: 512315 - RNA, 22 nt, Human
ucaguguuuauucaauguuauu

SEQ ID NO: 512316 - RNA, 22 nt, Human
cgaugguucuggcugcuuguau

SEQ ID NO: 512317 - RNA, 22 nt, Human
ugaagcuugagugucaguuccu

SEQ ID NO: 512318 - RNA, 22 nt, Human
cauguguaaggcucacaggcag

SEQ ID NO: 512319 - RNA, 22 nt, Human
agacaauauauaauuuuaguug

SEQ ID NO: 512320 - RNA, 22 nt, Human
gaaagugcucucucuauacaca

SEQ ID NO: 512321 - RNA, 22 nt, Human
gggcagaggggcgcuucccucu

SEQ ID NO: 512322 - RNA, 22 nt, Human
uucagagauggaaggcagaaug

SEQ ID NO: 512323 - RNA, 22 nt, Human
cuguccagcuuggcuccugggg

SEQ ID NO: 512324 - RNA, 22 nt, Human
aaaucaguuguuauauuaaaga

SEQ ID NO: 512325 - RNA, 22 nt, Human
ccaguguuauuuuagaguguga

SEQ ID NO: 512326 - RNA, 18 nt, Human
gucagaggauggggaaau

SEQ ID NO: 512327 - RNA, 22 nt, Human
cuggccuggcagggagggcaug

SEQ ID NO: 512328 - RNA, 22 nt, Human
agguggggaaaccagcgauccc

SEQ ID NO: 512329 - RNA, 22 nt, Human
aauacagagaauguuauuugga

SEQ ID NO: 512330 - RNA, 22 nt, Human
uggcagguagaguucugagaug

SEQ ID NO: 512331 - RNA, 23 nt, Human
acucagugagggccuugggcugc

SEQ ID NO: 512332 - RNA, 22 nt, Human
uacaguaucuucuggcaagcau

SEQ ID NO: 512333 - RNA, 22 nt, Human
augggcugacuaaugguaaacu

SEQ ID NO: 512334 - RNA, 22 nt, Human
ucccagagaagagcuggaugga

SEQ ID NO: 512335 - RNA, 22 nt, Human
gaggaguguauuccacaccacu

SEQ ID NO: 512336 - RNA, 22 nt, Human
acagccagugcuccgugaggac

SEQ ID NO: 512337 - RNA, 22 nt, Human
gagguggcuccuucagggaaua

SEQ ID NO: 512338 - RNA, 22 nt, Human
gcucagagcaucccagugaaug

SEQ ID NO: 512339 - RNA, 22 nt, Human
auguguauauuuauuguaguuu

SEQ ID NO: 512340 - RNA, 22 nt, Human
ccugccugucccucaguccaca

SEQ ID NO: 512341 - RNA, 22 nt, Human
cgcaccacugaauuccagccug

SEQ ID NO: 512342 - RNA, 22 nt, Human
uaaaugcaagggaaaggcaaga

SEQ ID NO: 512343 - RNA, 22 nt, Human
agcuuuaucacaauauuggcua

SEQ ID NO: 512344 - RNA, 22 nt, Human
ccagagcccagcacacggugcu

SEQ ID NO: 512345 - RNA, 22 nt, Human
accucaggauguggacacagaa

SEQ ID NO: 512346 - RNA, 22 nt, Human
gccuguuuuccugcugugguug

SEQ ID NO: 512347 - RNA, 22 nt, Human
cagggcuggauuucauuucuag

SEQ ID NO: 512348 - RNA, 22 nt, Human
gagguccagagcagguucagug

SEQ ID NO: 512349 - RNA, 17 nt, Human
agugacuuggaaagagc

SEQ ID NO: 512350 - RNA, 22 nt, Human
aaugaagccagcugggaugcga

SEQ ID NO: 512351 - RNA, 22 nt, Human
uucugagccagagucaguuaug

SEQ ID NO: 512352 - RNA, 22 nt, Human
ucauuuuucacacagggucacc

SEQ ID NO: 512353 - RNA, 22 nt, Human
gggccaaggggagcuggaaggg

SEQ ID NO: 512354 - RNA, 22 nt, Human
ccacagggaacaugacagccuu

SEQ ID NO: 512355 - RNA, 22 nt, Human
aucauuuuauggcugagaggac

SEQ ID NO: 512356 - RNA, 22 nt, Human
cagcugccacaccucuuucucu

SEQ ID NO: 512357 - RNA, 22 nt, Human
ccaggcagcucugauuuauguc

SEQ ID NO: 512358 - RNA, 22 nt, Human
uacauguuugguaaaugauggc

SEQ ID NO: 512359 - RNA, 22 nt, Human
aagaggaaaugauugacuauau

SEQ ID NO: 512360 - RNA, 22 nt, Human
uccugccuugccugggacauca

SEQ ID NO: 512361 - RNA, 22 nt, Human
guuugccuuuuagauaggaaug

SEQ ID NO: 512362 - RNA, 22 nt, Human
aggagcugaaacuucucauaug

SEQ ID NO: 512363 - RNA, 22 nt, Human
ugggccugggucuuugcugcca

SEQ ID NO: 512364 - RNA, 23 nt, Human
ggcacagaugcugagcaugugca

SEQ ID NO: 512365 - RNA, 22 nt, Human
gauaaauuaucagggguuuaaa

SEQ ID NO: 512366 - RNA, 22 nt, Human
agaagacagagucuacauucua

SEQ ID NO: 512367 - RNA, 22 nt, Human
gaagguagcugcugagaugaca

SEQ ID NO: 512368 - RNA, 22 nt, Human
gaccuucuugcuguguccuaac

SEQ ID NO: 512369 - RNA, 23 nt, Human
acagugugguggacaaggagcag

SEQ ID NO: 512370 - RNA, 22 nt, Human
gcaguguuucaaaucaaaggca

SEQ ID NO: 512371 - RNA, 19 nt, Human
uuucuaagcuaaaugcuuc

SEQ ID NO: 512372 - RNA, 22 nt, Human
uacaugugguagggagggcagu

SEQ ID NO: 512373 - RNA, 22 nt, Human
ggguccugcgugggcccaggac

SEQ ID NO: 512374 - RNA, 22 nt, Human
uauacuuaugcuaaaaaauguu

SEQ ID NO: 512375 - RNA, 22 nt, Human
accauuugacucucuaaggaua

SEQ ID NO: 512376 - RNA, 22 nt, Human
augcuaaauucagacaggguua

SEQ ID NO: 512377 - RNA, 22 nt, Human
cugugggcugaaagugcucccg

SEQ ID NO: 512378 - RNA, 22 nt, Human
cagcaggguauacagggaauuu

SEQ ID NO: 512379 - RNA, 22 nt, Human
aagauguuaggaaaguuagggu

SEQ ID NO: 512380 - RNA, 22 nt, Human
cuuccuccgaagaaguugcugg

SEQ ID NO: 512381 - RNA, 16 nt, Human
ugggugggaggagcgg

SEQ ID NO: 512382 - RNA, 22 nt, Human
agugucugccugggaggagcau

SEQ ID NO: 512383 - RNA, 22 nt, Human
gcagagccuugcgucaugugcc

SEQ ID NO: 512384 - RNA, 22 nt, Human
auaguguguuagugacauaggc

SEQ ID NO: 512385 - RNA, 22 nt, Human
ugagccaguggaagauggcagu

SEQ ID NO: 512386 - RNA, 21 nt, Human
guuuuaagggagaaaaccuag

SEQ ID NO: 512387 - RNA, 22 nt, Human
agccaaaguccaaaugcagugu

SEQ ID NO: 512388 - RNA, 22 nt, Human
caccaaagucgcuucugucguc

SEQ ID NO: 512389 - RNA, 22 nt, Human
aggucaaaccacagcucuaggc

SEQ ID NO: 512390 - RNA, 22 nt, Human
cuuauuauaaaauccuguuuga

SEQ ID NO: 512391 - RNA, 22 nt, Human
aguaugaaucucuuuauucugc

SEQ ID NO: 512392 - RNA, 22 nt, Human
gaggccagcgcgcagcacuuuu

SEQ ID NO: 512393 - RNA, 22 nt, Human
ugcguugcgcuccugcagcagg

SEQ ID NO: 512394 - RNA, 22 nt, Human
agucccaguucgguucuuccuc

SEQ ID NO: 512395 - RNA, 22 nt, Human
ucugaagcuggaggaagcuuug

SEQ ID NO: 512396 - RNA, 22 nt, Human
cuguauuuguccucuauuuauu

SEQ ID NO: 512397 - RNA, 18 nt, Human
gggaucaggcugccuagg

SEQ ID NO: 512398 - RNA, 22 nt, Human
agcuggcuucucugcagacauu

SEQ ID NO: 512399 - RNA, 22 nt, Human
uccucaguuauaaauaggaaac

SEQ ID NO: 512400 - RNA, 22 nt, Human
ggcucccuguucuauucccugg

SEQ ID NO: 512401 - RNA, 22 nt, Human
uuucauauuguccagucagcgc

SEQ ID NO: 512402 - RNA, 22 nt, Human
agaaggccaagaagaagccuau

SEQ ID NO: 512403 - RNA, 22 nt, Human
ugagagacacacugugcaugua

SEQ ID NO: 512404 - RNA, 22 nt, Human
aauaaugagacagcuuauuuaa

SEQ ID NO: 512405 - RNA, 22 nt, Human
auuguugaucuucugguaagcc

SEQ ID NO: 512406 - RNA, 19 nt, Human
gguaaaagugagcuucagg

SEQ ID NO: 512407 - RNA, 23 nt, Human
acucguggaauucucugcgaucg

SEQ ID NO: 512408 - RNA, 18 nt, Human
caugggugacagguggau

SEQ ID NO: 512409 - RNA, 22 nt, Human
ugagcccaggaguuggagaccg

SEQ ID NO: 512410 - RNA, 22 nt, Human
uuuaucugagcugauagauagu

SEQ ID NO: 512411 - RNA, 22 nt, Human
gaugcugagagguggagggaac

SEQ ID NO: 512412 - RNA, 22 nt, Human
gcugggucuggcugugagccgg

SEQ ID NO: 512413 - RNA, 22 nt, Human
uccugcagccacugcaggcaga

SEQ ID NO: 512414 - RNA, 22 nt, Human
uucuuucucacucuuuaggaag

SEQ ID NO: 512415 - RNA, 22 nt, Human
aauuccaacagacaaaguuaga

SEQ ID NO: 512416 - RNA, 22 nt, Human
ugagccaguucuucagauccau

SEQ ID NO: 512417 - RNA, 22 nt, Human
uaaacaagcugucugauauucu

SEQ ID NO: 512418 - RNA, 22 nt, Human
agcccaugcaacaggccuagcg

SEQ ID NO: 512419 - RNA, 20 nt, Human
auguccugcuucuccucacc

SEQ ID NO: 512420 - RNA, 22 nt, Human
uauuaguagcuugaaauuggug

SEQ ID NO: 512421 - RNA, 22 nt, Human
gcaaggcuuugugaauuuuaaa

SEQ ID NO: 512422 - RNA, 22 nt, Human
acaaugaacgcuuuuuaacugu

SEQ ID NO: 512423 - RNA, 22 nt, Human
aucaguuucugugaagaacaca

SEQ ID NO: 512424 - RNA, 22 nt, Human
ccuuggauuuugugcccacgcc

SEQ ID NO: 512425 - RNA, 22 nt, Human
ccaggacuuuaaguccagcacu

SEQ ID NO: 512426 - RNA, 22 nt, Human
ggcaggugcuugucgaaggccu

SEQ ID NO: 512427 - RNA, 22 nt, Human
cagacagacagccguggccacc

SEQ ID NO: 512428 - RNA, 22 nt, Human
gguggggccugcuccagcggcc

SEQ ID NO: 512429 - RNA, 22 nt, Human
aaguguuaaaagauuaaaugcu

SEQ ID NO: 512430 - RNA, 21 nt, Human
acacacugaguuuuccacugu

SEQ ID NO: 512431 - RNA, 22 nt, Human
ggagcauguggggugagcaggg

SEQ ID NO: 512432 - RNA, 22 nt, Human
aggagccaggaaaccugcucug

SEQ ID NO: 512433 - RNA, 22 nt, Human
ucacacagcugacagagccuuu

SEQ ID NO: 512434 - RNA, 18 nt, Human
aggcacagagcauacaua

SEQ ID NO: 512435 - RNA, 22 nt, Human
gccugcagugagugcagaaggu

SEQ ID NO: 512436 - RNA, 22 nt, Human
aaauuucuguuguuuugagcca

SEQ ID NO: 512437 - RNA, 22 nt, Human
ugauugaacugagcuucaagau

SEQ ID NO: 512438 - RNA, 22 nt, Human
cuccugucagaagcauccugag

SEQ ID NO: 512439 - RNA, 22 nt, Human
ccugccugggcucacuugccag

SEQ ID NO: 512440 - RNA, 22 nt, Human
augauuuccaguuguugcuaag

SEQ ID NO: 512441 - RNA, 22 nt, Human
aaugcauuagcuacauaugucu

SEQ ID NO: 512442 - RNA, 22 nt, Human
uggaagggggaagacagcucug

SEQ ID NO: 512443 - RNA, 22 nt, Human
gguccccguggaggcuggagcg

SEQ ID NO: 512444 - RNA, 22 nt, Human
uucaacauguucuacauaaggg

SEQ ID NO: 512445 - RNA, 22 nt, Human
aaguugaaucaguaacacaguu

SEQ ID NO: 512446 - RNA, 22 nt, Human
cagaagaauggugucugagcuc

SEQ ID NO: 512447 - RNA, 22 nt, Human
gcagcacauauaaacaaagaga

SEQ ID NO: 512448 - RNA, 22 nt, Human
agagccuguacuuuucugugaa

SEQ ID NO: 512449 - RNA, 22 nt, Human
agagaggcgaguuaccugugcu

SEQ ID NO: 512450 - RNA, 22 nt, Human
ugauaaacuggagagguggagg

SEQ ID NO: 512451 - RNA, 22 nt, Human
ucagggcugacugcuacucucc

SEQ ID NO: 512452 - RNA, 22 nt, Human
gccugggagcacaucggggucc

SEQ ID NO: 512453 - RNA, 22 nt, Human
aauguugagcuugaaaguaggu

SEQ ID NO: 512454 - RNA, 22 nt, Human
cccucugcaggcuggaccugcc

SEQ ID NO: 512455 - RNA, 22 nt, Human
ccacaguccgggcuggcaggac

SEQ ID NO: 512456 - RNA, 22 nt, Human
cacacagguauauauauguaca

SEQ ID NO: 512457 - RNA, 22 nt, Human
ggagguccaugugaauguggcc

SEQ ID NO: 512458 - RNA, 16 nt, Human
gagggcagaggcggaa

SEQ ID NO: 512459 - RNA, 22 nt, Human
gucagcaggguccccuugagug

SEQ ID NO: 512460 - RNA, 22 nt, Human
ugcaggugccucuugagcuugu

SEQ ID NO: 512461 - RNA, 21 nt, Human
agaagccauuuguuaggacuu

SEQ ID NO: 512462 - RNA, 22 nt, Human
cuagucacucagcacugacaaa

SEQ ID NO: 512463 - RNA, 22 nt, Human
uggcucagccauucguguugcc

SEQ ID NO: 512464 - RNA, 22 nt, Human
caagaaauguuuacugagcauc

SEQ ID NO: 512465 - RNA, 22 nt, Human
ggaagggcaaaagagaugaacu

SEQ ID NO: 512466 - RNA, 22 nt, Human
gaggcaggcacuguuaucagca

SEQ ID NO: 512467 - RNA, 22 nt, Human
accugccaagcaucaguggcag

SEQ ID NO: 512468 - RNA, 22 nt, Human
aaauucuaugucaauguuuauu

SEQ ID NO: 512469 - RNA, 23 nt, Human
agaaaguuugugccuugugacac

SEQ ID NO: 512470 - RNA, 22 nt, Human
uguguguuaucuuaguucaucu

SEQ ID NO: 512471 - RNA, 21 nt, Human
acagccugucaucucaugguc

SEQ ID NO: 512472 - RNA, 22 nt, Human
ucauugcaguugaguuguguua

SEQ ID NO: 512473 - RNA, 22 nt, Human
cucuguuuggcgcugcuccuuc

SEQ ID NO: 512474 - RNA, 22 nt, Human
gucuggaggcccgucagcccua

SEQ ID NO: 512475 - RNA, 22 nt, Human
gggacccagguaauccugugcu

SEQ ID NO: 512476 - RNA, 22 nt, Human
cagggagaggcaucauagggaa

SEQ ID NO: 512477 - RNA, 22 nt, Human
ugauuuccugugcgcccuuagg

SEQ ID NO: 512478 - RNA, 22 nt, Human
uuacaguuguucuaucagcaug

SEQ ID NO: 512479 - RNA, 22 nt, Human
acuaaauauuugagagguguag

SEQ ID NO: 512480 - RNA, 22 nt, Human
gucccugggucuaaggcaguaa

SEQ ID NO: 512481 - RNA, 22 nt, Human
ggagccuuccagacugcccaca

SEQ ID NO: 512482 - RNA, 22 nt, Human
cacuuaagcaguuaauuuaucu

SEQ ID NO: 512483 - RNA, 22 nt, Human
acauuucucccugcaugccugc

SEQ ID NO: 512484 - RNA, 22 nt, Human
uuguauauauucuuaaagaugu

SEQ ID NO: 512485 - RNA, 22 nt, Human
caguauuucauucagaauuguu

SEQ ID NO: 512486 - RNA, 22 nt, Human
ugcucuguauucuauggcaguu

SEQ ID NO: 512487 - RNA, 22 nt, Human
cagcagcucagucucucaguag

SEQ ID NO: 512488 - RNA, 22 nt, Human
uuugacagauccuuaacucagc

SEQ ID NO: 512489 - RNA, 22 nt, Human
ucagggacuaggugcugccuga

SEQ ID NO: 512490 - RNA, 22 nt, Human
auguaucagauaaagcaugugg

SEQ ID NO: 512491 - RNA, 22 nt, Human
ugggaggaaugucacugagcca

SEQ ID NO: 512492 - RNA, 22 nt, Human
cacuaguccugguuucaugcua

SEQ ID NO: 512493 - RNA, 22 nt, Human
uccucagggggccaacccagcc

SEQ ID NO: 512494 - RNA, 22 nt, Human
aaucaguuguucacucugaaaa

SEQ ID NO: 512495 - RNA, 22 nt, Human
acagaguagcucaagaagauug

SEQ ID NO: 512496 - RNA, 22 nt, Human
acagguguugacucacaggccc

SEQ ID NO: 512497 - RNA, 22 nt, Human
uauugugaguucagacuaaaaa

SEQ ID NO: 512498 - RNA, 21 nt, Human
guacacacagguggaugggcu

SEQ ID NO: 512499 - RNA, 19 nt, Human
ugucccagacuccgugucu

SEQ ID NO: 512500 - RNA, 22 nt, Human
aaauaauugaguuggucaauau

SEQ ID NO: 512501 - RNA, 22 nt, Human
acaggcucucagccaguuggca

SEQ ID NO: 512502 - RNA, 22 nt, Human
ucuagcugaggguaggagaccu

SEQ ID NO: 512503 - RNA, 22 nt, Human
cucuggaggccguuggcccuua

SEQ ID NO: 512504 - RNA, 22 nt, Human
caaguuugcugauccuuguuuu

SEQ ID NO: 512505 - RNA, 22 nt, Human
uaaagugccucagguccugggu

SEQ ID NO: 512506 - RNA, 22 nt, Human
ggcccaaggcccaggucgagcu

SEQ ID NO: 512507 - RNA, 18 nt, Human
uguggcugguccacacug

SEQ ID NO: 512508 - RNA, 22 nt, Human
uuuugugaauaguuuaucuaag

SEQ ID NO: 512509 - RNA, 22 nt, Human
gaguuauuaauggcugaguuug

SEQ ID NO: 512510 - RNA, 22 nt, Human
gagaggagguggcuaugacagc

SEQ ID NO: 512511 - RNA, 22 nt, Human
ggaggccaaggcagguggaucg

SEQ ID NO: 512512 - RNA, 22 nt, Human
gcucugcugcuuacuagauggu

SEQ ID NO: 512513 - RNA, 22 nt, Human
cuuaaaaucuggcaguuagcua

SEQ ID NO: 512514 - RNA, 22 nt, Human
ugaggugaagaguggagcucag

SEQ ID NO: 512515 - RNA, 19 nt, Human
gcucugugaugcugagggg

SEQ ID NO: 512516 - RNA, 22 nt, Human
cuggccucauagccaagcugug

SEQ ID NO: 512517 - RNA, 22 nt, Human
ucccagagcucuggagguugga

SEQ ID NO: 512518 - RNA, 22 nt, Human
uguguuccugccuggcucuggu

SEQ ID NO: 512519 - RNA, 22 nt, Human
uuuucucaggugcuuaucuaag

SEQ ID NO: 512520 - RNA, 22 nt, Human
ucccaggguuacagccagggca

SEQ ID NO: 512521 - RNA, 22 nt, Human
agugacugggcagggcagggcc

SEQ ID NO: 512522 - RNA, 22 nt, Human
uccauuuucaucucauguauaa

SEQ ID NO: 512523 - RNA, 20 nt, Human
auuuggcaugaaguauugau

SEQ ID NO: 512524 - RNA, 22 nt, Human
caaaugauccuugcaagcugug

SEQ ID NO: 512525 - RNA, 22 nt, Human
augagguauucguaauauuucc

SEQ ID NO: 512526 - RNA, 22 nt, Human
uguacaguaggaacuuguuauu

SEQ ID NO: 512527 - RNA, 22 nt, Human
auacuguuucucuucuacauga

SEQ ID NO: 512528 - RNA, 22 nt, Human
uucagcacuguuauggauuugc

SEQ ID NO: 512529 - RNA, 22 nt, Human
agagucugaggaggaccaacag

SEQ ID NO: 512530 - RNA, 22 nt, Human
ccagcuggcacuguggcugccc

SEQ ID NO: 512531 - RNA, 22 nt, Human
augcuuuauuauuuugcaggga

SEQ ID NO: 512532 - RNA, 22 nt, Human
ucagagaaaugaaguagggauu

SEQ ID NO: 512533 - RNA, 22 nt, Human
caggcagggagcuggaaaggau

SEQ ID NO: 512534 - RNA, 22 nt, Human
cuggcugcuugggacagccaug

SEQ ID NO: 512535 - RNA, 22 nt, Human
gggcaaguccggugcccagagc

SEQ ID NO: 512536 - RNA, 22 nt, Human
gaagagcuguagccugcucuuu

SEQ ID NO: 512537 - RNA, 22 nt, Human
auggaaauacagccagagcaga

SEQ ID NO: 512538 - RNA, 20 nt, Human
ugccuugggacagugccugu

SEQ ID NO: 512539 - RNA, 21 nt, Human
ugggccugauucccaggguca

SEQ ID NO: 512540 - RNA, 22 nt, Human
cugcuuuguaaaauagacauaa

SEQ ID NO: 512541 - RNA, 22 nt, Human
uggagcugggguuugaaucugg

SEQ ID NO: 512542 - RNA, 22 nt, Human
cagugcaauguuaaauaggaaa

SEQ ID NO: 512543 - RNA, 22 nt, Human
aggggugauuugggacaggaca

SEQ ID NO: 512544 - RNA, 22 nt, Human
aaagaugucauacacauuaaga

SEQ ID NO: 512545 - RNA, 22 nt, Human
ggacuuuagcuguaaugugugu

SEQ ID NO: 512546 - RNA, 22 nt, Human
gggaaacugaauucaggacucu

SEQ ID NO: 512547 - RNA, 22 nt, Human
uacagcuuuauacccaucaaaa

SEQ ID NO: 512548 - RNA, 22 nt, Human
agggcagcagcccauggcucug

SEQ ID NO: 512549 - RNA, 22 nt, Human
gggcuggggcucaauaauuugu

SEQ ID NO: 512550 - RNA, 22 nt, Human
ccugggagguggagguugcagc

SEQ ID NO: 512551 - RNA, 22 nt, Human
uauguagaagcugcucaaagaa

SEQ ID NO: 512552 - RNA, 22 nt, Human
aaugaagccacugaagacaauc

SEQ ID NO: 512553 - RNA, 22 nt, Human
aggcagaaccagcugggacuuu

SEQ ID NO: 512554 - RNA, 22 nt, Human
ucauaaauuagcugucuuugaa

SEQ ID NO: 512555 - RNA, 22 nt, Human
aagaguucucagaaacgugggu

SEQ ID NO: 512556 - RNA, 19 nt, Human
ccugggaggcggagguugc

SEQ ID NO: 512557 - RNA, 22 nt, Human
gccggggcuggggagagacaug

SEQ ID NO: 512558 - RNA, 22 nt, Human
uuucagauuaucucaacuuugg

SEQ ID NO: 512559 - RNA, 22 nt, Human
cucaaguaagaaacagaauugg

SEQ ID NO: 512560 - RNA, 22 nt, Human
cccaggcuuuuaaguuagacag

SEQ ID NO: 512561 - RNA, 22 nt, Human
gacaauaaaaugaucuuacagu

SEQ ID NO: 512562 - RNA, 22 nt, Human
ucccugcuuggaaugacccuua

SEQ ID NO: 512563 - RNA, 22 nt, Human
uugaaguucugcauuucuaaua

SEQ ID NO: 512564 - RNA, 22 nt, Human
uguccugggucccugcuagaag

SEQ ID NO: 512565 - RNA, 22 nt, Human
uuccaggggcagcagugauggu

SEQ ID NO: 512566 - RNA, 22 nt, Human
gaacauuuccagaaaggaacua

SEQ ID NO: 512567 - RNA, 22 nt, Human
ccaaaucaccagcacgaucauu

SEQ ID NO: 512568 - RNA, 22 nt, Human
ggcucugcuucagaaggcucau

SEQ ID NO: 512569 - RNA, 22 nt, Human
agcccugggauacaguaaaagc

SEQ ID NO: 512570 - RNA, 18 nt, Human
ggguccuguucuuggaag

SEQ ID NO: 512571 - RNA, 17 nt, Human
cuuguuuuccacuggga

SEQ ID NO: 512572 - RNA, 22 nt, Human
aggccagagaggggaccagccu

SEQ ID NO: 512573 - RNA, 23 nt, Human
agucaguguaaguuuggaaugca

SEQ ID NO: 512574 - RNA, 17 nt, Human
ugcugccaagucccaac

SEQ ID NO: 512575 - RNA, 22 nt, Human
ucacaguuauagucuguagaau

SEQ ID NO: 512576 - RNA, 22 nt, Human
cauugaaaccuaacauaggcug

SEQ ID NO: 512577 - RNA, 22 nt, Human
aacuauguuaauaaguuucauu

SEQ ID NO: 512578 - RNA, 22 nt, Human
aucuuggggaauccucugugua

SEQ ID NO: 512579 - RNA, 22 nt, Human
uaacagaaacagauaaguguaa

SEQ ID NO: 512580 - RNA, 22 nt, Human
cuguccugauggugccacuggu

SEQ ID NO: 512581 - RNA, 22 nt, Human
gcccaggcuagcguagagugca

SEQ ID NO: 512582 - RNA, 21 nt, Human
auucagaguaauucaucuuua

SEQ ID NO: 512583 - RNA, 22 nt, Human
agugucugaaccugcaguggga

SEQ ID NO: 512584 - RNA, 22 nt, Human
ugguuucccauuaucugcagga

SEQ ID NO: 512585 - RNA, 22 nt, Human
uagcaggguaaauguagaugga

SEQ ID NO: 512586 - RNA, 22 nt, Human
uauauaugggggaagcuggaug

SEQ ID NO: 512587 - RNA, 22 nt, Human
gcuggagggguaauaggauggg

SEQ ID NO: 512588 - RNA, 22 nt, Human
gggcugcuuuuuucuuagcaga

SEQ ID NO: 512589 - RNA, 22 nt, Human
gccucugggguggagcccagca

SEQ ID NO: 512590 - RNA, 23 nt, Human
ucuggcucuaugugacagcucuc

SEQ ID NO: 512591 - RNA, 22 nt, Human
ugggccugggcuggacagccug

SEQ ID NO: 512592 - RNA, 22 nt, Human
cagggcucccaaauaucucuuc

SEQ ID NO: 512593 - RNA, 22 nt, Human
ucacaugcuacugagccagacc

SEQ ID NO: 512594 - RNA, 22 nt, Human
ggccucucuccagucagugcag

SEQ ID NO: 512595 - RNA, 22 nt, Human
cccagcuucugagggggccuug

SEQ ID NO: 512596 - RNA, 22 nt, Human
aaaucaguuagugguaggauug

SEQ ID NO: 512597 - RNA, 22 nt, Human
acucugagcaucccaagucuua

SEQ ID NO: 512598 - RNA, 22 nt, Human
uuuaccaucugccacagauaug

SEQ ID NO: 512599 - RNA, 22 nt, Human
cuaguccagucucaaaaugcua

SEQ ID NO: 512600 - RNA, 22 nt, Human
gggcugcacagaucuucaaggg

SEQ ID NO: 512601 - RNA, 22 nt, Human
uuuaugaacuacagauauaacu

SEQ ID NO: 512602 - RNA, 22 nt, Human
cccagccuuccacccuggacua

SEQ ID NO: 512603 - RNA, 21 nt, Human
ucagaacaauuccaugccucc

SEQ ID NO: 512604 - RNA, 22 nt, Human
cucuccagaauaugccgccgug

SEQ ID NO: 512605 - RNA, 22 nt, Human
ggcagcaugggugccuuuguga

SEQ ID NO: 512606 - RNA, 22 nt, Human
uagcaaaagcucaacaggaagg

SEQ ID NO: 512607 - RNA, 22 nt, Human
cuagagcagauugcagaguagg

SEQ ID NO: 512608 - RNA, 22 nt, Human
ggaaggagccauaucauaucca

SEQ ID NO: 512609 - RNA, 22 nt, Human
ggguuccaaugaugagcaagag

SEQ ID NO: 512610 - RNA, 20 nt, Human
gcagagccucacugcaaggg

SEQ ID NO: 512611 - RNA, 22 nt, Human
gagggucccugcucagggccag

SEQ ID NO: 512612 - RNA, 20 nt, Human
ggccaccugcuucagacccc

SEQ ID NO: 512613 - RNA, 22 nt, Human
cagaggcucaccagccuuucac

SEQ ID NO: 512614 - RNA, 22 nt, Human
uccagagccuauauguucaacu

SEQ ID NO: 512615 - RNA, 22 nt, Human
gaaacaugucugacaauuuacc

SEQ ID NO: 512616 - RNA, 22 nt, Human
acaggcucaguucacuggauuu

SEQ ID NO: 512617 - RNA, 19 nt, Human
ugcccaggccucccaaaag

SEQ ID NO: 512618 - RNA, 22 nt, Human
agcuucuuuaauucagcaugau

SEQ ID NO: 512619 - RNA, 22 nt, Human
gcuucugggguucuggcaugcu

SEQ ID NO: 512620 - RNA, 22 nt, Human
ggcucagaaacuaaaggcgcug

SEQ ID NO: 512621 - RNA, 22 nt, Human
uuggaucuuaugaagguggcau

SEQ ID NO: 512622 - RNA, 22 nt, Human
uggagagccuggagucccugau

SEQ ID NO: 512623 - RNA, 22 nt, Human
uuaaauuauugagggauuguca

SEQ ID NO: 512624 - RNA, 22 nt, Human
uucacagugagcuaugucuugu

SEQ ID NO: 512625 - RNA, 22 nt, Human
uuacuuuguucucaagauaugu

SEQ ID NO: 512626 - RNA, 22 nt, Human
ucaggcuguuagccaccuccuc

SEQ ID NO: 512627 - RNA, 22 nt, Human
aaacagacugaagaguugaagc

SEQ ID NO: 512628 - RNA, 22 nt, Human
ucucacaucugcccugugcugg

SEQ ID NO: 512629 - RNA, 22 nt, Human
gacacaaaguuugucagaaauu

SEQ ID NO: 512630 - RNA, 22 nt, Human
gcugccugcuucaugugggaga

SEQ ID NO: 512631 - RNA, 22 nt, Human
ggaggcggggaaggcaucccau

SEQ ID NO: 512632 - RNA, 22 nt, Human
agagcagcuuuucggaaccacu

SEQ ID NO: 512633 - RNA, 22 nt, Human
ugagaggcagaauggugccugc

SEQ ID NO: 512634 - RNA, 22 nt, Human
guuuucucaucuccucaauggu

SEQ ID NO: 512635 - RNA, 22 nt, Human
uucaugaauggaaucaaugcuc

SEQ ID NO: 512636 - RNA, 22 nt, Human
uggaaucuuuaggaagcacaua

SEQ ID NO: 512637 - RNA, 23 nt, Human
ugcuggcuuccagcugcucccuc

SEQ ID NO: 512638 - RNA, 22 nt, Human
agaaggaguguacaggucaugc

SEQ ID NO: 512639 - RNA, 22 nt, Human
uucacaggaauguaggggucuu

SEQ ID NO: 512640 - RNA, 22 nt, Human
gcucacugccauucucuagaug

SEQ ID NO: 512641 - RNA, 22 nt, Human
uagugucagcaucucauugagc

SEQ ID NO: 512642 - RNA, 22 nt, Human
uuucaaaugcaugucuuuccuc

SEQ ID NO: 512643 - RNA, 22 nt, Human
aguggcaauguagagagugauc

SEQ ID NO: 512644 - RNA, 22 nt, Human
gcaggcguguuucacgugccag

SEQ ID NO: 512645 - RNA, 22 nt, Human
gcacaaaacacauuuugacaau

SEQ ID NO: 512646 - RNA, 21 nt, Human
ggcuguggagccaugacucac

SEQ ID NO: 512647 - RNA, 22 nt, Human
ugcauuugaguugggagcaggc

SEQ ID NO: 512648 - RNA, 22 nt, Human
aucuggcucaccuggguaaaua

SEQ ID NO: 512649 - RNA, 22 nt, Human
uucccaugccuggccccuaucc

SEQ ID NO: 512650 - RNA, 22 nt, Human
gcauuccugagaaugcagagug

SEQ ID NO: 512651 - RNA, 22 nt, Human
agaggggcucauauccugucau

SEQ ID NO: 512652 - RNA, 22 nt, Human
ccugaggacacacgcugcagga

SEQ ID NO: 512653 - RNA, 22 nt, Human
auucaaguggcugcuauguuaa

SEQ ID NO: 512654 - RNA, 22 nt, Human
ugugccugauggucacguggcc

SEQ ID NO: 512655 - RNA, 22 nt, Human
ucuggagcuggcagggcccugg

SEQ ID NO: 512656 - RNA, 22 nt, Human
ugcacgugggcucucugcucuu

SEQ ID NO: 512657 - RNA, 19 nt, Human
aggaaggaaccugagucug

SEQ ID NO: 512658 - RNA, 22 nt, Human
ccagcuuuagguugccugccag

SEQ ID NO: 512659 - RNA, 23 nt, Human
cucccuggaguuucuggaagaug

SEQ ID NO: 512660 - RNA, 22 nt, Human
uuauuauugugaccugagaaug

SEQ ID NO: 512661 - RNA, 19 nt, Human
acuaaaaaugauguuugag

SEQ ID NO: 512662 - RNA, 22 nt, Human
accuucuggucugccugacagc

SEQ ID NO: 512663 - RNA, 22 nt, Human
ugccugaacaugaauaguuuau

SEQ ID NO: 512664 - RNA, 22 nt, Human
uagggacccucccugcucuaac

SEQ ID NO: 512665 - RNA, 22 nt, Human
uagcagcuuccagagagggcag

SEQ ID NO: 512666 - RNA, 20 nt, Human
gcuuccuucccagcccccac

SEQ ID NO: 512667 - RNA, 20 nt, Human
agcugccuucauuuucuaga

SEQ ID NO: 512668 - RNA, 22 nt, Human
uugauuccuugaaauauccuug

SEQ ID NO: 512669 - RNA, 22 nt, Human
uggccucaagucugagggccuu

SEQ ID NO: 512670 - RNA, 22 nt, Human
aagcagcaugauuguaauacua

SEQ ID NO: 512671 - RNA, 22 nt, Human
auauuaggcaaggagauuauuu

SEQ ID NO: 512672 - RNA, 20 nt, Human
auugacagaaaguguucacc

SEQ ID NO: 512673 - RNA, 22 nt, Human
ucauaacagcuaagucccuuuc

SEQ ID NO: 512674 - RNA, 22 nt, Human
ccuggacucagaggugcuggug

SEQ ID NO: 512675 - RNA, 22 nt, Human
agcuccaggugcaagucauggu

SEQ ID NO: 512676 - RNA, 22 nt, Human
uggagugcaguugggaggacac

SEQ ID NO: 512677 - RNA, 22 nt, Human
guaaauauaaaugcuagcugcc

SEQ ID NO: 512678 - RNA, 22 nt, Human
cacaggcucuucucacuugauu

SEQ ID NO: 512679 - RNA, 22 nt, Human
uugaagcagcucaggaggcuua

SEQ ID NO: 512680 - RNA, 22 nt, Human
cuauacagugacuagaaguaau

SEQ ID NO: 512681 - RNA, 22 nt, Human
cagcagcucaggcugcuuccca

SEQ ID NO: 512682 - RNA, 22 nt, Human
caccuggcuggaagugcuccgg

SEQ ID NO: 512683 - RNA, 22 nt, Human
ucacagaagaaguagauugcau

SEQ ID NO: 512684 - RNA, 22 nt, Human
cauuuguauguuccuccuuagg

SEQ ID NO: 512685 - RNA, 22 nt, Human
ucucuggggaaaaggcugauac

SEQ ID NO: 512686 - RNA, 20 nt, Human
cucugggucgagacagacuu

SEQ ID NO: 512687 - RNA, 22 nt, Human
agucacaggguacacaaggauu

SEQ ID NO: 512688 - RNA, 22 nt, Human
cccagcucaucaggagccgccc

SEQ ID NO: 512689 - RNA, 22 nt, Human
ccaggaagccucagaugcugag

SEQ ID NO: 512690 - RNA, 22 nt, Human
ggguguguuccuaaggaaacca

SEQ ID NO: 512691 - RNA, 22 nt, Human
aucuacauaaaacgaauacaua

SEQ ID NO: 512692 - RNA, 22 nt, Human
gacuuugguuugagcaagucag

SEQ ID NO: 512693 - RNA, 22 nt, Human
uaaagugcaggcuacucagaag

SEQ ID NO: 512694 - RNA, 19 nt, Human
gcucugagaggggcauggg

SEQ ID NO: 512695 - RNA, 22 nt, Human
cuuauaaaguccaucugaacaa

SEQ ID NO: 512696 - RNA, 22 nt, Human
ugagaaugaggggguagaaggu

SEQ ID NO: 512697 - RNA, 22 nt, Human
accucugcaaugcaaugucaug

SEQ ID NO: 512698 - RNA, 22 nt, Human
ggggagaauuacauggcgugga

SEQ ID NO: 512699 - RNA, 18 nt, Human
ucagagagcagcuuuauu

SEQ ID NO: 512700 - RNA, 22 nt, Human
ugagguguguccccagggaggu

SEQ ID NO: 512701 - RNA, 22 nt, Human
ccugucugcaugaucccugcca

SEQ ID NO: 512702 - RNA, 20 nt, Human
auguccagugacuggaccau

SEQ ID NO: 512703 - RNA, 22 nt, Human
ccugcuucagggaugauggcac

SEQ ID NO: 512704 - RNA, 22 nt, Human
uggccugguuguugcugccguu

SEQ ID NO: 512705 - RNA, 22 nt, Human
ugcuuaaaggauaguuuaaacu

SEQ ID NO: 512706 - RNA, 22 nt, Human
gagcugaacaucauggaaaggc

SEQ ID NO: 512707 - RNA, 22 nt, Human
ccaggucuuguuugacaucaau

SEQ ID NO: 512708 - RNA, 20 nt, Human
gccucagccaacccaugggg

SEQ ID NO: 512709 - RNA, 22 nt, Human
ucuguguuuaaaagauaugucc

SEQ ID NO: 512710 - RNA, 22 nt, Human
ugggccugaguuugggaacugg

SEQ ID NO: 512711 - RNA, 22 nt, Human
aggccugggacgggagccguga

SEQ ID NO: 512712 - RNA, 22 nt, Human
gcagagcuaucuucuggauuug

SEQ ID NO: 512713 - RNA, 22 nt, Human
cagaggccaguggacaagggcc

SEQ ID NO: 512714 - RNA, 22 nt, Human
ucaggcagcuccaggaauggua

SEQ ID NO: 512715 - RNA, 22 nt, Human
uccaggcaaggauaauaaacau

SEQ ID NO: 512716 - RNA, 22 nt, Human
aucuggcucacuuagucuagga

SEQ ID NO: 512717 - RNA, 22 nt, Human
uuccugaugcacacagucauuu

SEQ ID NO: 512718 - RNA, 22 nt, Human
aaauguguguauguacauauau

SEQ ID NO: 512719 - RNA, 22 nt, Human
aaggaagguucauagucaaaga

SEQ ID NO: 512720 - RNA, 19 nt, Human
gagguggguccccgcagcc

SEQ ID NO: 512721 - RNA, 22 nt, Human
cuggaaggucuguccccacugc

SEQ ID NO: 512722 - RNA, 22 nt, Human
cugggcugcggugguagguugu

SEQ ID NO: 512723 - RNA, 22 nt, Human
agcugccuggagucauuuccug

SEQ ID NO: 512724 - RNA, 22 nt, Human
uugcauugaaaauauauuuuaa

SEQ ID NO: 512725 - RNA, 22 nt, Human
ucaggcagaggauggggagcgu

SEQ ID NO: 512726 - RNA, 16 nt, Human
uguaugaacgucucca

SEQ ID NO: 512727 - RNA, 22 nt, Human
auccuucaaggggcugacagcu

SEQ ID NO: 512728 - RNA, 22 nt, Human
cagcugucuaaguugagcagga

SEQ ID NO: 512729 - RNA, 22 nt, Human
uugacaauugggagauauaaag

SEQ ID NO: 512730 - RNA, 22 nt, Human
cacauaauugaacgugaugagu

SEQ ID NO: 512731 - RNA, 22 nt, Human
caaaugcuacuaauaggcaagu

SEQ ID NO: 512732 - RNA, 22 nt, Human
agcccucauggaacagcuccua

SEQ ID NO: 512733 - RNA, 22 nt, Human
gcaggcaccacggcucaggucu

SEQ ID NO: 512734 - RNA, 22 nt, Human
gcccuucaguuacuccuugaug

SEQ ID NO: 512735 - RNA, 22 nt, Human
ggcugcugaaguguggcaaucu

SEQ ID NO: 512736 - RNA, 22 nt, Human
agagugauucuaguuagggaau

SEQ ID NO: 512737 - RNA, 22 nt, Human
aaguaugucaaucauacuucaa

SEQ ID NO: 512738 - RNA, 22 nt, Human
auaaacacuucuagggcacaca

SEQ ID NO: 512739 - RNA, 22 nt, Human
gaggcccaguccugcaagcacg

SEQ ID NO: 512740 - RNA, 22 nt, Human
ccuuuuucaauauagaauugca

SEQ ID NO: 512741 - RNA, 22 nt, Human
aacaguaaaaaucauuuaguug

SEQ ID NO: 512742 - RNA, 22 nt, Human
cugggcugcgggcgccccucca

SEQ ID NO: 512743 - RNA, 23 nt, Human
ccugucugugcuggguggacaca

SEQ ID NO: 512744 - RNA, 22 nt, Human
agcagcugcagagggcuccccc

SEQ ID NO: 512745 - RNA, 22 nt, Human
aguuucucucaguauagaauag

SEQ ID NO: 512746 - RNA, 22 nt, Human
aggcaagaacagacaugggagu

SEQ ID NO: 512747 - RNA, 22 nt, Human
ucucugggcucaggagcccggc

SEQ ID NO: 512748 - RNA, 22 nt, Human
agggggcugccaaggaauguaa

SEQ ID NO: 512749 - RNA, 17 nt, Human
gcugccaccuuuggagc

SEQ ID NO: 512750 - RNA, 18 nt, Human
aggaagcaggaggaaggc

SEQ ID NO: 512751 - RNA, 22 nt, Human
ugcuuaauauugugauguaaua

SEQ ID NO: 512752 - RNA, 22 nt, Human
uuguuuaaaagaaaucauagaa

SEQ ID NO: 512753 - RNA, 22 nt, Human
aguuggagaagaggucgggaau

SEQ ID NO: 512754 - RNA, 22 nt, Human
guagaugagcucacaugaccuu

SEQ ID NO: 512755 - RNA, 22 nt, Human
gugugccaacaaaagacagugc

SEQ ID NO: 512756 - RNA, 22 nt, Human
ggcagaguugguggagucaguu

SEQ ID NO: 512757 - RNA, 22 nt, Human
cugggacacccaaggaaagagc

SEQ ID NO: 512758 - RNA, 20 nt, Human
ucuuuguuaauuuuaucucc

SEQ ID NO: 512759 - RNA, 22 nt, Human
gcaggcagguggcaucuuguga

SEQ ID NO: 512760 - RNA, 22 nt, Human
uuggcaggaauauugcagaggu

SEQ ID NO: 512761 - RNA, 22 nt, Human
acauaaugagcucuuuauaaau

SEQ ID NO: 512762 - RNA, 22 nt, Human
uauguguguaugacagacagag

SEQ ID NO: 512763 - RNA, 22 nt, Human
auguaacauugaauuauauagu

SEQ ID NO: 512764 - RNA, 19 nt, Human
ugccuggcaccagcuccac

SEQ ID NO: 512765 - RNA, 22 nt, Human
uuccaguuaaggaagcuauucu

SEQ ID NO: 512766 - RNA, 22 nt, Human
ucacauaaauuauacaauuuca

SEQ ID NO: 512767 - RNA, 22 nt, Human
aacacauaggcagagcaugaca

SEQ ID NO: 512768 - RNA, 22 nt, Human
gaaugcagauggcugguguaug

SEQ ID NO: 512769 - RNA, 22 nt, Human
cacacccucgugcucccucccg

SEQ ID NO: 512770 - RNA, 22 nt, Human
uucaaucauuagaaucucaggc

SEQ ID NO: 512771 - RNA, 22 nt, Human
gagcccgagcgcguacccggcg

SEQ ID NO: 512772 - RNA, 22 nt, Human
cagcagcagccccaggaagguu

SEQ ID NO: 512773 - RNA, 22 nt, Human
cagaaauggaauuuuccaucac

SEQ ID NO: 512774 - RNA, 22 nt, Human
gcacaggcuccggaggagagcu

SEQ ID NO: 512775 - RNA, 22 nt, Human
agccuggaccaggggccucaga

SEQ ID NO: 512776 - RNA, 22 nt, Human
uucuucauggguucuuuuagga

SEQ ID NO: 512777 - RNA, 17 nt, Human
agcagcugaagcagcca

SEQ ID NO: 512778 - RNA, 18 nt, Human
acauacauucugucugca

SEQ ID NO: 512779 - RNA, 17 nt, Human
gaauuucuuggucaaaa

SEQ ID NO: 512780 - RNA, 22 nt, Human
guacacacuauuuaaaguguuu

SEQ ID NO: 512781 - RNA, 22 nt, Human
gaaacaaucaucaugugauuug

SEQ ID NO: 512782 - RNA, 22 nt, Human
gcauuuguguucuuccuagagc

SEQ ID NO: 512783 - RNA, 22 nt, Human
agggcuggcaucucuaaugcug

SEQ ID NO: 512784 - RNA, 22 nt, Human
acaguaaaucaacagaauaucu

SEQ ID NO: 512785 - RNA, 22 nt, Human
cugccuuccaaccccagacucc

SEQ ID NO: 512786 - RNA, 22 nt, Human
gugucacaagagcccaggaaac

SEQ ID NO: 512787 - RNA, 22 nt, Human
cuauugaauagcccaaaucauu

SEQ ID NO: 512788 - RNA, 22 nt, Human
uacaguaaccagucuacuuaga

SEQ ID NO: 512789 - RNA, 22 nt, Human
uggccaccuuauggcuauugga

SEQ ID NO: 512790 - RNA, 22 nt, Human
gcagcaggaauuuaaauuuaua

SEQ ID NO: 512791 - RNA, 22 nt, Human
cucuggagaacuccuugugucu

SEQ ID NO: 512792 - RNA, 20 nt, Human
gaggcugcggacugcuggac

SEQ ID NO: 512793 - RNA, 22 nt, Human
ucacugcuauauuggauacuga

SEQ ID NO: 512794 - RNA, 22 nt, Human
uugaaaggcacaggcaccuggg

SEQ ID NO: 512795 - RNA, 22 nt, Human
ggcugucaauucauaggucaga

SEQ ID NO: 512796 - RNA, 22 nt, Human
gcucucugccuuucucaaugac

SEQ ID NO: 512797 - RNA, 22 nt, Human
cuuccugggucuggagacugga

SEQ ID NO: 512798 - RNA, 22 nt, Human
uguguacaggccuugcuagacu

SEQ ID NO: 512799 - RNA, 22 nt, Human
acucagacgaaaacaugaacau

SEQ ID NO: 512800 - RNA, 22 nt, Human
uccauuuucuugcucuagguaa

SEQ ID NO: 512801 - RNA, 22 nt, Human
gcacaaggagcaguguaugaaa

SEQ ID NO: 512802 - RNA, 22 nt, Human
aaguugaaugcguacgugacau

SEQ ID NO: 512803 - RNA, 22 nt, Human
uagucccggaacuccuucaggu

SEQ ID NO: 512804 - RNA, 22 nt, Human
gcucccugccuacacggaccuu

SEQ ID NO: 512805 - RNA, 22 nt, Human
cccuucaagcucucuggguuuu

SEQ ID NO: 512806 - RNA, 22 nt, Human
acacacaauuaguuuuaugcuu

SEQ ID NO: 512807 - RNA, 22 nt, Human
uacaguauuaugagugauugaa

SEQ ID NO: 512808 - RNA, 22 nt, Human
gaagagaugacaaaggagcaug

SEQ ID NO: 512809 - RNA, 22 nt, Human
augucuuucucacagccaguuc

SEQ ID NO: 512810 - RNA, 22 nt, Human
ucccuggacaacagacuucacu

SEQ ID NO: 512811 - RNA, 23 nt, Human
gguggcaggaguggaugcugagc

SEQ ID NO: 512812 - RNA, 22 nt, Human
ccuggcucuucgggaguuuguu

SEQ ID NO: 512813 - RNA, 22 nt, Human
gugcccugaguggguaggagag

SEQ ID NO: 512814 - RNA, 22 nt, Human
caaagccaggcuuucuaaugua

SEQ ID NO: 512815 - RNA, 22 nt, Human
uucaagaugucuucacaauagu

SEQ ID NO: 512816 - RNA, 22 nt, Human
ucuaauuccauuaaauugaugu

SEQ ID NO: 512817 - RNA, 22 nt, Human
ggcaggcuuucagcaucaaguc

SEQ ID NO: 512818 - RNA, 22 nt, Human
ggcugcugguggaaugguaggc

SEQ ID NO: 512819 - RNA, 22 nt, Human
cuuauguaaacuacagauaaua

SEQ ID NO: 512820 - RNA, 22 nt, Human
cugggcucugcggugucgcucu

SEQ ID NO: 512821 - RNA, 22 nt, Human
uuggccuuguacaucauauuaa

SEQ ID NO: 512822 - RNA, 22 nt, Human
caggaaagaaaugagaacacca

SEQ ID NO: 512823 - RNA, 22 nt, Human
cuauugaauuaacuauuaaagu

SEQ ID NO: 512824 - RNA, 22 nt, Human
ucuucauuuuacaggcagaccu

SEQ ID NO: 512825 - RNA, 22 nt, Human
caggguggcacaucacagcauu

SEQ ID NO: 512826 - RNA, 22 nt, Human
uuugaaauguaucaguauaggu

SEQ ID NO: 512827 - RNA, 23 nt, Human
ugaguucucaucuuggcuucuau

SEQ ID NO: 512828 - RNA, 22 nt, Human
acccagcuguuucccgugucau

SEQ ID NO: 512829 - RNA, 22 nt, Human
ucaggcucugccaccuagauua

SEQ ID NO: 512830 - RNA, 19 nt, Human
cuguggccuccaggaggga

SEQ ID NO: 512831 - RNA, 20 nt, Human
uucucuggauagccagaugu

SEQ ID NO: 512832 - RNA, 22 nt, Human
acauuuguaugcguuuuuacug

SEQ ID NO: 512833 - RNA, 22 nt, Human
caacauuucaaggucuuuagga

SEQ ID NO: 512834 - RNA, 22 nt, Human
gcuggccucgcaggcaggaugu

SEQ ID NO: 512835 - RNA, 22 nt, Human
ggccuucacgugaccuggcgug

SEQ ID NO: 512836 - RNA, 19 nt, Human
ggacacagaaagcugcauu

SEQ ID NO: 512837 - RNA, 22 nt, Human
uuggcaggaggcuucaguuccu

SEQ ID NO: 512838 - RNA, 22 nt, Human
cagagccccccuucugaucaca

SEQ ID NO: 512839 - RNA, 22 nt, Human
cugguuccaggauggaucuuuc

SEQ ID NO: 512840 - RNA, 22 nt, Human
agaaaauuagauuuuacugugu

SEQ ID NO: 512841 - RNA, 22 nt, Human
cccaggcagagagcuggugagc

SEQ ID NO: 512842 - RNA, 23 nt, Human
ugcugguucaaaaaggaaggagg

SEQ ID NO: 512843 - RNA, 22 nt, Human
gcagagccaugggagguuuuug

SEQ ID NO: 512844 - RNA, 22 nt, Human
ccaggccuggaccaugccaggg

SEQ ID NO: 512845 - RNA, 22 nt, Human
uggccccugaggagcaucagcc

SEQ ID NO: 512846 - RNA, 22 nt, Human
ugucagugaguuaguugcaagu

SEQ ID NO: 512847 - RNA, 22 nt, Human
ucagcacuuuuacucucuuugc

SEQ ID NO: 512848 - RNA, 22 nt, Human
gaggcagcagggcugguuccuu

SEQ ID NO: 512849 - RNA, 23 nt, Human
uggaccugaaccagugccucugu

SEQ ID NO: 512850 - RNA, 22 nt, Human
uccaggcagagcaacaaaauau

SEQ ID NO: 512851 - RNA, 22 nt, Human
cucagcaucaugguaucugggg

SEQ ID NO: 512852 - RNA, 22 nt, Human
ucacugcucucuaagcaucgcc

SEQ ID NO: 512853 - RNA, 22 nt, Human
ccugggcucuauccugacccag

SEQ ID NO: 512854 - RNA, 22 nt, Human
uagggaggaggguuuucaaauc

SEQ ID NO: 512855 - RNA, 22 nt, Human
ccacauacaaauggggugcugu

SEQ ID NO: 512856 - RNA, 22 nt, Human
gagacacagagaggcuguguga

SEQ ID NO: 512857 - RNA, 17 nt, Human
uaucaagaagucuggcc

SEQ ID NO: 512858 - RNA, 22 nt, Human
guguacauauugagucugcuga

SEQ ID NO: 512859 - RNA, 22 nt, Human
uaaggccaggcuguggucggca

SEQ ID NO: 512860 - RNA, 22 nt, Human
auguagaagcugacagugcugu

SEQ ID NO: 512861 - RNA, 22 nt, Human
agcaauaacagaaaacuuuccu

SEQ ID NO: 512862 - RNA, 22 nt, Human
ucagggaaaagucacacugggu

SEQ ID NO: 512863 - RNA, 20 nt, Human
gagggcaggcacccauuuca

SEQ ID NO: 512864 - RNA, 22 nt, Human
gcucuuuggauuccuuuacaaa

SEQ ID NO: 512865 - RNA, 22 nt, Human
gcaguggggaaugcuggggaga

SEQ ID NO: 512866 - RNA, 22 nt, Human
agugcuggcccauagcugcugg

SEQ ID NO: 512867 - RNA, 22 nt, Human
ggccucagaaauagaguaaaau

SEQ ID NO: 512868 - RNA, 22 nt, Human
ccaccccaaaugaagaccucuc

SEQ ID NO: 512869 - RNA, 22 nt, Human
aacagaauaguugauguacagu

SEQ ID NO: 512870 - RNA, 22 nt, Human
gucccugggaaaggagagggca

SEQ ID NO: 512871 - RNA, 22 nt, Human
agcuccuggcuuuccucucacc

SEQ ID NO: 512872 - RNA, 22 nt, Human
agggggugcauuugugaaugaa

SEQ ID NO: 512873 - RNA, 22 nt, Human
cagguccuggcaucaggcaggu

SEQ ID NO: 512874 - RNA, 22 nt, Human
acuuaguauuuuucagcuuuga

SEQ ID NO: 512875 - RNA, 22 nt, Human
cucugcagaggcccaaggcuga

SEQ ID NO: 512876 - RNA, 22 nt, Human
gcauccagucuuggcuccugga

SEQ ID NO: 512877 - RNA, 22 nt, Human
aguccagggcucucugugggau

SEQ ID NO: 512878 - RNA, 22 nt, Human
gcauuucuuccuggugugagcc

SEQ ID NO: 512879 - RNA, 22 nt, Human
agcacagaguugcagagagcgu

SEQ ID NO: 512880 - RNA, 22 nt, Human
uacuuuggauccuuacaauagc

SEQ ID NO: 512881 - RNA, 22 nt, Human
uggaacacuuuguugaaaugca

SEQ ID NO: 512882 - RNA, 22 nt, Human
uugccagggucaggaugagauc

SEQ ID NO: 512883 - RNA, 22 nt, Human
ccuuccuggcuguccgccugau

SEQ ID NO: 512884 - RNA, 22 nt, Human
cucagaaucugccaaguucagg

SEQ ID NO: 512885 - RNA, 20 nt, Human
uuugagaccagucugcccaa

SEQ ID NO: 512886 - RNA, 22 nt, Human
cugcugccggcgagccucccuu

SEQ ID NO: 512887 - RNA, 17 nt, Human
cccuggcaaagaauggc

SEQ ID NO: 512888 - RNA, 22 nt, Human
ucucuggggaugcuuauucuug

SEQ ID NO: 512889 - RNA, 22 nt, Human
ucaugcagaggaaggcuaguuu

SEQ ID NO: 512890 - RNA, 22 nt, Human
ugagacgaagucuugcucuguu

SEQ ID NO: 512891 - RNA, 18 nt, Human
ucaggcucucuggcuaga

SEQ ID NO: 512892 - RNA, 22 nt, Human
aggcacugggaauaugcugagg

SEQ ID NO: 512893 - RNA, 22 nt, Human
aucacauucuuucaaagcaguc

SEQ ID NO: 512894 - RNA, 22 nt, Human
ucugggucucagagugaccaug

SEQ ID NO: 512895 - RNA, 23 nt, Human
gggaccugguaggaggugauugg

SEQ ID NO: 512896 - RNA, 22 nt, Human
cucccuggaggugagcuggcac

SEQ ID NO: 512897 - RNA, 22 nt, Human
aucaggaagaucuagcgaaugu

SEQ ID NO: 512898 - RNA, 21 nt, Human
cacaggugggucagugaggcc

SEQ ID NO: 512899 - RNA, 22 nt, Human
gcagugcuaaguagcuggccca

SEQ ID NO: 512900 - RNA, 22 nt, Human
ucccagccuccugacaguuuug

SEQ ID NO: 512901 - RNA, 22 nt, Human
cagcccugagagaaccaucuau

SEQ ID NO: 512902 - RNA, 22 nt, Human
gcaggggcuaaggacacagaga

SEQ ID NO: 512903 - RNA, 22 nt, Human
cauucacaauggauugcuucaa

SEQ ID NO: 512904 - RNA, 22 nt, Human
agggcagaaaucgauuacaccu

SEQ ID NO: 512905 - RNA, 22 nt, Human
ucagaagcaaacaucacucuag

SEQ ID NO: 512906 - RNA, 22 nt, Human
gggccuggcaugcagccccguu

SEQ ID NO: 512907 - RNA, 22 nt, Human
auggggcucugcggcugcuccc

SEQ ID NO: 512908 - RNA, 22 nt, Human
gcaggaugccagggcagcagcg

SEQ ID NO: 512909 - RNA, 22 nt, Human
agucaguguucuccggagaggc

SEQ ID NO: 512910 - RNA, 22 nt, Human
uccagagggcgauggcuggggg

SEQ ID NO: 512911 - RNA, 22 nt, Human
ugaguguauaucaggagagagc

SEQ ID NO: 512912 - RNA, 22 nt, Human
gucaggauuggggucaugaguc

SEQ ID NO: 512913 - RNA, 22 nt, Human
ccuggcugugcauugccggccc

SEQ ID NO: 512914 - RNA, 22 nt, Human
caggauggucagaugcauuguc

SEQ ID NO: 512915 - RNA, 22 nt, Human
gggguggcccuacccucuggaa

SEQ ID NO: 512916 - RNA, 22 nt, Human
caggggcuguggcacauggugu

SEQ ID NO: 512917 - RNA, 22 nt, Human
cugccuggaccggcagcccucc

SEQ ID NO: 512918 - RNA, 22 nt, Human
agccaacuaggagauuaaggua

SEQ ID NO: 512919 - RNA, 22 nt, Human
gcagugaaucuggcaagaauuu

SEQ ID NO: 512920 - RNA, 22 nt, Human
gagcaagacucacugcaucuug

SEQ ID NO: 512921 - RNA, 22 nt, Human
gcugaggcuccucgggaggaca

SEQ ID NO: 512922 - RNA, 22 nt, Human
ucaggagagaaagaauacaauu

SEQ ID NO: 512923 - RNA, 22 nt, Human
ucccagagguugagucacuuau

SEQ ID NO: 512924 - RNA, 22 nt, Human
uguggcagaacugggacucaaa

SEQ ID NO: 512925 - RNA, 22 nt, Human
ucauggcuugcagauggccacc

SEQ ID NO: 512926 - RNA, 22 nt, Human
augauguugauaaauuacuuua

SEQ ID NO: 512927 - RNA, 22 nt, Human
ccuagagcucugcuuuaucuaa

SEQ ID NO: 512928 - RNA, 22 nt, Human
acauuuugcccuuauuugcuga

SEQ ID NO: 512929 - RNA, 22 nt, Human
ugcucccaggcauucucuguug

SEQ ID NO: 512930 - RNA, 22 nt, Human
ugguccugaggcuuguuuccac

SEQ ID NO: 512931 - RNA, 22 nt, Human
cugaggagaccaucaacuaauu

SEQ ID NO: 512932 - RNA, 22 nt, Human
uaacagcucuguguggcuguaa

SEQ ID NO: 512933 - RNA, 22 nt, Human
ccagcucucagcgggagacuca

SEQ ID NO: 512934 - RNA, 22 nt, Human
ccaggucucgggucugcucgug

SEQ ID NO: 512935 - RNA, 22 nt, Human
gcucugagucucagcuaccaca

SEQ ID NO: 512936 - RNA, 22 nt, Human
cucuucagauaaaagggauauu

SEQ ID NO: 512937 - RNA, 22 nt, Human
gcuggcuggaguaaggagggag

SEQ ID NO: 512938 - RNA, 22 nt, Human
auucucuuuguauaacaucuug

SEQ ID NO: 512939 - RNA, 22 nt, Human
uggguccuggaaggcgacaggu

SEQ ID NO: 512940 - RNA, 22 nt, Human
gggccuguaugggucucagaua

SEQ ID NO: 512941 - RNA, 22 nt, Human
auacagcagugaauaagauaaa

SEQ ID NO: 512942 - RNA, 22 nt, Human
cuguaugaggaucagacuggac

SEQ ID NO: 512943 - RNA, 22 nt, Human
uuuuaauuuugcaaaucuggug

SEQ ID NO: 512944 - RNA, 22 nt, Human
agggaacagugaaaggcaucag

SEQ ID NO: 512945 - RNA, 22 nt, Human
aucuggcucauucagggaacgg

SEQ ID NO: 512946 - RNA, 22 nt, Human
cucccuggcuuuguccugaggc

SEQ ID NO: 512947 - RNA, 22 nt, Human
ucacagugagccaugucagaga

SEQ ID NO: 512948 - RNA, 22 nt, Human
agggccucuaccauccaagguu

SEQ ID NO: 512949 - RNA, 22 nt, Human
uugucugaauucuucuaggcag

SEQ ID NO: 512950 - RNA, 22 nt, Human
uacauuaacuuacguccacaug

SEQ ID NO: 512951 - RNA, 23 nt, Human
aggcagagccaaggucaaaaccc

SEQ ID NO: 512952 - RNA, 22 nt, Human
ucagagagguuggugauaagaa

SEQ ID NO: 512953 - RNA, 20 nt, Human
cauuugggaucaugagguuu

SEQ ID NO: 512954 - RNA, 22 nt, Human
ggaggagauuccccucucacuu

SEQ ID NO: 512955 - RNA, 22 nt, Human
agcaggugguaggcagucagca

SEQ ID NO: 512956 - RNA, 22 nt, Human
ccuuacaaugcaguuuacuuag

SEQ ID NO: 512957 - RNA, 22 nt, Human
cuagggccaaaggcugugaugc

SEQ ID NO: 512958 - RNA, 22 nt, Human
aaagcuaugaggcaugcauuuc

SEQ ID NO: 512959 - RNA, 22 nt, Human
cugagcagcaacccagagccuc

SEQ ID NO: 512960 - RNA, 22 nt, Human
uuagccuuagaagcuuagcaaa

SEQ ID NO: 512961 - RNA, 22 nt, Human
ggcaggugaggcaugugccugg

SEQ ID NO: 512962 - RNA, 22 nt, Human
cuguggcuucagcauucagagc

SEQ ID NO: 512963 - RNA, 22 nt, Human
gcagcagaguuugggagauggu

SEQ ID NO: 512964 - RNA, 22 nt, Human
aguguuccacacaucuggggaa

SEQ ID NO: 512965 - RNA, 22 nt, Human
agaaauguuacaguuguuauuu

SEQ ID NO: 512966 - RNA, 22 nt, Human
ccccuguguuguucaaggguca

SEQ ID NO: 512967 - RNA, 22 nt, Human
gcacugcagccucagauggugg

SEQ ID NO: 512968 - RNA, 22 nt, Human
guccagagaguaaaggggguaa

SEQ ID NO: 512969 - RNA, 22 nt, Human
uugcccugcagcggugaguggu

SEQ ID NO: 512970 - RNA, 22 nt, Human
ggcaggcuugguggcaccgguu

SEQ ID NO: 512971 - RNA, 22 nt, Human
uggauuaaagauuaaaaugaca

SEQ ID NO: 512972 - RNA, 22 nt, Human
ucuugcuaggagcuauggaaga

SEQ ID NO: 512973 - RNA, 22 nt, Human
gaaggagaggauugugaggcug

SEQ ID NO: 512974 - RNA, 22 nt, Human
caaguuuuagaaauaucuggau

SEQ ID NO: 512975 - RNA, 19 nt, Human
agcagcuggagguggagug

SEQ ID NO: 512976 - RNA, 22 nt, Human
auacaagaucacuccagaaaau

SEQ ID NO: 512977 - RNA, 22 nt, Human
uugcugaacccugcccucuaau

SEQ ID NO: 512978 - RNA, 22 nt, Human
agggaaauggagaguguaguuu

SEQ ID NO: 512979 - RNA, 22 nt, Human
uccuaggguaaucagcauacau

SEQ ID NO: 512980 - RNA, 22 nt, Human
ucagcagggagaggagaaugca

SEQ ID NO: 512981 - RNA, 18 nt, Human
agcagagcccaugcauuc

SEQ ID NO: 512982 - RNA, 23 nt, Human
uccuucaaguuaggaagugaaca

SEQ ID NO: 512983 - RNA, 17 nt, Human
auuucacuuagcaugag

SEQ ID NO: 512984 - RNA, 22 nt, Human
caagcucugggauagcagagag

SEQ ID NO: 512985 - RNA, 22 nt, Human
ggucccaggagaauaggugcaa

SEQ ID NO: 512986 - RNA, 20 nt, Human
aaguuuucuccaaauacagu

SEQ ID NO: 512987 - RNA, 22 nt, Human
acucugggcuuugauuuguuac

SEQ ID NO: 512988 - RNA, 22 nt, Human
ucuguucaguugauuagacaga

SEQ ID NO: 512989 - RNA, 22 nt, Human
agagcuggcugguagcccugau

SEQ ID NO: 512990 - RNA, 22 nt, Human
guguuuggucagacguccgggg

SEQ ID NO: 512991 - RNA, 20 nt, Human
uugauaggcagcuugucagg

SEQ ID NO: 512992 - RNA, 17 nt, Human
gggcugacaguggccuc

SEQ ID NO: 512993 - RNA, 22 nt, Human
cuggaagguucuuugugugccu

SEQ ID NO: 512994 - RNA, 22 nt, Human
ccugucugcaugagugagcaua

SEQ ID NO: 512995 - RNA, 22 nt, Human
gaaaauacaaauagccuugaaa

SEQ ID NO: 512996 - RNA, 20 nt, Human
agggucaguagcacagagcu

SEQ ID NO: 512997 - RNA, 22 nt, Human
ugaaggagaauuaauaggcauu

SEQ ID NO: 512998 - RNA, 22 nt, Human
cuacauuuuaauaagcugcuua

SEQ ID NO: 512999 - RNA, 22 nt, Human
cugaaucauggucauuaguuua

SEQ ID NO: 513000 - RNA, 22 nt, Human
gcuggaggaucacuugagccca

SEQ ID NO: 513001 - RNA, 22 nt, Human
uggcugucagcugccuggugcg

SEQ ID NO: 513002 - RNA, 22 nt, Human
gcacagccggaccgaggaaaag

SEQ ID NO: 513003 - RNA, 22 nt, Human
aagaaaagaaaccugaggcuuu

SEQ ID NO: 513004 - RNA, 22 nt, Human
uucuggcuuauccuaacucuaa

SEQ ID NO: 513005 - RNA, 22 nt, Human
cugacccuagcaucucugugca

SEQ ID NO: 513006 - RNA, 22 nt, Human
gcuuccugucccucagccauga

SEQ ID NO: 513007 - RNA, 23 nt, Human
cuggggcuuucaaaucugggcag

SEQ ID NO: 513008 - RNA, 22 nt, Human
agauugucauugacgaugagca

SEQ ID NO: 513009 - RNA, 22 nt, Human
cugggugaguugaugaaggaga

SEQ ID NO: 513010 - RNA, 22 nt, Human
gucagugugagauaaucuugga

SEQ ID NO: 513011 - RNA, 22 nt, Human
uggcccagcucagggugggcgg

SEQ ID NO: 513012 - RNA, 22 nt, Human
caggcacacauccgugagagau

SEQ ID NO: 513013 - RNA, 20 nt, Human
accuggcuuccucuuggcau

SEQ ID NO: 513014 - RNA, 21 nt, Human
uugcaccaugauaaauucaga

SEQ ID NO: 513015 - RNA, 22 nt, Human
gcuguggccaacaaaccacuuu

SEQ ID NO: 513016 - RNA, 20 nt, Human
gucucagaauggauuugcau

SEQ ID NO: 513017 - RNA, 22 nt, Human
uuucuaagacauuugucaucuu

SEQ ID NO: 513018 - RNA, 22 nt, Human
uucaggauucugugucugacaa

SEQ ID NO: 513019 - RNA, 22 nt, Human
aauaauuuugagagccuggaaa

SEQ ID NO: 513020 - RNA, 22 nt, Human
ccugggcuggaguacagcagug

SEQ ID NO: 513021 - RNA, 22 nt, Human
uuauuucauguaaaauuuaugu

SEQ ID NO: 513022 - RNA, 22 nt, Human
uaagcagaaaaagugggaguua

SEQ ID NO: 513023 - RNA, 22 nt, Human
caagagcugaggcuggagaggu

SEQ ID NO: 513024 - RNA, 22 nt, Human
cagcuuuccagagaccugcccc

SEQ ID NO: 513025 - RNA, 22 nt, Human
aggccucugcuggaaagaguug

SEQ ID NO: 513026 - RNA, 22 nt, Human
acccuggguucccgcagcacca

SEQ ID NO: 513027 - RNA, 22 nt, Human
uauuuauaaucugccaaagaga

SEQ ID NO: 513028 - RNA, 23 nt, Human
agagaaucauggaaacucuuucu

SEQ ID NO: 513029 - RNA, 22 nt, Human
aggugcaguggcucaugccugu

SEQ ID NO: 513030 - RNA, 22 nt, Human
cagugcaguggcugagcuggag

SEQ ID NO: 513031 - RNA, 22 nt, Human
gccucugcacuguggcacacca

SEQ ID NO: 513032 - RNA, 22 nt, Human
uggccugccuucgcugagcuga

SEQ ID NO: 513033 - RNA, 22 nt, Human
gccuuugcaccaucagugcaau

SEQ ID NO: 513034 - RNA, 22 nt, Human
auuugccuuucgaaucaacagg

SEQ ID NO: 513035 - RNA, 22 nt, Human
aagucuuuuugaaucuauaacu

SEQ ID NO: 513036 - RNA, 22 nt, Human
uuggaggcaaugggaaggaggc

SEQ ID NO: 513037 - RNA, 22 nt, Human
cagaaagcgggaugcagcaugu

SEQ ID NO: 513038 - RNA, 22 nt, Human
caugugugggacccuuagguug

SEQ ID NO: 513039 - RNA, 19 nt, Human
ugucccuggucaccagacu

SEQ ID NO: 513040 - RNA, 22 nt, Human
uucgaguuggcuuuauuaaacu

SEQ ID NO: 513041 - RNA, 22 nt, Human
uuuguagaacuguagaacaaug

SEQ ID NO: 513042 - RNA, 22 nt, Human
ugguggcagcugggacagaggu

SEQ ID NO: 513043 - RNA, 22 nt, Human
uccucugcucagcauuccucac

SEQ ID NO: 513044 - RNA, 22 nt, Human
ugguuccaguuuucaauagagc

SEQ ID NO: 513045 - RNA, 22 nt, Human
gccugggagugcacagugaggu

SEQ ID NO: 513046 - RNA, 22 nt, Human
ugcccuggcucuccacuaguuu

SEQ ID NO: 513047 - RNA, 22 nt, Human
caguggcaugguugacugcagu

SEQ ID NO: 513048 - RNA, 22 nt, Human
uacuuuuugucucuuugaaugu

SEQ ID NO: 513049 - RNA, 22 nt, Human
gaggaggaaacccuguuccucu

SEQ ID NO: 513050 - RNA, 22 nt, Human
uguauguguauguacauaugca

SEQ ID NO: 513051 - RNA, 22 nt, Human
uggccaggcauucagauaagac

SEQ ID NO: 513052 - RNA, 22 nt, Human
uugcauuagugucauaaggugg

SEQ ID NO: 513053 - RNA, 22 nt, Human
acccagagcccuuagcacagac

SEQ ID NO: 513054 - RNA, 22 nt, Human
caagccucagaaucuucuccau

SEQ ID NO: 513055 - RNA, 22 nt, Human
uuagucacaugcccaucucuga

SEQ ID NO: 513056 - RNA, 22 nt, Human
auuuaugacaaccaaagaguga

SEQ ID NO: 513057 - RNA, 22 nt, Human
augcccugagcaggccuucaag

SEQ ID NO: 513058 - RNA, 20 nt, Human
cugggcucgguggcccuggc

SEQ ID NO: 513059 - RNA, 22 nt, Human
agcagaagaggucuuguugcug

SEQ ID NO: 513060 - RNA, 22 nt, Human
auggccuggccagagcucugcu

SEQ ID NO: 513061 - RNA, 22 nt, Human
ugucucaguucccuucucugga

SEQ ID NO: 513062 - RNA, 21 nt, Human
auacuuugaauuacagccuug

SEQ ID NO: 513063 - RNA, 22 nt, Human
agccuggccugggcaggcacau

SEQ ID NO: 513064 - RNA, 22 nt, Human
guggguggaggcgucgagggca

SEQ ID NO: 513065 - RNA, 22 nt, Human
gcacugggcuccaggaaggagg

SEQ ID NO: 513066 - RNA, 22 nt, Human
gacuggccuggggcugggcaca

SEQ ID NO: 513067 - RNA, 22 nt, Human
gugcccuguucauuucucuccc

SEQ ID NO: 513068 - RNA, 22 nt, Human
cuaaagcauucucagauuuugc

SEQ ID NO: 513069 - RNA, 22 nt, Human
aguaugaaccuggguucuggau

SEQ ID NO: 513070 - RNA, 22 nt, Human
gggcagauggggcacaggcuga

SEQ ID NO: 513071 - RNA, 22 nt, Human
agucaaagcuacaggcauuuga

SEQ ID NO: 513072 - RNA, 22 nt, Human
gugcauguuaaugguguacaaa

SEQ ID NO: 513073 - RNA, 22 nt, Human
cugggaguugacgaggcuugua

SEQ ID NO: 513074 - RNA, 22 nt, Human
uaccaugucuucaauaagucua

SEQ ID NO: 513075 - RNA, 22 nt, Human
ggcaggugugagcuguaaagga

SEQ ID NO: 513076 - RNA, 22 nt, Human
ugguccagacuuugaccucuca

SEQ ID NO: 513077 - RNA, 22 nt, Human
ccaggagcauuaagagaacaua

SEQ ID NO: 513078 - RNA, 22 nt, Human
auguaugagagauucuuuuauu

SEQ ID NO: 513079 - RNA, 22 nt, Human
gaggcagagugcaccccaggag

SEQ ID NO: 513080 - RNA, 22 nt, Human
gcugaagggagugcugagucug

SEQ ID NO: 513081 - RNA, 22 nt, Human
uuucuuagcgaugcuugauaaa

SEQ ID NO: 513082 - RNA, 20 nt, Human
ccugggcuccaggagccccg

SEQ ID NO: 513083 - RNA, 23 nt, Human
ucagugauguugaaccuagcagu

SEQ ID NO: 513084 - RNA, 22 nt, Human
augaaauugaucuugaacuuuu

SEQ ID NO: 513085 - RNA, 22 nt, Human
gcagaagggaauaaggagcuuu

SEQ ID NO: 513086 - RNA, 22 nt, Human
cccacaggcuagggguagggca

SEQ ID NO: 513087 - RNA, 22 nt, Human
cuggaaggagcccgggcggauc

SEQ ID NO: 513088 - RNA, 22 nt, Human
acagggucuuagagaucaccug

SEQ ID NO: 513089 - RNA, 22 nt, Human
cagugucuuauuuguagcucag

SEQ ID NO: 513090 - RNA, 22 nt, Human
uuccagggcuaauuccugugga

SEQ ID NO: 513091 - RNA, 22 nt, Human
uaaaguauccaguuauucuucu

SEQ ID NO: 513092 - RNA, 22 nt, Human
uuugugcagauguauauuugug

SEQ ID NO: 513093 - RNA, 22 nt, Human
ucucacagcaggggccaggucu

SEQ ID NO: 513094 - RNA, 22 nt, Human
gcagggauugugcagggggcua

SEQ ID NO: 513095 - RNA, 22 nt, Human
ggcgccagcacugcagcgccuc

SEQ ID NO: 513096 - RNA, 20 nt, Human
ugcacagggugggaagcaac

SEQ ID NO: 513097 - RNA, 22 nt, Human
ucuuuugagggccagaggaaga

SEQ ID NO: 513098 - RNA, 22 nt, Human
ggcaggaaguagcagucugagc

SEQ ID NO: 513099 - RNA, 22 nt, Human
gcuggccaggaagagucucaga

SEQ ID NO: 513100 - RNA, 22 nt, Human
uguaaugagucacuuaccuuaa

SEQ ID NO: 513101 - RNA, 22 nt, Human
uccuucaguuaaagaucucaca

SEQ ID NO: 513102 - RNA, 21 nt, Human
gccacguuucagucuucucag

SEQ ID NO: 513103 - RNA, 22 nt, Human
aaaugccucugcuguacacaau

SEQ ID NO: 513104 - RNA, 22 nt, Human
uaaauagaaucuaaacugcuca

SEQ ID NO: 513105 - RNA, 22 nt, Human
ucagcuggagauccuuguugug

SEQ ID NO: 513106 - RNA, 22 nt, Human
auggagggugucagagagcgaa

SEQ ID NO: 513107 - RNA, 22 nt, Human
agagcuggauggucaagauggc

SEQ ID NO: 513108 - RNA, 21 nt, Human
gggcaggucucugaugucaac

SEQ ID NO: 513109 - RNA, 22 nt, Human
ggcuucaggggcccagucagca

SEQ ID NO: 513110 - RNA, 22 nt, Human
ucuggcucucucaucacccaau

SEQ ID NO: 513111 - RNA, 22 nt, Human
ucacaggcuugugaacauugca

SEQ ID NO: 513112 - RNA, 19 nt, Human
uccagccugcuguuucucu

SEQ ID NO: 513113 - RNA, 19 nt, Human
ugguaaagacuguccccca

SEQ ID NO: 513114 - RNA, 22 nt, Human
gccugguggugugcucaagugg

SEQ ID NO: 513115 - RNA, 22 nt, Human
uaggaaaagucuagauugauga

SEQ ID NO: 513116 - RNA, 22 nt, Human
cucucugguuucagcgaagggg

SEQ ID NO: 513117 - RNA, 22 nt, Human
gagcagcacugaguuagcagcu

SEQ ID NO: 513118 - RNA, 21 nt, Human
aggcagcucaggcccagagag

SEQ ID NO: 513119 - RNA, 22 nt, Human
uggcccugucccuggagccugg

SEQ ID NO: 513120 - RNA, 22 nt, Human
ugugaaaggggucacagggaaa

SEQ ID NO: 513121 - RNA, 22 nt, Human
gagcuggucgaaaugggcugac

SEQ ID NO: 513122 - RNA, 22 nt, Human
aaguccugggugagaacugucc

SEQ ID NO: 513123 - RNA, 23 nt, Human
aaaaaaccauguaggcacucagu

SEQ ID NO: 513124 - RNA, 22 nt, Human
ucaguguuggcauucagaaaug

SEQ ID NO: 513125 - RNA, 22 nt, Human
ggaaaagacagaauucuagaau

SEQ ID NO: 513126 - RNA, 22 nt, Human
gcucagagaugucugcugccuu

SEQ ID NO: 513127 - RNA, 22 nt, Human
ucccuccuggugaugaugcaaa

SEQ ID NO: 513128 - RNA, 22 nt, Human
gaaucucaaggcuugugaggau

SEQ ID NO: 513129 - RNA, 22 nt, Human
ccagucccaggcagaaauccag

SEQ ID NO: 513130 - RNA, 22 nt, Human
ggcagaaggcaauuagagacug

SEQ ID NO: 513131 - RNA, 22 nt, Human
ugaggcuguucuaccagggcca

SEQ ID NO: 513132 - RNA, 22 nt, Human
aguggggagguccaggccaccc

SEQ ID NO: 513133 - RNA, 22 nt, Human
cuggccaccaagagcuugcuca

SEQ ID NO: 513134 - RNA, 22 nt, Human
agcagccagaaagggcagucga

SEQ ID NO: 513135 - RNA, 22 nt, Human
uggguaggggacguggaagaaa

SEQ ID NO: 513136 - RNA, 22 nt, Human
ccuggcucagcagcucuuucuc

SEQ ID NO: 513137 - RNA, 22 nt, Human
ggggcugagaauucagucucgg

SEQ ID NO: 513138 - RNA, 22 nt, Human
ucugggggaggaggcauggccc

SEQ ID NO: 513139 - RNA, 22 nt, Human
auaagcagggucaaaugccuac

SEQ ID NO: 513140 - RNA, 22 nt, Human
aucugugaucaagacagacagu

SEQ ID NO: 513141 - RNA, 22 nt, Human
aacauucaaaacccaguucagu

SEQ ID NO: 513142 - RNA, 22 nt, Human
cuccucagcugggaggaguccc

SEQ ID NO: 513143 - RNA, 22 nt, Human
agggcacagccuaaagccuaug

SEQ ID NO: 513144 - RNA, 19 nt, Human
caggaacauggagggaggg

SEQ ID NO: 513145 - RNA, 22 nt, Human
gagccuggguccuucccuggga

SEQ ID NO: 513146 - RNA, 22 nt, Human
agguccagugcucuuggugguu

SEQ ID NO: 513147 - RNA, 22 nt, Human
agcugcccccagggcugugcuu

SEQ ID NO: 513148 - RNA, 21 nt, Human
ucucuacacuuucacuaggcu

SEQ ID NO: 513149 - RNA, 20 nt, Human
accugccacagagaaaggua

SEQ ID NO: 513150 - RNA, 22 nt, Human
aagcaauagcaacaacuuuaca

SEQ ID NO: 513151 - RNA, 22 nt, Human
uagggcaggugaagaaaagcua

SEQ ID NO: 513152 - RNA, 22 nt, Human
agagaagagcaaugauaaauuu

SEQ ID NO: 513153 - RNA, 22 nt, Human
uauugaggaucuccugcuaauu

SEQ ID NO: 513154 - RNA, 22 nt, Human
cacugaaggaaggacuacugca

SEQ ID NO: 513155 - RNA, 22 nt, Human
gagacacagcagauauucaauc

SEQ ID NO: 513156 - RNA, 22 nt, Human
ggguguccugugccaagcuggg

SEQ ID NO: 513157 - RNA, 22 nt, Human
cugggaggcacuauucaggagg

SEQ ID NO: 513158 - RNA, 22 nt, Human
ccagagcuucggggcggcugua

SEQ ID NO: 513159 - RNA, 22 nt, Human
augugugcuacaggugugggaa

SEQ ID NO: 513160 - RNA, 22 nt, Human
cagcagugcuucagugugagau

SEQ ID NO: 513161 - RNA, 22 nt, Human
gcagaggccugaagguggcggg

SEQ ID NO: 513162 - RNA, 22 nt, Human
cuggcucugggcuaagcuccca

SEQ ID NO: 513163 - RNA, 22 nt, Human
cacagaagaaucaugcuguguu

SEQ ID NO: 513164 - RNA, 22 nt, Human
uggacucaaguccaaguucacg

SEQ ID NO: 513165 - RNA, 22 nt, Human
accacuguaucuccagcacauu

SEQ ID NO: 513166 - RNA, 22 nt, Human
agaccaagacuauaaugagagg

SEQ ID NO: 513167 - RNA, 19 nt, Human
auaaggcagugacuuuuuu

SEQ ID NO: 513168 - RNA, 22 nt, Human
aggaccugacauuguguuuucu

SEQ ID NO: 513169 - RNA, 22 nt, Human
uaaguggaagguuauaugcuaa

SEQ ID NO: 513170 - RNA, 21 nt, Human
aucagcaaaugccugucuccc

SEQ ID NO: 513171 - RNA, 22 nt, Human
aagauguuaaauugggggcauu

SEQ ID NO: 513172 - RNA, 22 nt, Human
aagcugcccuguguuagaguuc

SEQ ID NO: 513173 - RNA, 22 nt, Human
auuuacaggacagcuuggcauu

SEQ ID NO: 513174 - RNA, 22 nt, Human
cuccagauuccguuuauucagg

SEQ ID NO: 513175 - RNA, 22 nt, Human
cuuauguauauuuggaacguac

SEQ ID NO: 513176 - RNA, 22 nt, Human
aaguuauaucaucucauugacg

SEQ ID NO: 513177 - RNA, 22 nt, Human
caggcagcguccugcuuccugu

SEQ ID NO: 513178 - RNA, 20 nt, Human
gucaucgccggcagcaaaga

SEQ ID NO: 513179 - RNA, 22 nt, Human
ugaagcaacuggacaaguuggc

SEQ ID NO: 513180 - RNA, 22 nt, Human
gcuuuaaauggcuugcccaagu

SEQ ID NO: 513181 - RNA, 23 nt, Human
ggggccugcaccggucugcgcgg

SEQ ID NO: 513182 - RNA, 22 nt, Human
acacauguuuguguagucaguu

SEQ ID NO: 513183 - RNA, 22 nt, Human
auuagcuuuaaaccacagcagu

SEQ ID NO: 513184 - RNA, 22 nt, Human
uaaagcaaugaaaguuuugcag

SEQ ID NO: 513185 - RNA, 22 nt, Human
ugcauuaaauauaaucuguuga

SEQ ID NO: 513186 - RNA, 22 nt, Human
auuugugggacuauaaugcagg

SEQ ID NO: 513187 - RNA, 22 nt, Human
gacucagugauuugacaugccu

SEQ ID NO: 513188 - RNA, 22 nt, Human
cagcaccuguuagcauuaaaua

SEQ ID NO: 513189 - RNA, 22 nt, Human
uggaaacuagagaguuuguauu

SEQ ID NO: 513190 - RNA, 22 nt, Human
ccugauuauuguaaauauauuu

SEQ ID NO: 513191 - RNA, 22 nt, Human
caggagaagguuuggagugcag

SEQ ID NO: 513192 - RNA, 22 nt, Human
uuuauaaacaguaccacggugc

SEQ ID NO: 513193 - RNA, 22 nt, Human
aaagucuuuauuuuguaucuuu

SEQ ID NO: 513194 - RNA, 22 nt, Human
guucagcaagaauguuucuauu

SEQ ID NO: 513195 - RNA, 22 nt, Human
cugacucugacaggacuugugg

SEQ ID NO: 513196 - RNA, 22 nt, Human
ugauacagucagcucacaauug

SEQ ID NO: 513197 - RNA, 22 nt, Human
uccuggcuaaugcugcugaugg

SEQ ID NO: 513198 - RNA, 22 nt, Human
gccauuuucugucuuguuuauu

SEQ ID NO: 513199 - RNA, 22 nt, Human
aggaggccccuccuggguugcu

SEQ ID NO: 513200 - RNA, 21 nt, Human
ccugggcugugguuuggagac

SEQ ID NO: 513201 - RNA, 22 nt, Human
agaaugcauuuuguguagcuau

SEQ ID NO: 513202 - RNA, 22 nt, Human
cagugcugagagccuggccagg

SEQ ID NO: 513203 - RNA, 22 nt, Human
ugcagaagaaugagcuuggagu

SEQ ID NO: 513204 - RNA, 22 nt, Human
guuucucaguuuggucugcaga

SEQ ID NO: 513205 - RNA, 22 nt, Human
caguucugguuugcagauauau

SEQ ID NO: 513206 - RNA, 22 nt, Human
uggagcuggaauuugagcugga

SEQ ID NO: 513207 - RNA, 22 nt, Human
ucugggccgcugcguuccauga

SEQ ID NO: 513208 - RNA, 22 nt, Human
aaucuguuuaguucugcguaug

SEQ ID NO: 513209 - RNA, 22 nt, Human
cucuucaggauggcuugugaug

SEQ ID NO: 513210 - RNA, 19 nt, Human
acauugaauuuucuucuuu

SEQ ID NO: 513211 - RNA, 22 nt, Human
cugcugcaggaugggcacucug

SEQ ID NO: 513212 - RNA, 22 nt, Human
auugucuguacuuuaaaaaugu

SEQ ID NO: 513213 - RNA, 22 nt, Human
agugcaaagcagccuguacacc

SEQ ID NO: 513214 - RNA, 22 nt, Human
ggccacucggccaccccugccg

SEQ ID NO: 513215 - RNA, 22 nt, Human
acaaagugaauugcaucgaguu

SEQ ID NO: 513216 - RNA, 22 nt, Human
ccuggagaccagaggauacuuc

SEQ ID NO: 513217 - RNA, 22 nt, Human
ugaaugaugcauuuguuuccca

SEQ ID NO: 513218 - RNA, 22 nt, Human
uuucaggauuaguuuaagcagg

SEQ ID NO: 513219 - RNA, 22 nt, Human
guuggccauuaauuggaggaca

SEQ ID NO: 513220 - RNA, 22 nt, Human
aggggccucgcaggaccgcucc

SEQ ID NO: 513221 - RNA, 22 nt, Human
ugggcuggcccaccacaccucg

SEQ ID NO: 513222 - RNA, 22 nt, Human
uuggaaggccagcaccuugagu

SEQ ID NO: 513223 - RNA, 22 nt, Human
ugcagcagacugaguaugagaa

SEQ ID NO: 513224 - RNA, 22 nt, Human
acuagucauuuaggugauauua

SEQ ID NO: 513225 - RNA, 22 nt, Human
agucaguggcuccgagccuggu

SEQ ID NO: 513226 - RNA, 22 nt, Human
cagagcugggcauggugaaagg

SEQ ID NO: 513227 - RNA, 20 nt, Human
uauugccuaaauaccagaau

SEQ ID NO: 513228 - RNA, 22 nt, Human
uuagccaugcccuagaagagga

SEQ ID NO: 513229 - RNA, 22 nt, Human
cgguccuguacuugaugagaua

SEQ ID NO: 513230 - RNA, 22 nt, Human
gccauccucugagcacuaggca

SEQ ID NO: 513231 - RNA, 22 nt, Human
gcucugggguuggaaagugauc

SEQ ID NO: 513232 - RNA, 22 nt, Human
gaugggaggaaccugggucccu

SEQ ID NO: 513233 - RNA, 22 nt, Human
cagagcauuuggaagccacgug

SEQ ID NO: 513234 - RNA, 22 nt, Human
cugcccugacugaccuuuugaa

SEQ ID NO: 513235 - RNA, 23 nt, Human
uggcucagggucucuuaugaagu

SEQ ID NO: 513236 - RNA, 22 nt, Human
gacagcuucuagaggaauuggu

SEQ ID NO: 513237 - RNA, 22 nt, Human
uuggaaauguagaaaagcagau

SEQ ID NO: 513238 - RNA, 22 nt, Human
aguuucaauucuuuucacaaag

SEQ ID NO: 513239 - RNA, 22 nt, Human
cuggcuuucauuucaagcacgu

SEQ ID NO: 513240 - RNA, 22 nt, Human
cuggcuccauccuaggcaaaug

SEQ ID NO: 513241 - RNA, 22 nt, Human
ggcacagcaagaagggaaauga

SEQ ID NO: 513242 - RNA, 18 nt, Human
gagguagauaagauuuuc

SEQ ID NO: 513243 - RNA, 22 nt, Human
uauagaagagacaugugcauag

SEQ ID NO: 513244 - RNA, 22 nt, Human
gcccaugcacuuucugugaugg

SEQ ID NO: 513245 - RNA, 22 nt, Human
aaaugcacagguuuuaaauccu

SEQ ID NO: 513246 - RNA, 22 nt, Human
acauucuagauauguuauauuu

SEQ ID NO: 513247 - RNA, 22 nt, Human
uagaaacauauaggauggcagg

SEQ ID NO: 513248 - RNA, 22 nt, Human
cauguuuucuaggcuuucacaa

SEQ ID NO: 513249 - RNA, 21 nt, Human
cuguccucagauguggacgag

SEQ ID NO: 513250 - RNA, 23 nt, Human
cccauuuucauguuaacuccugg

SEQ ID NO: 513251 - RNA, 22 nt, Human
cacaauuuuaauacacagucaa

SEQ ID NO: 513252 - RNA, 22 nt, Human
gggagcugagggaccucugugg

SEQ ID NO: 513253 - RNA, 22 nt, Human
acuuccuguguuggucuugcug

SEQ ID NO: 513254 - RNA, 22 nt, Human
acccagccacagcauugaggga

SEQ ID NO: 513255 - RNA, 22 nt, Human
aagaugaacugucuucacccau

SEQ ID NO: 513256 - RNA, 22 nt, Human
gcugggagaggcagcuuucgga

SEQ ID NO: 513257 - RNA, 19 nt, Human
uccccaagaguucuagcuc

SEQ ID NO: 513258 - RNA, 22 nt, Human
gacggcagaaacucaugagguc

SEQ ID NO: 513259 - RNA, 22 nt, Human
uuucuaaguguauugagcuugg

SEQ ID NO: 513260 - RNA, 22 nt, Human
cagagcuggccugugauuuuug

SEQ ID NO: 513261 - RNA, 22 nt, Human
gaacaggguugggugagagagg

SEQ ID NO: 513262 - RNA, 19 nt, Human
uucaggauugacccuacug

SEQ ID NO: 513263 - RNA, 22 nt, Human
ucacuuauaaaaugcaagaucu

SEQ ID NO: 513264 - RNA, 22 nt, Human
uccuggcucugcugccuccuag

SEQ ID NO: 513265 - RNA, 22 nt, Human
ugaagccaucaggaagccagca

SEQ ID NO: 513266 - RNA, 22 nt, Human
gugacuguaauuaccuuagcaa

SEQ ID NO: 513267 - RNA, 22 nt, Human
aaugauauagcagacauagccu

SEQ ID NO: 513268 - RNA, 22 nt, Human
agagacagaucugagggaccuc

SEQ ID NO: 513269 - RNA, 22 nt, Human
uagggcucacugagaugaauau

SEQ ID NO: 513270 - RNA, 22 nt, Human
aggcuccacggcaggaugcugu

SEQ ID NO: 513271 - RNA, 22 nt, Human
ugccaaggguaugggcaagaua

SEQ ID NO: 513272 - RNA, 22 nt, Human
uaaggccagcaugaaugcagca

SEQ ID NO: 513273 - RNA, 22 nt, Human
acauaaaggugacuaacaucuu

SEQ ID NO: 513274 - RNA, 22 nt, Human
cagcuuggaggaggaucuaaga

SEQ ID NO: 513275 - RNA, 22 nt, Human
gccuggcuccuaagagcacaac

SEQ ID NO: 513276 - RNA, 22 nt, Human
uugcacagaguggauauucagu

SEQ ID NO: 513277 - RNA, 22 nt, Human
cuuagggagaaugccucugcag

SEQ ID NO: 513278 - RNA, 22 nt, Human
ggagcaagucccaggcacuagu

SEQ ID NO: 513279 - RNA, 22 nt, Human
uggcuuccuggacagaugcggu

SEQ ID NO: 513280 - RNA, 22 nt, Human
ugcugaaucauaugguaauucu

SEQ ID NO: 513281 - RNA, 22 nt, Human
cuccaguaucuguaggaaaagg

SEQ ID NO: 513282 - RNA, 22 nt, Human
agggcuggcuaggugcguuccc

SEQ ID NO: 513283 - RNA, 22 nt, Human
gccugagacagugugguccaau

SEQ ID NO: 513284 - RNA, 22 nt, Human
cacugcaggucugagauggggg

SEQ ID NO: 513285 - RNA, 22 nt, Human
ucugucuuuagaggccugugcu

SEQ ID NO: 513286 - RNA, 21 nt, Human
aacaguucucuuugaaggugu

SEQ ID NO: 513287 - RNA, 22 nt, Human
cuggcuccaaggaagagguuuu

SEQ ID NO: 513288 - RNA, 22 nt, Human
uuuccaauaaagugucauuguu

SEQ ID NO: 513289 - RNA, 22 nt, Human
uccagaguacggaagagucauc

SEQ ID NO: 513290 - RNA, 22 nt, Human
caguguuuaaucauugugaauu

SEQ ID NO: 513291 - RNA, 22 nt, Human
ucaguggauauuucuguggcug

SEQ ID NO: 513292 - RNA, 22 nt, Human
uaagaacagugucugucucaca

SEQ ID NO: 513293 - RNA, 22 nt, Human
caaaugcagauucaggaguucu

SEQ ID NO: 513294 - RNA, 22 nt, Human
aaaaggcucuucaaaauggaag

SEQ ID NO: 513295 - RNA, 22 nt, Human
agagccagguguagucucggag

SEQ ID NO: 513296 - RNA, 22 nt, Human
auuuguguuguauuaagcugcu

SEQ ID NO: 513297 - RNA, 22 nt, Human
aucucuggcaaugcagcaucgu

SEQ ID NO: 513298 - RNA, 22 nt, Human
augcacagacccaaaggccauc

SEQ ID NO: 513299 - RNA, 22 nt, Human
acacagccgugaaucugcuucu

SEQ ID NO: 513300 - RNA, 22 nt, Human
gggcacagcccagugggguccc

SEQ ID NO: 513301 - RNA, 22 nt, Human
caggucucucccaagcuacaau

SEQ ID NO: 513302 - RNA, 21 nt, Human
aauuagggugccucuuauaau

SEQ ID NO: 513303 - RNA, 19 nt, Human
aggucauugauagugcagg

SEQ ID NO: 513304 - RNA, 22 nt, Human
gcguaaggccucuggucucgga

SEQ ID NO: 513305 - RNA, 22 nt, Human
agggcugccugacuccagagcc

SEQ ID NO: 513306 - RNA, 22 nt, Human
uaccuugggcuauuaucuuuga

SEQ ID NO: 513307 - RNA, 22 nt, Human
augggcugaaagaguaagcugu

SEQ ID NO: 513308 - RNA, 22 nt, Human
agagcugcccacacagcagauu

SEQ ID NO: 513309 - RNA, 22 nt, Human
gguggcagaggugcaucagccc

SEQ ID NO: 513310 - RNA, 22 nt, Human
acagaugaggaauuuauuuggu

SEQ ID NO: 513311 - RNA, 19 nt, Human
ugggcagcucccucugucc

SEQ ID NO: 513312 - RNA, 22 nt, Human
gauggcagucaaccaggugagg

SEQ ID NO: 513313 - RNA, 22 nt, Human
cuucugggcauucagcugcaca

SEQ ID NO: 513314 - RNA, 23 nt, Human
cccagcuuucccacugccgagag

SEQ ID NO: 513315 - RNA, 22 nt, Human
ccuggcaggcuggggacagugc

SEQ ID NO: 513316 - RNA, 22 nt, Human
agggagacacaugaggaaguca

SEQ ID NO: 513317 - RNA, 18 nt, Human
gcuuuauuucuuggggaa

SEQ ID NO: 513318 - RNA, 22 nt, Human
uuccugagucgccgagucuaug

SEQ ID NO: 513319 - RNA, 22 nt, Human
caaaaguaauggcgguuuuuac

SEQ ID NO: 513320 - RNA, 22 nt, Human
acuugggagggugugggcagcu

SEQ ID NO: 513321 - RNA, 22 nt, Human
cugccuugaaaaugaagcuuua

SEQ ID NO: 513322 - RNA, 21 nt, Human
accaggcuugugggagggagc

SEQ ID NO: 513323 - RNA, 22 nt, Human
guggccagaaucuugaggccuu

SEQ ID NO: 513324 - RNA, 22 nt, Human
cccaggcagccccagaagcuug

SEQ ID NO: 513325 - RNA, 22 nt, Human
uucauugugaacacauucugcc

SEQ ID NO: 513326 - RNA, 22 nt, Human
ucaaggcuaaacuuucagagua

SEQ ID NO: 513327 - RNA, 22 nt, Human
ugcauuguugaugaguugaaua

SEQ ID NO: 513328 - RNA, 17 nt, Human
aggugcagaggcagagc

SEQ ID NO: 513329 - RNA, 22 nt, Human
uggccagugggguugagcagga

SEQ ID NO: 513330 - RNA, 22 nt, Human
cuaguucuuaacuguuaugauu

SEQ ID NO: 513331 - RNA, 22 nt, Human
caggugaccuuuguccuaaguu

SEQ ID NO: 513332 - RNA, 21 nt, Human
ugcugccauagaccugaggga

SEQ ID NO: 513333 - RNA, 22 nt, Human
agguggagaagagaugggcagu

SEQ ID NO: 513334 - RNA, 22 nt, Human
ccagggggcuuggugaggccau

SEQ ID NO: 513335 - RNA, 22 nt, Human
gugccuggaaugcgccucggcg

SEQ ID NO: 513336 - RNA, 22 nt, Human
ucacagaauaaauguacuggcc

SEQ ID NO: 513337 - RNA, 22 nt, Human
ucaugcaaggcugaaacauggu

SEQ ID NO: 513338 - RNA, 22 nt, Human
aucaguuuauacuuauaaaucu

SEQ ID NO: 513339 - RNA, 22 nt, Human
gaaacagcuagaaagccauugg

SEQ ID NO: 513340 - RNA, 22 nt, Human
gcccaggcuggagugcaguagc

SEQ ID NO: 513341 - RNA, 22 nt, Human
ucaguguuuauugcggugugua

SEQ ID NO: 513342 - RNA, 22 nt, Human
ugcauauuauguguaucugucu

SEQ ID NO: 513343 - RNA, 22 nt, Human
ucuuuguuugccuuuaucaaga

SEQ ID NO: 513344 - RNA, 22 nt, Human
uaauuuuguauugccauuguag

SEQ ID NO: 513345 - RNA, 22 nt, Human
ggucccaguccucucccugcua

SEQ ID NO: 513346 - RNA, 22 nt, Human
acuuucuucuuaugcauuaagg

SEQ ID NO: 513347 - RNA, 22 nt, Human
gcacccagccagcaucucagag

SEQ ID NO: 513348 - RNA, 22 nt, Human
uccagggaucuuuagagucuuu

SEQ ID NO: 513349 - RNA, 22 nt, Human
aggguaggguaaaugaugcauc

SEQ ID NO: 513350 - RNA, 20 nt, Human
gcucccugguagaaauguuu

SEQ ID NO: 513351 - RNA, 22 nt, Human
ugcugguggagaaaguggaggu

SEQ ID NO: 513352 - RNA, 22 nt, Human
agcugagcucaggcugauguaa

SEQ ID NO: 513353 - RNA, 22 nt, Human
uuauuaauaaaguggcauagcc

SEQ ID NO: 513354 - RNA, 22 nt, Human
uguggccaggaaaaggagaugg

SEQ ID NO: 513355 - RNA, 22 nt, Human
ccuggaaggcaggcauggauug

SEQ ID NO: 513356 - RNA, 22 nt, Human
aaacagcuuguuucaggaaagu

SEQ ID NO: 513357 - RNA, 22 nt, Human
cccugcucuuagugccugugug

SEQ ID NO: 513358 - RNA, 22 nt, Human
ccaggcuuuguaccaggcuuuc

SEQ ID NO: 513359 - RNA, 22 nt, Human
uauaaaugcacuuuugaaauau

SEQ ID NO: 513360 - RNA, 22 nt, Human
ucaaaccaccuuguuacugggg

SEQ ID NO: 513361 - RNA, 21 nt, Human
gccuggcucucacuggccugg

SEQ ID NO: 513362 - RNA, 22 nt, Human
gccuucagcccugacuggccag

SEQ ID NO: 513363 - RNA, 22 nt, Human
uucuaguugagggagacaaaua

SEQ ID NO: 513364 - RNA, 22 nt, Human
agggaaauaaucuauucugagg

SEQ ID NO: 513365 - RNA, 18 nt, Human
agagaugguguagaguuu

SEQ ID NO: 513366 - RNA, 22 nt, Human
agucucugagguucagaugccu

SEQ ID NO: 513367 - RNA, 22 nt, Human
augggcuguccuaguccagccc

SEQ ID NO: 513368 - RNA, 22 nt, Human
ugcagcagcagggaggaggcuc

SEQ ID NO: 513369 - RNA, 20 nt, Human
gagccugggaagucuaaggu

SEQ ID NO: 513370 - RNA, 19 nt, Human
acacagggaucagaggguu

SEQ ID NO: 513371 - RNA, 22 nt, Human
ucaguuuucucaucuguaauuu

SEQ ID NO: 513372 - RNA, 22 nt, Human
uugcccugcggguccugcgcaa

SEQ ID NO: 513373 - RNA, 22 nt, Human
uucauucaucucuaaaaugccu

SEQ ID NO: 513374 - RNA, 22 nt, Human
uucucacaggauuucuuuuagu

SEQ ID NO: 513375 - RNA, 22 nt, Human
gaaaguauuuaaguccauauuu

SEQ ID NO: 513376 - RNA, 22 nt, Human
ugugaggacauuggaggacuca

SEQ ID NO: 513377 - RNA, 22 nt, Human
uccaggcaaaaggaacugcuug

SEQ ID NO: 513378 - RNA, 22 nt, Human
ggccucugguucacagggagga

SEQ ID NO: 513379 - RNA, 22 nt, Human
ugggauggagccugaguauagu

SEQ ID NO: 513380 - RNA, 22 nt, Human
aucugaagaaugaauggaauua

SEQ ID NO: 513381 - RNA, 22 nt, Human
gaggggucacaugggcuggcuu

SEQ ID NO: 513382 - RNA, 22 nt, Human
ugccuacauuccuugcuuaugg

SEQ ID NO: 513383 - RNA, 22 nt, Human
ccaggcuggaguguagucgcau

SEQ ID NO: 513384 - RNA, 22 nt, Human
cuggagcaggcuugucccagcu

SEQ ID NO: 513385 - RNA, 22 nt, Human
cacuggugacuucugagcugga

SEQ ID NO: 513386 - RNA, 22 nt, Human
caguacuugggaaugcugggga

SEQ ID NO: 513387 - RNA, 19 nt, Human
uucuaaguuuugcuugcug

SEQ ID NO: 513388 - RNA, 19 nt, Human
uggcaggcccaggauggac

SEQ ID NO: 513389 - RNA, 22 nt, Human
cugggccugugacucccauccu

SEQ ID NO: 513390 - RNA, 22 nt, Human
auggaggaugugcagcaugggc

SEQ ID NO: 513391 - RNA, 22 nt, Human
augggcugaggugggauagaag

SEQ ID NO: 513392 - RNA, 22 nt, Human
agauggagaaugacaauuaagg

SEQ ID NO: 513393 - RNA, 22 nt, Human
uugagggucuggaucugcugcu

SEQ ID NO: 513394 - RNA, 22 nt, Human
cugggggccuuacggaacucca

SEQ ID NO: 513395 - RNA, 22 nt, Human
uagcuccuggugagccuacucu

SEQ ID NO: 513396 - RNA, 22 nt, Human
auaugugugccauuucagcagu

SEQ ID NO: 513397 - RNA, 22 nt, Human
uguacauugucacucaucaagu

SEQ ID NO: 513398 - RNA, 22 nt, Human
uguguacagcaugguccagcag

SEQ ID NO: 513399 - RNA, 22 nt, Human
aacacaguuuuccaaaauagag

SEQ ID NO: 513400 - RNA, 22 nt, Human
ucaaugauaguacaaucagccu

SEQ ID NO: 513401 - RNA, 22 nt, Human
ugcuggggucauggggcgcccg

SEQ ID NO: 513402 - RNA, 22 nt, Human
agugucauuuuguccaucuucu

SEQ ID NO: 513403 - RNA, 22 nt, Human
ccagagaggccuuggcaagaca

SEQ ID NO: 513404 - RNA, 22 nt, Human
acugucugcccugagaugccag

SEQ ID NO: 513405 - RNA, 17 nt, Human
ggugagaccucccacuc

SEQ ID NO: 513406 - RNA, 22 nt, Human
caggaccuggaaugcuugugaa

SEQ ID NO: 513407 - RNA, 20 nt, Human
agaggcuuccuugggaggag

SEQ ID NO: 513408 - RNA, 22 nt, Human
ugcaagagguaaaaugaaagga

SEQ ID NO: 513409 - RNA, 23 nt, Human
aaccagauaaauggcuccagggc

SEQ ID NO: 513410 - RNA, 22 nt, Human
uaggaagcugagcagcauuccu

SEQ ID NO: 513411 - RNA, 22 nt, Human
agucuggaauuuggccugagca

SEQ ID NO: 513412 - RNA, 22 nt, Human
ggaggaccugcuggcccugcaa

SEQ ID NO: 513413 - RNA, 22 nt, Human
caucuggguucucagauggaua

SEQ ID NO: 513414 - RNA, 22 nt, Human
ugcagaaggaggaggaaaucca

SEQ ID NO: 513415 - RNA, 22 nt, Human
caagccagcuccugccacagag

SEQ ID NO: 513416 - RNA, 22 nt, Human
gucccagggagguucagggcuu

SEQ ID NO: 513417 - RNA, 22 nt, Human
ggcacagcacagagcacaugua

SEQ ID NO: 513418 - RNA, 22 nt, Human
uuaaauuccagccucauaauag

SEQ ID NO: 513419 - RNA, 22 nt, Human
ggaaacuuggcauaauuuuaag

SEQ ID NO: 513420 - RNA, 22 nt, Human
ggcucccacccauagggcgagu

SEQ ID NO: 513421 - RNA, 22 nt, Human
ucaguaaaucucuaauuggcau

SEQ ID NO: 513422 - RNA, 22 nt, Human
ugucccagucaaggcugucauc

SEQ ID NO: 513423 - RNA, 16 nt, Human
ucacauacuuccuugc

SEQ ID NO: 513424 - RNA, 22 nt, Human
ucuaggagcaugaagggaaggc

SEQ ID NO: 513425 - RNA, 22 nt, Human
caguacuuuucaaccaguauga

SEQ ID NO: 513426 - RNA, 22 nt, Human
uucucucauucaaauuaaagug

SEQ ID NO: 513427 - RNA, 19 nt, Human
ccagagacauuggcaucuu

SEQ ID NO: 513428 - RNA, 22 nt, Human
uggagcaggcaucuuucucucu

SEQ ID NO: 513429 - RNA, 22 nt, Human
cagagguauuuugauaaacgcc

SEQ ID NO: 513430 - RNA, 22 nt, Human
ccugggcaaaugccagagacaa

SEQ ID NO: 513431 - RNA, 19 nt, Human
agcagccaucgaccaugga

SEQ ID NO: 513432 - RNA, 21 nt, Human
gugcugggacacagccaggcu

SEQ ID NO: 513433 - RNA, 22 nt, Human
cagagcuguuacuauucaugaa

SEQ ID NO: 513434 - RNA, 23 nt, Human
caggcaggaugaggacuacacuc

SEQ ID NO: 513435 - RNA, 22 nt, Human
caggccucccggugcacacuga

SEQ ID NO: 513436 - RNA, 18 nt, Human
ugcuggcaacuacuauug

SEQ ID NO: 513437 - RNA, 22 nt, Human
gaccauuucuaggaaucagacu

SEQ ID NO: 513438 - RNA, 22 nt, Human
ccugccucaggacucugcauau

SEQ ID NO: 513439 - RNA, 22 nt, Human
uagcagaacaauagucaaugau

SEQ ID NO: 513440 - RNA, 22 nt, Human
acuguacauguaaacauuguca

SEQ ID NO: 513441 - RNA, 22 nt, Human
uuucauaauacuguacaugaaa

SEQ ID NO: 513442 - RNA, 22 nt, Human
cuuaacagagagaaguguugcu

SEQ ID NO: 513443 - RNA, 22 nt, Human
acaucccacagaaacauacaua

SEQ ID NO: 513444 - RNA, 22 nt, Human
ugcuggccugguuagaaagggg

SEQ ID NO: 513445 - RNA, 22 nt, Human
uggccugccugggagcagcagg

SEQ ID NO: 513446 - RNA, 22 nt, Human
ucugcccuuggcucucuuguug

SEQ ID NO: 513447 - RNA, 22 nt, Human
ugcagcauuugcugaagcagga

SEQ ID NO: 513448 - RNA, 22 nt, Human
ccugggagggcaagugcugaug

SEQ ID NO: 513449 - RNA, 22 nt, Human
cagcucucacacccuccuccca

SEQ ID NO: 513450 - RNA, 22 nt, Human
gacacauaugcguauaguuuag

SEQ ID NO: 513451 - RNA, 22 nt, Human
gagccaggguuugaaacuagac

SEQ ID NO: 513452 - RNA, 22 nt, Human
gagggggagaugugcacacacu

SEQ ID NO: 513453 - RNA, 22 nt, Human
ccaguguuuucauccucccuug

SEQ ID NO: 513454 - RNA, 18 nt, Human
gccagagguacuacugau

SEQ ID NO: 513455 - RNA, 22 nt, Human
ggcaaaaaguucccaucagugu

SEQ ID NO: 513456 - RNA, 22 nt, Human
uggagucugugaugcucugggu

SEQ ID NO: 513457 - RNA, 22 nt, Human
agaugugagaaucaagugacca

SEQ ID NO: 513458 - RNA, 22 nt, Human
ugaagcccugugucagcuucca

SEQ ID NO: 513459 - RNA, 22 nt, Human
ccugcagaaaggguccccagga

SEQ ID NO: 513460 - RNA, 22 nt, Human
cuuccaaguugcucugcugacc

SEQ ID NO: 513461 - RNA, 22 nt, Human
caggugggaccaugauagggca

SEQ ID NO: 513462 - RNA, 22 nt, Human
accaggcagcacuuuccuugca

SEQ ID NO: 513463 - RNA, 22 nt, Human
accugccagcugagaagggugu

SEQ ID NO: 513464 - RNA, 22 nt, Human
caggguccggcugccuggcugu

SEQ ID NO: 513465 - RNA, 22 nt, Human
gcugccugccuugccuggagga

SEQ ID NO: 513466 - RNA, 22 nt, Human
ggcuucuuccugugaacauguu

SEQ ID NO: 513467 - RNA, 22 nt, Human
caccagcuacagacuacugugu

SEQ ID NO: 513468 - RNA, 22 nt, Human
ugaggaaagaaaggcaugcaug

SEQ ID NO: 513469 - RNA, 22 nt, Human
ugagguaugguaagguaaaauc

SEQ ID NO: 513470 - RNA, 22 nt, Human
gcuccuguuuucuuccagaaau

SEQ ID NO: 513471 - RNA, 22 nt, Human
gaagaggacuguggcauccuag

SEQ ID NO: 513472 - RNA, 18 nt, Human
ugccagccgacuggccug

SEQ ID NO: 513473 - RNA, 22 nt, Human
aaacacugugggacaucuuacu

SEQ ID NO: 513474 - RNA, 22 nt, Human
caaguuuguguucuaucauucu

SEQ ID NO: 513475 - RNA, 22 nt, Human
ugucucugaacagcuuacuaaa

SEQ ID NO: 513476 - RNA, 22 nt, Human
aggaaacuuucuuuugcuucau

SEQ ID NO: 513477 - RNA, 22 nt, Human
uuuuguuuguguccacugcagu

SEQ ID NO: 513478 - RNA, 22 nt, Human
aaagaacaaaugauauaugguu

SEQ ID NO: 513479 - RNA, 23 nt, Human
agaggccagccuuuggagacacc

SEQ ID NO: 513480 - RNA, 22 nt, Human
aaaggccacacagagcagggag

SEQ ID NO: 513481 - RNA, 22 nt, Human
agggccaguucagaggacaugg

SEQ ID NO: 513482 - RNA, 22 nt, Human
uacaggaagcacucaagaaaug

SEQ ID NO: 513483 - RNA, 22 nt, Human
ugggcugcugcggugcucuugg

SEQ ID NO: 513484 - RNA, 22 nt, Human
uccugucugcucacagagcugg

SEQ ID NO: 513485 - RNA, 22 nt, Human
agcacaugcacagugcuacacu

SEQ ID NO: 513486 - RNA, 22 nt, Human
aguuucacagaggguuagacgc

SEQ ID NO: 513487 - RNA, 22 nt, Human
ugucaugcuuauguuacauacu

SEQ ID NO: 513488 - RNA, 19 nt, Human
ggcuggagaaaggaaucag

SEQ ID NO: 513489 - RNA, 22 nt, Human
cggggcugcgcucuuccugccg

SEQ ID NO: 513490 - RNA, 22 nt, Human
aggccuuccucggagacaggga

SEQ ID NO: 513491 - RNA, 22 nt, Human
ucccuggcagcuguccuuucag

SEQ ID NO: 513492 - RNA, 22 nt, Human
uccuggcuuccugcucuuguca

SEQ ID NO: 513493 - RNA, 21 nt, Human
aaggccugcuuacugcuaguu

SEQ ID NO: 513494 - RNA, 16 nt, Human
gagccaggugccuuga

SEQ ID NO: 513495 - RNA, 23 nt, Human
acacagaagaagacccaaggaag

SEQ ID NO: 513496 - RNA, 22 nt, Human
ccugaggcccuggcugugcuga

SEQ ID NO: 513497 - RNA, 22 nt, Human
aaaucugggucaagguggagug

SEQ ID NO: 513498 - RNA, 22 nt, Human
aaagugcugugauuacaggcau

SEQ ID NO: 513499 - RNA, 22 nt, Human
cccaggcagccugcagggaagg

SEQ ID NO: 513500 - RNA, 22 nt, Human
uggccugaggcucggcaugggu

SEQ ID NO: 513501 - RNA, 22 nt, Human
ggagggcucaauugacuccuga

SEQ ID NO: 513502 - RNA, 22 nt, Human
cuucccuuggugaacagagcau

SEQ ID NO: 513503 - RNA, 22 nt, Human
gagcagcuguucugacuugucu

SEQ ID NO: 513504 - RNA, 22 nt, Human
uuucacauuuguuuuaagaagu

SEQ ID NO: 513505 - RNA, 18 nt, Human
ggagccagucugucucug

SEQ ID NO: 513506 - RNA, 22 nt, Human
uuacaagauuaauuauuggagu

SEQ ID NO: 513507 - RNA, 22 nt, Human
ucucuuguaauuuaaaaaaucu

SEQ ID NO: 513508 - RNA, 22 nt, Human
ugauucaauaggaauugaguag

SEQ ID NO: 513509 - RNA, 22 nt, Human
ucucaucugccauuugcaggag

SEQ ID NO: 513510 - RNA, 19 nt, Human
ugccagagauacucccaga

SEQ ID NO: 513511 - RNA, 19 nt, Human
ccugucugucuucagcuag

SEQ ID NO: 513512 - RNA, 22 nt, Human
uucagagaacuucauggaagag

SEQ ID NO: 513513 - RNA, 22 nt, Human
guguggcuaccucagaggagca

SEQ ID NO: 513514 - RNA, 22 nt, Human
gggugaggagcugccagucaug

SEQ ID NO: 513515 - RNA, 22 nt, Human
agucucuggacugggagauggc

SEQ ID NO: 513516 - RNA, 22 nt, Human
acagccagucaucucagcaggg

SEQ ID NO: 513517 - RNA, 22 nt, Human
ugaggcagccugcauuaaagag

SEQ ID NO: 513518 - RNA, 23 nt, Human
aggcacugaaugugucagugagu

SEQ ID NO: 513519 - RNA, 17 nt, Human
agagagagcaugccacc

SEQ ID NO: 513520 - RNA, 23 nt, Human
ugggcaucuccucugugccaggc

SEQ ID NO: 513521 - RNA, 22 nt, Human
uauuccuaagucccaacuacau

SEQ ID NO: 513522 - RNA, 22 nt, Human
auuugcugagcucaaagaaaag

SEQ ID NO: 513523 - RNA, 22 nt, Human
ugugccuggagucccugaggag

SEQ ID NO: 513524 - RNA, 21 nt, Human
uccugcagaaugccuuccuac

SEQ ID NO: 513525 - RNA, 22 nt, Human
aggccagcucacccuggcuccu

SEQ ID NO: 513526 - RNA, 22 nt, Human
uuauucaccgcaggugcuuccc

SEQ ID NO: 513527 - RNA, 22 nt, Human
ugcuccugcugcaugcaucucc

SEQ ID NO: 513528 - RNA, 22 nt, Human
agcugccaaguuucucaguuua

SEQ ID NO: 513529 - RNA, 22 nt, Human
acaguuugaauaauuuagauag

SEQ ID NO: 513530 - RNA, 22 nt, Human
ucugagcauugaauuuucuucc

SEQ ID NO: 513531 - RNA, 22 nt, Human
cugucuguucagauucauuacu

SEQ ID NO: 513532 - RNA, 22 nt, Human
cagcaggguuaagugacucacc

SEQ ID NO: 513533 - RNA, 22 nt, Human
aaaucagucccucuuggaauuu

SEQ ID NO: 513534 - RNA, 22 nt, Human
cccaggcaggagugugguggcu

SEQ ID NO: 513535 - RNA, 22 nt, Human
ccaaggagcucauauucuuguu

SEQ ID NO: 513536 - RNA, 22 nt, Human
aggcugagauagguggaucauu

SEQ ID NO: 513537 - RNA, 22 nt, Human
cgaggcggcggaagugcccgua

SEQ ID NO: 513538 - RNA, 22 nt, Human
aguaugaaaguuaaucaauuua

SEQ ID NO: 513539 - RNA, 22 nt, Human
cacagagcuggaaaggcugggc

SEQ ID NO: 513540 - RNA, 17 nt, Human
aucuggaagcuagcuga

SEQ ID NO: 513541 - RNA, 22 nt, Human
ucagcacugauguuucagaaga

SEQ ID NO: 513542 - RNA, 22 nt, Human
uaacagaaauuuuaguuagggg

SEQ ID NO: 513543 - RNA, 22 nt, Human
ugggaccugcccuggccccauc

SEQ ID NO: 513544 - RNA, 22 nt, Human
cagcagcugcgugcccaggccg

SEQ ID NO: 513545 - RNA, 22 nt, Human
accaugaucugcucugguguuu

SEQ ID NO: 513546 - RNA, 22 nt, Human
cuuccagguucugguugggaag

SEQ ID NO: 513547 - RNA, 22 nt, Human
gaggaacuuaugauauucuacu

SEQ ID NO: 513548 - RNA, 20 nt, Human
uuccacaucuuugcacaugc

SEQ ID NO: 513549 - RNA, 22 nt, Human
aguggcuggacgacaaggguga

SEQ ID NO: 513550 - RNA, 22 nt, Human
ucccuuaaaacucauguguugu

SEQ ID NO: 513551 - RNA, 17 nt, Human
uggggaugguucaugag

SEQ ID NO: 513552 - RNA, 22 nt, Human
gagcuuggugaugccuccuggu

SEQ ID NO: 513553 - RNA, 22 nt, Human
uucuggagacccagcaacaggg

SEQ ID NO: 513554 - RNA, 22 nt, Human
ugaggagcuucuggaaagugca

SEQ ID NO: 513555 - RNA, 22 nt, Human
ucccagggucaguggugaggcc

SEQ ID NO: 513556 - RNA, 22 nt, Human
auggcccaaacugcaauuacuu

SEQ ID NO: 513557 - RNA, 22 nt, Human
gagggagggaaaguuuaacacu

SEQ ID NO: 513558 - RNA, 22 nt, Human
aaaggccacugcaagggaaggu

SEQ ID NO: 513559 - RNA, 22 nt, Human
agggacacaugugauuauuuau

SEQ ID NO: 513560 - RNA, 22 nt, Human
gagcucccaggccccagcaagg

SEQ ID NO: 513561 - RNA, 22 nt, Human
aacaugagcauucuugugcuug

SEQ ID NO: 513562 - RNA, 22 nt, Human
uacuuuuagccuauuugauucu

SEQ ID NO: 513563 - RNA, 22 nt, Human
gaaagaaugcuauagugacuuc

SEQ ID NO: 513564 - RNA, 22 nt, Human
acagcagcgucaacuuaaaauu

SEQ ID NO: 513565 - RNA, 22 nt, Human
ggagaaugauucuuugcucacu

SEQ ID NO: 513566 - RNA, 22 nt, Human
uggagcaggugcucaggguaau

SEQ ID NO: 513567 - RNA, 20 nt, Human
acaaaugcauucugugacau

SEQ ID NO: 513568 - RNA, 22 nt, Human
guucauuuaugauguaacaugu

SEQ ID NO: 513569 - RNA, 22 nt, Human
agucaauucuuuucaacucaag

SEQ ID NO: 513570 - RNA, 22 nt, Human
ugugcagggaagggcaugcuau

SEQ ID NO: 513571 - RNA, 22 nt, Human
agcugccaggccccugagaacc

SEQ ID NO: 513572 - RNA, 17 nt, Human
cuccuggcagccucagg

SEQ ID NO: 513573 - RNA, 22 nt, Human
uuauacauguguuuugagauga

SEQ ID NO: 513574 - RNA, 22 nt, Human
uacagaaaucacaucgcuuuga

SEQ ID NO: 513575 - RNA, 22 nt, Human
auacagaagaacuauagccacu

SEQ ID NO: 513576 - RNA, 18 nt, Human
aaguagaucaugagccac

SEQ ID NO: 513577 - RNA, 22 nt, Human
ggagaaggaauauuggaguagg

SEQ ID NO: 513578 - RNA, 22 nt, Human
acauucuuggacuccacucuag

SEQ ID NO: 513579 - RNA, 22 nt, Human
uagcugcuucucacaugggcaa

SEQ ID NO: 513580 - RNA, 22 nt, Human
ugcuucugauucaugguuauug

SEQ ID NO: 513581 - RNA, 22 nt, Human
uuucacacugcagcaucagaga

SEQ ID NO: 513582 - RNA, 21 nt, Human
uuugaaagcccuauguuuuca

SEQ ID NO: 513583 - RNA, 22 nt, Human
ugagggaguguggauacaguag

SEQ ID NO: 513584 - RNA, 22 nt, Human
cagcccagccgagggccuggcu

SEQ ID NO: 513585 - RNA, 22 nt, Human
gccagagccacuuuugggugau

SEQ ID NO: 513586 - RNA, 22 nt, Human
gccaggcuggucuugaacuccu

SEQ ID NO: 513587 - RNA, 22 nt, Human
caggagagcccggguccgggcu

SEQ ID NO: 513588 - RNA, 22 nt, Human
cuggagccacugggucuuguau

SEQ ID NO: 513589 - RNA, 22 nt, Human
ucagccuuugaagggcugcagg

SEQ ID NO: 513590 - RNA, 18 nt, Human
cggcagagugcuucuagc

SEQ ID NO: 513591 - RNA, 22 nt, Human
uacaaaaaauugauacugacga

SEQ ID NO: 513592 - RNA, 22 nt, Human
cacuguccaugcuugcuaaccc

SEQ ID NO: 513593 - RNA, 22 nt, Human
acucagcugaugaagcacaagu

SEQ ID NO: 513594 - RNA, 22 nt, Human
aagauuauggcagauaacaauu

SEQ ID NO: 513595 - RNA, 22 nt, Human
ucaccacugaacagaccuuugg

SEQ ID NO: 513596 - RNA, 22 nt, Human
guuuauaauccaacucugcucc

SEQ ID NO: 513597 - RNA, 22 nt, Human
agcuggagaucaugcugauacu

SEQ ID NO: 513598 - RNA, 20 nt, Human
aacagggggcugcagagggc

SEQ ID NO: 513599 - RNA, 22 nt, Human
cacagguguaugaauaugucca

SEQ ID NO: 513600 - RNA, 22 nt, Human
gcucugucaacagcuagcugug

SEQ ID NO: 513601 - RNA, 22 nt, Human
uaacagaauccuguuauugcca

SEQ ID NO: 513602 - RNA, 22 nt, Human
guccagugcuuauagaaucagu

SEQ ID NO: 513603 - RNA, 22 nt, Human
acuccuggggauccauuccuuu

SEQ ID NO: 513604 - RNA, 22 nt, Human
uaugcuaauuguuagucacaug

SEQ ID NO: 513605 - RNA, 22 nt, Human
aguagauuuuagauuacauagu

SEQ ID NO: 513606 - RNA, 22 nt, Human
gagggcagagacagugauucac

SEQ ID NO: 513607 - RNA, 22 nt, Human
accugaggaagggcgagaagcu

SEQ ID NO: 513608 - RNA, 22 nt, Human
ggaaagagcccagcagugcuug

SEQ ID NO: 513609 - RNA, 22 nt, Human
gagugcaguuggggugagggga

SEQ ID NO: 513610 - RNA, 22 nt, Human
aaauggaggcaaaauugguuuc

SEQ ID NO: 513611 - RNA, 22 nt, Human
uuguagaacaugcagcacaaug

SEQ ID NO: 513612 - RNA, 22 nt, Human
agaggccccaugggauggcggu

SEQ ID NO: 513613 - RNA, 22 nt, Human
agugaccaaucaugguuagauu

SEQ ID NO: 513614 - RNA, 22 nt, Human
caggaggcccacaggccccugc

SEQ ID NO: 513615 - RNA, 22 nt, Human
cacagcagucuuucacuaaaua

SEQ ID NO: 513616 - RNA, 22 nt, Human
ucuugcuaaagaccaacacauu

SEQ ID NO: 513617 - RNA, 22 nt, Human
ugaagcaguucucagaaguggg

SEQ ID NO: 513618 - RNA, 22 nt, Human
gcccugcucuggucucugcccg

SEQ ID NO: 513619 - RNA, 22 nt, Human
accugccagugaauacuaucuu

SEQ ID NO: 513620 - RNA, 22 nt, Human
uccaaaggggcaguguccagcc

SEQ ID NO: 513621 - RNA, 22 nt, Human
guaaaguucuauuugaauuuag

SEQ ID NO: 513622 - RNA, 21 nt, Human
cccagggaagccgcagucacc

SEQ ID NO: 513623 - RNA, 22 nt, Human
auuuacagacguggauuagugc

SEQ ID NO: 513624 - RNA, 22 nt, Human
gggcuuuaaucuuguuaacuag

SEQ ID NO: 513625 - RNA, 19 nt, Human
uguuucuuccuccaucuga

SEQ ID NO: 513626 - RNA, 22 nt, Human
gagcuuggaugucuuuuguuca

SEQ ID NO: 513627 - RNA, 22 nt, Human
gcagcaggcuuuucauaccuug

SEQ ID NO: 513628 - RNA, 22 nt, Human
uaugaaugcuccaguaacuuuc

SEQ ID NO: 513629 - RNA, 22 nt, Human
gcuguccagagcaugggagcaa

SEQ ID NO: 513630 - RNA, 22 nt, Human
guucugucugagcaccacagga

SEQ ID NO: 513631 - RNA, 22 nt, Human
agaacagaugugggcagaccug

SEQ ID NO: 513632 - RNA, 22 nt, Human
ugcugucccccgugucugggcu

SEQ ID NO: 513633 - RNA, 22 nt, Human
ggccacugccuccgccauggcu

SEQ ID NO: 513634 - RNA, 22 nt, Human
agauuccagaucccaaaaauga

SEQ ID NO: 513635 - RNA, 22 nt, Human
cuggagcuccagggucuccucu

SEQ ID NO: 513636 - RNA, 22 nt, Human
ccuggagguggagguugcagug

SEQ ID NO: 513637 - RNA, 22 nt, Human
auggaaaaggcugauuucauua

SEQ ID NO: 513638 - RNA, 22 nt, Human
ccugggcuugcaucugugcugg

SEQ ID NO: 513639 - RNA, 19 nt, Human
cccaggguuuccucucucc

SEQ ID NO: 513640 - RNA, 22 nt, Human
gaggaagccccauugaagccag

SEQ ID NO: 513641 - RNA, 22 nt, Human
guuagaaacacauucuuauuga

SEQ ID NO: 513642 - RNA, 22 nt, Human
cugcccugcuaaugaguuccaa

SEQ ID NO: 513643 - RNA, 22 nt, Human
aggccugggucucgugccuacc

SEQ ID NO: 513644 - RNA, 22 nt, Human
uccuugaaaggggcugcagggc

SEQ ID NO: 513645 - RNA, 22 nt, Human
aggagugcaaauaguccagaga

SEQ ID NO: 513646 - RNA, 22 nt, Human
uauccuuguacuauaguauuua

SEQ ID NO: 513647 - RNA, 22 nt, Human
aaaauguguuuaugcauuucgu

SEQ ID NO: 513648 - RNA, 22 nt, Human
ucuccucuacugggucugcaga

SEQ ID NO: 513649 - RNA, 22 nt, Human
auacauguucguguacauguuc

SEQ ID NO: 513650 - RNA, 20 nt, Human
gcucugggugguaaaugacu

SEQ ID NO: 513651 - RNA, 22 nt, Human
ucugaggcccugcaggcagugu

SEQ ID NO: 513652 - RNA, 18 nt, Human
cagaaaucacaccagcac

SEQ ID NO: 513653 - RNA, 18 nt, Human
gcugucugaggucugagg

SEQ ID NO: 513654 - RNA, 22 nt, Human
agguuacagucaucucagaauc

SEQ ID NO: 513655 - RNA, 20 nt, Human
gucaggauuaguaaacucug

SEQ ID NO: 513656 - RNA, 22 nt, Human
aggccuggugugccggaugcag

SEQ ID NO: 513657 - RNA, 22 nt, Human
uuuguaaaggccugaauuucag

SEQ ID NO: 513658 - RNA, 22 nt, Human
gaucugguuucaucauggacuu

SEQ ID NO: 513659 - RNA, 22 nt, Human
cagguagaggcugccaucagcu

SEQ ID NO: 513660 - RNA, 20 nt, Human
ugaaggccauuuguuccaga

SEQ ID NO: 513661 - RNA, 18 nt, Human
uuucacaaccuccagagg

SEQ ID NO: 513662 - RNA, 22 nt, Human
cuucacaggcaagucuguuuuu

SEQ ID NO: 513663 - RNA, 20 nt, Human
caggcacacucauuccugcu

SEQ ID NO: 513664 - RNA, 22 nt, Human
aacaugaaaaccuccacagcaa

SEQ ID NO: 513665 - RNA, 22 nt, Human
ucaaaugcggucauggcuuuua

SEQ ID NO: 513666 - RNA, 22 nt, Human
uucacaggugacuggggauaac

SEQ ID NO: 513667 - RNA, 22 nt, Human
ccacagcugaccgcaggugagc

SEQ ID NO: 513668 - RNA, 22 nt, Human
gcaccacaucaaugaggggagc

SEQ ID NO: 513669 - RNA, 22 nt, Human
uggcucuguucgccaucaggag

SEQ ID NO: 513670 - RNA, 22 nt, Human
cagagguagaacuggcccucac

SEQ ID NO: 513671 - RNA, 20 nt, Human
accugaggucccuauggucu

SEQ ID NO: 513672 - RNA, 22 nt, Human
uuucaaagagaggcagaaggaa

SEQ ID NO: 513673 - RNA, 22 nt, Human
uggggcuggcuauugucucccu

SEQ ID NO: 513674 - RNA, 22 nt, Human
gcucugcugaagccccuugcau

SEQ ID NO: 513675 - RNA, 17 nt, Human
acacagccagguucucc

SEQ ID NO: 513676 - RNA, 19 nt, Human
gcuggcuggaggagggaca

SEQ ID NO: 513677 - RNA, 22 nt, Human
uguacagagacuaccauuaaua

SEQ ID NO: 513678 - RNA, 19 nt, Human
ugguccagcuucuucuccu

SEQ ID NO: 513679 - RNA, 22 nt, Human
caagaugggcaccccagcaccu

SEQ ID NO: 513680 - RNA, 22 nt, Human
cauuuguuggucagauuguagu

SEQ ID NO: 513681 - RNA, 22 nt, Human
ugccuacccaugguuagacaua

SEQ ID NO: 513682 - RNA, 22 nt, Human
uauuucugauugcucaugaggc

SEQ ID NO: 513683 - RNA, 22 nt, Human
cccucugccugcgcccuggugu

SEQ ID NO: 513684 - RNA, 22 nt, Human
ucaguuuuuacggucacaggga

SEQ ID NO: 513685 - RNA, 22 nt, Human
gcagggcaugggcccugucugc

SEQ ID NO: 513686 - RNA, 22 nt, Human
cucuucuuauggccguggcuga

SEQ ID NO: 513687 - RNA, 22 nt, Human
ugguccagucguuccuuuccuu

SEQ ID NO: 513688 - RNA, 20 nt, Human
gcccuggagccuuguccugg

SEQ ID NO: 513689 - RNA, 20 nt, Human
ccugaggguuuguguucuuu

SEQ ID NO: 513690 - RNA, 22 nt, Human
cuucacaaauggccuagaguuc

SEQ ID NO: 513691 - RNA, 22 nt, Human
cuucuaggcuucucagggggca

SEQ ID NO: 513692 - RNA, 22 nt, Human
guauuagcugccuuggagcuaa

SEQ ID NO: 513693 - RNA, 22 nt, Human
cuggcagcauggagccugugcu

SEQ ID NO: 513694 - RNA, 22 nt, Human
uccagccacucagcagggauug

SEQ ID NO: 513695 - RNA, 22 nt, Human
uccagcagaaaagagguaggga

SEQ ID NO: 513696 - RNA, 22 nt, Human
uuaauaauaaugagcccauuuu

SEQ ID NO: 513697 - RNA, 22 nt, Human
cagcagggcccccgggugcgcc

SEQ ID NO: 513698 - RNA, 22 nt, Human
uggaaagugagacauauuuaua

SEQ ID NO: 513699 - RNA, 17 nt, Human
gggcuuuagguggugua

SEQ ID NO: 513700 - RNA, 22 nt, Human
uccaggauugcaggugcacaac

SEQ ID NO: 513701 - RNA, 22 nt, Human
cacugaaauauuaauaucuuau

SEQ ID NO: 513702 - RNA, 22 nt, Human
cagaguccuggacacagagaca

SEQ ID NO: 513703 - RNA, 22 nt, Human
agccccugggaguagcugcugc

SEQ ID NO: 513704 - RNA, 22 nt, Human
aggcagcugaggucuggcgccc

SEQ ID NO: 513705 - RNA, 22 nt, Human
ucagcacuuacuaguggccuuu

SEQ ID NO: 513706 - RNA, 22 nt, Human
aguaaaaucaccaucucuuugu

SEQ ID NO: 513707 - RNA, 22 nt, Human
uuaaaugacgggacuggguuuu

SEQ ID NO: 513708 - RNA, 20 nt, Human
gcuguggcaaagcuuugugu

SEQ ID NO: 513709 - RNA, 22 nt, Human
ccagagcuaaacacacaggcug

SEQ ID NO: 513710 - RNA, 17 nt, Human
aaggccauuuccaccca

SEQ ID NO: 513711 - RNA, 22 nt, Human
ucugucuuugagaucucagccu

SEQ ID NO: 513712 - RNA, 22 nt, Human
ccuguacauggccaucuuuacc

SEQ ID NO: 513713 - RNA, 22 nt, Human
gcaaaugcucuccuuggucagg

SEQ ID NO: 513714 - RNA, 23 nt, Human
agacagaggcugaggcuggccgc

SEQ ID NO: 513715 - RNA, 22 nt, Human
ugccucugaggaagauuguguu

SEQ ID NO: 513716 - RNA, 22 nt, Human
gcagaggccuagguggaaggcc

SEQ ID NO: 513717 - RNA, 22 nt, Human
cccaagggagugccuggucaac

SEQ ID NO: 513718 - RNA, 17 nt, Human
agauggccucuaagauu

SEQ ID NO: 513719 - RNA, 22 nt, Human
auuuucuguaacuauuucuaua

SEQ ID NO: 513720 - RNA, 22 nt, Human
ccugucuggaacauggccuguu

SEQ ID NO: 513721 - RNA, 22 nt, Human
ugcacccucaucagucaaaugg

SEQ ID NO: 513722 - RNA, 22 nt, Human
cagaggcaggauaagaacugcg

SEQ ID NO: 513723 - RNA, 22 nt, Human
aaauccuaauaaugcacuagug

SEQ ID NO: 513724 - RNA, 22 nt, Human
aaguaacuuauuugcaaacagg

SEQ ID NO: 513725 - RNA, 22 nt, Human
caagggaccugagauggucucu

SEQ ID NO: 513726 - RNA, 22 nt, Human
caggaacaauguaagucucauu

SEQ ID NO: 513727 - RNA, 20 nt, Human
gcugccagugccugaugcuu

SEQ ID NO: 513728 - RNA, 22 nt, Human
agggccagaggcaccuugcagc

SEQ ID NO: 513729 - RNA, 22 nt, Human
acccugagaaagucacaugcau

SEQ ID NO: 513730 - RNA, 22 nt, Human
agggcuccaggggcugggugac

SEQ ID NO: 513731 - RNA, 22 nt, Human
agcaucuggucaugagugagaa

SEQ ID NO: 513732 - RNA, 22 nt, Human
ggccagagagccgcuguuagga

SEQ ID NO: 513733 - RNA, 20 nt, Human
uccugcagucgcuagcgccc

SEQ ID NO: 513734 - RNA, 22 nt, Human
aaacaguuuauaacaugauacu

SEQ ID NO: 513735 - RNA, 22 nt, Human
cagcucucuaaggucuugcuuu

SEQ ID NO: 513736 - RNA, 22 nt, Human
cugggccugguagggcuugaaa

SEQ ID NO: 513737 - RNA, 22 nt, Human
cugggccaguuaugucucaucu

SEQ ID NO: 513738 - RNA, 22 nt, Human
acaguccuguacaggccauauc

SEQ ID NO: 513739 - RNA, 22 nt, Human
cagacagcugcuuucuugcugu

SEQ ID NO: 513740 - RNA, 22 nt, Human
ccagcuaguaagcaccugcauc

SEQ ID NO: 513741 - RNA, 22 nt, Human
caucagcaggcaacacucuugg

SEQ ID NO: 513742 - RNA, 22 nt, Human
aaguucaagcucugccuaaaau

SEQ ID NO: 513743 - RNA, 16 nt, Human
aaggcugauuuucccu

SEQ ID NO: 513744 - RNA, 22 nt, Human
gguggauagguacauggacuuu

SEQ ID NO: 513745 - RNA, 22 nt, Human
ucuguaucuaauuuuacaguag

SEQ ID NO: 513746 - RNA, 22 nt, Human
ugcagcugggucugcccuggcu

SEQ ID NO: 513747 - RNA, 22 nt, Human
uaauauuucuacccugcugccu

SEQ ID NO: 513748 - RNA, 22 nt, Human
ugugggaggucuggaaggcucc

SEQ ID NO: 513749 - RNA, 22 nt, Human
gggaggcuggcucuggccacag

SEQ ID NO: 513750 - RNA, 22 nt, Human
cagugccaugucugagccccua

SEQ ID NO: 513751 - RNA, 22 nt, Human
ggcugccuucccugagccccgg

SEQ ID NO: 513752 - RNA, 19 nt, Human
ucccuuccugucgggcucc

SEQ ID NO: 513753 - RNA, 21 nt, Human
agggccugugcucuccagguc

SEQ ID NO: 513754 - RNA, 22 nt, Human
ggucagugcgauuucccacucc

SEQ ID NO: 513755 - RNA, 20 nt, Human
uuggaugugcauggccgugc

SEQ ID NO: 513756 - RNA, 22 nt, Human
ccucagggacuccaugcugcag

SEQ ID NO: 513757 - RNA, 22 nt, Human
ggaagacaagcaguggcugagc

SEQ ID NO: 513758 - RNA, 22 nt, Human
uccaaauauuaugauuauagga

SEQ ID NO: 513759 - RNA, 22 nt, Human
gggagcaggacauaauagcaau

SEQ ID NO: 513760 - RNA, 22 nt, Human
uucagugugccuaagucaguug

SEQ ID NO: 513761 - RNA, 22 nt, Human
cccuccagccauggacccaggu

SEQ ID NO: 513762 - RNA, 22 nt, Human
gcuggggagggcgucaaggcca

SEQ ID NO: 513763 - RNA, 22 nt, Human
guagggacccacagucuauauu

SEQ ID NO: 513764 - RNA, 22 nt, Human
gaggcuagauguuugcugggag

SEQ ID NO: 513765 - RNA, 22 nt, Human
cuuaagaauauugaaguugugg

SEQ ID NO: 513766 - RNA, 22 nt, Human
agccugucugucuccaaagcug

SEQ ID NO: 513767 - RNA, 22 nt, Human
gaggaggcuaagugggcucugg

SEQ ID NO: 513768 - RNA, 22 nt, Human
ggguuccagucugaaacuacag

SEQ ID NO: 513769 - RNA, 22 nt, Human
acugccuugucucuugccuguu

SEQ ID NO: 513770 - RNA, 22 nt, Human
gaagagcugugauucaggcuua

SEQ ID NO: 513771 - RNA, 22 nt, Human
ccuucaggucauauaugucaga

SEQ ID NO: 513772 - RNA, 22 nt, Human
ccuccuggcccugggccuggaa

SEQ ID NO: 513773 - RNA, 22 nt, Human
cccuagaacacgcagacacuga

SEQ ID NO: 513774 - RNA, 22 nt, Human
cagcacaugcucaucagggaag

SEQ ID NO: 513775 - RNA, 22 nt, Human
aaagccuugagauccuauaguu

SEQ ID NO: 513776 - RNA, 22 nt, Human
uagaaaugauugguugagcucu

SEQ ID NO: 513777 - RNA, 22 nt, Human
ucaggccucaagcugcuuuaag

SEQ ID NO: 513778 - RNA, 22 nt, Human
uggcucagcaagacauugaccu

SEQ ID NO: 513779 - RNA, 22 nt, Human
uccacagcacaaagccagugug

SEQ ID NO: 513780 - RNA, 19 nt, Human
uugguggugguuuugguuc

SEQ ID NO: 513781 - RNA, 22 nt, Human
ucauucagguugggcaaguguc

SEQ ID NO: 513782 - RNA, 19 nt, Human
cagagccucagagcuagaa

SEQ ID NO: 513783 - RNA, 22 nt, Human
aguggcaggaaaguggaagaga

SEQ ID NO: 513784 - RNA, 22 nt, Human
acaggccugagauuuugcauuu

SEQ ID NO: 513785 - RNA, 22 nt, Human
gugggggcuggaaaucuugcca

SEQ ID NO: 513786 - RNA, 22 nt, Human
guccucuggccuuucccaggac

SEQ ID NO: 513787 - RNA, 22 nt, Human
cagcuccugccugggcagcugu

SEQ ID NO: 513788 - RNA, 22 nt, Human
gggaccaggugggugcauuccg

SEQ ID NO: 513789 - RNA, 22 nt, Human
uggcugaggucuggggcuucug

SEQ ID NO: 513790 - RNA, 22 nt, Human
agcaguuauauuacucucaggu

SEQ ID NO: 513791 - RNA, 22 nt, Human
uuccucagacccucauugugag

SEQ ID NO: 513792 - RNA, 22 nt, Human
cccaggaggucgaagcugcagu

SEQ ID NO: 513793 - RNA, 22 nt, Human
cccagaaggucgaggcugcagu

SEQ ID NO: 513794 - RNA, 22 nt, Human
agaagcugcguuuauuuaaauc

SEQ ID NO: 513795 - RNA, 22 nt, Human
gccuggcugcuagccagaggca

SEQ ID NO: 513796 - RNA, 22 nt, Human
auuauuaggacuacugggguug

SEQ ID NO: 513797 - RNA, 22 nt, Human
ggugcccagagccaggaaugag

SEQ ID NO: 513798 - RNA, 22 nt, Human
agauuuguaugucuaaauguaa

SEQ ID NO: 513799 - RNA, 20 nt, Human
uagggcucauuaugaucucc

SEQ ID NO: 513800 - RNA, 22 nt, Human
agcuccuccugugccaggccag

SEQ ID NO: 513801 - RNA, 22 nt, Human
ccuggcugcuuucacuauggag

SEQ ID NO: 513802 - RNA, 23 nt, Human
cuuuuaacuugaucugagaccag

SEQ ID NO: 513803 - RNA, 22 nt, Human
aacuuguuagaaaugcagaauc

SEQ ID NO: 513804 - RNA, 18 nt, Human
ccuggcagccaugcgcgc

SEQ ID NO: 513805 - RNA, 22 nt, Human
aaggcgacacaggcagcaggcc

SEQ ID NO: 513806 - RNA, 22 nt, Human
gccuggcugucuggcaagguuc

SEQ ID NO: 513807 - RNA, 22 nt, Human
agccuggagaggcgccauacac

SEQ ID NO: 513808 - RNA, 22 nt, Human
agggaccugucaaugacaguua

SEQ ID NO: 513809 - RNA, 21 nt, Human
ucugggcugcugcugcccauc

SEQ ID NO: 513810 - RNA, 22 nt, Human
gagggugguggcuuaaggugcu

SEQ ID NO: 513811 - RNA, 22 nt, Human
ucagcacugaaucuggauuugc

SEQ ID NO: 513812 - RNA, 22 nt, Human
augcccugaaagauucaaaggc

SEQ ID NO: 513813 - RNA, 22 nt, Human
uggugcaagucucugaggaggg

SEQ ID NO: 513814 - RNA, 22 nt, Human
ugggcugagcagugaagcucau

SEQ ID NO: 513815 - RNA, 22 nt, Human
gcugaggcugggagcagccugu

SEQ ID NO: 513816 - RNA, 22 nt, Human
gaaauugucagcuucuuucagu

SEQ ID NO: 513817 - RNA, 22 nt, Human
auuuccaugaaggcagauuuua

SEQ ID NO: 513818 - RNA, 22 nt, Human
uaauuucuggagggagaaagag

SEQ ID NO: 513819 - RNA, 22 nt, Human
cuucugugcuucacaguugcca

SEQ ID NO: 513820 - RNA, 22 nt, Human
ucucaguguggugcuuaggaua

SEQ ID NO: 513821 - RNA, 22 nt, Human
guccugucccccaaggcugugg

SEQ ID NO: 513822 - RNA, 22 nt, Human
aagaacuuccuaauauauuuuc

SEQ ID NO: 513823 - RNA, 23 nt, Human
aucaagucaucagcaaaauacau

SEQ ID NO: 513824 - RNA, 20 nt, Human
ugggccugagccugugggcu

SEQ ID NO: 513825 - RNA, 22 nt, Human
uggcccagaucucugaccuuga

SEQ ID NO: 513826 - RNA, 22 nt, Human
aggauccuguauggagaagcug

SEQ ID NO: 513827 - RNA, 21 nt, Human
ugcaggcuguuuaagaggcaa

SEQ ID NO: 513828 - RNA, 22 nt, Human
gcuauugugacagcuuuucgcc

SEQ ID NO: 513829 - RNA, 22 nt, Human
gccccugggagcagagccacca

SEQ ID NO: 513830 - RNA, 22 nt, Human
aggagaggcaucaagaaaaucg

SEQ ID NO: 513831 - RNA, 22 nt, Human
uccaggcaucccccaggacaga

SEQ ID NO: 513832 - RNA, 18 nt, Human
uggcucuggacuugcucc

SEQ ID NO: 513833 - RNA, 22 nt, Human
uguaacacucaaucuguuuaac

SEQ ID NO: 513834 - RNA, 21 nt, Human
acacacucugagucuucuauu

SEQ ID NO: 513835 - RNA, 22 nt, Human
gaaaugauuuuaguuuaucaug

SEQ ID NO: 513836 - RNA, 22 nt, Human
cagagccuuccuagcagacucu

SEQ ID NO: 513837 - RNA, 22 nt, Human
cuuuucaugagucuguuauggg

SEQ ID NO: 513838 - RNA, 21 nt, Human
gcaggcuggucaaaccucagu

SEQ ID NO: 513839 - RNA, 22 nt, Human
aguccuggcucuacgggcuuca

SEQ ID NO: 513840 - RNA, 22 nt, Human
gggcuggaucuccugcaggcag

SEQ ID NO: 513841 - RNA, 22 nt, Human
cugggaggauacacaagaucag

SEQ ID NO: 513842 - RNA, 20 nt, Human
ggcagagggccugggagaag

SEQ ID NO: 513843 - RNA, 22 nt, Human
ucaccuaauugaagucaggagu

SEQ ID NO: 513844 - RNA, 22 nt, Human
auguaugaugcuaggcucucag

SEQ ID NO: 513845 - RNA, 22 nt, Human
guguacaguaagugaaucuagg

SEQ ID NO: 513846 - RNA, 22 nt, Human
aaggcacuagcagaauuaguga

SEQ ID NO: 513847 - RNA, 22 nt, Human
uccaggcagcccuuccugacuc

SEQ ID NO: 513848 - RNA, 22 nt, Human
gcucuuugcacagcucugcccu

SEQ ID NO: 513849 - RNA, 22 nt, Human
ugcacagcgggugucugucagg

SEQ ID NO: 513850 - RNA, 22 nt, Human
uucacugaauuaauuuccuucu

SEQ ID NO: 513851 - RNA, 22 nt, Human
guuucacagauggggagacacg

SEQ ID NO: 513852 - RNA, 22 nt, Human
aaagguuugcauggaauuuacc

SEQ ID NO: 513853 - RNA, 22 nt, Human
agaguguaauaagggcaagggc

SEQ ID NO: 513854 - RNA, 22 nt, Human
gagcagcugugggguugaccau

SEQ ID NO: 513855 - RNA, 22 nt, Human
aguuauucauuuauucuguaca

SEQ ID NO: 513856 - RNA, 22 nt, Human
ucugaggcauaaccuguucugc

SEQ ID NO: 513857 - RNA, 22 nt, Human
cuguggcugccucaccuacagg

SEQ ID NO: 513858 - RNA, 19 nt, Human
gugaggauacugcucagag

SEQ ID NO: 513859 - RNA, 22 nt, Human
gaggucagucagaccaggguuu

SEQ ID NO: 513860 - RNA, 22 nt, Human
agggcccuccccgcucagggca

SEQ ID NO: 513861 - RNA, 22 nt, Human
agggacagaugaaugacugagu

SEQ ID NO: 513862 - RNA, 22 nt, Human
cacaagagagugcgcguugcaa

SEQ ID NO: 513863 - RNA, 17 nt, Human
cagggcugucugccuag

SEQ ID NO: 513864 - RNA, 22 nt, Human
agauacaugucaagagacuuau

SEQ ID NO: 513865 - RNA, 22 nt, Human
ggccacauguggcugcucguau

SEQ ID NO: 513866 - RNA, 22 nt, Human
aagacuuucucccaaauccuca

SEQ ID NO: 513867 - RNA, 22 nt, Human
cuuuauuagauguagacuuucu

SEQ ID NO: 513868 - RNA, 22 nt, Human
ucucuggguauucacugccuuc

SEQ ID NO: 513869 - RNA, 22 nt, Human
aucuauuaugcugagaaacugu

SEQ ID NO: 513870 - RNA, 22 nt, Human
gcucugcugucuucuugcaggc

SEQ ID NO: 513871 - RNA, 22 nt, Human
uccagucauuuccauuguuccc

SEQ ID NO: 513872 - RNA, 22 nt, Human
gaugugggguugagggaccagc

SEQ ID NO: 513873 - RNA, 22 nt, Human
gauggagucugaagcugggaac

SEQ ID NO: 513874 - RNA, 19 nt, Human
gagcacagcggcauuuggu

SEQ ID NO: 513875 - RNA, 19 nt, Human
uccugggcugcgucuugcc

SEQ ID NO: 513876 - RNA, 22 nt, Human
aggcacugaagugguaaaugua

SEQ ID NO: 513877 - RNA, 22 nt, Human
gaggaaaauggaguguaauuaa

SEQ ID NO: 513878 - RNA, 20 nt, Human
acagcagauaccacaacuau

SEQ ID NO: 513879 - RNA, 22 nt, Human
ugaagcaaacgcuucuguuccu

SEQ ID NO: 513880 - RNA, 22 nt, Human
ucucagcacguuguuuucauug

SEQ ID NO: 513881 - RNA, 21 nt, Human
agaaaaguagaguuuucagag

SEQ ID NO: 513882 - RNA, 22 nt, Human
ggcagugacuguucagacgucc

SEQ ID NO: 513883 - RNA, 22 nt, Human
gcuggcagguccaagauagagc

SEQ ID NO: 513884 - RNA, 22 nt, Human
caguagcacuagauaugugugg

SEQ ID NO: 513885 - RNA, 22 nt, Human
gcuggcaggguucucacugaaa

SEQ ID NO: 513886 - RNA, 22 nt, Human
cacuucagcuacaaucacauga

SEQ ID NO: 513887 - RNA, 22 nt, Human
cugcccagaaucacucacucga

SEQ ID NO: 513888 - RNA, 22 nt, Human
ccagagccccugagcuucccug

SEQ ID NO: 513889 - RNA, 22 nt, Human
ucuguggcccaagugauggcug

SEQ ID NO: 513890 - RNA, 22 nt, Human
cagccccucccucaggcaggug

SEQ ID NO: 513891 - RNA, 22 nt, Human
uuagcauucucugugugcauaa

SEQ ID NO: 513892 - RNA, 23 nt, Human
uggccucuccccaccuggcagaa

SEQ ID NO: 513893 - RNA, 22 nt, Human
auauuucuggggguguguuucu

SEQ ID NO: 513894 - RNA, 22 nt, Human
uccugggguguguuuugcugcu

SEQ ID NO: 513895 - RNA, 22 nt, Human
caggcuccuuaucuuacaacuu

SEQ ID NO: 513896 - RNA, 22 nt, Human
agcagcuguggggacaagggua

SEQ ID NO: 513897 - RNA, 19 nt, Human
uggcuccugccugccuucu

SEQ ID NO: 513898 - RNA, 22 nt, Human
caugaguuuuuuaguucaugca

SEQ ID NO: 513899 - RNA, 22 nt, Human
uuugcauugcauuaaguauucu

SEQ ID NO: 513900 - RNA, 22 nt, Human
gccagcagguugucaaggagcu

SEQ ID NO: 513901 - RNA, 22 nt, Human
cagcaauaguguguuuguuuca

SEQ ID NO: 513902 - RNA, 22 nt, Human
gcucagggaacuuuuugcaggc

SEQ ID NO: 513903 - RNA, 22 nt, Human
gacagcagagcagacuaaugga

SEQ ID NO: 513904 - RNA, 22 nt, Human
ggagacaggguugaaccacgca

SEQ ID NO: 513905 - RNA, 22 nt, Human
aaagccagaguguguuagagac

SEQ ID NO: 513906 - RNA, 22 nt, Human
uucugaagggcuaagugucuau

SEQ ID NO: 513907 - RNA, 22 nt, Human
auggaagacuaacagaaacaug

SEQ ID NO: 513908 - RNA, 22 nt, Human
aguggcagaagucacuggguag

SEQ ID NO: 513909 - RNA, 22 nt, Human
ggugccuguauuuggggcacag

SEQ ID NO: 513910 - RNA, 22 nt, Human
uaagaugucuaagaggagaugc

SEQ ID NO: 513911 - RNA, 22 nt, Human
gcugagagaaaagugagguucu

SEQ ID NO: 513912 - RNA, 22 nt, Human
caguuucuuaucuucaaaauug

SEQ ID NO: 513913 - RNA, 21 nt, Human
ugaaugcuucgucauccuggc

SEQ ID NO: 513914 - RNA, 22 nt, Human
gaggccuggaauuccagccugg

SEQ ID NO: 513915 - RNA, 21 nt, Human
acagcaagccuuccuuucagg

SEQ ID NO: 513916 - RNA, 22 nt, Human
cuggggcucacuuuggucaggc

SEQ ID NO: 513917 - RNA, 22 nt, Human
uuccauaauuaaguggagagaa

SEQ ID NO: 513918 - RNA, 22 nt, Human
gguuccaggcauggcaggaugu

SEQ ID NO: 513919 - RNA, 19 nt, Human
ugucacugucauggcccag

SEQ ID NO: 513920 - RNA, 19 nt, Human
cagagcugcuggccucguc

SEQ ID NO: 513921 - RNA, 22 nt, Human
cugggcuugaguuccugcucgu

SEQ ID NO: 513922 - RNA, 22 nt, Human
cuuaaauuggaugaguuaaguu

SEQ ID NO: 513923 - RNA, 22 nt, Human
augcaguauaaaucauuucugg

SEQ ID NO: 513924 - RNA, 22 nt, Human
ccccucucccucacuuaucaau

SEQ ID NO: 513925 - RNA, 22 nt, Human
aggcugggaagguaaaguugua

SEQ ID NO: 513926 - RNA, 22 nt, Human
gacccagcuaaccaggugggga

SEQ ID NO: 513927 - RNA, 22 nt, Human
auguacauuuuccuaauguuuu

SEQ ID NO: 513928 - RNA, 21 nt, Human
accaucuuccaugcauuauau

SEQ ID NO: 513929 - RNA, 22 nt, Human
auuucaguagaaaaucuugauu

SEQ ID NO: 513930 - RNA, 22 nt, Human
auaucacaaacaagucuguacu

SEQ ID NO: 513931 - RNA, 22 nt, Human
cuuucacacacauacauuugga

SEQ ID NO: 513932 - RNA, 22 nt, Human
cuuguuaaauuauauaagcaga

SEQ ID NO: 513933 - RNA, 22 nt, Human
gagacacaguuaucaggcauac

SEQ ID NO: 513934 - RNA, 22 nt, Human
agguacaguagacagacaguua

SEQ ID NO: 513935 - RNA, 22 nt, Human
gccuggcugggcaccaggggag

SEQ ID NO: 513936 - RNA, 22 nt, Human
gaggggaguguccuccgggccc

SEQ ID NO: 513937 - RNA, 22 nt, Human
auaaucaaaguccuaugacauc

SEQ ID NO: 513938 - RNA, 22 nt, Human
ugcugaaugcugcaugccguau

SEQ ID NO: 513939 - RNA, 22 nt, Human
ugucuuuuaccuaaugagcugg

SEQ ID NO: 513940 - RNA, 22 nt, Human
gacccagcuuaagucacauguu

SEQ ID NO: 513941 - RNA, 22 nt, Human
aaaugcagguucuugagccaag

SEQ ID NO: 513942 - RNA, 22 nt, Human
ccugcaggggagagacuucuag

SEQ ID NO: 513943 - RNA, 22 nt, Human
aggacaguccgggguccuccac

SEQ ID NO: 513944 - RNA, 22 nt, Human
ggccggggccuccccgcgucgc

SEQ ID NO: 513945 - RNA, 22 nt, Human
uuuaauauucugcauucuccuu

SEQ ID NO: 513946 - RNA, 22 nt, Human
ggcaggugcccagagagcacga

SEQ ID NO: 513947 - RNA, 22 nt, Human
caguuucuacgaaggucaaccc

SEQ ID NO: 513948 - RNA, 20 nt, Human
uccuaauaaccugaagaaau

SEQ ID NO: 513949 - RNA, 22 nt, Human
ucugggcuuggauuggcucugc

SEQ ID NO: 513950 - RNA, 22 nt, Human
gcagcugccccgacugugaguc

SEQ ID NO: 513951 - RNA, 22 nt, Human
gggauggaggguagagcaagug

SEQ ID NO: 513952 - RNA, 18 nt, Human
uuaagagcugaaagggga

SEQ ID NO: 513953 - RNA, 22 nt, Human
aaaugcaccuugcugugagacu

SEQ ID NO: 513954 - RNA, 22 nt, Human
ccuggggcucaagauggcgccg

SEQ ID NO: 513955 - RNA, 22 nt, Human
cuacauuaaauuggcuuacuua

SEQ ID NO: 513956 - RNA, 22 nt, Human
acugccugccuuccagguacug

SEQ ID NO: 513957 - RNA, 22 nt, Human
cucagagaaaaggagcaagggu

SEQ ID NO: 513958 - RNA, 22 nt, Human
aggacagaccuaggacuggagc

SEQ ID NO: 513959 - RNA, 22 nt, Human
aaaggcuccuucucccaugacc

SEQ ID NO: 513960 - RNA, 22 nt, Human
ccagugcaggugagcaccaggu

SEQ ID NO: 513961 - RNA, 22 nt, Human
auccagcuuugucuggucuucg

SEQ ID NO: 513962 - RNA, 22 nt, Human
ggagacagcaggaagaaauauc

SEQ ID NO: 513963 - RNA, 22 nt, Human
uaccugagcccagugcagcaua

SEQ ID NO: 513964 - RNA, 22 nt, Human
uucuuucagaacacaagugauu

SEQ ID NO: 513965 - RNA, 22 nt, Human
caggggccaggcugucugcugu

SEQ ID NO: 513966 - RNA, 22 nt, Human
uccuucagggggccgccugcac

SEQ ID NO: 513967 - RNA, 20 nt, Human
ucuggggaugaggucuagga

SEQ ID NO: 513968 - RNA, 22 nt, Human
ggcagcaguccauggcccaagg

SEQ ID NO: 513969 - RNA, 22 nt, Human
uagggcucuggugggcucuguu

SEQ ID NO: 513970 - RNA, 22 nt, Human
uguggcugcucaggugcagacc

SEQ ID NO: 513971 - RNA, 22 nt, Human
augaggcauuccacucaaacuc

SEQ ID NO: 513972 - RNA, 22 nt, Human
gaccacagcuacaagggcaagg

SEQ ID NO: 513973 - RNA, 21 nt, Human
uguggcugccucuggcccugg

SEQ ID NO: 513974 - RNA, 22 nt, Human
gcugauccuuuuaugucuagcu

SEQ ID NO: 513975 - RNA, 22 nt, Human
cugugucuucugcuuacagucu

SEQ ID NO: 513976 - RNA, 22 nt, Human
ucaggaauccagacagggcaca

SEQ ID NO: 513977 - RNA, 22 nt, Human
uugauuaaucccaugugaguag

SEQ ID NO: 513978 - RNA, 22 nt, Human
cagggcagcuuccuuuguuagg

SEQ ID NO: 513979 - RNA, 22 nt, Human
uugcccugucaguagaagugca

SEQ ID NO: 513980 - RNA, 22 nt, Human
uggagcuggaagacagugauau

SEQ ID NO: 513981 - RNA, 22 nt, Human
uuguccugauuuugcaacuucu

SEQ ID NO: 513982 - RNA, 22 nt, Human
aucuggaacaaagcuuaggaau

SEQ ID NO: 513983 - RNA, 22 nt, Human
aaauacauacacuguacguggc

SEQ ID NO: 513984 - RNA, 18 nt, Human
aggaaagaaaggcaggug

SEQ ID NO: 513985 - RNA, 22 nt, Human
ccuggcagacugugagggcagg

SEQ ID NO: 513986 - RNA, 22 nt, Human
ucugcaggaggcuggcugcagg

SEQ ID NO: 513987 - RNA, 22 nt, Human
uggagcaggccggaaguggcuu

SEQ ID NO: 513988 - RNA, 22 nt, Human
cuguggugagcaacugacugaa

SEQ ID NO: 513989 - RNA, 22 nt, Human
guaacugaggcagcuuuuaaga

SEQ ID NO: 513990 - RNA, 22 nt, Human
uaaaugaguaauauagcuguuu

SEQ ID NO: 513991 - RNA, 19 nt, Human
cugggucuuauucugugaa

SEQ ID NO: 513992 - RNA, 22 nt, Human
ggguccagaguugaagagguua

SEQ ID NO: 513993 - RNA, 22 nt, Human
caucuugacugggauaagggau

SEQ ID NO: 513994 - RNA, 22 nt, Human
caaaugauacuguuuuuagucu

SEQ ID NO: 513995 - RNA, 22 nt, Human
uacccagcaaucccuagagguu

SEQ ID NO: 513996 - RNA, 22 nt, Human
aaaggugacugcagcagcuauu

SEQ ID NO: 513997 - RNA, 22 nt, Human
guguacaugagaaaucaacuuu

SEQ ID NO: 513998 - RNA, 22 nt, Human
ccaguguucaguaugcauuaag

SEQ ID NO: 513999 - RNA, 22 nt, Human
ucaacacucuuuggcacaguua

SEQ ID NO: 514000 - RNA, 22 nt, Human
ccuggagcuuuuccauccugga

SEQ ID NO: 514001 - RNA, 22 nt, Human
uccugggaacucggaaagcucu

SEQ ID NO: 514002 - RNA, 22 nt, Human
aaggagucugggccauucagag

SEQ ID NO: 514003 - RNA, 22 nt, Human
cugaggccccucucuugagcuu

SEQ ID NO: 514004 - RNA, 22 nt, Human
cagcuuugugcaaugcagucuc

SEQ ID NO: 514005 - RNA, 22 nt, Human
gucaggauuaaugggaguaugc

SEQ ID NO: 514006 - RNA, 23 nt, Human
guaaugaugggaauuuacuuaga

SEQ ID NO: 514007 - RNA, 22 nt, Human
cuguaauucacuagggucagcg

SEQ ID NO: 514008 - RNA, 20 nt, Human
auguuguuuacucauagcau

SEQ ID NO: 514009 - RNA, 22 nt, Human
uacaugcuccuuaugagaaucu

SEQ ID NO: 514010 - RNA, 22 nt, Human
uccuuggcaagcugcaauggga

SEQ ID NO: 514011 - RNA, 23 nt, Human
uuguccuucugaaauauaucugg

SEQ ID NO: 514012 - RNA, 22 nt, Human
guauuaggaaauaugaagaaag

SEQ ID NO: 514013 - RNA, 22 nt, Human
ucucagagauguuagggaagag

SEQ ID NO: 514014 - RNA, 22 nt, Human
agaucuggcccucagcuugauu

SEQ ID NO: 514015 - RNA, 22 nt, Human
agaacgucuuuacucuuacgaa

SEQ ID NO: 514016 - RNA, 22 nt, Human
agcccagcagaaaguccagccu

SEQ ID NO: 514017 - RNA, 22 nt, Human
caauaugcaagcuauuaaguau

SEQ ID NO: 514018 - RNA, 22 nt, Human
uagacauuauguauuaaguucu

SEQ ID NO: 514019 - RNA, 22 nt, Human
gaggcugaugcugccucacaga

SEQ ID NO: 514020 - RNA, 22 nt, Human
agucucuuuaaucacagugucu

SEQ ID NO: 514021 - RNA, 22 nt, Human
gauuucaagcccccagagauuc

SEQ ID NO: 514022 - RNA, 22 nt, Human
aaugcaaacuucuuguuacuug

SEQ ID NO: 514023 - RNA, 22 nt, Human
aguucagaggcaggagaaggcu

SEQ ID NO: 514024 - RNA, 22 nt, Human
agguccuguguccaggggccug

SEQ ID NO: 514025 - RNA, 22 nt, Human
aaacauuguaauuuuagcaugg

SEQ ID NO: 514026 - RNA, 22 nt, Human
cugggcaauaugcugggccugg

SEQ ID NO: 514027 - RNA, 22 nt, Human
ggagaggugaauggcugcucua

SEQ ID NO: 514028 - RNA, 19 nt, Human
acugccugaggcucacagg

SEQ ID NO: 514029 - RNA, 23 nt, Human
ucagcugcuuccuccugccugcc

SEQ ID NO: 514030 - RNA, 22 nt, Human
accaaaaccugcuacuaaagga

SEQ ID NO: 514031 - RNA, 20 nt, Human
agaggccaguuaggagucua

SEQ ID NO: 514032 - RNA, 22 nt, Human
agaggccaauaguagguggcau

SEQ ID NO: 514033 - RNA, 22 nt, Human
acacaauacagggcucaaaaua

SEQ ID NO: 514034 - RNA, 22 nt, Human
uauguacaccggggaagguggg

SEQ ID NO: 514035 - RNA, 22 nt, Human
uguuuauaccuugguauaacca

SEQ ID NO: 514036 - RNA, 22 nt, Human
uuaaaaugcagauuaugacuca

SEQ ID NO: 514037 - RNA, 22 nt, Human
ccauuguaaagaguauacuuug

SEQ ID NO: 514038 - RNA, 20 nt, Human
gcacagagaugagcaaagua

SEQ ID NO: 514039 - RNA, 22 nt, Human
cagagcaguccuugucaaucag

SEQ ID NO: 514040 - RNA, 22 nt, Human
uccguauuugacuauugcaccg

SEQ ID NO: 514041 - RNA, 22 nt, Human
guugaaagcuuuucauuuaguu

SEQ ID NO: 514042 - RNA, 17 nt, Human
aggagucucagaugagc

SEQ ID NO: 514043 - RNA, 22 nt, Human
uuccaugugaguacacugugau

SEQ ID NO: 514044 - RNA, 22 nt, Human
aggggagccccugguccuggug

SEQ ID NO: 514045 - RNA, 22 nt, Human
ugucagagcaaggccaggccag

SEQ ID NO: 514046 - RNA, 22 nt, Human
cuauuuguacagcauucgaguu

SEQ ID NO: 514047 - RNA, 22 nt, Human
uggacuuucuaggguagaggaa

SEQ ID NO: 514048 - RNA, 22 nt, Human
ccuccacucuggccucucaggu

SEQ ID NO: 514049 - RNA, 22 nt, Human
acugccuuauaugcugugugug

SEQ ID NO: 514050 - RNA, 22 nt, Human
ucucagagccuaacuaaccuaa

SEQ ID NO: 514051 - RNA, 22 nt, Human
ggguaugauagggaggugaaau

SEQ ID NO: 514052 - RNA, 22 nt, Human
ccucagagguuuucauucugua

SEQ ID NO: 514053 - RNA, 22 nt, Human
agagaacagacagaugcaauga

SEQ ID NO: 514054 - RNA, 22 nt, Human
auuucacucucccugccacuua

SEQ ID NO: 514055 - RNA, 22 nt, Human
ggucccagcuggucacugucag

SEQ ID NO: 514056 - RNA, 22 nt, Human
uacaguagacaauguuaguaug

SEQ ID NO: 514057 - RNA, 22 nt, Human
acagcucugcauggcaguuauu

SEQ ID NO: 514058 - RNA, 22 nt, Human
cugagccauaagggaggcuggg

SEQ ID NO: 514059 - RNA, 22 nt, Human
cucagggaguagcacaugugga

SEQ ID NO: 514060 - RNA, 22 nt, Human
cucucaggcuugggucguggca

SEQ ID NO: 514061 - RNA, 22 nt, Human
gaaguagauucguugcaucuug

SEQ ID NO: 514062 - RNA, 22 nt, Human
agguccugggaguucuagugug

SEQ ID NO: 514063 - RNA, 22 nt, Human
augcuuuuccuaaaaugaugcc

SEQ ID NO: 514064 - RNA, 22 nt, Human
ucaucucaaaacccaaggggca

SEQ ID NO: 514065 - RNA, 22 nt, Human
aguguggggucaccggcccagg

SEQ ID NO: 514066 - RNA, 22 nt, Human
uaaauguaccuucugccuuacu

SEQ ID NO: 514067 - RNA, 22 nt, Human
uuaaaaauauguagggcccgau

SEQ ID NO: 514068 - RNA, 22 nt, Human
gggaucugaguaggcagaagcu

SEQ ID NO: 514069 - RNA, 22 nt, Human
ucuuuguuuguacuguuagaau

SEQ ID NO: 514070 - RNA, 22 nt, Human
agcaggugcauggcgagcgcgg

SEQ ID NO: 514071 - RNA, 22 nt, Human
gcuggcccagggucaccuagga

SEQ ID NO: 514072 - RNA, 22 nt, Human
guuuccauggcucuguuaaugg

SEQ ID NO: 514073 - RNA, 22 nt, Human
agccagaguugaaugugagucu

SEQ ID NO: 514074 - RNA, 22 nt, Human
gcugucugagaacaugguggaa

SEQ ID NO: 514075 - RNA, 22 nt, Human
ugugaauauccauuuguuucag

SEQ ID NO: 514076 - RNA, 22 nt, Human
cagggcuagugacaccccaguc

SEQ ID NO: 514077 - RNA, 22 nt, Human
aguguauugauuggaacagccu

SEQ ID NO: 514078 - RNA, 22 nt, Human
aacugcauuugcauaaguccau

SEQ ID NO: 514079 - RNA, 22 nt, Human
uguucaauccccagguccugaa

SEQ ID NO: 514080 - RNA, 22 nt, Human
gguggagcuggaccaggagagg

SEQ ID NO: 514081 - RNA, 22 nt, Human
uccuggcccgaucccugugaag

SEQ ID NO: 514082 - RNA, 22 nt, Human
gcuccucucccagagcugcagg

SEQ ID NO: 514083 - RNA, 22 nt, Human
uuuguagacuaccaguaauugu

SEQ ID NO: 514084 - RNA, 22 nt, Human
gcagggugugucucauacaguu

SEQ ID NO: 514085 - RNA, 22 nt, Human
cuggaucuguuugugcuugugg

SEQ ID NO: 514086 - RNA, 22 nt, Human
gaaauguuguccugucucuuga

SEQ ID NO: 514087 - RNA, 22 nt, Human
ggagagcugacaucaugauguu

SEQ ID NO: 514088 - RNA, 23 nt, Human
gacagagugagaccuugucuuac

SEQ ID NO: 514089 - RNA, 18 nt, Human
caggucagccuggccuca

SEQ ID NO: 514090 - RNA, 22 nt, Human
cagccucucuguaucucaggau

SEQ ID NO: 514091 - RNA, 22 nt, Human
cuuuucuuauguggacguaccu

SEQ ID NO: 514092 - RNA, 22 nt, Human
uugcugaagaaaaaauauguua

SEQ ID NO: 514093 - RNA, 22 nt, Human
aagacuguaugagacaauauaa

SEQ ID NO: 514094 - RNA, 22 nt, Human
caggauggccccggggcugugc

SEQ ID NO: 514095 - RNA, 22 nt, Human
ccaggaucuguacaccucugag

SEQ ID NO: 514096 - RNA, 22 nt, Human
aaaugucagaagcuuuacuucu

SEQ ID NO: 514097 - RNA, 22 nt, Human
ugcaagaggaauucuagaagca

SEQ ID NO: 514098 - RNA, 22 nt, Human
uucuaaauuuuggaagaugcag

SEQ ID NO: 514099 - RNA, 22 nt, Human
agauguuccagccaaugggaau

SEQ ID NO: 514100 - RNA, 22 nt, Human
cucuacuccaaaaggcuacaau

SEQ ID NO: 514101 - RNA, 22 nt, Human
ucuccuggagcaggaagguggg

SEQ ID NO: 514102 - RNA, 22 nt, Human
agagguauauauucuccauauu

SEQ ID NO: 514103 - RNA, 22 nt, Human
acucuggcaagcuuccacuucc

SEQ ID NO: 514104 - RNA, 22 nt, Human
caguuaaaggcccaauaucugg

SEQ ID NO: 514105 - RNA, 22 nt, Human
ccaguguucugguguucauuuc

SEQ ID NO: 514106 - RNA, 22 nt, Human
uggggugguaauacaccguucu

SEQ ID NO: 514107 - RNA, 22 nt, Human
cuggagccauguauagccuaug

SEQ ID NO: 514108 - RNA, 23 nt, Human
gagugcagaauagacaugcagug

SEQ ID NO: 514109 - RNA, 22 nt, Human
gacagcaugagagaugccagug

SEQ ID NO: 514110 - RNA, 22 nt, Human
caaaggcaugugaguauaugug

SEQ ID NO: 514111 - RNA, 19 nt, Human
cccuggagaauacccugga

SEQ ID NO: 514112 - RNA, 22 nt, Human
uuaaaaaccaucuuccuuuccu

SEQ ID NO: 514113 - RNA, 22 nt, Human
gucccuggucuaccguggcuuc

SEQ ID NO: 514114 - RNA, 23 nt, Human
uugagcucaguagcucugcuggu

SEQ ID NO: 514115 - RNA, 22 nt, Human
uuugaaagcuacuuucggguca

SEQ ID NO: 514116 - RNA, 22 nt, Human
augggcugacaagacaugcaua

SEQ ID NO: 514117 - RNA, 22 nt, Human
caaaguuaucaacugcaacauu

SEQ ID NO: 514118 - RNA, 23 nt, Human
uaggcaggacucagauaugacag

SEQ ID NO: 514119 - RNA, 22 nt, Human
ccuguucaccauggucacgugc

SEQ ID NO: 514120 - RNA, 22 nt, Human
uacaugucuacaugcauuuuug

SEQ ID NO: 514121 - RNA, 22 nt, Human
ccugccagugaagcugacgggc

SEQ ID NO: 514122 - RNA, 22 nt, Human
gugcccuggggugaaccccugg

SEQ ID NO: 514123 - RNA, 22 nt, Human
uggaacacugaucauugccuuu

SEQ ID NO: 514124 - RNA, 22 nt, Human
uggaaggcuuugcuguccuugc

SEQ ID NO: 514125 - RNA, 22 nt, Human
uuuagcauauccuauaaaacua

SEQ ID NO: 514126 - RNA, 22 nt, Human
auggcagggacuguggcccuug

SEQ ID NO: 514127 - RNA, 22 nt, Human
aagagcuggucacagguccauu

SEQ ID NO: 514128 - RNA, 22 nt, Human
gccagagcuucccccgagugug

SEQ ID NO: 514129 - RNA, 22 nt, Human
ggugcagggagaggcaggcccc

SEQ ID NO: 514130 - RNA, 22 nt, Human
ccugggccuugaccucgugggc

SEQ ID NO: 514131 - RNA, 22 nt, Human
aagauguuuagauuuauacaau

SEQ ID NO: 514132 - RNA, 22 nt, Human
cucagggggaaucaggucacag

SEQ ID NO: 514133 - RNA, 22 nt, Human
uauuccaagcacagcaacccag

SEQ ID NO: 514134 - RNA, 22 nt, Human
ucccaaauauaaugcaagagac

SEQ ID NO: 514135 - RNA, 22 nt, Human
aguggcagagcaggugcuggaa

SEQ ID NO: 514136 - RNA, 22 nt, Human
agccaggacagggcagcucgcu

SEQ ID NO: 514137 - RNA, 22 nt, Human
gguccuggaaauugacggaaag

SEQ ID NO: 514138 - RNA, 22 nt, Human
aggggugaaggcccgauaggag

SEQ ID NO: 514139 - RNA, 22 nt, Human
aggcagcuuaagcccuggccca

SEQ ID NO: 514140 - RNA, 22 nt, Human
aaauauugguaggaugcuuguu

SEQ ID NO: 514141 - RNA, 20 nt, Human
ccuggcuuugcaucugugau

SEQ ID NO: 514142 - RNA, 18 nt, Human
gucaccuggaucagauua

SEQ ID NO: 514143 - RNA, 22 nt, Human
ucugggccagaucuagggaucu

SEQ ID NO: 514144 - RNA, 22 nt, Human
acagagcauuugggacagagag

SEQ ID NO: 514145 - RNA, 18 nt, Human
ugcagcauguucccauaa

SEQ ID NO: 514146 - RNA, 22 nt, Human
cagcauuuggaggagaggcuuu

SEQ ID NO: 514147 - RNA, 22 nt, Human
gucugggcucccagggucggcg

SEQ ID NO: 514148 - RNA, 22 nt, Human
cagcagccuacaaugcacagaa

SEQ ID NO: 514149 - RNA, 22 nt, Human
aucuggcuuuuaccccacggcc

SEQ ID NO: 514150 - RNA, 22 nt, Human
ggcuucagaggggagguagugc

SEQ ID NO: 514151 - RNA, 22 nt, Human
caggcagcugacugucagauau

SEQ ID NO: 514152 - RNA, 22 nt, Human
guuauaaaggugauaaugguca

SEQ ID NO: 514153 - RNA, 22 nt, Human
gagcaggcucugccuguguguc

SEQ ID NO: 514154 - RNA, 22 nt, Human
ugccagccagguucugaggcua

SEQ ID NO: 514155 - RNA, 22 nt, Human
guggcacagagauggggcauga

SEQ ID NO: 514156 - RNA, 22 nt, Human
uuauuuguuuucugagaaguau

SEQ ID NO: 514157 - RNA, 20 nt, Human
uccaugaguuagagacuaua

SEQ ID NO: 514158 - RNA, 22 nt, Human
ccagcuggagccaagguggacu

SEQ ID NO: 514159 - RNA, 22 nt, Human
ugccugccucuggagcccaucc

SEQ ID NO: 514160 - RNA, 19 nt, Human
ggccaggcugacugugguc

SEQ ID NO: 514161 - RNA, 20 nt, Human
aacuccuagccucaagugau

SEQ ID NO: 514162 - RNA, 22 nt, Human
gacauguugaagaauauuugga

SEQ ID NO: 514163 - RNA, 22 nt, Human
caaggcaggaagccugucuuau

SEQ ID NO: 514164 - RNA, 22 nt, Human
cacaugugcaaauacugaggcu

SEQ ID NO: 514165 - RNA, 22 nt, Human
guacccagaggcaugaucccag

SEQ ID NO: 514166 - RNA, 22 nt, Human
cagaauggcuuuuauggcucag

SEQ ID NO: 514167 - RNA, 22 nt, Human
ugcagcugccuagggcuggcuu

SEQ ID NO: 514168 - RNA, 23 nt, Human
gaggagggucugacaaguguagc

SEQ ID NO: 514169 - RNA, 22 nt, Human
cagcuucaacugcacagucaac

SEQ ID NO: 514170 - RNA, 22 nt, Human
acaaucacacaugcaauuauac

SEQ ID NO: 514171 - RNA, 23 nt, Human
auucuucauuaucuucuagaaaa

SEQ ID NO: 514172 - RNA, 22 nt, Human
uacuguacugcaguucugcaaa

SEQ ID NO: 514173 - RNA, 20 nt, Human
uuucugugcccaggucuguu

SEQ ID NO: 514174 - RNA, 22 nt, Human
ugagaggugaggcaugaggcau

SEQ ID NO: 514175 - RNA, 22 nt, Human
ugugcuucaucacuucucaguu

SEQ ID NO: 514176 - RNA, 22 nt, Human
ucagaagagcuggugcugccug

SEQ ID NO: 514177 - RNA, 22 nt, Human
gcagcacugauccuaaacuuag

SEQ ID NO: 514178 - RNA, 22 nt, Human
ccucaggcuuacgggcaaugga

SEQ ID NO: 514179 - RNA, 18 nt, Human
uuguuuuaagacucuguc

SEQ ID NO: 514180 - RNA, 22 nt, Human
acauucaugucccacuucuagc

SEQ ID NO: 514181 - RNA, 21 nt, Human
ccugugugugucccuuuaaga

SEQ ID NO: 514182 - RNA, 22 nt, Human
uucauucauuacgugccaggca

SEQ ID NO: 514183 - RNA, 23 nt, Human
cagggaggagauacuguguaucu

SEQ ID NO: 514184 - RNA, 22 nt, Human
aagcaugggaggccuggaggag

SEQ ID NO: 514185 - RNA, 22 nt, Human
cuucccaagacuguauugcaag

SEQ ID NO: 514186 - RNA, 22 nt, Human
uggguucuagagggaccagaac

SEQ ID NO: 514187 - RNA, 22 nt, Human
ugugcagcuaguccuggacuug

SEQ ID NO: 514188 - RNA, 22 nt, Human
auuugcuuucccuucccugaca

SEQ ID NO: 514189 - RNA, 22 nt, Human
ugucccagacacaguaugcgcu

SEQ ID NO: 514190 - RNA, 22 nt, Human
cugagcugagccaaaucugucu

SEQ ID NO: 514191 - RNA, 22 nt, Human
uagcagcugcaucauuuuacag

SEQ ID NO: 514192 - RNA, 22 nt, Human
aauauguucaaaauagaucacu

SEQ ID NO: 514193 - RNA, 17 nt, Human
uuaaaggaugcucucuc

SEQ ID NO: 514194 - RNA, 22 nt, Human
acugagagucaagauagcaugg

SEQ ID NO: 514195 - RNA, 23 nt, Human
auuuacagguuaaaugaaaucag

SEQ ID NO: 514196 - RNA, 22 nt, Human
cugaaggaagcagaagcgaggu

SEQ ID NO: 514197 - RNA, 22 nt, Human
gccuggguccacugaucaugcu

SEQ ID NO: 514198 - RNA, 23 nt, Human
aggaggccugaaacugaggcuga

SEQ ID NO: 514199 - RNA, 21 nt, Human
ucccacucuaaauggacugaa

SEQ ID NO: 514200 - RNA, 22 nt, Human
aaacuugagucacuucucuucc

SEQ ID NO: 514201 - RNA, 22 nt, Human
gggcagguuggcaucccgggca

SEQ ID NO: 514202 - RNA, 22 nt, Human
agaagcugccuacaugaccagc

SEQ ID NO: 514203 - RNA, 22 nt, Human
ccuucaaggcaaggagggcugg

SEQ ID NO: 514204 - RNA, 22 nt, Human
cugggcuggacacacuuaaccu

SEQ ID NO: 514205 - RNA, 22 nt, Human
aguggcuggaauugcaggugcg

SEQ ID NO: 514206 - RNA, 19 nt, Human
agccuggcuuugcucugcu

SEQ ID NO: 514207 - RNA, 23 nt, Human
uaaagcaaagucaagugcacucc

SEQ ID NO: 514208 - RNA, 22 nt, Human
ucuggcuuucucagcauggcau

SEQ ID NO: 514209 - RNA, 22 nt, Human
uggcagaguucgcuccuauuca

SEQ ID NO: 514210 - RNA, 17 nt, Human
agccugcugaucucaca

SEQ ID NO: 514211 - RNA, 21 nt, Human
ugcaggcaggcagagaugcug

SEQ ID NO: 514212 - RNA, 22 nt, Human
uggggagaguuacaaggaaucu

SEQ ID NO: 514213 - RNA, 22 nt, Human
cccucucucaggcugacagccu

SEQ ID NO: 514214 - RNA, 19 nt, Human
gccacuccugaugcugccc

SEQ ID NO: 514215 - RNA, 22 nt, Human
ugucccaguucccaggguugcu

SEQ ID NO: 514216 - RNA, 21 nt, Human
guccuucagcaaguuaguggc

SEQ ID NO: 514217 - RNA, 22 nt, Human
gccugcuggauguggccaggcc

SEQ ID NO: 514218 - RNA, 22 nt, Human
uggcugugggauaugugacuga

SEQ ID NO: 514219 - RNA, 22 nt, Human
ucuuacauauagcaugaguaca

SEQ ID NO: 514220 - RNA, 22 nt, Human
uggagcaggacugcugcccuca

SEQ ID NO: 514221 - RNA, 22 nt, Human
cagagugaaaacugagcucaaa

SEQ ID NO: 514222 - RNA, 22 nt, Human
cucagagucugcauuucuguca

SEQ ID NO: 514223 - RNA, 22 nt, Human
auuuguaauuucuuaucugugu

SEQ ID NO: 514224 - RNA, 22 nt, Human
ccacaucugguggccagugcua

SEQ ID NO: 514225 - RNA, 22 nt, Human
agccuugaaugcgcugcauugg

SEQ ID NO: 514226 - RNA, 22 nt, Human
uauauuuaaauccagguugaaa

SEQ ID NO: 514227 - RNA, 22 nt, Human
ucugggcuuuaguuuguuaucu

SEQ ID NO: 514228 - RNA, 22 nt, Human
aacaguaacgagauguccuaac

SEQ ID NO: 514229 - RNA, 22 nt, Human
aagcagccacuggccaguuaua

SEQ ID NO: 514230 - RNA, 22 nt, Human
uggcacugccuggcagggcccc

SEQ ID NO: 514231 - RNA, 22 nt, Human
uguggagaugugagcaagggga

SEQ ID NO: 514232 - RNA, 20 nt, Human
aaaguguaagcauauaauua

SEQ ID NO: 514233 - RNA, 16 nt, Human
cagaguguaaacagga

SEQ ID NO: 514234 - RNA, 22 nt, Human
gcagggacugugaucucacaga

SEQ ID NO: 514235 - RNA, 22 nt, Human
gccugugucauguaguagcuuc

SEQ ID NO: 514236 - RNA, 22 nt, Human
uccacacacauuucuaugugca

SEQ ID NO: 514237 - RNA, 22 nt, Human
ccugggaguggcacucacagca

SEQ ID NO: 514238 - RNA, 22 nt, Human
cugcuuugcauagcugccagag

SEQ ID NO: 514239 - RNA, 22 nt, Human
cuacccaggcuggagugcagua

SEQ ID NO: 514240 - RNA, 22 nt, Human
gccagcucaguuucaaaguagg

SEQ ID NO: 514241 - RNA, 22 nt, Human
uuuuuacacuuagcauugagcg

SEQ ID NO: 514242 - RNA, 19 nt, Human
uggcagguagugagcaguc

SEQ ID NO: 514243 - RNA, 22 nt, Human
uuugacaggacuaacauauggc

SEQ ID NO: 514244 - RNA, 22 nt, Human
cagccacguagcccuuggccgu

SEQ ID NO: 514245 - RNA, 22 nt, Human
aaggccaacuaggaugagcuag

SEQ ID NO: 514246 - RNA, 22 nt, Human
cucuaggcugcccaggagcuga

SEQ ID NO: 514247 - RNA, 20 nt, Human
aggcucugccugcaggccca

SEQ ID NO: 514248 - RNA, 22 nt, Human
gcacauaaagggcaugggaggu

SEQ ID NO: 514249 - RNA, 21 nt, Human
ccuucuccacagggucuccgg

SEQ ID NO: 514250 - RNA, 17 nt, Human
aaucagauuucugagga

SEQ ID NO: 514251 - RNA, 23 nt, Human
augggccaagcaagacccaugac

SEQ ID NO: 514252 - RNA, 22 nt, Human
aggcccugcccagagcuccucg

SEQ ID NO: 514253 - RNA, 22 nt, Human
agaggcccucucugcucagucu

SEQ ID NO: 514254 - RNA, 22 nt, Human
cagagggaucaucuuccugaag

SEQ ID NO: 514255 - RNA, 22 nt, Human
gcuucugggcaccugaacagga

SEQ ID NO: 514256 - RNA, 22 nt, Human
gcagccacccucaaggcugaau

SEQ ID NO: 514257 - RNA, 22 nt, Human
agagcucaagacgcucacagua

SEQ ID NO: 514258 - RNA, 22 nt, Human
gagcagugggaaggaacagggu

SEQ ID NO: 514259 - RNA, 22 nt, Human
cauuucugucacguucuuuuau

SEQ ID NO: 514260 - RNA, 22 nt, Human
ccagcucuuggugcacuuacau

SEQ ID NO: 514261 - RNA, 22 nt, Human
uagagcugggcagugcucugag

SEQ ID NO: 514262 - RNA, 22 nt, Human
agauaauuauuuacuucaaagu

SEQ ID NO: 514263 - RNA, 23 nt, Human
aucaagauaauccagaugaccua

SEQ ID NO: 514264 - RNA, 22 nt, Human
auccugggccucagaggugugu

SEQ ID NO: 514265 - RNA, 22 nt, Human
gguccugggaagaugcucauga

SEQ ID NO: 514266 - RNA, 23 nt, Human
cugcagucgccggccugggugcc

SEQ ID NO: 514267 - RNA, 22 nt, Human
gcuccuggcaggcagugugugu

SEQ ID NO: 514268 - RNA, 16 nt, Human
ucugccagggacaggc

SEQ ID NO: 514269 - RNA, 22 nt, Human
ugcagccauuugaaaagcaguu

SEQ ID NO: 514270 - RNA, 21 nt, Human
uggaaggcugcucugccaggg

SEQ ID NO: 514271 - RNA, 22 nt, Human
cauaugaaauaugaguugaaca

SEQ ID NO: 514272 - RNA, 22 nt, Human
aggcagucagcccugcuagggu

SEQ ID NO: 514273 - RNA, 22 nt, Human
aaggccagaguacuagaggcug

SEQ ID NO: 514274 - RNA, 22 nt, Human
uuuggccuuaguccagaagaag

SEQ ID NO: 514275 - RNA, 23 nt, Human
gagcugggauacaggcuuacugc

SEQ ID NO: 514276 - RNA, 22 nt, Human
uccaggucuggccugcuaggca

SEQ ID NO: 514277 - RNA, 22 nt, Human
gaauuacaaagugagacaagcu

SEQ ID NO: 514278 - RNA, 22 nt, Human
agggaggagaauggacuccuuc

SEQ ID NO: 514279 - RNA, 19 nt, Human
aucugccuuagugcugcug

SEQ ID NO: 514280 - RNA, 22 nt, Human
ggguccagggacguuucugcag

SEQ ID NO: 514281 - RNA, 22 nt, Human
cacagcuggugcacuagcucug

SEQ ID NO: 514282 - RNA, 22 nt, Human
uggcagugccccuugaccagug

SEQ ID NO: 514283 - RNA, 22 nt, Human
aaaugcacagagccuuagagau

SEQ ID NO: 514284 - RNA, 18 nt, Human
gaggauggaaggagaugc

SEQ ID NO: 514285 - RNA, 17 nt, Human
ucagcaaagacaaagga

SEQ ID NO: 514286 - RNA, 22 nt, Human
aaugaaguucuauucauuuucu

SEQ ID NO: 514287 - RNA, 22 nt, Human
ccugucuguaucgguucagagu

SEQ ID NO: 514288 - RNA, 22 nt, Human
cacagcaggugcuuaaugauua

SEQ ID NO: 514289 - RNA, 22 nt, Human
gugcauauguguguauacaaac

SEQ ID NO: 514290 - RNA, 22 nt, Human
uacagaguggugagaucuuuug

SEQ ID NO: 514291 - RNA, 22 nt, Human
gccuguggccgacugagagccu

SEQ ID NO: 514292 - RNA, 22 nt, Human
ugacagggcuagaggcaaugca

SEQ ID NO: 514293 - RNA, 22 nt, Human
uaucaucugcaaagcacaucua

SEQ ID NO: 514294 - RNA, 22 nt, Human
uaaaugugaccuucauuuuaua

SEQ ID NO: 514295 - RNA, 22 nt, Human
ccuggagauuauuugguccaau

SEQ ID NO: 514296 - RNA, 22 nt, Human
ucaggugggaccugcuaggaca

SEQ ID NO: 514297 - RNA, 22 nt, Human
ucuggagauaagacagacagau

SEQ ID NO: 514298 - RNA, 21 nt, Human
ugggcucuuuaacccaggcac

SEQ ID NO: 514299 - RNA, 22 nt, Human
acaauucuggguauuuauauag

SEQ ID NO: 514300 - RNA, 22 nt, Human
ugugccugaguuggcugaguac

SEQ ID NO: 514301 - RNA, 22 nt, Human
ucugucacuuauuaagauggau

SEQ ID NO: 514302 - RNA, 22 nt, Human
augccuggacugacaugcacug

SEQ ID NO: 514303 - RNA, 22 nt, Human
acugaaggcuuaacucuuucau

SEQ ID NO: 514304 - RNA, 22 nt, Human
ugcuuccuauccacacaaugcc

SEQ ID NO: 514305 - RNA, 22 nt, Human
aguaacaagugccaacguuaga

SEQ ID NO: 514306 - RNA, 20 nt, Human
gaaguccuguuauauccuuu

SEQ ID NO: 514307 - RNA, 22 nt, Human
uucuaaagugcaaucugacaga

SEQ ID NO: 514308 - RNA, 22 nt, Human
cugaggcugggcugaggguaua

SEQ ID NO: 514309 - RNA, 22 nt, Human
gcuucuggcagugcagccacca

SEQ ID NO: 514310 - RNA, 22 nt, Human
cugccccugccaggcagcuguc

SEQ ID NO: 514311 - RNA, 22 nt, Human
uggaaggccuguuguguccuag

SEQ ID NO: 514312 - RNA, 22 nt, Human
uguuuaauucaccaucauguuc

SEQ ID NO: 514313 - RNA, 22 nt, Human
aaagagaaaaugaucuguacau

SEQ ID NO: 514314 - RNA, 22 nt, Human
agagauggccuuaggugggaau

SEQ ID NO: 514315 - RNA, 22 nt, Human
agugcacagcgugauguauugg

SEQ ID NO: 514316 - RNA, 22 nt, Human
uucaggaagugcugccuggugu

SEQ ID NO: 514317 - RNA, 22 nt, Human
ccagcagcgauagggugagugc

SEQ ID NO: 514318 - RNA, 22 nt, Human
ccucccucuguuagagcugucu

SEQ ID NO: 514319 - RNA, 23 nt, Human
gcaguguuugcuucaucuuaucc

SEQ ID NO: 514320 - RNA, 21 nt, Human
gcuucagcaaggcuugcuggu

SEQ ID NO: 514321 - RNA, 22 nt, Human
gaucuugagcaaguuguguaac

SEQ ID NO: 514322 - RNA, 22 nt, Human
ugcauuaagguaauuguauaau

SEQ ID NO: 514323 - RNA, 22 nt, Human
agccacagcauguguguaugua

SEQ ID NO: 514324 - RNA, 22 nt, Human
uguagcagaguaucucuguuuu

SEQ ID NO: 514325 - RNA, 22 nt, Human
aggccuguuggcgugggcucua

SEQ ID NO: 514326 - RNA, 22 nt, Human
cuucacaauucuaacagggcaa

SEQ ID NO: 514327 - RNA, 22 nt, Human
agucuucccugugccagagugu

SEQ ID NO: 514328 - RNA, 22 nt, Human
gccaggcuaagaaaggugugau

SEQ ID NO: 514329 - RNA, 22 nt, Human
ccagagcaauucucacagaacu

SEQ ID NO: 514330 - RNA, 22 nt, Human
uuuccuguugccaucaagaaug

SEQ ID NO: 514331 - RNA, 22 nt, Human
ucaaauguucccuguacuggcc

SEQ ID NO: 514332 - RNA, 22 nt, Human
ggaggccaguccuggccgggcu

SEQ ID NO: 514333 - RNA, 22 nt, Human
ggucugugcucuggagccucug

SEQ ID NO: 514334 - RNA, 22 nt, Human
acuggcagccacaacuggcagg

SEQ ID NO: 514335 - RNA, 22 nt, Human
ucaugacaucuguuuaucucaa

SEQ ID NO: 514336 - RNA, 17 nt, Human
cagucacaggucuuuuc

SEQ ID NO: 514337 - RNA, 22 nt, Human
acaguuucuccauuuacaccuu

SEQ ID NO: 514338 - RNA, 22 nt, Human
ugugccugucacccucagagag

SEQ ID NO: 514339 - RNA, 22 nt, Human
ugagccagauaagggcucacgc

SEQ ID NO: 514340 - RNA, 22 nt, Human
ggcugagccuggagcaucuggu

SEQ ID NO: 514341 - RNA, 22 nt, Human
uguaggaguccaaucaggagac

SEQ ID NO: 514342 - RNA, 22 nt, Human
uaaagugcuuaugauaaccaag

SEQ ID NO: 514343 - RNA, 22 nt, Human
gucucuggcuuuaugcugguuu

SEQ ID NO: 514344 - RNA, 22 nt, Human
ccuggcucccggaacagggucu

SEQ ID NO: 514345 - RNA, 22 nt, Human
cuauugcauuugcaucuucauc

SEQ ID NO: 514346 - RNA, 22 nt, Human
gagguggaaggcaggaacaaau

SEQ ID NO: 514347 - RNA, 22 nt, Human
augcuguagaucuuagccucua

SEQ ID NO: 514348 - RNA, 22 nt, Human
agcccuucaaccugccuacucc

SEQ ID NO: 514349 - RNA, 22 nt, Human
ggaaggaaguaaaugaugcuau

SEQ ID NO: 514350 - RNA, 22 nt, Human
uaggacagaguucccugauggc

SEQ ID NO: 514351 - RNA, 20 nt, Human
ucuggcucuuugcuccuccc

SEQ ID NO: 514352 - RNA, 22 nt, Human
uuauguguauaauuacaggaag

SEQ ID NO: 514353 - RNA, 22 nt, Human
cuguagcagugugcucuuuuuc

SEQ ID NO: 514354 - RNA, 22 nt, Human
ccaugccuggacuccacucuca

SEQ ID NO: 514355 - RNA, 21 nt, Human
ucaggaagagcuucucccacu

SEQ ID NO: 514356 - RNA, 22 nt, Human
ugaaggcccuaucuccauauac

SEQ ID NO: 514357 - RNA, 22 nt, Human
acaagagacaagagguucuucu

SEQ ID NO: 514358 - RNA, 22 nt, Human
ccuccagucaccuggaugagaa

SEQ ID NO: 514359 - RNA, 22 nt, Human
uaaacagagagugcaguuauag

SEQ ID NO: 514360 - RNA, 22 nt, Human
cugugcccuggccaggccucuc

SEQ ID NO: 514361 - RNA, 22 nt, Human
cuucacagucacccugcugugu

SEQ ID NO: 514362 - RNA, 22 nt, Human
guugcugauuaacacuuugagu

SEQ ID NO: 514363 - RNA, 22 nt, Human
ucaccgccuugcccggccgggc

SEQ ID NO: 514364 - RNA, 18 nt, Human
uggagcaggaagccuggc

SEQ ID NO: 514365 - RNA, 22 nt, Human
acacaugagaaacaucaguugu

SEQ ID NO: 514366 - RNA, 22 nt, Human
aauacagaggggucacaauuca

SEQ ID NO: 514367 - RNA, 22 nt, Human
ggagaggcgaugagucacagcc

SEQ ID NO: 514368 - RNA, 22 nt, Human
ccaggaugacccccacuuuccu

SEQ ID NO: 514369 - RNA, 22 nt, Human
uuguuucagcccagaucuuuac

SEQ ID NO: 514370 - RNA, 22 nt, Human
auuauaaagaacaugugugugg

SEQ ID NO: 514371 - RNA, 22 nt, Human
uagagcaguguuguccaucaga

SEQ ID NO: 514372 - RNA, 22 nt, Human
agggccagcugaugagaaugag

SEQ ID NO: 514373 - RNA, 22 nt, Human
gccagcagccacagaagucacu

SEQ ID NO: 514374 - RNA, 22 nt, Human
caguguuuguauagaauaugca

SEQ ID NO: 514375 - RNA, 22 nt, Human
ggugccaggcucccagcucagg

SEQ ID NO: 514376 - RNA, 22 nt, Human
gcacugagucugucaugcugca

SEQ ID NO: 514377 - RNA, 22 nt, Human
ucugggcucugucagcaccucu

SEQ ID NO: 514378 - RNA, 22 nt, Human
auucaauaagucacuguggaau

SEQ ID NO: 514379 - RNA, 22 nt, Human
ucucagaggcccgacguucucc

SEQ ID NO: 514380 - RNA, 22 nt, Human
auccuguguugcuacuggagga

SEQ ID NO: 514381 - RNA, 22 nt, Human
auguaacaggugaagcucugag

SEQ ID NO: 514382 - RNA, 22 nt, Human
ucugggccuuggaguggggaga

SEQ ID NO: 514383 - RNA, 22 nt, Human
aaaguuugaaugauauauuagu

SEQ ID NO: 514384 - RNA, 22 nt, Human
aaauaauuauagcgagucuauc

SEQ ID NO: 514385 - RNA, 22 nt, Human
cauuuauugguuaggccagcag

SEQ ID NO: 514386 - RNA, 22 nt, Human
gcuggcuugacagaggccuggg

SEQ ID NO: 514387 - RNA, 23 nt, Human
uugaauuucucuugcaauauuua

SEQ ID NO: 514388 - RNA, 21 nt, Human
uuccuggggacuuccguggga

SEQ ID NO: 514389 - RNA, 22 nt, Human
agauaauuaugucaauuucuug

SEQ ID NO: 514390 - RNA, 22 nt, Human
aaagugcugaaauuacaggugu

SEQ ID NO: 514391 - RNA, 22 nt, Human
auguggccagucauguaguaac

SEQ ID NO: 514392 - RNA, 22 nt, Human
uggggacacagagccaaacuau

SEQ ID NO: 514393 - RNA, 17 nt, Human
ucuuuccugccaugcuc

SEQ ID NO: 514394 - RNA, 22 nt, Human
ggaaggcuugaguucccagguc

SEQ ID NO: 514395 - RNA, 22 nt, Human
ggcugcagagcugggugggccu

SEQ ID NO: 514396 - RNA, 22 nt, Human
cuucagaacuauaaaaaguacu

SEQ ID NO: 514397 - RNA, 22 nt, Human
gugauccuauaaagugagcaca

SEQ ID NO: 514398 - RNA, 22 nt, Human
agccccuccaguggcauaaaau

SEQ ID NO: 514399 - RNA, 22 nt, Human
uggagggcaugcuguccauggg

SEQ ID NO: 514400 - RNA, 22 nt, Human
guggaaggugcuagaacaagga

SEQ ID NO: 514401 - RNA, 22 nt, Human
cuggagccuucaccaggggaaa

SEQ ID NO: 514402 - RNA, 18 nt, Human
gcccaugguaaaugcugu

SEQ ID NO: 514403 - RNA, 22 nt, Human
gagcuuuaagggcacuggucuu

SEQ ID NO: 514404 - RNA, 22 nt, Human
gcaggccuccccugcuggagcu

SEQ ID NO: 514405 - RNA, 22 nt, Human
agaagugccauacuguggucca

SEQ ID NO: 514406 - RNA, 22 nt, Human
uaucaaaguuguccugugaagu

SEQ ID NO: 514407 - RNA, 22 nt, Human
auagauauuugaguuguuucca

SEQ ID NO: 514408 - RNA, 22 nt, Human
ucaaugauuagaguuuagugug

SEQ ID NO: 514409 - RNA, 22 nt, Human
aauguguuuucacugaagauuc

SEQ ID NO: 514410 - RNA, 22 nt, Human
aggcccaguagucgacggcgcu

SEQ ID NO: 514411 - RNA, 22 nt, Human
cuagauaaggauuucucaacuu

SEQ ID NO: 514412 - RNA, 23 nt, Human
gagcagagcgggcggggguccug

SEQ ID NO: 514413 - RNA, 22 nt, Human
cugggccuuugcuuauuaauuu

SEQ ID NO: 514414 - RNA, 22 nt, Human
agcuuuauuaacucuccaggug

SEQ ID NO: 514415 - RNA, 22 nt, Human
cccugcagacgucuugaugccu

SEQ ID NO: 514416 - RNA, 22 nt, Human
cccuggcucugccucagagccc

SEQ ID NO: 514417 - RNA, 22 nt, Human
uuuuaugugugaaaugcugucu

SEQ ID NO: 514418 - RNA, 22 nt, Human
ccugaccauuugccacaugggu

SEQ ID NO: 514419 - RNA, 22 nt, Human
uggguggaauaaaucaguucug

SEQ ID NO: 514420 - RNA, 22 nt, Human
uagagcugaguugacuccauuu

SEQ ID NO: 514421 - RNA, 22 nt, Human
ccucaguguguggauguuagag

SEQ ID NO: 514422 - RNA, 22 nt, Human
gccuggaguacuccuugaagug

SEQ ID NO: 514423 - RNA, 22 nt, Human
ucucaguguuuaaaaagauuuc

SEQ ID NO: 514424 - RNA, 22 nt, Human
ggucucuggccuuggagauuga

SEQ ID NO: 514425 - RNA, 22 nt, Human
ugucuagggagcugcucaggcu

SEQ ID NO: 514426 - RNA, 22 nt, Human
cuuuggaauaauuuccuggagu

SEQ ID NO: 514427 - RNA, 22 nt, Human
aaagcagagguugcagugagcu

SEQ ID NO: 514428 - RNA, 22 nt, Human
ccagggcaauaggaacacuuuu

SEQ ID NO: 514429 - RNA, 22 nt, Human
cagaagcauuccagcaaauagu

SEQ ID NO: 514430 - RNA, 22 nt, Human
uuccucuccucccaccagguga

SEQ ID NO: 514431 - RNA, 22 nt, Human
ucagcuggaagauggugcagaa

SEQ ID NO: 514432 - RNA, 22 nt, Human
aggcuacauguugggguggaag

SEQ ID NO: 514433 - RNA, 22 nt, Human
auuauuaggugcucucugacaa

SEQ ID NO: 514434 - RNA, 22 nt, Human
cuggguguuggguacugaccgu

SEQ ID NO: 514435 - RNA, 21 nt, Human
ggcagccugacccccagagag

SEQ ID NO: 514436 - RNA, 22 nt, Human
caagggggcaggaucacacuug

SEQ ID NO: 514437 - RNA, 23 nt, Human
agaggcaggaguggcuugcccgg

SEQ ID NO: 514438 - RNA, 22 nt, Human
aaaugauggaaaugaggcugaa

SEQ ID NO: 514439 - RNA, 20 nt, Human
aggcucugccauugucccug

SEQ ID NO: 514440 - RNA, 18 nt, Human
gggcaucauucacaaagu

SEQ ID NO: 514441 - RNA, 22 nt, Human
cccgagugucuacucacuccca

SEQ ID NO: 514442 - RNA, 17 nt, Human
aggcugcugggccaggg

SEQ ID NO: 514443 - RNA, 22 nt, Human
agaggcucagaggccugguccu

SEQ ID NO: 514444 - RNA, 22 nt, Human
ggucagcaucugguugagggca

SEQ ID NO: 514445 - RNA, 22 nt, Human
acaguauaccauugugacuuug

SEQ ID NO: 514446 - RNA, 22 nt, Human
cacacuagucuauccauuagcu

SEQ ID NO: 514447 - RNA, 22 nt, Human
ccagggugaccagcuggccuag

SEQ ID NO: 514448 - RNA, 22 nt, Human
ggcugccauaacugauaccaua

SEQ ID NO: 514449 - RNA, 22 nt, Human
gcagcguggggcugagucagcu

SEQ ID NO: 514450 - RNA, 18 nt, Human
auaaagugcuaauaaugg

SEQ ID NO: 514451 - RNA, 22 nt, Human
uugcugaaaacaggucaucagg

SEQ ID NO: 514452 - RNA, 22 nt, Human
gugcauuugugcaugcacaugu

SEQ ID NO: 514453 - RNA, 22 nt, Human
gcugagcugcuguucauccugc

SEQ ID NO: 514454 - RNA, 22 nt, Human
ggcuggccuguguggccgccac

SEQ ID NO: 514455 - RNA, 22 nt, Human
ggggcggggcucugagaagcau

SEQ ID NO: 514456 - RNA, 22 nt, Human
ucaaaggaauuugauuuugaug

SEQ ID NO: 514457 - RNA, 23 nt, Human
cacaccuguuaagaagagugccu

SEQ ID NO: 514458 - RNA, 22 nt, Human
aaguuacaguuauuauuuaaaa

SEQ ID NO: 514459 - RNA, 19 nt, Human
ucuagucagucagucauuc

SEQ ID NO: 514460 - RNA, 22 nt, Human
uggcagaggaggcucagauuga

SEQ ID NO: 514461 - RNA, 21 nt, Human
uggcugcuggcccucucucca

SEQ ID NO: 514462 - RNA, 22 nt, Human
auguaguuuggggcuagauuua

SEQ ID NO: 514463 - RNA, 19 nt, Human
agagaggcugugugaggga

SEQ ID NO: 514464 - RNA, 22 nt, Human
uguuaaauguuccuuuacugga

SEQ ID NO: 514465 - RNA, 22 nt, Human
cagggcagggagcuuagaauga

SEQ ID NO: 514466 - RNA, 22 nt, Human
auguguuuugguaauuucugcu

SEQ ID NO: 514467 - RNA, 22 nt, Human
agacacauaggaccacacugug

SEQ ID NO: 514468 - RNA, 22 nt, Human
ccagccugguucagaauuggcu

SEQ ID NO: 514469 - RNA, 22 nt, Human
ugccgcuccaggucucgcggug

SEQ ID NO: 514470 - RNA, 22 nt, Human
uugaaaaguuuugaaacacucu

SEQ ID NO: 514471 - RNA, 22 nt, Human
guugaguggguuaggaugcuga

SEQ ID NO: 514472 - RNA, 22 nt, Human
agaaagggaacuggcaaagcca

SEQ ID NO: 514473 - RNA, 22 nt, Human
aagaaagugcuuuguaaauuau

SEQ ID NO: 514474 - RNA, 19 nt, Human
ggcuucagggaguuagcau

SEQ ID NO: 514475 - RNA, 22 nt, Human
gaaaugugaccuacuuccuugu

SEQ ID NO: 514476 - RNA, 22 nt, Human
ugggccaacaggaggucuagga

SEQ ID NO: 514477 - RNA, 22 nt, Human
ccagcuuuuccucucauugcuu

SEQ ID NO: 514478 - RNA, 22 nt, Human
ccaggagguggagauugcagug

SEQ ID NO: 514479 - RNA, 22 nt, Human
cuggcagcguguuuaugaacau

SEQ ID NO: 514480 - RNA, 20 nt, Human
uaucuaaaugcuuacauuac

SEQ ID NO: 514481 - RNA, 23 nt, Human
acuuuauugaccccaggucaguu

SEQ ID NO: 514482 - RNA, 22 nt, Human
cccugaggggcuuacuuugccc

SEQ ID NO: 514483 - RNA, 23 nt, Human
uccucaguauauaaaggcagaug

SEQ ID NO: 514484 - RNA, 22 nt, Human
cuccuggggccauggaaggaac

SEQ ID NO: 514485 - RNA, 22 nt, Human
uuacaagacacagugcugaagg

SEQ ID NO: 514486 - RNA, 21 nt, Human
ugagugccaccugcuggccaa

SEQ ID NO: 514487 - RNA, 22 nt, Human
gccucugcaauuacauugugcc

SEQ ID NO: 514488 - RNA, 22 nt, Human
ucauccuuuugcaugggaaggc

SEQ ID NO: 514489 - RNA, 22 nt, Human
ccuggggagagaaagcccagcc

SEQ ID NO: 514490 - RNA, 19 nt, Human
ggugaccaccuggucagug

SEQ ID NO: 514491 - RNA, 22 nt, Human
cugcaggggccucgagcacagg

SEQ ID NO: 514492 - RNA, 22 nt, Human
cagcuugugcaaagguccuggg

SEQ ID NO: 514493 - RNA, 20 nt, Human
agcuucaggcucaagagaac

SEQ ID NO: 514494 - RNA, 22 nt, Human
aacauuucauaacuugacuuuu

SEQ ID NO: 514495 - RNA, 22 nt, Human
guacccaggcacgccuugcuga

SEQ ID NO: 514496 - RNA, 22 nt, Human
gguggcaggcccugagcauccc

SEQ ID NO: 514497 - RNA, 22 nt, Human
cuccugaggaaaagcuugguca

SEQ ID NO: 514498 - RNA, 22 nt, Human
acuaggaauucaaguagacaga

SEQ ID NO: 514499 - RNA, 22 nt, Human
caguccugugucccuugguggg

SEQ ID NO: 514500 - RNA, 22 nt, Human
ugcaggucauguggcgggacug

SEQ ID NO: 514501 - RNA, 19 nt, Human
gaaggagagcugaguuagg

SEQ ID NO: 514502 - RNA, 22 nt, Human
gaggccugcagcguggucccug

SEQ ID NO: 514503 - RNA, 22 nt, Human
agagggcauaaaauagagcacg

SEQ ID NO: 514504 - RNA, 22 nt, Human
gcugccaauccagcugugggag

SEQ ID NO: 514505 - RNA, 18 nt, Human
aucuuuccauagcauguu

SEQ ID NO: 514506 - RNA, 22 nt, Human
agcauccaacaggagggaaggg

SEQ ID NO: 514507 - RNA, 22 nt, Human
ugguccuggggaucugcaguga

SEQ ID NO: 514508 - RNA, 22 nt, Human
ucaggaugaccacgagccucua

SEQ ID NO: 514509 - RNA, 22 nt, Human
uuauaaagguuugugcauauuu

SEQ ID NO: 514510 - RNA, 22 nt, Human
ucaggagauggucuuuauaggc

SEQ ID NO: 514511 - RNA, 22 nt, Human
ggcuucucucuucacauggcuu

SEQ ID NO: 514512 - RNA, 20 nt, Human
accuugaacccgccagccau

SEQ ID NO: 514513 - RNA, 22 nt, Human
uauguccugcuacucucucaug

SEQ ID NO: 514514 - RNA, 22 nt, Human
aguaauaauuuauauuagggag

SEQ ID NO: 514515 - RNA, 17 nt, Human
ggugaguguccaggugg

SEQ ID NO: 514516 - RNA, 22 nt, Human
cccuguccuuggcugugaggcu

SEQ ID NO: 514517 - RNA, 20 nt, Human
acagaugaggaaaaugaagu

SEQ ID NO: 514518 - RNA, 20 nt, Human
agguggcuccugcugggggu

SEQ ID NO: 514519 - RNA, 22 nt, Human
gugcuggggagauaggaagaga

SEQ ID NO: 514520 - RNA, 22 nt, Human
aggcaauccccugaggauacuu

SEQ ID NO: 514521 - RNA, 22 nt, Human
acagaacaagaccugcuuauug

SEQ ID NO: 514522 - RNA, 22 nt, Human
uccugagggcgauucagcaggu

SEQ ID NO: 514523 - RNA, 22 nt, Human
uccugccuagcaggugaccuau

SEQ ID NO: 514524 - RNA, 22 nt, Human
uaacacaaaagaauaugugugu

SEQ ID NO: 514525 - RNA, 22 nt, Human
cuuccuugcggccccugccuag

SEQ ID NO: 514526 - RNA, 22 nt, Human
guggccagaggucccauguguc

SEQ ID NO: 514527 - RNA, 22 nt, Human
aagauguuagauuauggggaca

SEQ ID NO: 514528 - RNA, 22 nt, Human
acagcucucccucagagaaaug

SEQ ID NO: 514529 - RNA, 22 nt, Human
ugggaagggccgauggagccuc

SEQ ID NO: 514530 - RNA, 22 nt, Human
agagauuacagcaggguccagc

SEQ ID NO: 514531 - RNA, 22 nt, Human
ggggugggagugccauccuuga

SEQ ID NO: 514532 - RNA, 22 nt, Human
ucucuuuaaagacucagagauu

SEQ ID NO: 514533 - RNA, 22 nt, Human
auaaagaggauguauuuacagc

SEQ ID NO: 514534 - RNA, 22 nt, Human
gaggccugaaaggggaccuaug

SEQ ID NO: 514535 - RNA, 22 nt, Human
ucuggccuauuucugucagauc

SEQ ID NO: 514536 - RNA, 22 nt, Human
gcucccaccaggcagaccuacc

SEQ ID NO: 514537 - RNA, 22 nt, Human
aucagcugaugaauggaugaau

SEQ ID NO: 514538 - RNA, 22 nt, Human
ucccagcagucagagcuaugug

SEQ ID NO: 514539 - RNA, 22 nt, Human
agcagccauagauagcaugcaa

SEQ ID NO: 514540 - RNA, 22 nt, Human
uggcuggggagccccgacuccc

SEQ ID NO: 514541 - RNA, 22 nt, Human
uucacagauguauuggaacucc

SEQ ID NO: 514542 - RNA, 18 nt, Human
acagacacuuaguaugag

SEQ ID NO: 514543 - RNA, 22 nt, Human
agaggucuuuuggucugcagaa

SEQ ID NO: 514544 - RNA, 22 nt, Human
uaaggccagccagcaaaucugu

SEQ ID NO: 514545 - RNA, 22 nt, Human
gggcagcugccaagugcaucgc

SEQ ID NO: 514546 - RNA, 22 nt, Human
cagcugccuguauuguccucau

SEQ ID NO: 514547 - RNA, 22 nt, Human
gcagugcaggaacauagcuucu

SEQ ID NO: 514548 - RNA, 22 nt, Human
auuguggugucaguuauaggca

SEQ ID NO: 514549 - RNA, 22 nt, Human
ucacguuuuacugagugagaua

SEQ ID NO: 514550 - RNA, 21 nt, Human
uuugaaagcuacaucuauagc

SEQ ID NO: 514551 - RNA, 19 nt, Human
gccuaugucuucaaaucau

SEQ ID NO: 514552 - RNA, 22 nt, Human
agguaaggcuguaagcuaagcc

SEQ ID NO: 514553 - RNA, 21 nt, Human
ucucugggaggacuugugaga

SEQ ID NO: 514554 - RNA, 22 nt, Human
acagagcuuaauucaggagcuu

SEQ ID NO: 514555 - RNA, 22 nt, Human
cacagaggacuguagcggggag

SEQ ID NO: 514556 - RNA, 20 nt, Human
cacagaacaaauugcaggac

SEQ ID NO: 514557 - RNA, 22 nt, Human
cucagcaccccgacaggacauu

SEQ ID NO: 514558 - RNA, 22 nt, Human
uaaacaucugucauguguuuau

SEQ ID NO: 514559 - RNA, 22 nt, Human
ugcuggaggccugacuguguuu

SEQ ID NO: 514560 - RNA, 22 nt, Human
cuggaugcugagagguaccaag

SEQ ID NO: 514561 - RNA, 22 nt, Human
uuucuaauaucacuuccagcug

SEQ ID NO: 514562 - RNA, 23 nt, Human
uugagucuuauaggauugaggug

SEQ ID NO: 514563 - RNA, 22 nt, Human
ucaguguccggagccugagugc

SEQ ID NO: 514564 - RNA, 22 nt, Human
ggaggccaaagugugggcggcu

SEQ ID NO: 514565 - RNA, 23 nt, Human
cauuucugggagauuuauaaaau

SEQ ID NO: 514566 - RNA, 22 nt, Human
ucuaggagaaccaucagggagg

SEQ ID NO: 514567 - RNA, 22 nt, Human
cauuuucucaaugaacccucuu

SEQ ID NO: 514568 - RNA, 22 nt, Human
ucacagaaggcaucacagaaga

SEQ ID NO: 514569 - RNA, 22 nt, Human
ggaagggaauccaucugguuag

SEQ ID NO: 514570 - RNA, 22 nt, Human
uuugaagagccacagugaaauu

SEQ ID NO: 514571 - RNA, 22 nt, Human
aucuggcuuuuacugaauugcu

SEQ ID NO: 514572 - RNA, 22 nt, Human
ccuguacacaauuccgaggaua

SEQ ID NO: 514573 - RNA, 22 nt, Human
uuguccuggcccaaaugucaac

SEQ ID NO: 514574 - RNA, 22 nt, Human
agcagagccaggucucucugua

SEQ ID NO: 514575 - RNA, 22 nt, Human
aucugccuggcuccaggugagc

SEQ ID NO: 514576 - RNA, 22 nt, Human
acugcuuacaaaaggaaagaau

SEQ ID NO: 514577 - RNA, 22 nt, Human
ugaagcagaggggucuugagcu

SEQ ID NO: 514578 - RNA, 22 nt, Human
ggcuccacugcugaccacucca

SEQ ID NO: 514579 - RNA, 22 nt, Human
acaguguuuuaugagaauuguu

SEQ ID NO: 514580 - RNA, 22 nt, Human
uagcagcucugauucugggccc

SEQ ID NO: 514581 - RNA, 22 nt, Human
uacaaagugugcccaugcugag

SEQ ID NO: 514582 - RNA, 22 nt, Human
ucucaagagggaggcaaucaug

SEQ ID NO: 514583 - RNA, 22 nt, Human
uuuucacacaaggugauaaguu

SEQ ID NO: 514584 - RNA, 22 nt, Human
ggaggcucccacgcagcucaca

SEQ ID NO: 514585 - RNA, 23 nt, Human
agaugaaagcuucccaucacagu

SEQ ID NO: 514586 - RNA, 22 nt, Human
guccucuggaagaugaguucuu

SEQ ID NO: 514587 - RNA, 22 nt, Human
cucuccucugaaguggugaccc

SEQ ID NO: 514588 - RNA, 22 nt, Human
aaaggucagacuuaggcugggc

SEQ ID NO: 514589 - RNA, 22 nt, Human
gacagggcgagacucagucuca

SEQ ID NO: 514590 - RNA, 22 nt, Human
uaaagcaaggcaaauuguuggu

SEQ ID NO: 514591 - RNA, 22 nt, Human
cugggguggauggguccaaguu

SEQ ID NO: 514592 - RNA, 23 nt, Human
cuucaucaaaaguuaacacuagu

SEQ ID NO: 514593 - RNA, 22 nt, Human
gcaguguugagugguggcugaa

SEQ ID NO: 514594 - RNA, 22 nt, Human
caucacugaaccccaacuuucu

SEQ ID NO: 514595 - RNA, 22 nt, Human
gcuggccuccugcuagauggaa

SEQ ID NO: 514596 - RNA, 22 nt, Human
cuguggcuucugggucaguuca

SEQ ID NO: 514597 - RNA, 22 nt, Human
gcccagcagcugguggagaagg

SEQ ID NO: 514598 - RNA, 22 nt, Human
ggccuugguuccaaagcaggca

SEQ ID NO: 514599 - RNA, 22 nt, Human
acugagcugcaagucagggagg

SEQ ID NO: 514600 - RNA, 22 nt, Human
gcagagaguugggcugcgccag

SEQ ID NO: 514601 - RNA, 22 nt, Human
cugcccugggugcuggggaucc

SEQ ID NO: 514602 - RNA, 22 nt, Human
aagcaggcauuccagagacaau

SEQ ID NO: 514603 - RNA, 22 nt, Human
acagaguacauucagagacuau

SEQ ID NO: 514604 - RNA, 22 nt, Human
cugaaugagggauucugagggc

SEQ ID NO: 514605 - RNA, 22 nt, Human
agugacaaggugguaaugaagc

SEQ ID NO: 514606 - RNA, 22 nt, Human
aaagacaugacacauuggagag

SEQ ID NO: 514607 - RNA, 22 nt, Human
acagcacaaucugagucccaga

SEQ ID NO: 514608 - RNA, 22 nt, Human
uuggcugcuggucuuuggauau

SEQ ID NO: 514609 - RNA, 22 nt, Human
cuccucccucuuugccacacau

SEQ ID NO: 514610 - RNA, 22 nt, Human
ucuggggaauguucauuucuga

SEQ ID NO: 514611 - RNA, 22 nt, Human
uuucuaggacaugauaggauau

SEQ ID NO: 514612 - RNA, 22 nt, Human
ggcaguggugggaggcucgcuc

SEQ ID NO: 514613 - RNA, 20 nt, Human
gagggcucguggauggauaa

SEQ ID NO: 514614 - RNA, 22 nt, Human
ccagcuuuugcacuggacuggg

SEQ ID NO: 514615 - RNA, 20 nt, Human
ucccaggcuccacccuagac

SEQ ID NO: 514616 - RNA, 22 nt, Human
gccugcagccagggaguucucu

SEQ ID NO: 514617 - RNA, 22 nt, Human
uggggagaaaugucuuuguucc

SEQ ID NO: 514618 - RNA, 22 nt, Human
guguacaaaaugucuccaugga

SEQ ID NO: 514619 - RNA, 22 nt, Human
gggcauggaggucugucugcag

SEQ ID NO: 514620 - RNA, 22 nt, Human
ugguugugucacuuagauuaga

SEQ ID NO: 514621 - RNA, 22 nt, Human
cuaggcagacugagcucuaggg

SEQ ID NO: 514622 - RNA, 22 nt, Human
gccagcccagcuccaggggaaa

SEQ ID NO: 514623 - RNA, 22 nt, Human
guuuggggucugcagagcggcg

SEQ ID NO: 514624 - RNA, 22 nt, Human
uguauguaaaguuuguaauaga

SEQ ID NO: 514625 - RNA, 22 nt, Human
auuguuaugaaaauaagauguu

SEQ ID NO: 514626 - RNA, 22 nt, Human
cugcucugaagccaggauucug

SEQ ID NO: 514627 - RNA, 21 nt, Human
auggagggaccagggaagcag

SEQ ID NO: 514628 - RNA, 19 nt, Human
gcugugugaccuugggcaa

SEQ ID NO: 514629 - RNA, 23 nt, Human
gggcugcuccaggccaaggcugg

SEQ ID NO: 514630 - RNA, 22 nt, Human
gagaggggcccaagccacauag

SEQ ID NO: 514631 - RNA, 22 nt, Human
ggugucugcuucccuccagcug

SEQ ID NO: 514632 - RNA, 22 nt, Human
cagggccuuuuagcaucuucuc

SEQ ID NO: 514633 - RNA, 22 nt, Human
cauggacagugggacagugugu

SEQ ID NO: 514634 - RNA, 22 nt, Human
uuauuuguaaagguccauagua

SEQ ID NO: 514635 - RNA, 22 nt, Human
uacacagauuucaguaucauca

SEQ ID NO: 514636 - RNA, 22 nt, Human
aagcucugcucagcagacuagg

SEQ ID NO: 514637 - RNA, 22 nt, Human
caggauccccaggucgccgucc

SEQ ID NO: 514638 - RNA, 23 nt, Human
ugggauagaauuucauggcugcu

SEQ ID NO: 514639 - RNA, 22 nt, Human
acagucugccucucagagcagc

SEQ ID NO: 514640 - RNA, 22 nt, Human
agaggaaguaaucaggaccugc

SEQ ID NO: 514641 - RNA, 22 nt, Human
ucuggagucugagaucugagga

SEQ ID NO: 514642 - RNA, 22 nt, Human
agugcagugguuaggagccagg

SEQ ID NO: 514643 - RNA, 22 nt, Human
agcagcacccagagccaugucu

SEQ ID NO: 514644 - RNA, 17 nt, Human
cugcuuugugcaacgcu

SEQ ID NO: 514645 - RNA, 22 nt, Human
ccagucacuggaaaaugggaau

SEQ ID NO: 514646 - RNA, 22 nt, Human
uuagauaccuuuguguuguaga

SEQ ID NO: 514647 - RNA, 22 nt, Human
acugggccggugcagaguaguu

SEQ ID NO: 514648 - RNA, 22 nt, Human
ugugaggccuagacagccuggg

SEQ ID NO: 514649 - RNA, 22 nt, Human
gccuggcugcugguucugagga

SEQ ID NO: 514650 - RNA, 22 nt, Human
gcucugggugaacuuggagcaa

SEQ ID NO: 514651 - RNA, 19 nt, Human
auagucuuuccaauuauac

SEQ ID NO: 514652 - RNA, 22 nt, Human
uugcccugccucccugagguga

SEQ ID NO: 514653 - RNA, 17 nt, Human
aggcuggcucacaggga

SEQ ID NO: 514654 - RNA, 22 nt, Human
uuccaaguugagcgauuuuccu

SEQ ID NO: 514655 - RNA, 22 nt, Human
acagguggcauaggcaguuuga

SEQ ID NO: 514656 - RNA, 22 nt, Human
gcugcucugaaaaugacuguug

SEQ ID NO: 514657 - RNA, 22 nt, Human
uccaagaugguugguguggugg

SEQ ID NO: 514658 - RNA, 22 nt, Human
aagaagaaguguuauuuuuaga

SEQ ID NO: 514659 - RNA, 22 nt, Human
agccaggaauuggacaacacau

SEQ ID NO: 514660 - RNA, 18 nt, Human
aguaguggguuuagcuuc

SEQ ID NO: 514661 - RNA, 22 nt, Human
uuccucaucugugcaccucacu

SEQ ID NO: 514662 - RNA, 22 nt, Human
augacuucaccucugugaagca

SEQ ID NO: 514663 - RNA, 22 nt, Human
aauguugauguuuucagugagc

SEQ ID NO: 514664 - RNA, 22 nt, Human
ucaggucccacugcuaguaagu

SEQ ID NO: 514665 - RNA, 22 nt, Human
aaggcuguccaggagaaaauag

SEQ ID NO: 514666 - RNA, 22 nt, Human
uucaguguuaaucuugggagaa

SEQ ID NO: 514667 - RNA, 20 nt, Human
uggcggggaugagggaguua

SEQ ID NO: 514668 - RNA, 22 nt, Human
augcaaaucuuaaguaugugug

SEQ ID NO: 514669 - RNA, 22 nt, Human
ugccuggcugaggugacagguu

SEQ ID NO: 514670 - RNA, 22 nt, Human
acuguauaaggcauagguaagc

SEQ ID NO: 514671 - RNA, 22 nt, Human
uuauuaggaacucaggauuuuu

SEQ ID NO: 514672 - RNA, 20 nt, Human
cuaucuccuggcgugccuuc

SEQ ID NO: 514673 - RNA, 22 nt, Human
aguguuucaagugaugcuuugg

SEQ ID NO: 514674 - RNA, 18 nt, Human
gagcccugagucugcaca

SEQ ID NO: 514675 - RNA, 22 nt, Human
ggcugagggccagggcuagucu

SEQ ID NO: 514676 - RNA, 20 nt, Human
uuccagagaucugcauuuua

SEQ ID NO: 514677 - RNA, 22 nt, Human
cugaagagcucuccuguccccu

SEQ ID NO: 514678 - RNA, 22 nt, Human
agggggucguccggaagaccug

SEQ ID NO: 514679 - RNA, 22 nt, Human
ccugcagcuguaggagaaggcg

SEQ ID NO: 514680 - RNA, 22 nt, Human
ggugggcagcucuuggcaggca

SEQ ID NO: 514681 - RNA, 22 nt, Human
cucagugcuucuagcuugauga

SEQ ID NO: 514682 - RNA, 21 nt, Human
agcacagcuuuaagccaugug

SEQ ID NO: 514683 - RNA, 22 nt, Human
ugcugaauauagagcaagaagu

SEQ ID NO: 514684 - RNA, 22 nt, Human
ccaggcucugagccucacucuu

SEQ ID NO: 514685 - RNA, 22 nt, Human
uccugagggcucggggcucaug

SEQ ID NO: 514686 - RNA, 22 nt, Human
gcagggucuugagaggcagcca

SEQ ID NO: 514687 - RNA, 22 nt, Human
cugggccacuccagaugcccac

SEQ ID NO: 514688 - RNA, 22 nt, Human
acagguccucaagucagcuggg

SEQ ID NO: 514689 - RNA, 22 nt, Human
auaauuaauuucaguaaucucc

SEQ ID NO: 514690 - RNA, 22 nt, Human
aggaccaguaugagagcaucug

SEQ ID NO: 514691 - RNA, 22 nt, Human
aaugucaaacagagcagagcua

SEQ ID NO: 514692 - RNA, 23 nt, Human
uauuagggccaggacuggcaaau

SEQ ID NO: 514693 - RNA, 22 nt, Human
uagcagcaagaaugggaugugu

SEQ ID NO: 514694 - RNA, 22 nt, Human
acagagucaugguagucaaagg

SEQ ID NO: 514695 - RNA, 22 nt, Human
uugauaaaaugauaucuucuuu

SEQ ID NO: 514696 - RNA, 21 nt, Human
ucccugcuuucuggcccaguc

SEQ ID NO: 514697 - RNA, 22 nt, Human
ggcaggucagguccaugaccaa

SEQ ID NO: 514698 - RNA, 22 nt, Human
ugccugggaaccaauccuggcu

SEQ ID NO: 514699 - RNA, 22 nt, Human
uuacuuugaugaucaaugagcg

SEQ ID NO: 514700 - RNA, 20 nt, Human
cacguuuuuccacuagcaaa

SEQ ID NO: 514701 - RNA, 22 nt, Human
uugcuuuauguguaugacuuga

SEQ ID NO: 514702 - RNA, 22 nt, Human
agcaggagagcagugcgugguc

SEQ ID NO: 514703 - RNA, 22 nt, Human
aguugacauccauaacaggaag

SEQ ID NO: 514704 - RNA, 22 nt, Human
aaauaacagucagggacaacau

SEQ ID NO: 514705 - RNA, 20 nt, Human
uaaagacauaagcuacuauc

SEQ ID NO: 514706 - RNA, 22 nt, Human
gagagaagggacuucuacacuu

SEQ ID NO: 514707 - RNA, 22 nt, Human
gaguggggcccacugcugggug

SEQ ID NO: 514708 - RNA, 22 nt, Human
uggagaauuuugucaccagaca

SEQ ID NO: 514709 - RNA, 22 nt, Human
cauucugugauucuaaaucccu

SEQ ID NO: 514710 - RNA, 19 nt, Human
ucagaggauuuggcuauga

SEQ ID NO: 514711 - RNA, 22 nt, Human
gcagacuggucuucagccuugg

SEQ ID NO: 514712 - RNA, 22 nt, Human
uucuuuuacauuaagauuucag

SEQ ID NO: 514713 - RNA, 22 nt, Human
cuuguuuucuucugcagucuau

SEQ ID NO: 514714 - RNA, 20 nt, Human
gcauugaguauagacagaug

SEQ ID NO: 514715 - RNA, 22 nt, Human
acaggacaacucagcagccagc

SEQ ID NO: 514716 - RNA, 22 nt, Human
ucauuuaauaauuuuugaguag

SEQ ID NO: 514717 - RNA, 22 nt, Human
cagcaggcugcgauugcucauu

SEQ ID NO: 514718 - RNA, 22 nt, Human
uugccaggagcucaucugaggg

SEQ ID NO: 514719 - RNA, 23 nt, Human
agcuuugugaaagcagacauggg

SEQ ID NO: 514720 - RNA, 22 nt, Human
aagcuucaaugagauaauuguu

SEQ ID NO: 514721 - RNA, 22 nt, Human
ggauggcauguugggcucuguu

SEQ ID NO: 514722 - RNA, 22 nt, Human
cagucucucuuguagugcagcu

SEQ ID NO: 514723 - RNA, 22 nt, Human
caguggcagagaacagagaccu

SEQ ID NO: 514724 - RNA, 22 nt, Human
cuccuugguguaguacugagca

SEQ ID NO: 514725 - RNA, 22 nt, Human
gccuggcuccuaaggacuggcu

SEQ ID NO: 514726 - RNA, 22 nt, Human
uagcagcucuuuacuaaccagu

SEQ ID NO: 514727 - RNA, 22 nt, Human
uacauggguagguuaagucaua

SEQ ID NO: 514728 - RNA, 20 nt, Human
ugauauuucuggaaguggag

SEQ ID NO: 514729 - RNA, 22 nt, Human
gugcccugcaugccccggguau

SEQ ID NO: 514730 - RNA, 22 nt, Human
caggcccauucuaggcuugcua

SEQ ID NO: 514731 - RNA, 22 nt, Human
ggugccagccuagugcaguggu

SEQ ID NO: 514732 - RNA, 22 nt, Human
agaaaucuauguuuugguuaga

SEQ ID NO: 514733 - RNA, 22 nt, Human
gcugucugggaggccuccacuu

SEQ ID NO: 514734 - RNA, 19 nt, Human
augucccaccgccccugag

SEQ ID NO: 514735 - RNA, 22 nt, Human
aggaagcucauuuugacauauc

SEQ ID NO: 514736 - RNA, 22 nt, Human
aagucagagcaacugagacauu

SEQ ID NO: 514737 - RNA, 22 nt, Human
aauucuauguucuugaguaaga

SEQ ID NO: 514738 - RNA, 22 nt, Human
acauguaaaaggaacaugcaug

SEQ ID NO: 514739 - RNA, 22 nt, Human
uggcucuguggucuuagcaugc

SEQ ID NO: 514740 - RNA, 22 nt, Human
ugccugaggagucagggcaggu

SEQ ID NO: 514741 - RNA, 22 nt, Human
ccaugcccuaaaggacuggcag

SEQ ID NO: 514742 - RNA, 22 nt, Human
gcuuucugaagcaguguuucuc

SEQ ID NO: 514743 - RNA, 22 nt, Human
gcuccugggcccugggcuaacu

SEQ ID NO: 514744 - RNA, 22 nt, Human
uuguuucaggaugguuuguuac

SEQ ID NO: 514745 - RNA, 22 nt, Human
uccaggagacacaagguacaua

SEQ ID NO: 514746 - RNA, 22 nt, Human
aauuacagucggagcagcacug

SEQ ID NO: 514747 - RNA, 22 nt, Human
gccagcaguccugcugugugcc

SEQ ID NO: 514748 - RNA, 22 nt, Human
gcagcucuccucugugaggaac

SEQ ID NO: 514749 - RNA, 22 nt, Human
uaguaucuauuaguaacaagag

SEQ ID NO: 514750 - RNA, 22 nt, Human
ugggcucugugccagguuggug

SEQ ID NO: 514751 - RNA, 18 nt, Human
gcucugguuccuucaacc

SEQ ID NO: 514752 - RNA, 22 nt, Human
cagggccauuggcguggcuguc

SEQ ID NO: 514753 - RNA, 22 nt, Human
cagccaggagccucugcaacua

SEQ ID NO: 514754 - RNA, 22 nt, Human
ggugcaggcgguggggcaagua

SEQ ID NO: 514755 - RNA, 22 nt, Human
ucaacagaagugauagcuauua

SEQ ID NO: 514756 - RNA, 19 nt, Human
cuggaaggagggacuguuc

SEQ ID NO: 514757 - RNA, 21 nt, Human
aaauccaaacacuaguccaca

SEQ ID NO: 514758 - RNA, 22 nt, Human
ggccacacagaugacugcuuuc

SEQ ID NO: 514759 - RNA, 22 nt, Human
caaaguaauuuggagauauaua

SEQ ID NO: 514760 - RNA, 22 nt, Human
gcuugcuggugccugcaggcuc

SEQ ID NO: 514761 - RNA, 22 nt, Human
gcagcuuucuaagcuuuauugc

SEQ ID NO: 514762 - RNA, 22 nt, Human
guuuucaugucuauugggcaua

SEQ ID NO: 514763 - RNA, 22 nt, Human
gagcucauucauucauugccug

SEQ ID NO: 514764 - RNA, 22 nt, Human
cuggcuucugggccagggcaga

SEQ ID NO: 514765 - RNA, 22 nt, Human
aaauguucuaaauuacauguga

SEQ ID NO: 514766 - RNA, 22 nt, Human
cugaaugauauaagaucuuucu

SEQ ID NO: 514767 - RNA, 22 nt, Human
uggagucaguggcuauugggca

SEQ ID NO: 514768 - RNA, 22 nt, Human
agagcuguuaauuuugcacugg

SEQ ID NO: 514769 - RNA, 22 nt, Human
uuccugguuugccuggaaucca

SEQ ID NO: 514770 - RNA, 22 nt, Human
aggcugggcuccgcccaacucc

SEQ ID NO: 514771 - RNA, 22 nt, Human
ucuguaucacccguucccagaa

SEQ ID NO: 514772 - RNA, 22 nt, Human
aggcccuguccauggugcugaa

SEQ ID NO: 514773 - RNA, 22 nt, Human
caggacagguguucuagaucag

SEQ ID NO: 514774 - RNA, 22 nt, Human
gcaguguuuguguucucacaug

SEQ ID NO: 514775 - RNA, 22 nt, Human
uuuauuccaguguuucucaaau

SEQ ID NO: 514776 - RNA, 22 nt, Human
ccaggagucaauaaaggaagcu

SEQ ID NO: 514777 - RNA, 22 nt, Human
cccagcucucucaguucugcuu

SEQ ID NO: 514778 - RNA, 22 nt, Human
gagggcaguagccucguacccu

SEQ ID NO: 514779 - RNA, 22 nt, Human
ucagcagggcugggagcuguga

SEQ ID NO: 514780 - RNA, 20 nt, Human
cuuguugauucuaggaauga

SEQ ID NO: 514781 - RNA, 22 nt, Human
agccuccacagaugcaaagggc

SEQ ID NO: 514782 - RNA, 22 nt, Human
agaaauaugcugauuagaugaa

SEQ ID NO: 514783 - RNA, 22 nt, Human
ugggcagggaucucuuuugcaa

SEQ ID NO: 514784 - RNA, 22 nt, Human
gagcacugauuuauuuuugucu

SEQ ID NO: 514785 - RNA, 22 nt, Human
guugcugaaauuaauauuggag

SEQ ID NO: 514786 - RNA, 22 nt, Human
cuguggcuaugguguacauacu

SEQ ID NO: 514787 - RNA, 22 nt, Human
cuccccauccaggcagcaggug

SEQ ID NO: 514788 - RNA, 22 nt, Human
cagaugaagaucauagaauagu

SEQ ID NO: 514789 - RNA, 22 nt, Human
auuuaagauugcguauucaugu

SEQ ID NO: 514790 - RNA, 22 nt, Human
ugggcaaguaucggacucugag

SEQ ID NO: 514791 - RNA, 22 nt, Human
acugaaagauaaaucaguuagc

SEQ ID NO: 514792 - RNA, 22 nt, Human
guggcaggagacuggaagaugg

SEQ ID NO: 514793 - RNA, 22 nt, Human
agggagugguuaagaaggugca

SEQ ID NO: 514794 - RNA, 22 nt, Human
cauuuauuggcauguaguaggu

SEQ ID NO: 514795 - RNA, 22 nt, Human
gcuuuuauugucuuuacgacga

SEQ ID NO: 514796 - RNA, 21 nt, Human
ucucuggcgguguuuggcucc

SEQ ID NO: 514797 - RNA, 22 nt, Human
guggauggauuuugaggaaugg

SEQ ID NO: 514798 - RNA, 22 nt, Human
aaaguuuuagaacuaggaagca

SEQ ID NO: 514799 - RNA, 19 nt, Human
cccaacuugacuauuuucu

SEQ ID NO: 514800 - RNA, 22 nt, Human
uccucaggaugugggguagaau

SEQ ID NO: 514801 - RNA, 22 nt, Human
accugagggcccaaacuuggua

SEQ ID NO: 514802 - RNA, 22 nt, Human
uugugugguagcuucauugaac

SEQ ID NO: 514803 - RNA, 22 nt, Human
cccaggagguggagguugcagc

SEQ ID NO: 514804 - RNA, 22 nt, Human
uuuuaucugcuucauuaguuga

SEQ ID NO: 514805 - RNA, 22 nt, Human
ucuggggaugagguccagugau

SEQ ID NO: 514806 - RNA, 22 nt, Human
aaagucauguaaugauaugauu

SEQ ID NO: 514807 - RNA, 22 nt, Human
uguaggacauguacuuguaaca

SEQ ID NO: 514808 - RNA, 22 nt, Human
cucaggaggaggaaguucauug

SEQ ID NO: 514809 - RNA, 22 nt, Human
ugucccaggccucauguugcca

SEQ ID NO: 514810 - RNA, 22 nt, Human
uccugcugagcgucugucauuu

SEQ ID NO: 514811 - RNA, 22 nt, Human
uuuauguuugacaaugaucugg

SEQ ID NO: 514812 - RNA, 22 nt, Human
ucugggcuuggguagaaaucac

SEQ ID NO: 514813 - RNA, 22 nt, Human
cauugacaucaggcuuggccaa

SEQ ID NO: 514814 - RNA, 22 nt, Human
ccagcugcgggcaucgagaguu

SEQ ID NO: 514815 - RNA, 22 nt, Human
cuguccauuuucgugccuccuu

SEQ ID NO: 514816 - RNA, 20 nt, Human
ugacaaagaguaagaggagg

SEQ ID NO: 514817 - RNA, 22 nt, Human
caggcucuuuugguggcaagga

SEQ ID NO: 514818 - RNA, 22 nt, Human
gguggguauaguuagggccucu

SEQ ID NO: 514819 - RNA, 22 nt, Human
gcuggcagagacaagaagacua

SEQ ID NO: 514820 - RNA, 22 nt, Human
aguggcagagccaggguuggga

SEQ ID NO: 514821 - RNA, 22 nt, Human
ucacaggacccugaggguggcg

SEQ ID NO: 514822 - RNA, 22 nt, Human
uuugaacuucuccauucugaug

SEQ ID NO: 514823 - RNA, 22 nt, Human
cugggcugcagcgggagcgacg

SEQ ID NO: 514824 - RNA, 22 nt, Human
agccuaggucugggucuagcag

SEQ ID NO: 514825 - RNA, 22 nt, Human
caggucugugugccauuuccaa

SEQ ID NO: 514826 - RNA, 22 nt, Human
gacacagggacgugcucugccu

SEQ ID NO: 514827 - RNA, 22 nt, Human
ugggccacagcucacacaucca

SEQ ID NO: 514828 - RNA, 22 nt, Human
ucaguuuucucauuuaugagau

SEQ ID NO: 514829 - RNA, 22 nt, Human
aagacuugaccagguugaaggc

SEQ ID NO: 514830 - RNA, 22 nt, Human
uguggccaaaauaaaaugaggu

SEQ ID NO: 514831 - RNA, 22 nt, Human
cagggccucgaagccucugggc

SEQ ID NO: 514832 - RNA, 22 nt, Human
ucucaguccaaaugagagguug

SEQ ID NO: 514833 - RNA, 22 nt, Human
uauaauuuuaagugguaaauua

SEQ ID NO: 514834 - RNA, 22 nt, Human
caguuauuaugaggucauuagg

SEQ ID NO: 514835 - RNA, 22 nt, Human
gucuggagagcugagcagaguu

SEQ ID NO: 514836 - RNA, 22 nt, Human
uuggaaggggcagaguggcugc

SEQ ID NO: 514837 - RNA, 23 nt, Human
ugguccugccaacggugccccuc

SEQ ID NO: 514838 - RNA, 22 nt, Human
uaaguucaagucuuggauauaa

SEQ ID NO: 514839 - RNA, 22 nt, Human
caaauuacccucaacaucuaga

SEQ ID NO: 514840 - RNA, 22 nt, Human
cuguucaguaaccuauaaaaca

SEQ ID NO: 514841 - RNA, 22 nt, Human
cugggcacagcguugggcucuu

SEQ ID NO: 514842 - RNA, 22 nt, Human
aggcugugacagggucauggag

SEQ ID NO: 514843 - RNA, 20 nt, Human
cugagccaacucucuucuug

SEQ ID NO: 514844 - RNA, 22 nt, Human
cugagguguugaugaccuaugc

SEQ ID NO: 514845 - RNA, 22 nt, Human
ccugagggaaggaugcuaccca

SEQ ID NO: 514846 - RNA, 22 nt, Human
acauuugagaugccuuuuaggu

SEQ ID NO: 514847 - RNA, 22 nt, Human
uucagcuugaaucuggcuuuga

SEQ ID NO: 514848 - RNA, 22 nt, Human
gugcauauaugcacauaugugu

SEQ ID NO: 514849 - RNA, 18 nt, Human
cacaggaaggggaauauc

SEQ ID NO: 514850 - RNA, 22 nt, Human
ggagagcagggaggcugcucug

SEQ ID NO: 514851 - RNA, 22 nt, Human
ugauuaaauuaauuaagaugag

SEQ ID NO: 514852 - RNA, 22 nt, Human
ugucauugaggaaaacuaggug

SEQ ID NO: 514853 - RNA, 22 nt, Human
aucacaaaggcugcuucaugau

SEQ ID NO: 514854 - RNA, 22 nt, Human
ugcaaguaguccagccuuuggg

SEQ ID NO: 514855 - RNA, 22 nt, Human
cagauaacacaaagaaaugggc

SEQ ID NO: 514856 - RNA, 22 nt, Human
ggcagguagccuagaggagguu

SEQ ID NO: 514857 - RNA, 22 nt, Human
cagcuugggucaggugccugcu

SEQ ID NO: 514858 - RNA, 22 nt, Human
uaguuaaugcuaauuaacaaau

SEQ ID NO: 514859 - RNA, 22 nt, Human
ugcugccaagcccgugcuccug

SEQ ID NO: 514860 - RNA, 22 nt, Human
gcucagugagauauugacucca

SEQ ID NO: 514861 - RNA, 22 nt, Human
ugcugggcuaggguggagcucu

SEQ ID NO: 514862 - RNA, 22 nt, Human
agagcagcuggcugcaucuaga

SEQ ID NO: 514863 - RNA, 22 nt, Human
gccuggccgcuccgagcuccgc

SEQ ID NO: 514864 - RNA, 22 nt, Human
cugagcuguuuaaucccagaua

SEQ ID NO: 514865 - RNA, 19 nt, Human
gcucagagggcccugugcu

SEQ ID NO: 514866 - RNA, 22 nt, Human
uccaggucccuggggagauuuu

SEQ ID NO: 514867 - RNA, 22 nt, Human
ccuguucacugcacaguuuccg

SEQ ID NO: 514868 - RNA, 22 nt, Human
guaucacuuuugagagugagaa

SEQ ID NO: 514869 - RNA, 18 nt, Human
acccucuggcuucugagc

SEQ ID NO: 514870 - RNA, 22 nt, Human
ucagagcccugcuccuccccaa

SEQ ID NO: 514871 - RNA, 22 nt, Human
cucugaagggagggccaagccc

SEQ ID NO: 514872 - RNA, 22 nt, Human
aggccaccacccuaucuccugg

SEQ ID NO: 514873 - RNA, 22 nt, Human
ggcaagguacucuagagcacau

SEQ ID NO: 514874 - RNA, 22 nt, Human
uuuccuugccuccuguccuucu

SEQ ID NO: 514875 - RNA, 22 nt, Human
ucauuucucugagucugauaau

SEQ ID NO: 514876 - RNA, 22 nt, Human
gcucacagccggcuggcagggg

SEQ ID NO: 514877 - RNA, 22 nt, Human
gaggcuucccgcccaugcugga

SEQ ID NO: 514878 - RNA, 22 nt, Human
aaggaaaugagguugauggaug

SEQ ID NO: 514879 - RNA, 22 nt, Human
agguauaagucucauuucuguu

SEQ ID NO: 514880 - RNA, 16 nt, Human
ccugggcucuguugga

SEQ ID NO: 514881 - RNA, 22 nt, Human
cuggccugggagcugcuagcgu

SEQ ID NO: 514882 - RNA, 22 nt, Human
cuggauuuaauuaacuguugcu

SEQ ID NO: 514883 - RNA, 22 nt, Human
acucauguccuaggaguaaagc

SEQ ID NO: 514884 - RNA, 22 nt, Human
gcacaaagguggaaggaggaag

SEQ ID NO: 514885 - RNA, 19 nt, Human
uuucacaaagagagcguga

SEQ ID NO: 514886 - RNA, 21 nt, Human
ucagagagucacagugaacug

SEQ ID NO: 514887 - RNA, 21 nt, Human
gcugaagaacucuuuauuuuc

SEQ ID NO: 514888 - RNA, 22 nt, Human
uaggaaaaauacagaauuauau

SEQ ID NO: 514889 - RNA, 22 nt, Human
aguuuucuguucuacaauuuga

SEQ ID NO: 514890 - RNA, 22 nt, Human
ugagagugguucagcucagaag

SEQ ID NO: 514891 - RNA, 22 nt, Human
acagccuguuugaucuggugcu

SEQ ID NO: 514892 - RNA, 22 nt, Human
cccugccaaucccgucucucug

SEQ ID NO: 514893 - RNA, 22 nt, Human
ggcagcugguucuuuccauuaa

SEQ ID NO: 514894 - RNA, 22 nt, Human
cacauuucucuaccucacacaa

SEQ ID NO: 514895 - RNA, 22 nt, Human
ccagagccugcugagccccauu

SEQ ID NO: 514896 - RNA, 22 nt, Human
ucagaaauguaagcugaugacu

SEQ ID NO: 514897 - RNA, 22 nt, Human
uguuuguucccucucuuuccug

SEQ ID NO: 514898 - RNA, 22 nt, Human
agagaguuguaccacacucaua

SEQ ID NO: 514899 - RNA, 22 nt, Human
gccugcagggcccuuguggguc

SEQ ID NO: 514900 - RNA, 20 nt, Human
gccuggaggcagagauaaag

SEQ ID NO: 514901 - RNA, 22 nt, Human
acacuuuguuguggcauauacg

SEQ ID NO: 514902 - RNA, 22 nt, Human
aagcacagaaaaggagcaugga

SEQ ID NO: 514903 - RNA, 22 nt, Human
uguguauuucuggaacagacua

SEQ ID NO: 514904 - RNA, 22 nt, Human
ggcucaggaccugggauugcca

SEQ ID NO: 514905 - RNA, 19 nt, Human
ggcagaagguguaggggga

SEQ ID NO: 514906 - RNA, 22 nt, Human
aaguguguauuguuuaugcugc

SEQ ID NO: 514907 - RNA, 22 nt, Human
gcuucuauuauuuggagcugag

SEQ ID NO: 514908 - RNA, 22 nt, Human
cacugaaggcugcagcucagcc

SEQ ID NO: 514909 - RNA, 22 nt, Human
uacagagaguacagcauccaca

SEQ ID NO: 514910 - RNA, 22 nt, Human
caauauucaguggaaaagccau

SEQ ID NO: 514911 - RNA, 22 nt, Human
acacacuggcccccaguacuga

SEQ ID NO: 514912 - RNA, 22 nt, Human
gacaagacauugguaaagauau

SEQ ID NO: 514913 - RNA, 22 nt, Human
ucucuacagacacuguugacuu

SEQ ID NO: 514914 - RNA, 22 nt, Human
cccaucaggaacccaggagccc

SEQ ID NO: 514915 - RNA, 22 nt, Human
ugccugcuaggcccugcugggu

SEQ ID NO: 514916 - RNA, 20 nt, Human
cuuccacacaagaagcacag

SEQ ID NO: 514917 - RNA, 22 nt, Human
ccuuagcauggcugugcugugu

SEQ ID NO: 514918 - RNA, 22 nt, Human
ugagccaggcacugcuccugga

SEQ ID NO: 514919 - RNA, 22 nt, Human
cuguacauaaaggaauaggugu

SEQ ID NO: 514920 - RNA, 22 nt, Human
uuagcugacugugugauuuggc

SEQ ID NO: 514921 - RNA, 22 nt, Human
gggcacagaagucuaagacauc

SEQ ID NO: 514922 - RNA, 22 nt, Human
aagagcaucaaugacucgcagu

SEQ ID NO: 514923 - RNA, 22 nt, Human
gccaggucuaagcaucagccac

SEQ ID NO: 514924 - RNA, 22 nt, Human
cugaggugagcuucccugggcu

SEQ ID NO: 514925 - RNA, 22 nt, Human
gcagauggaaagugcuugaggg

SEQ ID NO: 514926 - RNA, 19 nt, Human
cucugggcaagucacuuaa

SEQ ID NO: 514927 - RNA, 22 nt, Human
uucucaguaugugacgaggacc

SEQ ID NO: 514928 - RNA, 22 nt, Human
gggagcuguaagggacagguag

SEQ ID NO: 514929 - RNA, 22 nt, Human
guuuagaauggcaaaauuaagu

SEQ ID NO: 514930 - RNA, 22 nt, Human
gcacacacuguuuuccucacau

SEQ ID NO: 514931 - RNA, 23 nt, Human
caacagcuguuagauaugggcuu

SEQ ID NO: 514932 - RNA, 22 nt, Human
uauuccaguccuauccucuuuu

SEQ ID NO: 514933 - RNA, 22 nt, Human
agcagcaagcagugcacggguu

SEQ ID NO: 514934 - RNA, 22 nt, Human
gcaaagcugggugugaaugcac

SEQ ID NO: 514935 - RNA, 22 nt, Human
agagauuugucaaugauuucca

SEQ ID NO: 514936 - RNA, 22 nt, Human
gagggcagaaaauuaugcggug

SEQ ID NO: 514937 - RNA, 22 nt, Human
cugcccugagucaugccagaug

SEQ ID NO: 514938 - RNA, 22 nt, Human
uguggccaggccccugauggug

SEQ ID NO: 514939 - RNA, 22 nt, Human
ggaacacugccuuuuauuuucc

SEQ ID NO: 514940 - RNA, 22 nt, Human
auaaaaguuuccaaucaugccu

SEQ ID NO: 514941 - RNA, 22 nt, Human
ucucaguguguugagaggucug

SEQ ID NO: 514942 - RNA, 22 nt, Human
ugucccagcagcuggguucucu

SEQ ID NO: 514943 - RNA, 22 nt, Human
agcuaggagauuuugugaggcu

SEQ ID NO: 514944 - RNA, 22 nt, Human
gaucucugaaucugaagccuuc

SEQ ID NO: 514945 - RNA, 22 nt, Human
ugaacuuagugggaauaucucu

SEQ ID NO: 514946 - RNA, 22 nt, Human
aguuucuugaagacugauguuu

SEQ ID NO: 514947 - RNA, 22 nt, Human
uugacagcaaagauugugccua

SEQ ID NO: 514948 - RNA, 22 nt, Human
cccugagaugccucacccuagu

SEQ ID NO: 514949 - RNA, 22 nt, Human
gacagccaugcacuucugcugu

SEQ ID NO: 514950 - RNA, 22 nt, Human
gccagcugaagggaagcuccug

SEQ ID NO: 514951 - RNA, 22 nt, Human
agcacagauaacauggagugga

SEQ ID NO: 514952 - RNA, 22 nt, Human
aacuagaacgucuaguugcugg

SEQ ID NO: 514953 - RNA, 22 nt, Human
uaaauucagugaguaauuucug

SEQ ID NO: 514954 - RNA, 22 nt, Human
cagcaggcccagaguuucaugg

SEQ ID NO: 514955 - RNA, 22 nt, Human
ccaguuuuuccagugcuuucug

SEQ ID NO: 514956 - RNA, 22 nt, Human
ugagccuguccugugcauguga

SEQ ID NO: 514957 - RNA, 22 nt, Human
cagagccaaaugcugugguuau

SEQ ID NO: 514958 - RNA, 20 nt, Human
aggcacuggauuucuuauau

SEQ ID NO: 514959 - RNA, 22 nt, Human
aaugaccucagagcacccagaa

SEQ ID NO: 514960 - RNA, 22 nt, Human
gaauuugugcucaggaagauua

SEQ ID NO: 514961 - RNA, 22 nt, Human
agugcaaauuauuuaccugauu

SEQ ID NO: 514962 - RNA, 22 nt, Human
auaaggcagaaaugauucuagu

SEQ ID NO: 514963 - RNA, 22 nt, Human
gccaggaguucagaugcauguu

SEQ ID NO: 514964 - RNA, 22 nt, Human
agucuggggucugguagaacga

SEQ ID NO: 514965 - RNA, 21 nt, Human
gccagggaagagaguuggcug

SEQ ID NO: 514966 - RNA, 22 nt, Human
cccuuuaaguagaauauauuau

SEQ ID NO: 514967 - RNA, 21 nt, Human
uggacuggugaguuuaggcug

SEQ ID NO: 514968 - RNA, 22 nt, Human
uguuuagaugcaaagucucaca

SEQ ID NO: 514969 - RNA, 22 nt, Human
ccagcucugauuuugaccucca

SEQ ID NO: 514970 - RNA, 20 nt, Human
acaguguuuuugaguagagc

SEQ ID NO: 514971 - RNA, 22 nt, Human
cagaugaggggcauauaacaau

SEQ ID NO: 514972 - RNA, 22 nt, Human
ucuggggaugaggaccuagaug

SEQ ID NO: 514973 - RNA, 22 nt, Human
gaauuugaaaagugaugggaau

SEQ ID NO: 514974 - RNA, 21 nt, Human
ucugggcuuucuuauaaggca

SEQ ID NO: 514975 - RNA, 22 nt, Human
caguacuuauuucuauuuaggg

SEQ ID NO: 514976 - RNA, 22 nt, Human
ccagcucugcauguuucccuug

SEQ ID NO: 514977 - RNA, 22 nt, Human
acagcugugaaaauccacagga

SEQ ID NO: 514978 - RNA, 22 nt, Human
ucaaagagcuauucaguugugg

SEQ ID NO: 514979 - RNA, 22 nt, Human
gccucaggacuggcauacucau

SEQ ID NO: 514980 - RNA, 22 nt, Human
aaugaagcaguuuucaucaagu

SEQ ID NO: 514981 - RNA, 22 nt, Human
guuccuuguauuucagacauga

SEQ ID NO: 514982 - RNA, 22 nt, Human
uugaaugagaaguuauugccau

SEQ ID NO: 514983 - RNA, 22 nt, Human
ugccucagaguugucccuacca

SEQ ID NO: 514984 - RNA, 22 nt, Human
cacauguacagaagcaggcugg

SEQ ID NO: 514985 - RNA, 22 nt, Human
aaauuagaaauacuuucaaagc

SEQ ID NO: 514986 - RNA, 22 nt, Human
uuccuucucagcccucgaggau

SEQ ID NO: 514987 - RNA, 19 nt, Human
auuucaagagguuuauugg

SEQ ID NO: 514988 - RNA, 22 nt, Human
guaagcaucugucucuucugca

SEQ ID NO: 514989 - RNA, 22 nt, Human
ggucauugaaaucagaaggguu

SEQ ID NO: 514990 - RNA, 22 nt, Human
uucucaaggacaaaaugacaug

SEQ ID NO: 514991 - RNA, 22 nt, Human
ucagguccuuuugguguauauu

SEQ ID NO: 514992 - RNA, 22 nt, Human
caauucaauggcaaaguauugu

SEQ ID NO: 514993 - RNA, 22 nt, Human
cagaaauggagcccaggaaucu

SEQ ID NO: 514994 - RNA, 20 nt, Human
ggguccugacuuggucuccu

SEQ ID NO: 514995 - RNA, 22 nt, Human
uaugcuuuacuuuucauuguga

SEQ ID NO: 514996 - RNA, 22 nt, Human
aggcagcaugcucugcuucuac

SEQ ID NO: 514997 - RNA, 22 nt, Human
ucagcauaucuugagcuucaug

SEQ ID NO: 514998 - RNA, 22 nt, Human
cagagacaaccugguagagaaa

SEQ ID NO: 514999 - RNA, 19 nt, Human
ccuguucaugacucugucc

SEQ ID NO: 515000 - RNA, 22 nt, Human
ccacagguacggauugaggacc

SEQ ID NO: 515001 - RNA, 22 nt, Human
ccugcagggugcugccacagau

SEQ ID NO: 515002 - RNA, 22 nt, Human
uggaagggagugacagucagag

SEQ ID NO: 515003 - RNA, 22 nt, Human
acagaacugcaggaggaaaagc

SEQ ID NO: 515004 - RNA, 22 nt, Human
uuguauuuccuauaaccuuucu

SEQ ID NO: 515005 - RNA, 22 nt, Human
gcagagaggauauuauugucca

SEQ ID NO: 515006 - RNA, 22 nt, Human
gcucugggaaggaucguaguga

SEQ ID NO: 515007 - RNA, 22 nt, Human
gaaguucaggugggaauugagc

SEQ ID NO: 515008 - RNA, 18 nt, Human
cuuucagauggauaugcu

SEQ ID NO: 515009 - RNA, 22 nt, Human
gagucacauuaauuuaauuuua

SEQ ID NO: 515010 - RNA, 22 nt, Human
gggggcuagagagaugaaauau

SEQ ID NO: 515011 - RNA, 22 nt, Human
aaaguccagggaaagagcgucu

SEQ ID NO: 515012 - RNA, 18 nt, Human
aggcccuggccucgaaca

SEQ ID NO: 515013 - RNA, 22 nt, Human
uggcuugucauguaucugaggc

SEQ ID NO: 515014 - RNA, 22 nt, Human
gcuggcucuuuuugccgggcuc

SEQ ID NO: 515015 - RNA, 22 nt, Human
agggcuuugcaaugcacagugg

SEQ ID NO: 515016 - RNA, 22 nt, Human
aagguacaaaguauuauuuaaa

SEQ ID NO: 515017 - RNA, 23 nt, Human
uccagggcaguggcugggucugc

SEQ ID NO: 515018 - RNA, 22 nt, Human
ucagcacaggucuugcaaaaca

SEQ ID NO: 515019 - RNA, 22 nt, Human
uggaagggaacagguggguguu

SEQ ID NO: 515020 - RNA, 22 nt, Human
acaggacauguaccaggugguc

SEQ ID NO: 515021 - RNA, 22 nt, Human
cugggagcugucaggagcgugu

SEQ ID NO: 515022 - RNA, 22 nt, Human
gaggaaagaaccccagucaaua

SEQ ID NO: 515023 - RNA, 22 nt, Human
gucagggcacagugacagcucc

SEQ ID NO: 515024 - RNA, 22 nt, Human
uccuggccuugcuccugaugcc

SEQ ID NO: 515025 - RNA, 22 nt, Human
uacugccuggagcauuggugcu

SEQ ID NO: 515026 - RNA, 22 nt, Human
ugcagugguguccagguguacu

SEQ ID NO: 515027 - RNA, 22 nt, Human
uaaugagaauucuuuuugggua

SEQ ID NO: 515028 - RNA, 22 nt, Human
aaccagagaaauggagugauaa

SEQ ID NO: 515029 - RNA, 22 nt, Human
ugggcuccggcggccucaggcu

SEQ ID NO: 515030 - RNA, 22 nt, Human
gcugaggccccagggugauggg

SEQ ID NO: 515031 - RNA, 22 nt, Human
ucuguggcuuccuauuucuugg

SEQ ID NO: 515032 - RNA, 22 nt, Human
uccugaggacccugucaggggc

SEQ ID NO: 515033 - RNA, 22 nt, Human
ucacucuggaguccgcuaccag

SEQ ID NO: 515034 - RNA, 22 nt, Human
cucugggccaccgcugguguau

SEQ ID NO: 515035 - RNA, 22 nt, Human
aggucuggagugggaucugaga

SEQ ID NO: 515036 - RNA, 22 nt, Human
guacaacaggauugauguacca

SEQ ID NO: 515037 - RNA, 22 nt, Human
gaugguuuggaaugaaguagcu

SEQ ID NO: 515038 - RNA, 22 nt, Human
aguguuccugcucucaggaagc

SEQ ID NO: 515039 - RNA, 22 nt, Human
ugucagagagcaggcaguagaa

SEQ ID NO: 515040 - RNA, 22 nt, Human
gagcacccuuugcacaucaguc

SEQ ID NO: 515041 - RNA, 22 nt, Human
cuuugugauaguguuaagacca

SEQ ID NO: 515042 - RNA, 22 nt, Human
uccaggucaucuuggagagcug

SEQ ID NO: 515043 - RNA, 22 nt, Human
gggcucucaaggcagggcccca

SEQ ID NO: 515044 - RNA, 20 nt, Human
caguccugccccuuggggac

SEQ ID NO: 515045 - RNA, 22 nt, Human
uccuggcucgauugcuaccaau

SEQ ID NO: 515046 - RNA, 22 nt, Human
acuggcugcgggguggaagaag

SEQ ID NO: 515047 - RNA, 22 nt, Human
cuagaaauacaggcacgugcca

SEQ ID NO: 515048 - RNA, 22 nt, Human
ucccuggguccugcuugcucuc

SEQ ID NO: 515049 - RNA, 22 nt, Human
uuucaacaucaccuagcaguuc

SEQ ID NO: 515050 - RNA, 22 nt, Human
ucugcccacugcucugcugccc

SEQ ID NO: 515051 - RNA, 22 nt, Human
augucuuuauaaauguauaaug

SEQ ID NO: 515052 - RNA, 22 nt, Human
acagaaauugcuaauagcucau

SEQ ID NO: 515053 - RNA, 22 nt, Human
ccuaagaauuaaugaauacacc

SEQ ID NO: 515054 - RNA, 22 nt, Human
acuggcagcuguaggaugcaug

SEQ ID NO: 515055 - RNA, 22 nt, Human
gagcugugagggacacauugcu

SEQ ID NO: 515056 - RNA, 22 nt, Human
ccuucaaguuccuggucccugg

SEQ ID NO: 515057 - RNA, 22 nt, Human
uaggaagguguuuuuaaggagc

SEQ ID NO: 515058 - RNA, 22 nt, Human
ccucugggcagguagcagcagc

SEQ ID NO: 515059 - RNA, 20 nt, Human
ucacauccucucccaacaug

SEQ ID NO: 515060 - RNA, 22 nt, Human
ucugggcuggugcucaugaauu

SEQ ID NO: 515061 - RNA, 22 nt, Human
gcagggcuguucaggagggugg

SEQ ID NO: 515062 - RNA, 22 nt, Human
ccaggagucuggaugagguguc

SEQ ID NO: 515063 - RNA, 22 nt, Human
agugauggugagugagaagcuc

SEQ ID NO: 515064 - RNA, 22 nt, Human
augauggugagguugagcacag

SEQ ID NO: 515065 - RNA, 22 nt, Human
ucuggcucucauacucgccagu

SEQ ID NO: 515066 - RNA, 22 nt, Human
cagaauuuuucgaauguacugu

SEQ ID NO: 515067 - RNA, 22 nt, Human
cuuuucacaggaggauaagccc

SEQ ID NO: 515068 - RNA, 18 nt, Human
ggaaggaguggaccccag

SEQ ID NO: 515069 - RNA, 22 nt, Human
ucuuccagcaaugugaaaucac

SEQ ID NO: 515070 - RNA, 22 nt, Human
uugaaagaagaagcugcgaugu

SEQ ID NO: 515071 - RNA, 22 nt, Human
ucacaggaaccaucagagaaau

SEQ ID NO: 515072 - RNA, 22 nt, Human
agguccaggccucaugauggcc

SEQ ID NO: 515073 - RNA, 22 nt, Human
ucagagugaggcgucaacauga

SEQ ID NO: 515074 - RNA, 20 nt, Human
aaacagcuaaaccagcucuc

SEQ ID NO: 515075 - RNA, 22 nt, Human
auagguccaaggagaggucuuu

SEQ ID NO: 515076 - RNA, 22 nt, Human
uuaaacaguguuucaugugggg

SEQ ID NO: 515077 - RNA, 22 nt, Human
uucucugcagcuuaggcccagu

SEQ ID NO: 515078 - RNA, 22 nt, Human
agucccagccuaggcugugcug

SEQ ID NO: 515079 - RNA, 22 nt, Human
ugggagaacccagggucaggcu

SEQ ID NO: 515080 - RNA, 22 nt, Human
uacagggguaacaguggggaau

SEQ ID NO: 515081 - RNA, 22 nt, Human
ggaggccaaggcaggcggauca

SEQ ID NO: 515082 - RNA, 22 nt, Human
agcagccaaaugaagauuuuac

SEQ ID NO: 515083 - RNA, 22 nt, Human
ucagagaggauuuuaauaagug

SEQ ID NO: 515084 - RNA, 22 nt, Human
ugcagcucauugguguccuggu

SEQ ID NO: 515085 - RNA, 23 nt, Human
aaguagauaacacuguucugaga

SEQ ID NO: 515086 - RNA, 22 nt, Human
uaauuuaauccaaguguuacau

SEQ ID NO: 515087 - RNA, 22 nt, Human
ugcccuggcuggagugcagugg

SEQ ID NO: 515088 - RNA, 22 nt, Human
ucuggggaugagugaugucgua

SEQ ID NO: 515089 - RNA, 22 nt, Human
gcagggguuuucugacuugagu

SEQ ID NO: 515090 - RNA, 22 nt, Human
gaacccaguccaggugcagccu

SEQ ID NO: 515091 - RNA, 22 nt, Human
ucucuuuuauguacacccugac

SEQ ID NO: 515092 - RNA, 23 nt, Human
cccagcgcugagcccugcaggca

SEQ ID NO: 515093 - RNA, 22 nt, Human
cucuuugugcuauuaugauccu

SEQ ID NO: 515094 - RNA, 22 nt, Human
ggcacugggagaggugagacgg

SEQ ID NO: 515095 - RNA, 22 nt, Human
cacugauuaagucugcuagagg

SEQ ID NO: 515096 - RNA, 22 nt, Human
ugcccuuggguaacuugcugau

SEQ ID NO: 515097 - RNA, 22 nt, Human
uaagcauaacuaaaaaugauuu

SEQ ID NO: 515098 - RNA, 22 nt, Human
uaauuucuaauucauuuucagu

SEQ ID NO: 515099 - RNA, 22 nt, Human
uacuuccuguuuccaugucugu

SEQ ID NO: 515100 - RNA, 22 nt, Human
gugucacaugguuuacugcagc

SEQ ID NO: 515101 - RNA, 22 nt, Human
agugaccauuuucagcuagagg

SEQ ID NO: 515102 - RNA, 20 nt, Human
aacuuguucuaccuguuuca

SEQ ID NO: 515103 - RNA, 19 nt, Human
ugugauaagcagaauucca

SEQ ID NO: 515104 - RNA, 19 nt, Human
agugcagggagcacccuca

SEQ ID NO: 515105 - RNA, 22 nt, Human
uuuggaauuaugcuuaaaguuu

SEQ ID NO: 515106 - RNA, 22 nt, Human
ggccagggaggagaggccccug

SEQ ID NO: 515107 - RNA, 22 nt, Human
uggcaccugaacuuagaggugu

SEQ ID NO: 515108 - RNA, 20 nt, Human
uaucaaucagaaagaagacu

SEQ ID NO: 515109 - RNA, 19 nt, Human
ccagagucaugucuccccc

SEQ ID NO: 515110 - RNA, 22 nt, Human
cauuacauuucaaaauguuucc

SEQ ID NO: 515111 - RNA, 22 nt, Human
ccugcagguccccggaugcgca

SEQ ID NO: 515112 - RNA, 22 nt, Human
cccucugcugccuggcuggguc

SEQ ID NO: 515113 - RNA, 22 nt, Human
ucaggaucggccuuuuuuuaag

SEQ ID NO: 515114 - RNA, 22 nt, Human
acauucauuccaggucagucag

SEQ ID NO: 515115 - RNA, 22 nt, Human
ggcacagggggcugaggacuag

SEQ ID NO: 515116 - RNA, 22 nt, Human
aggugagugugacugcaagaga

SEQ ID NO: 515117 - RNA, 22 nt, Human
aucuccaggcauuucaagagac

SEQ ID NO: 515118 - RNA, 18 nt, Human
cccagcuuagcgccccuc

SEQ ID NO: 515119 - RNA, 22 nt, Human
guccugggcaugcagggcuuuc

SEQ ID NO: 515120 - RNA, 22 nt, Human
gagcugaaucagagauauuauu

SEQ ID NO: 515121 - RNA, 22 nt, Human
aggucaagggcaagagugaggu

SEQ ID NO: 515122 - RNA, 17 nt, Human
gcagccagugcagcagg

SEQ ID NO: 515123 - RNA, 22 nt, Human
gcuacagacugagcauggcucu

SEQ ID NO: 515124 - RNA, 22 nt, Human
uggcugggggugcuauagcugc

SEQ ID NO: 515125 - RNA, 22 nt, Human
augugaaacugaagcauccaua

SEQ ID NO: 515126 - RNA, 22 nt, Human
gcagagccaggagcccaggauc

SEQ ID NO: 515127 - RNA, 22 nt, Human
ucccuguccugggcaaucccag

SEQ ID NO: 515128 - RNA, 22 nt, Human
ccugccaggcuuugggcuucug

SEQ ID NO: 515129 - RNA, 22 nt, Human
ugauauuuuaugagcuuucaua

SEQ ID NO: 515130 - RNA, 21 nt, Human
agggccagaucaccaaggagc

SEQ ID NO: 515131 - RNA, 22 nt, Human
gaaaucugcuucuugcauagua

SEQ ID NO: 515132 - RNA, 22 nt, Human
auagggccuaaaaaguauugcu

SEQ ID NO: 515133 - RNA, 22 nt, Human
guauuugauacaugaaauggug

SEQ ID NO: 515134 - RNA, 22 nt, Human
uaaaugcagcaguuucuguucu

SEQ ID NO: 515135 - RNA, 23 nt, Human
gguaccagcacagaguggagagg

SEQ ID NO: 515136 - RNA, 22 nt, Human
accaggaguuuugaccaggggc

SEQ ID NO: 515137 - RNA, 22 nt, Human
gcucugggccauccuggccggg

SEQ ID NO: 515138 - RNA, 22 nt, Human
auugaaagauaggcuacugugg

SEQ ID NO: 515139 - RNA, 22 nt, Human
cugcagggugacguugcccacc

SEQ ID NO: 515140 - RNA, 21 nt, Human
ccagagccugcugagcccccu

SEQ ID NO: 515141 - RNA, 20 nt, Human
ccucaagcagacugacagcu

SEQ ID NO: 515142 - RNA, 22 nt, Human
gauuuauuggucuuucauuggu

SEQ ID NO: 515143 - RNA, 22 nt, Human
ggcuuuauuaagcaggguaagu

SEQ ID NO: 515144 - RNA, 22 nt, Human
aagcuuucagagcagaauguga

SEQ ID NO: 515145 - RNA, 22 nt, Human
cagguccacggcgcccaggggu

SEQ ID NO: 515146 - RNA, 22 nt, Human
agcugucagugcugugccugua

SEQ ID NO: 515147 - RNA, 22 nt, Human
cauacuuugggauaagagugga

SEQ ID NO: 515148 - RNA, 22 nt, Human
acauucugucaacagugagcag

SEQ ID NO: 515149 - RNA, 22 nt, Human
ucucagaguuuacggggcugaa

SEQ ID NO: 515150 - RNA, 22 nt, Human
ucccagcagcauagcucagaau

SEQ ID NO: 515151 - RNA, 22 nt, Human
ucucuuuaaguauaaucuuaua

SEQ ID NO: 515152 - RNA, 21 nt, Human
ugaaacaaucagacagagucu

SEQ ID NO: 515153 - RNA, 22 nt, Human
caucagagugguggccuggugu

SEQ ID NO: 515154 - RNA, 22 nt, Human
aaauugugcucacacugauauu

SEQ ID NO: 515155 - RNA, 22 nt, Human
aaaagcaaggcagucugucuga

SEQ ID NO: 515156 - RNA, 22 nt, Human
ugaaagcucugucaucauuccu

SEQ ID NO: 515157 - RNA, 22 nt, Human
cuggcuuguuuuaagaauacaa

SEQ ID NO: 515158 - RNA, 22 nt, Human
agaggcccugggcuggugugcu

SEQ ID NO: 515159 - RNA, 22 nt, Human
uuucaaauggagucgugaaaug

SEQ ID NO: 515160 - RNA, 21 nt, Human
agcuggugucagagcucuggg

SEQ ID NO: 515161 - RNA, 22 nt, Human
uucuaagcucugaaauaaaucu

SEQ ID NO: 515162 - RNA, 22 nt, Human
ggaccagagaagugagcaccug

SEQ ID NO: 515163 - RNA, 22 nt, Human
uagccacaugcagacuuucaug

SEQ ID NO: 515164 - RNA, 18 nt, Human
acauuucuaggugaaagc

SEQ ID NO: 515165 - RNA, 22 nt, Human
auuuagaacuuuguuugccaau

SEQ ID NO: 515166 - RNA, 22 nt, Human
gcuggccauggccugcgccauc

SEQ ID NO: 515167 - RNA, 22 nt, Human
ccagcuggcccagcugugcucc

SEQ ID NO: 515168 - RNA, 22 nt, Human
uggcagaaguucacuaguagcu

SEQ ID NO: 515169 - RNA, 22 nt, Human
cacaggagcuguggggcagugu

SEQ ID NO: 515170 - RNA, 22 nt, Human
uccacagggauguugaguucuu

SEQ ID NO: 515171 - RNA, 22 nt, Human
ugcugagucguauuauuuuuua

SEQ ID NO: 515172 - RNA, 22 nt, Human
uacuguguggugagcugucucc

SEQ ID NO: 515173 - RNA, 22 nt, Human
ugggcuccuugggagcaaguga

SEQ ID NO: 515174 - RNA, 22 nt, Human
uacagaaaaacaucuggagccg

SEQ ID NO: 515175 - RNA, 22 nt, Human
auuucagcagcccauguuugga

SEQ ID NO: 515176 - RNA, 22 nt, Human
augguuuguaacccaauacucc

SEQ ID NO: 515177 - RNA, 22 nt, Human
gugcugaagugaaauucaucaa

SEQ ID NO: 515178 - RNA, 22 nt, Human
ucuggccccggucuucacagcu

SEQ ID NO: 515179 - RNA, 22 nt, Human
gccucugcccauccaccaucag

SEQ ID NO: 515180 - RNA, 22 nt, Human
ggccaaggaugguggcucuggu

SEQ ID NO: 515181 - RNA, 22 nt, Human
ugcagguggauucaauguggga

SEQ ID NO: 515182 - RNA, 22 nt, Human
ggcuucugaaccaggcccugga

SEQ ID NO: 515183 - RNA, 22 nt, Human
gcacagaggaugaggcagcucu

SEQ ID NO: 515184 - RNA, 22 nt, Human
auguucuaaucccugcuaugua

SEQ ID NO: 515185 - RNA, 22 nt, Human
ucacagacuguguugcuacuca

SEQ ID NO: 515186 - RNA, 22 nt, Human
uccagcuggggacaugggcuuc

SEQ ID NO: 515187 - RNA, 18 nt, Human
uaaauauauuucccccuu

SEQ ID NO: 515188 - RNA, 22 nt, Human
caugagaagguuuuggcauaua

SEQ ID NO: 515189 - RNA, 22 nt, Human
uauuuugcaaaccugaguuuga

SEQ ID NO: 515190 - RNA, 22 nt, Human
uguggaauauuagauuagguug

SEQ ID NO: 515191 - RNA, 22 nt, Human
caggugggagcggagacugauu

SEQ ID NO: 515192 - RNA, 22 nt, Human
ugcaaguaugacagccccaugg

SEQ ID NO: 515193 - RNA, 22 nt, Human
gucucccaucguuugugaggaa

SEQ ID NO: 515194 - RNA, 22 nt, Human
uugcauugaaugcacauuuuua

SEQ ID NO: 515195 - RNA, 22 nt, Human
ugagcagaacacgggauccaug

SEQ ID NO: 515196 - RNA, 22 nt, Human
ugagaaggcucaggcuuagaga

SEQ ID NO: 515197 - RNA, 22 nt, Human
auagaaaacagauguccuuaaa

SEQ ID NO: 515198 - RNA, 22 nt, Human
agugugagcccuggaguggugc

SEQ ID NO: 515199 - RNA, 22 nt, Human
cucagaguucuccugggaggug

SEQ ID NO: 515200 - RNA, 22 nt, Human
ugcuuuauuuauaaaauagcaa

SEQ ID NO: 515201 - RNA, 23 nt, Human
aagaggaggcccugcucccgucc

SEQ ID NO: 515202 - RNA, 22 nt, Human
caugugugaguauaucuuaucc

SEQ ID NO: 515203 - RNA, 22 nt, Human
cuguggcugugaaacuucucag

SEQ ID NO: 515204 - RNA, 22 nt, Human
ucucuggcacauaauaaggucu

SEQ ID NO: 515205 - RNA, 22 nt, Human
uauugaaauucuucauguccuc

SEQ ID NO: 515206 - RNA, 22 nt, Human
aagcagcauaauugcuauuuua

SEQ ID NO: 515207 - RNA, 22 nt, Human
guuuauaaauucugcuuuuguu

SEQ ID NO: 515208 - RNA, 22 nt, Human
gccagugugguguagucaugaa

SEQ ID NO: 515209 - RNA, 22 nt, Human
ggcagcuggguuggccagaaac

SEQ ID NO: 515210 - RNA, 22 nt, Human
ggcuccaagucucagagugaag

SEQ ID NO: 515211 - RNA, 22 nt, Human
gcauggccaggaaagguagaaa

SEQ ID NO: 515212 - RNA, 22 nt, Human
uggcagaaugaagacuggggcc

SEQ ID NO: 515213 - RNA, 22 nt, Human
caauguaucaaccagaaaguuc

SEQ ID NO: 515214 - RNA, 22 nt, Human
ggcugggcaaacaagacucuuc

SEQ ID NO: 515215 - RNA, 22 nt, Human
uuucuuccuuaccuuacuagag

SEQ ID NO: 515216 - RNA, 22 nt, Human
ccaggccaaauucagucagcag

SEQ ID NO: 515217 - RNA, 22 nt, Human
aaggggaaguagcaccagaggu

SEQ ID NO: 515218 - RNA, 22 nt, Human
ugcugcuccccagcacacagca

SEQ ID NO: 515219 - RNA, 22 nt, Human
ucuggccuacuggaguccauga

SEQ ID NO: 515220 - RNA, 22 nt, Human
auucagucaaaaaugauggaga

SEQ ID NO: 515221 - RNA, 22 nt, Human
augggguggaguccgggcagcg

SEQ ID NO: 515222 - RNA, 20 nt, Human
cgcccagugcgguucugacc

SEQ ID NO: 515223 - RNA, 22 nt, Human
agucccagaucuacaggaggga

SEQ ID NO: 515224 - RNA, 22 nt, Human
agggcagcuagcuguagaaaga

SEQ ID NO: 515225 - RNA, 22 nt, Human
ucagucucuggggcuucuguuu

SEQ ID NO: 515226 - RNA, 22 nt, Human
accaggcaguauggugcugcaa

SEQ ID NO: 515227 - RNA, 18 nt, Human
ucucuuuuccccucauug

SEQ ID NO: 515228 - RNA, 22 nt, Human
uuugcauuguuucaaaagugaa

SEQ ID NO: 515229 - RNA, 22 nt, Human
agcuccugggccaagcccaugc

SEQ ID NO: 515230 - RNA, 22 nt, Human
auuccuugggaauuauugaaug

SEQ ID NO: 515231 - RNA, 22 nt, Human
gucauuuuucacugcauauaga

SEQ ID NO: 515232 - RNA, 22 nt, Human
ugaaaucuucacuaagucucuu

SEQ ID NO: 515233 - RNA, 22 nt, Human
agggcccuagggaaugagacau

SEQ ID NO: 515234 - RNA, 21 nt, Human
uucaagauauuuaaaaggugg

SEQ ID NO: 515235 - RNA, 20 nt, Human
uggagccaaggugugucugg

SEQ ID NO: 515236 - RNA, 17 nt, Human
agcaaaaguaucaaagc

SEQ ID NO: 515237 - RNA, 22 nt, Human
ugggccaggauuucaagacccu

SEQ ID NO: 515238 - RNA, 22 nt, Human
uggagccaugccuggccuuucc

SEQ ID NO: 515239 - RNA, 22 nt, Human
caggggcuagcacuuaauguuu

SEQ ID NO: 515240 - RNA, 22 nt, Human
cagggcuucuuggcauuugcug

SEQ ID NO: 515241 - RNA, 22 nt, Human
gggcccuggauuuaagcaugga

SEQ ID NO: 515242 - RNA, 22 nt, Human
ucugagaguccaucuccaagcc

SEQ ID NO: 515243 - RNA, 22 nt, Human
agaaaagggcaggagggauaca

SEQ ID NO: 515244 - RNA, 22 nt, Human
ggagccuguggccgucacgacu

SEQ ID NO: 515245 - RNA, 22 nt, Human
ugauuuuuagcuauucugaaga

SEQ ID NO: 515246 - RNA, 22 nt, Human
uccagugguuugaaaggggugu

SEQ ID NO: 515247 - RNA, 22 nt, Human
ucugaagguugagaagggcuga

SEQ ID NO: 515248 - RNA, 19 nt, Human
ucacaggcaucuccccaga

SEQ ID NO: 515249 - RNA, 22 nt, Human
gcacagggccuggcacauaaga

SEQ ID NO: 515250 - RNA, 22 nt, Human
gcugccagcucacucuccugag

SEQ ID NO: 515251 - RNA, 22 nt, Human
aagcaauauacugauaugauua

SEQ ID NO: 515252 - RNA, 22 nt, Human
agccagcaugaagacagaggcc

SEQ ID NO: 515253 - RNA, 22 nt, Human
cugaaggacacgugaggagcca

SEQ ID NO: 515254 - RNA, 22 nt, Human
ccuggagcaaaaaucuaaggag

SEQ ID NO: 515255 - RNA, 17 nt, Human
ucaugcccaacuauuac

SEQ ID NO: 515256 - RNA, 22 nt, Human
cuuagcuuuguuuaacacaggg

SEQ ID NO: 515257 - RNA, 22 nt, Human
aggagcuaauucauaagccacu

SEQ ID NO: 515258 - RNA, 20 nt, Human
caccaggcgcucugagaaca

SEQ ID NO: 515259 - RNA, 22 nt, Human
ggcaaggccuugcccagcauuc

SEQ ID NO: 515260 - RNA, 22 nt, Human
gucccuggaauggacucugcgc

SEQ ID NO: 515261 - RNA, 22 nt, Human
ucuucuguuuuagauugcauac

SEQ ID NO: 515262 - RNA, 22 nt, Human
uugacaaaggaccuugcuauuu

SEQ ID NO: 515263 - RNA, 22 nt, Human
uucaggugucaaggauaggcug

SEQ ID NO: 515264 - RNA, 22 nt, Human
ugcuggggagugauugaccauc

SEQ ID NO: 515265 - RNA, 22 nt, Human
uaaacagccuaaaacuuucuuu

SEQ ID NO: 515266 - RNA, 22 nt, Human
caugcauuccuccucugccuua

SEQ ID NO: 515267 - RNA, 22 nt, Human
ugcagcaguuuaaugcaggguu

SEQ ID NO: 515268 - RNA, 17 nt, Human
uagcugccccgaaugcu

SEQ ID NO: 515269 - RNA, 22 nt, Human
uugagcuugaggaguuauuuga

SEQ ID NO: 515270 - RNA, 22 nt, Human
caagagcuggguggcaagcuag

SEQ ID NO: 515271 - RNA, 22 nt, Human
cugggcugugguguggcccaaa

SEQ ID NO: 515272 - RNA, 22 nt, Human
gcugaaggaggcucugguacua

SEQ ID NO: 515273 - RNA, 22 nt, Human
cagagcuggcucugcauguaca

SEQ ID NO: 515274 - RNA, 22 nt, Human
aaaucucaauuugaauuguagc

SEQ ID NO: 515275 - RNA, 22 nt, Human
agcccugggcagccaaggaagc

SEQ ID NO: 515276 - RNA, 22 nt, Human
uggccucugcaauggauucacc

SEQ ID NO: 515277 - RNA, 22 nt, Human
ucuguggcuugggccugccugu

SEQ ID NO: 515278 - RNA, 22 nt, Human
cucaugauguagcgaaugagaa

SEQ ID NO: 515279 - RNA, 20 nt, Human
agcaguuuccuaacucagcu

SEQ ID NO: 515280 - RNA, 22 nt, Human
acagccagggcauugucgccga

SEQ ID NO: 515281 - RNA, 21 nt, Human
uuggccuuugucucagacacu

SEQ ID NO: 515282 - RNA, 22 nt, Human
ccuguucaagguauuaauuauc

SEQ ID NO: 515283 - RNA, 20 nt, Human
uccagggcuagggagcucau

SEQ ID NO: 515284 - RNA, 22 nt, Human
uucaagaucuuccaaaggauac

SEQ ID NO: 515285 - RNA, 17 nt, Human
agguggguggaucaccu

SEQ ID NO: 515286 - RNA, 22 nt, Human
gcuacaaacugucauggugcuu

SEQ ID NO: 515287 - RNA, 23 nt, Human
uggcagagacccagaaucuacau

SEQ ID NO: 515288 - RNA, 22 nt, Human
agauuucccaaauacuuguuau

SEQ ID NO: 515289 - RNA, 22 nt, Human
ggggaccuucccagagcaguug

SEQ ID NO: 515290 - RNA, 22 nt, Human
uuagggacaaauuugcagaacc

SEQ ID NO: 515291 - RNA, 22 nt, Human
guccugaggcaggauggguuuc

SEQ ID NO: 515292 - RNA, 21 nt, Human
agguggggcugcaccucugcu

SEQ ID NO: 515293 - RNA, 22 nt, Human
ccacagcaugcaggccugacac

SEQ ID NO: 515294 - RNA, 22 nt, Human
gcuggcucccauugguccuucc

SEQ ID NO: 515295 - RNA, 22 nt, Human
gauuucaccugaucuugucauc

SEQ ID NO: 515296 - RNA, 22 nt, Human
cacugggcaauucugagccuaa

SEQ ID NO: 515297 - RNA, 22 nt, Human
cugugcccaccuggcucugagg

SEQ ID NO: 515298 - RNA, 22 nt, Human
ucagcugcucuguugagcugaa

SEQ ID NO: 515299 - RNA, 22 nt, Human
aaagacuagcauuuauauguac

SEQ ID NO: 515300 - RNA, 22 nt, Human
aggcaguuuauccccagagccu

SEQ ID NO: 515301 - RNA, 21 nt, Human
ugggaugggucugggaccagc

SEQ ID NO: 515302 - RNA, 22 nt, Human
uauguguguuucaguggaaaug

SEQ ID NO: 515303 - RNA, 22 nt, Human
gcagagcaguacucucuugacu

SEQ ID NO: 515304 - RNA, 22 nt, Human
ucucugaagcuguuguagucuc

SEQ ID NO: 515305 - RNA, 22 nt, Human
ucuggcuccaggaccgggcaca

SEQ ID NO: 515306 - RNA, 18 nt, Human
agaagcagguaaaauucu

SEQ ID NO: 515307 - RNA, 22 nt, Human
gaugauauuuugacuggagaau

SEQ ID NO: 515308 - RNA, 22 nt, Human
gucucagauucagacaucuaca

SEQ ID NO: 515309 - RNA, 20 nt, Human
uccuucaggcagggccuagu

SEQ ID NO: 515310 - RNA, 22 nt, Human
gccacugcacuccagcccaggc

SEQ ID NO: 515311 - RNA, 22 nt, Human
ccagccccgggaaccuggccgu

SEQ ID NO: 515312 - RNA, 22 nt, Human
uugcagaaaacaguuuucuugu

SEQ ID NO: 515313 - RNA, 22 nt, Human
gggcugacgaaggccaugugug

SEQ ID NO: 515314 - RNA, 22 nt, Human
cccaaggcugcagugagcauga

SEQ ID NO: 515315 - RNA, 22 nt, Human
gccaggagaaugcuagcagagg

SEQ ID NO: 515316 - RNA, 23 nt, Human
uggcaccaggcauucuaggggua

SEQ ID NO: 515317 - RNA, 22 nt, Human
ccuggcugucguuuugugaaau

SEQ ID NO: 515318 - RNA, 22 nt, Human
ccucaggauccgcaggugcagu

SEQ ID NO: 515319 - RNA, 22 nt, Human
gccagagguucaacaacugucu

SEQ ID NO: 515320 - RNA, 22 nt, Human
aucagcaagcauuuauugagug

SEQ ID NO: 515321 - RNA, 22 nt, Human
gagagcugauagaugagcuacu

SEQ ID NO: 515322 - RNA, 23 nt, Human
cacaccaggagccgucugggcca

SEQ ID NO: 515323 - RNA, 22 nt, Human
aaugauguauuaguacaacaca

SEQ ID NO: 515324 - RNA, 21 nt, Human
aagccucaagcagaagacaga

SEQ ID NO: 515325 - RNA, 22 nt, Human
aauagauggguuaaacagcaaa

SEQ ID NO: 515326 - RNA, 22 nt, Human
ugacacaggcagcucccagcac

SEQ ID NO: 515327 - RNA, 22 nt, Human
accugaggacuggaugguagaa

SEQ ID NO: 515328 - RNA, 22 nt, Human
gaugaaaaucuugagaugucga

SEQ ID NO: 515329 - RNA, 22 nt, Human
ccuggccucagccuagggcuga

SEQ ID NO: 515330 - RNA, 22 nt, Human
cgcaggcuccggggugcccugg

SEQ ID NO: 515331 - RNA, 22 nt, Human
gggugcugacuggggccugaaa

SEQ ID NO: 515332 - RNA, 22 nt, Human
acagagcauauaaagugcuuug

SEQ ID NO: 515333 - RNA, 22 nt, Human
ccaggcucacagcaucccagga

SEQ ID NO: 515334 - RNA, 23 nt, Human
uguguacacaauagaugagguuu

SEQ ID NO: 515335 - RNA, 22 nt, Human
acaaguaccaaaugcucaagua

SEQ ID NO: 515336 - RNA, 22 nt, Human
gggaccugccauugcucacagg

SEQ ID NO: 515337 - RNA, 22 nt, Human
acuuagcaguuuagaauauguc

SEQ ID NO: 515338 - RNA, 22 nt, Human
gagugaaaaaggaagggccaua

SEQ ID NO: 515339 - RNA, 22 nt, Human
cucagggaggagcuucugggcc

SEQ ID NO: 515340 - RNA, 22 nt, Human
ggcagagucagaggugguucug

SEQ ID NO: 515341 - RNA, 22 nt, Human
gaaaucuuccaauggucacauc

SEQ ID NO: 515342 - RNA, 22 nt, Human
agcauuagguguguuucagagg

SEQ ID NO: 515343 - RNA, 22 nt, Human
uuucauuaaagucaaaucuggu

SEQ ID NO: 515344 - RNA, 22 nt, Human
aagaugauguuguguuuucacu

SEQ ID NO: 515345 - RNA, 22 nt, Human
ugagaaagacagacauuccuaa

SEQ ID NO: 515346 - RNA, 22 nt, Human
ucaggaagggcucagucugugc

SEQ ID NO: 515347 - RNA, 22 nt, Human
uuucuaagaugugguuucaagg

SEQ ID NO: 515348 - RNA, 22 nt, Human
aauaucuguggccauacaauuu

SEQ ID NO: 515349 - RNA, 22 nt, Human
uaaggccaccguuauagaacca

SEQ ID NO: 515350 - RNA, 22 nt, Human
aggaugagccgcgcaagcugac

SEQ ID NO: 515351 - RNA, 17 nt, Human
ugguuccaaccauacgc

SEQ ID NO: 515352 - RNA, 22 nt, Human
gccugguggacacugggcauca

SEQ ID NO: 515353 - RNA, 22 nt, Human
uagucacaguacaggauaaaga

SEQ ID NO: 515354 - RNA, 22 nt, Human
agccccuugugggcgcacagca

SEQ ID NO: 515355 - RNA, 22 nt, Human
ucuggcucggauuugucuagca

SEQ ID NO: 515356 - RNA, 22 nt, Human
gugcccugagcuuaugcauucu

SEQ ID NO: 515357 - RNA, 22 nt, Human
gaaguuacauacugucacuucu

SEQ ID NO: 515358 - RNA, 22 nt, Human
caugccuguauuucugaucuau

SEQ ID NO: 515359 - RNA, 22 nt, Human
gggaccuggcaccuuugcucug

SEQ ID NO: 515360 - RNA, 20 nt, Human
cagguccagcacgugcacgg

SEQ ID NO: 515361 - RNA, 22 nt, Human
agaugcagaguuugcuguggac

SEQ ID NO: 515362 - RNA, 22 nt, Human
gcuggccucaucacugacuucu

SEQ ID NO: 515363 - RNA, 22 nt, Human
ucugaacagaaaagaugcacaa

SEQ ID NO: 515364 - RNA, 22 nt, Human
cauaccuuucucaagcacaugu

SEQ ID NO: 515365 - RNA, 22 nt, Human
gcacacacaugugaguacaugc

SEQ ID NO: 515366 - RNA, 22 nt, Human
ccugccaggccagugagcuucc

SEQ ID NO: 515367 - RNA, 22 nt, Human
accaggggaugguuggcacugu

SEQ ID NO: 515368 - RNA, 22 nt, Human
acugugugacuguuauuacugu

SEQ ID NO: 515369 - RNA, 22 nt, Human
auacaucuugucagauucaugu

SEQ ID NO: 515370 - RNA, 22 nt, Human
cuccagguuuuacaaggucuau

SEQ ID NO: 515371 - RNA, 22 nt, Human
gcaggcugaugacuggaguugg

SEQ ID NO: 515372 - RNA, 22 nt, Human
uugaaggacauccuauuucuag

SEQ ID NO: 515373 - RNA, 22 nt, Human
gugcuuucugcugcauuccucu

SEQ ID NO: 515374 - RNA, 22 nt, Human
uugggccaaauagcuauuuacu

SEQ ID NO: 515375 - RNA, 22 nt, Human
aacuaauacauuaauacaugug

SEQ ID NO: 515376 - RNA, 22 nt, Human
ggcaucaggaucugucuugcuu

SEQ ID NO: 515377 - RNA, 18 nt, Human
gcaagcccucuccauuaa

SEQ ID NO: 515378 - RNA, 22 nt, Human
acuucuggugucauacugcauu

SEQ ID NO: 515379 - RNA, 22 nt, Human
gaguccuggcguccaauuuccu

SEQ ID NO: 515380 - RNA, 20 nt, Human
auucuaaagcucugcucuuu

SEQ ID NO: 515381 - RNA, 22 nt, Human
agcagaaccugcagaccugucu

SEQ ID NO: 515382 - RNA, 22 nt, Human
gccacagugggcuggggccaga

SEQ ID NO: 515383 - RNA, 17 nt, Human
auuugugauguaacguc

SEQ ID NO: 515384 - RNA, 23 nt, Human
uagggcagcugggagggacaugc

SEQ ID NO: 515385 - RNA, 22 nt, Human
ucaggaugguguggaggaaaua

SEQ ID NO: 515386 - RNA, 22 nt, Human
uccuggaguugucuguacucau

SEQ ID NO: 515387 - RNA, 22 nt, Human
cucauggagggagugcucuucc

SEQ ID NO: 515388 - RNA, 22 nt, Human
aucuggcucccuuggaauccgu

SEQ ID NO: 515389 - RNA, 22 nt, Human
acugcagccuagggaccacagu

SEQ ID NO: 515390 - RNA, 17 nt, Human
aggccucccuccaggcc

SEQ ID NO: 515391 - RNA, 22 nt, Human
ccaagggcucugacuugccugc

SEQ ID NO: 515392 - RNA, 21 nt, Human
gccugccugcgugacccucuu

SEQ ID NO: 515393 - RNA, 22 nt, Human
ugggauaguggccaggaccccc

SEQ ID NO: 515394 - RNA, 20 nt, Human
auucacaaagccaguguugc

SEQ ID NO: 515395 - RNA, 22 nt, Human
gggcuguaggagcuggaauggg

SEQ ID NO: 515396 - RNA, 22 nt, Human
uccaauguuccugcuuucagcu

SEQ ID NO: 515397 - RNA, 22 nt, Human
uuuagggacaagggucuggggu

SEQ ID NO: 515398 - RNA, 22 nt, Human
cuguggagugcuuggcucagug

SEQ ID NO: 515399 - RNA, 22 nt, Human
acauuucucagguaagucauuu

SEQ ID NO: 515400 - RNA, 22 nt, Human
uuguaugaggauagcaagaagc

SEQ ID NO: 515401 - RNA, 22 nt, Human
gagggagggccaggucccaacc

SEQ ID NO: 515402 - RNA, 22 nt, Human
cuucaaauacaaguagauuaug

SEQ ID NO: 515403 - RNA, 22 nt, Human
uguuuucuguguagagaucaca

SEQ ID NO: 515404 - RNA, 22 nt, Human
uaaauuuacccaaggaacaugu

SEQ ID NO: 515405 - RNA, 22 nt, Human
cuuuucuguaucaaaaggauua

SEQ ID NO: 515406 - RNA, 22 nt, Human
cauuagggacugaggaauaagg

SEQ ID NO: 515407 - RNA, 22 nt, Human
aucuagauuagguauaagagcu

SEQ ID NO: 515408 - RNA, 22 nt, Human
ccuggaaggugaugguacagca

SEQ ID NO: 515409 - RNA, 22 nt, Human
cugcacagcccucaagagccug

SEQ ID NO: 515410 - RNA, 22 nt, Human
agaggccccaggugagcaugcc

SEQ ID NO: 515411 - RNA, 22 nt, Human
gagagcacaugaacauggagga

SEQ ID NO: 515412 - RNA, 22 nt, Human
agguggggcugggaaagauucc

SEQ ID NO: 515413 - RNA, 22 nt, Human
ucaggucuguacuauugucuug

SEQ ID NO: 515414 - RNA, 22 nt, Human
gcuggagccuucugcucuguug

SEQ ID NO: 515415 - RNA, 20 nt, Human
cuuagcuucuaagguucugg

SEQ ID NO: 515416 - RNA, 23 nt, Human
acagaaaguucugcuggacagag

SEQ ID NO: 515417 - RNA, 22 nt, Human
gaaucaauugugaagacuauga

SEQ ID NO: 515418 - RNA, 22 nt, Human
uccucccugaguggggacagcu

SEQ ID NO: 515419 - RNA, 22 nt, Human
caagagcuacccugugccauau

SEQ ID NO: 515420 - RNA, 22 nt, Human
uuugcuuucuugauucagauua

SEQ ID NO: 515421 - RNA, 22 nt, Human
gaggccaggacaugaaagcuga

SEQ ID NO: 515422 - RNA, 22 nt, Human
ggagcugggacccugucaucug

SEQ ID NO: 515423 - RNA, 22 nt, Human
ucagcagaggggaaggcaucug

SEQ ID NO: 515424 - RNA, 22 nt, Human
ugggcucagucugcuugguccu

SEQ ID NO: 515425 - RNA, 22 nt, Human
gcuggggagcaagaguagugag

SEQ ID NO: 515426 - RNA, 22 nt, Human
ugauauggcuaaagaaaguuuc

SEQ ID NO: 515427 - RNA, 22 nt, Human
uugaaucuggguacuuguaaua

SEQ ID NO: 515428 - RNA, 22 nt, Human
uuccucaugggguuccuucaga

SEQ ID NO: 515429 - RNA, 22 nt, Human
ccagggugaggaggcucccacg

SEQ ID NO: 515430 - RNA, 22 nt, Human
uccagcccgacugggccugccg

SEQ ID NO: 515431 - RNA, 20 nt, Human
ucucaggcccccuccuugcu

SEQ ID NO: 515432 - RNA, 22 nt, Human
gugcugauugggagcugggauu

SEQ ID NO: 515433 - RNA, 22 nt, Human
gcagacagacugcagugauuuu

SEQ ID NO: 515434 - RNA, 22 nt, Human
uagcagagguaaguguggcaau

SEQ ID NO: 515435 - RNA, 22 nt, Human
cugggucugugcccagggaccu

SEQ ID NO: 515436 - RNA, 18 nt, Human
gggcacuggggacuggag

SEQ ID NO: 515437 - RNA, 22 nt, Human
cuggucaccagguagcauugua

SEQ ID NO: 515438 - RNA, 22 nt, Human
uccucagaaaccccugugaggu

SEQ ID NO: 515439 - RNA, 22 nt, Human
ccuggacucaggcugugggcac

SEQ ID NO: 515440 - RNA, 22 nt, Human
agcagggccaacaguaaacacc

SEQ ID NO: 515441 - RNA, 22 nt, Human
gcagagacuccacugucuugug

SEQ ID NO: 515442 - RNA, 22 nt, Human
ugaggcaggaauggggaaaagu

SEQ ID NO: 515443 - RNA, 20 nt, Human
cuguccccgaggucaccagg

SEQ ID NO: 515444 - RNA, 22 nt, Human
uuguugaauggauaaauaaauu

SEQ ID NO: 515445 - RNA, 22 nt, Human
gcugaggcaaauaguuuuaagu

SEQ ID NO: 515446 - RNA, 20 nt, Human
acguggccaccaguggcuua

SEQ ID NO: 515447 - RNA, 22 nt, Human
uggcagagaacacggcugaucu

SEQ ID NO: 515448 - RNA, 22 nt, Human
aaaucaguuaagaugaggccau

SEQ ID NO: 515449 - RNA, 22 nt, Human
uucauuuguggugaaugaagug

SEQ ID NO: 515450 - RNA, 22 nt, Human
uacaguuucccagcagaugcaa

SEQ ID NO: 515451 - RNA, 22 nt, Human
uugaguguaaggaauguggggc

SEQ ID NO: 515452 - RNA, 22 nt, Human
ccuuucugauggccucccagcc

SEQ ID NO: 515453 - RNA, 22 nt, Human
agcuuucacgauuuggaacagg

SEQ ID NO: 515454 - RNA, 22 nt, Human
ggcagggaggaggugaaaguga

SEQ ID NO: 515455 - RNA, 22 nt, Human
caggccccauuccucuugggac

SEQ ID NO: 515456 - RNA, 20 nt, Human
ucacaggagggaaggcaggu

SEQ ID NO: 515457 - RNA, 20 nt, Human
gcaggucccuggcaugcaga

SEQ ID NO: 515458 - RNA, 22 nt, Human
ucauugcagcuucagguguuca

SEQ ID NO: 515459 - RNA, 22 nt, Human
auuccaguuaguggcagcuuau

SEQ ID NO: 515460 - RNA, 22 nt, Human
uacaaagcuguauagccugguc

SEQ ID NO: 515461 - RNA, 22 nt, Human
aggacacaugcacacccugcgu

SEQ ID NO: 515462 - RNA, 17 nt, Human
cauuuguugaucaguug

SEQ ID NO: 515463 - RNA, 22 nt, Human
ugcucccagggacucuggcugg

SEQ ID NO: 515464 - RNA, 22 nt, Human
aggcaggugggagugauuccuu

SEQ ID NO: 515465 - RNA, 22 nt, Human
agggccaggaacaccugaaggg

SEQ ID NO: 515466 - RNA, 22 nt, Human
ugauuucccucaucauaacaga

SEQ ID NO: 515467 - RNA, 22 nt, Human
ugugacaucgcugugucuguuu

SEQ ID NO: 515468 - RNA, 22 nt, Human
cacacaguaggcacucauuaau

SEQ ID NO: 515469 - RNA, 22 nt, Human
uacuuagagcgauaauuuauac

SEQ ID NO: 515470 - RNA, 22 nt, Human
uagaaaucuacuuagacuuucu

SEQ ID NO: 515471 - RNA, 22 nt, Human
gugugagagaagcugccaugga

SEQ ID NO: 515472 - RNA, 22 nt, Human
gcugucugucucugugacuuaa

SEQ ID NO: 515473 - RNA, 22 nt, Human
acagauguggaguuugcaugau

SEQ ID NO: 515474 - RNA, 22 nt, Human
agggcugcccagugugagagcu

SEQ ID NO: 515475 - RNA, 19 nt, Human
acacagggcuagaguuaca

SEQ ID NO: 515476 - RNA, 22 nt, Human
ggucucaggagacuggagagca

SEQ ID NO: 515477 - RNA, 22 nt, Human
ucccuccuuaauaagaggucug

SEQ ID NO: 515478 - RNA, 22 nt, Human
guccaguguguuuaucuuggau

SEQ ID NO: 515479 - RNA, 22 nt, Human
ucagcugaguucuagagcacuc

SEQ ID NO: 515480 - RNA, 22 nt, Human
gggcggugccugucuccgaagc

SEQ ID NO: 515481 - RNA, 22 nt, Human
aaugcuagugugauauguaagg

SEQ ID NO: 515482 - RNA, 22 nt, Human
guuagcaugauuccugcucauu

SEQ ID NO: 515483 - RNA, 22 nt, Human
uggagcaggugccaggugugug

SEQ ID NO: 515484 - RNA, 22 nt, Human
cagagacauuaagugccaugau

SEQ ID NO: 515485 - RNA, 22 nt, Human
aggagcuguuuuguucagcaaa

SEQ ID NO: 515486 - RNA, 22 nt, Human
gagacaaaaguuggagugcaag

SEQ ID NO: 515487 - RNA, 22 nt, Human
cccaggcuggagugcaauggca

SEQ ID NO: 515488 - RNA, 22 nt, Human
gaguggggucugggcaucaguc

SEQ ID NO: 515489 - RNA, 22 nt, Human
caggugagcucuaucuagggag

SEQ ID NO: 515490 - RNA, 22 nt, Human
ggguucagacuaaagcuaugca

SEQ ID NO: 515491 - RNA, 22 nt, Human
uuuuuggguccaggcuguaucu

SEQ ID NO: 515492 - RNA, 21 nt, Human
uccagggaauuucaacuuuua

SEQ ID NO: 515493 - RNA, 22 nt, Human
cucccaagggguaagggagcug

SEQ ID NO: 515494 - RNA, 22 nt, Human
cccagcagaccgcugugauggc

SEQ ID NO: 515495 - RNA, 22 nt, Human
ggacccugggcuugcuccuggg

SEQ ID NO: 515496 - RNA, 22 nt, Human
ucuggagccuuggaugggaaag

SEQ ID NO: 515497 - RNA, 20 nt, Human
cccagccccuaccuguugcc

SEQ ID NO: 515498 - RNA, 22 nt, Human
aucaguuugauaauaaggcuug

SEQ ID NO: 515499 - RNA, 22 nt, Human
ucaaaacaacacucagguguaa

SEQ ID NO: 515500 - RNA, 22 nt, Human
gauuucuuuagguguaauagug

SEQ ID NO: 515501 - RNA, 22 nt, Human
auacaaagacaaaucucaaucu

SEQ ID NO: 515502 - RNA, 19 nt, Human
ugagacugggugcaguacu

SEQ ID NO: 515503 - RNA, 22 nt, Human
cagggcucaucugugugaccag

SEQ ID NO: 515504 - RNA, 22 nt, Human
acaacagagcuggacugagagg

SEQ ID NO: 515505 - RNA, 18 nt, Human
uggcagguagacucaggu

SEQ ID NO: 515506 - RNA, 22 nt, Human
gccuccuggccuuugcuccuca

SEQ ID NO: 515507 - RNA, 21 nt, Human
gcugggccuguacuugcccug

SEQ ID NO: 515508 - RNA, 21 nt, Human
agucccaggggugagugaugu

SEQ ID NO: 515509 - RNA, 22 nt, Human
uagggcuauucugaguaauaau

SEQ ID NO: 515510 - RNA, 18 nt, Human
ugagagcauucgaggcaa

SEQ ID NO: 515511 - RNA, 22 nt, Human
ggcagcuuuuaucccugacaga

SEQ ID NO: 515512 - RNA, 22 nt, Human
ucauuauuuuggacuggagugu

SEQ ID NO: 515513 - RNA, 22 nt, Human
cuuagaaauaaugguuucaguu

SEQ ID NO: 515514 - RNA, 22 nt, Human
aagcaauaaucccaaagugcug

SEQ ID NO: 515515 - RNA, 22 nt, Human
aacagcagggggaccugcuggu

SEQ ID NO: 515516 - RNA, 22 nt, Human
ugccacacagucugguagaaua

SEQ ID NO: 515517 - RNA, 22 nt, Human
uagcagggaaggugugcugagc

SEQ ID NO: 515518 - RNA, 22 nt, Human
gccuggcuugccagcccuggcg

SEQ ID NO: 515519 - RNA, 22 nt, Human
ccugccugacagagaagguuca

SEQ ID NO: 515520 - RNA, 22 nt, Human
agcagccacccagcugcucauu

SEQ ID NO: 515521 - RNA, 22 nt, Human
uggcagguuaacuuacaacugu

SEQ ID NO: 515522 - RNA, 21 nt, Human
gcaugccugcaucuuaguguu

SEQ ID NO: 515523 - RNA, 22 nt, Human
cacaugggugugccuggaggaa

SEQ ID NO: 515524 - RNA, 22 nt, Human
aggcugagcugaccugguuugg

SEQ ID NO: 515525 - RNA, 17 nt, Human
cucuggggacaguucua

SEQ ID NO: 515526 - RNA, 22 nt, Human
gcagagccagaauggccaggac

SEQ ID NO: 515527 - RNA, 22 nt, Human
ccaggucugcgggcggcaggca

SEQ ID NO: 515528 - RNA, 22 nt, Human
cugcaggcaucuaacugugggc

SEQ ID NO: 515529 - RNA, 22 nt, Human
uagcugugagcacccaggcugu

SEQ ID NO: 515530 - RNA, 22 nt, Human
agagggagcccagucauagcug

SEQ ID NO: 515531 - RNA, 22 nt, Human
gccuaauaugcaaaauugauac

SEQ ID NO: 515532 - RNA, 22 nt, Human
cauuacaugguccaggauauau

SEQ ID NO: 515533 - RNA, 22 nt, Human
gagagguacacccuuuaaacuu

SEQ ID NO: 515534 - RNA, 22 nt, Human
ugguuucuuuccacucuccacc

SEQ ID NO: 515535 - RNA, 22 nt, Human
gacaguuuuuaauccuuucaug

SEQ ID NO: 515536 - RNA, 22 nt, Human
ugaggccaagccuccucugcca

SEQ ID NO: 515537 - RNA, 22 nt, Human
uuuacagugucuuguugacugu

SEQ ID NO: 515538 - RNA, 22 nt, Human
uuuccauauucugcgucugcca

SEQ ID NO: 515539 - RNA, 22 nt, Human
aggcgcagacauacagggucug

SEQ ID NO: 515540 - RNA, 22 nt, Human
uuggccuuugucaucaagauca

SEQ ID NO: 515541 - RNA, 22 nt, Human
gcuucaaacugagcuucaagug

SEQ ID NO: 515542 - RNA, 22 nt, Human
gacccagaaggagugcccuaga

SEQ ID NO: 515543 - RNA, 22 nt, Human
ggcaggagauaaaauauuaguu

SEQ ID NO: 515544 - RNA, 22 nt, Human
ucccagggcacucacccucccu

SEQ ID NO: 515545 - RNA, 22 nt, Human
cauuucuacagcuucuucagaa

SEQ ID NO: 515546 - RNA, 22 nt, Human
ggcaggacagucccaguucaaa

SEQ ID NO: 515547 - RNA, 21 nt, Human
gaaaggucuuaacuuacagag

SEQ ID NO: 515548 - RNA, 22 nt, Human
cuggcuggcaaguagaacacaa

SEQ ID NO: 515549 - RNA, 22 nt, Human
agugcagccgagaucaggugcu

SEQ ID NO: 515550 - RNA, 22 nt, Human
uccugguggugccagcugcagg

SEQ ID NO: 515551 - RNA, 22 nt, Human
caggccucagagaguggcgggg

SEQ ID NO: 515552 - RNA, 22 nt, Human
gagacagaguuucacucuuguu

SEQ ID NO: 515553 - RNA, 23 nt, Human
uggagccugggauacaauagaug

SEQ ID NO: 515554 - RNA, 22 nt, Human
ggcuucucucccccagcuccac

SEQ ID NO: 515555 - RNA, 22 nt, Human
ucccucugguccucgguggaga

SEQ ID NO: 515556 - RNA, 22 nt, Human
ggcauguuucaucacaucaaga

SEQ ID NO: 515557 - RNA, 22 nt, Human
auuagcuuaguguuuccguaau

SEQ ID NO: 515558 - RNA, 22 nt, Human
aauuuucuaaggugaugaucug

SEQ ID NO: 515559 - RNA, 22 nt, Human
cugcuucuaagaaccugcagcu

SEQ ID NO: 515560 - RNA, 22 nt, Human
gcccugucccuuggcuucuagg

SEQ ID NO: 515561 - RNA, 22 nt, Human
cuggcucccguuguccuugaag

SEQ ID NO: 515562 - RNA, 20 nt, Human
uggcuucauaaugguuucug

SEQ ID NO: 515563 - RNA, 22 nt, Human
cuggagccggaccagggacggu

SEQ ID NO: 515564 - RNA, 22 nt, Human
augugugugcauuucucucccu

SEQ ID NO: 515565 - RNA, 22 nt, Human
ucaucuucuauuaauagggaga

SEQ ID NO: 515566 - RNA, 22 nt, Human
ucuggaaagaucauuaaaucca

SEQ ID NO: 515567 - RNA, 19 nt, Human
ugagaggcuuaaggcagcu

SEQ ID NO: 515568 - RNA, 22 nt, Human
aagggaggggauguaagccugg

SEQ ID NO: 515569 - RNA, 22 nt, Human
gggaggucagggugccugcugg

SEQ ID NO: 515570 - RNA, 22 nt, Human
agcaguggagcgagauguuuaa

SEQ ID NO: 515571 - RNA, 19 nt, Human
cugagagaugcuucacaca

SEQ ID NO: 515572 - RNA, 22 nt, Human
aucugggccuguucccucaccu

SEQ ID NO: 515573 - RNA, 22 nt, Human
guccugugucccagagaaagag

SEQ ID NO: 515574 - RNA, 22 nt, Human
auauuaaugagcaaguaaguga

SEQ ID NO: 515575 - RNA, 22 nt, Human
gcucugcuugcaucaugacugc

SEQ ID NO: 515576 - RNA, 22 nt, Human
gcugucugcugugcacugagca

SEQ ID NO: 515577 - RNA, 22 nt, Human
aauuccugucuuaacaguucug

SEQ ID NO: 515578 - RNA, 22 nt, Human
guacaaaaguuauugcgguuuu

SEQ ID NO: 515579 - RNA, 19 nt, Human
gccaggucuuggguccagg

SEQ ID NO: 515580 - RNA, 22 nt, Human
augggccacacacgauugggug

SEQ ID NO: 515581 - RNA, 22 nt, Human
aggcaggcucaggcccaugcuu

SEQ ID NO: 515582 - RNA, 22 nt, Human
uguggcugcuccugggugguca

SEQ ID NO: 515583 - RNA, 18 nt, Human
cucagagaugcccuuauu

SEQ ID NO: 515584 - RNA, 22 nt, Human
uggaagcacuuggguuuuguug

SEQ ID NO: 515585 - RNA, 22 nt, Human
uaugcacacauguaugcaugug

SEQ ID NO: 515586 - RNA, 22 nt, Human
uuguuuuauucugcaauuuccc

SEQ ID NO: 515587 - RNA, 21 nt, Human
gggccacucuagagaaagaaa

SEQ ID NO: 515588 - RNA, 22 nt, Human
gagaaagauguaggcugggagg

SEQ ID NO: 515589 - RNA, 22 nt, Human
uuucuggcagcgggacaggggu

SEQ ID NO: 515590 - RNA, 22 nt, Human
uuauuuauggcacuguuggugg

SEQ ID NO: 515591 - RNA, 22 nt, Human
ucauguguccuaguucauauaa

SEQ ID NO: 515592 - RNA, 19 nt, Human
agcauccagucaugggauc

SEQ ID NO: 515593 - RNA, 23 nt, Human
agcuccagggaacaggcaguagg

SEQ ID NO: 515594 - RNA, 22 nt, Human
uugaagagugccuuccagacau

SEQ ID NO: 515595 - RNA, 22 nt, Human
cugagcuuggccaggaaugaau

SEQ ID NO: 515596 - RNA, 22 nt, Human
ucccaagugucuuggaccaggg

SEQ ID NO: 515597 - RNA, 22 nt, Human
uucaagauaauaggaaugaaaa

SEQ ID NO: 515598 - RNA, 22 nt, Human
agaugguguuuccccaggugga

SEQ ID NO: 515599 - RNA, 22 nt, Human
uagauaauuuggcaucauauug

SEQ ID NO: 515600 - RNA, 22 nt, Human
gggaugucacugugccuggcac

SEQ ID NO: 515601 - RNA, 22 nt, Human
agguacagcaauauaagagguc

SEQ ID NO: 515602 - RNA, 22 nt, Human
uaacagaagaaaacauauugga

SEQ ID NO: 515603 - RNA, 22 nt, Human
gaggaguggaguugcuggguug

SEQ ID NO: 515604 - RNA, 22 nt, Human
gcagagcucuguucuuaucucc

SEQ ID NO: 515605 - RNA, 22 nt, Human
augaccagccgagauaaacaga

SEQ ID NO: 515606 - RNA, 22 nt, Human
acuuccugcuaugagcuucugu

SEQ ID NO: 515607 - RNA, 23 nt, Human
acugccugcuacuaugcccacgg

SEQ ID NO: 515608 - RNA, 20 nt, Human
uggcuccucuuggcuguggc

SEQ ID NO: 515609 - RNA, 22 nt, Human
ucuguacaccaggggccauucu

SEQ ID NO: 515610 - RNA, 22 nt, Human
ggcagccauggacacuggcuag

SEQ ID NO: 515611 - RNA, 20 nt, Human
agcuggccuguccuaggccu

SEQ ID NO: 515612 - RNA, 17 nt, Human
uuucaucugggaccacc

SEQ ID NO: 515613 - RNA, 22 nt, Human
cagagaaacucagauagcugau

SEQ ID NO: 515614 - RNA, 22 nt, Human
gucucagugucaccuccagcug

SEQ ID NO: 515615 - RNA, 22 nt, Human
ucagccuccgaaagugcuggga

SEQ ID NO: 515616 - RNA, 22 nt, Human
ugcacacaaguuggagaaugaa

SEQ ID NO: 515617 - RNA, 22 nt, Human
agccuggagguaaugaggaaac

SEQ ID NO: 515618 - RNA, 22 nt, Human
uccuggcuuccacuccucuguu

SEQ ID NO: 515619 - RNA, 22 nt, Human
gguguugcaguugaagacuggu

SEQ ID NO: 515620 - RNA, 22 nt, Human
ucugggcugggcuuaggaaccc

SEQ ID NO: 515621 - RNA, 22 nt, Human
aguccaggaguugggugacauu

SEQ ID NO: 515622 - RNA, 22 nt, Human
auuuguuguugcuccccuaaga

SEQ ID NO: 515623 - RNA, 22 nt, Human
uuucuguagggauuucacaguu

SEQ ID NO: 515624 - RNA, 22 nt, Human
ugggcaggagagaagcuaaaga

SEQ ID NO: 515625 - RNA, 22 nt, Human
uggcuggcgccgggcuagccac

SEQ ID NO: 515626 - RNA, 22 nt, Human
uuuuaucuucauuccuaucuac

SEQ ID NO: 515627 - RNA, 22 nt, Human
cugcccugcuuguuuccagugg

SEQ ID NO: 515628 - RNA, 22 nt, Human
ccaggcugcuuuauuacucugu

SEQ ID NO: 515629 - RNA, 22 nt, Human
aagcagcauaugacagcaucca

SEQ ID NO: 515630 - RNA, 22 nt, Human
cuucugggugccugugaguguu

SEQ ID NO: 515631 - RNA, 22 nt, Human
uggcuucuuagaccaguggccu

SEQ ID NO: 515632 - RNA, 22 nt, Human
cugggcuuguguuagcugacaa

SEQ ID NO: 515633 - RNA, 22 nt, Human
gccugcagggccugggccuacc

SEQ ID NO: 515634 - RNA, 22 nt, Human
ugcugaauucuaccauccauuu

SEQ ID NO: 515635 - RNA, 22 nt, Human
aaggcuaugaucuuuuucauga

SEQ ID NO: 515636 - RNA, 22 nt, Human
gcacagaaguaaaauacaaguc

SEQ ID NO: 515637 - RNA, 22 nt, Human
uuaaauuuuagaaacagacucu

SEQ ID NO: 515638 - RNA, 22 nt, Human
ucaguuuucauuucaugagcag

SEQ ID NO: 515639 - RNA, 22 nt, Human
uggcucaggugugagcugaaga

SEQ ID NO: 515640 - RNA, 22 nt, Human
cugucccaggagcuguaagaca

SEQ ID NO: 515641 - RNA, 22 nt, Human
ucgggcucgcucuccuagcgga

SEQ ID NO: 515642 - RNA, 22 nt, Human
gcccugugcgacucuagagguu

SEQ ID NO: 515643 - RNA, 22 nt, Human
ucugagaggauuccugucccga

SEQ ID NO: 515644 - RNA, 22 nt, Human
cagagcaguaaaucuggggcac

SEQ ID NO: 515645 - RNA, 22 nt, Human
cagagccauccaggugccuguu

SEQ ID NO: 515646 - RNA, 22 nt, Human
uuacaaaguguuaugauaaaca

SEQ ID NO: 515647 - RNA, 22 nt, Human
uucugugacuccucagagauuu

SEQ ID NO: 515648 - RNA, 22 nt, Human
agagcugguuuacucaggaauu

SEQ ID NO: 515649 - RNA, 22 nt, Human
ugaguagcggcuauguguaacu

SEQ ID NO: 515650 - RNA, 22 nt, Human
uccuuugacuucuugcagucca

SEQ ID NO: 515651 - RNA, 22 nt, Human
ucacacaggguucuggucucau

SEQ ID NO: 515652 - RNA, 22 nt, Human
ugcagcucugaacagucaugaa

SEQ ID NO: 515653 - RNA, 22 nt, Human
ccagccuuugcaucccccaucu

SEQ ID NO: 515654 - RNA, 22 nt, Human
ggccggccuuugcgagcauucu

SEQ ID NO: 515655 - RNA, 22 nt, Human
ccagccuucugagcugccugga

SEQ ID NO: 515656 - RNA, 22 nt, Human
caaguucacuugucuacaaggg

SEQ ID NO: 515657 - RNA, 22 nt, Human
uucugcauuggagucuauucuu

SEQ ID NO: 515658 - RNA, 22 nt, Human
ucagcaauccucccacaggugg

SEQ ID NO: 515659 - RNA, 22 nt, Human
uacacaugacaguggacugaga

SEQ ID NO: 515660 - RNA, 22 nt, Human
gaggcucagagaagucauggua

SEQ ID NO: 515661 - RNA, 22 nt, Human
agauuuccugcacugccuuuga

SEQ ID NO: 515662 - RNA, 22 nt, Human
aguguccaacucagcuugucaa

SEQ ID NO: 515663 - RNA, 22 nt, Human
auuucaaggcuacagaaaccuu

SEQ ID NO: 515664 - RNA, 21 nt, Human
ggccuaggggcagauggugcu

SEQ ID NO: 515665 - RNA, 22 nt, Human
gcuggccaaaguguaccuggag

SEQ ID NO: 515666 - RNA, 22 nt, Human
caggucagagguagaugagaug

SEQ ID NO: 515667 - RNA, 22 nt, Human
ccagaagaccccguccaccucc

SEQ ID NO: 515668 - RNA, 22 nt, Human
gcucugagcacugugcggcugg

SEQ ID NO: 515669 - RNA, 22 nt, Human
gcucugcugagauaucugggag

SEQ ID NO: 515670 - RNA, 22 nt, Human
aaaugaaaugagugccuggagg

SEQ ID NO: 515671 - RNA, 22 nt, Human
uugucuguaaagacggccacca

SEQ ID NO: 515672 - RNA, 19 nt, Human
aagcauuagccaaagcauu

SEQ ID NO: 515673 - RNA, 22 nt, Human
cagaggcagccgggggagaacg

SEQ ID NO: 515674 - RNA, 22 nt, Human
gcagcugcuggaaguuccugcc

SEQ ID NO: 515675 - RNA, 22 nt, Human
uugcaaauauuguuuaccuuuc

SEQ ID NO: 515676 - RNA, 22 nt, Human
aagaggccuuggucugaccuga

SEQ ID NO: 515677 - RNA, 22 nt, Human
cccuggagggacagcugcucua

SEQ ID NO: 515678 - RNA, 22 nt, Human
gcagcucuuuucuuaaagagau

SEQ ID NO: 515679 - RNA, 22 nt, Human
gccaagcuggaugaagagguug

SEQ ID NO: 515680 - RNA, 22 nt, Human
auaagcuuuuaaagcuacuuug

SEQ ID NO: 515681 - RNA, 22 nt, Human
aaggcacuugcccagagcugca

SEQ ID NO: 515682 - RNA, 22 nt, Human
ucuguacaugaguugagaauca

SEQ ID NO: 515683 - RNA, 22 nt, Human
gagcugaguaugaaggauguga

SEQ ID NO: 515684 - RNA, 21 nt, Human
accagcaggagaucagaagga

SEQ ID NO: 515685 - RNA, 16 nt, Human
cagcuuuaugucagug

SEQ ID NO: 515686 - RNA, 22 nt, Human
ucugagaggcagaccuuccuaa

SEQ ID NO: 515687 - RNA, 22 nt, Human
caugagcugcugggagccuguc

SEQ ID NO: 515688 - RNA, 22 nt, Human
ucuucaaacccugguuuuguga

SEQ ID NO: 515689 - RNA, 22 nt, Human
gagaaagggaacuuacagagug

SEQ ID NO: 515690 - RNA, 22 nt, Human
ugaagguaaaggaaggaggcuu

SEQ ID NO: 515691 - RNA, 22 nt, Human
gagguccagccaagcggcaagg

SEQ ID NO: 515692 - RNA, 22 nt, Human
ccagcucccugaagccuggucu

SEQ ID NO: 515693 - RNA, 22 nt, Human
auuccugguggcagaaacauga

SEQ ID NO: 515694 - RNA, 22 nt, Human
caagagcuggagaggcagucua

SEQ ID NO: 515695 - RNA, 22 nt, Human
gaggaaugggugucucgugauu

SEQ ID NO: 515696 - RNA, 22 nt, Human
uacaauauguggccuuuuguga

SEQ ID NO: 515697 - RNA, 22 nt, Human
ccaggaguuggaagcugccaug

SEQ ID NO: 515698 - RNA, 23 nt, Human
acagcugcaccuggccgccuggc

SEQ ID NO: 515699 - RNA, 22 nt, Human
cagccagggagcaaagaguuga

SEQ ID NO: 515700 - RNA, 21 nt, Human
cucuuuguggcaauguauuuu

SEQ ID NO: 515701 - RNA, 22 nt, Human
ucagagugugagacauauugga

SEQ ID NO: 515702 - RNA, 22 nt, Human
cagggugccucugcucccacca

SEQ ID NO: 515703 - RNA, 22 nt, Human
cccuggaggaccccaauguggc

SEQ ID NO: 515704 - RNA, 22 nt, Human
ugucugaaacuugguccuaugc

SEQ ID NO: 515705 - RNA, 22 nt, Human
guccucugcuucaugcccugau

SEQ ID NO: 515706 - RNA, 22 nt, Human
uuaagucacuuaucuaaagaca

SEQ ID NO: 515707 - RNA, 22 nt, Human
guuuuggcucuggcauguggaa

SEQ ID NO: 515708 - RNA, 22 nt, Human
ugaggccagugacauauauuaa

SEQ ID NO: 515709 - RNA, 22 nt, Human
acagaagcaaagacucaggcaa

SEQ ID NO: 515710 - RNA, 22 nt, Human
ugagcuucuuuauuuggccaga

SEQ ID NO: 515711 - RNA, 22 nt, Human
accaucagagcacaguccgugc

SEQ ID NO: 515712 - RNA, 22 nt, Human
ugccugccaggcaaccugggag

SEQ ID NO: 515713 - RNA, 22 nt, Human
uccuggguuaauuaugauucac

SEQ ID NO: 515714 - RNA, 22 nt, Human
ggagggguggaaggagugccug

SEQ ID NO: 515715 - RNA, 22 nt, Human
caggcacaagaagcaaauguua

SEQ ID NO: 515716 - RNA, 22 nt, Human
agagccuguaacaucuuucuua

SEQ ID NO: 515717 - RNA, 22 nt, Human
ccagucugugugccagccugcg

SEQ ID NO: 515718 - RNA, 22 nt, Human
gcacagagguggaggacaaaua

SEQ ID NO: 515719 - RNA, 22 nt, Human
auuucuguuugcuacuauaagu

SEQ ID NO: 515720 - RNA, 22 nt, Human
acagaaauucugggacagaaaa

SEQ ID NO: 515721 - RNA, 22 nt, Human
ugccugaguuuaacccucagag

SEQ ID NO: 515722 - RNA, 22 nt, Human
ugcaccauuuugucaggcuacu

SEQ ID NO: 515723 - RNA, 22 nt, Human
uccugaggcccuguuagggucu

SEQ ID NO: 515724 - RNA, 22 nt, Human
ugagccacagugagagcuccug

SEQ ID NO: 515725 - RNA, 22 nt, Human
ugcaguuuuggccauugaaggc

SEQ ID NO: 515726 - RNA, 22 nt, Human
gcagcaggagaguuuguccugc

SEQ ID NO: 515727 - RNA, 22 nt, Human
ccaggacuuauuacaguauaac

SEQ ID NO: 515728 - RNA, 22 nt, Human
cugaggcugcccagggccaggu

SEQ ID NO: 515729 - RNA, 22 nt, Human
aggcuccguccagucucaggcc

SEQ ID NO: 515730 - RNA, 22 nt, Human
aggcugcuuucauggccgcccc

SEQ ID NO: 515731 - RNA, 22 nt, Human
aaaugcacaauaaaguaaaggc

SEQ ID NO: 515732 - RNA, 22 nt, Human
agagcagauggagcuggaagag

SEQ ID NO: 515733 - RNA, 22 nt, Human
cucaggaggugguagaggcccu

SEQ ID NO: 515734 - RNA, 22 nt, Human
caucaguguggcaguucacugu

SEQ ID NO: 515735 - RNA, 22 nt, Human
auacuuuggggguuaguguaga

SEQ ID NO: 515736 - RNA, 22 nt, Human
agggcucccgcgguguccggga

SEQ ID NO: 515737 - RNA, 20 nt, Human
agaguaacuggcacauaggg

SEQ ID NO: 515738 - RNA, 22 nt, Human
cagggccuuauccugccauuga

SEQ ID NO: 515739 - RNA, 22 nt, Human
uauuuccugcauggugauguaa

SEQ ID NO: 515740 - RNA, 18 nt, Human
ucuucaucuccugagcug

SEQ ID NO: 515741 - RNA, 22 nt, Human
ucagggcacaggccuguggguu

SEQ ID NO: 515742 - RNA, 22 nt, Human
ccugggcauaaaucacuccaag

SEQ ID NO: 515743 - RNA, 22 nt, Human
acauuucucauaggagagccac

SEQ ID NO: 515744 - RNA, 21 nt, Human
caaaagagacugauucuugga

SEQ ID NO: 515745 - RNA, 22 nt, Human
uuucacauucagauauagacuu

SEQ ID NO: 515746 - RNA, 22 nt, Human
cucuggagggaggcugagcugg

SEQ ID NO: 515747 - RNA, 22 nt, Human
gcuacaggagcugucacaugcu

SEQ ID NO: 515748 - RNA, 18 nt, Human
aagauguuuaaugggaag

SEQ ID NO: 515749 - RNA, 22 nt, Human
aaucuuucccuauuaaaugugg

SEQ ID NO: 515750 - RNA, 22 nt, Human
aagggaggccagagguuuugca

SEQ ID NO: 515751 - RNA, 20 nt, Human
agaagaggauacaaccaggc

SEQ ID NO: 515752 - RNA, 23 nt, Human
ucaugcccaggcuccagauguca

SEQ ID NO: 515753 - RNA, 22 nt, Human
aaaguguugauaugugacaucc

SEQ ID NO: 515754 - RNA, 22 nt, Human
agguggagaucagggacuaagg

SEQ ID NO: 515755 - RNA, 22 nt, Human
ggccugcuucucagugagcuug

SEQ ID NO: 515756 - RNA, 22 nt, Human
ucagcaggggccguugggugga

SEQ ID NO: 515757 - RNA, 22 nt, Human
cagcaggggaacugugggccag

SEQ ID NO: 515758 - RNA, 22 nt, Human
uuccucagaaaauacuguccaa

SEQ ID NO: 515759 - RNA, 22 nt, Human
ccugcccugucacuggcuaggg

SEQ ID NO: 515760 - RNA, 22 nt, Human
uucugugucuucuuguucugug

SEQ ID NO: 515761 - RNA, 22 nt, Human
uuaagugucauaauuuccaaga

SEQ ID NO: 515762 - RNA, 22 nt, Human
gauguacaaguaaaauaugugu

SEQ ID NO: 515763 - RNA, 22 nt, Human
uuucacacaacgugaauauacu

SEQ ID NO: 515764 - RNA, 17 nt, Human
ggccuuggggccucagu

SEQ ID NO: 515765 - RNA, 22 nt, Human
uuugagguuagcuagcagauca

SEQ ID NO: 515766 - RNA, 22 nt, Human
ugcuggcugggcugcuggagac

SEQ ID NO: 515767 - RNA, 20 nt, Human
caguccugcaggcgggagaa

SEQ ID NO: 515768 - RNA, 17 nt, Human
uccaggcauaucuccua

SEQ ID NO: 515769 - RNA, 22 nt, Human
ccaguguggccaggugcuggua

SEQ ID NO: 515770 - RNA, 22 nt, Human
aaacagcuuucagaaucucuca

SEQ ID NO: 515771 - RNA, 22 nt, Human
aagauguuuuaauauuucgagg

SEQ ID NO: 515772 - RNA, 22 nt, Human
gccaggcuccaggcccuccuga

SEQ ID NO: 515773 - RNA, 22 nt, Human
uaugagaaauugcugauauuug

SEQ ID NO: 515774 - RNA, 22 nt, Human
cccugcagcuuuugcauaguca

SEQ ID NO: 515775 - RNA, 22 nt, Human
cacaucagguagaccuacagag

SEQ ID NO: 515776 - RNA, 22 nt, Human
agucccaggcagccgagccggu

SEQ ID NO: 515777 - RNA, 22 nt, Human
gugaaugauagcuucucuuugg

SEQ ID NO: 515778 - RNA, 19 nt, Human
ucuuucauuucuagcucug

SEQ ID NO: 515779 - RNA, 22 nt, Human
ccagagccuggcaucugcauaa

SEQ ID NO: 515780 - RNA, 22 nt, Human
agcucccauuaucuucugaaac

SEQ ID NO: 515781 - RNA, 22 nt, Human
uuccugggacuggagcagccca

SEQ ID NO: 515782 - RNA, 22 nt, Human
aacaaaguagcugcuguucuua

SEQ ID NO: 515783 - RNA, 22 nt, Human
agacuacauaugccacaugaag

SEQ ID NO: 515784 - RNA, 22 nt, Human
gcacugaaugcuuuuacuguaa

SEQ ID NO: 515785 - RNA, 22 nt, Human
uugcauuugagaaaguucuccu

SEQ ID NO: 515786 - RNA, 22 nt, Human
ggcuuuauuugcagccauuguu

SEQ ID NO: 515787 - RNA, 22 nt, Human
agcugccucccugugcuugucc

SEQ ID NO: 515788 - RNA, 22 nt, Human
ugggaggcagguaggugaugau

SEQ ID NO: 515789 - RNA, 22 nt, Human
agggggugggaagucuagaauc

SEQ ID NO: 515790 - RNA, 22 nt, Human
cuuuagaauuucauguuugguc

SEQ ID NO: 515791 - RNA, 22 nt, Human
ugcuucuguuacauaccagaac

SEQ ID NO: 515792 - RNA, 21 nt, Human
uccagggaacuucucaggaau

SEQ ID NO: 515793 - RNA, 21 nt, Human
auggagccuaagaguggaggu

SEQ ID NO: 515794 - RNA, 22 nt, Human
auuuucauuuugcagggugaga

SEQ ID NO: 515795 - RNA, 22 nt, Human
ugagucuucuuccgggauugcu

SEQ ID NO: 515796 - RNA, 22 nt, Human
ucuggcuccuggcuccacugcc

SEQ ID NO: 515797 - RNA, 22 nt, Human
gaggccagaaugagcugaaugc

SEQ ID NO: 515798 - RNA, 22 nt, Human
ugcuucugucucuuaugccuug

SEQ ID NO: 515799 - RNA, 23 nt, Human
uggcucucucagugcugcagagg

SEQ ID NO: 515800 - RNA, 22 nt, Human
ucagggcugcagaagaggcagg

SEQ ID NO: 515801 - RNA, 22 nt, Human
cucuaaauccacgguauaguug

SEQ ID NO: 515802 - RNA, 23 nt, Human
augcccuguagaggcugcugacc

SEQ ID NO: 515803 - RNA, 22 nt, Human
cgcaggcucgguucacagagca

SEQ ID NO: 515804 - RNA, 22 nt, Human
ugggacagagugagcuuuggcc

SEQ ID NO: 515805 - RNA, 19 nt, Human
ucccagagucuagagguug

SEQ ID NO: 515806 - RNA, 22 nt, Human
guggaagguaaugcagcuuacu

SEQ ID NO: 515807 - RNA, 22 nt, Human
agucagugggcuuggcacagaa

SEQ ID NO: 515808 - RNA, 22 nt, Human
gcaggcagagagggguuuccag

SEQ ID NO: 515809 - RNA, 22 nt, Human
ggcacugagaggcucuuccuaa

SEQ ID NO: 515810 - RNA, 22 nt, Human
uggaaggggagcuggaaagggg

SEQ ID NO: 515811 - RNA, 22 nt, Human
agcaggcuaagggaccuguuua

SEQ ID NO: 515812 - RNA, 22 nt, Human
uguccaggucagcagcagggac

SEQ ID NO: 515813 - RNA, 22 nt, Human
ccugccuggcuuccagaagaga

SEQ ID NO: 515814 - RNA, 22 nt, Human
aucuggcugcugugcuuaagcu

SEQ ID NO: 515815 - RNA, 22 nt, Human
cugccaggacugacgucuucag

SEQ ID NO: 515816 - RNA, 22 nt, Human
gcucuguggcaggaggucuugu

SEQ ID NO: 515817 - RNA, 22 nt, Human
uccuggccagaggacaaagcug

SEQ ID NO: 515818 - RNA, 22 nt, Human
uacaagaaacuacaugaaugca

SEQ ID NO: 515819 - RNA, 23 nt, Human
ucccuguguacagccugcaugag

SEQ ID NO: 515820 - RNA, 20 nt, Human
cagcccuccaguggaggcag

SEQ ID NO: 515821 - RNA, 22 nt, Human
uucuggcucuccccugcugggu

SEQ ID NO: 515822 - RNA, 22 nt, Human
agggacagucuacuguucacug

SEQ ID NO: 515823 - RNA, 22 nt, Human
ugguuugagagugugagcuuuu

SEQ ID NO: 515824 - RNA, 22 nt, Human
gaaaucugcccagugcacuggu

SEQ ID NO: 515825 - RNA, 22 nt, Human
ccuggcagcgugccgagcugcg

SEQ ID NO: 515826 - RNA, 22 nt, Human
uguguucauguugauucauagc

SEQ ID NO: 515827 - RNA, 22 nt, Human
ucuccuccuuuuuucaacauag

SEQ ID NO: 515828 - RNA, 22 nt, Human
aauccagguggcggagguugug

SEQ ID NO: 515829 - RNA, 22 nt, Human
ugucaugguagcugaaggaugu

SEQ ID NO: 515830 - RNA, 22 nt, Human
gcugugcuugcaugagugucug

SEQ ID NO: 515831 - RNA, 21 nt, Human
uagcacuucgcuguaauuggg

SEQ ID NO: 515832 - RNA, 22 nt, Human
ucaggucugaugccucauccau

SEQ ID NO: 515833 - RNA, 22 nt, Human
ucagggcauccauugccuguug

SEQ ID NO: 515834 - RNA, 22 nt, Human
agcugaagggaggauauguaca

SEQ ID NO: 515835 - RNA, 22 nt, Human
ccuuucucauuuuaagcauuag

SEQ ID NO: 515836 - RNA, 22 nt, Human
uccugaggcacaauccuagaau

SEQ ID NO: 515837 - RNA, 22 nt, Human
gcccuuagggccacugucacug

SEQ ID NO: 515838 - RNA, 22 nt, Human
gcugccugucccaggaugagga

SEQ ID NO: 515839 - RNA, 22 nt, Human
cuuuuauuuugaauuaagggcu

SEQ ID NO: 515840 - RNA, 21 nt, Human
aguguguguggaaugagaaua

SEQ ID NO: 515841 - RNA, 22 nt, Human
uuggaaggaccaggccuugauu

SEQ ID NO: 515842 - RNA, 22 nt, Human
cccagaggugacaucccauucu

SEQ ID NO: 515843 - RNA, 21 nt, Human
ggagggcagcccagacuggcu

SEQ ID NO: 515844 - RNA, 17 nt, Human
ugcugucugcuucccua

SEQ ID NO: 515845 - RNA, 22 nt, Human
ggcuuuaugcagggauagaaau

SEQ ID NO: 515846 - RNA, 22 nt, Human
cuggggcucucuggaaugcuug

SEQ ID NO: 515847 - RNA, 22 nt, Human
uggaaggaaagguagcagagaa

SEQ ID NO: 515848 - RNA, 22 nt, Human
gcugccugcucggcuccuggga

SEQ ID NO: 515849 - RNA, 22 nt, Human
cuggaggacagaggccaugucu

SEQ ID NO: 515850 - RNA, 18 nt, Human
agccuggaggguugaagu

SEQ ID NO: 515851 - RNA, 22 nt, Human
aaaguacaugcaauucuucuga

SEQ ID NO: 515852 - RNA, 22 nt, Human
agagccaggcucccauggggca

SEQ ID NO: 515853 - RNA, 22 nt, Human
gagggcuccauuccccgugccc

SEQ ID NO: 515854 - RNA, 22 nt, Human
cauggccaaagaauuauauuuu

SEQ ID NO: 515855 - RNA, 22 nt, Human
gggcgcagccaauccuggcccu

SEQ ID NO: 515856 - RNA, 22 nt, Human
acuccugugggcauggcacccc

SEQ ID NO: 515857 - RNA, 22 nt, Human
uguaacaaaauaccuuggauug

SEQ ID NO: 515858 - RNA, 22 nt, Human
uuauuuguggcauccauguugg

SEQ ID NO: 515859 - RNA, 22 nt, Human
ccugcugcuaugaaggugacag

SEQ ID NO: 515860 - RNA, 22 nt, Human
uguggcaguauaagagcuagaa

SEQ ID NO: 515861 - RNA, 19 nt, Human
gggcuccuugggccucucu

SEQ ID NO: 515862 - RNA, 22 nt, Human
ccagagucuaugaguccucauu

SEQ ID NO: 515863 - RNA, 22 nt, Human
gagcagcuguccccaaagcuuc

SEQ ID NO: 515864 - RNA, 22 nt, Human
gaguccaggcuggucaaauagc

SEQ ID NO: 515865 - RNA, 22 nt, Human
uguaaaauaauucuccauguuu

SEQ ID NO: 515866 - RNA, 22 nt, Human
caggcuggagugaguguagugg

SEQ ID NO: 515867 - RNA, 22 nt, Human
auggcaaaaauuaacagaucaa

SEQ ID NO: 515868 - RNA, 22 nt, Human
caggagcucaagaccacccugg

SEQ ID NO: 515869 - RNA, 22 nt, Human
ggcacagcgacuaccaucgaaa

SEQ ID NO: 515870 - RNA, 22 nt, Human
uuggccuuguuaaggaggcccu

SEQ ID NO: 515871 - RNA, 22 nt, Human
aauuccaagagcuuccuaagug

SEQ ID NO: 515872 - RNA, 22 nt, Human
ugugaccauaauuuguaaauaa

SEQ ID NO: 515873 - RNA, 22 nt, Human
aaucuugagggacucaugaggu

SEQ ID NO: 515874 - RNA, 22 nt, Human
auuauaaaccuuugaggguggg

SEQ ID NO: 515875 - RNA, 22 nt, Human
ucacacagcuuggaguuauggu

SEQ ID NO: 515876 - RNA, 22 nt, Human
ugucagugguagacccagaggu

SEQ ID NO: 515877 - RNA, 22 nt, Human
ugcacacacgcggcacaucugu

SEQ ID NO: 515878 - RNA, 21 nt, Human
aagaggaagcauuauggcaua

SEQ ID NO: 515879 - RNA, 18 nt, Human
ucugucucuguccuugcu

SEQ ID NO: 515880 - RNA, 22 nt, Human
uuuagcauuacuaaaaugaaaa

SEQ ID NO: 515881 - RNA, 22 nt, Human
agaccauagggaccucagguug

SEQ ID NO: 515882 - RNA, 22 nt, Human
uggauaaacucacuguaaguug

SEQ ID NO: 515883 - RNA, 22 nt, Human
gagaaagcuucuuucccacagg

SEQ ID NO: 515884 - RNA, 22 nt, Human
ugugugaagugauuuuaagucu

SEQ ID NO: 515885 - RNA, 22 nt, Human
ccugggcugggcgucucauggg

SEQ ID NO: 515886 - RNA, 22 nt, Human
cggccaagccggggccccgaag

SEQ ID NO: 515887 - RNA, 22 nt, Human
gcagaagcugggagaagggauu

SEQ ID NO: 515888 - RNA, 22 nt, Human
uucaaugccuagaacuuagcau

SEQ ID NO: 515889 - RNA, 22 nt, Human
ugugccuggaucucugugacaa

SEQ ID NO: 515890 - RNA, 22 nt, Human
agcaguuuuuauaacacuggaa

SEQ ID NO: 515891 - RNA, 21 nt, Human
gcagagccggggcgagaaggc

SEQ ID NO: 515892 - RNA, 22 nt, Human
ggcagauggagaagcagcaggu

SEQ ID NO: 515893 - RNA, 22 nt, Human
agagccaggcucuaccuggguu

SEQ ID NO: 515894 - RNA, 22 nt, Human
cugggcacacagugacucugca

SEQ ID NO: 515895 - RNA, 22 nt, Human
gacacagacaguuagagguaau

SEQ ID NO: 515896 - RNA, 22 nt, Human
auuaaagaaacccagcauguga

SEQ ID NO: 515897 - RNA, 22 nt, Human
gugcauuucucauacacuaaau

SEQ ID NO: 515898 - RNA, 22 nt, Human
gcucuagaaagaaggauguggg

SEQ ID NO: 515899 - RNA, 23 nt, Human
agaaaagcuuggacacauggccu

SEQ ID NO: 515900 - RNA, 19 nt, Human
agccagggugagaaggagc

SEQ ID NO: 515901 - RNA, 23 nt, Human
aaagacucuccagagggaaguag

SEQ ID NO: 515902 - RNA, 22 nt, Human
cagugcaugaaacaauaugcag

SEQ ID NO: 515903 - RNA, 22 nt, Human
agaggcuccuagccacuggcuu

SEQ ID NO: 515904 - RNA, 22 nt, Human
cugggucugggccuccuggagu

SEQ ID NO: 515905 - RNA, 17 nt, Human
ggaaaaggaugauacag

SEQ ID NO: 515906 - RNA, 22 nt, Human
cagagugagggccugcaccugc

SEQ ID NO: 515907 - RNA, 22 nt, Human
auuugucuuuggaccugugaga

SEQ ID NO: 515908 - RNA, 22 nt, Human
gggaaacuucugcuaaaaccag

SEQ ID NO: 515909 - RNA, 19 nt, Human
ucacauucagccuugcuga

SEQ ID NO: 515910 - RNA, 21 nt, Human
ucccacugccacagcuucagg

SEQ ID NO: 515911 - RNA, 22 nt, Human
cccagggacagcuagguggggc

SEQ ID NO: 515912 - RNA, 22 nt, Human
cugagccaguagucagggacaa

SEQ ID NO: 515913 - RNA, 22 nt, Human
augauauauguguugagcuugc

SEQ ID NO: 515914 - RNA, 22 nt, Human
uggagagcgcgacgggaggaag

SEQ ID NO: 515915 - RNA, 22 nt, Human
agccauuuugguaaugauaaca

SEQ ID NO: 515916 - RNA, 22 nt, Human
cugagcccaggcgggagcugag

SEQ ID NO: 515917 - RNA, 21 nt, Human
ucauauuucucuugcuauugu

SEQ ID NO: 515918 - RNA, 22 nt, Human
uacucaaaaaguuaugaaucau

SEQ ID NO: 515919 - RNA, 22 nt, Human
gugugcaugugcuugcacagau

SEQ ID NO: 515920 - RNA, 22 nt, Human
uuucauaaacaguagaagacua

SEQ ID NO: 515921 - RNA, 22 nt, Human
agcucagcuuccucuccaugcu

SEQ ID NO: 515922 - RNA, 22 nt, Human
aaagcugcccuugugaaacaag

SEQ ID NO: 515923 - RNA, 19 nt, Human
cucugccucuggcuguggc

SEQ ID NO: 515924 - RNA, 22 nt, Human
caggucuggguugauggccugg

SEQ ID NO: 515925 - RNA, 22 nt, Human
ggggcugguggugguuucucca

SEQ ID NO: 515926 - RNA, 22 nt, Human
aggucauuggggacuaucuccg

SEQ ID NO: 515927 - RNA, 22 nt, Human
ugcagaagcagagccgguggcc

SEQ ID NO: 515928 - RNA, 22 nt, Human
ucagugucuugaccugggugug

SEQ ID NO: 515929 - RNA, 22 nt, Human
acaggagaaaucuggucaaaag

SEQ ID NO: 515930 - RNA, 22 nt, Human
cuggccgguauuugccucuggg

SEQ ID NO: 515931 - RNA, 20 nt, Human
accaauguuagcuuaguacu

SEQ ID NO: 515932 - RNA, 22 nt, Human
cuauacagagcauccuuaacuu

SEQ ID NO: 515933 - RNA, 22 nt, Human
ucucacagugagccugaggucg

SEQ ID NO: 515934 - RNA, 22 nt, Human
cuggggugugcucagagcaggg

SEQ ID NO: 515935 - RNA, 22 nt, Human
ugagccaggucucacucaccuu

SEQ ID NO: 515936 - RNA, 22 nt, Human
agccuggaguucccaggagaag

SEQ ID NO: 515937 - RNA, 22 nt, Human
augagcuguaagguggcuuccu

SEQ ID NO: 515938 - RNA, 22 nt, Human
uccuugaagagugggcggucga

SEQ ID NO: 515939 - RNA, 22 nt, Human
uggucucuucuuccaagauggc

SEQ ID NO: 515940 - RNA, 22 nt, Human
agcagcugagccccagcuguga

SEQ ID NO: 515941 - RNA, 19 nt, Human
aggcuucuacccuguccag

SEQ ID NO: 515942 - RNA, 22 nt, Human
ggguucuuauaguaucagagcu

SEQ ID NO: 515943 - RNA, 22 nt, Human
gaggcagcaugguaccuuggag

SEQ ID NO: 515944 - RNA, 22 nt, Human
agaaguuugaaauuaggagaaa

SEQ ID NO: 515945 - RNA, 22 nt, Human
ugcauauuuguaugauguuuag

SEQ ID NO: 515946 - RNA, 22 nt, Human
acagugugugcuuucccuuacg

SEQ ID NO: 515947 - RNA, 23 nt, Human
cucccugaacaugacacaccaga

SEQ ID NO: 515948 - RNA, 22 nt, Human
agugucauaugccacugcaucc

SEQ ID NO: 515949 - RNA, 22 nt, Human
caagcagacaguaggccuagaa

SEQ ID NO: 515950 - RNA, 22 nt, Human
augcuugggacucccuguagca

SEQ ID NO: 515951 - RNA, 22 nt, Human
gcagcaggcacggucucgacau

SEQ ID NO: 515952 - RNA, 22 nt, Human
cucacagguaccagcacccucc

SEQ ID NO: 515953 - RNA, 22 nt, Human
cacauacauucauguuacucua

SEQ ID NO: 515954 - RNA, 22 nt, Human
agauuguagaaacuguagcauu

SEQ ID NO: 515955 - RNA, 22 nt, Human
cagcagcuaaggcauguuccug

SEQ ID NO: 515956 - RNA, 22 nt, Human
ugucucuggcugcagccuguuc

SEQ ID NO: 515957 - RNA, 22 nt, Human
ggggauggugggaaggcaaucu

SEQ ID NO: 515958 - RNA, 22 nt, Human
gugagcuuugugguaaugaagu

SEQ ID NO: 515959 - RNA, 22 nt, Human
aguuuucucuguguucugcuua

SEQ ID NO: 515960 - RNA, 22 nt, Human
gcuuuguguagaaggaggaugg

SEQ ID NO: 515961 - RNA, 22 nt, Human
aaaguuacacaucuaguaagug

SEQ ID NO: 515962 - RNA, 22 nt, Human
ucagaggucacacagcaaguuu

SEQ ID NO: 515963 - RNA, 22 nt, Human
cagcagagguuggaacaguucu

SEQ ID NO: 515964 - RNA, 22 nt, Human
cacuggauuuccaggaauacuc

SEQ ID NO: 515965 - RNA, 22 nt, Human
uuuauuagugcuuguaucacug

SEQ ID NO: 515966 - RNA, 22 nt, Human
aaacacugguaugauguauagu

SEQ ID NO: 515967 - RNA, 22 nt, Human
uugcugaaagguagcugugugg

SEQ ID NO: 515968 - RNA, 22 nt, Human
aaaugaacaguugcauucucug

SEQ ID NO: 515969 - RNA, 22 nt, Human
aaauugcuaaauuguaagaggg

SEQ ID NO: 515970 - RNA, 22 nt, Human
aggccagcaagaaagagagucu

SEQ ID NO: 515971 - RNA, 22 nt, Human
gucaggaugagggaugaggagu

SEQ ID NO: 515972 - RNA, 20 nt, Human
cuaggaacuauggucuggcu

SEQ ID NO: 515973 - RNA, 22 nt, Human
cagcuccagcccaggcagcucc

SEQ ID NO: 515974 - RNA, 21 nt, Human
aauuuugaaggaagauuaagg

SEQ ID NO: 515975 - RNA, 22 nt, Human
acaaaugccauauauaaauucu

SEQ ID NO: 515976 - RNA, 22 nt, Human
uuucuguuuagcauaaaguggc

SEQ ID NO: 515977 - RNA, 23 nt, Human
cccuucagcgagggcauuaaggu

SEQ ID NO: 515978 - RNA, 18 nt, Human
aggccagcccugcuacug

SEQ ID NO: 515979 - RNA, 22 nt, Human
agcagcaugaugacagagucuc

SEQ ID NO: 515980 - RNA, 22 nt, Human
gcugccuuccaaagaguuuuau

SEQ ID NO: 515981 - RNA, 22 nt, Human
cagcucucacacuuagcuucua

SEQ ID NO: 515982 - RNA, 22 nt, Human
cccccaaggccaggcugagacc

SEQ ID NO: 515983 - RNA, 22 nt, Human
cagcagagcauuugguaggagg

SEQ ID NO: 515984 - RNA, 22 nt, Human
ggaaacagagggcaccugagcc

SEQ ID NO: 515985 - RNA, 22 nt, Human
cccuuccuccucgccugucaga

SEQ ID NO: 515986 - RNA, 22 nt, Human
agcagagccagaauuggaccag

SEQ ID NO: 515987 - RNA, 22 nt, Human
ugacuuaagcuguucuuuagau

SEQ ID NO: 515988 - RNA, 22 nt, Human
gggcaggugaccucuuguccug

SEQ ID NO: 515989 - RNA, 22 nt, Human
ucucagaguuugaaucuggagu

SEQ ID NO: 515990 - RNA, 22 nt, Human
cuuugccuccuagagcacguuc

SEQ ID NO: 515991 - RNA, 22 nt, Human
uuccaaguuaggcgagcuggug

SEQ ID NO: 515992 - RNA, 23 nt, Human
ggccucagcgcacagaaacugcu

SEQ ID NO: 515993 - RNA, 22 nt, Human
auuguacagaugagguaaguga

SEQ ID NO: 515994 - RNA, 22 nt, Human
guaugaaggcgagagcccacua

SEQ ID NO: 515995 - RNA, 22 nt, Human
ggcagaagauaggacagggaau

SEQ ID NO: 515996 - RNA, 22 nt, Human
uagcauuaucugucuuaucauu

SEQ ID NO: 515997 - RNA, 22 nt, Human
cucaggauucucgacacucaca

SEQ ID NO: 515998 - RNA, 22 nt, Human
aaggccaugaccacuugcugug

SEQ ID NO: 515999 - RNA, 22 nt, Human
aaaaguuuaagacucauucuag

SEQ ID NO: 516000 - RNA, 22 nt, Human
acaugugucuaagaaugaaaga

SEQ ID NO: 516001 - RNA, 22 nt, Human
aaacacuucuuaggucuuaagu

SEQ ID NO: 516002 - RNA, 22 nt, Human
ucaauaacuuuguuuagcauug

SEQ ID NO: 516003 - RNA, 22 nt, Human
ccugaggcuuaaucugucccaa

SEQ ID NO: 516004 - RNA, 22 nt, Human
acuccugggugcauuucugauu

SEQ ID NO: 516005 - RNA, 22 nt, Human
ugaagcugugggcaguggagcc

SEQ ID NO: 516006 - RNA, 22 nt, Human
gaaaucugaacaacagcuguca

SEQ ID NO: 516007 - RNA, 22 nt, Human
uggaggccagagguacugggac

SEQ ID NO: 516008 - RNA, 22 nt, Human
agguucuuuuggccaaccucau

SEQ ID NO: 516009 - RNA, 22 nt, Human
uagagcuguaucaaagagccuu

SEQ ID NO: 516010 - RNA, 22 nt, Human
ucauggaaacagcaaugcuaau

SEQ ID NO: 516011 - RNA, 22 nt, Human
aauggacaggagagcauaguca

SEQ ID NO: 516012 - RNA, 22 nt, Human
accugccuaguugguucugccc

SEQ ID NO: 516013 - RNA, 22 nt, Human
uacaugcuccacuuucuccugu

SEQ ID NO: 516014 - RNA, 22 nt, Human
uccauuuuagagaugaagaaac

SEQ ID NO: 516015 - RNA, 22 nt, Human
gccuggagggauagaaugcaag

SEQ ID NO: 516016 - RNA, 22 nt, Human
ccuggaaguuggagguugcagu

SEQ ID NO: 516017 - RNA, 22 nt, Human
acuguggcacuaggcaccuuac

SEQ ID NO: 516018 - RNA, 22 nt, Human
uaaaugcaagugcuccugggag

SEQ ID NO: 516019 - RNA, 20 nt, Human
uuucacaaugaacaugucuc

SEQ ID NO: 516020 - RNA, 22 nt, Human
uccaugggaagauuuugagugg

SEQ ID NO: 516021 - RNA, 22 nt, Human
uuugugcagguauaggcggaga

SEQ ID NO: 516022 - RNA, 22 nt, Human
agaagccauugaagcagaccuc

SEQ ID NO: 516023 - RNA, 22 nt, Human
ucugagagccucuagccuaagu

SEQ ID NO: 516024 - RNA, 22 nt, Human
acaauuugaggcuacucaauug

SEQ ID NO: 516025 - RNA, 22 nt, Human
ccugggugaugugcugcccucg

SEQ ID NO: 516026 - RNA, 22 nt, Human
uuugacaaaggaaaaaugcaca

SEQ ID NO: 516027 - RNA, 22 nt, Human
ggagggagucagcugauuagaa

SEQ ID NO: 516028 - RNA, 22 nt, Human
uuucuuucaauucuccuaaugc

SEQ ID NO: 516029 - RNA, 22 nt, Human
gcacaguguaccacagucccua

SEQ ID NO: 516030 - RNA, 22 nt, Human
gugggcaaggucccugccagcu

SEQ ID NO: 516031 - RNA, 22 nt, Human
agcagcuagacuucagaaucug

SEQ ID NO: 516032 - RNA, 22 nt, Human
uccugccuucauacugcuguau

SEQ ID NO: 516033 - RNA, 22 nt, Human
uggcagccacaucucguggauu

SEQ ID NO: 516034 - RNA, 22 nt, Human
ggaggugggagacauaggcggc

SEQ ID NO: 516035 - RNA, 22 nt, Human
ucuggagagucacagugccaga

SEQ ID NO: 516036 - RNA, 22 nt, Human
uucaagauggcaccagugagug

SEQ ID NO: 516037 - RNA, 22 nt, Human
agggacacugaugagaaauucu

SEQ ID NO: 516038 - RNA, 22 nt, Human
guaaauaacugguaauuggggu

SEQ ID NO: 516039 - RNA, 21 nt, Human
uggcggggacuuguggcugcc

SEQ ID NO: 516040 - RNA, 19 nt, Human
gggaccugacuaauuggca

SEQ ID NO: 516041 - RNA, 22 nt, Human
ucuggcuuucauuuguuuaaag

SEQ ID NO: 516042 - RNA, 22 nt, Human
ccuggagggcgccgcacagucc

SEQ ID NO: 516043 - RNA, 22 nt, Human
gcagcuggagccagccagacac

SEQ ID NO: 516044 - RNA, 19 nt, Human
gggcaguggcacuagggag

SEQ ID NO: 516045 - RNA, 22 nt, Human
ggggcucaguucggacagccug

SEQ ID NO: 516046 - RNA, 22 nt, Human
agggaaagguagugaggucaca

SEQ ID NO: 516047 - RNA, 22 nt, Human
aaggcuuuaugugaccaaaaga

SEQ ID NO: 516048 - RNA, 22 nt, Human
gagggcucugucuggaagggaa

SEQ ID NO: 516049 - RNA, 22 nt, Human
uugggggcauauugaguagugg

SEQ ID NO: 516050 - RNA, 22 nt, Human
auaacagauacucucugugagg

SEQ ID NO: 516051 - RNA, 23 nt, Human
acugggcugaaauuaaagguguc

SEQ ID NO: 516052 - RNA, 22 nt, Human
ccaaagucugcauuuuaacaug

SEQ ID NO: 516053 - RNA, 22 nt, Human
ggagggggaaacuuuggcugcc

SEQ ID NO: 516054 - RNA, 22 nt, Human
ugcaggccuaugguggggcccc

SEQ ID NO: 516055 - RNA, 22 nt, Human
uacuuuaaaaacugauaauuca

SEQ ID NO: 516056 - RNA, 22 nt, Human
ccugccuguacuagagacccag

SEQ ID NO: 516057 - RNA, 19 nt, Human
cugagcagcggcagcacuu

SEQ ID NO: 516058 - RNA, 22 nt, Human
aggccucacucucagagcuucu

SEQ ID NO: 516059 - RNA, 22 nt, Human
aagggcagaaagggacgcuuug

SEQ ID NO: 516060 - RNA, 22 nt, Human
guguucuuuugcuucacagaaa

SEQ ID NO: 516061 - RNA, 22 nt, Human
aggucugguguugggccugaaa

SEQ ID NO: 516062 - RNA, 23 nt, Human
aagcugccuucgcaguuggucug

SEQ ID NO: 516063 - RNA, 22 nt, Human
aucaaugcuugccaaauggaag

SEQ ID NO: 516064 - RNA, 22 nt, Human
cucugaacucuugggcagcaug

SEQ ID NO: 516065 - RNA, 22 nt, Human
cuggggcaucauccauucuuuc

SEQ ID NO: 516066 - RNA, 22 nt, Human
ugucucaggggcauugaaauaa

SEQ ID NO: 516067 - RNA, 22 nt, Human
guuaauaaagguauagaaucag

SEQ ID NO: 516068 - RNA, 22 nt, Human
gagugcaauaaacuguuuucua

SEQ ID NO: 516069 - RNA, 22 nt, Human
uccuucagaggacggcagccag

SEQ ID NO: 516070 - RNA, 22 nt, Human
gcaaggcugugcacuuugcauu

SEQ ID NO: 516071 - RNA, 20 nt, Human
aggcugccaggucucacauc

SEQ ID NO: 516072 - RNA, 22 nt, Human
ccuggaggagcgcugaccagcu

SEQ ID NO: 516073 - RNA, 22 nt, Human
ccuggcugcuuccucugccaug

SEQ ID NO: 516074 - RNA, 22 nt, Human
aaagccuucugucuagcagaua

SEQ ID NO: 516075 - RNA, 22 nt, Human
gaucacaugaauggaauagaag

SEQ ID NO: 516076 - RNA, 22 nt, Human
caaaggagguaaugggugugag

SEQ ID NO: 516077 - RNA, 22 nt, Human
guuagguagaaguuuacuuuga

SEQ ID NO: 516078 - RNA, 22 nt, Human
ucagggcagguuaacuugggug

SEQ ID NO: 516079 - RNA, 22 nt, Human
uggcacaggagcacugcccugg

SEQ ID NO: 516080 - RNA, 22 nt, Human
cuggccacaacuagcccaggac

SEQ ID NO: 516081 - RNA, 22 nt, Human
uucaaauccuagcccuguggcc

SEQ ID NO: 516082 - RNA, 22 nt, Human
uucaggaugcagagguuguagu

SEQ ID NO: 516083 - RNA, 22 nt, Human
augugaaagagguguucagugg

SEQ ID NO: 516084 - RNA, 22 nt, Human
uugcugaaaucuaugacauccu

SEQ ID NO: 516085 - RNA, 22 nt, Human
cacagaaucugugacuccaaga

SEQ ID NO: 516086 - RNA, 22 nt, Human
uggcccuuguucaaauauguca

SEQ ID NO: 516087 - RNA, 23 nt, Human
ccagcucccaggucugaggacug

SEQ ID NO: 516088 - RNA, 22 nt, Human
agcagcuccugccaugagugcu

SEQ ID NO: 516089 - RNA, 22 nt, Human
gggcagccucggugccugcugc

SEQ ID NO: 516090 - RNA, 21 nt, Human
agagucugcauuucugacaag

SEQ ID NO: 516091 - RNA, 22 nt, Human
aggaagcuccuggagagccagu

SEQ ID NO: 516092 - RNA, 22 nt, Human
agaggcccucucucuccugaug

SEQ ID NO: 516093 - RNA, 22 nt, Human
guggccaggccgacugccaggc

SEQ ID NO: 516094 - RNA, 22 nt, Human
cauuugaaauaguucauucuug

SEQ ID NO: 516095 - RNA, 22 nt, Human
cccucaggagaugucagcugga

SEQ ID NO: 516096 - RNA, 22 nt, Human
gaaaggucuuccggucuuccag

SEQ ID NO: 516097 - RNA, 22 nt, Human
gcugaagcugcagcaggaggaa

SEQ ID NO: 516098 - RNA, 22 nt, Human
uuauguacucugcaauguuuga

SEQ ID NO: 516099 - RNA, 22 nt, Human
cuuuucugugaugcugacaguc

SEQ ID NO: 516100 - RNA, 18 nt, Human
agucuucugauccauuuu

SEQ ID NO: 516101 - RNA, 22 nt, Human
uacuuuagaaggaaauaaguuc

SEQ ID NO: 516102 - RNA, 22 nt, Human
aaaaauaggucaaccguguaug

SEQ ID NO: 516103 - RNA, 22 nt, Human
cuaagacaugcccugcaugaua

SEQ ID NO: 516104 - RNA, 22 nt, Human
augaggcaugugaggagaaggg

SEQ ID NO: 516105 - RNA, 22 nt, Human
cagcuccucuguuagcccuggg

SEQ ID NO: 516106 - RNA, 20 nt, Human
uccuggaguauuccaugcuu

SEQ ID NO: 516107 - RNA, 22 nt, Human
cccagcagcuugcacagugcug

SEQ ID NO: 516108 - RNA, 22 nt, Human
ccuggcagcuguuuggcuuggc

SEQ ID NO: 516109 - RNA, 19 nt, Human
ccagccucucuuccacccc

SEQ ID NO: 516110 - RNA, 22 nt, Human
uccuugaagaaugauucuugga

SEQ ID NO: 516111 - RNA, 22 nt, Human
cugggccagaagacauuuagga

SEQ ID NO: 516112 - RNA, 22 nt, Human
agcugagagguggcaagcugua

SEQ ID NO: 516113 - RNA, 20 nt, Human
cuccagggaacagacuggag

SEQ ID NO: 516114 - RNA, 22 nt, Human
uccugcagacauuuacaccuuu

SEQ ID NO: 516115 - RNA, 21 nt, Human
uccuggcuuuaugcuaccucu

SEQ ID NO: 516116 - RNA, 22 nt, Human
cuuguuuuuaagagauguuuac

SEQ ID NO: 516117 - RNA, 22 nt, Human
gcagcuggaagugacacucugu

SEQ ID NO: 516118 - RNA, 22 nt, Human
ugauuuccucuacuagcaauua

SEQ ID NO: 516119 - RNA, 22 nt, Human
cugcccugugcacaggaaacug

SEQ ID NO: 516120 - RNA, 22 nt, Human
auuaguguacaucucacacgca

SEQ ID NO: 516121 - RNA, 22 nt, Human
ccagagagucgaugggggacac

SEQ ID NO: 516122 - RNA, 22 nt, Human
cugcugcaaucuggcuuccaug

SEQ ID NO: 516123 - RNA, 22 nt, Human
agagcuggcugcugcggugcuu

SEQ ID NO: 516124 - RNA, 22 nt, Human
uaaggaaacaacuuguauuuuu

SEQ ID NO: 516125 - RNA, 22 nt, Human
uggggcucaccuaggcuggaag

SEQ ID NO: 516126 - RNA, 22 nt, Human
agggccacuggcugacggcugc

SEQ ID NO: 516127 - RNA, 22 nt, Human
ugauauaagaaguaguauggau

SEQ ID NO: 516128 - RNA, 22 nt, Human
gauuucaaagguucugcaugcc

SEQ ID NO: 516129 - RNA, 22 nt, Human
acagcuggugaauguucucugu

SEQ ID NO: 516130 - RNA, 22 nt, Human
cugggaggcagucucucuagaa

SEQ ID NO: 516131 - RNA, 22 nt, Human
aaagcagaggugauaugacuua

SEQ ID NO: 516132 - RNA, 22 nt, Human
uagaaguuucaaaagacuucau

SEQ ID NO: 516133 - RNA, 22 nt, Human
cagagguaccagcagccucugg

SEQ ID NO: 516134 - RNA, 22 nt, Human
caugagugucaucucagcagcu

SEQ ID NO: 516135 - RNA, 22 nt, Human
ugcuggaugcuugauuuugagg

SEQ ID NO: 516136 - RNA, 22 nt, Human
aucuuugcuauuguaaaucacg

SEQ ID NO: 516137 - RNA, 22 nt, Human
cugucauugagccugucagggc

SEQ ID NO: 516138 - RNA, 22 nt, Human
uuacugaaaauucuucaggauu

SEQ ID NO: 516139 - RNA, 22 nt, Human
gacacuucaccuuucccagccu

SEQ ID NO: 516140 - RNA, 22 nt, Human
ggccagcagucacagggucaga

SEQ ID NO: 516141 - RNA, 20 nt, Human
agggcagagggauuacaggc

SEQ ID NO: 516142 - RNA, 22 nt, Human
uuggcugagagaggaaaagggc

SEQ ID NO: 516143 - RNA, 22 nt, Human
uggcauguuuaauguacuguau

SEQ ID NO: 516144 - RNA, 22 nt, Human
caaauauuccagguacaucccu

SEQ ID NO: 516145 - RNA, 22 nt, Human
acagcuuuuuacuaauagauug

SEQ ID NO: 516146 - RNA, 22 nt, Human
uuugcauuuuagauuuaggccu

SEQ ID NO: 516147 - RNA, 22 nt, Human
ccucugggugacagacucuugg

SEQ ID NO: 516148 - RNA, 22 nt, Human
aggaagcuaaccagggagugag

SEQ ID NO: 516149 - RNA, 22 nt, Human
ccuggcacauaguaaguacuag

SEQ ID NO: 516150 - RNA, 22 nt, Human
aggagcagaccguaguccugca

SEQ ID NO: 516151 - RNA, 22 nt, Human
cuaauuguaagcuccuugaggg

SEQ ID NO: 516152 - RNA, 22 nt, Human
aaggccugggaggccucucuuc

SEQ ID NO: 516153 - RNA, 22 nt, Human
acucuugucucaacuuuuguau

SEQ ID NO: 516154 - RNA, 22 nt, Human
ggagccugacagugcccagcau

SEQ ID NO: 516155 - RNA, 22 nt, Human
accaagcuguauauuauugguu

SEQ ID NO: 516156 - RNA, 22 nt, Human
guggccugucagaagccguggg

SEQ ID NO: 516157 - RNA, 22 nt, Human
ucacagaaggagggaagcuagu

SEQ ID NO: 516158 - RNA, 22 nt, Human
uuauucagucugucuagggagu

SEQ ID NO: 516159 - RNA, 22 nt, Human
agguauauauucugguccuuau

SEQ ID NO: 516160 - RNA, 21 nt, Human
gcagccacugccuucaacaau

SEQ ID NO: 516161 - RNA, 21 nt, Human
ugggauagaaauauggcugcu

SEQ ID NO: 516162 - RNA, 22 nt, Human
uuggccaguggaaagaggagga

SEQ ID NO: 516163 - RNA, 22 nt, Human
auuagcuuuauuugaaauagga

SEQ ID NO: 516164 - RNA, 23 nt, Human
ugcugggcagagcuggugcugag

SEQ ID NO: 516165 - RNA, 22 nt, Human
ugggugcuucgucagcucugag

SEQ ID NO: 516166 - RNA, 22 nt, Human
cagcccagccuugucucuuuau

SEQ ID NO: 516167 - RNA, 22 nt, Human
gugaauaaucacccuucuggau

SEQ ID NO: 516168 - RNA, 22 nt, Human
uauuugaagauucuucugaugu

SEQ ID NO: 516169 - RNA, 22 nt, Human
cugaggcucaagggcagguggg

SEQ ID NO: 516170 - RNA, 22 nt, Human
auaaaaguaggaccaacuuaca

SEQ ID NO: 516171 - RNA, 22 nt, Human
gcugcagcagcugcaggguugu

SEQ ID NO: 516172 - RNA, 22 nt, Human
guggaagggucacagccccuac

SEQ ID NO: 516173 - RNA, 22 nt, Human
aaugucuacaccguauguuguu

SEQ ID NO: 516174 - RNA, 23 nt, Human
aacuccugaaucgugagccaucu

SEQ ID NO: 516175 - RNA, 22 nt, Human
gggccccuuguaucucuggcuc

SEQ ID NO: 516176 - RNA, 22 nt, Human
ggcucacgcaauuaucccggcc

SEQ ID NO: 516177 - RNA, 22 nt, Human
acagcuuuugaaaaauuacugg

SEQ ID NO: 516178 - RNA, 22 nt, Human
auacauauaugguacuuccugg

SEQ ID NO: 516179 - RNA, 22 nt, Human
gacagcauggugucuguucagg

SEQ ID NO: 516180 - RNA, 22 nt, Human
gccaccagugggggccugggca

SEQ ID NO: 516181 - RNA, 22 nt, Human
uagacacauccguggaagcuuc

SEQ ID NO: 516182 - RNA, 22 nt, Human
cuuaauuucaaacugcuaguga

SEQ ID NO: 516183 - RNA, 22 nt, Human
augcuuuuaugucacaugguca

SEQ ID NO: 516184 - RNA, 22 nt, Human
aaacauuguacauucuguagcu

SEQ ID NO: 516185 - RNA, 22 nt, Human
cugggccuggcguuccaggcug

SEQ ID NO: 516186 - RNA, 22 nt, Human
ugucuguggcaauuguggguaa

SEQ ID NO: 516187 - RNA, 22 nt, Human
uagcuuuaccauagaagaguau

SEQ ID NO: 516188 - RNA, 22 nt, Human
uggaagcuguggcauaacugag

SEQ ID NO: 516189 - RNA, 23 nt, Human
ugcucccaggugacgcugcuguu

SEQ ID NO: 516190 - RNA, 22 nt, Human
gcugggucccaagccuggggag

SEQ ID NO: 516191 - RNA, 22 nt, Human
cagggcagaacauauagauagu

SEQ ID NO: 516192 - RNA, 19 nt, Human
cacaacuucgcuugauucc

SEQ ID NO: 516193 - RNA, 22 nt, Human
ugcugccagggcucugcccaca

SEQ ID NO: 516194 - RNA, 22 nt, Human
aauuaacagagggcuuauuacu

SEQ ID NO: 516195 - RNA, 19 nt, Human
ggcaccuuggcuaugccug

SEQ ID NO: 516196 - RNA, 22 nt, Human
aaggcacugagccagccgucuc

SEQ ID NO: 516197 - RNA, 22 nt, Human
cuucugggccauggccuuccuc

SEQ ID NO: 516198 - RNA, 22 nt, Human
aggcacuguucccaguuauccu

SEQ ID NO: 516199 - RNA, 22 nt, Human
ugucuuuucuacuguaagcaua

SEQ ID NO: 516200 - RNA, 22 nt, Human
gagaaggggugauguggguaau

SEQ ID NO: 516201 - RNA, 22 nt, Human
ccagagcugcauccagcagguu

SEQ ID NO: 516202 - RNA, 20 nt, Human
aguuauaguaucuagccaug

SEQ ID NO: 516203 - RNA, 22 nt, Human
agcagaacauuuucagggcugu

SEQ ID NO: 516204 - RNA, 22 nt, Human
cagauaaaggcuuacuaguagu

SEQ ID NO: 516205 - RNA, 22 nt, Human
uaaagugcuggauuugaguaaa

SEQ ID NO: 516206 - RNA, 22 nt, Human
uccaagaucuacagcaguuuag

SEQ ID NO: 516207 - RNA, 22 nt, Human
uuccaguugguagaauguaagg

SEQ ID NO: 516208 - RNA, 21 nt, Human
uucaaagagugggcauuguca

SEQ ID NO: 516209 - RNA, 22 nt, Human
cacauuugaaggaauuagcauu

SEQ ID NO: 516210 - RNA, 22 nt, Human
aaaguuagaaugauaucaacga

SEQ ID NO: 516211 - RNA, 20 nt, Human
ggaaaaaugcaugcucaaga

SEQ ID NO: 516212 - RNA, 22 nt, Human
acaggcagguccugucccagcu

SEQ ID NO: 516213 - RNA, 22 nt, Human
uucugggcaggacuggggaccc

SEQ ID NO: 516214 - RNA, 22 nt, Human
cugccaggcugucccagguccg

SEQ ID NO: 516215 - RNA, 22 nt, Human
ucuguucuuguccccacuucag

SEQ ID NO: 516216 - RNA, 22 nt, Human
agccacagagagggagcugcaa

SEQ ID NO: 516217 - RNA, 22 nt, Human
cagaggccuggcuuggacaccu

SEQ ID NO: 516218 - RNA, 22 nt, Human
caggguggcccuguggucucau

SEQ ID NO: 516219 - RNA, 22 nt, Human
uguuaucugagcaacgucgacg

SEQ ID NO: 516220 - RNA, 22 nt, Human
ggacacacaaguuaucuaauga

SEQ ID NO: 516221 - RNA, 18 nt, Human
aaagaaggauuggagagc

SEQ ID NO: 516222 - RNA, 22 nt, Human
cagaaauaaacuucucacaucg

SEQ ID NO: 516223 - RNA, 23 nt, Human
uugugggcagauuccauggggag

SEQ ID NO: 516224 - RNA, 22 nt, Human
cugggagggguagccaauccua

SEQ ID NO: 516225 - RNA, 22 nt, Human
gaugagaauguuuaucaaaugc

SEQ ID NO: 516226 - RNA, 19 nt, Human
ccaggccucuggggccugu

SEQ ID NO: 516227 - RNA, 22 nt, Human
aaguuucaugauguaauuauug

SEQ ID NO: 516228 - RNA, 22 nt, Human
uuccuugaaugagucauggaaa

SEQ ID NO: 516229 - RNA, 22 nt, Human
ugcccuguggguaucugauggc

SEQ ID NO: 516230 - RNA, 22 nt, Human
aaagagcuucauuuccauuuau

SEQ ID NO: 516231 - RNA, 22 nt, Human
uaaaugugagugaugcggugaa

SEQ ID NO: 516232 - RNA, 22 nt, Human
uacagugucccuuuuucagaca

SEQ ID NO: 516233 - RNA, 22 nt, Human
acauuuaggauguuuugagaga

SEQ ID NO: 516234 - RNA, 22 nt, Human
cuuguacauagagaagaagccu

SEQ ID NO: 516235 - RNA, 22 nt, Human
augccaaagcccaaguucauca

SEQ ID NO: 516236 - RNA, 22 nt, Human
uggcugcuagccagagcuucag

SEQ ID NO: 516237 - RNA, 22 nt, Human
cagaggugcauacaggucauua

SEQ ID NO: 516238 - RNA, 22 nt, Human
uauguguggcagcugggagugu

SEQ ID NO: 516239 - RNA, 22 nt, Human
aaguuuguucauucauucaucc

SEQ ID NO: 516240 - RNA, 22 nt, Human
caauuacauuuauugagcauuc

SEQ ID NO: 516241 - RNA, 22 nt, Human
acucacuuuccauucaagcacc

SEQ ID NO: 516242 - RNA, 22 nt, Human
acagcagcuaaccccugggcca

SEQ ID NO: 516243 - RNA, 22 nt, Human
aaucucacucaaagaauucucu

SEQ ID NO: 516244 - RNA, 22 nt, Human
auugacuuucccuucuccucau

SEQ ID NO: 516245 - RNA, 22 nt, Human
ugggcucuggagggccuaggau

SEQ ID NO: 516246 - RNA, 22 nt, Human
uauuuauguggaccauaagccu

SEQ ID NO: 516247 - RNA, 22 nt, Human
uuuaguagaaauauuugggccu

SEQ ID NO: 516248 - RNA, 20 nt, Human
accuaguacaaucuguuucu

SEQ ID NO: 516249 - RNA, 22 nt, Human
gccuguuuaaguauucugacau

SEQ ID NO: 516250 - RNA, 22 nt, Human
cuuuucuagagccgcagcccua

SEQ ID NO: 516251 - RNA, 22 nt, Human
aucaaaguccaucagaagguag

SEQ ID NO: 516252 - RNA, 22 nt, Human
uucacuuaacaucauaucauga

SEQ ID NO: 516253 - RNA, 22 nt, Human
auguaagguucagaguauguga

SEQ ID NO: 516254 - RNA, 22 nt, Human
agccauccuacuaccucagcau

SEQ ID NO: 516255 - RNA, 22 nt, Human
guauuagcaagaguugugauuu

SEQ ID NO: 516256 - RNA, 22 nt, Human
gcacugcagguggguggagagg

SEQ ID NO: 516257 - RNA, 22 nt, Human
cagcucugguccagggagggca

SEQ ID NO: 516258 - RNA, 22 nt, Human
guuggccugaauggucaagagg

SEQ ID NO: 516259 - RNA, 22 nt, Human
ccacugggggcugcaggcacuc

SEQ ID NO: 516260 - RNA, 22 nt, Human
ucugaggccccugggcaggaug

SEQ ID NO: 516261 - RNA, 22 nt, Human
aaaaugagccaugaaccaacca

SEQ ID NO: 516262 - RNA, 22 nt, Human
aggggauggagcuggaaggcag

SEQ ID NO: 516263 - RNA, 22 nt, Human
uagcugaagggcauuuaauaaa

SEQ ID NO: 516264 - RNA, 22 nt, Human
caggggcuuaagugacagaagg

SEQ ID NO: 516265 - RNA, 22 nt, Human
uggccugggugcugcugacauc

SEQ ID NO: 516266 - RNA, 22 nt, Human
ggaggccagccugaggcugagg

SEQ ID NO: 516267 - RNA, 22 nt, Human
uguaagauauucagcuuauuga

SEQ ID NO: 516268 - RNA, 22 nt, Human
guggcccaggcuuggcgcuggc

SEQ ID NO: 516269 - RNA, 22 nt, Human
uucagcaccuggaauagcaccu

SEQ ID NO: 516270 - RNA, 23 nt, Human
augcucugggcugugggaccugc

SEQ ID NO: 516271 - RNA, 22 nt, Human
ggcauccaguucugaucaacaa

SEQ ID NO: 516272 - RNA, 22 nt, Human
ucuacagugucaaugugucuug

SEQ ID NO: 516273 - RNA, 22 nt, Human
agacuucuuugugagcauuuuc

SEQ ID NO: 516274 - RNA, 22 nt, Human
ugcuuaaaaagcuccaucaaua

SEQ ID NO: 516275 - RNA, 22 nt, Human
gcacugaacuuuaaucauuucu

SEQ ID NO: 516276 - RNA, 19 nt, Human
gucucuggauuucaggucc

SEQ ID NO: 516277 - RNA, 22 nt, Human
ccuggugccacuagagaauguc

SEQ ID NO: 516278 - RNA, 22 nt, Human
gcugcugggguggagaaacgcu

SEQ ID NO: 516279 - RNA, 22 nt, Human
uggcagcucuguucaacaugag

SEQ ID NO: 516280 - RNA, 22 nt, Human
gugggguagaucuuucucagga

SEQ ID NO: 516281 - RNA, 22 nt, Human
accaugaugggaagcucagggc

SEQ ID NO: 516282 - RNA, 22 nt, Human
aauucuugguccuaguguauaa

SEQ ID NO: 516283 - RNA, 22 nt, Human
accugagccuagggagguugag

SEQ ID NO: 516284 - RNA, 22 nt, Human
uggcagguggcacagccuggga

SEQ ID NO: 516285 - RNA, 22 nt, Human
ccuggcucauuaugugccccca

SEQ ID NO: 516286 - RNA, 22 nt, Human
ucagccacuacccaccuuaaca

SEQ ID NO: 516287 - RNA, 22 nt, Human
ucucauggagucaggagcagaa

SEQ ID NO: 516288 - RNA, 22 nt, Human
gucagagagggcacgugcacac

SEQ ID NO: 516289 - RNA, 22 nt, Human
cuagucacacaguaaggacggg

SEQ ID NO: 516290 - RNA, 22 nt, Human
ggcaggguggcccuccagugag

SEQ ID NO: 516291 - RNA, 22 nt, Human
uagcacuauauguuagcuauua

SEQ ID NO: 516292 - RNA, 22 nt, Human
uccucagcuuuuauuucacuug

SEQ ID NO: 516293 - RNA, 19 nt, Human
cacacccaugcuugccaag

SEQ ID NO: 516294 - RNA, 22 nt, Human
uuucuguauuuaaaagaucugg

SEQ ID NO: 516295 - RNA, 22 nt, Human
uguucuugggaaucuuacaguu

SEQ ID NO: 516296 - RNA, 20 nt, Human
ucagccuucucauccugggg

SEQ ID NO: 516297 - RNA, 22 nt, Human
caguggguccugcgucugccag

SEQ ID NO: 516298 - RNA, 22 nt, Human
cugguccuccuugccuucagau

SEQ ID NO: 516299 - RNA, 22 nt, Human
aagccaggcaugcuuggacagu

SEQ ID NO: 516300 - RNA, 22 nt, Human
cugaauaauauuccauuaugag

SEQ ID NO: 516301 - RNA, 22 nt, Human
agcugcagcuuccuaguccagc

SEQ ID NO: 516302 - RNA, 18 nt, Human
caggugggucuccugccc

SEQ ID NO: 516303 - RNA, 22 nt, Human
aaaggccaauaaagacaagcug

SEQ ID NO: 516304 - RNA, 22 nt, Human
agccaugcaccuuacucuugcu

SEQ ID NO: 516305 - RNA, 22 nt, Human
ggaaggcucuguuccuugacuu

SEQ ID NO: 516306 - RNA, 22 nt, Human
agucucugcaugccugcugugc

SEQ ID NO: 516307 - RNA, 22 nt, Human
ucccacugcuuugcucugcuca

SEQ ID NO: 516308 - RNA, 22 nt, Human
aaggcugagacagcacaggucc

SEQ ID NO: 516309 - RNA, 22 nt, Human
cugggcucaaauccuaucucca

SEQ ID NO: 516310 - RNA, 22 nt, Human
acauuucagauucaugaaguga

SEQ ID NO: 516311 - RNA, 22 nt, Human
uggggacauucaugcagguugu

SEQ ID NO: 516312 - RNA, 22 nt, Human
aagcaggacguauuucuauccu

SEQ ID NO: 516313 - RNA, 22 nt, Human
ggguaauuggggccuugcagug

SEQ ID NO: 516314 - RNA, 22 nt, Human
uuccaggaaaacaguuggaagu

SEQ ID NO: 516315 - RNA, 22 nt, Human
aagagaugauggcagccagagg

SEQ ID NO: 516316 - RNA, 22 nt, Human
caggaggcaucauggagcggac

SEQ ID NO: 516317 - RNA, 22 nt, Human
auuauguauuugguauaguuug

SEQ ID NO: 516318 - RNA, 22 nt, Human
ggcugcuggaagacugaacaag

SEQ ID NO: 516319 - RNA, 22 nt, Human
aggauccuuuggccacuucuua

SEQ ID NO: 516320 - RNA, 22 nt, Human
gccuggggaacuugauccuguc

SEQ ID NO: 516321 - RNA, 23 nt, Human
agguccuggacauaugugcauca

SEQ ID NO: 516322 - RNA, 23 nt, Human
aaauucaguccuucaacucugag

SEQ ID NO: 516323 - RNA, 22 nt, Human
acagauguuagcaaugaugaug

SEQ ID NO: 516324 - RNA, 22 nt, Human
acugucucucuagcaguucagg

SEQ ID NO: 516325 - RNA, 22 nt, Human
uugcaucuagggcaacccagag

SEQ ID NO: 516326 - RNA, 22 nt, Human
ucucuggcuccugccgggucca

SEQ ID NO: 516327 - RNA, 22 nt, Human
ggaggugguggcagugacaauu

SEQ ID NO: 516328 - RNA, 23 nt, Human
acagaggcuuaaaugaguggcag

SEQ ID NO: 516329 - RNA, 22 nt, Human
ccuggcuuuuguuuauaaauuc

SEQ ID NO: 516330 - RNA, 22 nt, Human
ggaaggcagaggugucgugggg

SEQ ID NO: 516331 - RNA, 22 nt, Human
ugcagaagaauguaggcauaag

SEQ ID NO: 516332 - RNA, 22 nt, Human
gggaaggcagugucugguugaa

SEQ ID NO: 516333 - RNA, 22 nt, Human
agccaggaagaaggucacacca

SEQ ID NO: 516334 - RNA, 22 nt, Human
ccccaugcugggaucugacacc

SEQ ID NO: 516335 - RNA, 22 nt, Human
gcucugggaauucagaaagccu

SEQ ID NO: 516336 - RNA, 22 nt, Human
cuuuguggcuccugcaggccau

SEQ ID NO: 516337 - RNA, 22 nt, Human
gagaggccaaaaucccugcccc

SEQ ID NO: 516338 - RNA, 22 nt, Human
cucugggcaaguaugauagaaa

SEQ ID NO: 516339 - RNA, 22 nt, Human
cagacccucgggugaguuggcc

SEQ ID NO: 516340 - RNA, 22 nt, Human
caucuugcuugucuuuaguaag

SEQ ID NO: 516341 - RNA, 22 nt, Human
ugaagcagcuucuuucugucaa

SEQ ID NO: 516342 - RNA, 22 nt, Human
ucuacugcacuggugucucauc

SEQ ID NO: 516343 - RNA, 22 nt, Human
uauucacaaaaugagguccuca

SEQ ID NO: 516344 - RNA, 22 nt, Human
gcagggacaucuucagaucacu

SEQ ID NO: 516345 - RNA, 22 nt, Human
gggaucugaugcacugcugaaa

SEQ ID NO: 516346 - RNA, 22 nt, Human
gagcccaggcagagguugcagu

SEQ ID NO: 516347 - RNA, 22 nt, Human
cucucagugccugcccuaggcu

SEQ ID NO: 516348 - RNA, 22 nt, Human
guccuggcccacuggcaggcug

SEQ ID NO: 516349 - RNA, 22 nt, Human
caggcagcgcucguggccuggc

SEQ ID NO: 516350 - RNA, 21 nt, Human
gcaaggcuuuuguguuuccca

SEQ ID NO: 516351 - RNA, 22 nt, Human
caggcacugcacuaccacuuuu

SEQ ID NO: 516352 - RNA, 22 nt, Human
ccucagugugcagcagcaucug

SEQ ID NO: 516353 - RNA, 22 nt, Human
aagggcucugugcuugucccau

SEQ ID NO: 516354 - RNA, 17 nt, Human
ggccuugggcugcucuu

SEQ ID NO: 516355 - RNA, 22 nt, Human
gcuggccacacugcugauggag

SEQ ID NO: 516356 - RNA, 22 nt, Human
acucuggcuauucacuauaaua

SEQ ID NO: 516357 - RNA, 23 nt, Human
uuucuguuggguauauauccaag

SEQ ID NO: 516358 - RNA, 22 nt, Human
aggccugucuggggcucagcca

SEQ ID NO: 516359 - RNA, 22 nt, Human
cugugucugccugggauccauu

SEQ ID NO: 516360 - RNA, 22 nt, Human
gcguggcuuagagugggguacc

SEQ ID NO: 516361 - RNA, 22 nt, Human
gagugcaggccugagcaccauc

SEQ ID NO: 516362 - RNA, 22 nt, Human
auacuugagguuguauaaauau

SEQ ID NO: 516363 - RNA, 17 nt, Human
aaugaaugaauucuuug

SEQ ID NO: 516364 - RNA, 22 nt, Human
gggucuggcaugcugagaugga

SEQ ID NO: 516365 - RNA, 22 nt, Human
gaugaagccugacuucucggug

SEQ ID NO: 516366 - RNA, 22 nt, Human
acugcguggggagcugugacua

SEQ ID NO: 516367 - RNA, 22 nt, Human
uauauacaagguagguuuaggu

SEQ ID NO: 516368 - RNA, 22 nt, Human
uauaauuuggggaaaguggugu

SEQ ID NO: 516369 - RNA, 22 nt, Human
agggcuggccacaugauuuggu

SEQ ID NO: 516370 - RNA, 22 nt, Human
uuugaugaugaugauaaaguuu

SEQ ID NO: 516371 - RNA, 22 nt, Human
gagcugccaguguaugaauucu

SEQ ID NO: 516372 - RNA, 20 nt, Human
agagcugggaagcucccuau

SEQ ID NO: 516373 - RNA, 22 nt, Human
acacacagguaaaggagccugg

SEQ ID NO: 516374 - RNA, 22 nt, Human
auacuguacgucccagauagga

SEQ ID NO: 516375 - RNA, 22 nt, Human
agcaggcacgcucccugcgcga

SEQ ID NO: 516376 - RNA, 22 nt, Human
cacacauugaauucauucuugu

SEQ ID NO: 516377 - RNA, 20 nt, Human
uggaauggguccuugaaaaa

SEQ ID NO: 516378 - RNA, 22 nt, Human
gcaggcugauagaggauuccau

SEQ ID NO: 516379 - RNA, 22 nt, Human
uucauguguauggaacauuuuu

SEQ ID NO: 516380 - RNA, 22 nt, Human
aaaggagaaaacauacaggacu

SEQ ID NO: 516381 - RNA, 22 nt, Human
aggugacaucccggcagcagag

SEQ ID NO: 516382 - RNA, 22 nt, Human
ggccucagaggaggugugaguc

SEQ ID NO: 516383 - RNA, 22 nt, Human
cagcagcuccucugcggcuaug

SEQ ID NO: 516384 - RNA, 17 nt, Human
gcugcagcgguaggcag

SEQ ID NO: 516385 - RNA, 22 nt, Human
gugguccuggcaaccaugguga

SEQ ID NO: 516386 - RNA, 22 nt, Human
ggcaucuuguugcucaaaucua

SEQ ID NO: 516387 - RNA, 22 nt, Human
ucacagaagcaucauacccgga

SEQ ID NO: 516388 - RNA, 22 nt, Human
auguaaaguaucugaaaugcug

SEQ ID NO: 516389 - RNA, 22 nt, Human
uuucagagaugcagaauucagg

SEQ ID NO: 516390 - RNA, 22 nt, Human
gccaggcaggccacgcuguguu

SEQ ID NO: 516391 - RNA, 22 nt, Human
cagcaggaaagacaucugagca

SEQ ID NO: 516392 - RNA, 22 nt, Human
uauguacaguccuuaacuuaaa

SEQ ID NO: 516393 - RNA, 22 nt, Human
uucucuggaaggcucuacggga

SEQ ID NO: 516394 - RNA, 22 nt, Human
gcuggagcugcagccugggccu

SEQ ID NO: 516395 - RNA, 22 nt, Human
gcaggggaguccacucuaugca

SEQ ID NO: 516396 - RNA, 22 nt, Human
aauuucuccaagaaugcuuaga

SEQ ID NO: 516397 - RNA, 22 nt, Human
cuuguuuuaaacuguuguggcu

SEQ ID NO: 516398 - RNA, 22 nt, Human
gccugccugcugugugcaaguu

SEQ ID NO: 516399 - RNA, 22 nt, Human
ccagagagcuacaaggcauaaa

SEQ ID NO: 516400 - RNA, 22 nt, Human
aaauaguucagccacggugacu

SEQ ID NO: 516401 - RNA, 22 nt, Human
ccagaggcauguucaaagcaau

SEQ ID NO: 516402 - RNA, 22 nt, Human
ggaagagagggcugggccucaa

SEQ ID NO: 516403 - RNA, 22 nt, Human
cuucauuaaugucuauaaguuu

SEQ ID NO: 516404 - RNA, 21 nt, Human
agggcagauuagcuguaagag

SEQ ID NO: 516405 - RNA, 22 nt, Human
uuugggcaggcuuuucccuaga

SEQ ID NO: 516406 - RNA, 21 nt, Human
agacagaacaacugcucucca

SEQ ID NO: 516407 - RNA, 22 nt, Human
uccuggcccuguggccugcagu

SEQ ID NO: 516408 - RNA, 22 nt, Human
aucuggcucucucauuuacaaa

SEQ ID NO: 516409 - RNA, 22 nt, Human
augguguagcaugugauaugac

SEQ ID NO: 516410 - RNA, 22 nt, Human
gagguacaugaggauacacagg

SEQ ID NO: 516411 - RNA, 20 nt, Human
cugggcagguguuugaucuc

SEQ ID NO: 516412 - RNA, 22 nt, Human
acaaggaggucuggggggcccu

SEQ ID NO: 516413 - RNA, 22 nt, Human
gaggaccacagaugagccugca

SEQ ID NO: 516414 - RNA, 17 nt, Human
uuucagauucacuuucu

SEQ ID NO: 516415 - RNA, 22 nt, Human
aaaaacugcaauuacuuuuguc

SEQ ID NO: 516416 - RNA, 22 nt, Human
ccuuuuggccaggucagugcag

SEQ ID NO: 516417 - RNA, 22 nt, Human
auugaaagagaauguagcucuu

SEQ ID NO: 516418 - RNA, 21 nt, Human
uuccuggggaaggagcugccu

SEQ ID NO: 516419 - RNA, 22 nt, Human
aagggcaggaaaagauggaugu

SEQ ID NO: 516420 - RNA, 22 nt, Human
ucccuguguccaugccaggagg

SEQ ID NO: 516421 - RNA, 17 nt, Human
gaacuuuuauuaaauuc

SEQ ID NO: 516422 - RNA, 22 nt, Human
agucugaaccagauggcaaggu

SEQ ID NO: 516423 - RNA, 22 nt, Human
uuauacaggagauuccuuacuu

SEQ ID NO: 516424 - RNA, 22 nt, Human
auuaaauuggacgcugggggaa

SEQ ID NO: 516425 - RNA, 22 nt, Human
uguccuguucuugcuguguccu

SEQ ID NO: 516426 - RNA, 22 nt, Human
aaucaauguuagucaugaauuu

SEQ ID NO: 516427 - RNA, 19 nt, Human
uccugcccaccagccaggg

SEQ ID NO: 516428 - RNA, 22 nt, Human
ugggcagaggacagggaagauc

SEQ ID NO: 516429 - RNA, 22 nt, Human
aauuuggcagugucuugaagua

SEQ ID NO: 516430 - RNA, 22 nt, Human
ucacacguccuugcuacuccuc

SEQ ID NO: 516431 - RNA, 22 nt, Human
cacaugugugcugaggacugug

SEQ ID NO: 516432 - RNA, 21 nt, Human
ugcagagauaucugaagcaga

SEQ ID NO: 516433 - RNA, 23 nt, Human
aggcagguuugggcucuucuugu

SEQ ID NO: 516434 - RNA, 22 nt, Human
uguggccagggggccauguccc

SEQ ID NO: 516435 - RNA, 22 nt, Human
aaaccaucagauaauucauacu

SEQ ID NO: 516436 - RNA, 22 nt, Human
ugggaguccaaggcaggcggau

SEQ ID NO: 516437 - RNA, 22 nt, Human
cuccaggagguugcugcuuccu

SEQ ID NO: 516438 - RNA, 22 nt, Human
aagauuuccauuucuagcucau

SEQ ID NO: 516439 - RNA, 22 nt, Human
cuggagccugcaguuuucacuu

SEQ ID NO: 516440 - RNA, 22 nt, Human
uccuuggcagcagggagcauga

SEQ ID NO: 516441 - RNA, 22 nt, Human
gacuuuggcaucuagacauugu

SEQ ID NO: 516442 - RNA, 22 nt, Human
aagcagccucauuugugguaag

SEQ ID NO: 516443 - RNA, 22 nt, Human
caugagauaauuuuucuccagu

SEQ ID NO: 516444 - RNA, 22 nt, Human
ugcuucugcugauauuuuguga

SEQ ID NO: 516445 - RNA, 22 nt, Human
acuuugcaauacuuaauacaaa

SEQ ID NO: 516446 - RNA, 22 nt, Human
uaguguuccagaagcaaacaag

SEQ ID NO: 516447 - RNA, 22 nt, Human
gcagccagccccucugaccucu

SEQ ID NO: 516448 - RNA, 22 nt, Human
gagcagagucuauuuccacacu

SEQ ID NO: 516449 - RNA, 22 nt, Human
gagcagcucugugccuggagac

SEQ ID NO: 516450 - RNA, 22 nt, Human
cccugccucugaagcugcucag

SEQ ID NO: 516451 - RNA, 22 nt, Human
ccucuggggcaucagacaaagg

SEQ ID NO: 516452 - RNA, 22 nt, Human
uuccuggugguggugacagcac

SEQ ID NO: 516453 - RNA, 22 nt, Human
agaaaucagaacccugaaguuc

SEQ ID NO: 516454 - RNA, 22 nt, Human
agggaauguagcaagaugccaa

SEQ ID NO: 516455 - RNA, 22 nt, Human
aaauguuccuuuggauuaaacu

SEQ ID NO: 516456 - RNA, 22 nt, Human
acagugaaugcccaagaaaagu

SEQ ID NO: 516457 - RNA, 22 nt, Human
agccacagggggugagggacaa

SEQ ID NO: 516458 - RNA, 17 nt, Human
gguucaguucugcauuc

SEQ ID NO: 516459 - RNA, 22 nt, Human
agcuccagggaaagaguggauc

SEQ ID NO: 516460 - RNA, 22 nt, Human
ucaaucaaugguuuccaaauuu

SEQ ID NO: 516461 - RNA, 22 nt, Human
auccaaaggugacacagaauac

SEQ ID NO: 516462 - RNA, 22 nt, Human
ucagggcugccgggcagaccgu

SEQ ID NO: 516463 - RNA, 17 nt, Human
uuuucucucuuggauuc

SEQ ID NO: 516464 - RNA, 22 nt, Human
uucuuuccccauggaguucgga

SEQ ID NO: 516465 - RNA, 17 nt, Human
ugcauguccuuuguucc

SEQ ID NO: 516466 - RNA, 22 nt, Human
uggcucaguuucaguccugguu

SEQ ID NO: 516467 - RNA, 22 nt, Human
aguccguggccagacucaagag

SEQ ID NO: 516468 - RNA, 22 nt, Human
agagauugugcuacucacccaa

SEQ ID NO: 516469 - RNA, 20 nt, Human
gccucagucacauggccuac

SEQ ID NO: 516470 - RNA, 18 nt, Human
gugcugugggcaguggcc

SEQ ID NO: 516471 - RNA, 22 nt, Human
ccagagaccagaacauggggau

SEQ ID NO: 516472 - RNA, 22 nt, Human
gggacuucauagcuaggcacuu

SEQ ID NO: 516473 - RNA, 22 nt, Human
cagagguagccgagugcaaucg

SEQ ID NO: 516474 - RNA, 22 nt, Human
agggccacaguggggccugaga

SEQ ID NO: 516475 - RNA, 22 nt, Human
cagcaauaacucaaagccauuu

SEQ ID NO: 516476 - RNA, 22 nt, Human
ucuguuuugcauaauguucuuu

SEQ ID NO: 516477 - RNA, 22 nt, Human
uaauauguguuacugacuuuuu

SEQ ID NO: 516478 - RNA, 20 nt, Human
gggcaguggcgcuaucucag

SEQ ID NO: 516479 - RNA, 22 nt, Human
guggguggaucaccugagguca

SEQ ID NO: 516480 - RNA, 22 nt, Human
uuucauuauacagcuucauaaa

SEQ ID NO: 516481 - RNA, 22 nt, Human
aucacagagauugcuuuuaaaa

SEQ ID NO: 516482 - RNA, 21 nt, Human
guuauuuuaagugagcuuugc

SEQ ID NO: 516483 - RNA, 22 nt, Human
gaagagaaaggcaaggaguuuu

SEQ ID NO: 516484 - RNA, 22 nt, Human
aguuucuagccucacuguuuag

SEQ ID NO: 516485 - RNA, 22 nt, Human
aaguccagugcuuuagauucca

SEQ ID NO: 516486 - RNA, 22 nt, Human
cagugccucuuaagugucaccc

SEQ ID NO: 516487 - RNA, 22 nt, Human
cuguggaguccuggggaaugga

SEQ ID NO: 516488 - RNA, 22 nt, Human
cugggcuggagugcaauggcgc

SEQ ID NO: 516489 - RNA, 22 nt, Human
agcuuuaccugccuuggggcac

SEQ ID NO: 516490 - RNA, 22 nt, Human
ucccaaagcuacucuucugacu

SEQ ID NO: 516491 - RNA, 22 nt, Human
caaagcagugauccuuaaagga

SEQ ID NO: 516492 - RNA, 22 nt, Human
ugcuucugaguugcaggacuug

SEQ ID NO: 516493 - RNA, 22 nt, Human
agcauuuaauuacaguuuaauu

SEQ ID NO: 516494 - RNA, 22 nt, Human
aauguauaaaguguuaauaacu

SEQ ID NO: 516495 - RNA, 22 nt, Human
cuuuggcucaugguuuuaucca

SEQ ID NO: 516496 - RNA, 22 nt, Human
gugucaugcacacucaguguug

SEQ ID NO: 516497 - RNA, 22 nt, Human
cugaauaauacagacuagcuuc

SEQ ID NO: 516498 - RNA, 19 nt, Human
agcagccauagacaauaug

SEQ ID NO: 516499 - RNA, 21 nt, Human
cuuguuuugaaaggacuggcc

SEQ ID NO: 516500 - RNA, 22 nt, Human
uagaaagcuugggguguuuaaa

SEQ ID NO: 516501 - RNA, 21 nt, Human
uccaggcuggaaggggcguug

SEQ ID NO: 516502 - RNA, 21 nt, Human
guuuagaaguagucuggcuca

SEQ ID NO: 516503 - RNA, 22 nt, Human
ggaggccaaggcgggcggauca

SEQ ID NO: 516504 - RNA, 20 nt, Human
ucacagaaugccugaagaag

SEQ ID NO: 516505 - RNA, 22 nt, Human
cagcuccccucuguggggcagu

SEQ ID NO: 516506 - RNA, 20 nt, Human
ucaagacagacauggaguuu

SEQ ID NO: 516507 - RNA, 22 nt, Human
uggagccuguguuucugcccag

SEQ ID NO: 516508 - RNA, 20 nt, Human
acaaaauagguacuggguag

SEQ ID NO: 516509 - RNA, 22 nt, Human
ucaggagcugcacugggcccac

SEQ ID NO: 516510 - RNA, 22 nt, Human
uuucaguguuaugacuuucauu

SEQ ID NO: 516511 - RNA, 22 nt, Human
cugccugugccaccgccucauu

SEQ ID NO: 516512 - RNA, 21 nt, Human
ugggccucaggcagcugugac

SEQ ID NO: 516513 - RNA, 22 nt, Human
ucccucugcuagugcuugagcu

SEQ ID NO: 516514 - RNA, 22 nt, Human
ggcucugguugaccaugauggc

SEQ ID NO: 516515 - RNA, 22 nt, Human
uacauauagacaguuacucuag

SEQ ID NO: 516516 - RNA, 22 nt, Human
aggcacugaccugcuuccuuga

SEQ ID NO: 516517 - RNA, 22 nt, Human
cuguggcucauaucuguaaucu

SEQ ID NO: 516518 - RNA, 20 nt, Human
cagccuccacucacucagcu

SEQ ID NO: 516519 - RNA, 22 nt, Human
acacauuuacauguuuacguau

SEQ ID NO: 516520 - RNA, 22 nt, Human
acauuuacagugcuagacaauc

SEQ ID NO: 516521 - RNA, 22 nt, Human
ccccuuccgucucuugaguguc

SEQ ID NO: 516522 - RNA, 22 nt, Human
gaggcacagagcccuaggagcu

SEQ ID NO: 516523 - RNA, 22 nt, Human
cugggcagugguggcccuuccc

SEQ ID NO: 516524 - RNA, 22 nt, Human
gccugggaaagaguagggaaau

SEQ ID NO: 516525 - RNA, 22 nt, Human
uaauaauagcaguagcugccac

SEQ ID NO: 516526 - RNA, 22 nt, Human
ucauuucuuaacuagagugaac

SEQ ID NO: 516527 - RNA, 22 nt, Human
cuccugggaauuuaguugugag

SEQ ID NO: 516528 - RNA, 22 nt, Human
gugauugcccagcaccauuguu

SEQ ID NO: 516529 - RNA, 22 nt, Human
ugcaaacuauugguagagaugg

SEQ ID NO: 516530 - RNA, 21 nt, Human
aaauacagaugcaaaucuguu

SEQ ID NO: 516531 - RNA, 22 nt, Human
ucugucugacuaccaugaggca

SEQ ID NO: 516532 - RNA, 22 nt, Human
cugaaggagguagagugacaua

SEQ ID NO: 516533 - RNA, 22 nt, Human
gcuucauuacugacagucugug

SEQ ID NO: 516534 - RNA, 22 nt, Human
gucccuuggcucacaaacagcu

SEQ ID NO: 516535 - RNA, 22 nt, Human
auucucagggaguauuuucuau

SEQ ID NO: 516536 - RNA, 20 nt, Human
ugggucugcuuggcuucagu

SEQ ID NO: 516537 - RNA, 23 nt, Human
ccagcuccgugagccucgggcuc

SEQ ID NO: 516538 - RNA, 22 nt, Human
uggcagcaaguucuugggaggu

SEQ ID NO: 516539 - RNA, 22 nt, Human
uuuguagaggguaauugacaga

SEQ ID NO: 516540 - RNA, 22 nt, Human
caguggguccuaaguacaguuc

SEQ ID NO: 516541 - RNA, 22 nt, Human
cccagggacagaugggcagcua

SEQ ID NO: 516542 - RNA, 22 nt, Human
aacauuucuucugaaacugagu

SEQ ID NO: 516543 - RNA, 22 nt, Human
uggguccuugcugauugcugag

SEQ ID NO: 516544 - RNA, 22 nt, Human
uaggguccauauggaugaaugg

SEQ ID NO: 516545 - RNA, 22 nt, Human
ggccaggccaagaggguuggaa

SEQ ID NO: 516546 - RNA, 22 nt, Human
gccccagcucugccacaacuag

SEQ ID NO: 516547 - RNA, 22 nt, Human
uccugagcccuggggucagugu

SEQ ID NO: 516548 - RNA, 22 nt, Human
aaggcaguuaauuuggcuagaa

SEQ ID NO: 516549 - RNA, 22 nt, Human
gguucccggaucuccgaguccc

SEQ ID NO: 516550 - RNA, 22 nt, Human
cucuugaagcaggggccaguuc

SEQ ID NO: 516551 - RNA, 23 nt, Human
cccagcagauuguaaagugucca

SEQ ID NO: 516552 - RNA, 22 nt, Human
agcagagaagacacaggcuuca

SEQ ID NO: 516553 - RNA, 22 nt, Human
ugaagcagagaauuugacaguc

SEQ ID NO: 516554 - RNA, 22 nt, Human
uucaagauggccccagugagcc

SEQ ID NO: 516555 - RNA, 22 nt, Human
uagaggcacccuggaggagacu

SEQ ID NO: 516556 - RNA, 22 nt, Human
cugggagcccugacuagccugg

SEQ ID NO: 516557 - RNA, 21 nt, Human
uuccucugcaacugaugcuca

SEQ ID NO: 516558 - RNA, 22 nt, Human
ccaggcuuucccagccucucca

SEQ ID NO: 516559 - RNA, 22 nt, Human
gccugggaagacuaagugggag

SEQ ID NO: 516560 - RNA, 22 nt, Human
gcccuguggacagugagaagug

SEQ ID NO: 516561 - RNA, 22 nt, Human
ugucagaggcucagggucucag

SEQ ID NO: 516562 - RNA, 17 nt, Human
ggccuguguggcugcag

SEQ ID NO: 516563 - RNA, 22 nt, Human
ugcagggaggccccgcagcccu

SEQ ID NO: 516564 - RNA, 22 nt, Human
augugugcaucaaugauagauc

SEQ ID NO: 516565 - RNA, 22 nt, Human
uucaagucaaggaaagaggucu

SEQ ID NO: 516566 - RNA, 22 nt, Human
cuccaggauguuagacguccag

SEQ ID NO: 516567 - RNA, 22 nt, Human
ugauucaagccaccacauacug

SEQ ID NO: 516568 - RNA, 22 nt, Human
gugguccugcacccgcuuggcc

SEQ ID NO: 516569 - RNA, 21 nt, Human
uuaagagcuuagcaguaggcc

SEQ ID NO: 516570 - RNA, 23 nt, Human
acaaugucuguucauaaaauacc

SEQ ID NO: 516571 - RNA, 23 nt, Human
ucugcucugaaguucggcugagc

SEQ ID NO: 516572 - RNA, 22 nt, Human
ccaggcaggcagcguucucagg

SEQ ID NO: 516573 - RNA, 20 nt, Human
cucuuuugacucuuugcaag

SEQ ID NO: 516574 - RNA, 22 nt, Human
gccagagcaugcacugccugca

SEQ ID NO: 516575 - RNA, 22 nt, Human
acagaggucaccuuuguaucuu

SEQ ID NO: 516576 - RNA, 20 nt, Human
aauaaaagaagccuucaccc

SEQ ID NO: 516577 - RNA, 23 nt, Human
uucaaaacuggaaaaucagaugc

SEQ ID NO: 516578 - RNA, 22 nt, Human
uucuaccuacccucugcauaca

SEQ ID NO: 516579 - RNA, 22 nt, Human
gcaggucuugaaggugugauuu

SEQ ID NO: 516580 - RNA, 22 nt, Human
aaaauucugucauuaaauugug

SEQ ID NO: 516581 - RNA, 22 nt, Human
gccuggagugguccugcugccc

SEQ ID NO: 516582 - RNA, 22 nt, Human
uugcagcugcaguaaauguuca

SEQ ID NO: 516583 - RNA, 22 nt, Human
uaagauagaacucugaggcuac

SEQ ID NO: 516584 - RNA, 21 nt, Human
gcugagagguugggaaguuca

SEQ ID NO: 516585 - RNA, 22 nt, Human
uaauaucuacuucauagaguuu

SEQ ID NO: 516586 - RNA, 22 nt, Human
ccagggaagauuagaagccacu

SEQ ID NO: 516587 - RNA, 22 nt, Human
caggagcuggaucuccuugcgg

SEQ ID NO: 516588 - RNA, 21 nt, Human
uggcaggcagcuggaagcuug

SEQ ID NO: 516589 - RNA, 22 nt, Human
cuuauuugagagaaaagaaacu

SEQ ID NO: 516590 - RNA, 19 nt, Human
ugcuucuggaaugcaaggc

SEQ ID NO: 516591 - RNA, 22 nt, Human
ugcugccuuugggaccuggccu

SEQ ID NO: 516592 - RNA, 22 nt, Human
ggguccagacuaugaagaacuu

SEQ ID NO: 516593 - RNA, 22 nt, Human
ucagagaguuggaaagaauuaa

SEQ ID NO: 516594 - RNA, 22 nt, Human
aaaaaugcugugguagcugugu

SEQ ID NO: 516595 - RNA, 20 nt, Human
agugacagagacuguguggc

SEQ ID NO: 516596 - RNA, 22 nt, Human
uagagcagauagugaaacagaa

SEQ ID NO: 516597 - RNA, 22 nt, Human
agccggccauguggucuugugc

SEQ ID NO: 516598 - RNA, 22 nt, Human
caaauucucacccuguuugauu

SEQ ID NO: 516599 - RNA, 22 nt, Human
uugcagggcaggaccauggaca

SEQ ID NO: 516600 - RNA, 22 nt, Human
ugaaaucugucccacuuuagcu

SEQ ID NO: 516601 - RNA, 22 nt, Human
agagcauccaucggccaggacc

SEQ ID NO: 516602 - RNA, 22 nt, Human
ugcugcucuucaccauggccuc

SEQ ID NO: 516603 - RNA, 22 nt, Human
auccugggaaguggccuccucc

SEQ ID NO: 516604 - RNA, 22 nt, Human
caucuggcuagcuaucauugug

SEQ ID NO: 516605 - RNA, 22 nt, Human
ggcagguguggaguguuauuuu

SEQ ID NO: 516606 - RNA, 17 nt, Human
ccauacugacauauuga

SEQ ID NO: 516607 - RNA, 22 nt, Human
ggcugccugggagcccuccucu

SEQ ID NO: 516608 - RNA, 22 nt, Human
ggaggccaaggaggagcuugcc

SEQ ID NO: 516609 - RNA, 22 nt, Human
cagugcugugcuggaagcuguu

SEQ ID NO: 516610 - RNA, 18 nt, Human
cccagcuggugggucagu

SEQ ID NO: 516611 - RNA, 22 nt, Human
aaagaacaucggagugggcggg

SEQ ID NO: 516612 - RNA, 19 nt, Human
agucccaggcccgaaagag

SEQ ID NO: 516613 - RNA, 22 nt, Human
aguucaaagucaaggaaacugu

SEQ ID NO: 516614 - RNA, 22 nt, Human
caggcucacuguaaggucagcu

SEQ ID NO: 516615 - RNA, 22 nt, Human
caguuuuuagauuaguuggugg

SEQ ID NO: 516616 - RNA, 22 nt, Human
gggagacuagugcuauguuuuc

SEQ ID NO: 516617 - RNA, 22 nt, Human
ccuggcucugcgugcagcuccg

SEQ ID NO: 516618 - RNA, 22 nt, Human
cguguggucccggcaaggcaag

SEQ ID NO: 516619 - RNA, 22 nt, Human
ggcccaggcuggagugcggugg

SEQ ID NO: 516620 - RNA, 22 nt, Human
gcuugcucaacccccgucucuc

SEQ ID NO: 516621 - RNA, 22 nt, Human
gcagcauuaccaagacauggca

SEQ ID NO: 516622 - RNA, 22 nt, Human
caggcccauuuguagccacuuu

SEQ ID NO: 516623 - RNA, 22 nt, Human
uuggagagcaguaaaccacacu

SEQ ID NO: 516624 - RNA, 22 nt, Human
aagcagcagccaucccccaagg

SEQ ID NO: 516625 - RNA, 23 nt, Human
ggggaaagaccaugcuugaggac

SEQ ID NO: 516626 - RNA, 22 nt, Human
agguaggguuaauggagauaua

SEQ ID NO: 516627 - RNA, 22 nt, Human
agaaugcuccagagcugaaaga

SEQ ID NO: 516628 - RNA, 22 nt, Human
aacagacaacuccuguggcuca

SEQ ID NO: 516629 - RNA, 23 nt, Human
cuggccaccaucuuucuggcuuc

SEQ ID NO: 516630 - RNA, 22 nt, Human
ucuccugugcacccucccugug

SEQ ID NO: 516631 - RNA, 22 nt, Human
ucagugugaggggcuggguccu

SEQ ID NO: 516632 - RNA, 22 nt, Human
gucccucucaaauuuauaugcu

SEQ ID NO: 516633 - RNA, 22 nt, Human
uaaaguucagugcaugaaugug

SEQ ID NO: 516634 - RNA, 22 nt, Human
ccagauagaaaagaaggcagga

SEQ ID NO: 516635 - RNA, 22 nt, Human
aaagcaauuacaaaagggauaa

SEQ ID NO: 516636 - RNA, 22 nt, Human
acagauuugacugguaccuggc

SEQ ID NO: 516637 - RNA, 22 nt, Human
gagaagggauaugccacucucg

SEQ ID NO: 516638 - RNA, 22 nt, Human
uguuccugaaugccuggcuggc

SEQ ID NO: 516639 - RNA, 23 nt, Human
agagcuuucuaaaauguaaaucu

SEQ ID NO: 516640 - RNA, 22 nt, Human
aaaugugcuugugaucagcugu

SEQ ID NO: 516641 - RNA, 22 nt, Human
aaggcacugaaaaauugugugu

SEQ ID NO: 516642 - RNA, 22 nt, Human
uccaggcaaaaaccaacuacag

SEQ ID NO: 516643 - RNA, 22 nt, Human
ucaucacuguaucauugauaga

SEQ ID NO: 516644 - RNA, 22 nt, Human
cagugggcugugauggauucac

SEQ ID NO: 516645 - RNA, 22 nt, Human
agcuccugaguagcuuuacuca

SEQ ID NO: 516646 - RNA, 22 nt, Human
cagauaaauagauagauaaacu

SEQ ID NO: 516647 - RNA, 22 nt, Human
aggcccaaaagaaaccacuggg

SEQ ID NO: 516648 - RNA, 22 nt, Human
cugcagugcaagcccagaugga

SEQ ID NO: 516649 - RNA, 22 nt, Human
ucugccugaaauucacauguaa

SEQ ID NO: 516650 - RNA, 22 nt, Human
cagguccaagagauccuccuac

SEQ ID NO: 516651 - RNA, 22 nt, Human
uuguccuggagguuaauagagu

SEQ ID NO: 516652 - RNA, 22 nt, Human
aaaucucaggccucuauuuacu

SEQ ID NO: 516653 - RNA, 22 nt, Human
auguagagcaguguuguccaau

SEQ ID NO: 516654 - RNA, 22 nt, Human
aauagaauguaaucuaauacau

SEQ ID NO: 516655 - RNA, 22 nt, Human
agagcugcaauuucauguggug

SEQ ID NO: 516656 - RNA, 22 nt, Human
cagggauggccuggcgggccac

SEQ ID NO: 516657 - RNA, 22 nt, Human
ggacggggagcuggaaagggga

SEQ ID NO: 516658 - RNA, 23 nt, Human
ccuggcugaccugaagguguagu

SEQ ID NO: 516659 - RNA, 22 nt, Human
ccagggcagccaacccagaugc

SEQ ID NO: 516660 - RNA, 18 nt, Human
augugagagaaucuucuu

SEQ ID NO: 516661 - RNA, 20 nt, Human
ucccuggaggugguggcauc

SEQ ID NO: 516662 - RNA, 22 nt, Human
cucuggucauuuggaagagcau

SEQ ID NO: 516663 - RNA, 22 nt, Human
ggcuucugagugcucugcuguu

SEQ ID NO: 516664 - RNA, 22 nt, Human
aggacuggcagugugagggguc

SEQ ID NO: 516665 - RNA, 22 nt, Human
cauuugucaucacugagcugcc

SEQ ID NO: 516666 - RNA, 22 nt, Human
auguccaggaucuauccccaga

SEQ ID NO: 516667 - RNA, 22 nt, Human
cuggguggaucgcagccccagg

SEQ ID NO: 516668 - RNA, 22 nt, Human
auuagcuuuaaagacuuugauu

SEQ ID NO: 516669 - RNA, 22 nt, Human
gcacccaguuugucucaggguu

SEQ ID NO: 516670 - RNA, 22 nt, Human
aagccaggaagagagccuucac

SEQ ID NO: 516671 - RNA, 22 nt, Human
cagcauccuuugcugguuuccc

SEQ ID NO: 516672 - RNA, 22 nt, Human
uuccagccaugguuucccuaug

SEQ ID NO: 516673 - RNA, 22 nt, Human
cuguuuucaaagagagagaaug

SEQ ID NO: 516674 - RNA, 22 nt, Human
cagcuucaugacaaacaguuuu

SEQ ID NO: 516675 - RNA, 20 nt, Human
ggcugaaaguagaaaguauu

SEQ ID NO: 516676 - RNA, 22 nt, Human
agaagccaacagggcaggagag

SEQ ID NO: 516677 - RNA, 21 nt, Human
cauuucuauugaugagaaaag

SEQ ID NO: 516678 - RNA, 22 nt, Human
uucuggggacauaacaguaagc

SEQ ID NO: 516679 - RNA, 22 nt, Human
uacaaagugagcaaccucuuuu

SEQ ID NO: 516680 - RNA, 23 nt, Human
gcucuuuguucauguggaugccu

SEQ ID NO: 516681 - RNA, 22 nt, Human
augcuggucucauuggguuagg

SEQ ID NO: 516682 - RNA, 22 nt, Human
agaauucucuuccauugaaaca

SEQ ID NO: 516683 - RNA, 22 nt, Human
uggggacccggacuccuggguc

SEQ ID NO: 516684 - RNA, 22 nt, Human
gacaaagucaacaguacucuca

SEQ ID NO: 516685 - RNA, 22 nt, Human
accaucaguacuggaugcugac

SEQ ID NO: 516686 - RNA, 22 nt, Human
uuucuauuguaagucuccuaua

SEQ ID NO: 516687 - RNA, 22 nt, Human
guuucucaagcuugaaugcaca

SEQ ID NO: 516688 - RNA, 22 nt, Human
ugcagggacaggcucuggggau

SEQ ID NO: 516689 - RNA, 22 nt, Human
agggccuggaacuggagaccac

SEQ ID NO: 516690 - RNA, 22 nt, Human
ucagggcaaagggcagaguuug

SEQ ID NO: 516691 - RNA, 22 nt, Human
gaggcugaaguguacaugggug

SEQ ID NO: 516692 - RNA, 22 nt, Human
aauauuucuccuucguuauagc

SEQ ID NO: 516693 - RNA, 22 nt, Human
aucuuugcccagagacucagcc

SEQ ID NO: 516694 - RNA, 22 nt, Human
gaaagcaauuuguguaaucugu

SEQ ID NO: 516695 - RNA, 22 nt, Human
aagucacacuagacaacugagg

SEQ ID NO: 516696 - RNA, 22 nt, Human
ugcugucaguuggcaggaugag

SEQ ID NO: 516697 - RNA, 22 nt, Human
gccagccugugcuuggccaggc

SEQ ID NO: 516698 - RNA, 22 nt, Human
aggccugagccccagguuuguu

SEQ ID NO: 516699 - RNA, 22 nt, Human
ggaagggaguaguuggaaugca

SEQ ID NO: 516700 - RNA, 22 nt, Human
uuacaauggguauacuuccauu

SEQ ID NO: 516701 - RNA, 20 nt, Human
gaaaugugaccucuucugug

SEQ ID NO: 516702 - RNA, 22 nt, Human
gccagagccggcuucacaggau

SEQ ID NO: 516703 - RNA, 22 nt, Human
uccucaggcggugaggaggggc

SEQ ID NO: 516704 - RNA, 22 nt, Human
uccaggaggccucauuuccugu

SEQ ID NO: 516705 - RNA, 22 nt, Human
gaaugauagagcugccuucgga

SEQ ID NO: 516706 - RNA, 22 nt, Human
aaaacucugcaguuaguuucua

SEQ ID NO: 516707 - RNA, 22 nt, Human
aggucuggcucuucuccacaga

SEQ ID NO: 516708 - RNA, 22 nt, Human
aagaugcagcuuccacuuuugc

SEQ ID NO: 516709 - RNA, 22 nt, Human
aagaacugugcuccaggcucca

SEQ ID NO: 516710 - RNA, 22 nt, Human
ccucagggaggccucuguggcu

SEQ ID NO: 516711 - RNA, 21 nt, Human
acugggcuagccugacuucug

SEQ ID NO: 516712 - RNA, 22 nt, Human
uccaauuuguuugaugauggaa

SEQ ID NO: 516713 - RNA, 22 nt, Human
gacugucauucuagugcccaug

SEQ ID NO: 516714 - RNA, 22 nt, Human
aguggcagagccaaguagagcc

SEQ ID NO: 516715 - RNA, 22 nt, Human
agggcaaguugagugugcgugg

SEQ ID NO: 516716 - RNA, 22 nt, Human
aaagcaaugaugguagacacgu

SEQ ID NO: 516717 - RNA, 22 nt, Human
ucaguaacuuacuuauucaccu

SEQ ID NO: 516718 - RNA, 23 nt, Human
gggagccaggaccucgcgcccca

SEQ ID NO: 516719 - RNA, 22 nt, Human
cccagcaugcacgcugacacuc

SEQ ID NO: 516720 - RNA, 22 nt, Human
ggaaaaggccacagggacacau

SEQ ID NO: 516721 - RNA, 22 nt, Human
ugcagagagaccccugggccag

SEQ ID NO: 516722 - RNA, 22 nt, Human
ucaaaucagcaagcagcuuccc

SEQ ID NO: 516723 - RNA, 22 nt, Human
acagcagggggagcuguuggac

SEQ ID NO: 516724 - RNA, 22 nt, Human
acagaugaauuuauggauggaa

SEQ ID NO: 516725 - RNA, 22 nt, Human
aaaugcaucagcucauaagaga

SEQ ID NO: 516726 - RNA, 22 nt, Human
ugcagccaucgcagagucugua

SEQ ID NO: 516727 - RNA, 23 nt, Human
uaagaacagacaagcauuuacau

SEQ ID NO: 516728 - RNA, 22 nt, Human
ggaugggcagacaggacggcac

SEQ ID NO: 516729 - RNA, 22 nt, Human
cugaaugucgaucagcuugggu

SEQ ID NO: 516730 - RNA, 23 nt, Human
ucugggcugcuuaaggaucaagg

SEQ ID NO: 516731 - RNA, 20 nt, Human
agcuaggagaaagcauggag

SEQ ID NO: 516732 - RNA, 20 nt, Human
cuccucaguuccaugggagg

SEQ ID NO: 516733 - RNA, 22 nt, Human
uaaaguuauaaauuaccuguca

SEQ ID NO: 516734 - RNA, 22 nt, Human
gagggaggcaucaugaauccag

SEQ ID NO: 516735 - RNA, 22 nt, Human
ccagcucugcagggccuggggu

SEQ ID NO: 516736 - RNA, 19 nt, Human
uuggaaggagccagagugg

SEQ ID NO: 516737 - RNA, 22 nt, Human
cuggcugguuacuauuucuggu

SEQ ID NO: 516738 - RNA, 22 nt, Human
cugugugcugaaaugcagugag

SEQ ID NO: 516739 - RNA, 22 nt, Human
acagagagguaaaauauauagu

SEQ ID NO: 516740 - RNA, 19 nt, Human
cuggggcuuugguacugcc

SEQ ID NO: 516741 - RNA, 22 nt, Human
aagugcaaugaauagcugcaau

SEQ ID NO: 516742 - RNA, 22 nt, Human
gugggccaguuccucacaggua

SEQ ID NO: 516743 - RNA, 22 nt, Human
gggcugcacguauucugcucac

SEQ ID NO: 516744 - RNA, 22 nt, Human
ucugagcuacgaugccugucac

SEQ ID NO: 516745 - RNA, 22 nt, Human
gggcuccaaaaucuaugucuuc

SEQ ID NO: 516746 - RNA, 22 nt, Human
uccagccuugccacuuuucugu

SEQ ID NO: 516747 - RNA, 22 nt, Human
cagugaggugcccagccugccc

SEQ ID NO: 516748 - RNA, 19 nt, Human
aguguuaacccaguguugg

SEQ ID NO: 516749 - RNA, 22 nt, Human
uggccugguccuugucaaggca

SEQ ID NO: 516750 - RNA, 22 nt, Human
ccugagggaggguauaggcugu

SEQ ID NO: 516751 - RNA, 22 nt, Human
uuucuuccaaaggcacguucuc

SEQ ID NO: 516752 - RNA, 22 nt, Human
uuuguuuacucauucauugaug

SEQ ID NO: 516753 - RNA, 22 nt, Human
aagcuccccgaaacccaccucu

SEQ ID NO: 516754 - RNA, 22 nt, Human
gggcugcugcugccagcgacac

SEQ ID NO: 516755 - RNA, 22 nt, Human
gccucccugagucacccaagca

SEQ ID NO: 516756 - RNA, 22 nt, Human
ggcucugcaugugagugggugg

SEQ ID NO: 516757 - RNA, 22 nt, Human
cugugucccaguaccuugggua

SEQ ID NO: 516758 - RNA, 22 nt, Human
agggcugcaucugccuggugaa

SEQ ID NO: 516759 - RNA, 19 nt, Human
ucucagaggaaaaauugcu

SEQ ID NO: 516760 - RNA, 22 nt, Human
uagaaauggagaacagauuaau

SEQ ID NO: 516761 - RNA, 22 nt, Human
cucaggauuaaggaaucuaaau

SEQ ID NO: 516762 - RNA, 22 nt, Human
ucaaguuuaauugagauguuua

SEQ ID NO: 516763 - RNA, 22 nt, Human
gaggggcagugcacccgggccc

SEQ ID NO: 516764 - RNA, 22 nt, Human
auucuacacaacaugaugaugg

SEQ ID NO: 516765 - RNA, 22 nt, Human
ccuguacaagcucuuggugaca

SEQ ID NO: 516766 - RNA, 22 nt, Human
ucuuagcacagcuauauaaguu

SEQ ID NO: 516767 - RNA, 22 nt, Human
uagagacaccaguaccauucug

SEQ ID NO: 516768 - RNA, 22 nt, Human
gggcccuggggccugauuugca

SEQ ID NO: 516769 - RNA, 22 nt, Human
gagaggccauggcugugcagug

SEQ ID NO: 516770 - RNA, 22 nt, Human
aagaaucauccugcaagagucu

SEQ ID NO: 516771 - RNA, 22 nt, Human
ccuggcugaaccaaugaagugg

SEQ ID NO: 516772 - RNA, 22 nt, Human
acagugucaugucguguucccc

SEQ ID NO: 516773 - RNA, 22 nt, Human
cucugggcuuguugaccugcac

SEQ ID NO: 516774 - RNA, 22 nt, Human
gagcuccaccaccuucaggcag

SEQ ID NO: 516775 - RNA, 22 nt, Human
gcuggccugggcagaggcuaug

SEQ ID NO: 516776 - RNA, 22 nt, Human
gacaugcaacaauuuggcauuu

SEQ ID NO: 516777 - RNA, 21 nt, Human
aggagggcacaaggccaggaa

SEQ ID NO: 516778 - RNA, 22 nt, Human
agggcuuucuuuguaaaagaag

SEQ ID NO: 516779 - RNA, 22 nt, Human
uggguccuugcuggcuucaaag

SEQ ID NO: 516780 - RNA, 22 nt, Human
agaaugcaagauaaacuuuauu

SEQ ID NO: 516781 - RNA, 22 nt, Human
gagcagugagugaauguugccu

SEQ ID NO: 516782 - RNA, 21 nt, Human
aaagauguuucaucugagaaa

SEQ ID NO: 516783 - RNA, 22 nt, Human
cagagcucagagcagggcacuc

SEQ ID NO: 516784 - RNA, 22 nt, Human
cacaauuccauggcauucuuug

SEQ ID NO: 516785 - RNA, 22 nt, Human
ugggacaguuguccuccacucu

SEQ ID NO: 516786 - RNA, 22 nt, Human
ucacugcaaccucugccuuccg

SEQ ID NO: 516787 - RNA, 18 nt, Human
gcugaaugucugcuuugc

SEQ ID NO: 516788 - RNA, 22 nt, Human
gagugucugaauuagagcacaa

SEQ ID NO: 516789 - RNA, 22 nt, Human
uggagcugacucacaccagcua

SEQ ID NO: 516790 - RNA, 22 nt, Human
cucaggauuuacuaauuucaag

SEQ ID NO: 516791 - RNA, 22 nt, Human
cagguccagucacuggucugca

SEQ ID NO: 516792 - RNA, 22 nt, Human
aucccucucugcaugacugugu

SEQ ID NO: 516793 - RNA, 22 nt, Human
gcauuuguguggcggaaggauu

SEQ ID NO: 516794 - RNA, 22 nt, Human
ucucugucugagccuggcagac

SEQ ID NO: 516795 - RNA, 22 nt, Human
gggguuaacaguauugcucaug

SEQ ID NO: 516796 - RNA, 22 nt, Human
gacagcuucuagaaauggucac

SEQ ID NO: 516797 - RNA, 22 nt, Human
acagggcaccugagguaggaag

SEQ ID NO: 516798 - RNA, 20 nt, Human
ccccacacuauugagcacuu

SEQ ID NO: 516799 - RNA, 22 nt, Human
acacagggcugcgccugacccc

SEQ ID NO: 516800 - RNA, 22 nt, Human
uaaacagaaagcagauguacuu

SEQ ID NO: 516801 - RNA, 22 nt, Human
gagcuuggcagugucacuaggg

SEQ ID NO: 516802 - RNA, 22 nt, Human
aauguguucaguuaaaugaacu

SEQ ID NO: 516803 - RNA, 22 nt, Human
ugacagaaagaauaugucaauc

SEQ ID NO: 516804 - RNA, 22 nt, Human
guaaaguucuacuagaaucaac

SEQ ID NO: 516805 - RNA, 22 nt, Human
agaggccaucugcucugugggg

SEQ ID NO: 516806 - RNA, 22 nt, Human
uuuaaauguguucuuaguagcu

SEQ ID NO: 516807 - RNA, 22 nt, Human
uauuuuacaugauccagaguug

SEQ ID NO: 516808 - RNA, 22 nt, Human
cuugucugugucggauaaaacu

SEQ ID NO: 516809 - RNA, 22 nt, Human
cugccacuagcuuucacaucuu

SEQ ID NO: 516810 - RNA, 22 nt, Human
ucuggagcaacagagcaggaca

SEQ ID NO: 516811 - RNA, 22 nt, Human
cagugggaagggcagaggcuuu

SEQ ID NO: 516812 - RNA, 22 nt, Human
gggcagugggaccaggcaccag

SEQ ID NO: 516813 - RNA, 22 nt, Human
gaccacagauuccuaaguggca

SEQ ID NO: 516814 - RNA, 22 nt, Human
ggcucccuagggagagugggag

SEQ ID NO: 516815 - RNA, 23 nt, Human
uuugcaaauuggacacaaccaca

SEQ ID NO: 516816 - RNA, 22 nt, Human
ucucagugcuauccauauucca

SEQ ID NO: 516817 - RNA, 22 nt, Human
ucuccucuauuucuguauguau

SEQ ID NO: 516818 - RNA, 22 nt, Human
acagcuuuaucucagggaucag

SEQ ID NO: 516819 - RNA, 22 nt, Human
cuuccuguugucacagucugcg

SEQ ID NO: 516820 - RNA, 22 nt, Human
ucuucuccagugcuucugcaca

SEQ ID NO: 516821 - RNA, 23 nt, Human
aaggguccauagcuaucauuaca

SEQ ID NO: 516822 - RNA, 22 nt, Human
gagcagcuaaaauucucaugca

SEQ ID NO: 516823 - RNA, 22 nt, Human
agcagauggugucaugggaugg

SEQ ID NO: 516824 - RNA, 22 nt, Human
caagauguggugggcugaguuu

SEQ ID NO: 516825 - RNA, 22 nt, Human
ugcuuaaacauacuauuuauau

SEQ ID NO: 516826 - RNA, 22 nt, Human
ugagccuggccugcagagacca

SEQ ID NO: 516827 - RNA, 22 nt, Human
cccaggcuccuagaggcccaga

SEQ ID NO: 516828 - RNA, 22 nt, Human
guggcuugaccaucccugcuac

SEQ ID NO: 516829 - RNA, 22 nt, Human
ugugugaacauguuuucauuuc

SEQ ID NO: 516830 - RNA, 22 nt, Human
agaaugugugauugaagcucuu

SEQ ID NO: 516831 - RNA, 18 nt, Human
uccugccugugccccagg

SEQ ID NO: 516832 - RNA, 22 nt, Human
ucccaaggcacagggcagggac

SEQ ID NO: 516833 - RNA, 22 nt, Human
agaaagaacgcacuugugcugc

SEQ ID NO: 516834 - RNA, 22 nt, Human
uuccacagcccaagcugguggc

SEQ ID NO: 516835 - RNA, 22 nt, Human
aguucuuuugugaacauaugcu

SEQ ID NO: 516836 - RNA, 22 nt, Human
uucagcacccucugaggcaucc

SEQ ID NO: 516837 - RNA, 22 nt, Human
gagggccagaguccugggguca

SEQ ID NO: 516838 - RNA, 21 nt, Human
ugaggcuguuguaccagggag

SEQ ID NO: 516839 - RNA, 22 nt, Human
ugcaggcugcagucucaggugg

SEQ ID NO: 516840 - RNA, 22 nt, Human
uccacugcagcuucugauggaa

SEQ ID NO: 516841 - RNA, 22 nt, Human
gcaguguuuuucaaugcuucca

SEQ ID NO: 516842 - RNA, 22 nt, Human
cacaaugcguacauauaucaaa

SEQ ID NO: 516843 - RNA, 22 nt, Human
augggcugaggaagcuccugag

SEQ ID NO: 516844 - RNA, 22 nt, Human
guggaaggaagagauggcccca

SEQ ID NO: 516845 - RNA, 20 nt, Human
caaggccuggaucuaguugc

SEQ ID NO: 516846 - RNA, 22 nt, Human
cagaguguaucuguguaagcau

SEQ ID NO: 516847 - RNA, 22 nt, Human
aguacaaguagaaugcuacaag

SEQ ID NO: 516848 - RNA, 22 nt, Human
gugugcugagugacugucauca

SEQ ID NO: 516849 - RNA, 22 nt, Human
uuaaaguucauuaaaugagcca

SEQ ID NO: 516850 - RNA, 21 nt, Human
cuuuuacauucagucaugaug

SEQ ID NO: 516851 - RNA, 22 nt, Human
ccucccaccauuuagagagagc

SEQ ID NO: 516852 - RNA, 22 nt, Human
acacagggcagagagcuggcuc

SEQ ID NO: 516853 - RNA, 22 nt, Human
cagcuaccaugguuuguuccag

SEQ ID NO: 516854 - RNA, 22 nt, Human
ccagagccagagaggugccugc

SEQ ID NO: 516855 - RNA, 22 nt, Human
uccucccacauaggacaauggg

SEQ ID NO: 516856 - RNA, 22 nt, Human
cagauagcguuugagagcauaa

SEQ ID NO: 516857 - RNA, 22 nt, Human
aguuuuucuccccuggcuucau

SEQ ID NO: 516858 - RNA, 22 nt, Human
cugaggugcuauggaggauacg

SEQ ID NO: 516859 - RNA, 22 nt, Human
uuaauaaacaggugcagcugaa

SEQ ID NO: 516860 - RNA, 22 nt, Human
cugggcuccacuacuugcuaac

SEQ ID NO: 516861 - RNA, 22 nt, Human
gggcuuuaggggccagugacca

SEQ ID NO: 516862 - RNA, 22 nt, Human
uuugaaaauuagacacaggcua

SEQ ID NO: 516863 - RNA, 22 nt, Human
gaggcaugucuggccuguccca

SEQ ID NO: 516864 - RNA, 22 nt, Human
uccagcaguccaugugagacac

SEQ ID NO: 516865 - RNA, 22 nt, Human
cuguaugauauccaaauugaua

SEQ ID NO: 516866 - RNA, 22 nt, Human
gcagagcugucuaagucacuuc

SEQ ID NO: 516867 - RNA, 22 nt, Human
cagcaucuuucucuucuggagu

SEQ ID NO: 516868 - RNA, 22 nt, Human
caaggccaaagggccacuguca

SEQ ID NO: 516869 - RNA, 22 nt, Human
gcuggagcuugagaggacaggg

SEQ ID NO: 516870 - RNA, 22 nt, Human
auuucaguguuuuaagaguuca

SEQ ID NO: 516871 - RNA, 22 nt, Human
gugcuaggauuacaggcauggg

SEQ ID NO: 516872 - RNA, 22 nt, Human
uugcaaaugugaauaauuacac

SEQ ID NO: 516873 - RNA, 22 nt, Human
agauguaaacucucaugucauu

SEQ ID NO: 516874 - RNA, 22 nt, Human
gcagggcaaugaucccgagagg

SEQ ID NO: 516875 - RNA, 22 nt, Human
ugcuuuggccacuagaauucag

SEQ ID NO: 516876 - RNA, 22 nt, Human
gagaugaauguaaacaaaggca

SEQ ID NO: 516877 - RNA, 22 nt, Human
cauggccagauucuuucuucuc

SEQ ID NO: 516878 - RNA, 20 nt, Human
agguccuguuccuugucucc

SEQ ID NO: 516879 - RNA, 19 nt, Human
auuugcuugucugcucugc

SEQ ID NO: 516880 - RNA, 22 nt, Human
gagagguacggaaagagcgugg

SEQ ID NO: 516881 - RNA, 22 nt, Human
agagauuuacacaugccuuuuc

SEQ ID NO: 516882 - RNA, 22 nt, Human
guuaauuuaguagaguccagau

SEQ ID NO: 516883 - RNA, 22 nt, Human
agggagaaugaccaagguauau

SEQ ID NO: 516884 - RNA, 19 nt, Human
ccccuuagggguuaagccu

SEQ ID NO: 516885 - RNA, 22 nt, Human
uccuucagugucccgcucaggu

SEQ ID NO: 516886 - RNA, 22 nt, Human
cugcccuggcagccuaccaugg

SEQ ID NO: 516887 - RNA, 22 nt, Human
acugggcucaagugauuguccu

SEQ ID NO: 516888 - RNA, 22 nt, Human
ggcagagguagcuggaaccagg

SEQ ID NO: 516889 - RNA, 22 nt, Human
ucugugugcccaccugacaccu

SEQ ID NO: 516890 - RNA, 22 nt, Human
aagcugccuuccaugugaggaa

SEQ ID NO: 516891 - RNA, 22 nt, Human
cagcuuuauuucacguguuugu

SEQ ID NO: 516892 - RNA, 22 nt, Human
aggcacugugcagucccaagca

SEQ ID NO: 516893 - RNA, 22 nt, Human
ccucuucugagugagacucccu

SEQ ID NO: 516894 - RNA, 22 nt, Human
gggcugccuuucuucugggagc

SEQ ID NO: 516895 - RNA, 22 nt, Human
gcagccaggggcugugaccugu

SEQ ID NO: 516896 - RNA, 22 nt, Human
cuggagccacuuuuuauccuuu

SEQ ID NO: 516897 - RNA, 22 nt, Human
cagcuggcuccaccucugggcu

SEQ ID NO: 516898 - RNA, 22 nt, Human
agggaccuugauggguuuggga

SEQ ID NO: 516899 - RNA, 21 nt, Human
ucugggggugagccuagaaau

SEQ ID NO: 516900 - RNA, 22 nt, Human
ugaguaucaauuacauaguugu

SEQ ID NO: 516901 - RNA, 22 nt, Human
gcagggcaucccugagcgggug

SEQ ID NO: 516902 - RNA, 22 nt, Human
ccucucauagucuguauccuuu

SEQ ID NO: 516903 - RNA, 22 nt, Human
accagcucagaagccagaaaga

SEQ ID NO: 516904 - RNA, 23 nt, Human
cagugggcuucuaacugcuccug

SEQ ID NO: 516905 - RNA, 22 nt, Human
aucuaggauuugaaugcacagu

SEQ ID NO: 516906 - RNA, 22 nt, Human
uuuccaggugcauagaaaacag

SEQ ID NO: 516907 - RNA, 22 nt, Human
aaacuugauuuagaacuaaggc

SEQ ID NO: 516908 - RNA, 22 nt, Human
cagcuggcguggagugauugca

SEQ ID NO: 516909 - RNA, 22 nt, Human
cugaggcaugggaaguugggug

SEQ ID NO: 516910 - RNA, 22 nt, Human
aacuucauuccuuuuuaugacu

SEQ ID NO: 516911 - RNA, 22 nt, Human
cagaguguggcaucuuccaacu

SEQ ID NO: 516912 - RNA, 22 nt, Human
augagaaagaguuguaucuaga

SEQ ID NO: 516913 - RNA, 22 nt, Human
gcuggggacuccccaccauagc

SEQ ID NO: 516914 - RNA, 22 nt, Human
ggggcacacuuuugguagauau

SEQ ID NO: 516915 - RNA, 23 nt, Human
aguuuuucugcaugguucuguau

SEQ ID NO: 516916 - RNA, 22 nt, Human
aggaagccugcaggugacugcu

SEQ ID NO: 516917 - RNA, 22 nt, Human
agucacagaaugauggcuccag

SEQ ID NO: 516918 - RNA, 22 nt, Human
aggucacacaacugucagaggc

SEQ ID NO: 516919 - RNA, 22 nt, Human
aagagguaaugacugcuugagu

SEQ ID NO: 516920 - RNA, 22 nt, Human
gcccaagcuggacugcaguggc

SEQ ID NO: 516921 - RNA, 22 nt, Human
aauaauguacauacauauuucg

SEQ ID NO: 516922 - RNA, 22 nt, Human
uucaguuccauuucaggugggu

SEQ ID NO: 516923 - RNA, 22 nt, Human
uuucacagugcucuguaaguau

SEQ ID NO: 516924 - RNA, 22 nt, Human
aggaugagauugcuguguugua

SEQ ID NO: 516925 - RNA, 22 nt, Human
cugcaggaauucaaagugagcu

SEQ ID NO: 516926 - RNA, 22 nt, Human
uucagaggguuuuagggucaga

SEQ ID NO: 516927 - RNA, 22 nt, Human
agucucagaaaauaugcuuuuu

SEQ ID NO: 516928 - RNA, 22 nt, Human
agugaggggauucaggcaaggu

SEQ ID NO: 516929 - RNA, 22 nt, Human
uccuuucaccaaaaaguguugu

SEQ ID NO: 516930 - RNA, 22 nt, Human
cauguacaugccuacuaucaau

SEQ ID NO: 516931 - RNA, 22 nt, Human
aaaguguugggaagaaagugca

SEQ ID NO: 516932 - RNA, 20 nt, Human
uugcagcagugaggugaagg

SEQ ID NO: 516933 - RNA, 22 nt, Human
gggcaaguguuuugucugccug

SEQ ID NO: 516934 - RNA, 22 nt, Human
uguggucucguuauguugccca

SEQ ID NO: 516935 - RNA, 22 nt, Human
gagagaaaaaugagcuucauug

SEQ ID NO: 516936 - RNA, 22 nt, Human
aaucagaaagaggucauguugc

SEQ ID NO: 516937 - RNA, 22 nt, Human
guccaucuguaggagggacaca

SEQ ID NO: 516938 - RNA, 22 nt, Human
acauuucuuucuauucaguagc

SEQ ID NO: 516939 - RNA, 22 nt, Human
uuccuggguucccucucauucu

SEQ ID NO: 516940 - RNA, 22 nt, Human
caucucaguguacagggagucu

SEQ ID NO: 516941 - RNA, 22 nt, Human
cuggagagaccgaaagaggcug

SEQ ID NO: 516942 - RNA, 21 nt, Human
cucuugugucagagccagagg

SEQ ID NO: 516943 - RNA, 22 nt, Human
gaacauuuaugaugcaauaccu

SEQ ID NO: 516944 - RNA, 22 nt, Human
ucuggcugcguggccuuuagca

SEQ ID NO: 516945 - RNA, 22 nt, Human
aaaugcuugcucuugauuauuu

SEQ ID NO: 516946 - RNA, 22 nt, Human
aggcacaggccucagcacccag

SEQ ID NO: 516947 - RNA, 22 nt, Human
uuggaaggauuuagagaugucu

SEQ ID NO: 516948 - RNA, 22 nt, Human
uuugauaguugauuaaauucca

SEQ ID NO: 516949 - RNA, 22 nt, Human
cauuguuauagcauuacacacc

SEQ ID NO: 516950 - RNA, 22 nt, Human
caggauagaaaggccauggagu

SEQ ID NO: 516951 - RNA, 22 nt, Human
uccuggcuuuucuuggcucauc

SEQ ID NO: 516952 - RNA, 22 nt, Human
cagggugccaaagaacaaauau

SEQ ID NO: 516953 - RNA, 22 nt, Human
gagggaguaacguacuacagug

SEQ ID NO: 516954 - RNA, 22 nt, Human
gcauguuuugcaacaagugacc

SEQ ID NO: 516955 - RNA, 22 nt, Human
ugcaggagcugugcggugaggg

SEQ ID NO: 516956 - RNA, 22 nt, Human
ucccuggagguguuugcucagg

SEQ ID NO: 516957 - RNA, 22 nt, Human
agagccuggucugagauaggac

SEQ ID NO: 516958 - RNA, 22 nt, Human
aaauaugagauguucucuuucg

SEQ ID NO: 516959 - RNA, 22 nt, Human
uuagccauugucagcacauggc

SEQ ID NO: 516960 - RNA, 22 nt, Human
gguggcagcgucuaucugacau

SEQ ID NO: 516961 - RNA, 22 nt, Human
cuucucuuggguguggugucuu

SEQ ID NO: 516962 - RNA, 22 nt, Human
uaggcugaaaggagaggugaag

SEQ ID NO: 516963 - RNA, 22 nt, Human
cuguggcuggaauaauaaaugu

SEQ ID NO: 516964 - RNA, 22 nt, Human
agguccugaugaucucugagag

SEQ ID NO: 516965 - RNA, 22 nt, Human
auucacaugcccaagcagcacc

SEQ ID NO: 516966 - RNA, 22 nt, Human
cuggcucagugccuucagaagu

SEQ ID NO: 516967 - RNA, 22 nt, Human
uguggccagcagguggcugugu

SEQ ID NO: 516968 - RNA, 22 nt, Human
uucauguaauuccauaagguaa

SEQ ID NO: 516969 - RNA, 22 nt, Human
gagagaagggggauaugagccu

SEQ ID NO: 516970 - RNA, 22 nt, Human
uucaggauuguguuuuuccuga

SEQ ID NO: 516971 - RNA, 21 nt, Human
ccuauugaauauaggaagauu

SEQ ID NO: 516972 - RNA, 18 nt, Human
uuugcaaaggaaguaugg

SEQ ID NO: 516973 - RNA, 22 nt, Human
gcagcuuuuuggaugucaguua

SEQ ID NO: 516974 - RNA, 22 nt, Human
agagugauggguugugcugacc

SEQ ID NO: 516975 - RNA, 22 nt, Human
uauucccauuccacuuaucaag

SEQ ID NO: 516976 - RNA, 22 nt, Human
uaaacaugugagugugcauaua

SEQ ID NO: 516977 - RNA, 22 nt, Human
ggcagggguccugguguugacu

SEQ ID NO: 516978 - RNA, 22 nt, Human
ccucagcucuucccugugcaca

SEQ ID NO: 516979 - RNA, 22 nt, Human
uggcagagaaccugggcuuugu

SEQ ID NO: 516980 - RNA, 22 nt, Human
cugggagaggaaccucgagggu

SEQ ID NO: 516981 - RNA, 22 nt, Human
ccuggccuuaagggcagggagc

SEQ ID NO: 516982 - RNA, 22 nt, Human
gguccagguauguggugugaau

SEQ ID NO: 516983 - RNA, 22 nt, Human
aaguccagugauacuggcagga

SEQ ID NO: 516984 - RNA, 22 nt, Human
cuggccuuuagccccagugucu

SEQ ID NO: 516985 - RNA, 22 nt, Human
cgagaguggacagggcgcagcu

SEQ ID NO: 516986 - RNA, 16 nt, Human
uggaaggggucuccgg

SEQ ID NO: 516987 - RNA, 22 nt, Human
ugguuucuggguuugucuagga

SEQ ID NO: 516988 - RNA, 21 nt, Human
aggaagaaagguuggagguug

SEQ ID NO: 516989 - RNA, 22 nt, Human
cagcagagcuuauguuggguca

SEQ ID NO: 516990 - RNA, 22 nt, Human
ggagaugguggaagcuggugca

SEQ ID NO: 516991 - RNA, 21 nt, Human
cccugcaggccagggcugagc

SEQ ID NO: 516992 - RNA, 22 nt, Human
auuguaauuuuagagaaagugg

SEQ ID NO: 516993 - RNA, 22 nt, Human
ugaagccaucccucagauggcc

SEQ ID NO: 516994 - RNA, 22 nt, Human
ucagaacagaagcuggcuauaa

SEQ ID NO: 516995 - RNA, 23 nt, Human
gccuuggagaagucacucaggga

SEQ ID NO: 516996 - RNA, 22 nt, Human
guagggagcccagagcccagug

SEQ ID NO: 516997 - RNA, 22 nt, Human
uuucacauuggcuucuauuucu

SEQ ID NO: 516998 - RNA, 22 nt, Human
ggcaggugccaguuggcuuggg

SEQ ID NO: 516999 - RNA, 22 nt, Human
uagcuuuagaaauauucucaga

SEQ ID NO: 517000 - RNA, 22 nt, Human
uguggugagaaacugguagauu

SEQ ID NO: 517001 - RNA, 22 nt, Human
ugaaugauuugggugcauucag

SEQ ID NO: 517002 - RNA, 22 nt, Human
gcuccuggugcuguagagauuu

SEQ ID NO: 517003 - RNA, 22 nt, Human
ucccccacucuaaaggagccuu

SEQ ID NO: 517004 - RNA, 22 nt, Human
cugggccagggaggugucugua

SEQ ID NO: 517005 - RNA, 22 nt, Human
uaaaagcucuucuguugaguua

SEQ ID NO: 517006 - RNA, 22 nt, Human
ugggcuucauaauugguccuag

SEQ ID NO: 517007 - RNA, 22 nt, Human
aguggcugcugacuuuaauaca

SEQ ID NO: 517008 - RNA, 22 nt, Human
gcagcuggugcaaaugucacuc

SEQ ID NO: 517009 - RNA, 22 nt, Human
uuacaagauaugugagaacuag

SEQ ID NO: 517010 - RNA, 22 nt, Human
aauagcugggaccugaauuagc

SEQ ID NO: 517011 - RNA, 22 nt, Human
gcugcccucccagggcaagcuu

SEQ ID NO: 517012 - RNA, 22 nt, Human
acuuucuaggucucaguccuuu

SEQ ID NO: 517013 - RNA, 22 nt, Human
uucuucauucccuuacuuccga

SEQ ID NO: 517014 - RNA, 22 nt, Human
aguaugaauacagauuuucucu

SEQ ID NO: 517015 - RNA, 22 nt, Human
uaggggugaggccaggcaucag

SEQ ID NO: 517016 - RNA, 22 nt, Human
cugagccaugagccugcgccca

SEQ ID NO: 517017 - RNA, 22 nt, Human
aggccagaaaugucagggagug

SEQ ID NO: 517018 - RNA, 22 nt, Human
cucagaauuacaucccauuuua

SEQ ID NO: 517019 - RNA, 22 nt, Human
aggcuagggccauggcugguga

SEQ ID NO: 517020 - RNA, 22 nt, Human
cacaccucagccauguggaggc

SEQ ID NO: 517021 - RNA, 22 nt, Human
aaaggccacacugcucuuucuc

SEQ ID NO: 517022 - RNA, 21 nt, Human
ucagugcaauucuauggggaa

SEQ ID NO: 517023 - RNA, 22 nt, Human
gauuucuucucucccaagagga

SEQ ID NO: 517024 - RNA, 22 nt, Human
aggagcugcagauucugccuug

SEQ ID NO: 517025 - RNA, 20 nt, Human
ugcacagacaaugagcccag

SEQ ID NO: 517026 - RNA, 22 nt, Human
ccucacucuuguccuggcaggu

SEQ ID NO: 517027 - RNA, 22 nt, Human
uguguacacaugacaggcaccc

SEQ ID NO: 517028 - RNA, 22 nt, Human
uuguacagggaaguaauacaag

SEQ ID NO: 517029 - RNA, 16 nt, Human
uuguccugucucacug

SEQ ID NO: 517030 - RNA, 19 nt, Human
ucuggcuccgccucuuagu

SEQ ID NO: 517031 - RNA, 22 nt, Human
uccagcucaggguuggcucaag

SEQ ID NO: 517032 - RNA, 22 nt, Human
aaggcagucugguuucaaagca

SEQ ID NO: 517033 - RNA, 22 nt, Human
gucucagauaacauguauucua

SEQ ID NO: 517034 - RNA, 22 nt, Human
agaaaaagucaaggaauuggac

SEQ ID NO: 517035 - RNA, 21 nt, Human
uccucagggccccagagcacu

SEQ ID NO: 517036 - RNA, 22 nt, Human
agggcagaaaccaccuugaugg

SEQ ID NO: 517037 - RNA, 22 nt, Human
cuggagcuaggaaguccaagau

SEQ ID NO: 517038 - RNA, 22 nt, Human
agaggccaguggcugugcuguc

SEQ ID NO: 517039 - RNA, 20 nt, Human
guccugggagccacagcaca

SEQ ID NO: 517040 - RNA, 22 nt, Human
agguuccaagaaaucaucagug

SEQ ID NO: 517041 - RNA, 22 nt, Human
gcagcuggggaggucgugggga

SEQ ID NO: 517042 - RNA, 22 nt, Human
uugaaaacuuucuagaccaaga

SEQ ID NO: 517043 - RNA, 22 nt, Human
guccuggggaauacagaagccg

SEQ ID NO: 517044 - RNA, 22 nt, Human
uccagccuaauguucuucccac

SEQ ID NO: 517045 - RNA, 19 nt, Human
augauggucccauucaccu

SEQ ID NO: 517046 - RNA, 22 nt, Human
ccaggaggcggaagguacagug

SEQ ID NO: 517047 - RNA, 22 nt, Human
agccagugcaacagcagugaag

SEQ ID NO: 517048 - RNA, 22 nt, Human
acagacagggcaccugccuccu

SEQ ID NO: 517049 - RNA, 22 nt, Human
uucuuacauauuuucauauggu

SEQ ID NO: 517050 - RNA, 22 nt, Human
gcaggccuuuaucccugccuca

SEQ ID NO: 517051 - RNA, 22 nt, Human
uagagcauuuagaggggcagga

SEQ ID NO: 517052 - RNA, 22 nt, Human
aagccucaccuuuuagaagcua

SEQ ID NO: 517053 - RNA, 22 nt, Human
ccugcuggccaguggagggcug

SEQ ID NO: 517054 - RNA, 22 nt, Human
gcugagagcggccagcugggaa

SEQ ID NO: 517055 - RNA, 22 nt, Human
gugcucacugugagacguccug

SEQ ID NO: 517056 - RNA, 22 nt, Human
gcaggcugugaggcucagaugg

SEQ ID NO: 517057 - RNA, 22 nt, Human
ugcaggugauucugaugcaguu

SEQ ID NO: 517058 - RNA, 22 nt, Human
ugugcauguauugauuuguacc

SEQ ID NO: 517059 - RNA, 22 nt, Human
cugaaauuccauuucagccaca

SEQ ID NO: 517060 - RNA, 22 nt, Human
gcuuucugguucucaaagcacu

SEQ ID NO: 517061 - RNA, 22 nt, Human
cagagccugccucuggcugugg

SEQ ID NO: 517062 - RNA, 22 nt, Human
guggcuucuucuugggagcugc

SEQ ID NO: 517063 - RNA, 20 nt, Human
gagauggacagaugaagggg

SEQ ID NO: 517064 - RNA, 22 nt, Human
ugcaggucaaucuucagguucc

SEQ ID NO: 517065 - RNA, 22 nt, Human
cugggaagcuucgagcaggaaa

SEQ ID NO: 517066 - RNA, 22 nt, Human
caacugaaaagauucuacgcag

SEQ ID NO: 517067 - RNA, 22 nt, Human
uccagggcagugacuacagcgg

SEQ ID NO: 517068 - RNA, 22 nt, Human
ugcuucugcaacuugaauguac

SEQ ID NO: 517069 - RNA, 22 nt, Human
aagaguuuaccagugcugcuuc

SEQ ID NO: 517070 - RNA, 22 nt, Human
cagagcuggagggaacccuggc

SEQ ID NO: 517071 - RNA, 22 nt, Human
ucaaugcaugugacaaagagua

SEQ ID NO: 517072 - RNA, 22 nt, Human
gcugggcucuuuaccccuguac

SEQ ID NO: 517073 - RNA, 20 nt, Human
gcuuagcaggcauaguagcu

SEQ ID NO: 517074 - RNA, 22 nt, Human
uggcucagaggggaagugguuu

SEQ ID NO: 517075 - RNA, 22 nt, Human
uggggcugaggagccucacucu

SEQ ID NO: 517076 - RNA, 22 nt, Human
cucugggcuuaccugcuuccug

SEQ ID NO: 517077 - RNA, 22 nt, Human
cuacauuuuucaccgagccucu

SEQ ID NO: 517078 - RNA, 22 nt, Human
aggaggugagcggucauguggu

SEQ ID NO: 517079 - RNA, 22 nt, Human
gaggccugggagaacuguuuuu

SEQ ID NO: 517080 - RNA, 22 nt, Human
aauuugugaaucugucucuuga

SEQ ID NO: 517081 - RNA, 19 nt, Human
uacauuuguguacacuugu

SEQ ID NO: 517082 - RNA, 22 nt, Human
gaagaacacuucaugauucauu

SEQ ID NO: 517083 - RNA, 22 nt, Human
uguaaaaggaaaucaaagcacu

SEQ ID NO: 517084 - RNA, 22 nt, Human
ugcagcugcuugauucaucuug

SEQ ID NO: 517085 - RNA, 22 nt, Human
agguucacacacacaaaaagau

SEQ ID NO: 517086 - RNA, 22 nt, Human
gcccagcagaucucagugucuc

SEQ ID NO: 517087 - RNA, 22 nt, Human
caccuguuagcucuaauuuucu

SEQ ID NO: 517088 - RNA, 22 nt, Human
accagagauggggcuucucugu

SEQ ID NO: 517089 - RNA, 22 nt, Human
gucccucugggccaucaggucc

SEQ ID NO: 517090 - RNA, 22 nt, Human
aguggcugaauauauuuuacua

SEQ ID NO: 517091 - RNA, 21 nt, Human
aggcugcuggcucaggguccu

SEQ ID NO: 517092 - RNA, 22 nt, Human
agccacagcccacaggacucuu

SEQ ID NO: 517093 - RNA, 22 nt, Human
agaggccucuagggccccucag

SEQ ID NO: 517094 - RNA, 22 nt, Human
accaggcugugaagugagacua

SEQ ID NO: 517095 - RNA, 22 nt, Human
cugugucccccucagccaggug

SEQ ID NO: 517096 - RNA, 22 nt, Human
cagcucaaguuucccaggucag

SEQ ID NO: 517097 - RNA, 22 nt, Human
auccugggcugcacccucagcc

SEQ ID NO: 517098 - RNA, 22 nt, Human
gucccuggggguuuaggacuca

SEQ ID NO: 517099 - RNA, 22 nt, Human
gacacauagaucuaucucacuc

SEQ ID NO: 517100 - RNA, 22 nt, Human
agggcacccucucugcaguacc

SEQ ID NO: 517101 - RNA, 22 nt, Human
uugaaauuuuaggccuugcaau

SEQ ID NO: 517102 - RNA, 22 nt, Human
uuucacaggaguuguaccauuu

SEQ ID NO: 517103 - RNA, 22 nt, Human
ugauuaauaucaccaccauugg

SEQ ID NO: 517104 - RNA, 22 nt, Human
uuugauaauuaaaaauuguagu

SEQ ID NO: 517105 - RNA, 22 nt, Human
uaaagguuauugcacuggaguu

SEQ ID NO: 517106 - RNA, 22 nt, Human
uccagccccggcuuccuuacag

SEQ ID NO: 517107 - RNA, 22 nt, Human
cccuguguaguuaacuuuccac

SEQ ID NO: 517108 - RNA, 22 nt, Human
gauguagacacuuggaggcuua

SEQ ID NO: 517109 - RNA, 22 nt, Human
ggccaccuuccuguggucucug

SEQ ID NO: 517110 - RNA, 22 nt, Human
ugagaagauugggcagagugga

SEQ ID NO: 517111 - RNA, 22 nt, Human
uacuagucuucugcuauucccu

SEQ ID NO: 517112 - RNA, 19 nt, Human
ugaaggagggggauggcca

SEQ ID NO: 517113 - RNA, 22 nt, Human
uagaaaguaaaucaguuuuauu

SEQ ID NO: 517114 - RNA, 22 nt, Human
cucugcugcaggaaggcgugca

SEQ ID NO: 517115 - RNA, 22 nt, Human
gaaauacaaaugccuagauccu

SEQ ID NO: 517116 - RNA, 22 nt, Human
gccaagagaaugugagagaaau

SEQ ID NO: 517117 - RNA, 22 nt, Human
aguucuggcggcugucggcacu

SEQ ID NO: 517118 - RNA, 19 nt, Human
cuggcucuuggguggagga

SEQ ID NO: 517119 - RNA, 22 nt, Human
ccagcagaagcucccgcugggu

SEQ ID NO: 517120 - RNA, 22 nt, Human
aaugauaugcaaauuaucauca

SEQ ID NO: 517121 - RNA, 22 nt, Human
cuuuuucauuggcuuuaggaca

SEQ ID NO: 517122 - RNA, 22 nt, Human
guuucauaugcaguuaacagca

SEQ ID NO: 517123 - RNA, 22 nt, Human
ucagcuuuuaaaaacaagaagu

SEQ ID NO: 517124 - RNA, 22 nt, Human
ugcagcauuauucacaguagcc

SEQ ID NO: 517125 - RNA, 22 nt, Human
acugggaggcaucuggagcuga

SEQ ID NO: 517126 - RNA, 22 nt, Human
ucagaggaccuuacugagaacc

SEQ ID NO: 517127 - RNA, 22 nt, Human
cccuccccacaaagcuucacac

SEQ ID NO: 517128 - RNA, 22 nt, Human
uucccagacuccacacugaggc

SEQ ID NO: 517129 - RNA, 22 nt, Human
cagggcucccucuggcucccag

SEQ ID NO: 517130 - RNA, 22 nt, Human
ugcuguagcccugcacagugca

SEQ ID NO: 517131 - RNA, 22 nt, Human
agagcagguggcaacucuggga

SEQ ID NO: 517132 - RNA, 22 nt, Human
augcugaaugaaagaaauuagu

SEQ ID NO: 517133 - RNA, 22 nt, Human
gagacacaaacauuuauuccac

SEQ ID NO: 517134 - RNA, 22 nt, Human
agcugacuucuugauccaauga

SEQ ID NO: 517135 - RNA, 21 nt, Human
ccugucuuggacugaggcacc

SEQ ID NO: 517136 - RNA, 22 nt, Human
ugcauuaucuuuaauguucuca

SEQ ID NO: 517137 - RNA, 22 nt, Human
cugggccuagaggaagcugaca

SEQ ID NO: 517138 - RNA, 22 nt, Human
augggaggaugcucgggugcuc

SEQ ID NO: 517139 - RNA, 22 nt, Human
aggaguguggccagggcucugg

SEQ ID NO: 517140 - RNA, 22 nt, Human
agguaucaacagcagagucuga

SEQ ID NO: 517141 - RNA, 22 nt, Human
caggggacauuaaagcuccaua

SEQ ID NO: 517142 - RNA, 22 nt, Human
cauuaauauuguucuucuuuag

SEQ ID NO: 517143 - RNA, 22 nt, Human
agcaaagcuuccauaaagcagc

SEQ ID NO: 517144 - RNA, 22 nt, Human
aauuaaaaaaggagagcuugcu

SEQ ID NO: 517145 - RNA, 22 nt, Human
ugugacaugugucaucuuuucu

SEQ ID NO: 517146 - RNA, 22 nt, Human
uggugaagucagcggagcccgg

SEQ ID NO: 517147 - RNA, 20 nt, Human
cugagcugagcuccaugggu

SEQ ID NO: 517148 - RNA, 22 nt, Human
uggaggaaucagggcuuaggcu

SEQ ID NO: 517149 - RNA, 22 nt, Human
ggcugccauaacagaguaccac

SEQ ID NO: 517150 - RNA, 22 nt, Human
ugaaauauuuagagaguaaguu

SEQ ID NO: 517151 - RNA, 22 nt, Human
cucugucccagacccaccucuc

SEQ ID NO: 517152 - RNA, 22 nt, Human
ucugcugacauuuaugaauaga

SEQ ID NO: 517153 - RNA, 22 nt, Human
cacaggaaucagcauuaauggc

SEQ ID NO: 517154 - RNA, 22 nt, Human
aaggugacucacaaagccaguu

SEQ ID NO: 517155 - RNA, 22 nt, Human
cucagagaaccuaagcggagga

SEQ ID NO: 517156 - RNA, 22 nt, Human
ccaaagucagugcucagucguc

SEQ ID NO: 517157 - RNA, 23 nt, Human
uggcccugugcaugcugcuuccc

SEQ ID NO: 517158 - RNA, 22 nt, Human
caagccagcaguuuaaugacuc

SEQ ID NO: 517159 - RNA, 22 nt, Human
cacauguuuggcaugucaccaa

SEQ ID NO: 517160 - RNA, 22 nt, Human
gaaaguauucacaaaguucuug

SEQ ID NO: 517161 - RNA, 22 nt, Human
ggagugggaacaaugacauggu

SEQ ID NO: 517162 - RNA, 22 nt, Human
uacacaucacuguaucuuucag

SEQ ID NO: 517163 - RNA, 22 nt, Human
agcagggcagguaaggaucaga

SEQ ID NO: 517164 - RNA, 22 nt, Human
ucagcuccucaugcaggggaua

SEQ ID NO: 517165 - RNA, 22 nt, Human
gcugcagccaaauucauuguca

SEQ ID NO: 517166 - RNA, 22 nt, Human
aggcccuggguuagggcccacu

SEQ ID NO: 517167 - RNA, 22 nt, Human
uguacaguauauuucaaagcca

SEQ ID NO: 517168 - RNA, 22 nt, Human
gcugccucccccauggcuggaa

SEQ ID NO: 517169 - RNA, 22 nt, Human
ggagagaaauugagguagcaag

SEQ ID NO: 517170 - RNA, 22 nt, Human
auuuaagacugacuucaccagu

SEQ ID NO: 517171 - RNA, 22 nt, Human
caggaaaugaaagcuagcuaau

SEQ ID NO: 517172 - RNA, 22 nt, Human
ggguccagggccaguggcugag

SEQ ID NO: 517173 - RNA, 21 nt, Human
ucugaugguagaugagaugug

SEQ ID NO: 517174 - RNA, 22 nt, Human
ucagguccaagauggccaucca

SEQ ID NO: 517175 - RNA, 22 nt, Human
guuucauacagauuauucaugg

SEQ ID NO: 517176 - RNA, 22 nt, Human
uagggcucgggcacaggacagg

SEQ ID NO: 517177 - RNA, 23 nt, Human
gggaucuguaaguugaagacaaa

SEQ ID NO: 517178 - RNA, 22 nt, Human
uugauuuauagaauguucaagc

SEQ ID NO: 517179 - RNA, 22 nt, Human
uguccuggggcgacuuggggcc

SEQ ID NO: 517180 - RNA, 22 nt, Human
ugcucugggcaacagccucccu

SEQ ID NO: 517181 - RNA, 22 nt, Human
ggugaagggugucauggcauuu

SEQ ID NO: 517182 - RNA, 22 nt, Human
cugcagaggccucgccuccucu

SEQ ID NO: 517183 - RNA, 22 nt, Human
ucauaaagcauuucagcuuuug

SEQ ID NO: 517184 - RNA, 22 nt, Human
gucugcuguucagagauguugc

SEQ ID NO: 517185 - RNA, 22 nt, Human
uuagcauucucauuugcauaaa

SEQ ID NO: 517186 - RNA, 22 nt, Human
uauuagcuuguuuggcaggaug

SEQ ID NO: 517187 - RNA, 18 nt, Human
ugacagaaccuggagccu

SEQ ID NO: 517188 - RNA, 19 nt, Human
aagagggaaagugcuaugc

SEQ ID NO: 517189 - RNA, 22 nt, Human
aagauuucuuacuuauugaugc

SEQ ID NO: 517190 - RNA, 19 nt, Human
gccucugcuggggacaggc

SEQ ID NO: 517191 - RNA, 22 nt, Human
ugcccuguuccugccuccagcu

SEQ ID NO: 517192 - RNA, 21 nt, Human
cagggcacacagaggauggua

SEQ ID NO: 517193 - RNA, 19 nt, Human
uucucaguucaggagaaga

SEQ ID NO: 517194 - RNA, 23 nt, Human
gccagcuuuggucugucuccuag

SEQ ID NO: 517195 - RNA, 22 nt, Human
gagcugcccugagcuuugcaug

SEQ ID NO: 517196 - RNA, 22 nt, Human
gucacacagggccuccaaauca

SEQ ID NO: 517197 - RNA, 19 nt, Human
gcuuuuuguugucaaaggu

SEQ ID NO: 517198 - RNA, 22 nt, Human
ggugggcaggucacucugccuc

SEQ ID NO: 517199 - RNA, 22 nt, Human
agugcuggauuacaggcgugag

SEQ ID NO: 517200 - RNA, 22 nt, Human
ccuuuauucaauuaguccuaau

SEQ ID NO: 517201 - RNA, 22 nt, Human
ggcugccuacuuucccagaguu

SEQ ID NO: 517202 - RNA, 22 nt, Human
cagccugagccuucuguagcaa

SEQ ID NO: 517203 - RNA, 22 nt, Human
aaagacauuagcuuagauguca

SEQ ID NO: 517204 - RNA, 22 nt, Human
gcucccucccaccagccugcag

SEQ ID NO: 517205 - RNA, 22 nt, Human
aagauauucaaagauuuauuag

SEQ ID NO: 517206 - RNA, 22 nt, Human
gucugggcaagggagauggcgc

SEQ ID NO: 517207 - RNA, 22 nt, Human
aacagugcugauuauuuuaccu

SEQ ID NO: 517208 - RNA, 22 nt, Human
accugcaggggugcucucuggg

SEQ ID NO: 517209 - RNA, 22 nt, Human
agggacccugaugacugaggag

SEQ ID NO: 517210 - RNA, 22 nt, Human
uagaaacauucaguugcagucc

SEQ ID NO: 517211 - RNA, 22 nt, Human
aaguaacuaaagauauccauuu

SEQ ID NO: 517212 - RNA, 22 nt, Human
uauuuauucuuuguacugccuu

SEQ ID NO: 517213 - RNA, 22 nt, Human
cacaguccuacagagaucagag

SEQ ID NO: 517214 - RNA, 22 nt, Human
agccuucaguaaauccacugug

SEQ ID NO: 517215 - RNA, 22 nt, Human
gcugucugggaugucacugcug

SEQ ID NO: 517216 - RNA, 22 nt, Human
aaugaagcaguccaucugcucu

SEQ ID NO: 517217 - RNA, 22 nt, Human
gagcagcuggcuguauugguuu

SEQ ID NO: 517218 - RNA, 22 nt, Human
aagcagcauuguaaccaaugcc

SEQ ID NO: 517219 - RNA, 22 nt, Human
ugggccccagcacgucugggga

SEQ ID NO: 517220 - RNA, 22 nt, Human
cagaaaaccugacucuagaacu

SEQ ID NO: 517221 - RNA, 22 nt, Human
auuuugugaacccucaagcaau

SEQ ID NO: 517222 - RNA, 22 nt, Human
gcaaaaaccacaauuacuuuua

SEQ ID NO: 517223 - RNA, 22 nt, Human
guuuucuaaguagguagcacca

SEQ ID NO: 517224 - RNA, 22 nt, Human
uuuuucaagacaaccugcaugu

SEQ ID NO: 517225 - RNA, 22 nt, Human
cucuucaggaauaugucaguca

SEQ ID NO: 517226 - RNA, 22 nt, Human
ucuuuuagaaaaguugaaugua

SEQ ID NO: 517227 - RNA, 22 nt, Human
aaguccugggcauuugaacagg

SEQ ID NO: 517228 - RNA, 22 nt, Human
cuggcccauggugagcucuggg

SEQ ID NO: 517229 - RNA, 23 nt, Human
gcugggcuuacucuuucagugag

SEQ ID NO: 517230 - RNA, 22 nt, Human
acuaaagucagacugcauugau

SEQ ID NO: 517231 - RNA, 22 nt, Human
uguuacaguacuacaauucugc

SEQ ID NO: 517232 - RNA, 22 nt, Human
gcuucuaucccuccacugcacu

SEQ ID NO: 517233 - RNA, 22 nt, Human
ugcccagcacugugccagucac

SEQ ID NO: 517234 - RNA, 22 nt, Human
gacacagcacuguacaaggaau

SEQ ID NO: 517235 - RNA, 22 nt, Human
gggucuggagggcagcccuucu

SEQ ID NO: 517236 - RNA, 22 nt, Human
gaaaagagaacaucugaggauc

SEQ ID NO: 517237 - RNA, 22 nt, Human
ucauucuccucuggaaaaggca

SEQ ID NO: 517238 - RNA, 22 nt, Human
cccucagucuggcugggaagac

SEQ ID NO: 517239 - RNA, 22 nt, Human
uaugcacacaggcuuaauucau

SEQ ID NO: 517240 - RNA, 22 nt, Human
uggcucugugucucccagcagc

SEQ ID NO: 517241 - RNA, 22 nt, Human
ggcugcuggggacgugggagag

SEQ ID NO: 517242 - RNA, 22 nt, Human
ugucacauguguggcauuuuuc

SEQ ID NO: 517243 - RNA, 22 nt, Human
gggugcugggaggcugacaucu

SEQ ID NO: 517244 - RNA, 22 nt, Human
aagggcaggagaagacggauau

SEQ ID NO: 517245 - RNA, 22 nt, Human
aaguaaauaucuguuuauagca

SEQ ID NO: 517246 - RNA, 22 nt, Human
ggaguaaggcucagaggaaaug

SEQ ID NO: 517247 - RNA, 22 nt, Human
ugaggcaguugagcuuccugag

SEQ ID NO: 517248 - RNA, 22 nt, Human
auugaaucugcacuaguauuuu

SEQ ID NO: 517249 - RNA, 19 nt, Human
cugggaguucacugcugcc

SEQ ID NO: 517250 - RNA, 22 nt, Human
guccagcugcagcugggcagaa

SEQ ID NO: 517251 - RNA, 20 nt, Human
agugcaagaaagcacagcug

SEQ ID NO: 517252 - RNA, 22 nt, Human
ggcuuccuggggccuccugcaa

SEQ ID NO: 517253 - RNA, 22 nt, Human
auguaauuuauguuauccauaa

SEQ ID NO: 517254 - RNA, 22 nt, Human
aggugcagaaaaaaguccuuua

SEQ ID NO: 517255 - RNA, 21 nt, Human
ccagcccagcugugucccagc

SEQ ID NO: 517256 - RNA, 17 nt, Human
cugaggcccagggccca

SEQ ID NO: 517257 - RNA, 22 nt, Human
caggaucccuggccuccgccca

SEQ ID NO: 517258 - RNA, 22 nt, Human
ggcaccuggauguagcagugaa

SEQ ID NO: 517259 - RNA, 22 nt, Human
ugggcuggagcuuguugcuucc

SEQ ID NO: 517260 - RNA, 22 nt, Human
agcagcucugagaggccagcac

SEQ ID NO: 517261 - RNA, 22 nt, Human
ucagucucaucaacucuauucc

SEQ ID NO: 517262 - RNA, 22 nt, Human
ugcuuuauuaagagagaaauuu

SEQ ID NO: 517263 - RNA, 22 nt, Human
agacacugccacuucuguuccc

SEQ ID NO: 517264 - RNA, 17 nt, Human
uuuauaauuggccucuu

SEQ ID NO: 517265 - RNA, 19 nt, Human
gcagugucaugguaggagc

SEQ ID NO: 517266 - RNA, 20 nt, Human
augcccuguccucuucuguu

SEQ ID NO: 517267 - RNA, 22 nt, Human
acaggcugggcgcuuccugcgg

SEQ ID NO: 517268 - RNA, 22 nt, Human
gcuaaugacugaguuuuuagca

SEQ ID NO: 517269 - RNA, 22 nt, Human
ucaguguguacacugagcauuu

SEQ ID NO: 517270 - RNA, 22 nt, Human
caguguuugcuuaaguuauaug

SEQ ID NO: 517271 - RNA, 22 nt, Human
auuugucuagugguauucacgu

SEQ ID NO: 517272 - RNA, 22 nt, Human
uggccucaaccguccuaagcac

SEQ ID NO: 517273 - RNA, 22 nt, Human
agcagaacugaugagacuugag

SEQ ID NO: 517274 - RNA, 22 nt, Human
gccuucaguaguauccucauga

SEQ ID NO: 517275 - RNA, 22 nt, Human
agggaugauggaaagaagcagg

SEQ ID NO: 517276 - RNA, 21 nt, Human
aauaaaacaguuggugucaau

SEQ ID NO: 517277 - RNA, 22 nt, Human
gagccuggauagccuuguucca

SEQ ID NO: 517278 - RNA, 22 nt, Human
caggcaggagccagggauucca

SEQ ID NO: 517279 - RNA, 22 nt, Human
ccucgcggcacucgggccggau

SEQ ID NO: 517280 - RNA, 21 nt, Human
ucugucuuccucagccuaagg

SEQ ID NO: 517281 - RNA, 22 nt, Human
uuuguacauccuaauucugagu

SEQ ID NO: 517282 - RNA, 22 nt, Human
agcacuuugggagauaaagcug

SEQ ID NO: 517283 - RNA, 22 nt, Human
gcucccucugcucaggcacuug

SEQ ID NO: 517284 - RNA, 22 nt, Human
cagaggccagggggcucacaaa

SEQ ID NO: 517285 - RNA, 22 nt, Human
caggagcucucaucgucagggc

SEQ ID NO: 517286 - RNA, 22 nt, Human
gggagguucuguucgcacuuga

SEQ ID NO: 517287 - RNA, 22 nt, Human
cugcacagaggucggucugcca

SEQ ID NO: 517288 - RNA, 22 nt, Human
aaguuuaagguggaaguggugg

SEQ ID NO: 517289 - RNA, 22 nt, Human
ucaguguaaguuauguagaugu

SEQ ID NO: 517290 - RNA, 22 nt, Human
aguguucauuuauucauucacu

SEQ ID NO: 517291 - RNA, 22 nt, Human
aaggccaggacaccaggggacu

SEQ ID NO: 517292 - RNA, 22 nt, Human
aaagcagguugcaauuacagug

SEQ ID NO: 517293 - RNA, 22 nt, Human
auacaugucaucauauguuugu

SEQ ID NO: 517294 - RNA, 18 nt, Human
cccacggugcuguagggc

SEQ ID NO: 517295 - RNA, 22 nt, Human
uccaagcuugcuuuagccacag

SEQ ID NO: 517296 - RNA, 22 nt, Human
cuuuccuagauggccaucuuuc

SEQ ID NO: 517297 - RNA, 23 nt, Human
ugaugcaguaaauuggucucuaa

SEQ ID NO: 517298 - RNA, 22 nt, Human
ccuguucacuuugacuucucca

SEQ ID NO: 517299 - RNA, 22 nt, Human
aauuuguggccacauuguggaa

SEQ ID NO: 517300 - RNA, 20 nt, Human
ucauugcacauaauggaagc

SEQ ID NO: 517301 - RNA, 22 nt, Human
uucacagugccagggggcaggc

SEQ ID NO: 517302 - RNA, 22 nt, Human
agggacuauuuacccaucucac

SEQ ID NO: 517303 - RNA, 22 nt, Human
gcagaugauguagacagacagu

SEQ ID NO: 517304 - RNA, 22 nt, Human
ggccaggcacugugugagauau

SEQ ID NO: 517305 - RNA, 20 nt, Human
uuucuggguacucucccucu

SEQ ID NO: 517306 - RNA, 21 nt, Human
ccucugugcuaaagggcuccc

SEQ ID NO: 517307 - RNA, 22 nt, Human
cugucuuuucauacuuucccuc

SEQ ID NO: 517308 - RNA, 22 nt, Human
uuacaggggacauuggggacau

SEQ ID NO: 517309 - RNA, 22 nt, Human
cucccaggggaacuaucaagua

SEQ ID NO: 517310 - RNA, 22 nt, Human
ggggacccucaggacugcgucu

SEQ ID NO: 517311 - RNA, 20 nt, Human
uuggaagguggagaagagga

SEQ ID NO: 517312 - RNA, 22 nt, Human
uagagguagauggucagccaau

SEQ ID NO: 517313 - RNA, 22 nt, Human
cccagcuccagagccagaaaca

SEQ ID NO: 517314 - RNA, 22 nt, Human
aguaaacauaauuuaccuguag

SEQ ID NO: 517315 - RNA, 22 nt, Human
aaacucuuccuuucuuuaaagu

SEQ ID NO: 517316 - RNA, 22 nt, Human
gagcugccuguugcauagcaac

SEQ ID NO: 517317 - RNA, 22 nt, Human
gaagagaagcaucaauagguaa

SEQ ID NO: 517318 - RNA, 22 nt, Human
cugugcuuguguucauuguuaa

SEQ ID NO: 517319 - RNA, 22 nt, Human
agggcccuaaggaaggcacaca

SEQ ID NO: 517320 - RNA, 22 nt, Human
guuuagaagccaagauuugggu

SEQ ID NO: 517321 - RNA, 22 nt, Human
caaaaacugcaauuacuuuuac

SEQ ID NO: 517322 - RNA, 22 nt, Human
gcaaauucuuaacuggacugug

SEQ ID NO: 517323 - RNA, 22 nt, Human
cugcucuggucucuucauguuu

SEQ ID NO: 517324 - RNA, 22 nt, Human
uuuucuaacuuuacacucgaaa

SEQ ID NO: 517325 - RNA, 22 nt, Human
ugggccugccccaggcuucagc

SEQ ID NO: 517326 - RNA, 22 nt, Human
auucaagauuaauucuauguca

SEQ ID NO: 517327 - RNA, 22 nt, Human
cagcaggauuugaaaggaagag

SEQ ID NO: 517328 - RNA, 22 nt, Human
caggacacuuguucuucucugc

SEQ ID NO: 517329 - RNA, 22 nt, Human
ugagaaugccauaagagcuauu

SEQ ID NO: 517330 - RNA, 22 nt, Human
gcagagccugacgggauuuuuc

SEQ ID NO: 517331 - RNA, 22 nt, Human
agucucuuacccaagcagaaug

SEQ ID NO: 517332 - RNA, 22 nt, Human
uauaaauuaaugugcccaugag

SEQ ID NO: 517333 - RNA, 22 nt, Human
ugggaaauguguuucuggacca

SEQ ID NO: 517334 - RNA, 22 nt, Human
agauacauuguucuaagcauug

SEQ ID NO: 517335 - RNA, 22 nt, Human
cagcagugaugugugaggguuc

SEQ ID NO: 517336 - RNA, 22 nt, Human
ugcuuaaaaugaugauuauuuu

SEQ ID NO: 517337 - RNA, 22 nt, Human
aaugcacaaaggugucuauugc

SEQ ID NO: 517338 - RNA, 22 nt, Human
aguuucagaauuuaugcagaca

SEQ ID NO: 517339 - RNA, 21 nt, Human
uggagcugaauuuuuggcauc

SEQ ID NO: 517340 - RNA, 22 nt, Human
cuggacagaaaaggccacugga

SEQ ID NO: 517341 - RNA, 22 nt, Human
aaaguuccuuuuauagacauga

SEQ ID NO: 517342 - RNA, 22 nt, Human
auacauuagaaucugguacuca

SEQ ID NO: 517343 - RNA, 21 nt, Human
ucuggcaggcacgggcccagc

SEQ ID NO: 517344 - RNA, 22 nt, Human
ccuccugcacuugcuuuccuuc

SEQ ID NO: 517345 - RNA, 22 nt, Human
gcuucucucucagacugcaagc

SEQ ID NO: 517346 - RNA, 22 nt, Human
ggguuccaaacauagucuuccu

SEQ ID NO: 517347 - RNA, 22 nt, Human
uaagacaugguugaucuagugu

SEQ ID NO: 517348 - RNA, 22 nt, Human
ucuuuuauuaggcugaaauggg

SEQ ID NO: 517349 - RNA, 22 nt, Human
ugcucccaggcucuguggucug

SEQ ID NO: 517350 - RNA, 21 nt, Human
ucauuuuuauugcuaccuugc

SEQ ID NO: 517351 - RNA, 22 nt, Human
aaaagcaagaggcuggauuaaa

SEQ ID NO: 517352 - RNA, 22 nt, Human
cacagcuuagaaaagaagccau

SEQ ID NO: 517353 - RNA, 22 nt, Human
aggacagcagugcuggcacuug

SEQ ID NO: 517354 - RNA, 22 nt, Human
gggcucugaaucccaggucugc

SEQ ID NO: 517355 - RNA, 19 nt, Human
ugaguucugugguucucaa

SEQ ID NO: 517356 - RNA, 22 nt, Human
ccaggcaggcuagaauguaaau

SEQ ID NO: 517357 - RNA, 22 nt, Human
ucugggcugguugugcuugcuu

SEQ ID NO: 517358 - RNA, 22 nt, Human
aaucuucacagaaaaaugucug

SEQ ID NO: 517359 - RNA, 22 nt, Human
cuggcuccauccuugagcucug

SEQ ID NO: 517360 - RNA, 22 nt, Human
cauggcagagaaggggaacugg

SEQ ID NO: 517361 - RNA, 22 nt, Human
uuccaggaagcaguuagcagcc

SEQ ID NO: 517362 - RNA, 22 nt, Human
uuccauauguauauagcuguua

SEQ ID NO: 517363 - RNA, 22 nt, Human
ucauuuguucaucugcucuucu

SEQ ID NO: 517364 - RNA, 22 nt, Human
aaucaagaggcgauggauggaa

SEQ ID NO: 517365 - RNA, 22 nt, Human
gguuuccugcauugggaaauuu

SEQ ID NO: 517366 - RNA, 22 nt, Human
aguucacuauagaagacagugu

SEQ ID NO: 517367 - RNA, 22 nt, Human
cagacuggccacaucugcacug

SEQ ID NO: 517368 - RNA, 22 nt, Human
uggagcugagcaccuccagggc

SEQ ID NO: 517369 - RNA, 22 nt, Human
agauguaguagugggucuuuua

SEQ ID NO: 517370 - RNA, 22 nt, Human
aaagccaaaugaaagaugguuc

SEQ ID NO: 517371 - RNA, 21 nt, Human
ccaggcuccugaggcugguca

SEQ ID NO: 517372 - RNA, 22 nt, Human
ggaggccaaggugggcggauca

SEQ ID NO: 517373 - RNA, 22 nt, Human
auguagaggaguuucuggucug

SEQ ID NO: 517374 - RNA, 22 nt, Human
aagggaugcaggaaagaagguu

SEQ ID NO: 517375 - RNA, 22 nt, Human
gaggccaaguuggagaccaggu

SEQ ID NO: 517376 - RNA, 23 nt, Human
ugccagaggcagucacaguggug

SEQ ID NO: 517377 - RNA, 22 nt, Human
uucaagaugacccagucacacg

SEQ ID NO: 517378 - RNA, 22 nt, Human
uuuuuuaguuaggucagaaugu

SEQ ID NO: 517379 - RNA, 22 nt, Human
gcucugggcugaaucauuuauc

SEQ ID NO: 517380 - RNA, 22 nt, Human
cuuuuacaguggaccugccauu

SEQ ID NO: 517381 - RNA, 22 nt, Human
uaaccauauuuuccauuaaguu

SEQ ID NO: 517382 - RNA, 22 nt, Human
uggcagguggcucuggcauucu

SEQ ID NO: 517383 - RNA, 22 nt, Human
agccaggaaugcaugcucugcu

SEQ ID NO: 517384 - RNA, 22 nt, Human
gugcagugacccuggagagcug

SEQ ID NO: 517385 - RNA, 23 nt, Human
auuuccuacuauaaaagagguaa

SEQ ID NO: 517386 - RNA, 22 nt, Human
agcagggcuugccgcuuguccu

SEQ ID NO: 517387 - RNA, 22 nt, Human
ggccucugccccagccacaccu

SEQ ID NO: 517388 - RNA, 22 nt, Human
uugcuucagaaguucugcuugu

SEQ ID NO: 517389 - RNA, 22 nt, Human
uucuucaauuauuggaaagaaa

SEQ ID NO: 517390 - RNA, 22 nt, Human
aaggucauuuaacaauuuauga

SEQ ID NO: 517391 - RNA, 22 nt, Human
uaccaaaagcuuguuucauaca

SEQ ID NO: 517392 - RNA, 22 nt, Human
uucuuuguuugauaaguaugcu

SEQ ID NO: 517393 - RNA, 22 nt, Human
caugugugguuaccuacuugac

SEQ ID NO: 517394 - RNA, 22 nt, Human
cccugcagagccagcccugacc

SEQ ID NO: 517395 - RNA, 22 nt, Human
ucugugaacaucacauugacag

SEQ ID NO: 517396 - RNA, 22 nt, Human
agccuucaaccuagcuagagca

SEQ ID NO: 517397 - RNA, 22 nt, Human
ggguccuggaaucugcauuuua

SEQ ID NO: 517398 - RNA, 22 nt, Human
uagaaacacagaucugguguca

SEQ ID NO: 517399 - RNA, 22 nt, Human
acauacacaagcguacaugaac

SEQ ID NO: 517400 - RNA, 22 nt, Human
agcaggguauguuagagcugua

SEQ ID NO: 517401 - RNA, 22 nt, Human
guguccauucacugcaacacuu

SEQ ID NO: 517402 - RNA, 22 nt, Human
uuuagggaugucagaacaggga

SEQ ID NO: 517403 - RNA, 22 nt, Human
cucugggcuccuucagcccuuu

SEQ ID NO: 517404 - RNA, 20 nt, Human
gagauggcuaagugcugaac

SEQ ID NO: 517405 - RNA, 22 nt, Human
gccaugcuugguaugcugugag

SEQ ID NO: 517406 - RNA, 22 nt, Human
agcugccuuaaauuacuuugug

SEQ ID NO: 517407 - RNA, 22 nt, Human
uuccuuuagugucauauacuuu

SEQ ID NO: 517408 - RNA, 22 nt, Human
uggccacccacccuaaucuuuc

SEQ ID NO: 517409 - RNA, 22 nt, Human
acucugccaucccaggugcugu

SEQ ID NO: 517410 - RNA, 22 nt, Human
caaaguaucaacucccacacug

SEQ ID NO: 517411 - RNA, 22 nt, Human
uccucugguuauacuugcaccc

SEQ ID NO: 517412 - RNA, 21 nt, Human
agcagcugggcaacauggagg

SEQ ID NO: 517413 - RNA, 22 nt, Human
gcucuccaaacccuguggcuuu

SEQ ID NO: 517414 - RNA, 22 nt, Human
gcccauggcagaacugugagca

SEQ ID NO: 517415 - RNA, 22 nt, Human
auuuagaagcuaauuuuucaga

SEQ ID NO: 517416 - RNA, 22 nt, Human
uauucaugagauaggcaguuuu

SEQ ID NO: 517417 - RNA, 22 nt, Human
cagggcugaacugagcuuguga

SEQ ID NO: 517418 - RNA, 22 nt, Human
agguuccaucaccugcagugga

SEQ ID NO: 517419 - RNA, 22 nt, Human
cagcccugcacgcugccuccgc

SEQ ID NO: 517420 - RNA, 22 nt, Human
uuccugugguccagagucaucc

SEQ ID NO: 517421 - RNA, 22 nt, Human
ugggccagcaauugcugcucag

SEQ ID NO: 517422 - RNA, 22 nt, Human
aaaguauuugugauuuuuacca

SEQ ID NO: 517423 - RNA, 22 nt, Human
accaaggaagaaucuauuugag

SEQ ID NO: 517424 - RNA, 22 nt, Human
aaguucuugauaaguccacugu

SEQ ID NO: 517425 - RNA, 22 nt, Human
ucaaagcacuggggaaagccug

SEQ ID NO: 517426 - RNA, 22 nt, Human
gggcucagucugcggcgcgcgg

SEQ ID NO: 517427 - RNA, 22 nt, Human
ggaugucgaggaugggguagca

SEQ ID NO: 517428 - RNA, 20 nt, Human
agcaaagccuuuagaguuug

SEQ ID NO: 517429 - RNA, 22 nt, Human
cccagcuugcaaauggguugcu

SEQ ID NO: 517430 - RNA, 23 nt, Human
aguaacaugcaaauaacagucug

SEQ ID NO: 517431 - RNA, 22 nt, Human
aauaaugagcuugucuaauugu

SEQ ID NO: 517432 - RNA, 22 nt, Human
uaauacagggcacuuugaguga

SEQ ID NO: 517433 - RNA, 22 nt, Human
gcuccucugucaaaugagagug

SEQ ID NO: 517434 - RNA, 22 nt, Human
ucuggguccccgaggaaggaga

SEQ ID NO: 517435 - RNA, 22 nt, Human
agugaaauuuguuuagauaggu

SEQ ID NO: 517436 - RNA, 22 nt, Human
cagcagcucaggcuccuuccca

SEQ ID NO: 517437 - RNA, 22 nt, Human
acagagcuguacuacuuacuga

SEQ ID NO: 517438 - RNA, 22 nt, Human
aggaagcaguuuauaaugcauu

SEQ ID NO: 517439 - RNA, 22 nt, Human
accuguuuggaggagguguuag

SEQ ID NO: 517440 - RNA, 22 nt, Human
uggcaggguuggccaccuuacc

SEQ ID NO: 517441 - RNA, 22 nt, Human
aggagaauuaggaacucaagau

SEQ ID NO: 517442 - RNA, 22 nt, Human
augcacagcagugaguucagug

SEQ ID NO: 517443 - RNA, 22 nt, Human
ugccaggggaccuagggauguc

SEQ ID NO: 517444 - RNA, 22 nt, Human
agguaggauggguggagaugau

SEQ ID NO: 517445 - RNA, 22 nt, Human
ugccuucaaucaggauggucuc

SEQ ID NO: 517446 - RNA, 22 nt, Human
aggccugggcaagaaggggcgu

SEQ ID NO: 517447 - RNA, 22 nt, Human
uccuccucacgcuguugcuugu

SEQ ID NO: 517448 - RNA, 22 nt, Human
cuggauucuuucauaaaaguca

SEQ ID NO: 517449 - RNA, 22 nt, Human
guuugcauaucugugaaaugga

SEQ ID NO: 517450 - RNA, 22 nt, Human
ugcacagugaccacugagcaag

SEQ ID NO: 517451 - RNA, 22 nt, Human
ucuggcugauucccugggacug

SEQ ID NO: 517452 - RNA, 17 nt, Human
gacuuuggaguuucaua

SEQ ID NO: 517453 - RNA, 22 nt, Human
gccucacugcagccccaggaag

SEQ ID NO: 517454 - RNA, 22 nt, Human
aguaugaaucuuucagaccgua

SEQ ID NO: 517455 - RNA, 22 nt, Human
ccagcaggagagaacauuuccc

SEQ ID NO: 517456 - RNA, 22 nt, Human
aaauucaguuuuaauaaucacu

SEQ ID NO: 517457 - RNA, 22 nt, Human
gagcucauuguggauggauggg

SEQ ID NO: 517458 - RNA, 22 nt, Human
ugucuucaggaguaaauaucau

SEQ ID NO: 517459 - RNA, 22 nt, Human
ucacuagucaucaacuuccauu

SEQ ID NO: 517460 - RNA, 22 nt, Human
aagaacauguuaaaagauucac

SEQ ID NO: 517461 - RNA, 22 nt, Human
gccccuccgggcgcgucauagc

SEQ ID NO: 517462 - RNA, 23 nt, Human
aacacaaagcugauuccaguggc

SEQ ID NO: 517463 - RNA, 22 nt, Human
augaggaugggaagggagccaa

SEQ ID NO: 517464 - RNA, 22 nt, Human
ucugggucuaucccaugccuuu

SEQ ID NO: 517465 - RNA, 22 nt, Human
ggugaggcccagugaucugugu

SEQ ID NO: 517466 - RNA, 22 nt, Human
aguggcugcuucugguugcucc

SEQ ID NO: 517467 - RNA, 22 nt, Human
cucuuaaagcuuccaguuucaa

SEQ ID NO: 517468 - RNA, 22 nt, Human
cugggacauauugcuaguguug

SEQ ID NO: 517469 - RNA, 22 nt, Human
ucccagagcaguacuccaggag

SEQ ID NO: 517470 - RNA, 22 nt, Human
gcagcuggcucagagagguggg

SEQ ID NO: 517471 - RNA, 22 nt, Human
auuuuagcaaaugcaagaugga

SEQ ID NO: 517472 - RNA, 22 nt, Human
uggccuggaagagaggucgagg

SEQ ID NO: 517473 - RNA, 21 nt, Human
ucauuuauugagaaaugacug

SEQ ID NO: 517474 - RNA, 22 nt, Human
aagcuuuggaagggcaggguug

SEQ ID NO: 517475 - RNA, 22 nt, Human
uccaugugcuuccucaggggaa

SEQ ID NO: 517476 - RNA, 22 nt, Human
uucaagaugcacaguggcauuc

SEQ ID NO: 517477 - RNA, 22 nt, Human
gaggucaggcucaagcugggcc

SEQ ID NO: 517478 - RNA, 21 nt, Human
ggcagaaguagcauggacggg

SEQ ID NO: 517479 - RNA, 22 nt, Human
gcuacagagcucugugaagaga

SEQ ID NO: 517480 - RNA, 22 nt, Human
aacccagccguguagcugccgc

SEQ ID NO: 517481 - RNA, 22 nt, Human
cagggcuggcucaugaaaaguu

SEQ ID NO: 517482 - RNA, 22 nt, Human
cagggccaaguuggugccuuuu

SEQ ID NO: 517483 - RNA, 22 nt, Human
aagucacaaagugcuguacaug

SEQ ID NO: 517484 - RNA, 22 nt, Human
uggggagaagcaauagacucua

SEQ ID NO: 517485 - RNA, 22 nt, Human
uucuuugaguuaguacagucca

SEQ ID NO: 517486 - RNA, 22 nt, Human
uuggaauugugaacuaagugau

SEQ ID NO: 517487 - RNA, 22 nt, Human
uucucagugaaguuuagaacau

SEQ ID NO: 517488 - RNA, 22 nt, Human
ggugcagugguguggcaaaggg

SEQ ID NO: 517489 - RNA, 22 nt, Human
aaggcagcaccgccuccugaaa

SEQ ID NO: 517490 - RNA, 22 nt, Human
cagagccucucagaggucagac

SEQ ID NO: 517491 - RNA, 22 nt, Human
guaaaauugcaauuacuuuugc

SEQ ID NO: 517492 - RNA, 21 nt, Human
agcugagcccagaagacuggu

SEQ ID NO: 517493 - RNA, 22 nt, Human
uuggcucugauggggaucagga

SEQ ID NO: 517494 - RNA, 22 nt, Human
uggcugccaauggcuuggaaag

SEQ ID NO: 517495 - RNA, 21 nt, Human
agaauaaugguaucauuugcu

SEQ ID NO: 517496 - RNA, 22 nt, Human
uccuucaacuuuuuacuugccc

SEQ ID NO: 517497 - RNA, 22 nt, Human
auaaaaaggacagauguggucu

SEQ ID NO: 517498 - RNA, 22 nt, Human
acagugugguuugagcacuggg

SEQ ID NO: 517499 - RNA, 22 nt, Human
uccagugguacauggagacacu

SEQ ID NO: 517500 - RNA, 22 nt, Human
gcuguacauuuguguacacuug

SEQ ID NO: 517501 - RNA, 22 nt, Human
aacaguaucuuuuaucagaaau

SEQ ID NO: 517502 - RNA, 22 nt, Human
ggcugcaguuugucuuuugcuu

SEQ ID NO: 517503 - RNA, 22 nt, Human
ccacagaaucgcuaguggagca

SEQ ID NO: 517504 - RNA, 22 nt, Human
cguggcugguggaccugagggc

SEQ ID NO: 517505 - RNA, 22 nt, Human
gugcccuggaugacuuuggucu

SEQ ID NO: 517506 - RNA, 22 nt, Human
ggucucagcuggaguccuuggu

SEQ ID NO: 517507 - RNA, 22 nt, Human
cuccaggacccaguggcuccag

SEQ ID NO: 517508 - RNA, 22 nt, Human
gagagcauguggucuaguuuua

SEQ ID NO: 517509 - RNA, 22 nt, Human
cucuggguucacugaggcucug

SEQ ID NO: 517510 - RNA, 22 nt, Human
ugucccagggaaggcccagcac

SEQ ID NO: 517511 - RNA, 22 nt, Human
aggcugugcacagggcaccugc

SEQ ID NO: 517512 - RNA, 22 nt, Human
gcugucacaucaaggcacuaaa

SEQ ID NO: 517513 - RNA, 22 nt, Human
uggcucagucauggaugaguaa

SEQ ID NO: 517514 - RNA, 22 nt, Human
cugguuuugucagaagcuuuau

SEQ ID NO: 517515 - RNA, 22 nt, Human
uccuggagagugggcgagcaca

SEQ ID NO: 517516 - RNA, 22 nt, Human
ucugggagacguguguugucag

SEQ ID NO: 517517 - RNA, 21 nt, Human
cagaauccagucucuuauuac

SEQ ID NO: 517518 - RNA, 22 nt, Human
gcaguggggcgcugggaguugg

SEQ ID NO: 517519 - RNA, 22 nt, Human
ggaagacagaagccuacagcuu

SEQ ID NO: 517520 - RNA, 17 nt, Human
gcuuccucaugcaguuc

SEQ ID NO: 517521 - RNA, 22 nt, Human
gcugggcucagaccuagugaac

SEQ ID NO: 517522 - RNA, 22 nt, Human
cugagcagcguggggagcuggc

SEQ ID NO: 517523 - RNA, 22 nt, Human
ucugccugcaguguggcagggc

SEQ ID NO: 517524 - RNA, 22 nt, Human
acaaaguuauucuuucagagga

SEQ ID NO: 517525 - RNA, 22 nt, Human
agucccuucucaaagugugcgg

SEQ ID NO: 517526 - RNA, 22 nt, Human
guaacagaggguuugcagauau

SEQ ID NO: 517527 - RNA, 22 nt, Human
ugagucugcuccugguagcaga

SEQ ID NO: 517528 - RNA, 22 nt, Human
uacuguacauuccguuuguugc

SEQ ID NO: 517529 - RNA, 22 nt, Human
ucagugcucaggggagccgagg

SEQ ID NO: 517530 - RNA, 22 nt, Human
aaucaguuagaaggaagagaau

SEQ ID NO: 517531 - RNA, 22 nt, Human
acacaaacagucuauagcacca

SEQ ID NO: 517532 - RNA, 22 nt, Human
ggcuccuggggaggugagcuug

SEQ ID NO: 517533 - RNA, 22 nt, Human
accagccugucugagucguggg

SEQ ID NO: 517534 - RNA, 22 nt, Human
gaggcagugcauugucuagggg

SEQ ID NO: 517535 - RNA, 22 nt, Human
aggaaaaaccuguuaaugguag

SEQ ID NO: 517536 - RNA, 22 nt, Human
cagccucugacaccacagucgu

SEQ ID NO: 517537 - RNA, 22 nt, Human
auucaaguucuucugucuuugc

SEQ ID NO: 517538 - RNA, 22 nt, Human
uugcuaaaggauuuuguauuua

SEQ ID NO: 517539 - RNA, 22 nt, Human
gggccuggggugacguaccccu

SEQ ID NO: 517540 - RNA, 22 nt, Human
uuccugggugguccugguagag

SEQ ID NO: 517541 - RNA, 22 nt, Human
agugucuuucauauccuccauc

SEQ ID NO: 517542 - RNA, 22 nt, Human
ggcgggagauggggccguucag

SEQ ID NO: 517543 - RNA, 22 nt, Human
cagggucccaggagcugcuuuc

SEQ ID NO: 517544 - RNA, 22 nt, Human
ggucaggggcugcucuacagag

SEQ ID NO: 517545 - RNA, 22 nt, Human
gucugagggacagaguccuggc

SEQ ID NO: 517546 - RNA, 22 nt, Human
gugaaguugauuguuaucguca

SEQ ID NO: 517547 - RNA, 22 nt, Human
cagcccugucccugagggaccu

SEQ ID NO: 517548 - RNA, 22 nt, Human
uccagggauguccuguagcacu

SEQ ID NO: 517549 - RNA, 18 nt, Human
gauucugauucuggaggc

SEQ ID NO: 517550 - RNA, 22 nt, Human
ggcagaaggccucccagcuccu

SEQ ID NO: 517551 - RNA, 22 nt, Human
aagcagcuuucuuuccugugaa

SEQ ID NO: 517552 - RNA, 22 nt, Human
cagcccugcugacacugucuga

SEQ ID NO: 517553 - RNA, 22 nt, Human
uggggacaggagacuuacagcu

SEQ ID NO: 517554 - RNA, 22 nt, Human
uggagagguuuaaacaaaaguu

SEQ ID NO: 517555 - RNA, 22 nt, Human
gcaggaugaaggcagaggcuga

SEQ ID NO: 517556 - RNA, 22 nt, Human
aagcaaagaguuuaguggguga

SEQ ID NO: 517557 - RNA, 22 nt, Human
uggcucugcaccucaguguacc

SEQ ID NO: 517558 - RNA, 22 nt, Human
uggcugccuucccugcuggagg

SEQ ID NO: 517559 - RNA, 22 nt, Human
uucaaagugcauguuccucaga

SEQ ID NO: 517560 - RNA, 22 nt, Human
gugagagaugcuuucuuaacgc

SEQ ID NO: 517561 - RNA, 22 nt, Human
cacagguggcuccaaguuagag

SEQ ID NO: 517562 - RNA, 22 nt, Human
ucuuagaaauuccccaguggcu

SEQ ID NO: 517563 - RNA, 22 nt, Human
caggacaguuugcuuugcccug

SEQ ID NO: 517564 - RNA, 22 nt, Human
acugaaaaugaauuagaaacag

SEQ ID NO: 517565 - RNA, 22 nt, Human
aggcauggguagaagagaagcc

SEQ ID NO: 517566 - RNA, 22 nt, Human
uuguagaaaauuagaugcaugg

SEQ ID NO: 517567 - RNA, 22 nt, Human
ccugagcucaaagggugccugg

SEQ ID NO: 517568 - RNA, 22 nt, Human
aaaggagacagucuuaccugga

SEQ ID NO: 517569 - RNA, 22 nt, Human
ugcccaaguguuuggcugaguc

SEQ ID NO: 517570 - RNA, 22 nt, Human
cuuauuugcccauguuucuuua

SEQ ID NO: 517571 - RNA, 22 nt, Human
aagcagaugcguuggagcaguu

SEQ ID NO: 517572 - RNA, 22 nt, Human
aauacugucuuucacagauauu

SEQ ID NO: 517573 - RNA, 22 nt, Human
gcuggcuuccuucugcagcuag

SEQ ID NO: 517574 - RNA, 22 nt, Human
uggcacaggaauuuagaugcag

SEQ ID NO: 517575 - RNA, 22 nt, Human
gaaauagacacuuucuaugaau

SEQ ID NO: 517576 - RNA, 18 nt, Human
gaggaacauucaccuccu

SEQ ID NO: 517577 - RNA, 22 nt, Human
cacagacccagaagggaugaag

SEQ ID NO: 517578 - RNA, 22 nt, Human
gggccccuugcugcucugcugg

SEQ ID NO: 517579 - RNA, 23 nt, Human
aaguucaagucacagccugucuu

SEQ ID NO: 517580 - RNA, 22 nt, Human
uggcuuuaagaagacugacagc

SEQ ID NO: 517581 - RNA, 22 nt, Human
cugggcacaaguggcccuggau

SEQ ID NO: 517582 - RNA, 22 nt, Human
gggugggcccagcccagagaag

SEQ ID NO: 517583 - RNA, 22 nt, Human
cuggcagcugcccgagaugccc

SEQ ID NO: 517584 - RNA, 22 nt, Human
ucaaggaagggauauucuugaa

SEQ ID NO: 517585 - RNA, 22 nt, Human
ugcaaguaauuccagcuacuga

SEQ ID NO: 517586 - RNA, 22 nt, Human
gcugggcugagcuagacuuggc

SEQ ID NO: 517587 - RNA, 22 nt, Human
cuggcccagucucagaguguca

SEQ ID NO: 517588 - RNA, 22 nt, Human
uaaagugcccagggaaagcggg

SEQ ID NO: 517589 - RNA, 22 nt, Human
cucuggcuguuugcagcucaag

SEQ ID NO: 517590 - RNA, 22 nt, Human
gcaggcucaaaagcugguagga

SEQ ID NO: 517591 - RNA, 22 nt, Human
uaauaaaugaaagugcuggcau

SEQ ID NO: 517592 - RNA, 18 nt, Human
gaaaggagagacaguagg

SEQ ID NO: 517593 - RNA, 22 nt, Human
ugaaacagucuccagacuugga

SEQ ID NO: 517594 - RNA, 22 nt, Human
caauuagacauuuauuggccag

SEQ ID NO: 517595 - RNA, 22 nt, Human
agaaaugugagccccuuaucaa

SEQ ID NO: 517596 - RNA, 22 nt, Human
uguggcagggauacugaggcag

SEQ ID NO: 517597 - RNA, 22 nt, Human
uuccucuggaggcucuaggaga

SEQ ID NO: 517598 - RNA, 22 nt, Human
ggcuugcuucuuguccaggaau

SEQ ID NO: 517599 - RNA, 22 nt, Human
ugccaggcccugugcuggaugc

SEQ ID NO: 517600 - RNA, 22 nt, Human
agaucacaguggcaacucccuu

SEQ ID NO: 517601 - RNA, 22 nt, Human
gagcagaacuacucacauaucg

SEQ ID NO: 517602 - RNA, 22 nt, Human
gcuggugccuuguuguuguuac

SEQ ID NO: 517603 - RNA, 22 nt, Human
uguccuggagugcuugggggaa

SEQ ID NO: 517604 - RNA, 17 nt, Human
ccacagccuggcacuug

SEQ ID NO: 517605 - RNA, 20 nt, Human
ccuguuccauucccucaacc

SEQ ID NO: 517606 - RNA, 23 nt, Human
uccuccuuuugcuugugcuuccc

SEQ ID NO: 517607 - RNA, 23 nt, Human
agucauuaagaaguucaggaacu

SEQ ID NO: 517608 - RNA, 22 nt, Human
auagaacagaaacagaugcaca

SEQ ID NO: 517609 - RNA, 22 nt, Human
cucaggagguuuccugucuagg

SEQ ID NO: 517610 - RNA, 20 nt, Human
uauuuagauucaaguaugga

SEQ ID NO: 517611 - RNA, 22 nt, Human
auggcugcucuggauggagucc

SEQ ID NO: 517612 - RNA, 22 nt, Human
uuugcaauuugugcugcaaaug

SEQ ID NO: 517613 - RNA, 22 nt, Human
augaugguaaauucaguauccg

SEQ ID NO: 517614 - RNA, 22 nt, Human
uuggccuuaaccucucugugcc

SEQ ID NO: 517615 - RNA, 22 nt, Human
agcuguguucugguugauucac

SEQ ID NO: 517616 - RNA, 22 nt, Human
uugaaguucuaagccccaguac

SEQ ID NO: 517617 - RNA, 22 nt, Human
gcuguucagaugcgauucagga

SEQ ID NO: 517618 - RNA, 22 nt, Human
aagcugccugggaggaagggcu

SEQ ID NO: 517619 - RNA, 22 nt, Human
ggggaggaagcuggaacacggg

SEQ ID NO: 517620 - RNA, 22 nt, Human
ugccagugggugugcagagacu

SEQ ID NO: 517621 - RNA, 22 nt, Human
ugucaaaaccuuggaggcaagg

SEQ ID NO: 517622 - RNA, 22 nt, Human
guuuauaugaacuucauaccca

SEQ ID NO: 517623 - RNA, 22 nt, Human
ggagccagagucugcaguguaa

SEQ ID NO: 517624 - RNA, 22 nt, Human
aggcucugaguagagcugccag

SEQ ID NO: 517625 - RNA, 23 nt, Human
ucugggcugagcucgaguguaga

SEQ ID NO: 517626 - RNA, 22 nt, Human
ccagcacugcucucagacugag

SEQ ID NO: 517627 - RNA, 22 nt, Human
uucuaguguccuuggacuugcu

SEQ ID NO: 517628 - RNA, 22 nt, Human
ucagaaugaaauuucuuucaga

SEQ ID NO: 517629 - RNA, 22 nt, Human
gugggccaggccggagugcaga

SEQ ID NO: 517630 - RNA, 22 nt, Human
agacucugauucccucauguca

SEQ ID NO: 517631 - RNA, 22 nt, Human
cagaaauaucaguugaaagugc

SEQ ID NO: 517632 - RNA, 22 nt, Human
aucagucuguguuagaaaagag

SEQ ID NO: 517633 - RNA, 19 nt, Human
cucuggagcagacacugga

SEQ ID NO: 517634 - RNA, 22 nt, Human
agacagcauggagcugauaaca

SEQ ID NO: 517635 - RNA, 21 nt, Human
caaauacuuagaaacuuaaga

SEQ ID NO: 517636 - RNA, 19 nt, Human
acagaaauuaguuauuuuc

SEQ ID NO: 517637 - RNA, 22 nt, Human
aguaauaauagcuguaaagugc

SEQ ID NO: 517638 - RNA, 22 nt, Human
accuggccauccagcuggcauc

SEQ ID NO: 517639 - RNA, 22 nt, Human
gcaccaugacagugaggagaac

SEQ ID NO: 517640 - RNA, 23 nt, Human
agaccugcaucugauaggcccug

SEQ ID NO: 517641 - RNA, 22 nt, Human
cugauuccugauucaugcucuu

SEQ ID NO: 517642 - RNA, 22 nt, Human
cucuggguccuggggcuacaag

SEQ ID NO: 517643 - RNA, 22 nt, Human
augcugaagaguucaugauuau

SEQ ID NO: 517644 - RNA, 23 nt, Human
ggccuguguuuugucugaaguac

SEQ ID NO: 517645 - RNA, 22 nt, Human
uucaggauaguggugaguggca

SEQ ID NO: 517646 - RNA, 22 nt, Human
gagcucugggaaacaaagugua

SEQ ID NO: 517647 - RNA, 17 nt, Human
agccccucagcgucacc

SEQ ID NO: 517648 - RNA, 22 nt, Human
uucuggcaugagagaugggggu

SEQ ID NO: 517649 - RNA, 22 nt, Human
gagauucuguagucaggcaucu

SEQ ID NO: 517650 - RNA, 22 nt, Human
aaacucuauaggcagaagcaau

SEQ ID NO: 517651 - RNA, 22 nt, Human
uacaaaaguaauuacgguuuuu

SEQ ID NO: 517652 - RNA, 15 nt, Human
uucaggauaugacuc

SEQ ID NO: 517653 - RNA, 22 nt, Human
uagugcaagguuuugccaacuu

SEQ ID NO: 517654 - RNA, 21 nt, Human
uagaggcaggagggacugcag

SEQ ID NO: 517655 - RNA, 22 nt, Human
accugcagccacuucucuccuu

SEQ ID NO: 517656 - RNA, 22 nt, Human
uccaggcaugucccaagccgga

SEQ ID NO: 517657 - RNA, 22 nt, Human
uccaggcacgaggcccugugca

SEQ ID NO: 517658 - RNA, 22 nt, Human
gcgcaagccacacagccugggg

SEQ ID NO: 517659 - RNA, 22 nt, Human
ucauguacauguaagucagaaa

SEQ ID NO: 517660 - RNA, 22 nt, Human
cuguggcucauucuugguggca

SEQ ID NO: 517661 - RNA, 22 nt, Human
uaugaagcuuugaaaagcuuac

SEQ ID NO: 517662 - RNA, 22 nt, Human
agucagcagccuggccaggaga

SEQ ID NO: 517663 - RNA, 22 nt, Human
ugucugaggaagucagcccuuu

SEQ ID NO: 517664 - RNA, 21 nt, Human
guauugcagaguuaugugcuc

SEQ ID NO: 517665 - RNA, 22 nt, Human
agcccuggcccggcugugcuuu

SEQ ID NO: 517666 - RNA, 21 nt, Human
gcaggaugcaucuuggugucu

SEQ ID NO: 517667 - RNA, 23 nt, Human
gggcuccagucucugcucaguug

SEQ ID NO: 517668 - RNA, 23 nt, Human
agcaggcaucuguggcacaaggc

SEQ ID NO: 517669 - RNA, 22 nt, Human
agcugcagucaagcugggccac

SEQ ID NO: 517670 - RNA, 22 nt, Human
ugaccugcagucaagaggggaa

SEQ ID NO: 517671 - RNA, 21 nt, Human
aggugcagagccagggaccag

SEQ ID NO: 517672 - RNA, 22 nt, Human
uaagaacaguagaacaguaggu

SEQ ID NO: 517673 - RNA, 22 nt, Human
agcuuuaucagaggagucucua

SEQ ID NO: 517674 - RNA, 22 nt, Human
gccugccuucggugcgcagcgg

SEQ ID NO: 517675 - RNA, 22 nt, Human
agggcagccaugagccuucagg

SEQ ID NO: 517676 - RNA, 22 nt, Human
ccaggcucugucuggucagaag

SEQ ID NO: 517677 - RNA, 22 nt, Human
aagccagguguuuaggccagcg

SEQ ID NO: 517678 - RNA, 22 nt, Human
gaugcagaaaguagacaccauc

SEQ ID NO: 517679 - RNA, 22 nt, Human
uuccucuguaugcuuugcugcu

SEQ ID NO: 517680 - RNA, 22 nt, Human
ggcaaguauuugugcaucuaca

SEQ ID NO: 517681 - RNA, 22 nt, Human
cgcgguggcggccuccagcgcc

SEQ ID NO: 517682 - RNA, 22 nt, Human
caguuucucucauacauauuug

SEQ ID NO: 517683 - RNA, 22 nt, Human
uuuauauuaccuggaauagcuu

SEQ ID NO: 517684 - RNA, 22 nt, Human
acaguaauaaguguuggugagg

SEQ ID NO: 517685 - RNA, 22 nt, Human
uguguacacaaguauauauaca

SEQ ID NO: 517686 - RNA, 22 nt, Human
ugcaugcauaaauguacacaca

SEQ ID NO: 517687 - RNA, 22 nt, Human
gucccagggaagaaggcagcac

SEQ ID NO: 517688 - RNA, 22 nt, Human
aggcaggugagucaaaacagac

SEQ ID NO: 517689 - RNA, 22 nt, Human
uacuuguguucuacuagagaaa

SEQ ID NO: 517690 - RNA, 22 nt, Human
acauuguagacuuuucauaugu

SEQ ID NO: 517691 - RNA, 22 nt, Human
cuguggccuuggaccagcaucu

SEQ ID NO: 517692 - RNA, 22 nt, Human
uaaagcagccagggucuaagcc

SEQ ID NO: 517693 - RNA, 22 nt, Human
ggcugcagguugguuggcagcu

SEQ ID NO: 517694 - RNA, 22 nt, Human
gguuccagaguauuucauuuca

SEQ ID NO: 517695 - RNA, 22 nt, Human
guccuguggaaagcuagccgcu

SEQ ID NO: 517696 - RNA, 22 nt, Human
aguguacaucagaacauaucaa

SEQ ID NO: 517697 - RNA, 22 nt, Human
uuggccuucccuaccugggcca

SEQ ID NO: 517698 - RNA, 22 nt, Human
uccuagaaugcaccucugcugu

SEQ ID NO: 517699 - RNA, 22 nt, Human
cugcugggcuccucaugugacu

SEQ ID NO: 517700 - RNA, 22 nt, Human
caguuuuugccauuaagaguaa

SEQ ID NO: 517701 - RNA, 22 nt, Human
cuguccuguggaccugaggacg

SEQ ID NO: 517702 - RNA, 22 nt, Human
ggccagaggccacagcuguguc

SEQ ID NO: 517703 - RNA, 23 nt, Human
uugcaaauuucaguuaguucaug

SEQ ID NO: 517704 - RNA, 22 nt, Human
uuagaggugucaggagcacagg

SEQ ID NO: 517705 - RNA, 22 nt, Human
agcagcugaccagugaguccug

SEQ ID NO: 517706 - RNA, 21 nt, Human
ccuggcugcacaguugcuggu

SEQ ID NO: 517707 - RNA, 22 nt, Human
gaggagagggcugcgggcccac

SEQ ID NO: 517708 - RNA, 22 nt, Human
cugcacaguggacagugaagau

SEQ ID NO: 517709 - RNA, 22 nt, Human
gccuguuuacuuugccgcagga

SEQ ID NO: 517710 - RNA, 22 nt, Human
gccaagcuguuuuucagagacg

SEQ ID NO: 517711 - RNA, 22 nt, Human
gccaggcugcuccagggaggcc

SEQ ID NO: 517712 - RNA, 22 nt, Human
ugaaauguugccaugaggucuc

SEQ ID NO: 517713 - RNA, 22 nt, Human
uuguuuuggagaugagcuaaaa

SEQ ID NO: 517714 - RNA, 22 nt, Human
gcucugucuucagcacacagua

SEQ ID NO: 517715 - RNA, 22 nt, Human
auggaagggacagaagggcaag

SEQ ID NO: 517716 - RNA, 22 nt, Human
ugggggcacuucgaggucgccu

SEQ ID NO: 517717 - RNA, 22 nt, Human
uuguaugaccacaaucugacgu

SEQ ID NO: 517718 - RNA, 22 nt, Human
ugucuccucauacugucauauu

SEQ ID NO: 517719 - RNA, 22 nt, Human
uugauuugauugaugaacuaag

SEQ ID NO: 517720 - RNA, 22 nt, Human
aaguccuguuccucauacuucc

SEQ ID NO: 517721 - RNA, 22 nt, Human
cagggccugccugguuccugga

SEQ ID NO: 517722 - RNA, 21 nt, Human
agagccugagaucuuccagca

SEQ ID NO: 517723 - RNA, 22 nt, Human
guguaucaaagcacagacuuca

SEQ ID NO: 517724 - RNA, 22 nt, Human
aaauggcugacuaaauuaaauu

SEQ ID NO: 517725 - RNA, 22 nt, Human
acaccaugguucccaaacugug

SEQ ID NO: 517726 - RNA, 18 nt, Human
ugggauggagaguaacug

SEQ ID NO: 517727 - RNA, 22 nt, Human
ugucccaggcugaaguacagug

SEQ ID NO: 517728 - RNA, 22 nt, Human
ugaggcaggaaguuauauaaug

SEQ ID NO: 517729 - RNA, 22 nt, Human
gacaggccaggggcugaggugg

SEQ ID NO: 517730 - RNA, 22 nt, Human
cuggagcugcuguccuugggug

SEQ ID NO: 517731 - RNA, 22 nt, Human
aauggcuauacaacaugaguau

SEQ ID NO: 517732 - RNA, 22 nt, Human
auuuugaaaccaaguuauuucc

SEQ ID NO: 517733 - RNA, 18 nt, Human
gcagcugacacuggaguu

SEQ ID NO: 517734 - RNA, 22 nt, Human
gcaggucucaaucugagcaggc

SEQ ID NO: 517735 - RNA, 22 nt, Human
aaagcugcugccaaucaggcuu

SEQ ID NO: 517736 - RNA, 22 nt, Human
uauuuugucuucugcucaucac

SEQ ID NO: 517737 - RNA, 19 nt, Human
ucuuuucacgcauuuugaa

SEQ ID NO: 517738 - RNA, 23 nt, Human
cacugcagcguggucuggcagga

SEQ ID NO: 517739 - RNA, 22 nt, Human
uccuggccuagaguuuguguuc

SEQ ID NO: 517740 - RNA, 22 nt, Human
ugaaggagauuuuuagggaggc

SEQ ID NO: 517741 - RNA, 22 nt, Human
ucagggcagaauccaaagaauu

SEQ ID NO: 517742 - RNA, 22 nt, Human
ucaaaagaaacaccauguuccu

SEQ ID NO: 517743 - RNA, 22 nt, Human
caguccugggugcagcaggaaa

SEQ ID NO: 517744 - RNA, 22 nt, Human
agaaaguucacugguauauuuu

SEQ ID NO: 517745 - RNA, 22 nt, Human
augucuuucaaauucugccuag

SEQ ID NO: 517746 - RNA, 22 nt, Human
gcaggaguuaggcgucguggau

SEQ ID NO: 517747 - RNA, 22 nt, Human
agggcuacugccugccuucagg

SEQ ID NO: 517748 - RNA, 22 nt, Human
cccagagcugagucugauauau

SEQ ID NO: 517749 - RNA, 20 nt, Human
accuuucaaaugauucagca

SEQ ID NO: 517750 - RNA, 22 nt, Human
auugcugacucaauaauugaag

SEQ ID NO: 517751 - RNA, 22 nt, Human
guggaaggaauuaacagacuag

SEQ ID NO: 517752 - RNA, 20 nt, Human
aagcuucacuucauuugauc

SEQ ID NO: 517753 - RNA, 22 nt, Human
ucuguggcugugcugggccaga

SEQ ID NO: 517754 - RNA, 22 nt, Human
ccugggugucaugggcagcugg

SEQ ID NO: 517755 - RNA, 18 nt, Human
ugaacagaugaguugaag

SEQ ID NO: 517756 - RNA, 22 nt, Human
cacagcuucugucugacccaug

SEQ ID NO: 517757 - RNA, 22 nt, Human
ugugcccauuacacagaggcau

SEQ ID NO: 517758 - RNA, 22 nt, Human
gagguuggugaggggacacggu

SEQ ID NO: 517759 - RNA, 21 nt, Human
aggucccagguuugggcagca

SEQ ID NO: 517760 - RNA, 22 nt, Human
agcagagccugggcuaggggug

SEQ ID NO: 517761 - RNA, 22 nt, Human
ccuuccagaguucagucugccc

SEQ ID NO: 517762 - RNA, 22 nt, Human
uaaggaaaguacauguuuugac

SEQ ID NO: 517763 - RNA, 22 nt, Human
uagcuccuggcugcagggccuc

SEQ ID NO: 517764 - RNA, 22 nt, Human
guguuccauguuugagguaguu

SEQ ID NO: 517765 - RNA, 22 nt, Human
cugagcugguggaagcaugcag

SEQ ID NO: 517766 - RNA, 19 nt, Human
gucccugggcagaggcacc

SEQ ID NO: 517767 - RNA, 19 nt, Human
ggaagagaggaaaggugga

SEQ ID NO: 517768 - RNA, 22 nt, Human
ccagcuuuccaggguugacugg

SEQ ID NO: 517769 - RNA, 22 nt, Human
guuccuuggaagaacuugaggu

SEQ ID NO: 517770 - RNA, 22 nt, Human
auguguauacuugugcuuacuc

SEQ ID NO: 517771 - RNA, 22 nt, Human
aggcugaugcuggcugaggcug

SEQ ID NO: 517772 - RNA, 22 nt, Human
aauguguguucggggcccagag

SEQ ID NO: 517773 - RNA, 22 nt, Human
ucuggcccaaguuuucggugag

SEQ ID NO: 517774 - RNA, 22 nt, Human
acugggcuaccccaccauuacc

SEQ ID NO: 517775 - RNA, 22 nt, Human
auguuucaucaguaagguuuug

SEQ ID NO: 517776 - RNA, 22 nt, Human
cuggccuguccugacccagccu

SEQ ID NO: 517777 - RNA, 22 nt, Human
acagguggcuuauuggcugauu

SEQ ID NO: 517778 - RNA, 20 nt, Human
agugugcauuuagagucugc

SEQ ID NO: 517779 - RNA, 22 nt, Human
caguacuuaacuuauaggagag

SEQ ID NO: 517780 - RNA, 22 nt, Human
cagcugagucugagguucuuug

SEQ ID NO: 517781 - RNA, 22 nt, Human
ugguccugucucaaggagccuu

SEQ ID NO: 517782 - RNA, 22 nt, Human
cagcuucuauuuaucuuugugu

SEQ ID NO: 517783 - RNA, 22 nt, Human
ggucuuccgagaggccugugcu

SEQ ID NO: 517784 - RNA, 22 nt, Human
auaugccauuagcuagaaauaa

SEQ ID NO: 517785 - RNA, 22 nt, Human
gcaggucuaucaggcugcaggu

SEQ ID NO: 517786 - RNA, 22 nt, Human
auauacaggugguauguguaaa

SEQ ID NO: 517787 - RNA, 22 nt, Human
ucagagcugcccaugcaagggg

SEQ ID NO: 517788 - RNA, 22 nt, Human
ggcucaggcuggagugcagugg

SEQ ID NO: 517789 - RNA, 22 nt, Human
uguggcugugguuuucauaaau

SEQ ID NO: 517790 - RNA, 22 nt, Human
gagcuguccgccccugggccga

SEQ ID NO: 517791 - RNA, 22 nt, Human
agccugcuggaccaagcucaug

SEQ ID NO: 517792 - RNA, 22 nt, Human
ccuuugugguggcccagugugg

SEQ ID NO: 517793 - RNA, 23 nt, Human
agacccagagacuggcucugcuc

SEQ ID NO: 517794 - RNA, 22 nt, Human
aggcuggcccuacuggcugccu

SEQ ID NO: 517795 - RNA, 22 nt, Human
gggagggcuuggacccagaugu

SEQ ID NO: 517796 - RNA, 17 nt, Human
cguggcugagccauaga

SEQ ID NO: 517797 - RNA, 18 nt, Human
cacaggcaggugauaggu

SEQ ID NO: 517798 - RNA, 22 nt, Human
aaguucaagucuccugaguaua

SEQ ID NO: 517799 - RNA, 22 nt, Human
aggaugagagauacauggagca

SEQ ID NO: 517800 - RNA, 22 nt, Human
agcagccaauuggaggaugaag

SEQ ID NO: 517801 - RNA, 22 nt, Human
agagcucugcagcuggccucag

SEQ ID NO: 517802 - RNA, 22 nt, Human
gcaguguuucccagagauggaa

SEQ ID NO: 517803 - RNA, 22 nt, Human
cacagggcaggccccaggccuc

SEQ ID NO: 517804 - RNA, 19 nt, Human
ccaccccuuugcugggccc

SEQ ID NO: 517805 - RNA, 22 nt, Human
acagauauaaacuauaguagug

SEQ ID NO: 517806 - RNA, 22 nt, Human
ugaaacacugcgauaaaauccu

SEQ ID NO: 517807 - RNA, 22 nt, Human
ugugcaguuucuauguugucca

SEQ ID NO: 517808 - RNA, 22 nt, Human
uccagagccugcgcacuggcug

SEQ ID NO: 517809 - RNA, 23 nt, Human
aggaacugaggccuagggaggua

SEQ ID NO: 517810 - RNA, 22 nt, Human
cucugggcaccaaagagcagcu

SEQ ID NO: 517811 - RNA, 22 nt, Human
gugagcagaacagguggcuucu

SEQ ID NO: 517812 - RNA, 23 nt, Human
uucauuuaggaguucauaagagc

SEQ ID NO: 517813 - RNA, 22 nt, Human
gugggcugcccuugaggucagc

SEQ ID NO: 517814 - RNA, 22 nt, Human
uuguaaaugaccuuuucuaauu

SEQ ID NO: 517815 - RNA, 22 nt, Human
uguguacauauacacaaauaca

SEQ ID NO: 517816 - RNA, 23 nt, Human
agcaguaacuucagaaacaucag

SEQ ID NO: 517817 - RNA, 22 nt, Human
uccaggcuggacaugaggcggg

SEQ ID NO: 517818 - RNA, 20 nt, Human
gugggcagcaggcauacugg

SEQ ID NO: 517819 - RNA, 20 nt, Human
uggcaucucucaauuguagg

SEQ ID NO: 517820 - RNA, 22 nt, Human
cuggcaugaaauggcaucucau

SEQ ID NO: 517821 - RNA, 22 nt, Human
ugacagggugauuaugagagcu

SEQ ID NO: 517822 - RNA, 22 nt, Human
uuugaugaguuuaauaacagcc

SEQ ID NO: 517823 - RNA, 22 nt, Human
gcucugcucccucaaaugacau

SEQ ID NO: 517824 - RNA, 22 nt, Human
gggcgagggcgaaagcgagagc

SEQ ID NO: 517825 - RNA, 22 nt, Human
cacauuucuaggaaauuaaaug

SEQ ID NO: 517826 - RNA, 22 nt, Human
agcuggguucagaggcacaugg

SEQ ID NO: 517827 - RNA, 21 nt, Human
ccaggcugggagggcaguucc

SEQ ID NO: 517828 - RNA, 22 nt, Human
uagcagugccaggauuuugcug

SEQ ID NO: 517829 - RNA, 22 nt, Human
ugcuucuggaaacaguggcugu

SEQ ID NO: 517830 - RNA, 22 nt, Human
uuccucuccucacaugagucac

SEQ ID NO: 517831 - RNA, 22 nt, Human
gcugccuucccggaaugucauc

SEQ ID NO: 517832 - RNA, 22 nt, Human
uccuagaacuccaggacagucc

SEQ ID NO: 517833 - RNA, 22 nt, Human
uuccauaaugagauucccagcc

SEQ ID NO: 517834 - RNA, 20 nt, Human
aagauucauuguaauuaggg

SEQ ID NO: 517835 - RNA, 22 nt, Human
aauuacaaauguagacucucau

SEQ ID NO: 517836 - RNA, 22 nt, Human
uaggccauucuuggagcuuacu

SEQ ID NO: 517837 - RNA, 22 nt, Human
agagguauuagauuugcauagg

SEQ ID NO: 517838 - RNA, 22 nt, Human
guuuugugaggcacccacaggu

SEQ ID NO: 517839 - RNA, 22 nt, Human
cucuguagaaacagggcagaag

SEQ ID NO: 517840 - RNA, 22 nt, Human
uuuccacaauguuuuugcagga

SEQ ID NO: 517841 - RNA, 22 nt, Human
agggggcucagugacugaagug

SEQ ID NO: 517842 - RNA, 22 nt, Human
gggcaguggcucacgccuguaa

SEQ ID NO: 517843 - RNA, 22 nt, Human
agggcugccauuucuggcccaa

SEQ ID NO: 517844 - RNA, 22 nt, Human
gcucccagaaccaaggcugggg

SEQ ID NO: 517845 - RNA, 22 nt, Human
caggaugaagggcaaaggcaag

SEQ ID NO: 517846 - RNA, 22 nt, Human
uuaaagauucugaggcugauua

SEQ ID NO: 517847 - RNA, 18 nt, Human
acagaaauagcugugccu

SEQ ID NO: 517848 - RNA, 22 nt, Human
augagcugugggauuccagagg

SEQ ID NO: 517849 - RNA, 17 nt, Human
gugcagggaugaaggau

SEQ ID NO: 517850 - RNA, 22 nt, Human
acagagauguggaugagggauu

SEQ ID NO: 517851 - RNA, 22 nt, Human
gcuggccuucugcagaguucug

SEQ ID NO: 517852 - RNA, 22 nt, Human
ugccaggcauauggccucuuug

SEQ ID NO: 517853 - RNA, 22 nt, Human
agaugcugugaggaagcuagga

SEQ ID NO: 517854 - RNA, 22 nt, Human
ucagccugcgucauggugacac

SEQ ID NO: 517855 - RNA, 22 nt, Human
ggugcaaagauggcaguugcaa

SEQ ID NO: 517856 - RNA, 22 nt, Human
ggaaaucaugggagaguuggaa

SEQ ID NO: 517857 - RNA, 22 nt, Human
aguguuucuggcaaaugaaagu

SEQ ID NO: 517858 - RNA, 22 nt, Human
uccucagaugcucuuggacgcc

SEQ ID NO: 517859 - RNA, 22 nt, Human
ggccugcuauuggugggcagac

SEQ ID NO: 517860 - RNA, 22 nt, Human
ggggacugccuuccacagacac

SEQ ID NO: 517861 - RNA, 22 nt, Human
ccagaggaaaaauaucucccua

SEQ ID NO: 517862 - RNA, 22 nt, Human
ccagcccuugagauggaaggga

SEQ ID NO: 517863 - RNA, 22 nt, Human
gaaucaaaucaaguucuuuuga

SEQ ID NO: 517864 - RNA, 21 nt, Human
aaguggagaagaaaagcugga

SEQ ID NO: 517865 - RNA, 20 nt, Human
ugcuguaagauuagagagcu

SEQ ID NO: 517866 - RNA, 23 nt, Human
aguuccagaaaaaugcucaagca

SEQ ID NO: 517867 - RNA, 22 nt, Human
caggagccccaggcugacaaua

SEQ ID NO: 517868 - RNA, 20 nt, Human
cagaaggucuaagcuuuaga

SEQ ID NO: 517869 - RNA, 22 nt, Human
uugcccuggggcuggccuggca

SEQ ID NO: 517870 - RNA, 23 nt, Human
ucacuagucaagugccuuugagu

SEQ ID NO: 517871 - RNA, 22 nt, Human
ucaaggagcccacagucuaaug

SEQ ID NO: 517872 - RNA, 22 nt, Human
gaaggaagugcucauacuaguu

SEQ ID NO: 517873 - RNA, 22 nt, Human
acugggcuccaaggaccuggag

SEQ ID NO: 517874 - RNA, 22 nt, Human
gaagcuaaaccacagcuaagaa

SEQ ID NO: 517875 - RNA, 21 nt, Human
uucugccuuccccuagcuggg

SEQ ID NO: 517876 - RNA, 22 nt, Human
ugaaacaagggaccguccuuuc

SEQ ID NO: 517877 - RNA, 22 nt, Human
aacauuuaugguagucauugca

SEQ ID NO: 517878 - RNA, 22 nt, Human
ugaagccuuguguggccucucu

SEQ ID NO: 517879 - RNA, 22 nt, Human
agaaaauauucauugagaggcu

SEQ ID NO: 517880 - RNA, 22 nt, Human
cagcaaucgggugauaugcaau

SEQ ID NO: 517881 - RNA, 22 nt, Human
ggccugugcaagacagcacccc

SEQ ID NO: 517882 - RNA, 22 nt, Human
cagagcugguaagugguagagg

SEQ ID NO: 517883 - RNA, 22 nt, Human
gguggagcuguggacaggaagg

SEQ ID NO: 517884 - RNA, 22 nt, Human
gccuguuuccaucaacacaugc

SEQ ID NO: 517885 - RNA, 22 nt, Human
ccaguguuuacaguugaacaaa

SEQ ID NO: 517886 - RNA, 22 nt, Human
ugguggggucaucgucagaugc

SEQ ID NO: 517887 - RNA, 22 nt, Human
aucugggcucgaauccuagcuc

SEQ ID NO: 517888 - RNA, 23 nt, Human
ggacacaggccuugucugcgccu

SEQ ID NO: 517889 - RNA, 22 nt, Human
uacagucacauucugaggucuu

SEQ ID NO: 517890 - RNA, 22 nt, Human
gucagcagugucagcucugggg

SEQ ID NO: 517891 - RNA, 22 nt, Human
gggcaugccugcgcagugcaug

SEQ ID NO: 517892 - RNA, 22 nt, Human
agagaaggcauagaacuugagu

SEQ ID NO: 517893 - RNA, 22 nt, Human
gccucugcaucaucacuccagc

SEQ ID NO: 517894 - RNA, 21 nt, Human
cugaggcagcacagcuaguca

SEQ ID NO: 517895 - RNA, 22 nt, Human
gcuggcugaggucuagcucuuu

SEQ ID NO: 517896 - RNA, 22 nt, Human
ugcugaaugggugauuuuggag

SEQ ID NO: 517897 - RNA, 22 nt, Human
uccuccagugucuggggccuug

SEQ ID NO: 517898 - RNA, 22 nt, Human
aaacacagggauauauauucca

SEQ ID NO: 517899 - RNA, 22 nt, Human
cuggggaaggcggugacugcgc

SEQ ID NO: 517900 - RNA, 22 nt, Human
agaacugguggugaucaguuau

SEQ ID NO: 517901 - RNA, 22 nt, Human
agauauuuguaucuugcuauug

SEQ ID NO: 517902 - RNA, 22 nt, Human
ccucaugguacuuacuguagcu

SEQ ID NO: 517903 - RNA, 22 nt, Human
ucuuuacaguccucugucaauc

SEQ ID NO: 517904 - RNA, 22 nt, Human
gucuccugagacugcagucacc

SEQ ID NO: 517905 - RNA, 22 nt, Human
cuuguuuucuaaaacaucauuu

SEQ ID NO: 517906 - RNA, 22 nt, Human
uucugucuucccacugaggagc

SEQ ID NO: 517907 - RNA, 22 nt, Human
acugauacaucuguggaagugg

SEQ ID NO: 517908 - RNA, 22 nt, Human
accaccccaaaugaaccucugu

SEQ ID NO: 517909 - RNA, 20 nt, Human
aguuuauuccaggagaacug

SEQ ID NO: 517910 - RNA, 22 nt, Human
ucucugggaaugggccugggua

SEQ ID NO: 517911 - RNA, 22 nt, Human
ugguuucucagacucuuugcag

SEQ ID NO: 517912 - RNA, 22 nt, Human
acucagugaauuuucaucaaau

SEQ ID NO: 517913 - RNA, 18 nt, Human
uccugccugcgggcuccc

SEQ ID NO: 517914 - RNA, 22 nt, Human
gaaacuguauguaguuuuuggg

SEQ ID NO: 517915 - RNA, 22 nt, Human
gcagggacaccuuugugaagcu

SEQ ID NO: 517916 - RNA, 22 nt, Human
guccucaguaagagggccucug

SEQ ID NO: 517917 - RNA, 22 nt, Human
ucccaggcuggcaggcagcagu

SEQ ID NO: 517918 - RNA, 22 nt, Human
augcaaaaguaauugcaauuuu

SEQ ID NO: 517919 - RNA, 22 nt, Human
uuccugugauauuagccacugu

SEQ ID NO: 517920 - RNA, 22 nt, Human
guccugggaggggcugguccug

SEQ ID NO: 517921 - RNA, 22 nt, Human
ccaggccagcgcuggcuggagg

SEQ ID NO: 517922 - RNA, 22 nt, Human
aacaaagucguugccuagaaga

SEQ ID NO: 517923 - RNA, 22 nt, Human
ggccagaguugauggcaucuug

SEQ ID NO: 517924 - RNA, 22 nt, Human
uuaugcuaagugcaacaagcca

SEQ ID NO: 517925 - RNA, 22 nt, Human
agaacaaugcguauuuuacucc

SEQ ID NO: 517926 - RNA, 22 nt, Human
ucuggaguguguguauucagcu

SEQ ID NO: 517927 - RNA, 22 nt, Human
uacauacauuaccucauuuagu

SEQ ID NO: 517928 - RNA, 22 nt, Human
ggaggccacgguuuagcaccga

SEQ ID NO: 517929 - RNA, 22 nt, Human
ucuucaggaagggaaaucaucc

SEQ ID NO: 517930 - RNA, 22 nt, Human
guggaagggacugccuagagga

SEQ ID NO: 517931 - RNA, 22 nt, Human
guguaauuauauaaagaucuac

SEQ ID NO: 517932 - RNA, 22 nt, Human
uuuggaaugguaccuucaguug

SEQ ID NO: 517933 - RNA, 22 nt, Human
auugaaagauuuugggcucaug

SEQ ID NO: 517934 - RNA, 22 nt, Human
agcaggucuugcucucaacagg

SEQ ID NO: 517935 - RNA, 22 nt, Human
cugggucuggaggccaagggug

SEQ ID NO: 517936 - RNA, 22 nt, Human
caggauggugugagugugagga

SEQ ID NO: 517937 - RNA, 22 nt, Human
cccucugccucugaguaggaca

SEQ ID NO: 517938 - RNA, 22 nt, Human
auacauguaacugcauuguaau

SEQ ID NO: 517939 - RNA, 20 nt, Human
agcauuugaaauaugacuau

SEQ ID NO: 517940 - RNA, 22 nt, Human
aagcuucaguggacuguagugu

SEQ ID NO: 517941 - RNA, 18 nt, Human
ucagcuuuugaaaaccaa

SEQ ID NO: 517942 - RNA, 22 nt, Human
cugcucugugguccaugagaca

SEQ ID NO: 517943 - RNA, 22 nt, Human
cuccagugcuucuagaaaauac

SEQ ID NO: 517944 - RNA, 22 nt, Human
cccucucucgguugcugugguu

SEQ ID NO: 517945 - RNA, 22 nt, Human
ccuacauucucugaguuuuccu

SEQ ID NO: 517946 - RNA, 22 nt, Human
uacuguauuugauaagugaagu

SEQ ID NO: 517947 - RNA, 22 nt, Human
uaaggaaagugccaugauuucu

SEQ ID NO: 517948 - RNA, 22 nt, Human
cugggcugcaggaguggggcaa

SEQ ID NO: 517949 - RNA, 22 nt, Human
uaaaugugcacuuuacuuuuca

SEQ ID NO: 517950 - RNA, 22 nt, Human
acauguuugauaaauauuuggg

SEQ ID NO: 517951 - RNA, 22 nt, Human
ccuccaggcugaauaucuagaa

SEQ ID NO: 517952 - RNA, 22 nt, Human
cuguguuuugauuaaaaagcaa

SEQ ID NO: 517953 - RNA, 22 nt, Human
agggcucaauggugggcaugua

SEQ ID NO: 517954 - RNA, 22 nt, Human
aucuguguaugugaccuuaucu

SEQ ID NO: 517955 - RNA, 22 nt, Human
uauaaaguuucgaaagauguau

SEQ ID NO: 517956 - RNA, 20 nt, Human
ggguggaguugcggucugug

SEQ ID NO: 517957 - RNA, 22 nt, Human
gaaaucaauuucuugguugaua

SEQ ID NO: 517958 - RNA, 22 nt, Human
gcugcaggagcuggagcugugg

SEQ ID NO: 517959 - RNA, 22 nt, Human
cucuggagcgcugcuucccgcg

SEQ ID NO: 517960 - RNA, 22 nt, Human
gcauuuggaacuugguugagau

SEQ ID NO: 517961 - RNA, 22 nt, Human
cguuggagacacuugaggacuu

SEQ ID NO: 517962 - RNA, 22 nt, Human
gagagcugcaagguagggcggg

SEQ ID NO: 517963 - RNA, 22 nt, Human
uauuucuucgggauucaagcua

SEQ ID NO: 517964 - RNA, 22 nt, Human
caaaugaauuucccugcaaaug

SEQ ID NO: 517965 - RNA, 22 nt, Human
uauuauuauaguuauugggaag

SEQ ID NO: 517966 - RNA, 22 nt, Human
ggcaggcaggucuucauggccc

SEQ ID NO: 517967 - RNA, 22 nt, Human
uucagcuucauuugucuuuaug

SEQ ID NO: 517968 - RNA, 22 nt, Human
gugucccagcagcacauuggcu

SEQ ID NO: 517969 - RNA, 22 nt, Human
uccuggccuuagcgaggcgguc

SEQ ID NO: 517970 - RNA, 22 nt, Human
cacagcuucccaaaguggaccu

SEQ ID NO: 517971 - RNA, 22 nt, Human
cacaugggcguaauguccaugg

SEQ ID NO: 517972 - RNA, 22 nt, Human
aaauuucuaagcagccacuucc

SEQ ID NO: 517973 - RNA, 22 nt, Human
caugcuggucagccaguggaug

SEQ ID NO: 517974 - RNA, 22 nt, Human
ucucaggagccacagcgggagu

SEQ ID NO: 517975 - RNA, 23 nt, Human
uggagcugacagucagagggagg

SEQ ID NO: 517976 - RNA, 22 nt, Human
ggcaggcucuuggccuuaugag

SEQ ID NO: 517977 - RNA, 22 nt, Human
ugaaagguguccaauauuucuc

SEQ ID NO: 517978 - RNA, 21 nt, Human
aagcuuggcugauguuauugg

SEQ ID NO: 517979 - RNA, 23 nt, Human
ucccagccucuucucuugcauac

SEQ ID NO: 517980 - RNA, 22 nt, Human
ggagaggugcaggucaguggca

SEQ ID NO: 517981 - RNA, 22 nt, Human
cagcuuguuuuauuuggggacc

SEQ ID NO: 517982 - RNA, 22 nt, Human
ccaggcccugcuccucacacca

SEQ ID NO: 517983 - RNA, 22 nt, Human
uuuaccauccucuuuuagaauu

SEQ ID NO: 517984 - RNA, 22 nt, Human
cugggccuuggauugacacugu

SEQ ID NO: 517985 - RNA, 22 nt, Human
acugcagcaaagcccgugucuu

SEQ ID NO: 517986 - RNA, 22 nt, Human
uggccucaccacuagcugggug

SEQ ID NO: 517987 - RNA, 22 nt, Human
ugauucaacuuucuugaaugca

SEQ ID NO: 517988 - RNA, 22 nt, Human
ugagccaggaguuugaggcugu

SEQ ID NO: 517989 - RNA, 19 nt, Human
uacuuuuucaggacagagu

SEQ ID NO: 517990 - RNA, 22 nt, Human
ggcacugacugugcagcgcacc

SEQ ID NO: 517991 - RNA, 22 nt, Human
ucaguguuagacaaguuuggaa

SEQ ID NO: 517992 - RNA, 22 nt, Human
aagacacagcgaaauguuccug

SEQ ID NO: 517993 - RNA, 22 nt, Human
ugccugugucacagugauguuu

SEQ ID NO: 517994 - RNA, 22 nt, Human
aacaaauguguuuuguaauuaa

SEQ ID NO: 517995 - RNA, 22 nt, Human
uaagaacaucuguccccagauu

SEQ ID NO: 517996 - RNA, 23 nt, Human
ggacacauuuauuucagaauuca

SEQ ID NO: 517997 - RNA, 22 nt, Human
aagauuuacuagcauaauagcu

SEQ ID NO: 517998 - RNA, 22 nt, Human
ccugacaggagaagcgcagcau

SEQ ID NO: 517999 - RNA, 20 nt, Human
ccaggccugggccugcucua

SEQ ID NO: 518000 - RNA, 22 nt, Human
gcugccugcacagagcugcuuu

SEQ ID NO: 518001 - RNA, 22 nt, Human
ggcuggaaguccaagaucaagg

SEQ ID NO: 518002 - RNA, 23 nt, Human
uugcauguagcccaugaguaacu

SEQ ID NO: 518003 - RNA, 19 nt, Human
ugcagccacgugagagacu

SEQ ID NO: 518004 - RNA, 22 nt, Human
uggcugagcugcagcguggcuu

SEQ ID NO: 518005 - RNA, 22 nt, Human
ucaaacuguuuacagugagaua

SEQ ID NO: 518006 - RNA, 22 nt, Human
cuuccucacggugcaacaggaa

SEQ ID NO: 518007 - RNA, 22 nt, Human
aaggcugaggcuggagaauuac

SEQ ID NO: 518008 - RNA, 22 nt, Human
gggaucuuucugaugcuguggc

SEQ ID NO: 518009 - RNA, 16 nt, Human
ccucugggauguuugc

SEQ ID NO: 518010 - RNA, 22 nt, Human
gggaaggagccugcuugcuaga

SEQ ID NO: 518011 - RNA, 22 nt, Human
gcugcuucucugauggagucca

SEQ ID NO: 518012 - RNA, 22 nt, Human
agcaguccaacugagguggcau

SEQ ID NO: 518013 - RNA, 22 nt, Human
uaugagaacugacagagugcca

SEQ ID NO: 518014 - RNA, 22 nt, Human
caaaguucucggcucaaguccu

SEQ ID NO: 518015 - RNA, 22 nt, Human
uccugagaugagacagugcugc

SEQ ID NO: 518016 - RNA, 22 nt, Human
gcugggccagagcagcagcacu

SEQ ID NO: 518017 - RNA, 22 nt, Human
gcaggagaaaugaagauugggu

SEQ ID NO: 518018 - RNA, 22 nt, Human
ccugucuggccaccagggcgau

SEQ ID NO: 518019 - RNA, 21 nt, Human
acagggcaugcagcuggcugu

SEQ ID NO: 518020 - RNA, 22 nt, Human
aggacccagaggcagaggacgu

SEQ ID NO: 518021 - RNA, 20 nt, Human
aucuuugucucuguaguugu

SEQ ID NO: 518022 - RNA, 22 nt, Human
cucuccaggacuuuggcccaau

SEQ ID NO: 518023 - RNA, 22 nt, Human
acacauguauggcacuuacauu

SEQ ID NO: 518024 - RNA, 22 nt, Human
caguacauuucauaugauucua

SEQ ID NO: 518025 - RNA, 22 nt, Human
ugugcuucuugcagcuccugua

SEQ ID NO: 518026 - RNA, 22 nt, Human
cugagccuuauucaccagcccu

SEQ ID NO: 518027 - RNA, 23 nt, Human
uguguucucacacagaugcagua

SEQ ID NO: 518028 - RNA, 22 nt, Human
ugcagggaaaguguuggcagca

SEQ ID NO: 518029 - RNA, 22 nt, Human
ugguccuguagcucucuaaguu

SEQ ID NO: 518030 - RNA, 22 nt, Human
ucuuuuaucuguuguguaacaa

SEQ ID NO: 518031 - RNA, 22 nt, Human
agucagacauaauucuaacauu

SEQ ID NO: 518032 - RNA, 22 nt, Human
uuccugagcuuuuaaccuaguc

SEQ ID NO: 518033 - RNA, 22 nt, Human
ccuugugcagguucaugauggg

SEQ ID NO: 518034 - RNA, 22 nt, Human
ggccugagcagacagcaugaug

SEQ ID NO: 518035 - RNA, 22 nt, Human
uggaaggagacugggaagugug

SEQ ID NO: 518036 - RNA, 22 nt, Human
cugggcucuagaaaggaaagaa

SEQ ID NO: 518037 - RNA, 22 nt, Human
gagguagccacagauagagacu

SEQ ID NO: 518038 - RNA, 22 nt, Human
ccugugggcccuggacagagac

SEQ ID NO: 518039 - RNA, 22 nt, Human
uuuacagaaugucaauuucuau

SEQ ID NO: 518040 - RNA, 22 nt, Human
agggugccugcugcagguucag

SEQ ID NO: 518041 - RNA, 22 nt, Human
cagggcagccaggccccguggg

SEQ ID NO: 518042 - RNA, 22 nt, Human
aucuuaaucgaguccaugaaaa

SEQ ID NO: 518043 - RNA, 22 nt, Human
uagcuucaugcuucaccacgcu

SEQ ID NO: 518044 - RNA, 22 nt, Human
gcugagagugagcacuggauau

SEQ ID NO: 518045 - RNA, 22 nt, Human
uuggcucuggaacuauuucuga

SEQ ID NO: 518046 - RNA, 20 nt, Human
uauaaauucagagcuuuggu

SEQ ID NO: 518047 - RNA, 22 nt, Human
cagggcucgcucgcucgcucgc

SEQ ID NO: 518048 - RNA, 22 nt, Human
aggagccaguuccaccccagga

SEQ ID NO: 518049 - RNA, 22 nt, Human
caugucuuauauccugucuuca

SEQ ID NO: 518050 - RNA, 22 nt, Human
uucuuaaagaggcaaaacacag

SEQ ID NO: 518051 - RNA, 22 nt, Human
uaggugggugacuuccaugggg

SEQ ID NO: 518052 - RNA, 22 nt, Human
aguugaauaauuagacauaucu

SEQ ID NO: 518053 - RNA, 22 nt, Human
cuuacaagaccaaagaaaggau

SEQ ID NO: 518054 - RNA, 22 nt, Human
auugacaaggaaacuauaccag

SEQ ID NO: 518055 - RNA, 18 nt, Human
cagagcaguaugaauguu

SEQ ID NO: 518056 - RNA, 22 nt, Human
ggguccaggcacuaugcuaagu

SEQ ID NO: 518057 - RNA, 22 nt, Human
ucaguguugugcacauacaaaa

SEQ ID NO: 518058 - RNA, 19 nt, Human
cuauacagccucugaggaa

SEQ ID NO: 518059 - RNA, 22 nt, Human
gagugcaucguggccauuuuaa

SEQ ID NO: 518060 - RNA, 22 nt, Human
gccuggagaaaggaagguggga

SEQ ID NO: 518061 - RNA, 22 nt, Human
gucuggggaagucagggcauca

SEQ ID NO: 518062 - RNA, 22 nt, Human
uuuccagucucagcccuguaac

SEQ ID NO: 518063 - RNA, 22 nt, Human
aggcaggugcuuaugacuugcu

SEQ ID NO: 518064 - RNA, 22 nt, Human
aacaaguaaguuuauauauauu

SEQ ID NO: 518065 - RNA, 22 nt, Human
agggagcucaguuggaagcggu

SEQ ID NO: 518066 - RNA, 23 nt, Human
auaaggcauaaagguacauugga

SEQ ID NO: 518067 - RNA, 22 nt, Human
aaauggaggcacgcagugguua

SEQ ID NO: 518068 - RNA, 22 nt, Human
ggggaugguagaccggugacgu

SEQ ID NO: 518069 - RNA, 22 nt, Human
ccugggcagggagaccaggcuc

SEQ ID NO: 518070 - RNA, 19 nt, Human
agagacugccaccagcugu

SEQ ID NO: 518071 - RNA, 22 nt, Human
uggaagagggagcuggguggcc

SEQ ID NO: 518072 - RNA, 22 nt, Human
gagucaguaauggauaugucau

SEQ ID NO: 518073 - RNA, 22 nt, Human
ucuucuuccucauuuauacaua

SEQ ID NO: 518074 - RNA, 20 nt, Human
uaacagaaguagaagugggu

SEQ ID NO: 518075 - RNA, 22 nt, Human
ugauuacaguauuugagaucca

SEQ ID NO: 518076 - RNA, 22 nt, Human
ugggccagaggcauggagcuau

SEQ ID NO: 518077 - RNA, 22 nt, Human
ugggccagcacugggugcucau

SEQ ID NO: 518078 - RNA, 22 nt, Human
ucugccuggauuuuggaaagcu

SEQ ID NO: 518079 - RNA, 22 nt, Human
gauuucuuuaugaaguacagaa

SEQ ID NO: 518080 - RNA, 22 nt, Human
caugcacaaagguaagaugcgu

SEQ ID NO: 518081 - RNA, 22 nt, Human
uggcacaggaucucagcggcca

SEQ ID NO: 518082 - RNA, 22 nt, Human
agcuacucugcagugcccaugg

SEQ ID NO: 518083 - RNA, 22 nt, Human
augaaaacggaccagagcuauu

SEQ ID NO: 518084 - RNA, 16 nt, Human
ggguccagaucugcuc

SEQ ID NO: 518085 - RNA, 22 nt, Human
caccugcagggggagucaagag

SEQ ID NO: 518086 - RNA, 22 nt, Human
uccugagggcauuuuggugacu

SEQ ID NO: 518087 - RNA, 22 nt, Human
cauucccacguguucuuugcuu

SEQ ID NO: 518088 - RNA, 22 nt, Human
aagcagcugauuucacagcuca

SEQ ID NO: 518089 - RNA, 22 nt, Human
aggcucagcaucugauucauau

SEQ ID NO: 518090 - RNA, 22 nt, Human
aggcaggccuacacaaugggag

SEQ ID NO: 518091 - RNA, 21 nt, Human
ucacacacguuuccaagggca

SEQ ID NO: 518092 - RNA, 22 nt, Human
aacaaacauuaccuggugcugg

SEQ ID NO: 518093 - RNA, 22 nt, Human
acacaugugucugcaugcagug

SEQ ID NO: 518094 - RNA, 22 nt, Human
ggcccuguccccuucaguuuug

SEQ ID NO: 518095 - RNA, 22 nt, Human
gcacagccugucccuguccugg

SEQ ID NO: 518096 - RNA, 22 nt, Human
ugcugucugcaacaguacuaca

SEQ ID NO: 518097 - RNA, 21 nt, Human
agguccaguucugucuuggac

SEQ ID NO: 518098 - RNA, 22 nt, Human
cagagcagucuggagauccagc

SEQ ID NO: 518099 - RNA, 22 nt, Human
ggagccagggaagcugcuuccu

SEQ ID NO: 518100 - RNA, 22 nt, Human
ucucuuaauaaguaaauacuga

SEQ ID NO: 518101 - RNA, 17 nt, Human
ucugaggccucuaggag

SEQ ID NO: 518102 - RNA, 22 nt, Human
ugagcagagucgcuccagagug

SEQ ID NO: 518103 - RNA, 22 nt, Human
uggccuguggcuuaaggucugu

SEQ ID NO: 518104 - RNA, 22 nt, Human
ggcuccuuaucucuccuaugcc

SEQ ID NO: 518105 - RNA, 20 nt, Human
gugcaauggcucagucucag

SEQ ID NO: 518106 - RNA, 22 nt, Human
auuucacagcgugguugacugc

SEQ ID NO: 518107 - RNA, 22 nt, Human
ugcaaucucggcacuuugggag

SEQ ID NO: 518108 - RNA, 22 nt, Human
uuccauuguuucugucuucacu

SEQ ID NO: 518109 - RNA, 22 nt, Human
aggcauggcauggggcagaugu

SEQ ID NO: 518110 - RNA, 23 nt, Human
cucaccaagcgccgccgcugugu

SEQ ID NO: 518111 - RNA, 19 nt, Human
aagggcugggcaccucacu

SEQ ID NO: 518112 - RNA, 22 nt, Human
uccuggagggaggcggugcuac

SEQ ID NO: 518113 - RNA, 18 nt, Human
aggagccuuugcacugga

SEQ ID NO: 518114 - RNA, 22 nt, Human
cuguggagcagggcagggucac

SEQ ID NO: 518115 - RNA, 22 nt, Human
ggcucuggagcacagacgucug

SEQ ID NO: 518116 - RNA, 23 nt, Human
ggagugcaauggcgccaucucgg

SEQ ID NO: 518117 - RNA, 22 nt, Human
ugcacaaaggcucccugcugag

SEQ ID NO: 518118 - RNA, 22 nt, Human
agcccuggaagccacaguccua

SEQ ID NO: 518119 - RNA, 21 nt, Human
ccugggagaucagcugccuuc

SEQ ID NO: 518120 - RNA, 22 nt, Human
ggacugggaaucagggagaugc

SEQ ID NO: 518121 - RNA, 22 nt, Human
ccacagccauuccagggaggcu

SEQ ID NO: 518122 - RNA, 22 nt, Human
ggcaggacauugacuacaguga

SEQ ID NO: 518123 - RNA, 22 nt, Human
uuauuacacugaaagaauugcg

SEQ ID NO: 518124 - RNA, 22 nt, Human
accaggcagcugggggugaugu

SEQ ID NO: 518125 - RNA, 22 nt, Human
gcaggagcugcucuccugacga

SEQ ID NO: 518126 - RNA, 19 nt, Human
ugucucugaaagaugagcu

SEQ ID NO: 518127 - RNA, 22 nt, Human
uguaugaaugggaaaaggaaac

SEQ ID NO: 518128 - RNA, 22 nt, Human
acugucaccuaaauuuucauug

SEQ ID NO: 518129 - RNA, 22 nt, Human
uauuagcuccaguacuguugcc

SEQ ID NO: 518130 - RNA, 22 nt, Human
auuugcuuguaaauguaugccu

SEQ ID NO: 518131 - RNA, 22 nt, Human
ggagagugggagcaacuguugc

SEQ ID NO: 518132 - RNA, 22 nt, Human
ugaacccaggagguugcaguga

SEQ ID NO: 518133 - RNA, 22 nt, Human
aauuagcuuuaccuaggauugu

SEQ ID NO: 518134 - RNA, 22 nt, Human
gcagcaucuagggcacuggccu

SEQ ID NO: 518135 - RNA, 22 nt, Human
auuccuuggcauucuggacuug

SEQ ID NO: 518136 - RNA, 22 nt, Human
gcuuggaaguaggauugggaga

SEQ ID NO: 518137 - RNA, 22 nt, Human
gagauguuauucuucagugugu

SEQ ID NO: 518138 - RNA, 22 nt, Human
caugcuuucuguccaaauguua

SEQ ID NO: 518139 - RNA, 22 nt, Human
cuggguuuuauuacagugagcu

SEQ ID NO: 518140 - RNA, 22 nt, Human
uggaaacugugguauuucuuua

SEQ ID NO: 518141 - RNA, 22 nt, Human
ugcccugcagugagugcgucug

SEQ ID NO: 518142 - RNA, 22 nt, Human
gcuuaguguaggaccuggaaua

SEQ ID NO: 518143 - RNA, 22 nt, Human
gcaugugucuccccaguggagg

SEQ ID NO: 518144 - RNA, 22 nt, Human
gccuggcucccucugcagcucc

SEQ ID NO: 518145 - RNA, 22 nt, Human
acaaauguggacauggauaaug

SEQ ID NO: 518146 - RNA, 20 nt, Human
cuggcaggagcgagucuacc

SEQ ID NO: 518147 - RNA, 22 nt, Human
uuagaucuuaggcaaauguguu

SEQ ID NO: 518148 - RNA, 22 nt, Human
uguagcucuccagccagcaagg

SEQ ID NO: 518149 - RNA, 22 nt, Human
uucuggagccccaagaucugua

SEQ ID NO: 518150 - RNA, 22 nt, Human
caaagauaugacauggaaaaug

SEQ ID NO: 518151 - RNA, 22 nt, Human
cugaauaauuuuauaguugcug

SEQ ID NO: 518152 - RNA, 22 nt, Human
cccugcaggcucagacuggagu

SEQ ID NO: 518153 - RNA, 17 nt, Human
gaaagguccuagaaauc

SEQ ID NO: 518154 - RNA, 20 nt, Human
uaggcagagcugugcagccu

SEQ ID NO: 518155 - RNA, 22 nt, Human
cucuggccgcagcucagcucug

SEQ ID NO: 518156 - RNA, 22 nt, Human
uucaggauaugugauaucugaa

SEQ ID NO: 518157 - RNA, 22 nt, Human
acugggcuguaaagagaggcaa

SEQ ID NO: 518158 - RNA, 22 nt, Human
uuugugaauucuuggaagauug

SEQ ID NO: 518159 - RNA, 22 nt, Human
uucacauuugcccuuaugugug

SEQ ID NO: 518160 - RNA, 22 nt, Human
gaggaggaggaaguggaaccca

SEQ ID NO: 518161 - RNA, 22 nt, Human
uuguguccugauuugacacaau

SEQ ID NO: 518162 - RNA, 22 nt, Human
gccagggaaacugcagaccagc

SEQ ID NO: 518163 - RNA, 22 nt, Human
gggaaggcaccaugguguucca

SEQ ID NO: 518164 - RNA, 22 nt, Human
uuagcauuucaguacacauguu

SEQ ID NO: 518165 - RNA, 21 nt, Human
cacaagacacauaggguguuu

SEQ ID NO: 518166 - RNA, 22 nt, Human
ugagcagaaaagaaugcugagc

SEQ ID NO: 518167 - RNA, 22 nt, Human
uccaaauucuagggccuugguu

SEQ ID NO: 518168 - RNA, 22 nt, Human
aacacuguaacagcaucauuuu

SEQ ID NO: 518169 - RNA, 22 nt, Human
acuggcugaaaguaaagaacac

SEQ ID NO: 518170 - RNA, 22 nt, Human
acauacauggauucauggauuc

SEQ ID NO: 518171 - RNA, 20 nt, Human
agagguucagucuggagaag

SEQ ID NO: 518172 - RNA, 22 nt, Human
ccagggugagugucauggguua

SEQ ID NO: 518173 - RNA, 22 nt, Human
ugucucuggcccaugagcagag

SEQ ID NO: 518174 - RNA, 19 nt, Human
cugaagucuuuucagcugg

SEQ ID NO: 518175 - RNA, 22 nt, Human
gccuggcuggucacugccuggc

SEQ ID NO: 518176 - RNA, 22 nt, Human
caucugcuguuccuuggacuca

SEQ ID NO: 518177 - RNA, 22 nt, Human
ggcaugucugauggcccaaguc

SEQ ID NO: 518178 - RNA, 22 nt, Human
cagagccagcaguggggacagg

SEQ ID NO: 518179 - RNA, 22 nt, Human
aaauaugaaugauaagaguuau

SEQ ID NO: 518180 - RNA, 22 nt, Human
ucacagcaggguaacaggaaga

SEQ ID NO: 518181 - RNA, 22 nt, Human
guucuccauucagcuuccugug

SEQ ID NO: 518182 - RNA, 22 nt, Human
agaugcugccucuccucacaag

SEQ ID NO: 518183 - RNA, 22 nt, Human
uuuaugagcaaugcugagggga

SEQ ID NO: 518184 - RNA, 20 nt, Human
gaaguccuuucacucuuccc

SEQ ID NO: 518185 - RNA, 22 nt, Human
agcagcauacacaucauguuga

SEQ ID NO: 518186 - RNA, 22 nt, Human
cauagaaaucaggugagaaucu

SEQ ID NO: 518187 - RNA, 22 nt, Human
cugaggcuuggaggggucuggu

SEQ ID NO: 518188 - RNA, 22 nt, Human
uaacucuagucccaggcaugaa

SEQ ID NO: 518189 - RNA, 20 nt, Human
guugaaaguaauaugaugcu

SEQ ID NO: 518190 - RNA, 22 nt, Human
cuagggacagaaagaggguaga

SEQ ID NO: 518191 - RNA, 22 nt, Human
cuucaaaugugauuuuaauaac

SEQ ID NO: 518192 - RNA, 22 nt, Human
uuccuucuuccagaggcugccc

SEQ ID NO: 518193 - RNA, 22 nt, Human
agggcagugggaaagccugcuc

SEQ ID NO: 518194 - RNA, 22 nt, Human
uuguuuccauugcagacugugu

SEQ ID NO: 518195 - RNA, 22 nt, Human
ucccagaguuuccuguguccca

SEQ ID NO: 518196 - RNA, 22 nt, Human
uggcucaguaaucgagucuccu

SEQ ID NO: 518197 - RNA, 22 nt, Human
uguuccuguacugcuguggcuu

SEQ ID NO: 518198 - RNA, 22 nt, Human
agcagcuucuuucacuccugga

SEQ ID NO: 518199 - RNA, 22 nt, Human
uguuccugacggccaaagaggu

SEQ ID NO: 518200 - RNA, 23 nt, Human
ccugugugcccuuaauucacagc

SEQ ID NO: 518201 - RNA, 22 nt, Human
aaaaguguccagauuaugaaga

SEQ ID NO: 518202 - RNA, 22 nt, Human
acaggccuuggcaggcauguga

SEQ ID NO: 518203 - RNA, 22 nt, Human
acacugaauaauugagaguuga

SEQ ID NO: 518204 - RNA, 22 nt, Human
uccaagcucucuaugccaugau

SEQ ID NO: 518205 - RNA, 22 nt, Human
aggccaaguagcuagcauugaa

SEQ ID NO: 518206 - RNA, 22 nt, Human
ccaggcucaggccugcucguug

SEQ ID NO: 518207 - RNA, 22 nt, Human
uauguacacuuaaguuugagaa

SEQ ID NO: 518208 - RNA, 22 nt, Human
uccugcagcugauaaauacagu

SEQ ID NO: 518209 - RNA, 22 nt, Human
cuguggcuccauagaaguugca

SEQ ID NO: 518210 - RNA, 22 nt, Human
uugaacauuaacuucagucuau

SEQ ID NO: 518211 - RNA, 22 nt, Human
cagaggcuguguaggcagacug

SEQ ID NO: 518212 - RNA, 22 nt, Human
ugauuuuuggaucugagcugca

SEQ ID NO: 518213 - RNA, 22 nt, Human
gccuuagccugcacuuccuguu

SEQ ID NO: 518214 - RNA, 22 nt, Human
uuucagugcacguaguuuauuu

SEQ ID NO: 518215 - RNA, 22 nt, Human
caguuucuuagugacacaaauc

SEQ ID NO: 518216 - RNA, 22 nt, Human
auucuaggcuugaaacaugaag

SEQ ID NO: 518217 - RNA, 22 nt, Human
uacauuccuucguuuagagauu

SEQ ID NO: 518218 - RNA, 22 nt, Human
ggcugaaaggugggaggauggc

SEQ ID NO: 518219 - RNA, 22 nt, Human
acucaggagggaucagcuauca

SEQ ID NO: 518220 - RNA, 22 nt, Human
gaggaaaucauuccagaaaagg

SEQ ID NO: 518221 - RNA, 22 nt, Human
caggacagagcccagacugugu

SEQ ID NO: 518222 - RNA, 22 nt, Human
cagcucugggugacaggagggc

SEQ ID NO: 518223 - RNA, 22 nt, Human
uaaaagacauauaacuguagga

SEQ ID NO: 518224 - RNA, 22 nt, Human
caccugagcacuggggccgccc

SEQ ID NO: 518225 - RNA, 22 nt, Human
ggagggcaacuuuucaguaggu

SEQ ID NO: 518226 - RNA, 22 nt, Human
uccugccucaggcucuggagua

SEQ ID NO: 518227 - RNA, 22 nt, Human
cuccucuggguccugguggcca

SEQ ID NO: 518228 - RNA, 22 nt, Human
uuacaaagaguguucuuuucca

SEQ ID NO: 518229 - RNA, 22 nt, Human
ugcucucucaggccuggcccac

SEQ ID NO: 518230 - RNA, 19 nt, Human
agagccagacagcauagga

SEQ ID NO: 518231 - RNA, 22 nt, Human
uuaccaagcucugcauguuaag

SEQ ID NO: 518232 - RNA, 22 nt, Human
gcugggcagccuggccgcugcc

SEQ ID NO: 518233 - RNA, 22 nt, Human
aucucuggccuuccuuuuccaa

SEQ ID NO: 518234 - RNA, 23 nt, Human
uccagcucccuucaauggcacug

SEQ ID NO: 518235 - RNA, 22 nt, Human
cagggugacugcccuggccacu

SEQ ID NO: 518236 - RNA, 22 nt, Human
augggcugcuucuccagcaccu

SEQ ID NO: 518237 - RNA, 22 nt, Human
ccuggcuuccauauggcacaua

SEQ ID NO: 518238 - RNA, 23 nt, Human
ugcagcucaaagauggguaaaug

SEQ ID NO: 518239 - RNA, 22 nt, Human
uggugcugccaccuccucugcu

SEQ ID NO: 518240 - RNA, 22 nt, Human
aaaucuaggcucauccuggucc

SEQ ID NO: 518241 - RNA, 22 nt, Human
ugggccuggagcccuggagagu

SEQ ID NO: 518242 - RNA, 21 nt, Human
ggcaagaaacacaaucaagua

SEQ ID NO: 518243 - RNA, 21 nt, Human
ugggcacugagggugcugcuc

SEQ ID NO: 518244 - RNA, 22 nt, Human
ccaggcuccccaggaggcccuu

SEQ ID NO: 518245 - RNA, 22 nt, Human
uggcccuguguccugcugccag

SEQ ID NO: 518246 - RNA, 21 nt, Human
guagggacagagaguugguga

SEQ ID NO: 518247 - RNA, 22 nt, Human
ccuuuggguucaaucucggucu

SEQ ID NO: 518248 - RNA, 20 nt, Human
caggaugauuggacacgaug

SEQ ID NO: 518249 - RNA, 22 nt, Human
aucucuggguccauagaagaga

SEQ ID NO: 518250 - RNA, 23 nt, Human
ucagagaaguuguaggcugggga

SEQ ID NO: 518251 - RNA, 19 nt, Human
agcaggccacagggccagc

SEQ ID NO: 518252 - RNA, 22 nt, Human
cugccucaugcugccugcagcc

SEQ ID NO: 518253 - RNA, 22 nt, Human
auggcagaccuccuggccacaa

SEQ ID NO: 518254 - RNA, 22 nt, Human
aggcuggaguacaguggcuauu

SEQ ID NO: 518255 - RNA, 22 nt, Human
agagccagagaccuggguucac

SEQ ID NO: 518256 - RNA, 22 nt, Human
ucucuggcccuguuuucuaucu

SEQ ID NO: 518257 - RNA, 22 nt, Human
uuucuaagugugauuuuagauu

SEQ ID NO: 518258 - RNA, 22 nt, Human
gcagaaggucuggcacuucagg

SEQ ID NO: 518259 - RNA, 22 nt, Human
ccucccugcgcuccugcggcgg

SEQ ID NO: 518260 - RNA, 22 nt, Human
ccaggucuuggcccccggaccu

SEQ ID NO: 518261 - RNA, 22 nt, Human
gcuggguuuccagcaggcagga

SEQ ID NO: 518262 - RNA, 22 nt, Human
ucuucuuuuugucccacagaau

SEQ ID NO: 518263 - RNA, 22 nt, Human
ggaggaugagcuacgaggagcu

SEQ ID NO: 518264 - RNA, 22 nt, Human
uuuacuguucaacuugcaagua

SEQ ID NO: 518265 - RNA, 22 nt, Human
acacagaagcuuuuucuauucc

SEQ ID NO: 518266 - RNA, 22 nt, Human
cuucagcagaugcaaaaccccu

SEQ ID NO: 518267 - RNA, 22 nt, Human
cuggagccagccagggcccucu

SEQ ID NO: 518268 - RNA, 22 nt, Human
acuggggaguugaagcacuuuc

SEQ ID NO: 518269 - RNA, 22 nt, Human
ucccauggucuauauagaggca

SEQ ID NO: 518270 - RNA, 22 nt, Human
gcccagucucuucuggcccugu

SEQ ID NO: 518271 - RNA, 22 nt, Human
uggcagcuccggguaggggcug

SEQ ID NO: 518272 - RNA, 22 nt, Human
uucugagccucauucaugaggc

SEQ ID NO: 518273 - RNA, 20 nt, Human
aggagaugauccagagucag

SEQ ID NO: 518274 - RNA, 22 nt, Human
ucacauguguuuucucaccaac

SEQ ID NO: 518275 - RNA, 22 nt, Human
uuuuauguaauccuuacugucg

SEQ ID NO: 518276 - RNA, 22 nt, Human
gccuaauaacuagcuguguaac

SEQ ID NO: 518277 - RNA, 22 nt, Human
agucagcagugaaagcacagcc

SEQ ID NO: 518278 - RNA, 22 nt, Human
ccccagccagcaggaccucuga

SEQ ID NO: 518279 - RNA, 22 nt, Human
ugagaaugaaucuuuugcuuuc

SEQ ID NO: 518280 - RNA, 21 nt, Human
uggcagaguugaguaguuaug

SEQ ID NO: 518281 - RNA, 22 nt, Human
acucagagaaacagcagggugu

SEQ ID NO: 518282 - RNA, 22 nt, Human
ugaccuauuagauuuccuugcc

SEQ ID NO: 518283 - RNA, 22 nt, Human
cuccucaguugucccauggaga

SEQ ID NO: 518284 - RNA, 22 nt, Human
uuuaucuuuggaucuucagaaa

SEQ ID NO: 518285 - RNA, 22 nt, Human
cuugagcuaggaaggcugaggc

SEQ ID NO: 518286 - RNA, 22 nt, Human
acuguucauccuuuuugaacaa

SEQ ID NO: 518287 - RNA, 20 nt, Human
ggagagcagggaagacagua

SEQ ID NO: 518288 - RNA, 22 nt, Human
auucuacaaucauguagauccu

SEQ ID NO: 518289 - RNA, 22 nt, Human
gagaaccucuccacaagucugg

SEQ ID NO: 518290 - RNA, 22 nt, Human
ugggggacugcacuggcgucag

SEQ ID NO: 518291 - RNA, 22 nt, Human
uaauguguugaauauuuguaca

SEQ ID NO: 518292 - RNA, 22 nt, Human
gccuguuucuccuccuuggccc

SEQ ID NO: 518293 - RNA, 22 nt, Human
caagagcuagacuuugucagga

SEQ ID NO: 518294 - RNA, 22 nt, Human
auaucuuuguuuuugccaagau

SEQ ID NO: 518295 - RNA, 22 nt, Human
cccaccccuggacaggugagug

SEQ ID NO: 518296 - RNA, 22 nt, Human
cuggcccuggagggcugugcga

SEQ ID NO: 518297 - RNA, 22 nt, Human
agagcuggccagggaucacucu

SEQ ID NO: 518298 - RNA, 22 nt, Human
gcuccuggguguggcugccccu

SEQ ID NO: 518299 - RNA, 22 nt, Human
gaaagcacaguucugaccaugu

SEQ ID NO: 518300 - RNA, 22 nt, Human
guuuacaaauauuuuaaauggu

SEQ ID NO: 518301 - RNA, 22 nt, Human
agcagcaggagccgugggguga

SEQ ID NO: 518302 - RNA, 22 nt, Human
ggccagggccaaggcuuuccca

SEQ ID NO: 518303 - RNA, 19 nt, Human
ucauuguugguuugucggg

SEQ ID NO: 518304 - RNA, 22 nt, Human
gcaguuuuauuaugauggaaau

SEQ ID NO: 518305 - RNA, 22 nt, Human
aguggcagccgagcaggagaug

SEQ ID NO: 518306 - RNA, 23 nt, Human
uggcccugaaucuguccuggagg

SEQ ID NO: 518307 - RNA, 22 nt, Human
ucacauacugaaaguccaguga

SEQ ID NO: 518308 - RNA, 22 nt, Human
aagggcugagaaguggggcugg

SEQ ID NO: 518309 - RNA, 22 nt, Human
gagagucuaggaaccucauaua

SEQ ID NO: 518310 - RNA, 22 nt, Human
uguguucaugucacuggaaucc

SEQ ID NO: 518311 - RNA, 18 nt, Human
gggcucacacaggucauc

SEQ ID NO: 518312 - RNA, 22 nt, Human
uuauaaagauuguuauguaucu

SEQ ID NO: 518313 - RNA, 22 nt, Human
cuagucacgucuuucaguuacc

SEQ ID NO: 518314 - RNA, 22 nt, Human
uggccugggccggcagauauac

SEQ ID NO: 518315 - RNA, 22 nt, Human
ggugcuggacacguggcacucc

SEQ ID NO: 518316 - RNA, 22 nt, Human
guuauguaaucuaacacucagu

SEQ ID NO: 518317 - RNA, 23 nt, Human
gcugaauguaauguucuuugggu

SEQ ID NO: 518318 - RNA, 22 nt, Human
cugaggcacugguaaugggcau

SEQ ID NO: 518319 - RNA, 22 nt, Human
ggcagcucacugauuagcaauu

SEQ ID NO: 518320 - RNA, 22 nt, Human
uggguccuggcuuugucagggu

SEQ ID NO: 518321 - RNA, 22 nt, Human
gacagcuuagugaaaauguaaa

SEQ ID NO: 518322 - RNA, 22 nt, Human
auaugucgcuacaucauuagau

SEQ ID NO: 518323 - RNA, 22 nt, Human
uucagagagaccaaguggcgug

SEQ ID NO: 518324 - RNA, 22 nt, Human
ugucugggagggacagggcuac

SEQ ID NO: 518325 - RNA, 22 nt, Human
ugcagaagauggucugagcacc

SEQ ID NO: 518326 - RNA, 22 nt, Human
acccgggaggcaggagucauag

SEQ ID NO: 518327 - RNA, 22 nt, Human
uuccgcuggggccgccuggcgg

SEQ ID NO: 518328 - RNA, 22 nt, Human
aacaucagaauauccauguugg

SEQ ID NO: 518329 - RNA, 22 nt, Human
ugggccugugaugcugggcuau

SEQ ID NO: 518330 - RNA, 22 nt, Human
aauggccagcaacaggagugaa

SEQ ID NO: 518331 - RNA, 22 nt, Human
gcagcugagcgugaggaagagu

SEQ ID NO: 518332 - RNA, 22 nt, Human
ugccuugcagguuuuaaauaca

SEQ ID NO: 518333 - RNA, 22 nt, Human
auaugauuccacuauuguaugg

SEQ ID NO: 518334 - RNA, 22 nt, Human
gagcugccugaacaagcagcag

SEQ ID NO: 518335 - RNA, 22 nt, Human
gcagcuuuguaaaguaugaagc

SEQ ID NO: 518336 - RNA, 22 nt, Human
gagguggauguugcagugagcu

SEQ ID NO: 518337 - RNA, 23 nt, Human
guaaaauacgcagugcaguguga

SEQ ID NO: 518338 - RNA, 21 nt, Human
cccuugccugcacuccucggc

SEQ ID NO: 518339 - RNA, 22 nt, Human
uuugggaaacuuaggggucaga

SEQ ID NO: 518340 - RNA, 22 nt, Human
ugucucugggugauucaguccu

SEQ ID NO: 518341 - RNA, 22 nt, Human
ugcuuuuaagaacaaugcugcu

SEQ ID NO: 518342 - RNA, 22 nt, Human
cagcuucugcucauggaggggu

SEQ ID NO: 518343 - RNA, 22 nt, Human
cuguaaauaugaagaauauaug

SEQ ID NO: 518344 - RNA, 22 nt, Human
ugugugaggacucagugaaaca

SEQ ID NO: 518345 - RNA, 22 nt, Human
ugugggaagauguugcaggaga

SEQ ID NO: 518346 - RNA, 22 nt, Human
acucugggcccacccucagagu

SEQ ID NO: 518347 - RNA, 22 nt, Human
uggcucugggcaccguguccac

SEQ ID NO: 518348 - RNA, 20 nt, Human
ucccaggcugggcuccagcu

SEQ ID NO: 518349 - RNA, 22 nt, Human
agugccaggagcaaggagcucc

SEQ ID NO: 518350 - RNA, 22 nt, Human
agguggagugugcagggagagc

SEQ ID NO: 518351 - RNA, 22 nt, Human
uucucaugaaacucgcuuccuc

SEQ ID NO: 518352 - RNA, 22 nt, Human
cugcugagcccuggcacaggug

SEQ ID NO: 518353 - RNA, 22 nt, Human
gagagaaagccccugcaucccu

SEQ ID NO: 518354 - RNA, 22 nt, Human
uggcugccgacuggcucuuggc

SEQ ID NO: 518355 - RNA, 21 nt, Human
uuggaauuugggagcuaugug

SEQ ID NO: 518356 - RNA, 22 nt, Human
caccuucagaaugcuccaggca

SEQ ID NO: 518357 - RNA, 22 nt, Human
ucauuugugugagugauuugac

SEQ ID NO: 518358 - RNA, 22 nt, Human
uuccugguaguaagacaucugg

SEQ ID NO: 518359 - RNA, 22 nt, Human
aggaaaaaagucugugauuaua

SEQ ID NO: 518360 - RNA, 22 nt, Human
uggggaaacuauuuccuugucc

SEQ ID NO: 518361 - RNA, 22 nt, Human
aggcauggauguagcagugacc

SEQ ID NO: 518362 - RNA, 22 nt, Human
uccauuuucuaaguaucacuua

SEQ ID NO: 518363 - RNA, 22 nt, Human
cuggcccugccuaauguacuug

SEQ ID NO: 518364 - RNA, 22 nt, Human
gccacagggcgagcggaggcca

SEQ ID NO: 518365 - RNA, 20 nt, Human
ucagguagaucuuugagguc

SEQ ID NO: 518366 - RNA, 22 nt, Human
acauucaaaaagcaucugucac

SEQ ID NO: 518367 - RNA, 22 nt, Human
uuaauuaaauucaugagcauug

SEQ ID NO: 518368 - RNA, 22 nt, Human
gggaaacugcaacucagagagg

SEQ ID NO: 518369 - RNA, 22 nt, Human
augggaggcaggcucagaaccg

SEQ ID NO: 518370 - RNA, 22 nt, Human
aucagaagcuuguagucucucu

SEQ ID NO: 518371 - RNA, 22 nt, Human
gagaggccaccugacgagcagu

SEQ ID NO: 518372 - RNA, 22 nt, Human
ucaggauggcuucugcaucaaa

SEQ ID NO: 518373 - RNA, 22 nt, Human
aagugaagaaauacaugagaau

SEQ ID NO: 518374 - RNA, 22 nt, Human
ccugggcucaggcuugggcagc

SEQ ID NO: 518375 - RNA, 22 nt, Human
ugaggauggggagauggugucu

SEQ ID NO: 518376 - RNA, 22 nt, Human
ggagcagggaauuacagcgcag

SEQ ID NO: 518377 - RNA, 22 nt, Human
ggagucccagcaaagccuuccc

SEQ ID NO: 518378 - RNA, 19 nt, Human
ucugccucuggucaggcuc

SEQ ID NO: 518379 - RNA, 19 nt, Human
gcucagagacaccuguugc

SEQ ID NO: 518380 - RNA, 22 nt, Human
uccuaguucucugccagucgcu

SEQ ID NO: 518381 - RNA, 22 nt, Human
gcaaggcugagcacauuugcau

SEQ ID NO: 518382 - RNA, 22 nt, Human
gugucauggaaaauugcaaugg

SEQ ID NO: 518383 - RNA, 22 nt, Human
acugugcuuucucuggaggcau

SEQ ID NO: 518384 - RNA, 22 nt, Human
ucuggcuccugaguccaugcuc

SEQ ID NO: 518385 - RNA, 22 nt, Human
ggcugcugggaauaugccagcu

SEQ ID NO: 518386 - RNA, 22 nt, Human
gcucuggaagcaucugagagga

SEQ ID NO: 518387 - RNA, 22 nt, Human
agcaggugacagggcuguggug

SEQ ID NO: 518388 - RNA, 22 nt, Human
aagauguugggugccuccggaa

SEQ ID NO: 518389 - RNA, 22 nt, Human
ccaguucugacacaagcacagu

SEQ ID NO: 518390 - RNA, 22 nt, Human
ggcccagccucagacaugcccu

SEQ ID NO: 518391 - RNA, 19 nt, Human
ccuguacauuauucucccc

SEQ ID NO: 518392 - RNA, 22 nt, Human
acagacagauuuugucugaugu

SEQ ID NO: 518393 - RNA, 22 nt, Human
agcugccaaguuggaguagcaa

SEQ ID NO: 518394 - RNA, 17 nt, Human
ucaggcugugccuggua

SEQ ID NO: 518395 - RNA, 22 nt, Human
accucccagcucugagcuuggg

SEQ ID NO: 518396 - RNA, 22 nt, Human
auccucgucugcacaucaaagg

SEQ ID NO: 518397 - RNA, 22 nt, Human
gcacagagugggugagaugugg

SEQ ID NO: 518398 - RNA, 22 nt, Human
uuuguacauauauaaaaucugu

SEQ ID NO: 518399 - RNA, 23 nt, Human
ucagugugcaagaauggagaagc

SEQ ID NO: 518400 - RNA, 19 nt, Human
aucugccuguuaucacaua

SEQ ID NO: 518401 - RNA, 22 nt, Human
cuuccucugcggcgccgggcgc

SEQ ID NO: 518402 - RNA, 22 nt, Human
aaggcaggagcuguaucuuauu

SEQ ID NO: 518403 - RNA, 22 nt, Human
caugggagguuggcuuggcaug

SEQ ID NO: 518404 - RNA, 22 nt, Human
caaaugcuggcccugcuacuua

SEQ ID NO: 518405 - RNA, 23 nt, Human
ucccagggaaggugagcgaggcu

SEQ ID NO: 518406 - RNA, 22 nt, Human
caagagcucagaaacccuugcu

SEQ ID NO: 518407 - RNA, 22 nt, Human
uugaagauucuuuuuguuagua

SEQ ID NO: 518408 - RNA, 22 nt, Human
agaacagcagcacgucaagcug

SEQ ID NO: 518409 - RNA, 22 nt, Human
aggcacagcacaccuggccccc

SEQ ID NO: 518410 - RNA, 22 nt, Human
uguggcuguguccaccugcugc

SEQ ID NO: 518411 - RNA, 22 nt, Human
ucagcaggcacaccaaaaacug

SEQ ID NO: 518412 - RNA, 22 nt, Human
gggcagcagcaggaggucucug

SEQ ID NO: 518413 - RNA, 22 nt, Human
uuucagagucuggcugcagccu

SEQ ID NO: 518414 - RNA, 18 nt, Human
ccagcaugccagaggcug

SEQ ID NO: 518415 - RNA, 22 nt, Human
aggguaggaacugaguggaagg

SEQ ID NO: 518416 - RNA, 22 nt, Human
gugcugcagagucucgugccgc

SEQ ID NO: 518417 - RNA, 22 nt, Human
cuucagaaacuaguaacagcua

SEQ ID NO: 518418 - RNA, 22 nt, Human
aggcagggucuugcuauguugc

SEQ ID NO: 518419 - RNA, 22 nt, Human
cugcaggauucucccaguugga

SEQ ID NO: 518420 - RNA, 22 nt, Human
caaagagcuguucagugucgcu

SEQ ID NO: 518421 - RNA, 22 nt, Human
uuccaauuuguggugaguuaau

SEQ ID NO: 518422 - RNA, 22 nt, Human
gccuggagacagcagaggcggc

SEQ ID NO: 518423 - RNA, 22 nt, Human
caggguggggaaauagcgcccu

SEQ ID NO: 518424 - RNA, 22 nt, Human
agcugcugagagucugccgggc

SEQ ID NO: 518425 - RNA, 22 nt, Human
uccuggaguauuucuguggugu

SEQ ID NO: 518426 - RNA, 22 nt, Human
cuaugaccccagcaugaauaag

SEQ ID NO: 518427 - RNA, 22 nt, Human
uuugaaaggaauuaggaugaca

SEQ ID NO: 518428 - RNA, 22 nt, Human
caggccuccacuccacgcagac

SEQ ID NO: 518429 - RNA, 22 nt, Human
aggaaacuggguaugguuauac

SEQ ID NO: 518430 - RNA, 22 nt, Human
ugacagugcaugugacaaagga

SEQ ID NO: 518431 - RNA, 18 nt, Human
uucucugguggauguuau

SEQ ID NO: 518432 - RNA, 22 nt, Human
augaccaguuuccccacugucc

SEQ ID NO: 518433 - RNA, 22 nt, Human
cuggcucccagcuuucagggag

SEQ ID NO: 518434 - RNA, 22 nt, Human
ccucagggaaugggaggcuggg

SEQ ID NO: 518435 - RNA, 22 nt, Human
ggagaucuuuaggaguuggacu

SEQ ID NO: 518436 - RNA, 22 nt, Human
uguauuuucuucuggaagcuua

SEQ ID NO: 518437 - RNA, 22 nt, Human
guaacaaaguuucuaggugcug

SEQ ID NO: 518438 - RNA, 22 nt, Human
ugagaauuuuuugucaugcauu

SEQ ID NO: 518439 - RNA, 22 nt, Human
agccuggagaagauguguauug

SEQ ID NO: 518440 - RNA, 23 nt, Human
gggggcgugucauggagggccac

SEQ ID NO: 518441 - RNA, 22 nt, Human
ucuggcaggcaaucggcucugg

SEQ ID NO: 518442 - RNA, 22 nt, Human
ccugccugguguaagucuaagg

SEQ ID NO: 518443 - RNA, 21 nt, Human
gccagcugcagggcuuccuug

SEQ ID NO: 518444 - RNA, 22 nt, Human
gcaagauguuaacauagggaga

SEQ ID NO: 518445 - RNA, 22 nt, Human
aaugaacaggugaaugucagau

SEQ ID NO: 518446 - RNA, 22 nt, Human
uuucuaaguguguuucauagga

SEQ ID NO: 518447 - RNA, 22 nt, Human
uugcauugauguuccuucuugc

SEQ ID NO: 518448 - RNA, 22 nt, Human
ccacagagcauuagauuucaga

SEQ ID NO: 518449 - RNA, 22 nt, Human
ggaugagguagaugaacaaggg

SEQ ID NO: 518450 - RNA, 22 nt, Human
gugccugguuuggggaguguuc

SEQ ID NO: 518451 - RNA, 22 nt, Human
uagcugcccaucuuuccuuuag

SEQ ID NO: 518452 - RNA, 22 nt, Human
gguucaguuuacauuaaaaucu

SEQ ID NO: 518453 - RNA, 22 nt, Human
acagaaauugggcaaauggaag

SEQ ID NO: 518454 - RNA, 19 nt, Human
ugaagcaggcagagaagau

SEQ ID NO: 518455 - RNA, 22 nt, Human
ggacugggccagggguuggacu

SEQ ID NO: 518456 - RNA, 22 nt, Human
ugucuucaaauauugaaauccu

SEQ ID NO: 518457 - RNA, 22 nt, Human
uaggaaauugacaccugcuuga

SEQ ID NO: 518458 - RNA, 22 nt, Human
gaagaagccucuguggaucuga

SEQ ID NO: 518459 - RNA, 22 nt, Human
acauuucuugaugccucuguga

SEQ ID NO: 518460 - RNA, 22 nt, Human
uccuucaaagcuccuagugagc

SEQ ID NO: 518461 - RNA, 22 nt, Human
ucuuguuucuguauauaaugac

SEQ ID NO: 518462 - RNA, 22 nt, Human
gugcuggcuggacauggagcac

SEQ ID NO: 518463 - RNA, 22 nt, Human
gaagaaagggaauuaacuugag

SEQ ID NO: 518464 - RNA, 22 nt, Human
aggagccaguggaguuccugcc

SEQ ID NO: 518465 - RNA, 20 nt, Human
gcucuuuguaagggaauuug

SEQ ID NO: 518466 - RNA, 22 nt, Human
uugcucagcacuggagccagcu

SEQ ID NO: 518467 - RNA, 22 nt, Human
cuggaggcugaguugggucucc

SEQ ID NO: 518468 - RNA, 22 nt, Human
aaagacacacagccagcaagug

SEQ ID NO: 518469 - RNA, 22 nt, Human
auuuacagaagcauguaauagc

SEQ ID NO: 518470 - RNA, 22 nt, Human
ucuccucugugccacagcuugg

SEQ ID NO: 518471 - RNA, 22 nt, Human
aagcagcugcagguucaaagga

SEQ ID NO: 518472 - RNA, 22 nt, Human
gggugggccugucuggccaugu

SEQ ID NO: 518473 - RNA, 22 nt, Human
accaucagucauugucaguggg

SEQ ID NO: 518474 - RNA, 22 nt, Human
uggggcugucccgguuuggcga

SEQ ID NO: 518475 - RNA, 22 nt, Human
ugagaaaagguugagaugauaa

SEQ ID NO: 518476 - RNA, 22 nt, Human
ugcccugggaacacagaugcca

SEQ ID NO: 518477 - RNA, 22 nt, Human
gaaauagaucucugggaugcaa

SEQ ID NO: 518478 - RNA, 22 nt, Human
cugaaagaauaagauguuuaca

SEQ ID NO: 518479 - RNA, 22 nt, Human
auucagagcacuggguagaauu

SEQ ID NO: 518480 - RNA, 22 nt, Human
caguguggugagauuccaggug

SEQ ID NO: 518481 - RNA, 22 nt, Human
guauuuuucauuccaagugaga

SEQ ID NO: 518482 - RNA, 22 nt, Human
ggcacagcacaguggacccagg

SEQ ID NO: 518483 - RNA, 22 nt, Human
ggugcagaucuuucucuucagg

SEQ ID NO: 518484 - RNA, 22 nt, Human
cagcuuauucaguaagcacaua

SEQ ID NO: 518485 - RNA, 22 nt, Human
auuucugauaaacguaagcugc

SEQ ID NO: 518486 - RNA, 22 nt, Human
uaugaagauauaucugaucucu

SEQ ID NO: 518487 - RNA, 22 nt, Human
gggcacugugcuaggugcugag

SEQ ID NO: 518488 - RNA, 20 nt, Human
gggaugagaguccuagcucu

SEQ ID NO: 518489 - RNA, 22 nt, Human
ggcgcuggccacgguggcucug

SEQ ID NO: 518490 - RNA, 22 nt, Human
gcccuucauuuauaguuggaau

SEQ ID NO: 518491 - RNA, 21 nt, Human
gggaucugaggcaagucuccu

SEQ ID NO: 518492 - RNA, 19 nt, Human
uggcagcauugguaccuug

SEQ ID NO: 518493 - RNA, 22 nt, Human
cagagccucagaauccugugga

SEQ ID NO: 518494 - RNA, 22 nt, Human
cauuucagugucuugugaugaa

SEQ ID NO: 518495 - RNA, 22 nt, Human
guggcugcagcccagcggcacg

SEQ ID NO: 518496 - RNA, 19 nt, Human
ucucaauguucagaaagcu

SEQ ID NO: 518497 - RNA, 22 nt, Human
uuggcauugaaguuucauuggu

SEQ ID NO: 518498 - RNA, 22 nt, Human
ugcugcucuguaaagugaugag

SEQ ID NO: 518499 - RNA, 22 nt, Human
ucucaggacuuugggaagcuca

SEQ ID NO: 518500 - RNA, 20 nt, Human
ugagaaaguagagacucagg

SEQ ID NO: 518501 - RNA, 22 nt, Human
aacaugaaaguugcuaagugca

SEQ ID NO: 518502 - RNA, 22 nt, Human
acagcaaucugagagacauagu

SEQ ID NO: 518503 - RNA, 22 nt, Human
caugggcuuuggaggcuggagg

SEQ ID NO: 518504 - RNA, 22 nt, Human
cagccaagaaagcagugcucca

SEQ ID NO: 518505 - RNA, 22 nt, Human
uauuucacauaccacagagugu

SEQ ID NO: 518506 - RNA, 22 nt, Human
uccuuaaaugugaucuagauuu

SEQ ID NO: 518507 - RNA, 21 nt, Human
uccuugcuauuuuccucagcu

SEQ ID NO: 518508 - RNA, 22 nt, Human
gugugccaccacugacaggauu

SEQ ID NO: 518509 - RNA, 22 nt, Human
uccuggugccuggagcucucca

SEQ ID NO: 518510 - RNA, 22 nt, Human
cugaggccagcugcagagcucu

SEQ ID NO: 518511 - RNA, 22 nt, Human
agcaccaucacagcuguauguc

SEQ ID NO: 518512 - RNA, 22 nt, Human
agccuucauaaucuugggcuuu

SEQ ID NO: 518513 - RNA, 22 nt, Human
ucuacuguagugaugcugcagu

SEQ ID NO: 518514 - RNA, 22 nt, Human
ggagucugcggcagacacugua

SEQ ID NO: 518515 - RNA, 22 nt, Human
gagguacagaguguuccaaugu

SEQ ID NO: 518516 - RNA, 22 nt, Human
cacuguacccauuuaaauaaau

SEQ ID NO: 518517 - RNA, 22 nt, Human
caggcacugugcaagggucucg

SEQ ID NO: 518518 - RNA, 19 nt, Human
uggaaaauggauugaauca

SEQ ID NO: 518519 - RNA, 22 nt, Human
uguuaaauugauucaccuuucu

SEQ ID NO: 518520 - RNA, 21 nt, Human
ggccuuggcgggggccgaauu

SEQ ID NO: 518521 - RNA, 22 nt, Human
auuugcuugacuauggcuugca

SEQ ID NO: 518522 - RNA, 22 nt, Human
gggaaggcaggccucuguugga

SEQ ID NO: 518523 - RNA, 22 nt, Human
gucaggauuuacaaacuucagu

SEQ ID NO: 518524 - RNA, 20 nt, Human
ugcagggcucugcuucucuc

SEQ ID NO: 518525 - RNA, 22 nt, Human
cuggagagauccuccugaaaaa

SEQ ID NO: 518526 - RNA, 22 nt, Human
ccuuugggguccugccugggcu

SEQ ID NO: 518527 - RNA, 22 nt, Human
aaaguucaugguguuauagaaa

SEQ ID NO: 518528 - RNA, 22 nt, Human
cccacacacauuuaugauagga

SEQ ID NO: 518529 - RNA, 23 nt, Human
uggccagguagaggagguaguga

SEQ ID NO: 518530 - RNA, 22 nt, Human
gcauccaaaccauucaucagcc

SEQ ID NO: 518531 - RNA, 22 nt, Human
uaaggccaaggggccauagucu

SEQ ID NO: 518532 - RNA, 22 nt, Human
acagugcauuauugcugaaugc

SEQ ID NO: 518533 - RNA, 22 nt, Human
caguggguaggaaaggcucuuc

SEQ ID NO: 518534 - RNA, 22 nt, Human
agggccuggaacugugggcagg

SEQ ID NO: 518535 - RNA, 20 nt, Human
ccagagcugauggcugcccg

SEQ ID NO: 518536 - RNA, 22 nt, Human
guggagacgggacagaagcuaa

SEQ ID NO: 518537 - RNA, 22 nt, Human
ccucugugggccgggccugcug

SEQ ID NO: 518538 - RNA, 22 nt, Human
uagagcuggaauuugcagcaag

SEQ ID NO: 518539 - RNA, 22 nt, Human
gaaggccacaaaaaaugucaua

SEQ ID NO: 518540 - RNA, 22 nt, Human
cuucaguuagccaauucagguc

SEQ ID NO: 518541 - RNA, 22 nt, Human
gggcagcagagcccugccgagu

SEQ ID NO: 518542 - RNA, 22 nt, Human
uaugagaagguauggugacuug

SEQ ID NO: 518543 - RNA, 22 nt, Human
uagacacaucaaguauaguuaa

SEQ ID NO: 518544 - RNA, 22 nt, Human
uucuggagcuaaaguccacucu

SEQ ID NO: 518545 - RNA, 22 nt, Human
agugcagagaccuggucaggca

SEQ ID NO: 518546 - RNA, 20 nt, Human
cagcugccuggcucugggau

SEQ ID NO: 518547 - RNA, 22 nt, Human
gagcaggucuuucauggugcau

SEQ ID NO: 518548 - RNA, 22 nt, Human
aaguuacaggagaaagagauca

SEQ ID NO: 518549 - RNA, 22 nt, Human
agaaacugaauuauuucugagg

SEQ ID NO: 518550 - RNA, 22 nt, Human
cuggacucauccauagagguga

SEQ ID NO: 518551 - RNA, 22 nt, Human
uggacaggaucugagacugaga

SEQ ID NO: 518552 - RNA, 22 nt, Human
uacaaaugaaccaacuuugaug

SEQ ID NO: 518553 - RNA, 22 nt, Human
agcccaggucuggcccagccug

SEQ ID NO: 518554 - RNA, 22 nt, Human
guucagggagggacagaugaag

SEQ ID NO: 518555 - RNA, 22 nt, Human
aggagaggcucuaacucugugu

SEQ ID NO: 518556 - RNA, 22 nt, Human
aaggaggccuggcagaugaaga

SEQ ID NO: 518557 - RNA, 22 nt, Human
ucuccucugcgcggcagugccc

SEQ ID NO: 518558 - RNA, 22 nt, Human
cuuuuacauuuguugaagagua

SEQ ID NO: 518559 - RNA, 22 nt, Human
ucacauacacuaggauauuuuu

SEQ ID NO: 518560 - RNA, 22 nt, Human
guccagccacccuggaggcacg

SEQ ID NO: 518561 - RNA, 22 nt, Human
gucauucagagaugcagguaga

SEQ ID NO: 518562 - RNA, 22 nt, Human
ccaggcuuuuagcugcauggca

SEQ ID NO: 518563 - RNA, 22 nt, Human
ggauggcaggacaaggacccag

SEQ ID NO: 518564 - RNA, 22 nt, Human
uccacuuuagcaaugauugaau

SEQ ID NO: 518565 - RNA, 22 nt, Human
ucccugggcaucacguugcuuc

SEQ ID NO: 518566 - RNA, 22 nt, Human
ggcugaggguuaagaucagaca

SEQ ID NO: 518567 - RNA, 22 nt, Human
aucagcugaaaaacaggcagca

SEQ ID NO: 518568 - RNA, 22 nt, Human
uggcucuggagcuccugggccc

SEQ ID NO: 518569 - RNA, 22 nt, Human
acagaggccucggccugcccag

SEQ ID NO: 518570 - RNA, 22 nt, Human
ccugaagcaaggguaggcaggu

SEQ ID NO: 518571 - RNA, 22 nt, Human
aagagcaaguggguagugaagc

SEQ ID NO: 518572 - RNA, 22 nt, Human
uuuguucaugccuauauucuca

SEQ ID NO: 518573 - RNA, 22 nt, Human
uaaauguguaaaccuccauuac

SEQ ID NO: 518574 - RNA, 22 nt, Human
ccaggcauccauugcuuccucu

SEQ ID NO: 518575 - RNA, 22 nt, Human
uggcucaguuaggucagaaaca

SEQ ID NO: 518576 - RNA, 22 nt, Human
guccaagucuuccuucccaaac

SEQ ID NO: 518577 - RNA, 22 nt, Human
agucauauguggcauuuucuaa

SEQ ID NO: 518578 - RNA, 22 nt, Human
ugcugaaagaccguauuuaucu

SEQ ID NO: 518579 - RNA, 22 nt, Human
gcuggauuggagcaauagaguc

SEQ ID NO: 518580 - RNA, 22 nt, Human
agaaggcagaugggacggagca

SEQ ID NO: 518581 - RNA, 22 nt, Human
acuggggagagucaugccagca

SEQ ID NO: 518582 - RNA, 22 nt, Human
cuacagacccaccuuggaagaa

SEQ ID NO: 518583 - RNA, 21 nt, Human
agccugcaauguagguaccgg

SEQ ID NO: 518584 - RNA, 22 nt, Human
ugcuucugggccugguguuccc

SEQ ID NO: 518585 - RNA, 22 nt, Human
ugugaauggacaauuaaaucua

SEQ ID NO: 518586 - RNA, 22 nt, Human
ucugucugccuugugagggcac

SEQ ID NO: 518587 - RNA, 21 nt, Human
gcagaaguggcuacaucucca

SEQ ID NO: 518588 - RNA, 22 nt, Human
ggaccuuccuggcuccuggggu

SEQ ID NO: 518589 - RNA, 22 nt, Human
caggcagcccugcaccaagugu

SEQ ID NO: 518590 - RNA, 22 nt, Human
gauuuccuaauguggaucucug

SEQ ID NO: 518591 - RNA, 22 nt, Human
acaaggcugaacagugaagccg

SEQ ID NO: 518592 - RNA, 22 nt, Human
ucaagucuggagaucuggaacu

SEQ ID NO: 518593 - RNA, 22 nt, Human
aggcugcuggcaggcguggacg

SEQ ID NO: 518594 - RNA, 22 nt, Human
ugaggcagugugagauaauaaa

SEQ ID NO: 518595 - RNA, 22 nt, Human
cccaggcagugcugaucccuca

SEQ ID NO: 518596 - RNA, 22 nt, Human
gagguccacugaggcaacaggg

SEQ ID NO: 518597 - RNA, 22 nt, Human
ugugcacaggaagcuauucucu

SEQ ID NO: 518598 - RNA, 19 nt, Human
agucucaguguacagaggc

SEQ ID NO: 518599 - RNA, 22 nt, Human
cuggggaggcagggcugccccu

SEQ ID NO: 518600 - RNA, 22 nt, Human
caaugucaugauuuuccauuag

SEQ ID NO: 518601 - RNA, 22 nt, Human
cagagguuaccuagagcaagaa

SEQ ID NO: 518602 - RNA, 22 nt, Human
gauuugugcucauuuuccauua

SEQ ID NO: 518603 - RNA, 22 nt, Human
acucuggcugccuugugagcau

SEQ ID NO: 518604 - RNA, 22 nt, Human
auucugucuuuuuaaaauaaua

SEQ ID NO: 518605 - RNA, 22 nt, Human
aggagagucuugagucacuggu

SEQ ID NO: 518606 - RNA, 22 nt, Human
uucccagaggagauuugcuuau

SEQ ID NO: 518607 - RNA, 22 nt, Human
uacuaaaugauuaagcaggaau

SEQ ID NO: 518608 - RNA, 22 nt, Human
cugggcagaauuuuaggauggc

SEQ ID NO: 518609 - RNA, 22 nt, Human
uggagaaucuggaaacuguuga

SEQ ID NO: 518610 - RNA, 22 nt, Human
cuugaaagcuuugcgucuucua

SEQ ID NO: 518611 - RNA, 22 nt, Human
cugugcugaacaauucugcauu

SEQ ID NO: 518612 - RNA, 22 nt, Human
ucaggcccuucucccaggacuc

SEQ ID NO: 518613 - RNA, 22 nt, Human
uuuugugacacuucuugagaca

SEQ ID NO: 518614 - RNA, 22 nt, Human
gagaagccgagucagcugagcc

SEQ ID NO: 518615 - RNA, 22 nt, Human
uggguccucgucuuccaaggca

SEQ ID NO: 518616 - RNA, 22 nt, Human
uggcucagcuuacuuuugaggg

SEQ ID NO: 518617 - RNA, 22 nt, Human
uguuuuaagcucuagaagggga

SEQ ID NO: 518618 - RNA, 22 nt, Human
ccaguguuugaugggauuuuca

SEQ ID NO: 518619 - RNA, 22 nt, Human
gaggcagcuuaggguacugacu

SEQ ID NO: 518620 - RNA, 22 nt, Human
caagauggguguugugaugguu

SEQ ID NO: 518621 - RNA, 22 nt, Human
gcuccugggcucuaccuugcua

SEQ ID NO: 518622 - RNA, 22 nt, Human
uauguacaucuugagcaaugaa

SEQ ID NO: 518623 - RNA, 22 nt, Human
cacugugucaguuugguuagac

SEQ ID NO: 518624 - RNA, 22 nt, Human
auauuuguaguggguaagaagu

SEQ ID NO: 518625 - RNA, 22 nt, Human
aguuuucuuucgcaaagguaca

SEQ ID NO: 518626 - RNA, 22 nt, Human
cauugcucaggcccagcaggaa

SEQ ID NO: 518627 - RNA, 22 nt, Human
auuaaauuaaguggcuaauuua

SEQ ID NO: 518628 - RNA, 22 nt, Human
uucuaucauacuugaauacauu

SEQ ID NO: 518629 - RNA, 22 nt, Human
uuuauuguuguuagucauaagu

SEQ ID NO: 518630 - RNA, 23 nt, Human
cccuggaguaaauucuuggaagg

SEQ ID NO: 518631 - RNA, 22 nt, Human
caagccuuggaaauccauucug

SEQ ID NO: 518632 - RNA, 22 nt, Human
ucugccaggcuuggugcuagau

SEQ ID NO: 518633 - RNA, 22 nt, Human
gggcguggauggucagugcagg

SEQ ID NO: 518634 - RNA, 22 nt, Human
uggcagaggaaaaagucacugg

SEQ ID NO: 518635 - RNA, 22 nt, Human
aaacagcugcaguacacggccu

SEQ ID NO: 518636 - RNA, 22 nt, Human
cuuucacauaauugaccuugaa

SEQ ID NO: 518637 - RNA, 22 nt, Human
augaggcauauccuccuauggu

SEQ ID NO: 518638 - RNA, 22 nt, Human
agucuccacuugacaucagcag

SEQ ID NO: 518639 - RNA, 22 nt, Human
aaauggcuacaagaugugcucu

SEQ ID NO: 518640 - RNA, 22 nt, Human
agucccagugacuuggccagaa

SEQ ID NO: 518641 - RNA, 22 nt, Human
agccugagcugccugccgccuc

SEQ ID NO: 518642 - RNA, 22 nt, Human
gagcagcucaggcacuuagcca

SEQ ID NO: 518643 - RNA, 22 nt, Human
gaagcacugccauaauucagac

SEQ ID NO: 518644 - RNA, 20 nt, Human
auguaaaauuauaaggcuga

SEQ ID NO: 518645 - RNA, 22 nt, Human
cgccggcuugaggcaggcggca

SEQ ID NO: 518646 - RNA, 22 nt, Human
uacacagacucuucaauucaga

SEQ ID NO: 518647 - RNA, 22 nt, Human
gcagcagagaccccaggaagga

SEQ ID NO: 518648 - RNA, 22 nt, Human
agauggagaccuuggaugaacu

SEQ ID NO: 518649 - RNA, 22 nt, Human
gagccugagugcugccuccccu

SEQ ID NO: 518650 - RNA, 22 nt, Human
uuuagagacccucugcuauuuu

SEQ ID NO: 518651 - RNA, 22 nt, Human
aagggcuccaagagguagcugg

SEQ ID NO: 518652 - RNA, 22 nt, Human
aaaggauuaaauaaaugugcug

SEQ ID NO: 518653 - RNA, 23 nt, Human
ggcuggcccggggcugcuccuga

SEQ ID NO: 518654 - RNA, 22 nt, Human
acuucauuguaauauuauagca

SEQ ID NO: 518655 - RNA, 22 nt, Human
ugugcugacaagaucagaaggu

SEQ ID NO: 518656 - RNA, 22 nt, Human
gucagugucuuaacagagauua

SEQ ID NO: 518657 - RNA, 22 nt, Human
uugcugaaguaugaaaaagaca

SEQ ID NO: 518658 - RNA, 22 nt, Human
gccgagcacagugcagcugccu

SEQ ID NO: 518659 - RNA, 22 nt, Human
gcagggugaaggucacauagaa

SEQ ID NO: 518660 - RNA, 22 nt, Human
aguggccagugcugcucugggg

SEQ ID NO: 518661 - RNA, 22 nt, Human
cauucauuuacuuucaacagcu

SEQ ID NO: 518662 - RNA, 22 nt, Human
ccuugcaggggaacaggcagug

SEQ ID NO: 518663 - RNA, 22 nt, Human
acagggcccuugccagcacaag

SEQ ID NO: 518664 - RNA, 22 nt, Human
uccuguuuaucugugugacucg

SEQ ID NO: 518665 - RNA, 22 nt, Human
cagguuuagguggacgugcagg

SEQ ID NO: 518666 - RNA, 22 nt, Human
guuccugaagggacuggugcag

SEQ ID NO: 518667 - RNA, 22 nt, Human
gggcugugcugaguaggaggug

SEQ ID NO: 518668 - RNA, 19 nt, Human
aucagcaagguaggaugug

SEQ ID NO: 518669 - RNA, 22 nt, Human
cugccucucagccugaccgcca

SEQ ID NO: 518670 - RNA, 22 nt, Human
ucacuagucgcggggggaggua

SEQ ID NO: 518671 - RNA, 22 nt, Human
guucacaaaguacuguaugcau

SEQ ID NO: 518672 - RNA, 22 nt, Human
uacauguaauuuucauaguaag

SEQ ID NO: 518673 - RNA, 22 nt, Human
gauuuucauuugcacucuagaa

SEQ ID NO: 518674 - RNA, 22 nt, Human
uccuagaauagugugucuggag

SEQ ID NO: 518675 - RNA, 22 nt, Human
accaggcuggagugcaguggcg

SEQ ID NO: 518676 - RNA, 20 nt, Human
gcagccucaacaggcacagc

SEQ ID NO: 518677 - RNA, 22 nt, Human
gaggcacucucgacaagggugg

SEQ ID NO: 518678 - RNA, 22 nt, Human
cacacacuguuaauguaggagu

SEQ ID NO: 518679 - RNA, 22 nt, Human
ggcaggaggugaguggcgggug

SEQ ID NO: 518680 - RNA, 20 nt, Human
cugggcugcccagcuauggg

SEQ ID NO: 518681 - RNA, 22 nt, Human
auuguugaggcaguucaucuug

SEQ ID NO: 518682 - RNA, 22 nt, Human
uggcucagugacauuccuccca

SEQ ID NO: 518683 - RNA, 22 nt, Human
uccugagcugacacuuggggag

SEQ ID NO: 518684 - RNA, 22 nt, Human
cugucucucuaggacacugggg

SEQ ID NO: 518685 - RNA, 22 nt, Human
aggcccagcuugaagugggaag

SEQ ID NO: 518686 - RNA, 18 nt, Human
uagggcucuagggaguga

SEQ ID NO: 518687 - RNA, 22 nt, Human
accaggggugucaacagcauuu

SEQ ID NO: 518688 - RNA, 22 nt, Human
cugcuuuggcucagugacauca

SEQ ID NO: 518689 - RNA, 16 nt, Human
aggcagagauuuaccc

SEQ ID NO: 518690 - RNA, 21 nt, Human
aaggagccuaggaggcucagg

SEQ ID NO: 518691 - RNA, 22 nt, Human
acauuugucuucuuucagauua

SEQ ID NO: 518692 - RNA, 22 nt, Human
gccuaggagacaagcgugaaag

SEQ ID NO: 518693 - RNA, 22 nt, Human
caguugaugggacucauguggg

SEQ ID NO: 518694 - RNA, 22 nt, Human
gauuucuucauucauuagaugg

SEQ ID NO: 518695 - RNA, 22 nt, Human
ugcacaaagcauucuagacgca

SEQ ID NO: 518696 - RNA, 22 nt, Human
gacagacacaauugauccauga

SEQ ID NO: 518697 - RNA, 22 nt, Human
cuggggcauugggagaggccug

SEQ ID NO: 518698 - RNA, 22 nt, Human
uucucuggagaguaucuucuua

SEQ ID NO: 518699 - RNA, 22 nt, Human
uaaggccaaacuauuauaguuc

SEQ ID NO: 518700 - RNA, 18 nt, Human
gcccugguggagcuggug

SEQ ID NO: 518701 - RNA, 22 nt, Human
aucuguguccuuauaagagaca

SEQ ID NO: 518702 - RNA, 22 nt, Human
guggcuucugcggugugcgcag

SEQ ID NO: 518703 - RNA, 20 nt, Human
ucucuggguucucacucagc

SEQ ID NO: 518704 - RNA, 22 nt, Human
aaucuucacagagaaaauuagg

SEQ ID NO: 518705 - RNA, 21 nt, Human
ucucugggcccuccugugggg

SEQ ID NO: 518706 - RNA, 22 nt, Human
cugagucucccggcaguggagg

SEQ ID NO: 518707 - RNA, 18 nt, Human
auccugggagcagacagc

SEQ ID NO: 518708 - RNA, 22 nt, Human
agcagcauuaagggaacugcag

SEQ ID NO: 518709 - RNA, 22 nt, Human
cuuuuacacucaucugggaggg

SEQ ID NO: 518710 - RNA, 22 nt, Human
uaaggcaccuguccaggcuggg

SEQ ID NO: 518711 - RNA, 20 nt, Human
cacaagagaauacacacugg

SEQ ID NO: 518712 - RNA, 22 nt, Human
ucucaguguguuuucucucaga

SEQ ID NO: 518713 - RNA, 22 nt, Human
aggccucagccugccaggccug

SEQ ID NO: 518714 - RNA, 22 nt, Human
cagugcuccugauguacccuug

SEQ ID NO: 518715 - RNA, 22 nt, Human
gcacccagggacuuggcuggcc

SEQ ID NO: 518716 - RNA, 22 nt, Human
agccacagcgaaccucucuucc

SEQ ID NO: 518717 - RNA, 22 nt, Human
cuggccuucagacucggacuga

SEQ ID NO: 518718 - RNA, 22 nt, Human
cacucccuucaggagccuagga

SEQ ID NO: 518719 - RNA, 22 nt, Human
aagacccuauacucagugaccc

SEQ ID NO: 518720 - RNA, 22 nt, Human
cugaggugcuagggucccugcu

SEQ ID NO: 518721 - RNA, 19 nt, Human
ggcccaaguacugagugcc

SEQ ID NO: 518722 - RNA, 23 nt, Human
uuuuccuuuggacaggcuguauu

SEQ ID NO: 518723 - RNA, 17 nt, Human
aggaaacauuuucuuuc

SEQ ID NO: 518724 - RNA, 22 nt, Human
acaggcuuuuuuagaaugacau

SEQ ID NO: 518725 - RNA, 22 nt, Human
acagcucauuuguaaaacggag

SEQ ID NO: 518726 - RNA, 22 nt, Human
auucugaugccuggguacugcc

SEQ ID NO: 518727 - RNA, 23 nt, Human
aaaugcagggucgcagguuacag

SEQ ID NO: 518728 - RNA, 22 nt, Human
ggcaggagaauggcgugaacuc

SEQ ID NO: 518729 - RNA, 22 nt, Human
gaaguauuucugaguugcccag

SEQ ID NO: 518730 - RNA, 22 nt, Human
aucuaagauguauugagcacuu

SEQ ID NO: 518731 - RNA, 22 nt, Human
cuguacaggugaggagggggcu

SEQ ID NO: 518732 - RNA, 22 nt, Human
ugcagccccugaaaauggcagc

SEQ ID NO: 518733 - RNA, 23 nt, Human
uuugugaaaguguugagaggaga

SEQ ID NO: 518734 - RNA, 22 nt, Human
uugucugauguucccucaugau

SEQ ID NO: 518735 - RNA, 22 nt, Human
uagcugucaccagaaauggcca

SEQ ID NO: 518736 - RNA, 22 nt, Human
acuggagcugagagcaugggua

SEQ ID NO: 518737 - RNA, 22 nt, Human
uggcagggaguugcaggauuuc

SEQ ID NO: 518738 - RNA, 20 nt, Human
cccaggcagagcuagcggca

SEQ ID NO: 518739 - RNA, 22 nt, Human
ggugggagagcuugcuuugaug

SEQ ID NO: 518740 - RNA, 22 nt, Human
ggggcagagaauaaaaaccuaa

SEQ ID NO: 518741 - RNA, 18 nt, Human
aggcuucccaggcaggcc

SEQ ID NO: 518742 - RNA, 22 nt, Human
ggaaggucgagcugcaucuggc

SEQ ID NO: 518743 - RNA, 22 nt, Human
cugggcccuauggaagaaaggg

SEQ ID NO: 518744 - RNA, 22 nt, Human
gagcagcucgagaaggaagcag

SEQ ID NO: 518745 - RNA, 22 nt, Human
aaaauccuuagccgagugaggu

SEQ ID NO: 518746 - RNA, 22 nt, Human
guggcuuccaugugcaucugac

SEQ ID NO: 518747 - RNA, 22 nt, Human
acagaauauugguuacuguugc

SEQ ID NO: 518748 - RNA, 22 nt, Human
caggcagcugcgacaagagagc

SEQ ID NO: 518749 - RNA, 22 nt, Human
caagcagagagguuagaacaca

SEQ ID NO: 518750 - RNA, 22 nt, Human
ucuguccagagguccuggagac

SEQ ID NO: 518751 - RNA, 22 nt, Human
aagagcugcccaaggugaacag

SEQ ID NO: 518752 - RNA, 22 nt, Human
uacaggguauagguacagauga

SEQ ID NO: 518753 - RNA, 19 nt, Human
uagagcugcuuccuggcag

SEQ ID NO: 518754 - RNA, 22 nt, Human
uauuuuguuaauaauccagucc

SEQ ID NO: 518755 - RNA, 22 nt, Human
acuguggccugcuguaugggcu

SEQ ID NO: 518756 - RNA, 22 nt, Human
aauaauuagugggacagagaac

SEQ ID NO: 518757 - RNA, 22 nt, Human
cagaguuuuaucauacguggau

SEQ ID NO: 518758 - RNA, 22 nt, Human
cuccagggaaaggggcguccgc

SEQ ID NO: 518759 - RNA, 22 nt, Human
gagggggcucccugaagccagu

SEQ ID NO: 518760 - RNA, 22 nt, Human
ccauccugcauugcuauucaga

SEQ ID NO: 518761 - RNA, 22 nt, Human
cagcagcaacaauagcggucac

SEQ ID NO: 518762 - RNA, 22 nt, Human
aggcucagcugguggugaucgc

SEQ ID NO: 518763 - RNA, 22 nt, Human
cuagagggauguuaggauagca

SEQ ID NO: 518764 - RNA, 22 nt, Human
gggagacaaggagaaccaaaga

SEQ ID NO: 518765 - RNA, 15 nt, Human
uguggcuggcuccug

SEQ ID NO: 518766 - RNA, 22 nt, Human
guggggagcagccuuagccccu

SEQ ID NO: 518767 - RNA, 22 nt, Human
cagagcugcuucccaguuugug

SEQ ID NO: 518768 - RNA, 22 nt, Human
agcucccagaguccucugccca

SEQ ID NO: 518769 - RNA, 20 nt, Human
ucacaggggaccaggagcag

SEQ ID NO: 518770 - RNA, 19 nt, Human
cucuuaaauugucucuugc

SEQ ID NO: 518771 - RNA, 22 nt, Human
agcagcaguacauauaagacua

SEQ ID NO: 518772 - RNA, 22 nt, Human
aagcuggaacaucuugaggaag

SEQ ID NO: 518773 - RNA, 20 nt, Human
uccagcugucuuucagagac

SEQ ID NO: 518774 - RNA, 22 nt, Human
cagguuucuaguucuaagaaua

SEQ ID NO: 518775 - RNA, 22 nt, Human
cagggaggcugucuuaugccug

SEQ ID NO: 518776 - RNA, 22 nt, Human
gcagagugagccgaggcugcuc

SEQ ID NO: 518777 - RNA, 22 nt, Human
uggagcccagacacuggcauug

SEQ ID NO: 518778 - RNA, 22 nt, Human
aggcuuccucgugccuuagaua

SEQ ID NO: 518779 - RNA, 22 nt, Human
ugggagcccaagggagcugccg

SEQ ID NO: 518780 - RNA, 22 nt, Human
uucuagcacaagauaugaaagu

SEQ ID NO: 518781 - RNA, 22 nt, Human
acacauuucuaaauuuuuaccg

SEQ ID NO: 518782 - RNA, 22 nt, Human
gggucuggacggcugcaggaag

SEQ ID NO: 518783 - RNA, 21 nt, Human
cucugggccauuuucuuccac

SEQ ID NO: 518784 - RNA, 22 nt, Human
aagcaaaugugggugcagaauu

SEQ ID NO: 518785 - RNA, 22 nt, Human
ccaggaagcggugagggcugcc

SEQ ID NO: 518786 - RNA, 22 nt, Human
aggguggccaugagggagagau

SEQ ID NO: 518787 - RNA, 22 nt, Human
ggcuggaaguccaagaucaaga

SEQ ID NO: 518788 - RNA, 22 nt, Human
auagaaauguauuuuggacuag

SEQ ID NO: 518789 - RNA, 22 nt, Human
gcugugagugagcugccuaggc

SEQ ID NO: 518790 - RNA, 22 nt, Human
uggagaaagcugcauauggaaa

SEQ ID NO: 518791 - RNA, 22 nt, Human
cccagagaagugaagugacuug

SEQ ID NO: 518792 - RNA, 20 nt, Human
augcaaacucacaaaauacc

SEQ ID NO: 518793 - RNA, 22 nt, Human
gaaaucuuuauggaaauaacaa

SEQ ID NO: 518794 - RNA, 22 nt, Human
aaaugcaauuguauguacucca

SEQ ID NO: 518795 - RNA, 22 nt, Human
augcaucauggaaaacucaguu

SEQ ID NO: 518796 - RNA, 22 nt, Human
agcuugguggcccuccuggcug

SEQ ID NO: 518797 - RNA, 21 nt, Human
agcuggcagauauggugucug

SEQ ID NO: 518798 - RNA, 22 nt, Human
ccuggcagcuccuccccggcgg

SEQ ID NO: 518799 - RNA, 22 nt, Human
gcugggcugcgucggggaagcc

SEQ ID NO: 518800 - RNA, 22 nt, Human
gacagacauuuccugauccaau

SEQ ID NO: 518801 - RNA, 22 nt, Human
uccuuagcaggcauucaggacc

SEQ ID NO: 518802 - RNA, 20 nt, Human
ugcuccaucuaaagugauua

SEQ ID NO: 518803 - RNA, 22 nt, Human
uuuuggaaugaggaacauccag

SEQ ID NO: 518804 - RNA, 22 nt, Human
ucugaaauacugcagguucucu

SEQ ID NO: 518805 - RNA, 16 nt, Human
cuuccucuucacuggc

SEQ ID NO: 518806 - RNA, 22 nt, Human
ucuggaguugugcaguggaccu

SEQ ID NO: 518807 - RNA, 18 nt, Human
ccugagcccugcuuacuu

SEQ ID NO: 518808 - RNA, 22 nt, Human
agccagggcugcgagcagacag

SEQ ID NO: 518809 - RNA, 22 nt, Human
cuuuauguccaccagacugcaa

SEQ ID NO: 518810 - RNA, 22 nt, Human
ugcccacauucaaaaggugaug

SEQ ID NO: 518811 - RNA, 22 nt, Human
agcuccugcucuuugucccuaa

SEQ ID NO: 518812 - RNA, 22 nt, Human
gcuguccucuuggacucagggc

SEQ ID NO: 518813 - RNA, 22 nt, Human
ucugggcuugguuagggcuguu

SEQ ID NO: 518814 - RNA, 22 nt, Human
aagguccaugacucggcauagu

SEQ ID NO: 518815 - RNA, 22 nt, Human
auguuuauguugggcuauauuu

SEQ ID NO: 518816 - RNA, 22 nt, Human
uuaggaaaggguuuucuaacag

SEQ ID NO: 518817 - RNA, 22 nt, Human
ucugggugugguaucuuagcca

SEQ ID NO: 518818 - RNA, 22 nt, Human
auggggggaugaaggaguccaa

SEQ ID NO: 518819 - RNA, 22 nt, Human
ccagcagacacacaggcguggg

SEQ ID NO: 518820 - RNA, 22 nt, Human
ggaggcugcugccucacguggg

SEQ ID NO: 518821 - RNA, 22 nt, Human
ccaaguacagauuccuccacug

SEQ ID NO: 518822 - RNA, 22 nt, Human
ucagugaucuaaggguauggcc

SEQ ID NO: 518823 - RNA, 22 nt, Human
aaucaguuguccaaaguucaca

SEQ ID NO: 518824 - RNA, 22 nt, Human
guuuauuauacaacaaaagcua

SEQ ID NO: 518825 - RNA, 22 nt, Human
cauuuagaaacuguuuuuaaca

SEQ ID NO: 518826 - RNA, 22 nt, Human
cagugugacuucugagcugcca

SEQ ID NO: 518827 - RNA, 22 nt, Human
cuucaggaguaguuaccuagca

SEQ ID NO: 518828 - RNA, 22 nt, Human
cacagcuucugagugaggauuu

SEQ ID NO: 518829 - RNA, 22 nt, Human
ucugagcugcagaguggggugg

SEQ ID NO: 518830 - RNA, 22 nt, Human
cccuggcucuucaccaccugcc

SEQ ID NO: 518831 - RNA, 22 nt, Human
cagcuuuaggacucauaauaaa

SEQ ID NO: 518832 - RNA, 22 nt, Human
gaggucaggggagaggcugaug

SEQ ID NO: 518833 - RNA, 22 nt, Human
uuaugaaagacauuucuguugg

SEQ ID NO: 518834 - RNA, 22 nt, Human
aaugaaaauuggacccuagaac

SEQ ID NO: 518835 - RNA, 22 nt, Human
aggggcugcuggguccgccccu

SEQ ID NO: 518836 - RNA, 19 nt, Human
agaaguuagacauugcaau

SEQ ID NO: 518837 - RNA, 22 nt, Human
gcaaaaacugcaauuacuuuug

SEQ ID NO: 518838 - RNA, 18 nt, Human
ggcaccucucuugccuua

SEQ ID NO: 518839 - RNA, 22 nt, Human
acauuucuaucauccuguaaug

SEQ ID NO: 518840 - RNA, 22 nt, Human
cugggguggaggagcuccccug

SEQ ID NO: 518841 - RNA, 23 nt, Human
acaguuauagcugugaauaacau

SEQ ID NO: 518842 - RNA, 22 nt, Human
guccugggagaugggacccuga

SEQ ID NO: 518843 - RNA, 22 nt, Human
uuauuuacaacucuucucuucc

SEQ ID NO: 518844 - RNA, 21 nt, Human
uaaaucucuguauucuucagu

SEQ ID NO: 518845 - RNA, 22 nt, Human
gccaggcugcuggcugcugucc

SEQ ID NO: 518846 - RNA, 22 nt, Human
uugaaaguagcagcugcauaug

SEQ ID NO: 518847 - RNA, 22 nt, Human
aaaagcaauugcaguucuugcc

SEQ ID NO: 518848 - RNA, 22 nt, Human
aagcccagcugaaagcauuuuu

SEQ ID NO: 518849 - RNA, 22 nt, Human
ucugugcuagaggaguuggcca

SEQ ID NO: 518850 - RNA, 21 nt, Human
agcagaggggacauguuugau

SEQ ID NO: 518851 - RNA, 22 nt, Human
aagaaauauugggccuuauaaa

SEQ ID NO: 518852 - RNA, 22 nt, Human
ccagggugggaggcugaaggcg

SEQ ID NO: 518853 - RNA, 22 nt, Human
cugccuggagcauucugaaggu

SEQ ID NO: 518854 - RNA, 22 nt, Human
cuuaauuuuuguaguagaugga

SEQ ID NO: 518855 - RNA, 20 nt, Human
ggcugcugugggcagagagg

SEQ ID NO: 518856 - RNA, 22 nt, Human
caccagggacaaugcuaggggu

SEQ ID NO: 518857 - RNA, 22 nt, Human
ggggcugagucagugggaagag

SEQ ID NO: 518858 - RNA, 22 nt, Human
aaguccagcauuuggguagauu

SEQ ID NO: 518859 - RNA, 21 nt, Human
aaauuucugcaagccucaacu

SEQ ID NO: 518860 - RNA, 22 nt, Human
uugcaaaggggaauaaagcaau

SEQ ID NO: 518861 - RNA, 22 nt, Human
gagcucccuggagguucagaua

SEQ ID NO: 518862 - RNA, 23 nt, Human
cccaugcugggcgcagugaaugg

SEQ ID NO: 518863 - RNA, 22 nt, Human
cagcauggggcuuggagucagc

SEQ ID NO: 518864 - RNA, 22 nt, Human
uacagcuugauguuuguguguu

SEQ ID NO: 518865 - RNA, 22 nt, Human
uacaaacuuguuuuaaguaagu

SEQ ID NO: 518866 - RNA, 22 nt, Human
ucagagagccucaggcacugcc

SEQ ID NO: 518867 - RNA, 22 nt, Human
aaaaugcaugagaaugugcucg

SEQ ID NO: 518868 - RNA, 17 nt, Human
cugggccucugcccuuu

SEQ ID NO: 518869 - RNA, 22 nt, Human
ugguccuggaagguccugaggg

SEQ ID NO: 518870 - RNA, 22 nt, Human
aaauauaguaaaugcauaguuc

SEQ ID NO: 518871 - RNA, 22 nt, Human
aauguauucugggaaaauguua

SEQ ID NO: 518872 - RNA, 22 nt, Human
cacagggcagguacucucagag

SEQ ID NO: 518873 - RNA, 22 nt, Human
auaaugagaauacaguaacuau

SEQ ID NO: 518874 - RNA, 22 nt, Human
accuuucacgguaucagacauc

SEQ ID NO: 518875 - RNA, 22 nt, Human
gcaaaucaccaccuagcuggau

SEQ ID NO: 518876 - RNA, 22 nt, Human
ccagcauccaugcucccucggg

SEQ ID NO: 518877 - RNA, 22 nt, Human
guccugggaacuggacagcuaa

SEQ ID NO: 518878 - RNA, 22 nt, Human
ugagcccagagcccuuguaggg

SEQ ID NO: 518879 - RNA, 22 nt, Human
agacaaaggauuaaugaugaug

SEQ ID NO: 518880 - RNA, 22 nt, Human
aaaagcuuuguuaauagguuug

SEQ ID NO: 518881 - RNA, 22 nt, Human
gucccagaaacauauugcuggu

SEQ ID NO: 518882 - RNA, 22 nt, Human
gcuucuggugaggccucaggaa

SEQ ID NO: 518883 - RNA, 22 nt, Human
agagcugugcuuugcaccacgu

SEQ ID NO: 518884 - RNA, 19 nt, Human
ucccgcccacugagcgugc

SEQ ID NO: 518885 - RNA, 22 nt, Human
uuucacauacaguguauaguag

SEQ ID NO: 518886 - RNA, 22 nt, Human
uguuuuaugagccauauaaccu

SEQ ID NO: 518887 - RNA, 22 nt, Human
caaugaaauugagauccagaga

SEQ ID NO: 518888 - RNA, 22 nt, Human
ggccaccaguccucuggcaggg

SEQ ID NO: 518889 - RNA, 22 nt, Human
gguuucaacuuuugugaggaau

SEQ ID NO: 518890 - RNA, 20 nt, Human
agacaaaaugacuucaugca

SEQ ID NO: 518891 - RNA, 22 nt, Human
cucugggcacauuuuccaggac

SEQ ID NO: 518892 - RNA, 22 nt, Human
gaggagcccuguuccccaggcc

SEQ ID NO: 518893 - RNA, 22 nt, Human
auucacaauuagaaguagauaa

SEQ ID NO: 518894 - RNA, 22 nt, Human
ugcaaguaaccaucacuaucuc

SEQ ID NO: 518895 - RNA, 22 nt, Human
agacuguacuuucugcagcucu

SEQ ID NO: 518896 - RNA, 22 nt, Human
cucaggggaccuggcuccgagu

SEQ ID NO: 518897 - RNA, 22 nt, Human
uuggcuucuuuagucaguuugg

SEQ ID NO: 518898 - RNA, 22 nt, Human
gcugcuggagagcgagacuguu

SEQ ID NO: 518899 - RNA, 22 nt, Human
guuguugaucacaugcauaucu

SEQ ID NO: 518900 - RNA, 22 nt, Human
uuguuuguaugcugagaagaau

SEQ ID NO: 518901 - RNA, 17 nt, Human
cccagagaugcugccuu

SEQ ID NO: 518902 - RNA, 22 nt, Human
gaaagggaguggacaacaggca

SEQ ID NO: 518903 - RNA, 22 nt, Human
cagauaauaauaugacuucacu

SEQ ID NO: 518904 - RNA, 22 nt, Human
uaaguaaauuuauaaugugauu

SEQ ID NO: 518905 - RNA, 22 nt, Human
gggcgggguggcucaugccugu

SEQ ID NO: 518906 - RNA, 22 nt, Human
aggcucaggcaggaauggcgga

SEQ ID NO: 518907 - RNA, 21 nt, Human
cugcccauuugugaugucccc

SEQ ID NO: 518908 - RNA, 22 nt, Human
caagcccaggauuccccaguua

SEQ ID NO: 518909 - RNA, 22 nt, Human
acagccagaggugguccugggu

SEQ ID NO: 518910 - RNA, 22 nt, Human
guauuuuuagguaaggaaagua

SEQ ID NO: 518911 - RNA, 22 nt, Human
caggcucccuaagucagcagcc

SEQ ID NO: 518912 - RNA, 22 nt, Human
ucaguuuugauuccugguucuc

SEQ ID NO: 518913 - RNA, 22 nt, Human
cagggcucacucggcuggcguc

SEQ ID NO: 518914 - RNA, 20 nt, Human
gggaggccccagaguccagg

SEQ ID NO: 518915 - RNA, 20 nt, Human
caggcuccgcaggacuaggg

SEQ ID NO: 518916 - RNA, 17 nt, Human
gcaaucucagucuccuu

SEQ ID NO: 518917 - RNA, 22 nt, Human
gaaaggugccccauaggcagga

SEQ ID NO: 518918 - RNA, 22 nt, Human
agugucaaaugugugccaagcu

SEQ ID NO: 518919 - RNA, 22 nt, Human
uccugggauuaagguggugauu

SEQ ID NO: 518920 - RNA, 22 nt, Human
gccuguuugacuggucucugcu

SEQ ID NO: 518921 - RNA, 23 nt, Human
gccucugcagccuaguuaguguc

SEQ ID NO: 518922 - RNA, 22 nt, Human
agagagcauggcacagaggggu

SEQ ID NO: 518923 - RNA, 22 nt, Human
agguccagaggcuccuuauuac

SEQ ID NO: 518924 - RNA, 19 nt, Human
agcuggagauuggagggca

SEQ ID NO: 518925 - RNA, 17 nt, Human
agagggaaaaugcgguu

SEQ ID NO: 518926 - RNA, 22 nt, Human
uuaaacagagucugaaauguaa

SEQ ID NO: 518927 - RNA, 22 nt, Human
ggugcccagcaagcuuucaaug

SEQ ID NO: 518928 - RNA, 22 nt, Human
agguaaagacagugaaagaggg

SEQ ID NO: 518929 - RNA, 22 nt, Human
uucaggagaaaguucaguacuu

SEQ ID NO: 518930 - RNA, 22 nt, Human
ggcugcugaguuggccaggaga

SEQ ID NO: 518931 - RNA, 22 nt, Human
ggcugccugaggcagugagaga

SEQ ID NO: 518932 - RNA, 22 nt, Human
cugggccaucagaggggcugga

SEQ ID NO: 518933 - RNA, 22 nt, Human
aauuagcugucaaugaggaucu

SEQ ID NO: 518934 - RNA, 22 nt, Human
aacaguuugagcuuugaauuuc

SEQ ID NO: 518935 - RNA, 22 nt, Human
gagacacaggugguuccuguca

SEQ ID NO: 518936 - RNA, 22 nt, Human
cuaggcccaugagguuugcugg

SEQ ID NO: 518937 - RNA, 22 nt, Human
gagaaagaaagggaaguuuguu

SEQ ID NO: 518938 - RNA, 22 nt, Human
caggccagagcgcgugguuggg

SEQ ID NO: 518939 - RNA, 22 nt, Human
gccuguuugagaauagucaggg

SEQ ID NO: 518940 - RNA, 22 nt, Human
gaaggccauuuuuagguagaau

SEQ ID NO: 518941 - RNA, 22 nt, Human
agcagcaucugguucugaugug

SEQ ID NO: 518942 - RNA, 22 nt, Human
ugggaagaggcgggaggcuguu

SEQ ID NO: 518943 - RNA, 22 nt, Human
ugaggccagagaguuugcauuu

SEQ ID NO: 518944 - RNA, 22 nt, Human
ccugggaggcugugggucugcu

SEQ ID NO: 518945 - RNA, 22 nt, Human
ugauuuccaauaaggagaaugu

SEQ ID NO: 518946 - RNA, 19 nt, Human
ggcucucccuugagagagc

SEQ ID NO: 518947 - RNA, 22 nt, Human
guguccagagaacugugggagc

SEQ ID NO: 518948 - RNA, 22 nt, Human
cugagcauuugugcagcuucuc

SEQ ID NO: 518949 - RNA, 22 nt, Human
cauuuguaguaucuguuuauau

SEQ ID NO: 518950 - RNA, 20 nt, Human
agcccaggccugugugaguc

SEQ ID NO: 518951 - RNA, 22 nt, Human
ccaguguuuaggaauaaaaugu

SEQ ID NO: 518952 - RNA, 22 nt, Human
agucucagccacacagaccuau

SEQ ID NO: 518953 - RNA, 22 nt, Human
guagggacaugccauuaucuca

SEQ ID NO: 518954 - RNA, 22 nt, Human
cuggagccccagacagggagag

SEQ ID NO: 518955 - RNA, 22 nt, Human
uccaggcaaagggacuagcagg

SEQ ID NO: 518956 - RNA, 22 nt, Human
cacaaauaccaguuuccuaaca

SEQ ID NO: 518957 - RNA, 22 nt, Human
agcagcuguggaaaaguaacua

SEQ ID NO: 518958 - RNA, 22 nt, Human
guuuuacaaaugacggcauuca

SEQ ID NO: 518959 - RNA, 22 nt, Human
ggucuggccuggcauucuaugg

SEQ ID NO: 518960 - RNA, 22 nt, Human
ugaaaauuuccaucaguuauau

SEQ ID NO: 518961 - RNA, 21 nt, Human
guuugcaugaacaagucagcc

SEQ ID NO: 518962 - RNA, 22 nt, Human
cagcucugaggaacacuccuuu

SEQ ID NO: 518963 - RNA, 22 nt, Human
agagccaggugcugcuguuuga

SEQ ID NO: 518964 - RNA, 22 nt, Human
ucuggggcaguuacuggggccu

SEQ ID NO: 518965 - RNA, 22 nt, Human
gaaggccauuagagccugugcc

SEQ ID NO: 518966 - RNA, 22 nt, Human
cuucuuucuuuugaucacaggu

SEQ ID NO: 518967 - RNA, 22 nt, Human
gucagaggaggcugaguaggaa

SEQ ID NO: 518968 - RNA, 22 nt, Human
aaucaagagcugacuauauuuu

SEQ ID NO: 518969 - RNA, 22 nt, Human
uuaccauagaaacuuccuuuuu

SEQ ID NO: 518970 - RNA, 22 nt, Human
ggaggcuccuaagcugacuuga

SEQ ID NO: 518971 - RNA, 22 nt, Human
ucucuucacaugcuugcuccaa

SEQ ID NO: 518972 - RNA, 22 nt, Human
ggcaaagcccugccugguucaa

SEQ ID NO: 518973 - RNA, 22 nt, Human
ucacauucuagaauguuaucgu

SEQ ID NO: 518974 - RNA, 22 nt, Human
gcagggguggaggcuguccugu

SEQ ID NO: 518975 - RNA, 22 nt, Human
auguaugaagcuuuguuuggga

SEQ ID NO: 518976 - RNA, 22 nt, Human
cauaauuaaauucugggcaaga

SEQ ID NO: 518977 - RNA, 22 nt, Human
acuaaggaauaugacaaacuca

SEQ ID NO: 518978 - RNA, 22 nt, Human
aacaacugaaaagcuuuuucug

SEQ ID NO: 518979 - RNA, 22 nt, Human
uuugaaagggacaaagucacug

SEQ ID NO: 518980 - RNA, 22 nt, Human
cacaggaaaugauucugcagca

SEQ ID NO: 518981 - RNA, 22 nt, Human
aggcucaguuugguuuccauug

SEQ ID NO: 518982 - RNA, 22 nt, Human
gcugucuuccuugcuccaaggg

SEQ ID NO: 518983 - RNA, 22 nt, Human
uagaaagacaugggccagcagc

SEQ ID NO: 518984 - RNA, 22 nt, Human
gcagugggaagguuggcacaug

SEQ ID NO: 518985 - RNA, 22 nt, Human
cacagggcuuugauggcugagu

SEQ ID NO: 518986 - RNA, 22 nt, Human
ucagaggacaagcucccuggug

SEQ ID NO: 518987 - RNA, 22 nt, Human
uucccagagauaagacgucuua

SEQ ID NO: 518988 - RNA, 22 nt, Human
aaucaguucuacaucuuaucca

SEQ ID NO: 518989 - RNA, 22 nt, Human
gcugagaguguaggauguuuac

SEQ ID NO: 518990 - RNA, 22 nt, Human
uaacacugauuuguucucaggg

SEQ ID NO: 518991 - RNA, 21 nt, Human
gggcucaguggaaaagagugu

SEQ ID NO: 518992 - RNA, 22 nt, Human
gaaucaaugguagauuaaguaa

SEQ ID NO: 518993 - RNA, 22 nt, Human
acacaaaguuggaugacaaaau

SEQ ID NO: 518994 - RNA, 22 nt, Human
uucacaggaggguggaugcaug

SEQ ID NO: 518995 - RNA, 22 nt, Human
gagcuccacuuagcaaggccac

SEQ ID NO: 518996 - RNA, 21 nt, Human
acugagagauguuggaucaua

SEQ ID NO: 518997 - RNA, 22 nt, Human
ugcucugugguccaagauggcu

SEQ ID NO: 518998 - RNA, 21 nt, Human
uggcagggguaguaguacagc

SEQ ID NO: 518999 - RNA, 22 nt, Human
uaguaacagauuuauacagucu

SEQ ID NO: 519000 - RNA, 22 nt, Human
gagugcaaguucuuccuucuuc

SEQ ID NO: 519001 - RNA, 22 nt, Human
gguccuggcagcucugugucca

SEQ ID NO: 519002 - RNA, 22 nt, Human
ggagcugucuguagggcacagg

SEQ ID NO: 519003 - RNA, 22 nt, Human
gagggcugaugcuuacuuauuu

SEQ ID NO: 519004 - RNA, 22 nt, Human
caggcacagaguuauucauuua

SEQ ID NO: 519005 - RNA, 22 nt, Human
auauuugucaucugccuuaguu

SEQ ID NO: 519006 - RNA, 22 nt, Human
ugcugccuugaccuccugggcu

SEQ ID NO: 519007 - RNA, 22 nt, Human
agcagugaugcaugacagccua

SEQ ID NO: 519008 - RNA, 22 nt, Human
uguaugcagcaaaacaauuagu

SEQ ID NO: 519009 - RNA, 22 nt, Human
gucccauaaguagugcaacuug

SEQ ID NO: 519010 - RNA, 22 nt, Human
agcaggaaagaaaaaucugugu

SEQ ID NO: 519011 - RNA, 22 nt, Human
agcugccagcaucccggaaggg

SEQ ID NO: 519012 - RNA, 22 nt, Human
uucucaggucaccagggugcca

SEQ ID NO: 519013 - RNA, 22 nt, Human
ccacagggugucaucagcuuga

SEQ ID NO: 519014 - RNA, 22 nt, Human
aacucaguuacauauuagaaua

SEQ ID NO: 519015 - RNA, 22 nt, Human
accauccaaacugcuuucugug

SEQ ID NO: 519016 - RNA, 21 nt, Human
ucuguggcggacucuaggccc

SEQ ID NO: 519017 - RNA, 22 nt, Human
uggcccaggucucucugagccc

SEQ ID NO: 519018 - RNA, 22 nt, Human
agaagccagaggcaguggguac

SEQ ID NO: 519019 - RNA, 22 nt, Human
ugcaguggcgccaucucagcuc

SEQ ID NO: 519020 - RNA, 22 nt, Human
cagagcugcacauucuaugaug

SEQ ID NO: 519021 - RNA, 22 nt, Human
agggccagagucuguguagaua

SEQ ID NO: 519022 - RNA, 22 nt, Human
cagggaugucucuggaagggag

SEQ ID NO: 519023 - RNA, 22 nt, Human
uccuggcuggaauuucucacuc

SEQ ID NO: 519024 - RNA, 22 nt, Human
cagugagggcccccuuccaggu

SEQ ID NO: 519025 - RNA, 22 nt, Human
uagagcuagcuucaaaaugcga

SEQ ID NO: 519026 - RNA, 22 nt, Human
gaggggcuggguagggcaaccc

SEQ ID NO: 519027 - RNA, 22 nt, Human
ucuguacaguaccagauaguaa

SEQ ID NO: 519028 - RNA, 22 nt, Human
uggcccagagcacugcugggca

SEQ ID NO: 519029 - RNA, 22 nt, Human
uccagggaugguaaugagcagu

SEQ ID NO: 519030 - RNA, 22 nt, Human
ucacugggcaucggagcugaaa

SEQ ID NO: 519031 - RNA, 22 nt, Human
uguugauuaguguuuagacuua

SEQ ID NO: 519032 - RNA, 22 nt, Human
uuuguucauuuugagcucauca

SEQ ID NO: 519033 - RNA, 22 nt, Human
gagagugaugaaugguuaaaca

SEQ ID NO: 519034 - RNA, 22 nt, Human
guccucuggagguuuuuaggug

SEQ ID NO: 519035 - RNA, 23 nt, Human
cagaugagguuggcagcaugguc

SEQ ID NO: 519036 - RNA, 19 nt, Human
gcugugccucucuccugcu

SEQ ID NO: 519037 - RNA, 18 nt, Human
uggaaauugaaacagaaa

SEQ ID NO: 519038 - RNA, 22 nt, Human
uuacaagaucuuugaaggcaag

SEQ ID NO: 519039 - RNA, 22 nt, Human
ccuggcucccuggaccucauua

SEQ ID NO: 519040 - RNA, 22 nt, Human
gugccagcucuccccacaucug

SEQ ID NO: 519041 - RNA, 22 nt, Human
uuuacaaggaucaagggaucuc

SEQ ID NO: 519042 - RNA, 22 nt, Human
ugagccagaggaggcugugugg

SEQ ID NO: 519043 - RNA, 22 nt, Human
gaagauuaaacauauuuagugu

SEQ ID NO: 519044 - RNA, 22 nt, Human
uuuuaaguuaauauaauugagg

SEQ ID NO: 519045 - RNA, 22 nt, Human
ggcaguaugaguucaaauaauu

SEQ ID NO: 519046 - RNA, 22 nt, Human
agccacagcuccuugguggaga

SEQ ID NO: 519047 - RNA, 22 nt, Human
caagagcuuuagaaaugcucau

SEQ ID NO: 519048 - RNA, 19 nt, Human
gaaugggaaugggaaagcu

SEQ ID NO: 519049 - RNA, 22 nt, Human
uccugggaccaggcaccuacug

SEQ ID NO: 519050 - RNA, 21 nt, Human
agaagucaauugaacugaaau

SEQ ID NO: 519051 - RNA, 22 nt, Human
cugcugugcacccaggaaggcu

SEQ ID NO: 519052 - RNA, 22 nt, Human
gagccaggcaccuucuguguug

SEQ ID NO: 519053 - RNA, 22 nt, Human
gcugccugcucacccggccugg

SEQ ID NO: 519054 - RNA, 22 nt, Human
auguuucaugacugagcaaaau

SEQ ID NO: 519055 - RNA, 22 nt, Human
aauuugcaugaugagaacaaua

SEQ ID NO: 519056 - RNA, 22 nt, Human
gugugggaaggcuaggaugcug

SEQ ID NO: 519057 - RNA, 22 nt, Human
aaugauugcaaacauugagaac

SEQ ID NO: 519058 - RNA, 22 nt, Human
auguuauuuuggaaaauacaaa

SEQ ID NO: 519059 - RNA, 22 nt, Human
aggcacugacagauucuguguc

SEQ ID NO: 519060 - RNA, 22 nt, Human
gccagcaguauguccuggcagu

SEQ ID NO: 519061 - RNA, 22 nt, Human
auugaggcagcauaguucaggg

SEQ ID NO: 519062 - RNA, 22 nt, Human
cauuccuuaacguggggagucu

SEQ ID NO: 519063 - RNA, 22 nt, Human
uugcagcuucgagucuaucugu

SEQ ID NO: 519064 - RNA, 22 nt, Human
auguacaguuucuagacucaaa

SEQ ID NO: 519065 - RNA, 22 nt, Human
cagagaaagaagcccauucauu

SEQ ID NO: 519066 - RNA, 22 nt, Human
gugaggggccaagaguagggca

SEQ ID NO: 519067 - RNA, 22 nt, Human
ucauuuguugaacuuuagugcg

SEQ ID NO: 519068 - RNA, 22 nt, Human
auaagccugauucacuugucau

SEQ ID NO: 519069 - RNA, 22 nt, Human
caggcugaucagggcugggaug

SEQ ID NO: 519070 - RNA, 22 nt, Human
cucugagcugaaacaugagcau

SEQ ID NO: 519071 - RNA, 22 nt, Human
uggcugaauaauauucuguugu

SEQ ID NO: 519072 - RNA, 23 nt, Human
cagcugaagcagccugggcugga

SEQ ID NO: 519073 - RNA, 22 nt, Human
cucagugcuuuggauccuggau

SEQ ID NO: 519074 - RNA, 22 nt, Human
ccagcugcagguguuccagaug

SEQ ID NO: 519075 - RNA, 22 nt, Human
agggcugcaccggggcuucgcg

SEQ ID NO: 519076 - RNA, 22 nt, Human
uggaccugagccuggcccugcc

SEQ ID NO: 519077 - RNA, 22 nt, Human
ucagcaguguaguuuaucauuc

SEQ ID NO: 519078 - RNA, 19 nt, Human
uaauaagcaauauggaagu

SEQ ID NO: 519079 - RNA, 20 nt, Human
aucagcaacugccacucagu

SEQ ID NO: 519080 - RNA, 22 nt, Human
uuucaaagcaacugaaaaggaa

SEQ ID NO: 519081 - RNA, 22 nt, Human
cugggcuguaauguggcacuga

SEQ ID NO: 519082 - RNA, 22 nt, Human
aacagcuuacucaauggugauu

SEQ ID NO: 519083 - RNA, 22 nt, Human
uucaggauuauacucucuuccc

SEQ ID NO: 519084 - RNA, 22 nt, Human
auguaacaaaugguauacaugu

SEQ ID NO: 519085 - RNA, 22 nt, Human
cagagccagcuguccuuggcau

SEQ ID NO: 519086 - RNA, 22 nt, Human
ugcuggaggaguuuacuguggc

SEQ ID NO: 519087 - RNA, 22 nt, Human
ccccucuuggcauugagugcca

SEQ ID NO: 519088 - RNA, 23 nt, Human
aaauuauugcucuucaauugccu

SEQ ID NO: 519089 - RNA, 22 nt, Human
gcagaggauagcauaugaaccu

SEQ ID NO: 519090 - RNA, 22 nt, Human
ggcacagggaggcccuggugug

SEQ ID NO: 519091 - RNA, 22 nt, Human
auucuacaaaagaacuggaucu

SEQ ID NO: 519092 - RNA, 22 nt, Human
ccagcuggaaacaaauagagug

SEQ ID NO: 519093 - RNA, 22 nt, Human
acucuggcccuccugcugccag

SEQ ID NO: 519094 - RNA, 21 nt, Human
aauuacagauggaauuacaga

SEQ ID NO: 519095 - RNA, 22 nt, Human
ccccuuccaggaagcagaaucg

SEQ ID NO: 519096 - RNA, 22 nt, Human
gugucacaggcccagcucuuca

SEQ ID NO: 519097 - RNA, 22 nt, Human
cuuaacagauacaucugugguu

SEQ ID NO: 519098 - RNA, 22 nt, Human
gacaaucagccauauccagggu

SEQ ID NO: 519099 - RNA, 22 nt, Human
gugggcuuguuuugaugagauc

SEQ ID NO: 519100 - RNA, 19 nt, Human
uuaugaauagcuucaucca

SEQ ID NO: 519101 - RNA, 22 nt, Human
uccuucaaaaguugagagagcc

SEQ ID NO: 519102 - RNA, 22 nt, Human
guguguccucaguaguggcaug

SEQ ID NO: 519103 - RNA, 22 nt, Human
acagagguguuccagaccuagg

SEQ ID NO: 519104 - RNA, 22 nt, Human
guuuuauaugucucugcugaca

SEQ ID NO: 519105 - RNA, 22 nt, Human
uucucugggguucaguaucucu

SEQ ID NO: 519106 - RNA, 22 nt, Human
cuucagggugacgcaggcugca

SEQ ID NO: 519107 - RNA, 22 nt, Human
cugcugcauuacucuucucaag

SEQ ID NO: 519108 - RNA, 22 nt, Human
aagugguaggaagagagcacug

SEQ ID NO: 519109 - RNA, 22 nt, Human
gaaauauuucucuugagccccu

SEQ ID NO: 519110 - RNA, 22 nt, Human
ggaggcagaacuucccgucagu

SEQ ID NO: 519111 - RNA, 22 nt, Human
cauggaaggcaaaagacacaga

SEQ ID NO: 519112 - RNA, 21 nt, Human
agcccuuaggacauaagagag

SEQ ID NO: 519113 - RNA, 23 nt, Human
ggccuccuggucuaggcuagacu

SEQ ID NO: 519114 - RNA, 23 nt, Human
ccuggcagcaaacgaggagguua

SEQ ID NO: 519115 - RNA, 22 nt, Human
augcuuuaguucaaaggacuua

SEQ ID NO: 519116 - RNA, 22 nt, Human
cuuuaguguucaacccagauaa

SEQ ID NO: 519117 - RNA, 22 nt, Human
aaacaaguguaaacuagucugu

SEQ ID NO: 519118 - RNA, 22 nt, Human
cucuggaguucucaugaggaac

SEQ ID NO: 519119 - RNA, 22 nt, Human
acagacauuuucuguauugccu

SEQ ID NO: 519120 - RNA, 22 nt, Human
cugggggcaagcagacagcugu

SEQ ID NO: 519121 - RNA, 19 nt, Human
uuugaauccagcugguaac

SEQ ID NO: 519122 - RNA, 22 nt, Human
gggaaaaauaaugcacagauau

SEQ ID NO: 519123 - RNA, 22 nt, Human
gggcuggucuggcuuagucagg

SEQ ID NO: 519124 - RNA, 22 nt, Human
cucacuguccaacaggcuuuac

SEQ ID NO: 519125 - RNA, 22 nt, Human
ugccaggcuccggaacgacagu

SEQ ID NO: 519126 - RNA, 22 nt, Human
cccagcuaccucugcuaggaga

SEQ ID NO: 519127 - RNA, 17 nt, Human
gccuuccuuccuccaca

SEQ ID NO: 519128 - RNA, 22 nt, Human
cucaggcccacagcagacccac

SEQ ID NO: 519129 - RNA, 22 nt, Human
guuuuuuggguguauaucuucu

SEQ ID NO: 519130 - RNA, 22 nt, Human
ggggcagaguagcuggggugug

SEQ ID NO: 519131 - RNA, 22 nt, Human
caccugagugucaguauucuca

SEQ ID NO: 519132 - RNA, 20 nt, Human
gugcauuucaccuguacugu

SEQ ID NO: 519133 - RNA, 22 nt, Human
ugaagccacuuuccagaaucac

SEQ ID NO: 519134 - RNA, 22 nt, Human
ugcauacacaugugcacauacg

SEQ ID NO: 519135 - RNA, 21 nt, Human
acaggcucacgauccauuucu

SEQ ID NO: 519136 - RNA, 22 nt, Human
uggaguucauccaugacagcuu

SEQ ID NO: 519137 - RNA, 23 nt, Human
aaagugacuuuuauaccacuaac

SEQ ID NO: 519138 - RNA, 22 nt, Human
aaggcugaguaaaacagagaac

SEQ ID NO: 519139 - RNA, 22 nt, Human
ugaaugaugguguguucuugcc

SEQ ID NO: 519140 - RNA, 22 nt, Human
gugaaggacuagcauggagggc

SEQ ID NO: 519141 - RNA, 22 nt, Human
gcagccacacuguuacagaaug

SEQ ID NO: 519142 - RNA, 23 nt, Human
ugaaugauuguacugagcuuuua

SEQ ID NO: 519143 - RNA, 19 nt, Human
gcugcucugggucucaucu

SEQ ID NO: 519144 - RNA, 22 nt, Human
ccagagccuaagaucugauccu

SEQ ID NO: 519145 - RNA, 22 nt, Human
ggcuuuauauuguuugagcaga

SEQ ID NO: 519146 - RNA, 22 nt, Human
auuugucucugcacuuuacuca

SEQ ID NO: 519147 - RNA, 22 nt, Human
gagcagaacaggccggguggga

SEQ ID NO: 519148 - RNA, 23 nt, Human
cuguaugauguuaaguggaaagc

SEQ ID NO: 519149 - RNA, 22 nt, Human
cagccacuggugccaggcuguu

SEQ ID NO: 519150 - RNA, 22 nt, Human
aguccaaggccauacaguugug

SEQ ID NO: 519151 - RNA, 22 nt, Human
uguuaucacuuguaaaagcaau

SEQ ID NO: 519152 - RNA, 22 nt, Human
cagggcuugguuggaaccaccc

SEQ ID NO: 519153 - RNA, 22 nt, Human
gccuggugaaaggcagagagcg

SEQ ID NO: 519154 - RNA, 21 nt, Human
gaggggcagcucuuagcauua

SEQ ID NO: 519155 - RNA, 22 nt, Human
uggaggaugagugugggcucug

SEQ ID NO: 519156 - RNA, 22 nt, Human
ugggccuguugccugaguccau

SEQ ID NO: 519157 - RNA, 22 nt, Human
gaggggcagagguagagaacaa

SEQ ID NO: 519158 - RNA, 22 nt, Human
gcucccaacucaggccuccucc

SEQ ID NO: 519159 - RNA, 22 nt, Human
acugcuuuagaccuagagcucu

SEQ ID NO: 519160 - RNA, 22 nt, Human
caaagucagccagcuaguaggu

SEQ ID NO: 519161 - RNA, 22 nt, Human
gcaggcagagaaggaacauuua

SEQ ID NO: 519162 - RNA, 22 nt, Human
ugccaguugggaaaacagacau

SEQ ID NO: 519163 - RNA, 22 nt, Human
caccugcaaggagcuuucauuu

SEQ ID NO: 519164 - RNA, 22 nt, Human
gucaauaauuuuauggagagaa

SEQ ID NO: 519165 - RNA, 22 nt, Human
ggucccagaauugguuagcaca

SEQ ID NO: 519166 - RNA, 22 nt, Human
cagaggcauuacugaaaaggug

SEQ ID NO: 519167 - RNA, 22 nt, Human
ccagccucacuggcaucaccua

SEQ ID NO: 519168 - RNA, 22 nt, Human
gggagggaggugcugguucacg

SEQ ID NO: 519169 - RNA, 22 nt, Human
ccuuagcaacugucauagagca

SEQ ID NO: 519170 - RNA, 22 nt, Human
cugagccacugcuuguucagug

SEQ ID NO: 519171 - RNA, 22 nt, Human
uugaagcauuucuuugagcuuc

SEQ ID NO: 519172 - RNA, 22 nt, Human
ggaaagaggauaguggguaggu

SEQ ID NO: 519173 - RNA, 22 nt, Human
cuggcugccuggagugagggag

SEQ ID NO: 519174 - RNA, 15 nt, Human
ugauuuccuacuaac

SEQ ID NO: 519175 - RNA, 22 nt, Human
auucuuggcaaggagauuuaaa

SEQ ID NO: 519176 - RNA, 22 nt, Human
guuguaaauacagcagauaauu

SEQ ID NO: 519177 - RNA, 22 nt, Human
cuacauucugggaaaucagaug

SEQ ID NO: 519178 - RNA, 22 nt, Human
uguaugcuuuccaaaaaugcug

SEQ ID NO: 519179 - RNA, 22 nt, Human
ggacaaagccugguggcaggug

SEQ ID NO: 519180 - RNA, 22 nt, Human
uauauagaaaagcagauguugg

SEQ ID NO: 519181 - RNA, 22 nt, Human
gaggcucagagggagcaugguc

SEQ ID NO: 519182 - RNA, 22 nt, Human
cagaugugcaugaugggaaggg

SEQ ID NO: 519183 - RNA, 22 nt, Human
ccucacugaagaggugacauuu

SEQ ID NO: 519184 - RNA, 22 nt, Human
uaguaaguucucgcauuguuau

SEQ ID NO: 519185 - RNA, 22 nt, Human
cucuccuccaacagcccugccg

SEQ ID NO: 519186 - RNA, 22 nt, Human
gauuuguggugugaggaagagc

SEQ ID NO: 519187 - RNA, 22 nt, Human
cuucuuaaucccuuauauauuu

SEQ ID NO: 519188 - RNA, 22 nt, Human
aaaaagauagcauugugcuccu

SEQ ID NO: 519189 - RNA, 22 nt, Human
caggacaguauaggcuuuagga

SEQ ID NO: 519190 - RNA, 22 nt, Human
ccugguggccuucagcccacaa

SEQ ID NO: 519191 - RNA, 22 nt, Human
agaauuacauaaauacaugaau

SEQ ID NO: 519192 - RNA, 22 nt, Human
uaguuuguaaugaggagaagua

SEQ ID NO: 519193 - RNA, 22 nt, Human
uccugcagcauccgucgucugu

SEQ ID NO: 519194 - RNA, 23 nt, Human
ucuuuccucagcacacaccaaga

SEQ ID NO: 519195 - RNA, 22 nt, Human
gaggugccuggcgaugucucug

SEQ ID NO: 519196 - RNA, 22 nt, Human
aggaaggguucuuugugaaaga

SEQ ID NO: 519197 - RNA, 22 nt, Human
aaauucaauuaacuuucaugcu

SEQ ID NO: 519198 - RNA, 22 nt, Human
ugcugaauugguaguacuguug

SEQ ID NO: 519199 - RNA, 22 nt, Human
aucuguucuucaaaauauuaca

SEQ ID NO: 519200 - RNA, 22 nt, Human
uucuggggcuaauacagagguc

SEQ ID NO: 519201 - RNA, 22 nt, Human
uugcuuuguggugguucuucca

SEQ ID NO: 519202 - RNA, 22 nt, Human
ucccagaggucucugcugguuc

SEQ ID NO: 519203 - RNA, 22 nt, Human
uggaagagaaaggaguggaucu

SEQ ID NO: 519204 - RNA, 22 nt, Human
uugagcucuccucaucacccug

SEQ ID NO: 519205 - RNA, 22 nt, Human
cgcugccaggucaccaggggua

SEQ ID NO: 519206 - RNA, 22 nt, Human
ucacaaagagaauugugggugu

SEQ ID NO: 519207 - RNA, 22 nt, Human
cacacagaaccgcucgccacuu

SEQ ID NO: 519208 - RNA, 22 nt, Human
agcucuggaauaaugaugugau

SEQ ID NO: 519209 - RNA, 22 nt, Human
ugaggcaggacauggacaacug

SEQ ID NO: 519210 - RNA, 23 nt, Human
gcuugcucauucuaucacacagc

SEQ ID NO: 519211 - RNA, 22 nt, Human
caacuuuaugauugguuuguca

SEQ ID NO: 519212 - RNA, 22 nt, Human
guggagcccugccuugcucaug

SEQ ID NO: 519213 - RNA, 22 nt, Human
uuagaaaggaaucuucauuuca

SEQ ID NO: 519214 - RNA, 22 nt, Human
uggagucagaaugcgacaggcc

SEQ ID NO: 519215 - RNA, 22 nt, Human
uugccagggcuuugguggcauc

SEQ ID NO: 519216 - RNA, 22 nt, Human
aucuacuccugaauauaucuag

SEQ ID NO: 519217 - RNA, 22 nt, Human
gucugggguacuuucaucugau

SEQ ID NO: 519218 - RNA, 22 nt, Human
guggcucucgccagccugcggg

SEQ ID NO: 519219 - RNA, 22 nt, Human
ugaggccucauaaugagauuuc

SEQ ID NO: 519220 - RNA, 22 nt, Human
uuuucuuauagagcuuaaaguu

SEQ ID NO: 519221 - RNA, 22 nt, Human
aguggcuguaucagucaacccu

SEQ ID NO: 519222 - RNA, 22 nt, Human
uggcugagaccaucagggugua

SEQ ID NO: 519223 - RNA, 22 nt, Human
cccugaggagagcgcuucccga

SEQ ID NO: 519224 - RNA, 22 nt, Human
cugggccuucauugcucuccca

SEQ ID NO: 519225 - RNA, 22 nt, Human
uaugagaaauuauaccuagguu

SEQ ID NO: 519226 - RNA, 22 nt, Human
ugcucuggaguggcuugugcac

SEQ ID NO: 519227 - RNA, 22 nt, Human
gaggccuggguuggaggugcau

SEQ ID NO: 519228 - RNA, 22 nt, Human
ugcaugugucgggccugugcua

SEQ ID NO: 519229 - RNA, 21 nt, Human
cagaggcugagagggcaaucu

SEQ ID NO: 519230 - RNA, 22 nt, Human
uguggcaggcauucugaggcug

SEQ ID NO: 519231 - RNA, 18 nt, Human
cuucagugacagucuggc

SEQ ID NO: 519232 - RNA, 23 nt, Human
ugccucaguggaaugugagggug

SEQ ID NO: 519233 - RNA, 22 nt, Human
cuggcuccauuacucagcaucu

SEQ ID NO: 519234 - RNA, 22 nt, Human
agccccuuccaguucucagauc

SEQ ID NO: 519235 - RNA, 22 nt, Human
aagggcuuuuaagauuuauccu

SEQ ID NO: 519236 - RNA, 18 nt, Human
accugccuguucuucucu

SEQ ID NO: 519237 - RNA, 22 nt, Human
agugucugaaccaccggggcau

SEQ ID NO: 519238 - RNA, 21 nt, Human
ggccugaguauaggacaggcc

SEQ ID NO: 519239 - RNA, 22 nt, Human
gguaaaaaucacaaauacuuua

SEQ ID NO: 519240 - RNA, 22 nt, Human
guccagagaagggaggggacuc

SEQ ID NO: 519241 - RNA, 22 nt, Human
gucccucugcucuagagagcca

SEQ ID NO: 519242 - RNA, 22 nt, Human
gcuccacuugcagcuaggcuug

SEQ ID NO: 519243 - RNA, 22 nt, Human
aagcaggagaugggugcuuuuc

SEQ ID NO: 519244 - RNA, 22 nt, Human
cugggccaaaagaaguguucuu

SEQ ID NO: 519245 - RNA, 22 nt, Human
ccugggucuucagucugcuggu

SEQ ID NO: 519246 - RNA, 22 nt, Human
guuuuuccuugcugaggacccg

SEQ ID NO: 519247 - RNA, 22 nt, Human
uuucaaagaccauuaacuauca

SEQ ID NO: 519248 - RNA, 22 nt, Human
aucuggguucaccaugcuccug

SEQ ID NO: 519249 - RNA, 22 nt, Human
cccaggcugaguuagagguguc

SEQ ID NO: 519250 - RNA, 22 nt, Human
uggaggagaauuuauggucgaa

SEQ ID NO: 519251 - RNA, 22 nt, Human
agcuucuggaagccuggcagca

SEQ ID NO: 519252 - RNA, 22 nt, Human
agaaaucuaagaugcucaagga

SEQ ID NO: 519253 - RNA, 22 nt, Human
accugaggccuccccagcagac

SEQ ID NO: 519254 - RNA, 20 nt, Human
uggggccuguuucugugguu

SEQ ID NO: 519255 - RNA, 22 nt, Human
guggcuucaccccaguugucuc

SEQ ID NO: 519256 - RNA, 20 nt, Human
uccagcccagguccugccug

SEQ ID NO: 519257 - RNA, 22 nt, Human
aucacugucgucaucugagauu

SEQ ID NO: 519258 - RNA, 22 nt, Human
uggaaucuugcgggcacauggc

SEQ ID NO: 519259 - RNA, 22 nt, Human
agacacaggauucugcauuucu

SEQ ID NO: 519260 - RNA, 22 nt, Human
uggagaagucaaagugaacagg

SEQ ID NO: 519261 - RNA, 22 nt, Human
gcccugugagucaugcggcaga

SEQ ID NO: 519262 - RNA, 22 nt, Human
ugauugaagaggugaggaaguu

SEQ ID NO: 519263 - RNA, 22 nt, Human
ucagcuuuggucacauugaguu

SEQ ID NO: 519264 - RNA, 22 nt, Human
cucugggcugccuuuuagcucu

SEQ ID NO: 519265 - RNA, 22 nt, Human
cugagccaaaaagcagagcuug

SEQ ID NO: 519266 - RNA, 22 nt, Human
cacccaggcagguggcugagaa

SEQ ID NO: 519267 - RNA, 22 nt, Human
uguccuccagcagcaugguaug

SEQ ID NO: 519268 - RNA, 22 nt, Human
uggccagcccucuucccacacu

SEQ ID NO: 519269 - RNA, 22 nt, Human
ugugcuucugcagagacuauuu

SEQ ID NO: 519270 - RNA, 22 nt, Human
gaaguucuuuauagcaguguga

SEQ ID NO: 519271 - RNA, 22 nt, Human
acuuagaauuaaauauuuuugg

SEQ ID NO: 519272 - RNA, 22 nt, Human
uucuggagagaaaccuuacaaa

SEQ ID NO: 519273 - RNA, 22 nt, Human
gucuucuguucugugaggcuuc

SEQ ID NO: 519274 - RNA, 22 nt, Human
ugggcccugacuucaagcaucc

SEQ ID NO: 519275 - RNA, 20 nt, Human
ugagugauggaggcggguca

SEQ ID NO: 519276 - RNA, 22 nt, Human
cggagcugccugccaagccugc

SEQ ID NO: 519277 - RNA, 22 nt, Human
uccugcaggcuugaguccucag

SEQ ID NO: 519278 - RNA, 22 nt, Human
ucagaagcugguguccuuugaa

SEQ ID NO: 519279 - RNA, 23 nt, Human
uggccaggguacuacacccaccc

SEQ ID NO: 519280 - RNA, 22 nt, Human
gauuuccuagacauggggcaga

SEQ ID NO: 519281 - RNA, 22 nt, Human
ggcuguggccagcggggcugag

SEQ ID NO: 519282 - RNA, 22 nt, Human
gucacccugcuguuuguccauu

SEQ ID NO: 519283 - RNA, 22 nt, Human
ucccaguguggcaggccaugga

SEQ ID NO: 519284 - RNA, 22 nt, Human
caauguaucaagaagcaucagu

SEQ ID NO: 519285 - RNA, 23 nt, Human
aggauguaggauguauggcagag

SEQ ID NO: 519286 - RNA, 22 nt, Human
ugggcuucuggaguggggcaga

SEQ ID NO: 519287 - RNA, 22 nt, Human
uucaaauuaccacauuugcuua

SEQ ID NO: 519288 - RNA, 22 nt, Human
ugcccugucuaagcugucagua

SEQ ID NO: 519289 - RNA, 22 nt, Human
uagugaaauuuaugcacagcua

SEQ ID NO: 519290 - RNA, 22 nt, Human
uccuggcccacuaugccagcau

SEQ ID NO: 519291 - RNA, 22 nt, Human
uuaaagcacuaaaugaugaggg

SEQ ID NO: 519292 - RNA, 22 nt, Human
aagcuggacucugccauuuacu

SEQ ID NO: 519293 - RNA, 22 nt, Human
agaggagcuuuuggaaaaggcc

SEQ ID NO: 519294 - RNA, 22 nt, Human
ccagcuccucuugucucuagca

SEQ ID NO: 519295 - RNA, 22 nt, Human
ccagcccuucccaacuggccag

SEQ ID NO: 519296 - RNA, 22 nt, Human
ggccaagauggaaggagagaug

SEQ ID NO: 519297 - RNA, 22 nt, Human
ucuggcucaaaauacguacucu

SEQ ID NO: 519298 - RNA, 22 nt, Human
aaaguuugcaauuuauguuaau

SEQ ID NO: 519299 - RNA, 22 nt, Human
ggcagucccaggcugcauguug

SEQ ID NO: 519300 - RNA, 22 nt, Human
ccaggcagagggaauagcaagu

SEQ ID NO: 519301 - RNA, 22 nt, Human
uucagagaagcaaaggcagauu

SEQ ID NO: 519302 - RNA, 22 nt, Human
cuggcucaauaaauauuagcug

SEQ ID NO: 519303 - RNA, 23 nt, Human
ugauugaaaugaggaguauuugu

SEQ ID NO: 519304 - RNA, 22 nt, Human
uugaaaggguuaaagugguaaa

SEQ ID NO: 519305 - RNA, 22 nt, Human
aagauguaaaggcaauauaaag

SEQ ID NO: 519306 - RNA, 22 nt, Human
uuugcuuuugugcucuaguggu

SEQ ID NO: 519307 - RNA, 22 nt, Human
cuugccuguggcuaguuggcuc

SEQ ID NO: 519308 - RNA, 22 nt, Human
ccugucugcggaggaguggaag

SEQ ID NO: 519309 - RNA, 22 nt, Human
uggagcugucacucagaaccaa

SEQ ID NO: 519310 - RNA, 22 nt, Human
aggugccagcucucaggcagga

SEQ ID NO: 519311 - RNA, 22 nt, Human
caggcacuggggaugcugggau

SEQ ID NO: 519312 - RNA, 22 nt, Human
cagagucuuguguguucagccc

SEQ ID NO: 519313 - RNA, 22 nt, Human
aaacagcugggagguagaggcg

SEQ ID NO: 519314 - RNA, 22 nt, Human
uguuucaugauugcugucauuu

SEQ ID NO: 519315 - RNA, 22 nt, Human
uguggccaccagagcugcuauu

SEQ ID NO: 519316 - RNA, 22 nt, Human
ugaaaucaucugccaauaaguu

SEQ ID NO: 519317 - RNA, 22 nt, Human
cucuggcucccgcagcccccau

SEQ ID NO: 519318 - RNA, 22 nt, Human
uagguucacugucuugaggagc

SEQ ID NO: 519319 - RNA, 22 nt, Human
ggagggccccuccagugggcag

SEQ ID NO: 519320 - RNA, 22 nt, Human
aaccauuugccauuaucuuaag

SEQ ID NO: 519321 - RNA, 22 nt, Human
ugaccccacugugcucagaggu

SEQ ID NO: 519322 - RNA, 22 nt, Human
uucaggauucuuucagacuggg

SEQ ID NO: 519323 - RNA, 22 nt, Human
uaaggcacccauguucauacag

SEQ ID NO: 519324 - RNA, 22 nt, Human
ugcuggggguucagaugaguaa

SEQ ID NO: 519325 - RNA, 22 nt, Human
uggcccuguggaggucagugag

SEQ ID NO: 519326 - RNA, 22 nt, Human
agcagcugcagggagggucugc

SEQ ID NO: 519327 - RNA, 22 nt, Human
auuugaagaaaguuuucuagau

SEQ ID NO: 519328 - RNA, 22 nt, Human
uccuggaucagcgggggcaggc

SEQ ID NO: 519329 - RNA, 22 nt, Human
ccugggucuccuccugcuggcu

SEQ ID NO: 519330 - RNA, 22 nt, Human
ucucagagugguggucccucug

SEQ ID NO: 519331 - RNA, 22 nt, Human
gaaacauuguguucuacagauu

SEQ ID NO: 519332 - RNA, 20 nt, Human
gugaccagaagacagugggu

SEQ ID NO: 519333 - RNA, 22 nt, Human
uaccuguuuuaaagcuaaaagg

SEQ ID NO: 519334 - RNA, 22 nt, Human
gucugggcaggaaucugcauuc

SEQ ID NO: 519335 - RNA, 22 nt, Human
cucugguuucgcaggaaauaga

SEQ ID NO: 519336 - RNA, 22 nt, Human
uagcagcuuaaguaauuagaau

SEQ ID NO: 519337 - RNA, 22 nt, Human
gucugggcaucagacugcgggc

SEQ ID NO: 519338 - RNA, 22 nt, Human
uaugcacacauuagcacagggu

SEQ ID NO: 519339 - RNA, 22 nt, Human
cccaggcugcaugaguccaugg

SEQ ID NO: 519340 - RNA, 22 nt, Human
cuccugcaagccuccccaagca

SEQ ID NO: 519341 - RNA, 22 nt, Human
agcagggcugcagugugucuuu

SEQ ID NO: 519342 - RNA, 22 nt, Human
cauuuguuuagaagucuuuaua

SEQ ID NO: 519343 - RNA, 22 nt, Human
augggaugcauggcuguggcca

SEQ ID NO: 519344 - RNA, 17 nt, Human
gaggacagggaaguagg

SEQ ID NO: 519345 - RNA, 22 nt, Human
caggaggaggugagguagaacu

SEQ ID NO: 519346 - RNA, 22 nt, Human
gggcugagucugcugccuguca

SEQ ID NO: 519347 - RNA, 22 nt, Human
ugacacagaaauuaagcuguca

SEQ ID NO: 519348 - RNA, 22 nt, Human
ucucaagaucucaagauggccc

SEQ ID NO: 519349 - RNA, 22 nt, Human
ucacagaagcuugaagauuuuc

SEQ ID NO: 519350 - RNA, 22 nt, Human
acagagguaggacaugagauau

SEQ ID NO: 519351 - RNA, 22 nt, Human
ggcuucuuuuuaguaaauguca

SEQ ID NO: 519352 - RNA, 22 nt, Human
caaaugcagucccuuuguugcu

SEQ ID NO: 519353 - RNA, 23 nt, Human
ccugggcauuggcugcagcuucu

SEQ ID NO: 519354 - RNA, 21 nt, Human
agagacugucacugcaguacc

SEQ ID NO: 519355 - RNA, 22 nt, Human
ccuccugggacaggcuggcaca

SEQ ID NO: 519356 - RNA, 22 nt, Human
uccccacacagauacagaguag

SEQ ID NO: 519357 - RNA, 22 nt, Human
ucagugcaggaauuuccuuaga

SEQ ID NO: 519358 - RNA, 22 nt, Human
cccaggcaucccauuaaggagc

SEQ ID NO: 519359 - RNA, 22 nt, Human
auguuacagaaagcaaagauga

SEQ ID NO: 519360 - RNA, 22 nt, Human
cacucaggguacaauggagggc

SEQ ID NO: 519361 - RNA, 22 nt, Human
gccugcuguuaacugcaggaau

SEQ ID NO: 519362 - RNA, 22 nt, Human
gcacacaguauaugcucauuaa

SEQ ID NO: 519363 - RNA, 22 nt, Human
uugaaauacugcauuguucagu

SEQ ID NO: 519364 - RNA, 22 nt, Human
ucacagaauuuuugcuuccagu

SEQ ID NO: 519365 - RNA, 22 nt, Human
aucaguuucacuugcuugcaaa

SEQ ID NO: 519366 - RNA, 22 nt, Human
auuauguagcuaaaaauugugu

SEQ ID NO: 519367 - RNA, 22 nt, Human
augcacaaacccacaauuaguc

SEQ ID NO: 519368 - RNA, 22 nt, Human
agauguguuucuaguuccugca

SEQ ID NO: 519369 - RNA, 22 nt, Human
ucuggcucuccagugcucuuag

SEQ ID NO: 519370 - RNA, 22 nt, Human
ccauggcauuuuaugugucuua

SEQ ID NO: 519371 - RNA, 22 nt, Human
aggccucuucagggagcaugga

SEQ ID NO: 519372 - RNA, 22 nt, Human
uuccaaguccagccaggccaaa

SEQ ID NO: 519373 - RNA, 22 nt, Human
uacacagaaauuguguagggau

SEQ ID NO: 519374 - RNA, 22 nt, Human
aagguacagaaauuaacaagga

SEQ ID NO: 519375 - RNA, 22 nt, Human
aucaggaucacugggagucuug

SEQ ID NO: 519376 - RNA, 19 nt, Human
ugaaauggcaguugcuaaa

SEQ ID NO: 519377 - RNA, 22 nt, Human
cucugaccauucccuugauuuu

SEQ ID NO: 519378 - RNA, 22 nt, Human
ggagaaggugcuggucacugug

SEQ ID NO: 519379 - RNA, 20 nt, Human
aaucucaguauccuaugcaa

SEQ ID NO: 519380 - RNA, 22 nt, Human
gcugggcugcccaaccucugac

SEQ ID NO: 519381 - RNA, 22 nt, Human
cuucuuccaguuauaagagcuu

SEQ ID NO: 519382 - RNA, 22 nt, Human
agccuggauccauguggcuacc

SEQ ID NO: 519383 - RNA, 22 nt, Human
augaugcuguuuaucauauacu

SEQ ID NO: 519384 - RNA, 22 nt, Human
uggcuggcuagugggcaggauu

SEQ ID NO: 519385 - RNA, 21 nt, Human
agcugcuccagggagcucagg

SEQ ID NO: 519386 - RNA, 22 nt, Human
cuuucacagcacaagccugccu

SEQ ID NO: 519387 - RNA, 22 nt, Human
gcugucaggaacaugccuuggu

SEQ ID NO: 519388 - RNA, 22 nt, Human
gggauggggucaacauguaccu

SEQ ID NO: 519389 - RNA, 22 nt, Human
gccugucugcagggcugucauu

SEQ ID NO: 519390 - RNA, 22 nt, Human
gccuggagcucggcugagggcg

SEQ ID NO: 519391 - RNA, 22 nt, Human
agaauaugaucggaauacagau

SEQ ID NO: 519392 - RNA, 22 nt, Human
uauguacaaucagcaguucaua

SEQ ID NO: 519393 - RNA, 22 nt, Human
uuuaucuuuaggacuuugcaga

SEQ ID NO: 519394 - RNA, 22 nt, Human
agcuggccuguuagagcugagu

SEQ ID NO: 519395 - RNA, 21 nt, Human
gauaaaaugggccuugguccu

SEQ ID NO: 519396 - RNA, 22 nt, Human
ucacacacauaaucuaagauua

SEQ ID NO: 519397 - RNA, 23 nt, Human
uagcaaaguuguuugggaaauuu

SEQ ID NO: 519398 - RNA, 22 nt, Human
gagaggucaucucccaucagca

SEQ ID NO: 519399 - RNA, 18 nt, Human
cuguccaguagacucugc

SEQ ID NO: 519400 - RNA, 22 nt, Human
agcagcauuaugauauaucuua

SEQ ID NO: 519401 - RNA, 23 nt, Human
agcaauaagaagggauacaugug

SEQ ID NO: 519402 - RNA, 19 nt, Human
aggaaagguggccuuagca

SEQ ID NO: 519403 - RNA, 22 nt, Human
cauuucuaagaaggcugcacau

SEQ ID NO: 519404 - RNA, 22 nt, Human
uccaguccuaucugcccuugga

SEQ ID NO: 519405 - RNA, 22 nt, Human
caccaucagcagcaggugucaa

SEQ ID NO: 519406 - RNA, 22 nt, Human
gcauggccuugugcuccuucuc

SEQ ID NO: 519407 - RNA, 22 nt, Human
ggagcugugcagugacuacaga

SEQ ID NO: 519408 - RNA, 22 nt, Human
caguguuccaggcggcagugaa

SEQ ID NO: 519409 - RNA, 22 nt, Human
caggagcucacagucuuugggu

SEQ ID NO: 519410 - RNA, 22 nt, Human
caagagcugcaaauagcgugac

SEQ ID NO: 519411 - RNA, 22 nt, Human
gaaucaauuauccaggcuguug

SEQ ID NO: 519412 - RNA, 23 nt, Human
augcccugugcagaaauguggaa

SEQ ID NO: 519413 - RNA, 22 nt, Human
uuuguagaacuauacuuacauu

SEQ ID NO: 519414 - RNA, 22 nt, Human
ucuuugcaugcauuuucccuua

SEQ ID NO: 519415 - RNA, 22 nt, Human
gggccccaaaaugccaggcucu

SEQ ID NO: 519416 - RNA, 21 nt, Human
ggagucauuagucauuuccuu

SEQ ID NO: 519417 - RNA, 22 nt, Human
gcugcccuaauaucacauguua

SEQ ID NO: 519418 - RNA, 22 nt, Human
agcugccacaugcccaagggca

SEQ ID NO: 519419 - RNA, 22 nt, Human
caacagcucagacacgggaccu

SEQ ID NO: 519420 - RNA, 22 nt, Human
aaaaguauccacagcucaggag

SEQ ID NO: 519421 - RNA, 22 nt, Human
ucaguuuuuguuugccagauag

SEQ ID NO: 519422 - RNA, 22 nt, Human
ucaggcugcccguucagggcuc

SEQ ID NO: 519423 - RNA, 22 nt, Human
gcugccugguuucucagcugca

SEQ ID NO: 519424 - RNA, 22 nt, Human
aucaggaugaagcuguagcgaa

SEQ ID NO: 519425 - RNA, 22 nt, Human
gaagcagcucagauugacugaa

SEQ ID NO: 519426 - RNA, 22 nt, Human
uugggcucaggaguuugagacc

SEQ ID NO: 519427 - RNA, 22 nt, Human
gugcagcaaaguuugagauaua

SEQ ID NO: 519428 - RNA, 22 nt, Human
agcugcugcggaaagaugccac

SEQ ID NO: 519429 - RNA, 22 nt, Human
cuggugcuggagccuagucccu

SEQ ID NO: 519430 - RNA, 22 nt, Human
cauuaagauuuuuuucuacugg

SEQ ID NO: 519431 - RNA, 17 nt, Human
aauagcugcucagagag

SEQ ID NO: 519432 - RNA, 22 nt, Human
uaaauucccaacucugcucuuc

SEQ ID NO: 519433 - RNA, 22 nt, Human
uaugcauaugaccccaagcuug

SEQ ID NO: 519434 - RNA, 22 nt, Human
cuguauuuucaugccuacguac

SEQ ID NO: 519435 - RNA, 22 nt, Human
aaguccuuggagaauagaaagg

SEQ ID NO: 519436 - RNA, 20 nt, Human
ugaugguucuuuccggguug

SEQ ID NO: 519437 - RNA, 22 nt, Human
cugcagccuccuccagcuacgu

SEQ ID NO: 519438 - RNA, 22 nt, Human
ccucaggaaaugaauaaauggc

SEQ ID NO: 519439 - RNA, 17 nt, Human
gcacauguguucuuuua

SEQ ID NO: 519440 - RNA, 22 nt, Human
uauuagcucaugauuucggugg

SEQ ID NO: 519441 - RNA, 22 nt, Human
caugcagugacucagacacagg

SEQ ID NO: 519442 - RNA, 22 nt, Human
aguccuggguucugguguuuug

SEQ ID NO: 519443 - RNA, 22 nt, Human
acuuguucauugaguacauaug

SEQ ID NO: 519444 - RNA, 22 nt, Human
ucugggcuugccugguugugca

SEQ ID NO: 519445 - RNA, 22 nt, Human
gaaaggagggaaacagagcggu

SEQ ID NO: 519446 - RNA, 22 nt, Human
gcagccacuaguuuuccuguuu

SEQ ID NO: 519447 - RNA, 22 nt, Human
uuugaaguaccugguucugacu

SEQ ID NO: 519448 - RNA, 22 nt, Human
cagggguggcugcagcagaggu

SEQ ID NO: 519449 - RNA, 22 nt, Human
acagaacuuccugcuggagugg

SEQ ID NO: 519450 - RNA, 22 nt, Human
acacuacaaucucagaacuaua

SEQ ID NO: 519451 - RNA, 22 nt, Human
cuucccuucugugcagggcaga

SEQ ID NO: 519452 - RNA, 22 nt, Human
ucuucaaagaauuuuaguaauu

SEQ ID NO: 519453 - RNA, 22 nt, Human
ucauacauucagcagauauuug

SEQ ID NO: 519454 - RNA, 22 nt, Human
ugagccugcugucgcuggaccc

SEQ ID NO: 519455 - RNA, 20 nt, Human
aggaaaaauggaaacuggag

SEQ ID NO: 519456 - RNA, 22 nt, Human
uagagugguuaacaguuuagaa

SEQ ID NO: 519457 - RNA, 21 nt, Human
agcagcugcaguuucuaucug

SEQ ID NO: 519458 - RNA, 22 nt, Human
cagcaggaccauugaggcauca

SEQ ID NO: 519459 - RNA, 22 nt, Human
ggagccaggggaccuucacaga

SEQ ID NO: 519460 - RNA, 18 nt, Human
gcugagguggugucagag

SEQ ID NO: 519461 - RNA, 22 nt, Human
acaaaaauuagcugggcauggu

SEQ ID NO: 519462 - RNA, 22 nt, Human
cacauaagaaaugaauaugaga

SEQ ID NO: 519463 - RNA, 22 nt, Human
uagggcuccacucccagagauu

SEQ ID NO: 519464 - RNA, 22 nt, Human
cacccuggaaagaaggucuggg

SEQ ID NO: 519465 - RNA, 22 nt, Human
caggagugucuccacacagcaa

SEQ ID NO: 519466 - RNA, 22 nt, Human
gcaguuccuacaguggaaagcg

SEQ ID NO: 519467 - RNA, 22 nt, Human
gcagacagccagacugcacugg

SEQ ID NO: 519468 - RNA, 22 nt, Human
uauuccaaaaucccaaacugcc

SEQ ID NO: 519469 - RNA, 19 nt, Human
ucugaaguccagggcauac

SEQ ID NO: 519470 - RNA, 18 nt, Human
ccuggaccugucuccuuu

SEQ ID NO: 519471 - RNA, 22 nt, Human
uucagagccacuucaagucuaa

SEQ ID NO: 519472 - RNA, 22 nt, Human
ugcuggggcucugaccacucca

SEQ ID NO: 519473 - RNA, 19 nt, Human
cagaaauagcgaaguguaa

SEQ ID NO: 519474 - RNA, 22 nt, Human
gcaggcuccaaggccugggaga

SEQ ID NO: 519475 - RNA, 22 nt, Human
cuguggcugcagaccuuaaaca

SEQ ID NO: 519476 - RNA, 20 nt, Human
aagagaagaagucuuugaaa

SEQ ID NO: 519477 - RNA, 22 nt, Human
acaaagugcacaagaugagaac

SEQ ID NO: 519478 - RNA, 22 nt, Human
ucacagaacaagccugguggag

SEQ ID NO: 519479 - RNA, 22 nt, Human
gaagccaacauuccaaguagaa

SEQ ID NO: 519480 - RNA, 22 nt, Human
aaaaugagacacaugugacucc

SEQ ID NO: 519481 - RNA, 22 nt, Human
ucaaagucauggcuaguaauga

SEQ ID NO: 519482 - RNA, 22 nt, Human
ugucccuggaacuauggcucca

SEQ ID NO: 519483 - RNA, 22 nt, Human
agaaaggaggaagaaugaccuc

SEQ ID NO: 519484 - RNA, 22 nt, Human
uauuuagaacagacaauagaaa

SEQ ID NO: 519485 - RNA, 22 nt, Human
uucucuucaucucaguaaaugu

SEQ ID NO: 519486 - RNA, 22 nt, Human
gaauaacagcaaguuugcaggc

SEQ ID NO: 519487 - RNA, 22 nt, Human
accuggcuucuaaucauggcuc

SEQ ID NO: 519488 - RNA, 22 nt, Human
aggugcugccccgagaaggaug

SEQ ID NO: 519489 - RNA, 22 nt, Human
caggaacagcaccaggagcuag

SEQ ID NO: 519490 - RNA, 22 nt, Human
acaaaggugcgucccuucagcu

SEQ ID NO: 519491 - RNA, 23 nt, Human
gccuucagcucgggaaggcuccc

SEQ ID NO: 519492 - RNA, 22 nt, Human
cuccaggccagggaaguggaca

SEQ ID NO: 519493 - RNA, 22 nt, Human
aagccagauagaagaacucauu

SEQ ID NO: 519494 - RNA, 22 nt, Human
cagaggccccagaacuagcucu

SEQ ID NO: 519495 - RNA, 22 nt, Human
uuucacacuagucagaauacca

SEQ ID NO: 519496 - RNA, 22 nt, Human
ggccaucugccucaaugugugc

SEQ ID NO: 519497 - RNA, 22 nt, Human
gagcuuggugcugccuguuguc

SEQ ID NO: 519498 - RNA, 22 nt, Human
ccuggcuccagcugccuguccu

SEQ ID NO: 519499 - RNA, 20 nt, Human
cagagcuguuauggaugaug

SEQ ID NO: 519500 - RNA, 19 nt, Human
ggauucugcaguuuucaca

SEQ ID NO: 519501 - RNA, 22 nt, Human
ugugggaggaacacagccagaa

SEQ ID NO: 519502 - RNA, 22 nt, Human
ucuggggauaagacccagguau

SEQ ID NO: 519503 - RNA, 22 nt, Human
gcagggccagggcucaggcugu

SEQ ID NO: 519504 - RNA, 22 nt, Human
uuagccauggacugaauugacu

SEQ ID NO: 519505 - RNA, 22 nt, Human
aacguccucaccuguaacuugg

SEQ ID NO: 519506 - RNA, 22 nt, Human
uaaagccacuucauucuagucu

SEQ ID NO: 519507 - RNA, 22 nt, Human
uuuauacuccacucugcaagcg

SEQ ID NO: 519508 - RNA, 22 nt, Human
ucucuucuuuggggugggcuca

SEQ ID NO: 519509 - RNA, 22 nt, Human
aagaggccucaccucacugccc

SEQ ID NO: 519510 - RNA, 22 nt, Human
ucugucacccagagugcagugg

SEQ ID NO: 519511 - RNA, 22 nt, Human
aagugacaaaaggguauccaaa

SEQ ID NO: 519512 - RNA, 22 nt, Human
guccugugaccugcauccugag

SEQ ID NO: 519513 - RNA, 22 nt, Human
uagaaacucaggauacucuucc

SEQ ID NO: 519514 - RNA, 22 nt, Human
caucucaggucugugguucacu

SEQ ID NO: 519515 - RNA, 22 nt, Human
ugcaaggcuugcaauggugauc

SEQ ID NO: 519516 - RNA, 22 nt, Human
uaauuuugcugugaccauugaa

SEQ ID NO: 519517 - RNA, 21 nt, Human
aagaacuauugagguacacag

SEQ ID NO: 519518 - RNA, 15 nt, Human
ugggcagaucacuug

SEQ ID NO: 519519 - RNA, 22 nt, Human
gagguuccccauuguacuggcu

SEQ ID NO: 519520 - RNA, 22 nt, Human
gaaguucuuugcuccccaguac

SEQ ID NO: 519521 - RNA, 22 nt, Human
ccuuggagcggucagcacuggu

SEQ ID NO: 519522 - RNA, 22 nt, Human
aagccuucccuuuuugagcuca

SEQ ID NO: 519523 - RNA, 22 nt, Human
guauuagcuguuagcuacauca

SEQ ID NO: 519524 - RNA, 18 nt, Human
gcuccuggagucugacuc

SEQ ID NO: 519525 - RNA, 22 nt, Human
auauuucuugagcaccugguau

SEQ ID NO: 519526 - RNA, 22 nt, Human
acaaaugcagcauaaagugaac

SEQ ID NO: 519527 - RNA, 22 nt, Human
cuucagagaguccagggacugc

SEQ ID NO: 519528 - RNA, 22 nt, Human
ugggaagguacacgggaaagag

SEQ ID NO: 519529 - RNA, 22 nt, Human
ugaggaggucagagucuggcug

SEQ ID NO: 519530 - RNA, 22 nt, Human
cuguugcaucauggcucuuaau

SEQ ID NO: 519531 - RNA, 22 nt, Human
ccuuagcagggccgggccuggg

SEQ ID NO: 519532 - RNA, 23 nt, Human
cauggcagcaagagcucauggcc

SEQ ID NO: 519533 - RNA, 22 nt, Human
aaauaguuuagcucucauuuca

SEQ ID NO: 519534 - RNA, 22 nt, Human
aaaauccacaacgcucauuuca

SEQ ID NO: 519535 - RNA, 22 nt, Human
caugugucaaaugauguagcug

SEQ ID NO: 519536 - RNA, 22 nt, Human
accuguuuagaaagcuuaugag

SEQ ID NO: 519537 - RNA, 22 nt, Human
aagagucuauuggaacuagaca

SEQ ID NO: 519538 - RNA, 22 nt, Human
cacauuccuggugcucagcagc

SEQ ID NO: 519539 - RNA, 22 nt, Human
uggcccugaggacccagugugg

SEQ ID NO: 519540 - RNA, 22 nt, Human
ucugccagguggggagaggcca

SEQ ID NO: 519541 - RNA, 22 nt, Human
caaggccaagucucugugaaga

SEQ ID NO: 519542 - RNA, 22 nt, Human
ucacagaaggaccuuguuucau

SEQ ID NO: 519543 - RNA, 22 nt, Human
guggcuuuauaggaagaggaac

SEQ ID NO: 519544 - RNA, 22 nt, Human
gugcugaauugugcucuuuaca

SEQ ID NO: 519545 - RNA, 22 nt, Human
ggcuucugaaaucucugugcgu

SEQ ID NO: 519546 - RNA, 22 nt, Human
agggagagaaguuauacaagau

SEQ ID NO: 519547 - RNA, 22 nt, Human
ucccugcuuucuugugagggga

SEQ ID NO: 519548 - RNA, 20 nt, Human
agggucugaugugguggccc

SEQ ID NO: 519549 - RNA, 22 nt, Human
ucacaaagcuuugauaagcaga

SEQ ID NO: 519550 - RNA, 22 nt, Human
aucuggcuggauucuuagcguu

SEQ ID NO: 519551 - RNA, 23 nt, Human
agaagcagcuucuggaguaucgg

SEQ ID NO: 519552 - RNA, 22 nt, Human
augaaaugcugagaggugcuuc

SEQ ID NO: 519553 - RNA, 22 nt, Human
caguuucugggcguucacaggu

SEQ ID NO: 519554 - RNA, 22 nt, Human
ccuggccagccagggcuggggu

SEQ ID NO: 519555 - RNA, 22 nt, Human
aguacauuuauuaaugguaaaa

SEQ ID NO: 519556 - RNA, 22 nt, Human
aagaagcuguagggauuaacuc

SEQ ID NO: 519557 - RNA, 22 nt, Human
cuguccuguacuuugaggcccu

SEQ ID NO: 519558 - RNA, 22 nt, Human
cauugcacuucugcuuuuccuc

SEQ ID NO: 519559 - RNA, 22 nt, Human
ggggauggaauguaguagugau

SEQ ID NO: 519560 - RNA, 22 nt, Human
ucagagugcagcgggaggcugg

SEQ ID NO: 519561 - RNA, 22 nt, Human
cagucucacccuggaggcccca

SEQ ID NO: 519562 - RNA, 22 nt, Human
aagguacaccaaaguucaaguu

SEQ ID NO: 519563 - RNA, 22 nt, Human
ccugggaggcggagguugcagg

SEQ ID NO: 519564 - RNA, 22 nt, Human
acugggcuggggcucauucucc

SEQ ID NO: 519565 - RNA, 18 nt, Human
cccggcuaauuuuuggua

SEQ ID NO: 519566 - RNA, 18 nt, Human
acaaaggucugcaagacc

SEQ ID NO: 519567 - RNA, 21 nt, Human
acagccaggaacaugaggggc

SEQ ID NO: 519568 - RNA, 22 nt, Human
gaguggagcaaaagagguagau

SEQ ID NO: 519569 - RNA, 22 nt, Human
acuauaaaaggauaaaccagaa

SEQ ID NO: 519570 - RNA, 22 nt, Human
cuucaguucuaaaguagaaugu

SEQ ID NO: 519571 - RNA, 22 nt, Human
cuccaaguccgagggcucucaa

SEQ ID NO: 519572 - RNA, 22 nt, Human
aggagcugagggagcgcccuug

SEQ ID NO: 519573 - RNA, 22 nt, Human
aucuagaaaguguugaagauca

SEQ ID NO: 519574 - RNA, 22 nt, Human
agaccugggugcccugugcuuu

SEQ ID NO: 519575 - RNA, 22 nt, Human
gcugcuggaacaaaucacccca

SEQ ID NO: 519576 - RNA, 22 nt, Human
gagauuggauuuaauggccaaa

SEQ ID NO: 519577 - RNA, 22 nt, Human
gcuggcuguuggagguaccugc

SEQ ID NO: 519578 - RNA, 22 nt, Human
uuugaaaguucuucugacacua

SEQ ID NO: 519579 - RNA, 22 nt, Human
gcagggaagacccggagcagcg

SEQ ID NO: 519580 - RNA, 22 nt, Human
gaagucauccacuaugggggag

SEQ ID NO: 519581 - RNA, 22 nt, Human
cccaguguuacgugacagccug

SEQ ID NO: 519582 - RNA, 20 nt, Human
agcuucagcccuaggauugc

SEQ ID NO: 519583 - RNA, 22 nt, Human
cucucuggguccucuuuuauag

SEQ ID NO: 519584 - RNA, 21 nt, Human
gggugcuguggucaugcagga

SEQ ID NO: 519585 - RNA, 22 nt, Human
cagagcugucauuugccaguga

SEQ ID NO: 519586 - RNA, 22 nt, Human
aaugcaguuucauuuguagaau

SEQ ID NO: 519587 - RNA, 22 nt, Human
ccaggcucagcgcgcacgucug

SEQ ID NO: 519588 - RNA, 22 nt, Human
uccugccuaccuugcggaggug

SEQ ID NO: 519589 - RNA, 22 nt, Human
aagagaaggcccugacccaccc

SEQ ID NO: 519590 - RNA, 22 nt, Human
gggguccucggagccugggucu

SEQ ID NO: 519591 - RNA, 22 nt, Human
agccucucuuucugguggcuaa

SEQ ID NO: 519592 - RNA, 22 nt, Human
aauuucagagguagagauucua

SEQ ID NO: 519593 - RNA, 20 nt, Human
aguuugugugucuaugcgcu

SEQ ID NO: 519594 - RNA, 22 nt, Human
aggagcugucauuugauucaca

SEQ ID NO: 519595 - RNA, 22 nt, Human
uauuuggacaccaaguagaagu

SEQ ID NO: 519596 - RNA, 22 nt, Human
ggaccugcccuggcucagaugc

SEQ ID NO: 519597 - RNA, 22 nt, Human
gaccauuuguugaaaagauuau

SEQ ID NO: 519598 - RNA, 22 nt, Human
aaccugagauaauaggagagua

SEQ ID NO: 519599 - RNA, 22 nt, Human
ugacaauacagagagagcaaaa

SEQ ID NO: 519600 - RNA, 22 nt, Human
ucaggaaauggacaucuuugcu

SEQ ID NO: 519601 - RNA, 22 nt, Human
agaggcucugccgccucaggua

SEQ ID NO: 519602 - RNA, 22 nt, Human
caacagaaggaagcagggucag

SEQ ID NO: 519603 - RNA, 22 nt, Human
uggaagcagugauucuugucug

SEQ ID NO: 519604 - RNA, 22 nt, Human
uugucagccagcucgcacucuu

SEQ ID NO: 519605 - RNA, 22 nt, Human
ucuguacauuuggggaccccag

SEQ ID NO: 519606 - RNA, 22 nt, Human
agagacugucacauaacagagg

SEQ ID NO: 519607 - RNA, 22 nt, Human
gagccugaugaaacaggcagac

SEQ ID NO: 519608 - RNA, 22 nt, Human
cucaguguuaaauauaagguau

SEQ ID NO: 519609 - RNA, 22 nt, Human
uaguaucuuucuauauuuccca

SEQ ID NO: 519610 - RNA, 22 nt, Human
cacuggaauauggcguugaacc

SEQ ID NO: 519611 - RNA, 22 nt, Human
uagcauuuggacauugucaccu

SEQ ID NO: 519612 - RNA, 22 nt, Human
uagucuuuuuaauaaauaaugc

SEQ ID NO: 519613 - RNA, 22 nt, Human
auauuuguaaaauucugugucu

SEQ ID NO: 519614 - RNA, 22 nt, Human
uagguucaugaaauuuucagga

SEQ ID NO: 519615 - RNA, 22 nt, Human
ccagaggaugcuggucagccuc

SEQ ID NO: 519616 - RNA, 22 nt, Human
gaggccaggagugcuguaaguu

SEQ ID NO: 519617 - RNA, 20 nt, Human
ccagggcuggcuccugggau

SEQ ID NO: 519618 - RNA, 22 nt, Human
uaaagcagugugguuguguccc

SEQ ID NO: 519619 - RNA, 23 nt, Human
acugggcugaaauuuuucauggc

SEQ ID NO: 519620 - RNA, 22 nt, Human
acagcuggcaggggggcaugaa

SEQ ID NO: 519621 - RNA, 20 nt, Human
aaaggaauauaugaaguaua

SEQ ID NO: 519622 - RNA, 22 nt, Human
uuaauuuauguccaaaccagau

SEQ ID NO: 519623 - RNA, 22 nt, Human
cucccuggugacucccaaagcu

SEQ ID NO: 519624 - RNA, 22 nt, Human
ugcaggucaucccugugcuucu

SEQ ID NO: 519625 - RNA, 22 nt, Human
cugggucugucacuagauaaau

SEQ ID NO: 519626 - RNA, 22 nt, Human
cugcacagcuggccagggagag

SEQ ID NO: 519627 - RNA, 22 nt, Human
ugcuggccucggcgcugggccu

SEQ ID NO: 519628 - RNA, 22 nt, Human
cuggcagcuggaggcuagaggc

SEQ ID NO: 519629 - RNA, 22 nt, Human
uuguccuuggaugaagcuggga

SEQ ID NO: 519630 - RNA, 20 nt, Human
uuauuuguuuacuuuggucc

SEQ ID NO: 519631 - RNA, 22 nt, Human
uucccacaguguugaauccucu

SEQ ID NO: 519632 - RNA, 22 nt, Human
gggucaggcucagcagggcagc

SEQ ID NO: 519633 - RNA, 21 nt, Human
cugccuugaaugguacuggga

SEQ ID NO: 519634 - RNA, 22 nt, Human
gcuggguggaucggaggcucug

SEQ ID NO: 519635 - RNA, 22 nt, Human
gcguggugcugcccugcacaca

SEQ ID NO: 519636 - RNA, 22 nt, Human
agagcugauuugauuacagugc

SEQ ID NO: 519637 - RNA, 17 nt, Human
agcaggcugcagaggcc

SEQ ID NO: 519638 - RNA, 20 nt, Human
gugccuggagaagaggcugu

SEQ ID NO: 519639 - RNA, 22 nt, Human
guaagccugagaaacaccaccu

SEQ ID NO: 519640 - RNA, 22 nt, Human
aucagcaaaaaugccuucagaa

SEQ ID NO: 519641 - RNA, 22 nt, Human
uguuuauugagugccuacuaua

SEQ ID NO: 519642 - RNA, 22 nt, Human
uaaaagacccucuagaguccca

SEQ ID NO: 519643 - RNA, 22 nt, Human
auucaaguccagcuucucuaca

SEQ ID NO: 519644 - RNA, 22 nt, Human
guccuggcuuaguucgcuguaa

SEQ ID NO: 519645 - RNA, 22 nt, Human
aacuuucagaauccuaugcauu

SEQ ID NO: 519646 - RNA, 22 nt, Human
acuuucucaaaucagacuuuaa

SEQ ID NO: 519647 - RNA, 22 nt, Human
ugcaguggaaagacucagacuu

SEQ ID NO: 519648 - RNA, 22 nt, Human
uucacaaagcuggagcauuucc

SEQ ID NO: 519649 - RNA, 21 nt, Human
ggcuggucgcgugcaugucuc

SEQ ID NO: 519650 - RNA, 22 nt, Human
uugcauugugauuacagaggug

SEQ ID NO: 519651 - RNA, 22 nt, Human
auaaacagcuccauuuagugcc

SEQ ID NO: 519652 - RNA, 22 nt, Human
uaucaucuuguugucaugcagc

SEQ ID NO: 519653 - RNA, 22 nt, Human
gcucagaggaugcuccuuuaug

SEQ ID NO: 519654 - RNA, 22 nt, Human
gucaaaaaguagucauuucugu

SEQ ID NO: 519655 - RNA, 21 nt, Human
gagugcagcaagguagagucu

SEQ ID NO: 519656 - RNA, 22 nt, Human
uaacuucuggaaaugcaucugc

SEQ ID NO: 519657 - RNA, 22 nt, Human
cauuuacagugagaguuuuuac

SEQ ID NO: 519658 - RNA, 22 nt, Human
acugggcugguuaguuuuacua

SEQ ID NO: 519659 - RNA, 22 nt, Human
cuuaggauuuaauuucagacuc

SEQ ID NO: 519660 - RNA, 22 nt, Human
cugggccuccacgggccaucac

SEQ ID NO: 519661 - RNA, 22 nt, Human
gcaucuuucuguccauucagca

SEQ ID NO: 519662 - RNA, 22 nt, Human
cuucuugucaauuugccauugu

SEQ ID NO: 519663 - RNA, 22 nt, Human
gagagcugggaaagccguggag

SEQ ID NO: 519664 - RNA, 22 nt, Human
gcuggcuggaggugaggaagaa

SEQ ID NO: 519665 - RNA, 22 nt, Human
uaaaaugacuuccuccaacauc

SEQ ID NO: 519666 - RNA, 22 nt, Human
agagacuggagaugggcagugu

SEQ ID NO: 519667 - RNA, 22 nt, Human
gguccagaguccuugcuagaga

SEQ ID NO: 519668 - RNA, 22 nt, Human
aaaagagguuaaccaggugugu

SEQ ID NO: 519669 - RNA, 22 nt, Human
acaguguucugcuuuuuaaucc

SEQ ID NO: 519670 - RNA, 22 nt, Human
ucucagagaaaugugucaccau

SEQ ID NO: 519671 - RNA, 22 nt, Human
uccuggggccagcacuggugga

SEQ ID NO: 519672 - RNA, 22 nt, Human
cacauuuaauccuuuauaagua

SEQ ID NO: 519673 - RNA, 20 nt, Human
acauguacuaaugaauacag

SEQ ID NO: 519674 - RNA, 22 nt, Human
augucaaacacaacaccagugg

SEQ ID NO: 519675 - RNA, 22 nt, Human
gagagcugggcuuugggugaag

SEQ ID NO: 519676 - RNA, 20 nt, Human
uuguuucugcuauuuucuaa

SEQ ID NO: 519677 - RNA, 22 nt, Human
cugccaggugagcuccaggccu

SEQ ID NO: 519678 - RNA, 22 nt, Human
auaugcauguacgugugcacaa

SEQ ID NO: 519679 - RNA, 22 nt, Human
aacaaauguguggcaguguggg

SEQ ID NO: 519680 - RNA, 22 nt, Human
aaauauuauugcuuaaggggag

SEQ ID NO: 519681 - RNA, 22 nt, Human
acacagggaggaggugcugugc

SEQ ID NO: 519682 - RNA, 22 nt, Human
gagcccagcucuaccucagacu

SEQ ID NO: 519683 - RNA, 22 nt, Human
accucuggccuucaggcaucau

SEQ ID NO: 519684 - RNA, 19 nt, Human
ccugggagucagcugaagg

SEQ ID NO: 519685 - RNA, 22 nt, Human
gcguccagggaaggcccagcug

SEQ ID NO: 519686 - RNA, 22 nt, Human
ugccaggaggaggugggacaga

SEQ ID NO: 519687 - RNA, 21 nt, Human
ucuguacaucauugagucccc

SEQ ID NO: 519688 - RNA, 22 nt, Human
agcagccauuuaaaaugaauug

SEQ ID NO: 519689 - RNA, 22 nt, Human
guguggcugccagccaagaggc

SEQ ID NO: 519690 - RNA, 22 nt, Human
uccaaguccauuaugguggucu

SEQ ID NO: 519691 - RNA, 20 nt, Human
ggcaggugcucgcuuggucu

SEQ ID NO: 519692 - RNA, 22 nt, Human
uuacaacaaaggcacgugcaug

SEQ ID NO: 519693 - RNA, 22 nt, Human
cacccagggcugugccugccca

SEQ ID NO: 519694 - RNA, 22 nt, Human
aaugcaaacagcccagaaucca

SEQ ID NO: 519695 - RNA, 22 nt, Human
ugagagucucagaccuccuggu

SEQ ID NO: 519696 - RNA, 22 nt, Human
ugucagagcaaugagguucagc

SEQ ID NO: 519697 - RNA, 22 nt, Human
uggcccugcuguaucaucugcu

SEQ ID NO: 519698 - RNA, 17 nt, Human
caaggccagcaucuuca

SEQ ID NO: 519699 - RNA, 22 nt, Human
uugugaguagugccgcaauaaa

SEQ ID NO: 519700 - RNA, 22 nt, Human
caccuguuguuuauucaucucu

SEQ ID NO: 519701 - RNA, 22 nt, Human
agcccagguugaggcugcagug

SEQ ID NO: 519702 - RNA, 22 nt, Human
ucaguccuccucucauagagag

SEQ ID NO: 519703 - RNA, 18 nt, Human
ccucaggggaccuggcag

SEQ ID NO: 519704 - RNA, 22 nt, Human
aaauauagugacacuuauaguc

SEQ ID NO: 519705 - RNA, 22 nt, Human
uguauuuuuaggaaugcgcuau

SEQ ID NO: 519706 - RNA, 22 nt, Human
gugucauuaaccaccaugcaaa

SEQ ID NO: 519707 - RNA, 22 nt, Human
accagugggaaguggaaaauga

SEQ ID NO: 519708 - RNA, 22 nt, Human
auguccuucuccucuuaccugc

SEQ ID NO: 519709 - RNA, 22 nt, Human
uggagaauauuuccaaaucuaa

SEQ ID NO: 519710 - RNA, 22 nt, Human
gggcuucucccuaaggacucug

SEQ ID NO: 519711 - RNA, 20 nt, Human
cccagagccauagccagaca

SEQ ID NO: 519712 - RNA, 22 nt, Human
acaggucuccagagugagagga

SEQ ID NO: 519713 - RNA, 22 nt, Human
gggaggagcugagugugugugc

SEQ ID NO: 519714 - RNA, 22 nt, Human
uauuuguguggguaucuauaua

SEQ ID NO: 519715 - RNA, 22 nt, Human
aagugcaaaucuguggcugaaa

SEQ ID NO: 519716 - RNA, 22 nt, Human
aguggcugauuacaaacugagu

SEQ ID NO: 519717 - RNA, 22 nt, Human
augcagaaggagccaugcuugc

SEQ ID NO: 519718 - RNA, 22 nt, Human
ggcauggccuguaagacggaga

SEQ ID NO: 519719 - RNA, 22 nt, Human
aagcuucaggcccacccauguc

SEQ ID NO: 519720 - RNA, 22 nt, Human
cagaggcugcucuggguggcau

SEQ ID NO: 519721 - RNA, 22 nt, Human
uagcacauaacuuagaauaguu

SEQ ID NO: 519722 - RNA, 22 nt, Human
aacagcuuuagaggauaauagu

SEQ ID NO: 519723 - RNA, 22 nt, Human
aagucaaagcuuucagaggaaa

SEQ ID NO: 519724 - RNA, 23 nt, Human
ucucugggugggcugugucuaua

SEQ ID NO: 519725 - RNA, 22 nt, Human
augcuucuguaaugugggaaug

SEQ ID NO: 519726 - RNA, 22 nt, Human
agccagggaugcagcacaguga

SEQ ID NO: 519727 - RNA, 22 nt, Human
cccaggcuggauuucgguggca

SEQ ID NO: 519728 - RNA, 22 nt, Human
gcaguguuaggaauaaaaauga

SEQ ID NO: 519729 - RNA, 21 nt, Human
gauuucacuuaccuucauuua

SEQ ID NO: 519730 - RNA, 22 nt, Human
ccagcuuuuagugggcuuauua

SEQ ID NO: 519731 - RNA, 22 nt, Human
gcuggcucagggacuagaguuu

SEQ ID NO: 519732 - RNA, 22 nt, Human
caacaccuugaucuuggacuuc

SEQ ID NO: 519733 - RNA, 22 nt, Human
aaccugcaguuuuuauucugag

SEQ ID NO: 519734 - RNA, 22 nt, Human
cuuacaguacuucuaauaugau

SEQ ID NO: 519735 - RNA, 22 nt, Human
agcuguguagggaaucagagaa

SEQ ID NO: 519736 - RNA, 22 nt, Human
acucagcucaggagcuggcugg

SEQ ID NO: 519737 - RNA, 22 nt, Human
uuucuacaguacugauuucaua

SEQ ID NO: 519738 - RNA, 22 nt, Human
gcagcccagagcgcaggacccc

SEQ ID NO: 519739 - RNA, 22 nt, Human
cccuuucccuucuggcucaggg

SEQ ID NO: 519740 - RNA, 22 nt, Human
gggacaggccccucgcuagcuu

SEQ ID NO: 519741 - RNA, 22 nt, Human
ugcuucugacauguucuugguu

SEQ ID NO: 519742 - RNA, 22 nt, Human
ucuagaaaaaaacugcugugga

SEQ ID NO: 519743 - RNA, 22 nt, Human
ccugugucaucagcuguggcua

SEQ ID NO: 519744 - RNA, 22 nt, Human
aucuugugugaugaugagaaag

SEQ ID NO: 519745 - RNA, 22 nt, Human
cugcugugagugguucuugccu

SEQ ID NO: 519746 - RNA, 22 nt, Human
agauaaaaugguucaaaggcua

SEQ ID NO: 519747 - RNA, 22 nt, Human
ucagugcagggugggagagaga

SEQ ID NO: 519748 - RNA, 22 nt, Human
ccagcaggguugguuucuucug

SEQ ID NO: 519749 - RNA, 22 nt, Human
caucacagguccugaugacauu

SEQ ID NO: 519750 - RNA, 22 nt, Human
gcugccucugcgacucugggcg

SEQ ID NO: 519751 - RNA, 22 nt, Human
ucaggaaaauacugcuuaucca

SEQ ID NO: 519752 - RNA, 22 nt, Human
ggucccuggggaacuaggcugu

SEQ ID NO: 519753 - RNA, 22 nt, Human
uaauuauaacaguuacaucuua

SEQ ID NO: 519754 - RNA, 22 nt, Human
accugcagguguuuccacacuu

SEQ ID NO: 519755 - RNA, 22 nt, Human
gagugugggcacgggggccuug

SEQ ID NO: 519756 - RNA, 22 nt, Human
auugaaaaauucacaauucugg

SEQ ID NO: 519757 - RNA, 22 nt, Human
ccaguguuccagagagcugaug

SEQ ID NO: 519758 - RNA, 23 nt, Human
ugaaacauuuaggguagaauuuc

SEQ ID NO: 519759 - RNA, 22 nt, Human
auguccagaguguccuggaaag

SEQ ID NO: 519760 - RNA, 22 nt, Human
uacccaggagaaacagcagggc

SEQ ID NO: 519761 - RNA, 22 nt, Human
gcuguggcuguacagagaccau

SEQ ID NO: 519762 - RNA, 20 nt, Human
guucucacugaucugcaggg

SEQ ID NO: 519763 - RNA, 22 nt, Human
agcauugccugccuauugcuaa

SEQ ID NO: 519764 - RNA, 20 nt, Human
gcugaggucauuaugccuca

SEQ ID NO: 519765 - RNA, 22 nt, Human
agagagcccgggccagggcaca

SEQ ID NO: 519766 - RNA, 22 nt, Human
cugccuuggcccuaguucaugg

SEQ ID NO: 519767 - RNA, 22 nt, Human
gggcuccaucacaggcuccauc

SEQ ID NO: 519768 - RNA, 22 nt, Human
ggcccucccugagccagguggg

SEQ ID NO: 519769 - RNA, 22 nt, Human
gcucugggcugcccucuggaca

SEQ ID NO: 519770 - RNA, 20 nt, Human
uugaaugaaugucuggcuca

SEQ ID NO: 519771 - RNA, 22 nt, Human
augugucauuauccagaauaac

SEQ ID NO: 519772 - RNA, 22 nt, Human
aaauggauggaauugacauuua

SEQ ID NO: 519773 - RNA, 22 nt, Human
caggguggaauggaaugcuggc

SEQ ID NO: 519774 - RNA, 22 nt, Human
cauuuguaucauauguaucuua

SEQ ID NO: 519775 - RNA, 20 nt, Human
ucagaugggagugagccauc

SEQ ID NO: 519776 - RNA, 19 nt, Human
uggccagguacugucugcu

SEQ ID NO: 519777 - RNA, 22 nt, Human
guauuuguaguagcauagaauu

SEQ ID NO: 519778 - RNA, 22 nt, Human
agagucugaggcagcugcagcc

SEQ ID NO: 519779 - RNA, 22 nt, Human
cuuuuucuaaucauaauugucu

SEQ ID NO: 519780 - RNA, 22 nt, Human
aagauguaucaguuaagucuuc

SEQ ID NO: 519781 - RNA, 22 nt, Human
agugcaaagggaucagauuggg

SEQ ID NO: 519782 - RNA, 22 nt, Human
uggcacuugcuucagaugaugu

SEQ ID NO: 519783 - RNA, 22 nt, Human
cucagcuggcaauucuggcucc

SEQ ID NO: 519784 - RNA, 22 nt, Human
aaagcauuauucuguggaaaaa

SEQ ID NO: 519785 - RNA, 22 nt, Human
agcagggcuuugcagacuuggg

SEQ ID NO: 519786 - RNA, 22 nt, Human
gguggccucucaugcaagguag

SEQ ID NO: 519787 - RNA, 22 nt, Human
ccacagugacacgggcuggccc

SEQ ID NO: 519788 - RNA, 22 nt, Human
guccugugagauucaugcucaa

SEQ ID NO: 519789 - RNA, 22 nt, Human
agauacauuaguaguuacuugu

SEQ ID NO: 519790 - RNA, 22 nt, Human
cuauuacauuucuggacauuca

SEQ ID NO: 519791 - RNA, 21 nt, Human
ugggccagaucugaguuucua

SEQ ID NO: 519792 - RNA, 22 nt, Human
caggggcugugggcggagccuc

SEQ ID NO: 519793 - RNA, 22 nt, Human
auugaagauuaaaugcuuccuu

SEQ ID NO: 519794 - RNA, 22 nt, Human
aaguccaucucugccccacaca

SEQ ID NO: 519795 - RNA, 22 nt, Human
aagcccagaugugagaacugag

SEQ ID NO: 519796 - RNA, 22 nt, Human
aauauaauuuuauuccuagagu

SEQ ID NO: 519797 - RNA, 22 nt, Human
ggguccagguuuagucauuugu

SEQ ID NO: 519798 - RNA, 20 nt, Human
cucugggcugcguugcaaac

SEQ ID NO: 519799 - RNA, 22 nt, Human
cugaaccacuaauauuuugauu

SEQ ID NO: 519800 - RNA, 22 nt, Human
ugaggaugagaugagauaacac

SEQ ID NO: 519801 - RNA, 22 nt, Human
uagacagauuuaaaggaaugga

SEQ ID NO: 519802 - RNA, 22 nt, Human
uuuaaauuuguguuuagagggu

SEQ ID NO: 519803 - RNA, 22 nt, Human
aagccuucagaguuggcugguc

SEQ ID NO: 519804 - RNA, 22 nt, Human
cauaauuagucauguuaugcau

SEQ ID NO: 519805 - RNA, 22 nt, Human
gacaccagcaaggcugugagga

SEQ ID NO: 519806 - RNA, 23 nt, Human
agccccucauggugucuagacag

SEQ ID NO: 519807 - RNA, 22 nt, Human
aggguagggccguagggccaug

SEQ ID NO: 519808 - RNA, 22 nt, Human
ucuccuggucaccucagaaguc

SEQ ID NO: 519809 - RNA, 22 nt, Human
uucaaucauugcaaaguaaugg

SEQ ID NO: 519810 - RNA, 22 nt, Human
cccaggucucccugcagcccug

SEQ ID NO: 519811 - RNA, 20 nt, Human
gcaaauggaucccacaagcc

SEQ ID NO: 519812 - RNA, 22 nt, Human
caacuuguucuugguagaucua

SEQ ID NO: 519813 - RNA, 22 nt, Human
ugcagcauuauguagcuguuuu

SEQ ID NO: 519814 - RNA, 22 nt, Human
acucaggaaauugagauaaugg

SEQ ID NO: 519815 - RNA, 22 nt, Human
agucucuuggcauucugaaaca

SEQ ID NO: 519816 - RNA, 21 nt, Human
ugcacuuugggggacaggcug

SEQ ID NO: 519817 - RNA, 22 nt, Human
ccuggccugugaaucugagagc

SEQ ID NO: 519818 - RNA, 22 nt, Human
uuuugccugcacuguauauaua

SEQ ID NO: 519819 - RNA, 22 nt, Human
aggccugaggaccuucuggagg

SEQ ID NO: 519820 - RNA, 22 nt, Human
guucaauuuagaaagcacaguu

SEQ ID NO: 519821 - RNA, 22 nt, Human
gccugaaguuucaugccucuau

SEQ ID NO: 519822 - RNA, 22 nt, Human
augaggcaaggaucagguaagg

SEQ ID NO: 519823 - RNA, 22 nt, Human
ugaggcagucacccccuccugc

SEQ ID NO: 519824 - RNA, 22 nt, Human
ugcaaauagccugaugaaagaa

SEQ ID NO: 519825 - RNA, 22 nt, Human
agccauggcgccacuagaggga

SEQ ID NO: 519826 - RNA, 22 nt, Human
aguuucauauuaccaugucacc

SEQ ID NO: 519827 - RNA, 22 nt, Human
gagugugucggucagcguggcg

SEQ ID NO: 519828 - RNA, 22 nt, Human
auagaaauggcagcuggugcua

SEQ ID NO: 519829 - RNA, 22 nt, Human
acaaaaagcuccauuacugucc

SEQ ID NO: 519830 - RNA, 22 nt, Human
uucccaguauuaccuucaggaa

SEQ ID NO: 519831 - RNA, 18 nt, Human
gccaggaagaggaaugug

SEQ ID NO: 519832 - RNA, 22 nt, Human
aggccuggccuuuauguucaag

SEQ ID NO: 519833 - RNA, 21 nt, Human
aaauguguuccauaaugcuuu

SEQ ID NO: 519834 - RNA, 23 nt, Human
accuggcugcucaaccugcaggg

SEQ ID NO: 519835 - RNA, 23 nt, Human
ugauuuccagugagucaguggga

SEQ ID NO: 519836 - RNA, 22 nt, Human
uccuggaguggagucuguuguu

SEQ ID NO: 519837 - RNA, 22 nt, Human
ucugagagcuguagaagccuau

SEQ ID NO: 519838 - RNA, 22 nt, Human
ggggaaaggccauggcaagaac

SEQ ID NO: 519839 - RNA, 23 nt, Human
ccucucucccuguuuggcaaaua

SEQ ID NO: 519840 - RNA, 22 nt, Human
cagaaugcaaauuuuauaauau

SEQ ID NO: 519841 - RNA, 18 nt, Human
ugucucugaauuccagug

SEQ ID NO: 519842 - RNA, 22 nt, Human
uguuuaauuucacaaaguugac

SEQ ID NO: 519843 - RNA, 19 nt, Human
cuuuucaucaacagccaau

SEQ ID NO: 519844 - RNA, 22 nt, Human
uugaaacaguagcucauagacc

SEQ ID NO: 519845 - RNA, 22 nt, Human
cuggcccugguaaggacaccca

SEQ ID NO: 519846 - RNA, 22 nt, Human
ccucugcagcagagagccagag

SEQ ID NO: 519847 - RNA, 22 nt, Human
agcuccugcgcacggugcacac

SEQ ID NO: 519848 - RNA, 22 nt, Human
gacccugaggaugcaccagcag

SEQ ID NO: 519849 - RNA, 22 nt, Human
cuggcugccacuucagggucuu

SEQ ID NO: 519850 - RNA, 22 nt, Human
caaauguguagagcuuuugggg

SEQ ID NO: 519851 - RNA, 22 nt, Human
gccaggcagauaugugagcuua

SEQ ID NO: 519852 - RNA, 22 nt, Human
gcaaagguagccaaggagcuca

SEQ ID NO: 519853 - RNA, 22 nt, Human
ggaguucacugugcaggcucug

SEQ ID NO: 519854 - RNA, 22 nt, Human
uauuucuaagcuguaagucuga

SEQ ID NO: 519855 - RNA, 23 nt, Human
gaguguucauagcaggcucuugc

SEQ ID NO: 519856 - RNA, 22 nt, Human
ggucaacagagguaaugguaac

SEQ ID NO: 519857 - RNA, 22 nt, Human
gugcaugugcauccauguguac

SEQ ID NO: 519858 - RNA, 22 nt, Human
aaagcaaucagauucagauguc

SEQ ID NO: 519859 - RNA, 22 nt, Human
agaggcugcacuugcucaugau

SEQ ID NO: 519860 - RNA, 22 nt, Human
gggggucccaagcugggcugcu

SEQ ID NO: 519861 - RNA, 22 nt, Human
agagcagcacguuguccccaca

SEQ ID NO: 519862 - RNA, 22 nt, Human
auuaaaagcuucccaagaguua

SEQ ID NO: 519863 - RNA, 22 nt, Human
ccagggcacguugggacaguac

SEQ ID NO: 519864 - RNA, 22 nt, Human
gauccuugcaacucugugaggu

SEQ ID NO: 519865 - RNA, 22 nt, Human
ggagauagacuuggugagccac

SEQ ID NO: 519866 - RNA, 22 nt, Human
caguagcaggcacucagcacgu

SEQ ID NO: 519867 - RNA, 22 nt, Human
uagaaagagcuuugcuuccuuu

SEQ ID NO: 519868 - RNA, 22 nt, Human
aaagauuugaaauuaggcauca

SEQ ID NO: 519869 - RNA, 22 nt, Human
gaaguucuuagucucauuugca

SEQ ID NO: 519870 - RNA, 22 nt, Human
agguggaacguucaggugcuag

SEQ ID NO: 519871 - RNA, 22 nt, Human
augaggcagguggaggcugcca

SEQ ID NO: 519872 - RNA, 22 nt, Human
ccuguauuagguagacaacuau

SEQ ID NO: 519873 - RNA, 22 nt, Human
uggcuuccugcauggauccucu

SEQ ID NO: 519874 - RNA, 19 nt, Human
ugagaaggcaguggggagc

SEQ ID NO: 519875 - RNA, 22 nt, Human
agaaauggaaauccaagcaacu

SEQ ID NO: 519876 - RNA, 22 nt, Human
uggccaggccggggacagaacu

SEQ ID NO: 519877 - RNA, 20 nt, Human
augggcugguuaggaagugu

SEQ ID NO: 519878 - RNA, 22 nt, Human
uuggaaggcccugccuagcagg

SEQ ID NO: 519879 - RNA, 22 nt, Human
cagcucuggcgucagggagcga

SEQ ID NO: 519880 - RNA, 22 nt, Human
auggauaaucaugaacuuugag

SEQ ID NO: 519881 - RNA, 22 nt, Human
agacaugucaccaauucuuacu

SEQ ID NO: 519882 - RNA, 22 nt, Human
cugagaaaggaccucaaacagg

SEQ ID NO: 519883 - RNA, 22 nt, Human
gccugcagccucaagggcugag

SEQ ID NO: 519884 - RNA, 22 nt, Human
cucagagagggcaccagggcca

SEQ ID NO: 519885 - RNA, 22 nt, Human
cugugugcauaguugugcucaa

SEQ ID NO: 519886 - RNA, 22 nt, Human
caggggcaggugugagaucauc

SEQ ID NO: 519887 - RNA, 22 nt, Human
uccucuggaaccucacccuugc

SEQ ID NO: 519888 - RNA, 22 nt, Human
auuccucauuuguugagaacca

SEQ ID NO: 519889 - RNA, 22 nt, Human
ucaaggaaggucuguugcucca

SEQ ID NO: 519890 - RNA, 22 nt, Human
agguggccggugccagccgggc

SEQ ID NO: 519891 - RNA, 22 nt, Human
gccucuggucccucaugcugug

SEQ ID NO: 519892 - RNA, 22 nt, Human
uucaauucaauucuaaauauau

SEQ ID NO: 519893 - RNA, 22 nt, Human
agaccaugggcucugaagagca

SEQ ID NO: 519894 - RNA, 19 nt, Human
agcagcuguagauagacac

SEQ ID NO: 519895 - RNA, 22 nt, Human
agaggcaguauacaauccgagc

SEQ ID NO: 519896 - RNA, 22 nt, Human
caaugaaaauuuaaguugcagc

SEQ ID NO: 519897 - RNA, 22 nt, Human
uuagauaaauuaagacuuuaca

SEQ ID NO: 519898 - RNA, 22 nt, Human
cugcccugcagcuccacggacu

SEQ ID NO: 519899 - RNA, 22 nt, Human
uagaaauccccagucucauagu

SEQ ID NO: 519900 - RNA, 22 nt, Human
aagccagcauuuucccauuccu

SEQ ID NO: 519901 - RNA, 22 nt, Human
gggcccagcacuggcugggauc

SEQ ID NO: 519902 - RNA, 22 nt, Human
gaggcugaggguuagagaguca

SEQ ID NO: 519903 - RNA, 22 nt, Human
ugugccuuaugaauucuuucug

SEQ ID NO: 519904 - RNA, 22 nt, Human
ccuuucucuggcagcaggacag

SEQ ID NO: 519905 - RNA, 21 nt, Human
uuugccuucacgaagcauccu

SEQ ID NO: 519906 - RNA, 22 nt, Human
ccucuggcaagugauuuaucau

SEQ ID NO: 519907 - RNA, 22 nt, Human
acagacagacagagaacuauuc

SEQ ID NO: 519908 - RNA, 20 nt, Human
gccugagcuccgccuccugu

SEQ ID NO: 519909 - RNA, 22 nt, Human
ccucuuuguucaggcugcuggc

SEQ ID NO: 519910 - RNA, 22 nt, Human
guguaauugaaauugagaacca

SEQ ID NO: 519911 - RNA, 22 nt, Human
acuggcaguuugagaaugcauu

SEQ ID NO: 519912 - RNA, 22 nt, Human
uaacagaaaagaacugaguuug

SEQ ID NO: 519913 - RNA, 22 nt, Human
gaggagccuggccccacaucca

SEQ ID NO: 519914 - RNA, 22 nt, Human
uggccacuuggcaugugugcca

SEQ ID NO: 519915 - RNA, 22 nt, Human
ccagagggagccaccagggugu

SEQ ID NO: 519916 - RNA, 22 nt, Human
cauggggagacaccuagggaaa

SEQ ID NO: 519917 - RNA, 22 nt, Human
gggcuggaggugagcaggacag

SEQ ID NO: 519918 - RNA, 22 nt, Human
ugguuuaccccuguccuauauc

SEQ ID NO: 519919 - RNA, 22 nt, Human
cuugcuuuguccagaaauucag

SEQ ID NO: 519920 - RNA, 22 nt, Human
cagagcagagugauuguucugg

SEQ ID NO: 519921 - RNA, 22 nt, Human
ugggcucugcaucagugcccau

SEQ ID NO: 519922 - RNA, 22 nt, Human
uuccaaaguuauucaagcagua

SEQ ID NO: 519923 - RNA, 22 nt, Human
augugcagaggcuuccuugacu

SEQ ID NO: 519924 - RNA, 22 nt, Human
uuuuccucugcaauaaaagcag

SEQ ID NO: 519925 - RNA, 22 nt, Human
ucagcugccccaguggccccag

SEQ ID NO: 519926 - RNA, 22 nt, Human
aacaguaaagacagaauuuauc

SEQ ID NO: 519927 - RNA, 22 nt, Human
aauuuagauugauaaacaugga

SEQ ID NO: 519928 - RNA, 22 nt, Human
cacacaggagagugcuggaggu

SEQ ID NO: 519929 - RNA, 21 nt, Human
cagaaguaaggguaacuucuc

SEQ ID NO: 519930 - RNA, 22 nt, Human
cuuccugaacaaugccaucaau

SEQ ID NO: 519931 - RNA, 22 nt, Human
caucaucaaaacaaauggaguc

SEQ ID NO: 519932 - RNA, 22 nt, Human
aaauaugacuagaaugccaggu

SEQ ID NO: 519933 - RNA, 18 nt, Human
uucagcagcagacacacu

SEQ ID NO: 519934 - RNA, 22 nt, Human
uggcaggcgggagccauagagg

SEQ ID NO: 519935 - RNA, 22 nt, Human
agcagccacagcagaucugagu

SEQ ID NO: 519936 - RNA, 22 nt, Human
aaguacuucuagauggauaauc

SEQ ID NO: 519937 - RNA, 22 nt, Human
aaauacauuuacagucguggcu

SEQ ID NO: 519938 - RNA, 19 nt, Human
gcccugcaggagguggggc

SEQ ID NO: 519939 - RNA, 22 nt, Human
uggcucugaccagguagaggag

SEQ ID NO: 519940 - RNA, 22 nt, Human
accugcaggcacaggugugcgc

SEQ ID NO: 519941 - RNA, 22 nt, Human
gagcagcuagauaaagcccuuc

SEQ ID NO: 519942 - RNA, 22 nt, Human
cagcugcaggaacaaaaaugug

SEQ ID NO: 519943 - RNA, 22 nt, Human
gcccugcugucuucagaguaua

SEQ ID NO: 519944 - RNA, 22 nt, Human
ucagaggacuaccuucuccagu

SEQ ID NO: 519945 - RNA, 22 nt, Human
caaguagaacagagcuaccuug

SEQ ID NO: 519946 - RNA, 22 nt, Human
ugcuugcaagagaugcaaugac

SEQ ID NO: 519947 - RNA, 22 nt, Human
ucuuucagcucuucaggaccca

SEQ ID NO: 519948 - RNA, 22 nt, Human
cucagugucacguuuugccuua

SEQ ID NO: 519949 - RNA, 22 nt, Human
caguuuugguccuuucuaggua

SEQ ID NO: 519950 - RNA, 22 nt, Human
gcuguucacaucuggaccauuu

SEQ ID NO: 519951 - RNA, 22 nt, Human
uggcagggccugaaucuuauac

SEQ ID NO: 519952 - RNA, 22 nt, Human
uucuuuugggaauuacguaugc

SEQ ID NO: 519953 - RNA, 22 nt, Human
agagugaaguucaucgugcagc

SEQ ID NO: 519954 - RNA, 22 nt, Human
ugcaggagcugcuguccugcuc

SEQ ID NO: 519955 - RNA, 22 nt, Human
gcucagugaagggugccaagua

SEQ ID NO: 519956 - RNA, 22 nt, Human
uuuacagaucuguugauuuguu

SEQ ID NO: 519957 - RNA, 22 nt, Human
aaagauaauguuuccuuauucu

SEQ ID NO: 519958 - RNA, 22 nt, Human
uuccaaguagaagcauuugcau

SEQ ID NO: 519959 - RNA, 22 nt, Human
gagaagcaaucaguggccaccc

SEQ ID NO: 519960 - RNA, 22 nt, Human
aaagcaaugucucugccugguu

SEQ ID NO: 519961 - RNA, 22 nt, Human
ggcuggcauccagggaaaucca

SEQ ID NO: 519962 - RNA, 22 nt, Human
auuugcaugcuucuauugugaa

SEQ ID NO: 519963 - RNA, 22 nt, Human
aagggagcuuaggagaucaggc

SEQ ID NO: 519964 - RNA, 22 nt, Human
ggcaaggugcuacagacaguga

SEQ ID NO: 519965 - RNA, 22 nt, Human
uaaaugcaguacaaauuguucu

SEQ ID NO: 519966 - RNA, 22 nt, Human
agugaaaugacugaaucagaua

SEQ ID NO: 519967 - RNA, 20 nt, Human
cuggggaggaggauguguuc

SEQ ID NO: 519968 - RNA, 22 nt, Human
uccuugaaugaagagaggugac

SEQ ID NO: 519969 - RNA, 22 nt, Human
uacagaauuagauuauuagaga

SEQ ID NO: 519970 - RNA, 22 nt, Human
ugugugaagcacauguucaagg

SEQ ID NO: 519971 - RNA, 22 nt, Human
guaacauuuacaguuccuagag

SEQ ID NO: 519972 - RNA, 22 nt, Human
agagagccugaguggcagcuau

SEQ ID NO: 519973 - RNA, 20 nt, Human
agcacuagguguggcaggug

SEQ ID NO: 519974 - RNA, 22 nt, Human
caggaacacaaugagucucaaa

SEQ ID NO: 519975 - RNA, 22 nt, Human
cagccagccucucaaccaugca

SEQ ID NO: 519976 - RNA, 22 nt, Human
uagcuuuaggaugguucucuug

SEQ ID NO: 519977 - RNA, 22 nt, Human
gccagaagggguggauccaggc

SEQ ID NO: 519978 - RNA, 22 nt, Human
uugauuacuauguguugaaagc

SEQ ID NO: 519979 - RNA, 22 nt, Human
gaaaaugugccuuuggguauug

SEQ ID NO: 519980 - RNA, 22 nt, Human
aggcauggcuuuaggcaggcgu

SEQ ID NO: 519981 - RNA, 22 nt, Human
cagacacagauaugcauauggc

SEQ ID NO: 519982 - RNA, 22 nt, Human
ucccugggguaucgcugaggca

SEQ ID NO: 519983 - RNA, 22 nt, Human
auauuuguuuggcagaguucag

SEQ ID NO: 519984 - RNA, 22 nt, Human
uucacauuugaaaggaaagaua

SEQ ID NO: 519985 - RNA, 22 nt, Human
ugguccuggucaucugggcugg

SEQ ID NO: 519986 - RNA, 22 nt, Human
agggaggaaggaacuccuucua

SEQ ID NO: 519987 - RNA, 22 nt, Human
ucacugcaaggaggcuucucaa

SEQ ID NO: 519988 - RNA, 22 nt, Human
aggaaugaacucgagugaucug

SEQ ID NO: 519989 - RNA, 22 nt, Human
gccuguccacuaaacagccaag

SEQ ID NO: 519990 - RNA, 22 nt, Human
uaguuuguagaaaucuagaaau

SEQ ID NO: 519991 - RNA, 21 nt, Human
uccagaccucccucuccuagc

SEQ ID NO: 519992 - RNA, 22 nt, Human
gagaaugggaaugaaaguagca

SEQ ID NO: 519993 - RNA, 22 nt, Human
agccaagcaccacuggcacucg

SEQ ID NO: 519994 - RNA, 22 nt, Human
aaugaaauaguuggcuguagag

SEQ ID NO: 519995 - RNA, 22 nt, Human
ugaagauuuccaccaaaucaca

SEQ ID NO: 519996 - RNA, 22 nt, Human
uguuuucacaaugaugucagau

SEQ ID NO: 519997 - RNA, 18 nt, Human
uccaaaaucauguauuuu

SEQ ID NO: 519998 - RNA, 22 nt, Human
ucucaggguuuguacaagugua

SEQ ID NO: 519999 - RNA, 22 nt, Human
uauacaaguaaugcugaaugau

SEQ ID NO: 520000 - RNA, 22 nt, Human
ucucagagauuuauggaaaacu

SEQ ID NO: 520001 - RNA, 21 nt, Human
uggcacugcuuagcagguucc

SEQ ID NO: 520002 - RNA, 22 nt, Human
gcaucuaauccaguccagcauc

SEQ ID NO: 520003 - RNA, 22 nt, Human
cugggacacccagagcugcaga

SEQ ID NO: 520004 - RNA, 19 nt, Human
cugucccucccagguauga

SEQ ID NO: 520005 - RNA, 22 nt, Human
gcaggugaugugaugugagcau

SEQ ID NO: 520006 - RNA, 22 nt, Human
uccagcagguccgagacaaguu

SEQ ID NO: 520007 - RNA, 22 nt, Human
uuguccuguuuagggauaagga

SEQ ID NO: 520008 - RNA, 22 nt, Human
uguccuggaguuauaaugccug

SEQ ID NO: 520009 - RNA, 22 nt, Human
caugaaaaauuuacuguuaaca

SEQ ID NO: 520010 - RNA, 22 nt, Human
agcuucucagcuucagaacugu

SEQ ID NO: 520011 - RNA, 22 nt, Human
gcaaggucuuucagaaaggaaa

SEQ ID NO: 520012 - RNA, 22 nt, Human
ugccuaggaaaccucaugcuuc

SEQ ID NO: 520013 - RNA, 20 nt, Human
gaggcucugggcauggcgcc

SEQ ID NO: 520014 - RNA, 19 nt, Human
uagcagcugccaaaggaga

SEQ ID NO: 520015 - RNA, 22 nt, Human
gcucugagaggugcagcaguaa

SEQ ID NO: 520016 - RNA, 22 nt, Human
gaggcugagaguuuguucuacu

SEQ ID NO: 520017 - RNA, 22 nt, Human
ccaggguggaggcuggauggag

SEQ ID NO: 520018 - RNA, 22 nt, Human
acugccugcuccuggcuccaca

SEQ ID NO: 520019 - RNA, 22 nt, Human
accuucaauuauuuuuguucca

SEQ ID NO: 520020 - RNA, 22 nt, Human
aaaugcacagaaaggaugugga

SEQ ID NO: 520021 - RNA, 22 nt, Human
acacagaagaucucuuaaugcu

SEQ ID NO: 520022 - RNA, 22 nt, Human
uugcugaaaacaguggguauug

SEQ ID NO: 520023 - RNA, 16 nt, Human
ggagagugucugcaaa

SEQ ID NO: 520024 - RNA, 22 nt, Human
uggccuuggcagugagaagagu

SEQ ID NO: 520025 - RNA, 22 nt, Human
agaauucugacaauagaauugg

SEQ ID NO: 520026 - RNA, 22 nt, Human
uggcacauagcagguacucagu

SEQ ID NO: 520027 - RNA, 22 nt, Human
uuucaauguaugucuuucugag

SEQ ID NO: 520028 - RNA, 22 nt, Human
ccuggguccuggcagccuccug

SEQ ID NO: 520029 - RNA, 22 nt, Human
ucacagaaaagcugagcaucag

SEQ ID NO: 520030 - RNA, 22 nt, Human
cucauggauauaagaacuguuu

SEQ ID NO: 520031 - RNA, 22 nt, Human
gagaccucuugguaucgcuagg

SEQ ID NO: 520032 - RNA, 22 nt, Human
ucauuguugacauaccaagagc

SEQ ID NO: 520033 - RNA, 19 nt, Human
ugccagcauuaggcugaag

SEQ ID NO: 520034 - RNA, 22 nt, Human
cacagcuucuuccauuccacuc

SEQ ID NO: 520035 - RNA, 22 nt, Human
uuguuuuaaugagggagguuga

SEQ ID NO: 520036 - RNA, 22 nt, Human
gaacuguaguuaauacuacaca

SEQ ID NO: 520037 - RNA, 22 nt, Human
ucauaaagcuugccugcagugu

SEQ ID NO: 520038 - RNA, 22 nt, Human
uccuucuuugacaaguggcaga

SEQ ID NO: 520039 - RNA, 23 nt, Human
aaguucuuuuagaugucuucgug

SEQ ID NO: 520040 - RNA, 22 nt, Human
agccagggaaggauaacaagaa

SEQ ID NO: 520041 - RNA, 22 nt, Human
caggggacaguaugguggauga

SEQ ID NO: 520042 - RNA, 22 nt, Human
ugcuuuauucgacaucugguag

SEQ ID NO: 520043 - RNA, 22 nt, Human
auacaguauuaccuguucagga

SEQ ID NO: 520044 - RNA, 21 nt, Human
uggccaaacuggagcauuuga

SEQ ID NO: 520045 - RNA, 22 nt, Human
uguuuagacucaaaauugaaag

SEQ ID NO: 520046 - RNA, 22 nt, Human
uucucacaggcuggaaugauga

SEQ ID NO: 520047 - RNA, 22 nt, Human
caugugucuuuauggagccaca

SEQ ID NO: 520048 - RNA, 22 nt, Human
aggagcagauugguaagaucau

SEQ ID NO: 520049 - RNA, 22 nt, Human
uggagcaggaagucuauggcug

SEQ ID NO: 520050 - RNA, 22 nt, Human
cacugaaucucaaggggagggu

SEQ ID NO: 520051 - RNA, 22 nt, Human
gcagcagggugccagcuuugca

SEQ ID NO: 520052 - RNA, 22 nt, Human
uccuucaggguugaggccgacu

SEQ ID NO: 520053 - RNA, 19 nt, Human
uucucuggacuagaugcug

SEQ ID NO: 520054 - RNA, 23 nt, Human
gcuucuagucaauuucaccagga

SEQ ID NO: 520055 - RNA, 22 nt, Human
cccuguccuggaugggagcacu

SEQ ID NO: 520056 - RNA, 22 nt, Human
aauaaaaugaacugguagaguu

SEQ ID NO: 520057 - RNA, 22 nt, Human
acagagagaggcccgaggcugc

SEQ ID NO: 520058 - RNA, 22 nt, Human
aaauaugugaucagugaauaaa

SEQ ID NO: 520059 - RNA, 22 nt, Human
aucaguuuaaaugggcuguugg

SEQ ID NO: 520060 - RNA, 22 nt, Human
cuccagugcgcaggacagcccc

SEQ ID NO: 520061 - RNA, 22 nt, Human
ucggagcuguagaugaaacccu

SEQ ID NO: 520062 - RNA, 22 nt, Human
ucagaaauacuaucagcuuuug

SEQ ID NO: 520063 - RNA, 22 nt, Human
uuguaacacuuuucuauuaaua

SEQ ID NO: 520064 - RNA, 22 nt, Human
gugaggauacuuaagagaacac

SEQ ID NO: 520065 - RNA, 22 nt, Human
gugcaggggaucagguugcagc

SEQ ID NO: 520066 - RNA, 22 nt, Human
cccucugaccuccugccacagu

SEQ ID NO: 520067 - RNA, 22 nt, Human
cugggccucaaucucagaguuu

SEQ ID NO: 520068 - RNA, 22 nt, Human
ucuggccucuugggaugcuccc

SEQ ID NO: 520069 - RNA, 22 nt, Human
ugggccaggcaugugaucagca

SEQ ID NO: 520070 - RNA, 22 nt, Human
agcaggcugggcaauaugggca

SEQ ID NO: 520071 - RNA, 22 nt, Human
ugucugaaucgcuuccuagagg

SEQ ID NO: 520072 - RNA, 22 nt, Human
ucuccuggauggaccuucucuu

SEQ ID NO: 520073 - RNA, 20 nt, Human
cagugcccguggaaaagaug

SEQ ID NO: 520074 - RNA, 22 nt, Human
ccucagaggugaacaucagugc

SEQ ID NO: 520075 - RNA, 22 nt, Human
cucuggcuuguuaaugcauauu

SEQ ID NO: 520076 - RNA, 22 nt, Human
aaauacagauuccagggucuua

SEQ ID NO: 520077 - RNA, 22 nt, Human
ccagcugauucgguggugguug

SEQ ID NO: 520078 - RNA, 22 nt, Human
auguagcagaagauguuuuccu

SEQ ID NO: 520079 - RNA, 20 nt, Human
uccaggaaugguagaggacu

SEQ ID NO: 520080 - RNA, 22 nt, Human
gucugcugcagagcauggcuuu

SEQ ID NO: 520081 - RNA, 20 nt, Human
uggcuccugcgguggaacca

SEQ ID NO: 520082 - RNA, 22 nt, Human
auguaacacccacuuuuauagc

SEQ ID NO: 520083 - RNA, 22 nt, Human
ggcucuggugugaagcagccuc

SEQ ID NO: 520084 - RNA, 22 nt, Human
aagauguuauugucuuccuugc

SEQ ID NO: 520085 - RNA, 22 nt, Human
augaagcugguuuuggcuuggg

SEQ ID NO: 520086 - RNA, 22 nt, Human
gaagagcugacagugucauccu

SEQ ID NO: 520087 - RNA, 22 nt, Human
cacaguccagacuccuggaguu

SEQ ID NO: 520088 - RNA, 22 nt, Human
uccaggcuagguuuacaggaca

SEQ ID NO: 520089 - RNA, 22 nt, Human
gagcuugggugccaugcugagc

SEQ ID NO: 520090 - RNA, 22 nt, Human
uucuggaauacuaaguuccuuu

SEQ ID NO: 520091 - RNA, 22 nt, Human
gagcccuggcagucugggaugg

SEQ ID NO: 520092 - RNA, 23 nt, Human
gaaguucuuucuucucaugcugu

SEQ ID NO: 520093 - RNA, 22 nt, Human
uugagucuccucagcagggcua

SEQ ID NO: 520094 - RNA, 22 nt, Human
gacagcuucuugggccgggccu

SEQ ID NO: 520095 - RNA, 22 nt, Human
aaaguguuuacauugcuauaag

SEQ ID NO: 520096 - RNA, 22 nt, Human
ugggccuguggcuuggcucuag

SEQ ID NO: 520097 - RNA, 17 nt, Human
uguuuucauucauugcu

SEQ ID NO: 520098 - RNA, 22 nt, Human
caggcaggucagugaagaagga

SEQ ID NO: 520099 - RNA, 22 nt, Human
ugggugagugggaaaagcccag

SEQ ID NO: 520100 - RNA, 23 nt, Human
agagcaucaugaugcuaagucug

SEQ ID NO: 520101 - RNA, 20 nt, Human
cagagaccugucuucacaga

SEQ ID NO: 520102 - RNA, 22 nt, Human
cuggcagcucugagucccuucu

SEQ ID NO: 520103 - RNA, 22 nt, Human
agagcagugcugaagaguaggg

SEQ ID NO: 520104 - RNA, 22 nt, Human
gggcugaccaaugccuugcuuu

SEQ ID NO: 520105 - RNA, 20 nt, Human
cuuugccuauucucugccug

SEQ ID NO: 520106 - RNA, 22 nt, Human
ggccaggagcaagccaggcucu

SEQ ID NO: 520107 - RNA, 22 nt, Human
gauuucaaggauguuagaggug

SEQ ID NO: 520108 - RNA, 22 nt, Human
gccaaaguaccuagcccucugc

SEQ ID NO: 520109 - RNA, 22 nt, Human
ggcucagguuuaaagugcuuua

SEQ ID NO: 520110 - RNA, 22 nt, Human
ggcugccuccugcugggcugga

SEQ ID NO: 520111 - RNA, 22 nt, Human
uggcaucucaaacaggcagauu

SEQ ID NO: 520112 - RNA, 22 nt, Human
aggggcucaaagugugcaggga

SEQ ID NO: 520113 - RNA, 22 nt, Human
aaagacauggcaagagaugggg

SEQ ID NO: 520114 - RNA, 22 nt, Human
aaucgguugaacccaggaagug

SEQ ID NO: 520115 - RNA, 22 nt, Human
uccagcucuggcuuggcuagcu

SEQ ID NO: 520116 - RNA, 22 nt, Human
uccauucuaugcuuacauuuau

SEQ ID NO: 520117 - RNA, 22 nt, Human
uuucuaaguaagauuaacuucu

SEQ ID NO: 520118 - RNA, 22 nt, Human
gccugugcuuaacugacgugag

SEQ ID NO: 520119 - RNA, 17 nt, Human
aguguuuccuuaucauu

SEQ ID NO: 520120 - RNA, 22 nt, Human
cagagcauuaaaaccagcucug

SEQ ID NO: 520121 - RNA, 22 nt, Human
acaguguuacuugauaguguau

SEQ ID NO: 520122 - RNA, 22 nt, Human
ugagcugguucuugaggcauga

SEQ ID NO: 520123 - RNA, 22 nt, Human
cugcaugucacucugcuguccc

SEQ ID NO: 520124 - RNA, 22 nt, Human
ggguaugagauauaggugaaua

SEQ ID NO: 520125 - RNA, 22 nt, Human
ugcucugggauucagcagccug

SEQ ID NO: 520126 - RNA, 22 nt, Human
aggcacugggggaugagcaagg

SEQ ID NO: 520127 - RNA, 22 nt, Human
aaauggaagaagugcaauacug

SEQ ID NO: 520128 - RNA, 23 nt, Human
ugauuacaagggccaaagaaagg

SEQ ID NO: 520129 - RNA, 22 nt, Human
ucucacagugcaggucugucuc

SEQ ID NO: 520130 - RNA, 22 nt, Human
ucacuuauugcucaucucaugc

SEQ ID NO: 520131 - RNA, 22 nt, Human
ugcaauaacuacuuuaauguug

SEQ ID NO: 520132 - RNA, 22 nt, Human
aagguacaguuuuaagaauaag

SEQ ID NO: 520133 - RNA, 20 nt, Human
uacaaaccuccacacuggug

SEQ ID NO: 520134 - RNA, 22 nt, Human
ggggugagugcucagccccgga

SEQ ID NO: 520135 - RNA, 22 nt, Human
agggggugaucaaggugcggcg

SEQ ID NO: 520136 - RNA, 22 nt, Human
ugcuugggaauguggagucaga

SEQ ID NO: 520137 - RNA, 22 nt, Human
gccuggaguucagccaaguccc

SEQ ID NO: 520138 - RNA, 22 nt, Human
ugaaaucuuagccauucugccu

SEQ ID NO: 520139 - RNA, 23 nt, Human
cagggccaggcagcagcugucac

SEQ ID NO: 520140 - RNA, 22 nt, Human
ucucucaaccucggcacuauug

SEQ ID NO: 520141 - RNA, 22 nt, Human
cacaugcaccagaaaucaacau

SEQ ID NO: 520142 - RNA, 22 nt, Human
cagugauggauauggagaaguc

SEQ ID NO: 520143 - RNA, 17 nt, Human
ugggggcgccagggucu

SEQ ID NO: 520144 - RNA, 22 nt, Human
ucugucucaaguucuugcacuc

SEQ ID NO: 520145 - RNA, 20 nt, Human
uggaugucaaauuaggcugg

SEQ ID NO: 520146 - RNA, 22 nt, Human
uaacacacugaaggugagaugg

SEQ ID NO: 520147 - RNA, 21 nt, Human
ucagcagaaagcaaggucagu

SEQ ID NO: 520148 - RNA, 22 nt, Human
uagacauuagguagguucaugg

SEQ ID NO: 520149 - RNA, 22 nt, Human
cccuucccuucugggagaucca

SEQ ID NO: 520150 - RNA, 22 nt, Human
aaguagaaucucagguaggcua

SEQ ID NO: 520151 - RNA, 22 nt, Human
ccagggcuccauugcucauccu

SEQ ID NO: 520152 - RNA, 22 nt, Human
gcucugggaacugacugccuuc

SEQ ID NO: 520153 - RNA, 22 nt, Human
ugucaacacaccuaucucaauu

SEQ ID NO: 520154 - RNA, 22 nt, Human
uuauuuugagagaaugugugcu

SEQ ID NO: 520155 - RNA, 22 nt, Human
ggaggacaggggcugcagcaca

SEQ ID NO: 520156 - RNA, 22 nt, Human
ccaggccuuucuucuuggucug

SEQ ID NO: 520157 - RNA, 22 nt, Human
ggagccugugggaugagaugug

SEQ ID NO: 520158 - RNA, 22 nt, Human
agcuggcccucgagagccaauu

SEQ ID NO: 520159 - RNA, 22 nt, Human
ucucugguggcuccaucaguag

SEQ ID NO: 520160 - RNA, 22 nt, Human
gccuggaaucaugcagggguua

SEQ ID NO: 520161 - RNA, 22 nt, Human
uauguacaugauuucauuugcu

SEQ ID NO: 520162 - RNA, 22 nt, Human
cuggccugaggucggcuguagg

SEQ ID NO: 520163 - RNA, 22 nt, Human
gcugccuugaacuuggccuggg

SEQ ID NO: 520164 - RNA, 22 nt, Human
uagcagggccaggcugggaacc

SEQ ID NO: 520165 - RNA, 22 nt, Human
auauguguacgugcaguauaua

SEQ ID NO: 520166 - RNA, 22 nt, Human
guuuaauuuuagguugucaagc

SEQ ID NO: 520167 - RNA, 20 nt, Human
gggagucuggaugaaagaug

SEQ ID NO: 520168 - RNA, 19 nt, Human
cagaacagaggucauggcc

SEQ ID NO: 520169 - RNA, 21 nt, Human
cauuuacaugacagauugguu

SEQ ID NO: 520170 - RNA, 22 nt, Human
gucauuccuuauguugauucag

SEQ ID NO: 520171 - RNA, 22 nt, Human
caggcagcugggucaccguccc

SEQ ID NO: 520172 - RNA, 22 nt, Human
guccucagggaauguggcgggu

SEQ ID NO: 520173 - RNA, 19 nt, Human
cuggucugcugcuuccagg

SEQ ID NO: 520174 - RNA, 22 nt, Human
gagccugccucuagucucuaga

SEQ ID NO: 520175 - RNA, 22 nt, Human
aguggcuggcauaggaacagac

SEQ ID NO: 520176 - RNA, 22 nt, Human
gugcccuggagggguugaaggg

SEQ ID NO: 520177 - RNA, 22 nt, Human
uuuccucuuccgagggggaggc

SEQ ID NO: 520178 - RNA, 18 nt, Human
ugggccugcauccuaguc

SEQ ID NO: 520179 - RNA, 22 nt, Human
aaguaaaagcuuuaccaugcgc

SEQ ID NO: 520180 - RNA, 22 nt, Human
uccugcagaucaaagccuuuga

SEQ ID NO: 520181 - RNA, 22 nt, Human
ucaggagcuugguagugugauu

SEQ ID NO: 520182 - RNA, 22 nt, Human
ccugugugcacacgaggccaug

SEQ ID NO: 520183 - RNA, 22 nt, Human
uggaaucaguuacaugugguug

SEQ ID NO: 520184 - RNA, 22 nt, Human
cagcaggaaguacuagcuuuga

SEQ ID NO: 520185 - RNA, 22 nt, Human
aauuugauuuucuuaaaccaua

SEQ ID NO: 520186 - RNA, 22 nt, Human
ugaccacugaauaugacugccu

SEQ ID NO: 520187 - RNA, 21 nt, Human
agaggaagugauuggucuggc

SEQ ID NO: 520188 - RNA, 22 nt, Human
auuuccaggcuguuuugugaau

SEQ ID NO: 520189 - RNA, 22 nt, Human
gugcauuggugcgccacuucac

SEQ ID NO: 520190 - RNA, 22 nt, Human
cagggcuucuauaccaauucau

SEQ ID NO: 520191 - RNA, 22 nt, Human
acacacaugcaugcuugccauu

SEQ ID NO: 520192 - RNA, 22 nt, Human
uccuuuuuaagucguuguggua

SEQ ID NO: 520193 - RNA, 22 nt, Human
ucucuucugaaaccugucuuua

SEQ ID NO: 520194 - RNA, 22 nt, Human
ccaggcucagggcagacuuuca

SEQ ID NO: 520195 - RNA, 22 nt, Human
ucagggcauggcugcacuuggc

SEQ ID NO: 520196 - RNA, 22 nt, Human
acaggcuuacaggcugcaagua

SEQ ID NO: 520197 - RNA, 22 nt, Human
caggugggcugccucuccagcu

SEQ ID NO: 520198 - RNA, 22 nt, Human
uucguuuucuaggaccaacaga

SEQ ID NO: 520199 - RNA, 22 nt, Human
aaauucuuucauggcuaauaag

SEQ ID NO: 520200 - RNA, 22 nt, Human
ugcaggugaaaauuaugaggau

SEQ ID NO: 520201 - RNA, 23 nt, Human
uggcagcuguguaagagaaagca

SEQ ID NO: 520202 - RNA, 22 nt, Human
uggcucugucaaacugcacaca

SEQ ID NO: 520203 - RNA, 22 nt, Human
cuggugugauugagcccaggug

SEQ ID NO: 520204 - RNA, 22 nt, Human
uuuauuggauauuuacaagaua

SEQ ID NO: 520205 - RNA, 23 nt, Human
uuauuuugucagaagggacuuuu

SEQ ID NO: 520206 - RNA, 22 nt, Human
ucugaaaucuguaagcacuagc

SEQ ID NO: 520207 - RNA, 22 nt, Human
uuacauaacgguaugaaaaaug

SEQ ID NO: 520208 - RNA, 23 nt, Human
gugagcagcccacuaggaaugcc

SEQ ID NO: 520209 - RNA, 22 nt, Human
ugaagcuuuccuguggucagga

SEQ ID NO: 520210 - RNA, 22 nt, Human
ggcccagucuggggcccuguga

SEQ ID NO: 520211 - RNA, 22 nt, Human
ugugucaauuuucauuccuacu

SEQ ID NO: 520212 - RNA, 22 nt, Human
agacaaagaaaccguagaagca

SEQ ID NO: 520213 - RNA, 22 nt, Human
gucccaggcagagucaggaggg

SEQ ID NO: 520214 - RNA, 21 nt, Human
agcaacucugacuagaugagg

SEQ ID NO: 520215 - RNA, 22 nt, Human
acacacagaguuuauacaggca

SEQ ID NO: 520216 - RNA, 22 nt, Human
ugguccugguagcggugugcuu

SEQ ID NO: 520217 - RNA, 22 nt, Human
cuccuucaugucauguguccgg

SEQ ID NO: 520218 - RNA, 20 nt, Human
aucacuggagaaggaaaccu

SEQ ID NO: 520219 - RNA, 17 nt, Human
guuugcaugguguuaac

SEQ ID NO: 520220 - RNA, 22 nt, Human
ugaggcaggaggauugcaggau

SEQ ID NO: 520221 - RNA, 22 nt, Human
cagggcaaguuugagauuauuu

SEQ ID NO: 520222 - RNA, 22 nt, Human
cagggccagcgucucgggcuau

SEQ ID NO: 520223 - RNA, 22 nt, Human
gcggggggcaggcaguacguug

SEQ ID NO: 520224 - RNA, 22 nt, Human
uucugucugauggugccagaac

SEQ ID NO: 520225 - RNA, 22 nt, Human
uuaugacagaaaugaaaagcug

SEQ ID NO: 520226 - RNA, 22 nt, Human
ucuggggugcagccuggacaua

SEQ ID NO: 520227 - RNA, 22 nt, Human
uccucagggaagaugagccuca

SEQ ID NO: 520228 - RNA, 22 nt, Human
cccuggaggcaaagguugcagu

SEQ ID NO: 520229 - RNA, 22 nt, Human
uugaggagcacuagucagguau

SEQ ID NO: 520230 - RNA, 22 nt, Human
cucaggccagguuucucccaca

SEQ ID NO: 520231 - RNA, 22 nt, Human
ggucagccuuggauuugguagc

SEQ ID NO: 520232 - RNA, 22 nt, Human
cagagguagcaugcuguggcuu

SEQ ID NO: 520233 - RNA, 22 nt, Human
acaguguuuaaaaaucagaucu

SEQ ID NO: 520234 - RNA, 18 nt, Human
ggaaaaggagugucuagc

SEQ ID NO: 520235 - RNA, 22 nt, Human
auuucacucauucauguuacuu

SEQ ID NO: 520236 - RNA, 22 nt, Human
uguggcaguaaaauugggcaac

SEQ ID NO: 520237 - RNA, 22 nt, Human
cugcucuguuucuuagcugggu

SEQ ID NO: 520238 - RNA, 22 nt, Human
gacccuguuucuacaaauaauu

SEQ ID NO: 520239 - RNA, 20 nt, Human
aguggcagggaaauggaaag

SEQ ID NO: 520240 - RNA, 22 nt, Human
uacauguaggugacauuuuaau

SEQ ID NO: 520241 - RNA, 22 nt, Human
gaggccuggagccgccuaggcg

SEQ ID NO: 520242 - RNA, 22 nt, Human
auuagcuuaggcaugaagagaa

SEQ ID NO: 520243 - RNA, 22 nt, Human
agggccugggguagcuuacugc

SEQ ID NO: 520244 - RNA, 22 nt, Human
ugcuuuauaucucucuucuuag

SEQ ID NO: 520245 - RNA, 22 nt, Human
uaugaauauaccacaauuuagg

SEQ ID NO: 520246 - RNA, 22 nt, Human
gggcauggugaugugcaccugu

SEQ ID NO: 520247 - RNA, 18 nt, Human
uagaagugugcuauacaa

SEQ ID NO: 520248 - RNA, 22 nt, Human
aguguuucccaguaggaugaaa

SEQ ID NO: 520249 - RNA, 21 nt, Human
gugcacaguccugcacacagg

SEQ ID NO: 520250 - RNA, 22 nt, Human
cugguuuuaauguuauguuuau

SEQ ID NO: 520251 - RNA, 22 nt, Human
gcugaggauugaagaguugcca

SEQ ID NO: 520252 - RNA, 22 nt, Human
acagugcaaauaggacugucuu

SEQ ID NO: 520253 - RNA, 22 nt, Human
uaaaucacuccuaauaaucagu

SEQ ID NO: 520254 - RNA, 22 nt, Human
agggggugaaugucugucuaca

SEQ ID NO: 520255 - RNA, 22 nt, Human
aacuguaaggcuuagaacagca

SEQ ID NO: 520256 - RNA, 22 nt, Human
gcuccucuuauuucaucagggc

SEQ ID NO: 520257 - RNA, 19 nt, Human
cauaauacaguggaucuga

SEQ ID NO: 520258 - RNA, 22 nt, Human
uaaaggguagguuuuacuguaa

SEQ ID NO: 520259 - RNA, 22 nt, Human
agcuucagauuuaucuuucugu

SEQ ID NO: 520260 - RNA, 22 nt, Human
aucagcaaucucguguauuagg

SEQ ID NO: 520261 - RNA, 22 nt, Human
aauguuaaaaccuucagugcuu

SEQ ID NO: 520262 - RNA, 22 nt, Human
gaaggcuggcuuucugagagca

SEQ ID NO: 520263 - RNA, 22 nt, Human
agcugccacugagggugcacag

SEQ ID NO: 520264 - RNA, 22 nt, Human
ucaaucaaugugucaguuccca

SEQ ID NO: 520265 - RNA, 22 nt, Human
ucuguuuucauuugucuugaga

SEQ ID NO: 520266 - RNA, 17 nt, Human
uccuggccuggugugug

SEQ ID NO: 520267 - RNA, 22 nt, Human
ugcaaauuucuuuaguacauaa

SEQ ID NO: 520268 - RNA, 22 nt, Human
uggcucaggagggaucuuugcu

SEQ ID NO: 520269 - RNA, 22 nt, Human
uccagggcuuggcugggacggu

SEQ ID NO: 520270 - RNA, 22 nt, Human
auuuugcacacuaugcagcuuu

SEQ ID NO: 520271 - RNA, 22 nt, Human
acacugaaugcuguuuagaaau

SEQ ID NO: 520272 - RNA, 22 nt, Human
uccugggcuguggccccgggca

SEQ ID NO: 520273 - RNA, 22 nt, Human
ccaggccuuccaguacgcagaa

SEQ ID NO: 520274 - RNA, 22 nt, Human
aggccagcagcaugacggcauc

SEQ ID NO: 520275 - RNA, 22 nt, Human
agaugaaauuuguguugaguug

SEQ ID NO: 520276 - RNA, 22 nt, Human
cauguccauuuaugcacagaaa

SEQ ID NO: 520277 - RNA, 22 nt, Human
cagugauguuucugcaucagag

SEQ ID NO: 520278 - RNA, 22 nt, Human
cagagcugcagauugaaggcau

SEQ ID NO: 520279 - RNA, 22 nt, Human
uuggaauucagcuugcuuauaa

SEQ ID NO: 520280 - RNA, 23 nt, Human
uuacaguaggaguuggaaaacca

SEQ ID NO: 520281 - RNA, 22 nt, Human
gccugaagaacagcugugagga

SEQ ID NO: 520282 - RNA, 22 nt, Human
uuuuuguggugcagacuaaagc

SEQ ID NO: 520283 - RNA, 22 nt, Human
cccuguuuaagaaaccuguaaa

SEQ ID NO: 520284 - RNA, 22 nt, Human
ucuguucaugaaauaucuuuuu

SEQ ID NO: 520285 - RNA, 22 nt, Human
gagcugggacuuggaauccaca

SEQ ID NO: 520286 - RNA, 22 nt, Human
acaguuaucuuugaaauagaga

SEQ ID NO: 520287 - RNA, 21 nt, Human
uacaagaccggauucgggccc

SEQ ID NO: 520288 - RNA, 22 nt, Human
cugcagggaccacaagcagguu

SEQ ID NO: 520289 - RNA, 22 nt, Human
ggggugggguuacucauugugc

SEQ ID NO: 520290 - RNA, 22 nt, Human
cacagaauaaauugguaucaga

SEQ ID NO: 520291 - RNA, 22 nt, Human
uccugcagcugaagcucaugug

SEQ ID NO: 520292 - RNA, 22 nt, Human
cucagacccccagagcugcuaa

SEQ ID NO: 520293 - RNA, 22 nt, Human
caggggcucccugggugccagu

SEQ ID NO: 520294 - RNA, 22 nt, Human
ugcugggccaaagcaggguuuu

SEQ ID NO: 520295 - RNA, 20 nt, Human
augccucuaauuuugcaaac

SEQ ID NO: 520296 - RNA, 22 nt, Human
aucacaauguacguuaaaaugu

SEQ ID NO: 520297 - RNA, 22 nt, Human
ccucuuugacucucaggucuuu

SEQ ID NO: 520298 - RNA, 22 nt, Human
ugcacacaaaugugaacgugcc

SEQ ID NO: 520299 - RNA, 22 nt, Human
uacaacauguaaagugguuuaa

SEQ ID NO: 520300 - RNA, 22 nt, Human
uaagacuucauuaguaauaugg

SEQ ID NO: 520301 - RNA, 22 nt, Human
ggcugucagggugagcuggcuu

SEQ ID NO: 520302 - RNA, 23 nt, Human
ugacaaagcgagacuccagcuca

SEQ ID NO: 520303 - RNA, 20 nt, Human
cugcagggugagugggcgau

SEQ ID NO: 520304 - RNA, 22 nt, Human
aauugcaacagguagacuuuuc

SEQ ID NO: 520305 - RNA, 22 nt, Human
agagcacaaauuuuaaggaggc

SEQ ID NO: 520306 - RNA, 21 nt, Human
agauuguauggaggugagagg

SEQ ID NO: 520307 - RNA, 22 nt, Human
ggccaccuuaaguuaaggauau

SEQ ID NO: 520308 - RNA, 22 nt, Human
acagugcagggugggaagaagg

SEQ ID NO: 520309 - RNA, 22 nt, Human
ggcuccuguccuccuggagcuc

SEQ ID NO: 520310 - RNA, 22 nt, Human
cugaaugaguggauuuuucauu

SEQ ID NO: 520311 - RNA, 22 nt, Human
caggguagacaguaggugucug

SEQ ID NO: 520312 - RNA, 22 nt, Human
ucuguacauuuguguugugaau

SEQ ID NO: 520313 - RNA, 22 nt, Human
uuccuggggcuuagcaauggag

SEQ ID NO: 520314 - RNA, 22 nt, Human
gccaggcuggaaagaacagaca

SEQ ID NO: 520315 - RNA, 22 nt, Human
ucucagggaccaugaugaugac

SEQ ID NO: 520316 - RNA, 22 nt, Human
aggcaguguguagcuggaagag

SEQ ID NO: 520317 - RNA, 22 nt, Human
augguacaaaauguauaaaguc

SEQ ID NO: 520318 - RNA, 18 nt, Human
uccuggccacacuaccuu

SEQ ID NO: 520319 - RNA, 22 nt, Human
uuggaugaagucuagcuuuagu

SEQ ID NO: 520320 - RNA, 19 nt, Human
aggcagcacccaguccuug

SEQ ID NO: 520321 - RNA, 19 nt, Human
ugcucauggggacuucucc

SEQ ID NO: 520322 - RNA, 22 nt, Human
gugugcaggcuugaggauuagg

SEQ ID NO: 520323 - RNA, 22 nt, Human
cccaggcagaauuaguguuuca

SEQ ID NO: 520324 - RNA, 18 nt, Human
cauaauuuucuuucuuua

SEQ ID NO: 520325 - RNA, 22 nt, Human
agcaugaagacuucagagcuag

SEQ ID NO: 520326 - RNA, 22 nt, Human
ccagggcauguccaagacuuag

SEQ ID NO: 520327 - RNA, 22 nt, Human
auguauguuaguguauuaucua

SEQ ID NO: 520328 - RNA, 22 nt, Human
aucaaugcucuguacccagaau

SEQ ID NO: 520329 - RNA, 21 nt, Human
cagagguggccugaccucuga

SEQ ID NO: 520330 - RNA, 17 nt, Human
cuuguugagcucguucc

SEQ ID NO: 520331 - RNA, 22 nt, Human
gcaggaagaugagcucagguaa

SEQ ID NO: 520332 - RNA, 22 nt, Human
gcucugggccgggcaccagccu

SEQ ID NO: 520333 - RNA, 22 nt, Human
cuucuuaaugacagauuaaaau

SEQ ID NO: 520334 - RNA, 23 nt, Human
auuuuaaccuugacuaacaugca

SEQ ID NO: 520335 - RNA, 22 nt, Human
ccucuuugugccugcaggcugc

SEQ ID NO: 520336 - RNA, 22 nt, Human
gcuugaguuuugggacaaagcc

SEQ ID NO: 520337 - RNA, 22 nt, Human
cucagcacugacccaggagaug

SEQ ID NO: 520338 - RNA, 22 nt, Human
guauuaggaggaacacaggccu

SEQ ID NO: 520339 - RNA, 22 nt, Human
cucagcauucaauguccagucc

SEQ ID NO: 520340 - RNA, 22 nt, Human
uagggcucagaguccaguuucu

SEQ ID NO: 520341 - RNA, 22 nt, Human
ccacugcuaacuugcugcagcu

SEQ ID NO: 520342 - RNA, 22 nt, Human
gcaguaaauaauuuuguguaua

SEQ ID NO: 520343 - RNA, 22 nt, Human
caggcugauaggguccaaaguu

SEQ ID NO: 520344 - RNA, 22 nt, Human
ugucucugagaugacucccacc

SEQ ID NO: 520345 - RNA, 22 nt, Human
gucauuucuguuucuucagugc

SEQ ID NO: 520346 - RNA, 22 nt, Human
aaucaguuaaauauugaguaca

SEQ ID NO: 520347 - RNA, 23 nt, Human
caguacuuaguguagcguuaauu

SEQ ID NO: 520348 - RNA, 22 nt, Human
gucaggaugcuauuguuauuaa

SEQ ID NO: 520349 - RNA, 22 nt, Human
gcaggagagucugugccagguu

SEQ ID NO: 520350 - RNA, 22 nt, Human
ucaggccuuucuucagagcuuc

SEQ ID NO: 520351 - RNA, 22 nt, Human
aaauuagucgguuuaggaauuu

SEQ ID NO: 520352 - RNA, 22 nt, Human
uccuggcccacuccuagcuucu

SEQ ID NO: 520353 - RNA, 22 nt, Human
gcugagcuagaaaaggaccaca

SEQ ID NO: 520354 - RNA, 22 nt, Human
acagcagcacuauugacauuuu

SEQ ID NO: 520355 - RNA, 22 nt, Human
uuagagaaauucugguaaugua

SEQ ID NO: 520356 - RNA, 21 nt, Human
ggcaggugggucucuguugcu

SEQ ID NO: 520357 - RNA, 22 nt, Human
gagagugaggccugggaaucua

SEQ ID NO: 520358 - RNA, 22 nt, Human
caugucuggguauaugcauaug

SEQ ID NO: 520359 - RNA, 22 nt, Human
guaggcagucucucaggugauc

SEQ ID NO: 520360 - RNA, 22 nt, Human
acaaauaugguacucggagaaa

SEQ ID NO: 520361 - RNA, 22 nt, Human
uucaauucuaaacuaauauucu

SEQ ID NO: 520362 - RNA, 23 nt, Human
uuaggcacuuaguagggccagag

SEQ ID NO: 520363 - RNA, 22 nt, Human
guggccucugugcuccugccua

SEQ ID NO: 520364 - RNA, 20 nt, Human
cccuggccuguuucaugccc

SEQ ID NO: 520365 - RNA, 23 nt, Human
ugcagcugccucuggcgggccgg

SEQ ID NO: 520366 - RNA, 22 nt, Human
caugagaagggguggaguuaga

SEQ ID NO: 520367 - RNA, 22 nt, Human
uggagucacagugaccugaguc

SEQ ID NO: 520368 - RNA, 21 nt, Human
aggcucucauccagggaccca

SEQ ID NO: 520369 - RNA, 21 nt, Human
ugggugggcagagucucuuca

SEQ ID NO: 520370 - RNA, 22 nt, Human
agucagcaucugcacugugcug

SEQ ID NO: 520371 - RNA, 22 nt, Human
augcaaaauuaccauucuguuc

SEQ ID NO: 520372 - RNA, 22 nt, Human
acuucuugggacccuggcaccg

SEQ ID NO: 520373 - RNA, 22 nt, Human
uaccacuacauuugcuaauggc

SEQ ID NO: 520374 - RNA, 22 nt, Human
cagacagaggcuguaugagggc

SEQ ID NO: 520375 - RNA, 23 nt, Human
acagagguccaaacaguauaagc

SEQ ID NO: 520376 - RNA, 19 nt, Human
uccugcagguggcuugcag

SEQ ID NO: 520377 - RNA, 22 nt, Human
caugcaaacacguaaacauuca

SEQ ID NO: 520378 - RNA, 22 nt, Human
aaggcuguuuauuagaaaaagu

SEQ ID NO: 520379 - RNA, 22 nt, Human
gagggagugccagagggccagc

SEQ ID NO: 520380 - RNA, 22 nt, Human
uuguccugagauaaggaacaga

SEQ ID NO: 520381 - RNA, 21 nt, Human
agaggcaggcauuaaguacac

SEQ ID NO: 520382 - RNA, 22 nt, Human
ucaggucugggcacaugguaca

SEQ ID NO: 520383 - RNA, 22 nt, Human
uuaaacagacaguaaaugaaac

SEQ ID NO: 520384 - RNA, 22 nt, Human
agcaggucgccgaagauagcuc

SEQ ID NO: 520385 - RNA, 22 nt, Human
cugggucuggccacaggaagua

SEQ ID NO: 520386 - RNA, 17 nt, Human
uccuucagggccucaca

SEQ ID NO: 520387 - RNA, 22 nt, Human
acaguguuguggcucuuaauag

SEQ ID NO: 520388 - RNA, 22 nt, Human
ccagcagggaaaaacccaccaa

SEQ ID NO: 520389 - RNA, 22 nt, Human
agggggcccuugcaggugagcg

SEQ ID NO: 520390 - RNA, 22 nt, Human
ugggcagaaggaagagccaccu

SEQ ID NO: 520391 - RNA, 22 nt, Human
ugggagaagcagugggacagua

SEQ ID NO: 520392 - RNA, 20 nt, Human
agcagcauuguucuagagca

SEQ ID NO: 520393 - RNA, 22 nt, Human
uuuccuuccagguuccuaaggc

SEQ ID NO: 520394 - RNA, 22 nt, Human
aagauucuacaguagguacauu

SEQ ID NO: 520395 - RNA, 22 nt, Human
cucccucccuacgugagcucac

SEQ ID NO: 520396 - RNA, 22 nt, Human
ucagaggguggcugggagcauc

SEQ ID NO: 520397 - RNA, 22 nt, Human
ggcucagauuccgaguggcccu

SEQ ID NO: 520398 - RNA, 22 nt, Human
aucagcaagcaugguuaggugu

SEQ ID NO: 520399 - RNA, 17 nt, Human
guccuacccauggucua

SEQ ID NO: 520400 - RNA, 23 nt, Human
augaaaguucuuaaaaugucaug

SEQ ID NO: 520401 - RNA, 22 nt, Human
ugaaaaggagccuuagguaggu

SEQ ID NO: 520402 - RNA, 22 nt, Human
uuuguacuggaagaacaugcaa

SEQ ID NO: 520403 - RNA, 22 nt, Human
ccccuuucucccgcgucuggcc

SEQ ID NO: 520404 - RNA, 22 nt, Human
ucuauuugcugguugcuucugu

SEQ ID NO: 520405 - RNA, 22 nt, Human
agagggcccauguugggcugcu

SEQ ID NO: 520406 - RNA, 22 nt, Human
uggccugguuauauugcuauca

SEQ ID NO: 520407 - RNA, 21 nt, Human
cugggcuuucucucaaagaca

SEQ ID NO: 520408 - RNA, 22 nt, Human
ugagucugauuuuucuagcauu

SEQ ID NO: 520409 - RNA, 22 nt, Human
uucuguguucugugcaaugagc

SEQ ID NO: 520410 - RNA, 22 nt, Human
gcagcucaagagaggugcuaug

SEQ ID NO: 520411 - RNA, 22 nt, Human
gcaaguagugggaaagaagaug

SEQ ID NO: 520412 - RNA, 22 nt, Human
aucagcacaacguacagagaaa

SEQ ID NO: 520413 - RNA, 22 nt, Human
gggaaggagguggcuugaagug

SEQ ID NO: 520414 - RNA, 23 nt, Human
cucagagguguuuuucacuuacu

SEQ ID NO: 520415 - RNA, 22 nt, Human
cuugggagacacaagaagacau

SEQ ID NO: 520416 - RNA, 22 nt, Human
acagagcuuaggaugacuccca

SEQ ID NO: 520417 - RNA, 22 nt, Human
cuuggcagauccaaaaaugaca

SEQ ID NO: 520418 - RNA, 22 nt, Human
cagcagcuccaaagaauagcca

SEQ ID NO: 520419 - RNA, 22 nt, Human
ugggcugagcacugaggaagga

SEQ ID NO: 520420 - RNA, 22 nt, Human
ucugucacaauuugcuuacucu

SEQ ID NO: 520421 - RNA, 22 nt, Human
gggcucugggaugcucuuagag

SEQ ID NO: 520422 - RNA, 22 nt, Human
aaggacuccaauucuuucaucu

SEQ ID NO: 520423 - RNA, 22 nt, Human
uguuuucaucacagaauguaac

SEQ ID NO: 520424 - RNA, 19 nt, Human
uggcugggcgugccuccgu

SEQ ID NO: 520425 - RNA, 22 nt, Human
gaguuauuucagaaggaaagau

SEQ ID NO: 520426 - RNA, 22 nt, Human
ucaugccaaacugaacacaguu

SEQ ID NO: 520427 - RNA, 22 nt, Human
ggcggguggcgaggcuucucgg

SEQ ID NO: 520428 - RNA, 23 nt, Human
ucuuuucaaugguucuuuaugug

SEQ ID NO: 520429 - RNA, 22 nt, Human
uuuguagacgucagaaguuacu

SEQ ID NO: 520430 - RNA, 22 nt, Human
auucacagggacaaugggagag

SEQ ID NO: 520431 - RNA, 22 nt, Human
ugcugaauucucauucccugga

SEQ ID NO: 520432 - RNA, 22 nt, Human
agcaggcugccuuccaaagccu

SEQ ID NO: 520433 - RNA, 22 nt, Human
aaauguucccaauaugaagcug

SEQ ID NO: 520434 - RNA, 20 nt, Human
ucugcccaccccggcuccca

SEQ ID NO: 520435 - RNA, 22 nt, Human
ugcucugcacaucccucacaaa

SEQ ID NO: 520436 - RNA, 22 nt, Human
uuggaaauggcuguaguuauga

SEQ ID NO: 520437 - RNA, 22 nt, Human
uguccugugauuccagcucuuc

SEQ ID NO: 520438 - RNA, 22 nt, Human
gggaccugccaaggccacccag

SEQ ID NO: 520439 - RNA, 22 nt, Human
ccuguucaagggaugauugacc

SEQ ID NO: 520440 - RNA, 22 nt, Human
uuugcaaaaugaggugaagagu

SEQ ID NO: 520441 - RNA, 22 nt, Human
acacucucagcuuuucaacuua

SEQ ID NO: 520442 - RNA, 18 nt, Human
cagggcuguggggucacu

SEQ ID NO: 520443 - RNA, 22 nt, Human
uuuuggcacugcgucuacaugg

SEQ ID NO: 520444 - RNA, 22 nt, Human
guggagaccuccuaggaugugu

SEQ ID NO: 520445 - RNA, 22 nt, Human
uaggcaggcugaauguagauuu

SEQ ID NO: 520446 - RNA, 22 nt, Human
gcauggccucugugcuuguugc

SEQ ID NO: 520447 - RNA, 22 nt, Human
uucaggaugcucagaguagucu

SEQ ID NO: 520448 - RNA, 15 nt, Human
cagucccagggaccc

SEQ ID NO: 520449 - RNA, 22 nt, Human
gauggcagcagcagccagggau

SEQ ID NO: 520450 - RNA, 22 nt, Human
agcuggccauugugaguggccu

SEQ ID NO: 520451 - RNA, 22 nt, Human
gccucugcaacuccgccuuggu

SEQ ID NO: 520452 - RNA, 22 nt, Human
aucaggaugacuauaaggcugc

SEQ ID NO: 520453 - RNA, 22 nt, Human
aggagaaagacuggacagccaa

SEQ ID NO: 520454 - RNA, 22 nt, Human
aggcuuuaauuaucuacaggag

SEQ ID NO: 520455 - RNA, 20 nt, Human
ucaaagcacugccugucauc

SEQ ID NO: 520456 - RNA, 20 nt, Human
agcuccaugaaguagucacu

SEQ ID NO: 520457 - RNA, 22 nt, Human
uuucagagccuuuaucucucua

SEQ ID NO: 520458 - RNA, 22 nt, Human
cccacagguccccaugaacucg

SEQ ID NO: 520459 - RNA, 20 nt, Human
cacugaagacuucuugcuca

SEQ ID NO: 520460 - RNA, 22 nt, Human
aggcuccauucaugugaaggca

SEQ ID NO: 520461 - RNA, 22 nt, Human
caagagcugugaccucauucac

SEQ ID NO: 520462 - RNA, 22 nt, Human
uuaagaaugugccuuuugguug

SEQ ID NO: 520463 - RNA, 22 nt, Human
agcaggagaacacuguggcucu

SEQ ID NO: 520464 - RNA, 19 nt, Human
uccuucagucagaucuggg

SEQ ID NO: 520465 - RNA, 22 nt, Human
cuuaucagauuaucugggcugu

SEQ ID NO: 520466 - RNA, 22 nt, Human
uaggaaauuagaacuuggaaac

SEQ ID NO: 520467 - RNA, 22 nt, Human
ugcaagaaugacccaucuaccc

SEQ ID NO: 520468 - RNA, 22 nt, Human
cagcauggugccagugagucca

SEQ ID NO: 520469 - RNA, 22 nt, Human
uauuuuguauuuaugcaagaaa

SEQ ID NO: 520470 - RNA, 22 nt, Human
ucuguaggguaguaguggagau

SEQ ID NO: 520471 - RNA, 22 nt, Human
ggcacugagaacaggcugacuu

SEQ ID NO: 520472 - RNA, 22 nt, Human
aacagaaggggguauuuacauu

SEQ ID NO: 520473 - RNA, 22 nt, Human
ucaaggaauuuaguuuaguaaa

SEQ ID NO: 520474 - RNA, 22 nt, Human
caguauguuugggagacaugac

SEQ ID NO: 520475 - RNA, 22 nt, Human
auccugggcaguuuugagugcu

SEQ ID NO: 520476 - RNA, 22 nt, Human
caguccugcccaggcugacaga

SEQ ID NO: 520477 - RNA, 22 nt, Human
guuuaagaaaauucauguuguu

SEQ ID NO: 520478 - RNA, 22 nt, Human
gugguccucauaauucagugag

SEQ ID NO: 520479 - RNA, 22 nt, Human
gccaggcauuauuccgaucccu

SEQ ID NO: 520480 - RNA, 22 nt, Human
agacaacaccaaaugcuagugu

SEQ ID NO: 520481 - RNA, 22 nt, Human
uugcauguuauuuaaucuguau

SEQ ID NO: 520482 - RNA, 22 nt, Human
caucucuucauuagcauuauug

SEQ ID NO: 520483 - RNA, 22 nt, Human
ugucugagugugccugggcauu

SEQ ID NO: 520484 - RNA, 22 nt, Human
ucagcaggguuugacuucuaau

SEQ ID NO: 520485 - RNA, 22 nt, Human
ucuggcucagggcucugaggga

SEQ ID NO: 520486 - RNA, 22 nt, Human
ucauuguuauguuuugcugucu

SEQ ID NO: 520487 - RNA, 22 nt, Human
ggcacauggagacuuggcauca

SEQ ID NO: 520488 - RNA, 22 nt, Human
uuccucuguaguugcugaugaa

SEQ ID NO: 520489 - RNA, 21 nt, Human
gcacagcaugaguguuggcau

SEQ ID NO: 520490 - RNA, 22 nt, Human
ugggcagaucuuugguggcuag

SEQ ID NO: 520491 - RNA, 22 nt, Human
uuugaaaagaaccaucgccuua

SEQ ID NO: 520492 - RNA, 22 nt, Human
cuacauuuguucuauagcuuuu

SEQ ID NO: 520493 - RNA, 22 nt, Human
gugauuucagguuuuucauacu

SEQ ID NO: 520494 - RNA, 22 nt, Human
uuccaggaacacucuguguccc

SEQ ID NO: 520495 - RNA, 22 nt, Human
ugcauuauaacugaauguuguu

SEQ ID NO: 520496 - RNA, 22 nt, Human
ugcugaaugggauauguugagc

SEQ ID NO: 520497 - RNA, 22 nt, Human
ugagagugauugguucgaaugu

SEQ ID NO: 520498 - RNA, 22 nt, Human
gcuuucucuucacugauguuca

SEQ ID NO: 520499 - RNA, 22 nt, Human
uuccagaaaaaaauguauaucu

SEQ ID NO: 520500 - RNA, 22 nt, Human
ggcccuuggagccuccacagug

SEQ ID NO: 520501 - RNA, 22 nt, Human
aaaacaggugucagcaaacuau

SEQ ID NO: 520502 - RNA, 22 nt, Human
cugggcuacguguugacagcau

SEQ ID NO: 520503 - RNA, 22 nt, Human
agcagagcugcaguggccugcu

SEQ ID NO: 520504 - RNA, 22 nt, Human
cuuaaauuuucaucuacaagaa

SEQ ID NO: 520505 - RNA, 22 nt, Human
agggcugaaguuauggcugagc

SEQ ID NO: 520506 - RNA, 22 nt, Human
auugucuucuggucuuaucuuu

SEQ ID NO: 520507 - RNA, 22 nt, Human
gcugggaggaauuuggggaaua

SEQ ID NO: 520508 - RNA, 22 nt, Human
cagucccaccaggaucgcucuu

SEQ ID NO: 520509 - RNA, 22 nt, Human
gaggugggagggcagucccuaa

SEQ ID NO: 520510 - RNA, 22 nt, Human
aaggcugacucaacagggggcc

SEQ ID NO: 520511 - RNA, 22 nt, Human
uaaggcaccauaauauauuuaa

SEQ ID NO: 520512 - RNA, 22 nt, Human
cuggggauccuuuuugcaucua

SEQ ID NO: 520513 - RNA, 22 nt, Human
gauuuagagaauguuuuguaag

SEQ ID NO: 520514 - RNA, 20 nt, Human
aggacagcagcugccacuug

SEQ ID NO: 520515 - RNA, 22 nt, Human
gguuugcacgauauuuccaugg

SEQ ID NO: 520516 - RNA, 22 nt, Human
gggcacagagggucuugaagaa

SEQ ID NO: 520517 - RNA, 22 nt, Human
uccaaagacuugcuguauguaa

SEQ ID NO: 520518 - RNA, 22 nt, Human
caagagcucaccggagagcauu

SEQ ID NO: 520519 - RNA, 22 nt, Human
cccugcaggggaccugcagccu

SEQ ID NO: 520520 - RNA, 22 nt, Human
uguggcccagaugagugugcua

SEQ ID NO: 520521 - RNA, 21 nt, Human
ugaaugaggaggauggcauuu

SEQ ID NO: 520522 - RNA, 22 nt, Human
acugucuguacuucuugcaagg

SEQ ID NO: 520523 - RNA, 22 nt, Human
gugcacagaaauugguaagacu

SEQ ID NO: 520524 - RNA, 22 nt, Human
cuccugggagucuuccuggaug

SEQ ID NO: 520525 - RNA, 22 nt, Human
gaugauggacaaagcauuggug

SEQ ID NO: 520526 - RNA, 22 nt, Human
acugugcacaauucuaaguccu

SEQ ID NO: 520527 - RNA, 17 nt, Human
uuucaagguuacguucc

SEQ ID NO: 520528 - RNA, 22 nt, Human
cccacacucugagaaaugcuga

SEQ ID NO: 520529 - RNA, 22 nt, Human
gggcagugguccaggcuacagc

SEQ ID NO: 520530 - RNA, 22 nt, Human
gccuggagccucagcaaggagg

SEQ ID NO: 520531 - RNA, 22 nt, Human
caauguguguguuuuucucaac

SEQ ID NO: 520532 - RNA, 22 nt, Human
uguguuccuucgucuucccuuc

SEQ ID NO: 520533 - RNA, 22 nt, Human
cugaaggauuagagagcacuua

SEQ ID NO: 520534 - RNA, 22 nt, Human
ucagggaaauagcagggcugaa

SEQ ID NO: 520535 - RNA, 22 nt, Human
agauuucucuuucccuggcuga

SEQ ID NO: 520536 - RNA, 22 nt, Human
ucuccauaggcaguucauaaca

SEQ ID NO: 520537 - RNA, 22 nt, Human
gagaaaauagcauguguaguau

SEQ ID NO: 520538 - RNA, 22 nt, Human
ucccagccuuucuuuucugcug

SEQ ID NO: 520539 - RNA, 22 nt, Human
uauuacaaauuauaaugggaga

SEQ ID NO: 520540 - RNA, 22 nt, Human
caggugggagcgaggagcuacu

SEQ ID NO: 520541 - RNA, 22 nt, Human
cccaggcagcggggucuccuug

SEQ ID NO: 520542 - RNA, 22 nt, Human
ucccagggugcgccugcccucg

SEQ ID NO: 520543 - RNA, 22 nt, Human
agucucagaaaagaagcaugga

SEQ ID NO: 520544 - RNA, 22 nt, Human
uaguccauuuucacacugcuga

SEQ ID NO: 520545 - RNA, 22 nt, Human
ggccucuggcaggcaggcccuc

SEQ ID NO: 520546 - RNA, 22 nt, Human
aaugucugccagaacugaucau

SEQ ID NO: 520547 - RNA, 22 nt, Human
ccagugcacaauggaacaacuc

SEQ ID NO: 520548 - RNA, 22 nt, Human
aacaggagaguaaauauaugau

SEQ ID NO: 520549 - RNA, 22 nt, Human
auggaaauggagugugcuugcu

SEQ ID NO: 520550 - RNA, 23 nt, Human
aggaaggagguccuaacaguauc

SEQ ID NO: 520551 - RNA, 22 nt, Human
ccuggccaggcucucagcacug

SEQ ID NO: 520552 - RNA, 22 nt, Human
caguaugagaguugaaucaagg

SEQ ID NO: 520553 - RNA, 22 nt, Human
aguaaucaauuuuucgguggau

SEQ ID NO: 520554 - RNA, 22 nt, Human
uuggaaauacgaguaguaucau

SEQ ID NO: 520555 - RNA, 22 nt, Human
guccucugcccaggucaagguu

SEQ ID NO: 520556 - RNA, 22 nt, Human
ucuguuuugugucucucuggug

SEQ ID NO: 520557 - RNA, 22 nt, Human
cagagcauaauugacaugaggu

SEQ ID NO: 520558 - RNA, 22 nt, Human
aaauguucuacuuugauaauua

SEQ ID NO: 520559 - RNA, 22 nt, Human
ugccuggcacuccuggagcuca

SEQ ID NO: 520560 - RNA, 22 nt, Human
acauaaauagauuauugggagg

SEQ ID NO: 520561 - RNA, 22 nt, Human
acuuugcugcagguuuaaagag

SEQ ID NO: 520562 - RNA, 22 nt, Human
uauucugugugauauguaaaug

SEQ ID NO: 520563 - RNA, 22 nt, Human
cagcaggaggugagaugugacc

SEQ ID NO: 520564 - RNA, 22 nt, Human
uacauguuuacuccaagucagg

SEQ ID NO: 520565 - RNA, 22 nt, Human
uagaaauguaggcuuccugaca

SEQ ID NO: 520566 - RNA, 20 nt, Human
gugcuucagaagccauugcu

SEQ ID NO: 520567 - RNA, 22 nt, Human
cuucaaguugucugaggguggg

SEQ ID NO: 520568 - RNA, 22 nt, Human
uagauucagauauuuaggacaa

SEQ ID NO: 520569 - RNA, 22 nt, Human
ccucugcucccuggugucugag

SEQ ID NO: 520570 - RNA, 22 nt, Human
uccccacaucucugcaucaggc

SEQ ID NO: 520571 - RNA, 22 nt, Human
cugcuuccauaaauaaugugcu

SEQ ID NO: 520572 - RNA, 22 nt, Human
ccugggccucacccagcucuug

SEQ ID NO: 520573 - RNA, 22 nt, Human
ccuguucaugaaacugcuuucc

SEQ ID NO: 520574 - RNA, 22 nt, Human
gcugccacucugagcuugcuuc

SEQ ID NO: 520575 - RNA, 22 nt, Human
agggugggcuagacucuucccc

SEQ ID NO: 520576 - RNA, 22 nt, Human
gcucaggaaggcucaaccagga

SEQ ID NO: 520577 - RNA, 21 nt, Human
acaugucucuaaucucaguga

SEQ ID NO: 520578 - RNA, 15 nt, Human
ucugggcugugagca

SEQ ID NO: 520579 - RNA, 23 nt, Human
ccuggcuggauucucugcauuca

SEQ ID NO: 520580 - RNA, 22 nt, Human
ggcugccugcuccuccugcacg

SEQ ID NO: 520581 - RNA, 22 nt, Human
gaaggccaagaggcuccaagau

SEQ ID NO: 520582 - RNA, 22 nt, Human
aaaggaagauugagcuuuucca

SEQ ID NO: 520583 - RNA, 22 nt, Human
ccugggcaacauagugagaccu

SEQ ID NO: 520584 - RNA, 22 nt, Human
gggaggagcuuggagauucacu

SEQ ID NO: 520585 - RNA, 22 nt, Human
guaugaaguuggacuguauaaa

SEQ ID NO: 520586 - RNA, 22 nt, Human
uuguaacagcugcuuaauagag

SEQ ID NO: 520587 - RNA, 23 nt, Human
gcucaucaggcuuagagucaagg

SEQ ID NO: 520588 - RNA, 22 nt, Human
agaagauuauuagagacuuugu

SEQ ID NO: 520589 - RNA, 22 nt, Human
agccucucuguuagucacuggg

SEQ ID NO: 520590 - RNA, 22 nt, Human
agcuggagaaaccugggagggu

SEQ ID NO: 520591 - RNA, 22 nt, Human
cugggcacauuuugacuagugu

SEQ ID NO: 520592 - RNA, 22 nt, Human
agagacauggagaggcaaaguu

SEQ ID NO: 520593 - RNA, 22 nt, Human
agcagcauucucugguaugggg

SEQ ID NO: 520594 - RNA, 22 nt, Human
uucacuuauagggauguuauug

SEQ ID NO: 520595 - RNA, 22 nt, Human
uacauugaauuuuuuagcaugu

SEQ ID NO: 520596 - RNA, 16 nt, Human
ugggaccuguggccaa

SEQ ID NO: 520597 - RNA, 22 nt, Human
caggucuggugagagaacaguu

SEQ ID NO: 520598 - RNA, 22 nt, Human
aguggggacuuaugccagcauu

SEQ ID NO: 520599 - RNA, 22 nt, Human
cacacaaauauucuggaggcaa

SEQ ID NO: 520600 - RNA, 20 nt, Human
ugacucugcaaccgucucuc

SEQ ID NO: 520601 - RNA, 22 nt, Human
ccucugggcggagaucugcugc

SEQ ID NO: 520602 - RNA, 22 nt, Human
ggucccaguugcccaggucagg

SEQ ID NO: 520603 - RNA, 22 nt, Human
aucauuaaauauaagcuucaca

SEQ ID NO: 520604 - RNA, 22 nt, Human
uucccuucuaguuuugagagac

SEQ ID NO: 520605 - RNA, 21 nt, Human
gugguuauuuucauuagcauc

SEQ ID NO: 520606 - RNA, 22 nt, Human
ucuugggcaauuucucuagagg

SEQ ID NO: 520607 - RNA, 19 nt, Human
gcaggcaguggcauucgga

SEQ ID NO: 520608 - RNA, 22 nt, Human
cccagcagccuggauguucuuu

SEQ ID NO: 520609 - RNA, 22 nt, Human
agggcagaccacgugcaaggau

SEQ ID NO: 520610 - RNA, 22 nt, Human
gggagggaggugaugcuuggcu

SEQ ID NO: 520611 - RNA, 22 nt, Human
agggccucugacgcccccagcc

SEQ ID NO: 520612 - RNA, 22 nt, Human
gcagccacugggagugcuuaua

SEQ ID NO: 520613 - RNA, 22 nt, Human
cugggagaucuccugagggcag

SEQ ID NO: 520614 - RNA, 22 nt, Human
uacagcuucagugugccccagu

SEQ ID NO: 520615 - RNA, 22 nt, Human
acugcagacucuacaguuauaa

SEQ ID NO: 520616 - RNA, 22 nt, Human
uugaaaguccuucuugaguuac

SEQ ID NO: 520617 - RNA, 22 nt, Human
cccugcagagagugcuuuugug

SEQ ID NO: 520618 - RNA, 22 nt, Human
ccugccagucacuaugucaccu

SEQ ID NO: 520619 - RNA, 22 nt, Human
agcagggggccacagucacagc

SEQ ID NO: 520620 - RNA, 22 nt, Human
cucagggcaguauggcugagag

SEQ ID NO: 520621 - RNA, 22 nt, Human
ucugaggcccuacccugagccu

SEQ ID NO: 520622 - RNA, 22 nt, Human
gaauagauccucauuuauugau

SEQ ID NO: 520623 - RNA, 22 nt, Human
ccugugcccucagccuggcucu

SEQ ID NO: 520624 - RNA, 22 nt, Human
aaggacagaaacagauugcugg

SEQ ID NO: 520625 - RNA, 22 nt, Human
gcucaggauuucauccaugugu

SEQ ID NO: 520626 - RNA, 22 nt, Human
caucaaagggccuguggugcag

SEQ ID NO: 520627 - RNA, 22 nt, Human
uaagaacaagauguuccuguuu

SEQ ID NO: 520628 - RNA, 22 nt, Human
gagcugugccaaucugucuggg

SEQ ID NO: 520629 - RNA, 22 nt, Human
aaguauauuuuuugaagcauau

SEQ ID NO: 520630 - RNA, 22 nt, Human
gucuggugggauuccaaguggc

SEQ ID NO: 520631 - RNA, 22 nt, Human
cuauuacaauucugcaaggagu

SEQ ID NO: 520632 - RNA, 22 nt, Human
aaguuagaaauaagggcucucc

SEQ ID NO: 520633 - RNA, 22 nt, Human
guguucauggaugucaauuuga

SEQ ID NO: 520634 - RNA, 20 nt, Human
caaugcacacagcugcuucu

SEQ ID NO: 520635 - RNA, 22 nt, Human
auccaguucucagugcuuacag

SEQ ID NO: 520636 - RNA, 22 nt, Human
gaguaaaucgucauugcagcau

SEQ ID NO: 520637 - RNA, 22 nt, Human
ccacacagauaaguguuuucua

SEQ ID NO: 520638 - RNA, 23 nt, Human
auaaauuacuaucucccuagagc

SEQ ID NO: 520639 - RNA, 22 nt, Human
ggccaccuggcugugggggcag

SEQ ID NO: 520640 - RNA, 22 nt, Human
agugaaauagcauuuaugaagc

SEQ ID NO: 520641 - RNA, 22 nt, Human
gccaagcucuuuaaaggccaaa

SEQ ID NO: 520642 - RNA, 18 nt, Human
aaaaugcaggcgacaugg

SEQ ID NO: 520643 - RNA, 22 nt, Human
guccucagucaguuuggugggg

SEQ ID NO: 520644 - RNA, 22 nt, Human
cauuucuagacaaguccuggag

SEQ ID NO: 520645 - RNA, 19 nt, Human
uuagccauccacagugaaa

SEQ ID NO: 520646 - RNA, 22 nt, Human
agcuuuaucuucaccugggaau

SEQ ID NO: 520647 - RNA, 22 nt, Human
auaaggcagugacuucaucuau

SEQ ID NO: 520648 - RNA, 22 nt, Human
ugauaugugaagcuauuaguuc

SEQ ID NO: 520649 - RNA, 22 nt, Human
aagcuucaucugaugccgaacu

SEQ ID NO: 520650 - RNA, 22 nt, Human
ccuggcacacgguggcauucaa

SEQ ID NO: 520651 - RNA, 22 nt, Human
cccaggcaguagaaagaagagg

SEQ ID NO: 520652 - RNA, 22 nt, Human
uccccacacuuucacuccuggc

SEQ ID NO: 520653 - RNA, 22 nt, Human
ccaaaguccauaguuuacauua

SEQ ID NO: 520654 - RNA, 22 nt, Human
uaaccaaagggccuaaggaaug

SEQ ID NO: 520655 - RNA, 22 nt, Human
cagcuugggggcgcuggccuca

SEQ ID NO: 520656 - RNA, 22 nt, Human
augcaguacagauaauucuaca

SEQ ID NO: 520657 - RNA, 22 nt, Human
ggcuggagauaugucuggaaca

SEQ ID NO: 520658 - RNA, 22 nt, Human
acugcaugauaauaauagcaga

SEQ ID NO: 520659 - RNA, 19 nt, Human
uguguucauucaucagagg

SEQ ID NO: 520660 - RNA, 22 nt, Human
uggagcagccaugaugacagag

SEQ ID NO: 520661 - RNA, 22 nt, Human
cgaggcaggcaggcggaggaua

SEQ ID NO: 520662 - RNA, 22 nt, Human
gcagcugaagcugcaguuccag

SEQ ID NO: 520663 - RNA, 22 nt, Human
ggaguagcugcauuccgagcac

SEQ ID NO: 520664 - RNA, 21 nt, Human
cugcuuuacuucagaggaucu

SEQ ID NO: 520665 - RNA, 22 nt, Human
gagacugcauuguccaaggguu

SEQ ID NO: 520666 - RNA, 22 nt, Human
aaguguuuacuuaaagucaugg

SEQ ID NO: 520667 - RNA, 22 nt, Human
agggagagacauuuccuucuug

SEQ ID NO: 520668 - RNA, 22 nt, Human
gguccagaagcugguaggguag

SEQ ID NO: 520669 - RNA, 22 nt, Human
uuccaaagaaauugaccaagac

SEQ ID NO: 520670 - RNA, 22 nt, Human
agaaaucucaguaucucaggga

SEQ ID NO: 520671 - RNA, 20 nt, Human
cagcaacuuuggacugaguu

SEQ ID NO: 520672 - RNA, 22 nt, Human
acagagcuaauguugcauaggc

SEQ ID NO: 520673 - RNA, 22 nt, Human
gaagcccaggcuuccuuggcuu

SEQ ID NO: 520674 - RNA, 19 nt, Human
cgcaggagccgaggugacc

SEQ ID NO: 520675 - RNA, 22 nt, Human
ucuguucaagacugaggugaca

SEQ ID NO: 520676 - RNA, 22 nt, Human
auuucagcccaguaugagcccc

SEQ ID NO: 520677 - RNA, 22 nt, Human
ccucagugaguguuuccuucuu

SEQ ID NO: 520678 - RNA, 22 nt, Human
ucuuugcaggagcccuuugaac

SEQ ID NO: 520679 - RNA, 22 nt, Human
agagaacagcauugcagcuuug

SEQ ID NO: 520680 - RNA, 22 nt, Human
gaggaacaugaggugaccuggg

SEQ ID NO: 520681 - RNA, 22 nt, Human
aggaaagguucagugauugaaa

SEQ ID NO: 520682 - RNA, 22 nt, Human
auccuugagaaaauaaaugacc

SEQ ID NO: 520683 - RNA, 22 nt, Human
ccuggcucugcagccacuccag

SEQ ID NO: 520684 - RNA, 22 nt, Human
cacucugcagcugaagggcugg

SEQ ID NO: 520685 - RNA, 18 nt, Human
ucagagguacagaaaagu

SEQ ID NO: 520686 - RNA, 22 nt, Human
ucuggcucugacacuacuguua

SEQ ID NO: 520687 - RNA, 22 nt, Human
gagagaauguacaugcuagggg

SEQ ID NO: 520688 - RNA, 22 nt, Human
gagcagcucugggugacccagu

SEQ ID NO: 520689 - RNA, 22 nt, Human
aaugaugguuucaucacuugaa

SEQ ID NO: 520690 - RNA, 22 nt, Human
ugcuagaaaucugaaacuagca

SEQ ID NO: 520691 - RNA, 22 nt, Human
cagggcuggcuguggcaaucuc

SEQ ID NO: 520692 - RNA, 20 nt, Human
ucucaggccccaguuuucuu

SEQ ID NO: 520693 - RNA, 22 nt, Human
cucccuggcacagcgagagguu

SEQ ID NO: 520694 - RNA, 22 nt, Human
gaggaagaagcaaaccagcuaa

SEQ ID NO: 520695 - RNA, 22 nt, Human
ugcuaggagaggcagcacagcg

SEQ ID NO: 520696 - RNA, 18 nt, Human
gcagugcaggaagaagag

SEQ ID NO: 520697 - RNA, 17 nt, Human
agaaagaggauccacag

SEQ ID NO: 520698 - RNA, 22 nt, Human
gucaguaggaaccuagggucaa

SEQ ID NO: 520699 - RNA, 21 nt, Human
cugccaggauagcaugcaggc

SEQ ID NO: 520700 - RNA, 22 nt, Human
gcucaccacugcuagagucuau

SEQ ID NO: 520701 - RNA, 22 nt, Human
aggcagaauguuggaaaggaag

SEQ ID NO: 520702 - RNA, 22 nt, Human
uucuuucccuuccagcagcucc

SEQ ID NO: 520703 - RNA, 22 nt, Human
guauuagguuggugcaaaauug

SEQ ID NO: 520704 - RNA, 19 nt, Human
agggaauccggcugaggga

SEQ ID NO: 520705 - RNA, 17 nt, Human
ucuggccuuccugaacu

SEQ ID NO: 520706 - RNA, 23 nt, Human
ucguugaauagcaauagcacaac

SEQ ID NO: 520707 - RNA, 22 nt, Human
acuuuuuacaggguguauacca

SEQ ID NO: 520708 - RNA, 22 nt, Human
uuacauaaaaguucacguaggc

SEQ ID NO: 520709 - RNA, 21 nt, Human
gccagagcaguacaaugaggu

SEQ ID NO: 520710 - RNA, 20 nt, Human
agggccuggaguacagcagg

SEQ ID NO: 520711 - RNA, 22 nt, Human
ucaggggcugugcauuucccag

SEQ ID NO: 520712 - RNA, 22 nt, Human
agcagcauggcugacuaaagac

SEQ ID NO: 520713 - RNA, 22 nt, Human
accuguuuacccugggcucccc

SEQ ID NO: 520714 - RNA, 22 nt, Human
agaaaaggcuugaagagguuuu

SEQ ID NO: 520715 - RNA, 22 nt, Human
ccuggcucccccaucauagcug

SEQ ID NO: 520716 - RNA, 22 nt, Human
aggugggacccguggggugcga

SEQ ID NO: 520717 - RNA, 22 nt, Human
aaacaaacauagguuugaaagu

SEQ ID NO: 520718 - RNA, 22 nt, Human
guggcucuccauugacauggaa

SEQ ID NO: 520719 - RNA, 22 nt, Human
uuccucucgcucuccggggccc

SEQ ID NO: 520720 - RNA, 22 nt, Human
caggccagugggaaauagggau

SEQ ID NO: 520721 - RNA, 22 nt, Human
acagagucucaaaccuacaaag

SEQ ID NO: 520722 - RNA, 22 nt, Human
auaaaagaucccuucugagcuc

SEQ ID NO: 520723 - RNA, 22 nt, Human
gcagggaggaagagaugcuucc

SEQ ID NO: 520724 - RNA, 18 nt, Human
uggacaggguggagaaaa

SEQ ID NO: 520725 - RNA, 22 nt, Human
aggaggcugguucaggccauau

SEQ ID NO: 520726 - RNA, 22 nt, Human
uguguucaaugacuucaucuuu

SEQ ID NO: 520727 - RNA, 22 nt, Human
aaaaguaauugcaauuuuguag

SEQ ID NO: 520728 - RNA, 22 nt, Human
ugaugcuucacgcugaauaugc

SEQ ID NO: 520729 - RNA, 22 nt, Human
gggguggauuccuacaggucca

SEQ ID NO: 520730 - RNA, 22 nt, Human
uuucucucagccuguagaaacu

SEQ ID NO: 520731 - RNA, 22 nt, Human
uuaagacaguguauuuguuuuc

SEQ ID NO: 520732 - RNA, 22 nt, Human
uauugucuguccgggucaaagc

SEQ ID NO: 520733 - RNA, 22 nt, Human
acaugcauucucuaaaagcaaa

SEQ ID NO: 520734 - RNA, 22 nt, Human
uccagccaacugccuagggagc

SEQ ID NO: 520735 - RNA, 21 nt, Human
uuguucuuccagaagcaaagu

SEQ ID NO: 520736 - RNA, 17 nt, Human
uggucuggaagaacuga

SEQ ID NO: 520737 - RNA, 22 nt, Human
cagaggcugaugugggaugggc

SEQ ID NO: 520738 - RNA, 22 nt, Human
uccucuggggcgugguccugga

SEQ ID NO: 520739 - RNA, 22 nt, Human
uucacauaaugauacaaagcuu

SEQ ID NO: 520740 - RNA, 22 nt, Human
ggucaggguuccagguaucuuc

SEQ ID NO: 520741 - RNA, 22 nt, Human
uguuaacaucuuggacucguga

SEQ ID NO: 520742 - RNA, 20 nt, Human
uguacacaguacuuuacaau

SEQ ID NO: 520743 - RNA, 22 nt, Human
uguggccuggaaggggcugcuc

SEQ ID NO: 520744 - RNA, 22 nt, Human
gugcucuccuggcugcccugac

SEQ ID NO: 520745 - RNA, 22 nt, Human
agcagggacuacgugaaaguga

SEQ ID NO: 520746 - RNA, 22 nt, Human
uacaaaguuugggguccucaaa

SEQ ID NO: 520747 - RNA, 22 nt, Human
ccuguacaucugcucucauugc

SEQ ID NO: 520748 - RNA, 16 nt, Human
gcacacacaucaauga

SEQ ID NO: 520749 - RNA, 22 nt, Human
aucccccucuuggauggcggca

SEQ ID NO: 520750 - RNA, 22 nt, Human
aaugggaggauuuucucucuug

SEQ ID NO: 520751 - RNA, 22 nt, Human
gaaaugaacugauuaucauugc

SEQ ID NO: 520752 - RNA, 22 nt, Human
augaugguuguccuaggugcau

SEQ ID NO: 520753 - RNA, 22 nt, Human
ccuggggagccgccugagcccc

SEQ ID NO: 520754 - RNA, 22 nt, Human
caggugggcuugggagaacacu

SEQ ID NO: 520755 - RNA, 22 nt, Human
ccucaaaggccuggcaccagaa

SEQ ID NO: 520756 - RNA, 21 nt, Human
cccuucuugggucaaaguaua

SEQ ID NO: 520757 - RNA, 19 nt, Human
ccaggccuggcgucuccgc

SEQ ID NO: 520758 - RNA, 22 nt, Human
ccaggcuggagugcaauggugc

SEQ ID NO: 520759 - RNA, 22 nt, Human
caguccugagcuccugggcuga

SEQ ID NO: 520760 - RNA, 17 nt, Human
ugccagccugucccagg

SEQ ID NO: 520761 - RNA, 22 nt, Human
ccuuucucuaucgacccaucgc

SEQ ID NO: 520762 - RNA, 23 nt, Human
gagcucugcacuaggcccuggga

SEQ ID NO: 520763 - RNA, 22 nt, Human
cuccaguggugauggggaagaa

SEQ ID NO: 520764 - RNA, 22 nt, Human
gcaggguccauggaggcagccc

SEQ ID NO: 520765 - RNA, 22 nt, Human
auacauucaaaggaaggauaga

SEQ ID NO: 520766 - RNA, 22 nt, Human
cuguuuauacgacagguggagg

SEQ ID NO: 520767 - RNA, 22 nt, Human
uuuuuaagcuccuuugauguca

SEQ ID NO: 520768 - RNA, 22 nt, Human
uguaugcaaauuuauuagcaca

SEQ ID NO: 520769 - RNA, 22 nt, Human
uacauucugaaauaaaugguuu

SEQ ID NO: 520770 - RNA, 22 nt, Human
acacaguauuacaauaggugcu

SEQ ID NO: 520771 - RNA, 22 nt, Human
gaaaucugaacucuguauccuu

SEQ ID NO: 520772 - RNA, 22 nt, Human
acuuucuccagaaaaccaagga

SEQ ID NO: 520773 - RNA, 22 nt, Human
cauggccaggcccagggcccag

SEQ ID NO: 520774 - RNA, 22 nt, Human
ugcucuucggggccacugcuug

SEQ ID NO: 520775 - RNA, 22 nt, Human
gcagagccugggggucugcgga

SEQ ID NO: 520776 - RNA, 22 nt, Human
auaauaaaccaggaugggucug

SEQ ID NO: 520777 - RNA, 22 nt, Human
auggcugcaguccgugcccugg

SEQ ID NO: 520778 - RNA, 21 nt, Human
ucucugugucuuuaagcugga

SEQ ID NO: 520779 - RNA, 22 nt, Human
gcugggcuugguuucccugcuu

SEQ ID NO: 520780 - RNA, 22 nt, Human
cagccaagaaccacagacccag

SEQ ID NO: 520781 - RNA, 22 nt, Human
uuaauuaacuagccaaccacua

SEQ ID NO: 520782 - RNA, 22 nt, Human
ccucugggaagccaguccugcu

SEQ ID NO: 520783 - RNA, 22 nt, Human
gcugccugaucauacaccaggg

SEQ ID NO: 520784 - RNA, 22 nt, Human
gugggaugcaguggugaguggc

SEQ ID NO: 520785 - RNA, 22 nt, Human
gagcuuggcuggaccucacgga

SEQ ID NO: 520786 - RNA, 22 nt, Human
ucucuggguucucacucagcac

SEQ ID NO: 520787 - RNA, 22 nt, Human
cuggcugcuuguagacucgacu

SEQ ID NO: 520788 - RNA, 22 nt, Human
cuucagcaucuuuuucuugggg

SEQ ID NO: 520789 - RNA, 22 nt, Human
gggaggugauggcaagcagcgg

SEQ ID NO: 520790 - RNA, 22 nt, Human
ugcaggcucugguuuauagugc

SEQ ID NO: 520791 - RNA, 18 nt, Human
uggagcugagggcaaugc

SEQ ID NO: 520792 - RNA, 22 nt, Human
uggcucagucuggguugacuga

SEQ ID NO: 520793 - RNA, 22 nt, Human
uaguuaggaauagcagcgacuc

SEQ ID NO: 520794 - RNA, 22 nt, Human
aguguguguuugggcgguuuau

SEQ ID NO: 520795 - RNA, 22 nt, Human
auccaaagauggaaagaacuuu

SEQ ID NO: 520796 - RNA, 22 nt, Human
gccugggugucgaucacuagug

SEQ ID NO: 520797 - RNA, 21 nt, Human
augcauguuccauaaaguggg

SEQ ID NO: 520798 - RNA, 22 nt, Human
uggguccuugccaucuuggagu

SEQ ID NO: 520799 - RNA, 22 nt, Human
guccucuguuuccaucugacuu

SEQ ID NO: 520800 - RNA, 21 nt, Human
cagugcugccuaauagggagu

SEQ ID NO: 520801 - RNA, 22 nt, Human
cuggguccccucagugacacug

SEQ ID NO: 520802 - RNA, 22 nt, Human
ggcuuccuaauacucccuacac

SEQ ID NO: 520803 - RNA, 22 nt, Human
gacagacacagggccaugauug

SEQ ID NO: 520804 - RNA, 22 nt, Human
ggcugcugggucaugaugcaga

SEQ ID NO: 520805 - RNA, 22 nt, Human
uuaaauuagucaagcuucucug

SEQ ID NO: 520806 - RNA, 22 nt, Human
gcaggucccagaaaguuaauuc

SEQ ID NO: 520807 - RNA, 22 nt, Human
uagguucacuuagcugugggaa

SEQ ID NO: 520808 - RNA, 22 nt, Human
cagaguucaaagccugcuggga

SEQ ID NO: 520809 - RNA, 22 nt, Human
uucugggcucucuuucugugug

SEQ ID NO: 520810 - RNA, 22 nt, Human
auauuauucuagcucuugugug

SEQ ID NO: 520811 - RNA, 22 nt, Human
cagguggggcgcccucaggcag

SEQ ID NO: 520812 - RNA, 22 nt, Human
cuggcuccugaggcuuggcccc

SEQ ID NO: 520813 - RNA, 22 nt, Human
ccaggccagcaggcacaccugc

SEQ ID NO: 520814 - RNA, 22 nt, Human
cagggcagggauguugcggcag

SEQ ID NO: 520815 - RNA, 20 nt, Human
ugcugcugugagcgucccug

SEQ ID NO: 520816 - RNA, 22 nt, Human
uuuaacagaugugaaauuuuca

SEQ ID NO: 520817 - RNA, 22 nt, Human
ucugggcucacgagucuggaca

SEQ ID NO: 520818 - RNA, 22 nt, Human
ucucuuaaaggucuucagcuga

SEQ ID NO: 520819 - RNA, 22 nt, Human
gaaaugcauggaucuuggcaga

SEQ ID NO: 520820 - RNA, 22 nt, Human
auauaaagaaguggaaaaugag

SEQ ID NO: 520821 - RNA, 22 nt, Human
ggcucuggcaaggggaggcuac

SEQ ID NO: 520822 - RNA, 22 nt, Human
gcccugcuucuggcaugcagaa

SEQ ID NO: 520823 - RNA, 22 nt, Human
aaaaguguucaggaagaauaau

SEQ ID NO: 520824 - RNA, 22 nt, Human
acauagaguucaauuuucaguc

SEQ ID NO: 520825 - RNA, 22 nt, Human
gcugccugauguccagcaggac

SEQ ID NO: 520826 - RNA, 22 nt, Human
gaaggcagguuuuucaaaacug

SEQ ID NO: 520827 - RNA, 22 nt, Human
gagugcaguaugagaggcugcu

SEQ ID NO: 520828 - RNA, 22 nt, Human
cucuggcugccucucaggccug

SEQ ID NO: 520829 - RNA, 22 nt, Human
agagccuggacuuuucugagcc

SEQ ID NO: 520830 - RNA, 22 nt, Human
uucaggaagguccuauagcaga

SEQ ID NO: 520831 - RNA, 22 nt, Human
agccacagagguugaugugguu

SEQ ID NO: 520832 - RNA, 22 nt, Human
gagucuucuacgcucacacaaa

SEQ ID NO: 520833 - RNA, 18 nt, Human
acuccccacaggcucugu

SEQ ID NO: 520834 - RNA, 22 nt, Human
cauugcacuccaucuugggcaa

SEQ ID NO: 520835 - RNA, 22 nt, Human
gugagagggcugggcucaugau

SEQ ID NO: 520836 - RNA, 21 nt, Human
uuacaugguuuaucauaugga

SEQ ID NO: 520837 - RNA, 22 nt, Human
uguauagaguuggaagaugacu

SEQ ID NO: 520838 - RNA, 22 nt, Human
gugugaaaguaauugcgguuuu

SEQ ID NO: 520839 - RNA, 22 nt, Human
aaggcacucauucaaggagaua

SEQ ID NO: 520840 - RNA, 22 nt, Human
uauucaagauugaacuggcaga

SEQ ID NO: 520841 - RNA, 22 nt, Human
cagucccaucucccagguggcu

SEQ ID NO: 520842 - RNA, 17 nt, Human
guggcugcacacacaug

SEQ ID NO: 520843 - RNA, 22 nt, Human
ggguccagauggugagaguuaa

SEQ ID NO: 520844 - RNA, 22 nt, Human
gcaggugguccccguggagugg

SEQ ID NO: 520845 - RNA, 22 nt, Human
ccagagagauugcuucuaaaga

SEQ ID NO: 520846 - RNA, 22 nt, Human
agugugagaugauugaggagca

SEQ ID NO: 520847 - RNA, 17 nt, Human
uggaagcuucauguugg

SEQ ID NO: 520848 - RNA, 22 nt, Human
acugcagggcauccuggccaag

SEQ ID NO: 520849 - RNA, 22 nt, Human
gcccugucggaacugcgaccuc

SEQ ID NO: 520850 - RNA, 19 nt, Human
uuuauuugagacaugccuu

SEQ ID NO: 520851 - RNA, 22 nt, Human
cacugcucgcugcagcauggcc

SEQ ID NO: 520852 - RNA, 19 nt, Human
gaagaagcuugagaaguag

SEQ ID NO: 520853 - RNA, 22 nt, Human
gccagguggcugagugacugag

SEQ ID NO: 520854 - RNA, 22 nt, Human
ucagaagaagagacuccacagc

SEQ ID NO: 520855 - RNA, 22 nt, Human
uucuaguuuagggcucuucaac

SEQ ID NO: 520856 - RNA, 22 nt, Human
ugucccucauugacgcugugcc

SEQ ID NO: 520857 - RNA, 22 nt, Human
caggguccccgggucuccugug

SEQ ID NO: 520858 - RNA, 22 nt, Human
uaaagugucugccucagcucag

SEQ ID NO: 520859 - RNA, 22 nt, Human
ggauggcagucugcaugagaaa

SEQ ID NO: 520860 - RNA, 20 nt, Human
ucugucucugagcuagacuu

SEQ ID NO: 520861 - RNA, 22 nt, Human
cagcucaggcucuccaugcucc

SEQ ID NO: 520862 - RNA, 21 nt, Human
cucuggaggcaagggagagug

SEQ ID NO: 520863 - RNA, 22 nt, Human
uguaugaaaaggaauagauuga

SEQ ID NO: 520864 - RNA, 22 nt, Human
cugccuggcauggagaagagaa

SEQ ID NO: 520865 - RNA, 22 nt, Human
acauuucugcaucucagagcua

SEQ ID NO: 520866 - RNA, 22 nt, Human
cagcugagaagugauagcugca

SEQ ID NO: 520867 - RNA, 22 nt, Human
aguuuuuccugauuuuacagaa

SEQ ID NO: 520868 - RNA, 22 nt, Human
gccagagcugagugagguucuu

SEQ ID NO: 520869 - RNA, 18 nt, Human
cuuuaugugcagagcuuu

SEQ ID NO: 520870 - RNA, 21 nt, Human
gcugggucagcagguccucug

SEQ ID NO: 520871 - RNA, 22 nt, Human
ucaagagaagugcuccacagua

SEQ ID NO: 520872 - RNA, 22 nt, Human
agagcugagcaccaagcauggu

SEQ ID NO: 520873 - RNA, 22 nt, Human
gucccugcaucugcaggccaug

SEQ ID NO: 520874 - RNA, 22 nt, Human
auuagugauaugugacuagacc

SEQ ID NO: 520875 - RNA, 22 nt, Human
uaccuugggguuuuguugcucu

SEQ ID NO: 520876 - RNA, 22 nt, Human
gcuggggagcuagaccucagca

SEQ ID NO: 520877 - RNA, 22 nt, Human
uguggagaagaaggccacugca

SEQ ID NO: 520878 - RNA, 22 nt, Human
ucuggauggucagcucuuccug

SEQ ID NO: 520879 - RNA, 22 nt, Human
agggccugagcuggcugaccuc

SEQ ID NO: 520880 - RNA, 22 nt, Human
ucugugacuugcgggaggagaa

SEQ ID NO: 520881 - RNA, 23 nt, Human
uaacucugugaagggugacuggg

SEQ ID NO: 520882 - RNA, 22 nt, Human
aggccagcuuccagaggggcag

SEQ ID NO: 520883 - RNA, 22 nt, Human
agguccaguuuucaguucucau

SEQ ID NO: 520884 - RNA, 22 nt, Human
guggggcaguggccugggagca

SEQ ID NO: 520885 - RNA, 22 nt, Human
acccacaccuccguauaucacu

SEQ ID NO: 520886 - RNA, 22 nt, Human
cuugagcacagcggcuucagga

SEQ ID NO: 520887 - RNA, 23 nt, Human
gccucugcucugcguuggggacu

SEQ ID NO: 520888 - RNA, 23 nt, Human
uugggcuggcucucgaugccucu

SEQ ID NO: 520889 - RNA, 22 nt, Human
ugaccacagacccaaugacuac

SEQ ID NO: 520890 - RNA, 22 nt, Human
ggcccucugccugugcuggcga

SEQ ID NO: 520891 - RNA, 22 nt, Human
gugaaauuguauuuggcauuga

SEQ ID NO: 520892 - RNA, 22 nt, Human
gagaggcaggaauccuggguga

SEQ ID NO: 520893 - RNA, 22 nt, Human
gcagggcauagaggcacggagg

SEQ ID NO: 520894 - RNA, 22 nt, Human
uggcuccuggcagguguuucaa

SEQ ID NO: 520895 - RNA, 19 nt, Human
ucugaggguccagaugcau

SEQ ID NO: 520896 - RNA, 22 nt, Human
ggcacuggaaggaucaugugag

SEQ ID NO: 520897 - RNA, 22 nt, Human
gcuggucacucugggagcugcu

SEQ ID NO: 520898 - RNA, 22 nt, Human
aagccagggauuccugagggag

SEQ ID NO: 520899 - RNA, 22 nt, Human
auuagcuugguaugccauaaag

SEQ ID NO: 520900 - RNA, 22 nt, Human
gacuucuauuaauaccucuacu

SEQ ID NO: 520901 - RNA, 22 nt, Human
agaggccagcaaccacaguaaa

SEQ ID NO: 520902 - RNA, 20 nt, Human
aaaauauguauaacucuucu

SEQ ID NO: 520903 - RNA, 22 nt, Human
ucacaaagggagggauagcugg

SEQ ID NO: 520904 - RNA, 22 nt, Human
cgccuggaaccucuaggaccag

SEQ ID NO: 520905 - RNA, 22 nt, Human
agucugaaguagucuuuagugu

SEQ ID NO: 520906 - RNA, 22 nt, Human
cuggcucuuuccuagcuaggcu

SEQ ID NO: 520907 - RNA, 22 nt, Human
gcucccacaaccuucuugcucc

SEQ ID NO: 520908 - RNA, 22 nt, Human
gcggggggcagcagucgcucag

SEQ ID NO: 520909 - RNA, 22 nt, Human
uuccaagugucagaucagauuu

SEQ ID NO: 520910 - RNA, 22 nt, Human
agccuuaaaugcuagauucaua

SEQ ID NO: 520911 - RNA, 22 nt, Human
acucaguggcacuuuggaauuu

SEQ ID NO: 520912 - RNA, 22 nt, Human
aagccagggucaggggccuccu

SEQ ID NO: 520913 - RNA, 22 nt, Human
uuggccacacucacuagagccc

SEQ ID NO: 520914 - RNA, 22 nt, Human
agggucaggagacacuggcaac

SEQ ID NO: 520915 - RNA, 22 nt, Human
ucacuguaucauguugcacuua

SEQ ID NO: 520916 - RNA, 22 nt, Human
uauuuaguuaucuuucauaaaa

SEQ ID NO: 520917 - RNA, 22 nt, Human
cgccugggaguccacaccugcu

SEQ ID NO: 520918 - RNA, 22 nt, Human
aaggagcucccggcagaccagg

SEQ ID NO: 520919 - RNA, 22 nt, Human
gucaugccagcggagcucggga

SEQ ID NO: 520920 - RNA, 22 nt, Human
gcagagucagguccaaggacug

SEQ ID NO: 520921 - RNA, 22 nt, Human
cugagcugguucucuugugaaa

SEQ ID NO: 520922 - RNA, 22 nt, Human
caguggccugagccaggcuucc

SEQ ID NO: 520923 - RNA, 22 nt, Human
aggggcugacuggaaagugcca

SEQ ID NO: 520924 - RNA, 22 nt, Human
ggauuucuuccuuccucagaag

SEQ ID NO: 520925 - RNA, 22 nt, Human
gccaggcaaauuaaggaaugca

SEQ ID NO: 520926 - RNA, 22 nt, Human
cugggccacaagccugugugau

SEQ ID NO: 520927 - RNA, 22 nt, Human
ccuuagcaacacuuagcaacug

SEQ ID NO: 520928 - RNA, 22 nt, Human
ucuuuccuuagaauaauucuuu

SEQ ID NO: 520929 - RNA, 22 nt, Human
ggacaggaugcugaagaugaag

SEQ ID NO: 520930 - RNA, 22 nt, Human
cagucucucagcuuucagcugu

SEQ ID NO: 520931 - RNA, 22 nt, Human
cccaggcuaguaugauaucagu

SEQ ID NO: 520932 - RNA, 18 nt, Human
ucaaagucuggcuccacu

SEQ ID NO: 520933 - RNA, 22 nt, Human
guguacaggaugacuguacuua

SEQ ID NO: 520934 - RNA, 22 nt, Human
ugucacauaggcaaaauguuuu

SEQ ID NO: 520935 - RNA, 22 nt, Human
ccauuguaguaucuguuuuagu

SEQ ID NO: 520936 - RNA, 22 nt, Human
cgccccucagcgacccaccagc

SEQ ID NO: 520937 - RNA, 22 nt, Human
augaagauaagaccaggcugga

SEQ ID NO: 520938 - RNA, 22 nt, Human
uuccuggguuuacguauugggu

SEQ ID NO: 520939 - RNA, 22 nt, Human
ucaguguucuggauuuggggca

SEQ ID NO: 520940 - RNA, 22 nt, Human
aagcugcuggugacugggcuga

SEQ ID NO: 520941 - RNA, 22 nt, Human
uccaggcaugucugaguccuuc

SEQ ID NO: 520942 - RNA, 22 nt, Human
uuuuuccaccguacuuccugag

SEQ ID NO: 520943 - RNA, 22 nt, Human
cagcagguggacacacucaccu

SEQ ID NO: 520944 - RNA, 22 nt, Human
cuguggcaagucugccugucac

SEQ ID NO: 520945 - RNA, 22 nt, Human
cugcagugaaaucaggaagcaa

SEQ ID NO: 520946 - RNA, 22 nt, Human
auggaaaucgaugucuaaguua

SEQ ID NO: 520947 - RNA, 22 nt, Human
aagaaagccaaaguucauaccu

SEQ ID NO: 520948 - RNA, 22 nt, Human
cagccccuuccuggcaucugga

SEQ ID NO: 520949 - RNA, 22 nt, Human
aucuguuguuuguuugcuaaag

SEQ ID NO: 520950 - RNA, 22 nt, Human
gugcuggcaccccucuccaguu

SEQ ID NO: 520951 - RNA, 22 nt, Human
uagaaaugugauaauagcuuaa

SEQ ID NO: 520952 - RNA, 22 nt, Human
gcacaugagcugcugggauggg

SEQ ID NO: 520953 - RNA, 22 nt, Human
cuggcaggagcauucacagagg

SEQ ID NO: 520954 - RNA, 22 nt, Human
cagauucuucauucauucuaca

SEQ ID NO: 520955 - RNA, 19 nt, Human
cuucuggcccugagccacc

SEQ ID NO: 520956 - RNA, 18 nt, Human
ucagagagaauaguaauu

SEQ ID NO: 520957 - RNA, 22 nt, Human
aggaugaauaacugaaauggug

SEQ ID NO: 520958 - RNA, 22 nt, Human
gcccagcuuuuugaggcaggca

SEQ ID NO: 520959 - RNA, 22 nt, Human
cuggcucuaucuccaaggcugg

SEQ ID NO: 520960 - RNA, 22 nt, Human
gggcucagccccauugaaccag

SEQ ID NO: 520961 - RNA, 22 nt, Human
gaagcagcuggugagauggagc

SEQ ID NO: 520962 - RNA, 21 nt, Human
agugugugauaggcaggaaga

SEQ ID NO: 520963 - RNA, 22 nt, Human
cuggccuggggccucagcugcu

SEQ ID NO: 520964 - RNA, 22 nt, Human
ucacagaaguguguuucaggag

SEQ ID NO: 520965 - RNA, 22 nt, Human
uucucuuaucuggcauuauugg

SEQ ID NO: 520966 - RNA, 22 nt, Human
agcuccuugaagggcucuggga

SEQ ID NO: 520967 - RNA, 22 nt, Human
cuuuguaucuaaauaucuugaa

SEQ ID NO: 520968 - RNA, 22 nt, Human
uagcaaaggccuuggacacgcu

SEQ ID NO: 520969 - RNA, 21 nt, Human
ugcaagaaucaggaagcugcc

SEQ ID NO: 520970 - RNA, 22 nt, Human
ucugggugaugaaaugcacugu

SEQ ID NO: 520971 - RNA, 22 nt, Human
uggugcuguggaggggcagaag

SEQ ID NO: 520972 - RNA, 22 nt, Human
gggugggagucuggcccucaaa

SEQ ID NO: 520973 - RNA, 22 nt, Human
cugaggucaauuaaucaacaac

SEQ ID NO: 520974 - RNA, 22 nt, Human
ucugcaggcauuuuugguuguc

SEQ ID NO: 520975 - RNA, 22 nt, Human
ucauuuaugcaggaauggcaua

SEQ ID NO: 520976 - RNA, 17 nt, Human
uuauuuuuugggcugag

SEQ ID NO: 520977 - RNA, 22 nt, Human
cacacacaguuuuguauucugu

SEQ ID NO: 520978 - RNA, 22 nt, Human
guggccuuuccugaagaaauga

SEQ ID NO: 520979 - RNA, 19 nt, Human
cuggccuguguccugugcu

SEQ ID NO: 520980 - RNA, 22 nt, Human
uccaggcacuauauauacuuuu

SEQ ID NO: 520981 - RNA, 22 nt, Human
uaaauguguguagccaucugug

SEQ ID NO: 520982 - RNA, 22 nt, Human
uccagucaggcugaauucaagg

SEQ ID NO: 520983 - RNA, 21 nt, Human
ggcuuuaugcucacccagccu

SEQ ID NO: 520984 - RNA, 20 nt, Human
uccucagaagacauuugggg

SEQ ID NO: 520985 - RNA, 22 nt, Human
cugggaugauagugcuaguauu

SEQ ID NO: 520986 - RNA, 22 nt, Human
ucucagagauuuuguuucccuu

SEQ ID NO: 520987 - RNA, 22 nt, Human
ggcuggcuggcugguagacaag

SEQ ID NO: 520988 - RNA, 22 nt, Human
guggggggacguuggucacuuu

SEQ ID NO: 520989 - RNA, 22 nt, Human
cacccagcacagagggaggcga

SEQ ID NO: 520990 - RNA, 22 nt, Human
ugagcagaggagugacguaggu

SEQ ID NO: 520991 - RNA, 17 nt, Human
ugguggcuggagucagg

SEQ ID NO: 520992 - RNA, 22 nt, Human
agggcucugagugggaaagagg

SEQ ID NO: 520993 - RNA, 22 nt, Human
uuugaacaagagcuucacauua

SEQ ID NO: 520994 - RNA, 22 nt, Human
gcccauggacacccaagugcca

SEQ ID NO: 520995 - RNA, 21 nt, Human
ucagcaggcaccagaaggcug

SEQ ID NO: 520996 - RNA, 22 nt, Human
aguucagcuucccaggucacug

SEQ ID NO: 520997 - RNA, 22 nt, Human
aggggcugccuggcuuggcacu

SEQ ID NO: 520998 - RNA, 22 nt, Human
gcugggagcccuggucugcucc

SEQ ID NO: 520999 - RNA, 22 nt, Human
gaaggccucacucugcagcaua

SEQ ID NO: 521000 - RNA, 17 nt, Human
ccaggugggaggugggg

SEQ ID NO: 521001 - RNA, 22 nt, Human
caggcagggagccacuguauaa

SEQ ID NO: 521002 - RNA, 22 nt, Human
gagcagaugugugccaggaugc

SEQ ID NO: 521003 - RNA, 22 nt, Human
ugcucugguccucccucggcgc

SEQ ID NO: 521004 - RNA, 22 nt, Human
auuuucauggcuucugcucagu

SEQ ID NO: 521005 - RNA, 22 nt, Human
gaggaggucccccgacaugccu

SEQ ID NO: 521006 - RNA, 21 nt, Human
gccugggauaguggccuccgg

SEQ ID NO: 521007 - RNA, 22 nt, Human
uagacauuuggaguuuuaugac

SEQ ID NO: 521008 - RNA, 22 nt, Human
aaguucuacagcuucgcaggca

SEQ ID NO: 521009 - RNA, 22 nt, Human
ggccugcucugcagccucuaca

SEQ ID NO: 521010 - RNA, 22 nt, Human
uguccugggucaaccaggucga

SEQ ID NO: 521011 - RNA, 22 nt, Human
gagacaucauaaugaaguuucc

SEQ ID NO: 521012 - RNA, 22 nt, Human
aagggcucccugccugaggugg

SEQ ID NO: 521013 - RNA, 22 nt, Human
uaucuacaguuaauaugucauc

SEQ ID NO: 521014 - RNA, 20 nt, Human
ggagcuggcauccagccucu

SEQ ID NO: 521015 - RNA, 22 nt, Human
gccuucugauaucucuuggcau

SEQ ID NO: 521016 - RNA, 22 nt, Human
uugccacugaaccagucuugca

SEQ ID NO: 521017 - RNA, 22 nt, Human
guccucugaaguugugcaaugc

SEQ ID NO: 521018 - RNA, 22 nt, Human
cccagcauuucugggcugcacu

SEQ ID NO: 521019 - RNA, 22 nt, Human
uccuggcucggcuuggggacuu

SEQ ID NO: 521020 - RNA, 22 nt, Human
gaggcugcuuugaugacaggag

SEQ ID NO: 521021 - RNA, 22 nt, Human
gccccuucguggaagugcauuc

SEQ ID NO: 521022 - RNA, 22 nt, Human
ccacagaguccgcauuugaggc

SEQ ID NO: 521023 - RNA, 22 nt, Human
ccucagaugucuuaaggcacug

SEQ ID NO: 521024 - RNA, 23 nt, Human
ugaauuuggaacucagagaauua

SEQ ID NO: 521025 - RNA, 22 nt, Human
guccauuuuauucagagacuuu

SEQ ID NO: 521026 - RNA, 19 nt, Human
gccugccagauaguaauga

SEQ ID NO: 521027 - RNA, 22 nt, Human
gccacagucaggacggggagag

SEQ ID NO: 521028 - RNA, 22 nt, Human
cucugggcaggaccaguggacc

SEQ ID NO: 521029 - RNA, 22 nt, Human
cuguggcugucucuuucccaug

SEQ ID NO: 521030 - RNA, 22 nt, Human
augugcaggauccaggcuccua

SEQ ID NO: 521031 - RNA, 20 nt, Human
cagggccacgcuccaaggca

SEQ ID NO: 521032 - RNA, 22 nt, Human
cagagcugggaucccaugggcg

SEQ ID NO: 521033 - RNA, 22 nt, Human
acagauuuugguauuugcaaug

SEQ ID NO: 521034 - RNA, 22 nt, Human
cugugcaguaggucagggcugg

SEQ ID NO: 521035 - RNA, 22 nt, Human
gaggcugaguagcuuugugcuc

SEQ ID NO: 521036 - RNA, 22 nt, Human
aaagaacaauguggaaucuccu

SEQ ID NO: 521037 - RNA, 22 nt, Human
ggucccaggcucccucuugucc

SEQ ID NO: 521038 - RNA, 22 nt, Human
agagccacugggagacagagca

SEQ ID NO: 521039 - RNA, 21 nt, Human
agcuuguguguaucacagugu

SEQ ID NO: 521040 - RNA, 22 nt, Human
agcuggaacccgggugggcagc

SEQ ID NO: 521041 - RNA, 21 nt, Human
ucucuuugggaacauuaauca

SEQ ID NO: 521042 - RNA, 22 nt, Human
ugagcccagucugucugacaug

SEQ ID NO: 521043 - RNA, 22 nt, Human
gcccuuagguacuacuuauucu

SEQ ID NO: 521044 - RNA, 22 nt, Human
uccaugugccaaggggcagagg

SEQ ID NO: 521045 - RNA, 23 nt, Human
ugaaggcccuggagccacgaggc

SEQ ID NO: 521046 - RNA, 22 nt, Human
gcagugcaugucggaacucauu

SEQ ID NO: 521047 - RNA, 22 nt, Human
gcacacagauuaggaaacagaa

SEQ ID NO: 521048 - RNA, 22 nt, Human
cuguggcuuucucugccuccuu

SEQ ID NO: 521049 - RNA, 22 nt, Human
gcuuccucccugcugcucacua

SEQ ID NO: 521050 - RNA, 22 nt, Human
ggaaccaguggaaugauaugcu

SEQ ID NO: 521051 - RNA, 22 nt, Human
uacagagacuuuauggcacaaa

SEQ ID NO: 521052 - RNA, 22 nt, Human
gggcaggugauuuuggcuccau

SEQ ID NO: 521053 - RNA, 22 nt, Human
ucugccagaagccagggucugg

SEQ ID NO: 521054 - RNA, 22 nt, Human
ucuggcagggucagggcccagg

SEQ ID NO: 521055 - RNA, 22 nt, Human
uguacaguguagucaugagguu

SEQ ID NO: 521056 - RNA, 22 nt, Human
agagccuggagguucugcugaa

SEQ ID NO: 521057 - RNA, 22 nt, Human
cagaaaauagaguuucucugag

SEQ ID NO: 521058 - RNA, 22 nt, Human
gguccagggaacuuugaaggau

SEQ ID NO: 521059 - RNA, 22 nt, Human
uuuacaaccucauauucugaug

SEQ ID NO: 521060 - RNA, 22 nt, Human
aaaucugguucaguaaguccuc

SEQ ID NO: 521061 - RNA, 22 nt, Human
cagugcugggcagaggagagcg

SEQ ID NO: 521062 - RNA, 19 nt, Human
agguccugaucagcaagga

SEQ ID NO: 521063 - RNA, 22 nt, Human
ugcuucugacugggucaguuga

SEQ ID NO: 521064 - RNA, 22 nt, Human
gcucuggcuaguuaccucuuac

SEQ ID NO: 521065 - RNA, 18 nt, Human
uccugggaacuugcuagc

SEQ ID NO: 521066 - RNA, 22 nt, Human
ugucucugugagaucugacgau

SEQ ID NO: 521067 - RNA, 22 nt, Human
gcuggggagaauuggguuaucu

SEQ ID NO: 521068 - RNA, 22 nt, Human
agccaggccagcugucuugagu

SEQ ID NO: 521069 - RNA, 22 nt, Human
uggcaggagguuuucuccagga

SEQ ID NO: 521070 - RNA, 22 nt, Human
aggucuggugggcuuuagauug

SEQ ID NO: 521071 - RNA, 22 nt, Human
ggcuucugguaaagaccacacc

SEQ ID NO: 521072 - RNA, 22 nt, Human
aaaccuuugccuggaagggagu

SEQ ID NO: 521073 - RNA, 22 nt, Human
aaaguauuuuugacaggcauua

SEQ ID NO: 521074 - RNA, 22 nt, Human
gccaggcuguuuuuauuacugu

SEQ ID NO: 521075 - RNA, 22 nt, Human
aaagagcucacaguccacugga

SEQ ID NO: 521076 - RNA, 22 nt, Human
agggaugguggagguugcaagu

SEQ ID NO: 521077 - RNA, 22 nt, Human
cagcuuucaucagugacacuca

SEQ ID NO: 521078 - RNA, 22 nt, Human
cuuccucccccacacacucacu

SEQ ID NO: 521079 - RNA, 22 nt, Human
cagucucuaaaucaaucugaau

SEQ ID NO: 521080 - RNA, 22 nt, Human
aauagacuccagggucuauuuu

SEQ ID NO: 521081 - RNA, 22 nt, Human
auuucucagugaaaugacaggc

SEQ ID NO: 521082 - RNA, 22 nt, Human
acucaggaaaaauguagugaua

SEQ ID NO: 521083 - RNA, 23 nt, Human
agcagccagagauccucggcccu

SEQ ID NO: 521084 - RNA, 22 nt, Human
gcccuuccaacccagagggcaa

SEQ ID NO: 521085 - RNA, 22 nt, Human
acaaguucugggaauuaggaca

SEQ ID NO: 521086 - RNA, 20 nt, Human
ugcugaagaaucacagaugg

SEQ ID NO: 521087 - RNA, 22 nt, Human
ggccucaguuucuucaacugua

SEQ ID NO: 521088 - RNA, 22 nt, Human
uuuucauugagcaccugaguaa

SEQ ID NO: 521089 - RNA, 22 nt, Human
augacagacagaagggauuuuu

SEQ ID NO: 521090 - RNA, 22 nt, Human
uggggccugaaagguucucgcc

SEQ ID NO: 521091 - RNA, 22 nt, Human
uggagcagagaugguggccuuc

SEQ ID NO: 521092 - RNA, 22 nt, Human
gggcugaucgcuugagcucagg

SEQ ID NO: 521093 - RNA, 22 nt, Human
aggugcugggcagcagucauug

SEQ ID NO: 521094 - RNA, 22 nt, Human
uugcaccauuucacuuccauua

SEQ ID NO: 521095 - RNA, 22 nt, Human
gcagggcuaauggggcaaguag

SEQ ID NO: 521096 - RNA, 17 nt, Human
cuggagccaagagggcc

SEQ ID NO: 521097 - RNA, 20 nt, Human
uuuauagugaucaauuuaua

SEQ ID NO: 521098 - RNA, 22 nt, Human
ccccacaccugccgggcagcag

SEQ ID NO: 521099 - RNA, 22 nt, Human
agagugaaggccagguuacagu

SEQ ID NO: 521100 - RNA, 22 nt, Human
cuuccugguuugaagcucgccg

SEQ ID NO: 521101 - RNA, 22 nt, Human
ccaggucuucacuuuacugaag

SEQ ID NO: 521102 - RNA, 18 nt, Human
ucugggcuucccgaggcu

SEQ ID NO: 521103 - RNA, 22 nt, Human
ccacacuaaacugcucaaacca

SEQ ID NO: 521104 - RNA, 22 nt, Human
ccgggccucgggacaccgggua

SEQ ID NO: 521105 - RNA, 22 nt, Human
ggcuucuccccuuugagucuuc

SEQ ID NO: 521106 - RNA, 22 nt, Human
caugaccccccaaggccugcag

SEQ ID NO: 521107 - RNA, 22 nt, Human
acgugcaucuuuccauaugugg

SEQ ID NO: 521108 - RNA, 22 nt, Human
cuccagugcacccagaggauuu

SEQ ID NO: 521109 - RNA, 22 nt, Human
auguguaugagugugcuucuuu

SEQ ID NO: 521110 - RNA, 22 nt, Human
gggcuucucuuaugcuaacugg

SEQ ID NO: 521111 - RNA, 22 nt, Human
cuuagggaaucuuagagcugga

SEQ ID NO: 521112 - RNA, 22 nt, Human
gcagaagucagaccaucugaau

SEQ ID NO: 521113 - RNA, 22 nt, Human
ucaauucaauugaacaguuacu

SEQ ID NO: 521114 - RNA, 23 nt, Human
ugccaggguuuguuugugguuca

SEQ ID NO: 521115 - RNA, 22 nt, Human
cuguuaaucugcuugcaugaug

SEQ ID NO: 521116 - RNA, 22 nt, Human
cagcccuggcuagggcgagggc

SEQ ID NO: 521117 - RNA, 22 nt, Human
caggucugcagacagggccaug

SEQ ID NO: 521118 - RNA, 21 nt, Human
ugggaccuagcuuugcacagg

SEQ ID NO: 521119 - RNA, 22 nt, Human
gcuggccugggcagccugucgg

SEQ ID NO: 521120 - RNA, 22 nt, Human
acaucacaguaguuaagccaga

SEQ ID NO: 521121 - RNA, 22 nt, Human
ugucucagaguaucccugaacu

SEQ ID NO: 521122 - RNA, 22 nt, Human
guguuuccucacuucucugacu

SEQ ID NO: 521123 - RNA, 22 nt, Human
acagcaggaagcuggagggaaa

SEQ ID NO: 521124 - RNA, 22 nt, Human
ccaaaugcuccacugacuuugg

SEQ ID NO: 521125 - RNA, 22 nt, Human
aguuucucuuaaucuaguaucu

SEQ ID NO: 521126 - RNA, 22 nt, Human
cucaggaaaauauugaagaagu

SEQ ID NO: 521127 - RNA, 22 nt, Human
ucucaccaaagccuugaccaua

SEQ ID NO: 521128 - RNA, 22 nt, Human
uuguggaaauacagacuccaag

SEQ ID NO: 521129 - RNA, 22 nt, Human
ucuaccacuuauuagcucugug

SEQ ID NO: 521130 - RNA, 22 nt, Human
ucucuggagggcuccaggcggg

SEQ ID NO: 521131 - RNA, 20 nt, Human
agacccucuggacugggccc

SEQ ID NO: 521132 - RNA, 22 nt, Human
agcugccacauggugucacugu

SEQ ID NO: 521133 - RNA, 22 nt, Human
uagcuuuaggcacguuugaauu

SEQ ID NO: 521134 - RNA, 20 nt, Human
agaagccaagugacauguuu

SEQ ID NO: 521135 - RNA, 22 nt, Human
cugugagggccagagucagggc

SEQ ID NO: 521136 - RNA, 22 nt, Human
uggggcuguggauucucacgaa

SEQ ID NO: 521137 - RNA, 22 nt, Human
uacagccacaggugacucucau

SEQ ID NO: 521138 - RNA, 22 nt, Human
gucuggagacuugggucaucaa

SEQ ID NO: 521139 - RNA, 22 nt, Human
uggcucaguuucugcccagcug

SEQ ID NO: 521140 - RNA, 20 nt, Human
uuuucugugccaagaaaacu

SEQ ID NO: 521141 - RNA, 22 nt, Human
gcugccaugguccaggcuccag

SEQ ID NO: 521142 - RNA, 22 nt, Human
ggcccaguguugccagaccuga

SEQ ID NO: 521143 - RNA, 22 nt, Human
cugcagagcauaaaucugaaua

SEQ ID NO: 521144 - RNA, 22 nt, Human
gcucuggcacuggcgcgggaug

SEQ ID NO: 521145 - RNA, 22 nt, Human
ggcugcugcccaccccugcaug

SEQ ID NO: 521146 - RNA, 22 nt, Human
aaacaguuucauuuucaugacc

SEQ ID NO: 521147 - RNA, 19 nt, Human
gccugggaugggcagaacu

SEQ ID NO: 521148 - RNA, 22 nt, Human
agacaucauguuacagauuaag

SEQ ID NO: 521149 - RNA, 20 nt, Human
cagcucugggcaggucgagg

SEQ ID NO: 521150 - RNA, 22 nt, Human
acccagagcacagaugcaacgu

SEQ ID NO: 521151 - RNA, 23 nt, Human
uugauuuagcugggauugcaugc

SEQ ID NO: 521152 - RNA, 22 nt, Human
uggcucagaagaaaagguaaac

SEQ ID NO: 521153 - RNA, 22 nt, Human
agcuuuauauaaaagaguacau

SEQ ID NO: 521154 - RNA, 23 nt, Human
cuggcucauccugguugcagugg

SEQ ID NO: 521155 - RNA, 22 nt, Human
uuuuuccuagugcuuucuggua

SEQ ID NO: 521156 - RNA, 22 nt, Human
aggucauuccuugucuucuugc

SEQ ID NO: 521157 - RNA, 22 nt, Human
gggaagaguaacuagcccaugu

SEQ ID NO: 521158 - RNA, 22 nt, Human
ccuuagcauuagaagcuguggg

SEQ ID NO: 521159 - RNA, 22 nt, Human
ggggccacuggcaggaccuugg

SEQ ID NO: 521160 - RNA, 22 nt, Human
cugcugggggacacagguccgg

SEQ ID NO: 521161 - RNA, 22 nt, Human
aagcuuuaaggaauuuuaugga

SEQ ID NO: 521162 - RNA, 22 nt, Human
augauuucuauauaaacuuaaa

SEQ ID NO: 521163 - RNA, 22 nt, Human
auauuaggugcucaauacaugc

SEQ ID NO: 521164 - RNA, 22 nt, Human
aaggccugcucagcugucugug

SEQ ID NO: 521165 - RNA, 22 nt, Human
ggggcagaaagcccacagagug

SEQ ID NO: 521166 - RNA, 22 nt, Human
uuauuccaauuucuccuacaaa

SEQ ID NO: 521167 - RNA, 22 nt, Human
uucacagacuuuccauagauug

SEQ ID NO: 521168 - RNA, 22 nt, Human
cccaaggccuucaagccagcuc

SEQ ID NO: 521169 - RNA, 22 nt, Human
agacacaguguugaaggcuagu

SEQ ID NO: 521170 - RNA, 22 nt, Human
agcuguccuggcucaggcugug

SEQ ID NO: 521171 - RNA, 22 nt, Human
guacaguuuucaguguucacug

SEQ ID NO: 521172 - RNA, 22 nt, Human
gcuggagguuucaccugaguuu

SEQ ID NO: 521173 - RNA, 22 nt, Human
ugcauuguaggauguuuagcag

SEQ ID NO: 521174 - RNA, 22 nt, Human
uuuuagaaguucacuuggguuu

SEQ ID NO: 521175 - RNA, 22 nt, Human
caggcuggacauuagauacaua

SEQ ID NO: 521176 - RNA, 22 nt, Human
uuuauugggccuggaggaucua

SEQ ID NO: 521177 - RNA, 22 nt, Human
uagagguagaguuacauuaguc

SEQ ID NO: 521178 - RNA, 22 nt, Human
ccacugaaggucaacauagagc

SEQ ID NO: 521179 - RNA, 22 nt, Human
aauguguagggugccuguuuuu

SEQ ID NO: 521180 - RNA, 22 nt, Human
auuauuuguguccacagaauac

SEQ ID NO: 521181 - RNA, 22 nt, Human
ucacagggcauuauggcuccag

SEQ ID NO: 521182 - RNA, 22 nt, Human
agagcugaauuuggguggugga

SEQ ID NO: 521183 - RNA, 22 nt, Human
augugguugaagaauuacaucu

SEQ ID NO: 521184 - RNA, 19 nt, Human
auacacauacguaaacuga

SEQ ID NO: 521185 - RNA, 22 nt, Human
cagccugacaccagcuuugggc

SEQ ID NO: 521186 - RNA, 22 nt, Human
cccagccucuggauucugcccu

SEQ ID NO: 521187 - RNA, 22 nt, Human
gggaacagggccugagcugggg

SEQ ID NO: 521188 - RNA, 16 nt, Human
gccuggaguggcaggg

SEQ ID NO: 521189 - RNA, 22 nt, Human
uucuggcuugaccccuacuucc

SEQ ID NO: 521190 - RNA, 22 nt, Human
cacaugugcaguuacaugaauu

SEQ ID NO: 521191 - RNA, 22 nt, Human
caagagagaugcagcucacuca

SEQ ID NO: 521192 - RNA, 20 nt, Human
cugggcucaagugauccucc

SEQ ID NO: 521193 - RNA, 22 nt, Human
cuuggccugacauguggcaggg

SEQ ID NO: 521194 - RNA, 18 nt, Human
gacccagcagaugggcuu

SEQ ID NO: 521195 - RNA, 22 nt, Human
cccugcugucaggugcugggag

SEQ ID NO: 521196 - RNA, 22 nt, Human
ucacucucuaagcaugacagac

SEQ ID NO: 521197 - RNA, 22 nt, Human
gcaaguacaaacgcaucggcug

SEQ ID NO: 521198 - RNA, 22 nt, Human
ggccagggggcuucagacucca

SEQ ID NO: 521199 - RNA, 22 nt, Human
agccaggauuggcugagccuua

SEQ ID NO: 521200 - RNA, 20 nt, Human
uaaauuagccuugaagauua

SEQ ID NO: 521201 - RNA, 22 nt, Human
ucccuagucgcaucuguggaga

SEQ ID NO: 521202 - RNA, 22 nt, Human
agcaccuggucuccuggcgcug

SEQ ID NO: 521203 - RNA, 22 nt, Human
agccacagucugaugccugaga

SEQ ID NO: 521204 - RNA, 21 nt, Human
ucagaguguguuacagcaagc

SEQ ID NO: 521205 - RNA, 22 nt, Human
uugugauaaaacauuagacauu

SEQ ID NO: 521206 - RNA, 22 nt, Human
caauucaaguugaguacagcuu

SEQ ID NO: 521207 - RNA, 21 nt, Human
uuuauuuauauaggacacaug

SEQ ID NO: 521208 - RNA, 22 nt, Human
auuuaauuuucucaacagugcu

SEQ ID NO: 521209 - RNA, 22 nt, Human
ugauuuccaguugcugggugcu

SEQ ID NO: 521210 - RNA, 22 nt, Human
aggcuucuacguggucccaggg

SEQ ID NO: 521211 - RNA, 22 nt, Human
aaugcugcaagaggugaaaaga

SEQ ID NO: 521212 - RNA, 22 nt, Human
aguacugucagcaggguguuga

SEQ ID NO: 521213 - RNA, 22 nt, Human
caggauccuggcugcauggacg

SEQ ID NO: 521214 - RNA, 22 nt, Human
agagcugaggauccagcugagc

SEQ ID NO: 521215 - RNA, 22 nt, Human
gacagacaggaggcauucaggg

SEQ ID NO: 521216 - RNA, 22 nt, Human
gcucuugucaaaaauuaguuga

SEQ ID NO: 521217 - RNA, 22 nt, Human
gaggacagcuuagggcuuccug

SEQ ID NO: 521218 - RNA, 20 nt, Human
cucuccucacccgugucagg

SEQ ID NO: 521219 - RNA, 22 nt, Human
agccuggagcuugaguuaugag

SEQ ID NO: 521220 - RNA, 22 nt, Human
uacaacaguucaugaaaugaaa

SEQ ID NO: 521221 - RNA, 22 nt, Human
caucacuguccaaaguucaguu

SEQ ID NO: 521222 - RNA, 22 nt, Human
gccagguucuggggagguacaa

SEQ ID NO: 521223 - RNA, 22 nt, Human
ucuucagagacucugagccccu

SEQ ID NO: 521224 - RNA, 22 nt, Human
ggugauuuucgaguuucauguu

SEQ ID NO: 521225 - RNA, 22 nt, Human
uggcugaggagagggcggaagu

SEQ ID NO: 521226 - RNA, 22 nt, Human
agcuggcuuugagcugggaggu

SEQ ID NO: 521227 - RNA, 22 nt, Human
agaagggaacucagagaugauu

SEQ ID NO: 521228 - RNA, 22 nt, Human
cuggaaggcucugcugccuguc

SEQ ID NO: 521229 - RNA, 22 nt, Human
uacagucaacauugaugaugau

SEQ ID NO: 521230 - RNA, 21 nt, Human
ggaaagaaggcaaggcucagg

SEQ ID NO: 521231 - RNA, 22 nt, Human
aggcuccuaucgcuuucagcaa

SEQ ID NO: 521232 - RNA, 22 nt, Human
aauuagaagggaguuauugaua

SEQ ID NO: 521233 - RNA, 22 nt, Human
ggcugcucuccaucccaggccu

SEQ ID NO: 521234 - RNA, 22 nt, Human
aagcaggauggaucuaguguuc

SEQ ID NO: 521235 - RNA, 22 nt, Human
cugcucugcagcuuggacuccc

SEQ ID NO: 521236 - RNA, 22 nt, Human
cagggcagagccaggauuucaa

SEQ ID NO: 521237 - RNA, 22 nt, Human
cuggccacugcgggccucugcc

SEQ ID NO: 521238 - RNA, 22 nt, Human
ccugggcuccacuccaagagca

SEQ ID NO: 521239 - RNA, 22 nt, Human
gccugagccgccugagcggcgg

SEQ ID NO: 521240 - RNA, 22 nt, Human
gagggcagagucuaaugaugca

SEQ ID NO: 521241 - RNA, 22 nt, Human
cugucaguaggcucccaucauu

SEQ ID NO: 521242 - RNA, 22 nt, Human
cagcugagcaucacuagucugg

SEQ ID NO: 521243 - RNA, 21 nt, Human
gggaaauuaggauugcucauc

SEQ ID NO: 521244 - RNA, 18 nt, Human
cucucuggucuggauccc

SEQ ID NO: 521245 - RNA, 22 nt, Human
ccugucaggguuugccucagaa

SEQ ID NO: 521246 - RNA, 22 nt, Human
gaagcccacguuuggugaugua

SEQ ID NO: 521247 - RNA, 22 nt, Human
agugaccaacaaugcugagaag

SEQ ID NO: 521248 - RNA, 22 nt, Human
agguuccagggauuaggaugug

SEQ ID NO: 521249 - RNA, 22 nt, Human
augggccaaguaaacauucuca

SEQ ID NO: 521250 - RNA, 22 nt, Human
ggagugacucacagcugggaca

SEQ ID NO: 521251 - RNA, 22 nt, Human
ccaggucuuuggccuuggcacu

SEQ ID NO: 521252 - RNA, 22 nt, Human
aaacuguaaagcaggugaguag

SEQ ID NO: 521253 - RNA, 22 nt, Human
ucccaggaucugagggcagaga

SEQ ID NO: 521254 - RNA, 22 nt, Human
ugauuuccccagucuugcugcu

SEQ ID NO: 521255 - RNA, 22 nt, Human
cugcugugcaggugccuaugau

SEQ ID NO: 521256 - RNA, 22 nt, Human
ccagcagagcauggggaggaag

SEQ ID NO: 521257 - RNA, 22 nt, Human
cauggccuugagugacugcacu

SEQ ID NO: 521258 - RNA, 22 nt, Human
ggcucugguggcaauugacugg

SEQ ID NO: 521259 - RNA, 22 nt, Human
auugcaccuuggguuuugaaag

SEQ ID NO: 521260 - RNA, 22 nt, Human
ucagcuggcaguucagaggcug

SEQ ID NO: 521261 - RNA, 22 nt, Human
gugucccagccccacaggccug

SEQ ID NO: 521262 - RNA, 22 nt, Human
ucuuagcauuucauaacaacug

SEQ ID NO: 521263 - RNA, 22 nt, Human
auuucacaucuaucucagauuu

SEQ ID NO: 521264 - RNA, 22 nt, Human
ucuucacaugaccuucaugucu

SEQ ID NO: 521265 - RNA, 22 nt, Human
ucaucuaagagucuuacauuua

SEQ ID NO: 521266 - RNA, 22 nt, Human
ccucagagaaagguauggcuga

SEQ ID NO: 521267 - RNA, 22 nt, Human
guuugcauaaaguggaugcagg

SEQ ID NO: 521268 - RNA, 22 nt, Human
ccugccugucuuuauccccugu

SEQ ID NO: 521269 - RNA, 22 nt, Human
gaggcugcggggaggagccugc

SEQ ID NO: 521270 - RNA, 22 nt, Human
cacugaagcuuucauucucuug

SEQ ID NO: 521271 - RNA, 22 nt, Human
uagaacacuugaccacugcucc

SEQ ID NO: 521272 - RNA, 22 nt, Human
aucuggagaugggucugucacc

SEQ ID NO: 521273 - RNA, 21 nt, Human
ccucugcucgggcaugcguuu

SEQ ID NO: 521274 - RNA, 22 nt, Human
uguccugggaaaucccuuaggc

SEQ ID NO: 521275 - RNA, 22 nt, Human
aaggggaguuagugauaaaacc

SEQ ID NO: 521276 - RNA, 22 nt, Human
uauugaauuagacccuaaaaug

SEQ ID NO: 521277 - RNA, 22 nt, Human
agccuccaguagcugaagagac

SEQ ID NO: 521278 - RNA, 22 nt, Human
cagcuguucacauuuccaaaac

SEQ ID NO: 521279 - RNA, 22 nt, Human
aaaagacauaugugggcauucu

SEQ ID NO: 521280 - RNA, 22 nt, Human
uaggccauugauuuuuauaagu

SEQ ID NO: 521281 - RNA, 22 nt, Human
agugggagcggcagucggggac

SEQ ID NO: 521282 - RNA, 22 nt, Human
agcacagaaugagguggaagug

SEQ ID NO: 521283 - RNA, 22 nt, Human
agucccagagaggucggggcca

SEQ ID NO: 521284 - RNA, 22 nt, Human
aggccuggguguucaccagaag

SEQ ID NO: 521285 - RNA, 22 nt, Human
uucacauuacaaggccauauuu

SEQ ID NO: 521286 - RNA, 23 nt, Human
ccuccugggcacaggccugaugg

SEQ ID NO: 521287 - RNA, 22 nt, Human
cauuuacuguugaaucccuagc

SEQ ID NO: 521288 - RNA, 22 nt, Human
aggggugugcauccuggaggau

SEQ ID NO: 521289 - RNA, 22 nt, Human
cagcaugcaaguccagaugugg

SEQ ID NO: 521290 - RNA, 22 nt, Human
guggccaggacauugccaggca

SEQ ID NO: 521291 - RNA, 22 nt, Human
ccacugucugcaggccucagca

SEQ ID NO: 521292 - RNA, 22 nt, Human
aucuggcuuggguguggguagc

SEQ ID NO: 521293 - RNA, 22 nt, Human
uccucaguaaggcauggcuuug

SEQ ID NO: 521294 - RNA, 21 nt, Human
uagggcucucugugucaggug

SEQ ID NO: 521295 - RNA, 22 nt, Human
auaaauuaggaucugggguucc

SEQ ID NO: 521296 - RNA, 22 nt, Human
cagguucucagaaggcagucac

SEQ ID NO: 521297 - RNA, 22 nt, Human
ggagcagcuugcaugcucaggg

SEQ ID NO: 521298 - RNA, 22 nt, Human
agagccacaguggauaggagcc

SEQ ID NO: 521299 - RNA, 22 nt, Human
uacaguagaauuuuuaguaacu

SEQ ID NO: 521300 - RNA, 22 nt, Human
cccagcagaaucugaugagggc

SEQ ID NO: 521301 - RNA, 22 nt, Human
aggcccagggcugcucucugaa

SEQ ID NO: 521302 - RNA, 22 nt, Human
uuuuagauugggaaauguaaag

SEQ ID NO: 521303 - RNA, 22 nt, Human
ucucaucuauucacauuaacug

SEQ ID NO: 521304 - RNA, 20 nt, Human
acugccuugguucaguaggu

SEQ ID NO: 521305 - RNA, 22 nt, Human
gcugugcuggaaggggaccugc

SEQ ID NO: 521306 - RNA, 22 nt, Human
cuggggcugcgguggaggagcc

SEQ ID NO: 521307 - RNA, 22 nt, Human
agccugggcaacaacacagcga

SEQ ID NO: 521308 - RNA, 22 nt, Human
ugcuuuauaacuuaguuuaugg

SEQ ID NO: 521309 - RNA, 23 nt, Human
uggcuccaugaaaauuacgagga

SEQ ID NO: 521310 - RNA, 22 nt, Human
gcugcagcuguaggacacaauu

SEQ ID NO: 521311 - RNA, 22 nt, Human
accugccagaaugcuaguccug

SEQ ID NO: 521312 - RNA, 22 nt, Human
agucucaggcagaggaaggcua

SEQ ID NO: 521313 - RNA, 18 nt, Human
ugagaggcagguagagga

SEQ ID NO: 521314 - RNA, 22 nt, Human
aauucaaucuguagauugugau

SEQ ID NO: 521315 - RNA, 22 nt, Human
ccaggcucaggugcgagagaca

SEQ ID NO: 521316 - RNA, 22 nt, Human
gcuucucgggccugaugucguc

SEQ ID NO: 521317 - RNA, 22 nt, Human
agcaggcuccaggcuggccauc

SEQ ID NO: 521318 - RNA, 22 nt, Human
auuccaaaggcuggccuggagg

SEQ ID NO: 521319 - RNA, 22 nt, Human
acccucaacaaauucacucuau

SEQ ID NO: 521320 - RNA, 16 nt, Human
gcuuagugagagcaac

SEQ ID NO: 521321 - RNA, 22 nt, Human
gacccaggguauccagagcugc

SEQ ID NO: 521322 - RNA, 22 nt, Human
uggaacacaucuaaggaagcag

SEQ ID NO: 521323 - RNA, 22 nt, Human
gggccuccgugugcuggugcuc

SEQ ID NO: 521324 - RNA, 22 nt, Human
cagcccugagcaaggcuuuuaa

SEQ ID NO: 521325 - RNA, 22 nt, Human
uguggcuggucuccgagcgucg

SEQ ID NO: 521326 - RNA, 22 nt, Human
gccugccugcugucaucugccu

SEQ ID NO: 521327 - RNA, 22 nt, Human
uccugcaggccagaggggugag

SEQ ID NO: 521328 - RNA, 19 nt, Human
ucgagucaagacacuaggc

SEQ ID NO: 521329 - RNA, 22 nt, Human
ggguuggggcccagcagucugc

SEQ ID NO: 521330 - RNA, 22 nt, Human
acauugaugaaaagguaucauu

SEQ ID NO: 521331 - RNA, 22 nt, Human
acugucugugccagaugcuggg

SEQ ID NO: 521332 - RNA, 21 nt, Human
aaugugugcuauuuaucuuuu

SEQ ID NO: 521333 - RNA, 22 nt, Human
ucuggcugggaagggggcccga

SEQ ID NO: 521334 - RNA, 22 nt, Human
aaagcuucuaggccuauugcuu

SEQ ID NO: 521335 - RNA, 22 nt, Human
ugggccaccugcuuuuuugcau

SEQ ID NO: 521336 - RNA, 22 nt, Human
cagggcacggagaagucacccc

SEQ ID NO: 521337 - RNA, 22 nt, Human
uaucuagauauuuggauaaaug

SEQ ID NO: 521338 - RNA, 22 nt, Human
aguucuguggcugugcccugua

SEQ ID NO: 521339 - RNA, 22 nt, Human
cacagggccuggggcagcugcu

SEQ ID NO: 521340 - RNA, 22 nt, Human
cuggcucccaugagcucucacg

SEQ ID NO: 521341 - RNA, 22 nt, Human
aggggaggcagcgauaaaccug

SEQ ID NO: 521342 - RNA, 23 nt, Human
uuggaagggaagagcauuugaga

SEQ ID NO: 521343 - RNA, 19 nt, Human
gagcugccuuuugaagacc

SEQ ID NO: 521344 - RNA, 22 nt, Human
guggccugaugccagcccugug

SEQ ID NO: 521345 - RNA, 22 nt, Human
ucugggcuggcuuuaugcugac

SEQ ID NO: 521346 - RNA, 22 nt, Human
ggcagcuguuuguccuccuguu

SEQ ID NO: 521347 - RNA, 22 nt, Human
acauacacaugaauauauuuuu

SEQ ID NO: 521348 - RNA, 22 nt, Human
augggcugugagguccggcagg

SEQ ID NO: 521349 - RNA, 22 nt, Human
ugccagaagauucucuaucaga

SEQ ID NO: 521350 - RNA, 22 nt, Human
gaggagcacaugaggcugaggg

SEQ ID NO: 521351 - RNA, 22 nt, Human
ucugggcugcugugcagugacc

SEQ ID NO: 521352 - RNA, 22 nt, Human
guuccacaaaauguacccaguu

SEQ ID NO: 521353 - RNA, 22 nt, Human
cugcugaaguuguuggucuuuu

SEQ ID NO: 521354 - RNA, 22 nt, Human
acacuaguggaaauugauuugu

SEQ ID NO: 521355 - RNA, 22 nt, Human
cucagaguccccaguggguuug

SEQ ID NO: 521356 - RNA, 22 nt, Human
cuacagaaaaucagccacaggc

SEQ ID NO: 521357 - RNA, 22 nt, Human
ugcaggcuggcagauaucucau

SEQ ID NO: 521358 - RNA, 22 nt, Human
auggcagggcagccucucagag

SEQ ID NO: 521359 - RNA, 22 nt, Human
cagggaugcugcuuaggcaguu

SEQ ID NO: 521360 - RNA, 22 nt, Human
ccaggacaagccagagggacag

SEQ ID NO: 521361 - RNA, 22 nt, Human
uacauucugguggagaaaguaa

SEQ ID NO: 521362 - RNA, 22 nt, Human
agcaucuggugagggccuaguu

SEQ ID NO: 521363 - RNA, 22 nt, Human
augcaauaguaauucuagucug

SEQ ID NO: 521364 - RNA, 22 nt, Human
gagcucagagccuauaguuggu

SEQ ID NO: 521365 - RNA, 22 nt, Human
cagcugccuaugaccuagccuc

SEQ ID NO: 521366 - RNA, 22 nt, Human
gagugcagaugaacagaagauu

SEQ ID NO: 521367 - RNA, 22 nt, Human
uagaaguuaaaggaauacagaa

SEQ ID NO: 521368 - RNA, 22 nt, Human
ucucagaggucuucagccucug

SEQ ID NO: 521369 - RNA, 22 nt, Human
uguuccauaaguggugcuuugu

SEQ ID NO: 521370 - RNA, 22 nt, Human
ugguaucagagccaucuguauu

SEQ ID NO: 521371 - RNA, 22 nt, Human
auucugaguuagagucagccag

SEQ ID NO: 521372 - RNA, 22 nt, Human
uccugaggaaaguucaugaaug

SEQ ID NO: 521373 - RNA, 22 nt, Human
ccagaggaggggggucuuucug

SEQ ID NO: 521374 - RNA, 22 nt, Human
agccauuuuccugaaauauaac

SEQ ID NO: 521375 - RNA, 22 nt, Human
cugggccugggaggccaggucu

SEQ ID NO: 521376 - RNA, 22 nt, Human
uacagaaagggaugauugaucu

SEQ ID NO: 521377 - RNA, 22 nt, Human
acuuugcaaugggcagaaccca

SEQ ID NO: 521378 - RNA, 22 nt, Human
gcagggcugcugaaacuuguuu

SEQ ID NO: 521379 - RNA, 22 nt, Human
uaacagaagaugaaacuucuuu

SEQ ID NO: 521380 - RNA, 22 nt, Human
auauuuauaagcaagcaggacu

SEQ ID NO: 521381 - RNA, 18 nt, Human
ucuggcucaggacugaac

SEQ ID NO: 521382 - RNA, 22 nt, Human
ggcucuggugcccuggcuccca

SEQ ID NO: 521383 - RNA, 22 nt, Human
ccagagaauuuuagacaaaaau

SEQ ID NO: 521384 - RNA, 22 nt, Human
uucucaggccuuugggauggga

SEQ ID NO: 521385 - RNA, 22 nt, Human
cuggcuuccucaggagcagugg

SEQ ID NO: 521386 - RNA, 22 nt, Human
agaagaugucacugcagacagc

SEQ ID NO: 521387 - RNA, 22 nt, Human
ugcccagccuaaacuuggcaag

SEQ ID NO: 521388 - RNA, 22 nt, Human
cagccagcugaauguaccauga

SEQ ID NO: 521389 - RNA, 22 nt, Human
ccuggcucuucagagguuccua

SEQ ID NO: 521390 - RNA, 22 nt, Human
uuaagaagguacucaaagaucu

SEQ ID NO: 521391 - RNA, 20 nt, Human
uuacaaagaggcaucgcuuu

SEQ ID NO: 521392 - RNA, 22 nt, Human
uuucuccaauguaucagcacac

SEQ ID NO: 521393 - RNA, 22 nt, Human
aaggcucuuggagugaaugcag

SEQ ID NO: 521394 - RNA, 22 nt, Human
auggaaagcuaagccauuuacc

SEQ ID NO: 521395 - RNA, 22 nt, Human
uucaaaggcaggauagcagcug

SEQ ID NO: 521396 - RNA, 22 nt, Human
gagaggaguaggcugauggugc

SEQ ID NO: 521397 - RNA, 22 nt, Human
cugggcucuucucacccuguuu

SEQ ID NO: 521398 - RNA, 18 nt, Human
ugauggaggagggcuggu

SEQ ID NO: 521399 - RNA, 22 nt, Human
aagcacugggaggaggcugaga

SEQ ID NO: 521400 - RNA, 22 nt, Human
agugcauuugggguaguggaag

SEQ ID NO: 521401 - RNA, 22 nt, Human
aggaguggaauuacuggguucu

SEQ ID NO: 521402 - RNA, 22 nt, Human
uauuccaacuucacuauugucu

SEQ ID NO: 521403 - RNA, 22 nt, Human
gaaaggucaguuccacuuccau

SEQ ID NO: 521404 - RNA, 21 nt, Human
ugguggagugugcugagcaug

SEQ ID NO: 521405 - RNA, 22 nt, Human
gcugcuaagcguuucuguucca

SEQ ID NO: 521406 - RNA, 22 nt, Human
auacaagacucagcacagacgg

SEQ ID NO: 521407 - RNA, 19 nt, Human
gcaggucauuaggcuaggu

SEQ ID NO: 521408 - RNA, 22 nt, Human
cccuguuuuaaguugauauuga

SEQ ID NO: 521409 - RNA, 22 nt, Human
gcuggguccuaugcugguagag

SEQ ID NO: 521410 - RNA, 22 nt, Human
acccuuucuuacucacacgcuc

SEQ ID NO: 521411 - RNA, 22 nt, Human
auuaucuauguagaaugauuuu

SEQ ID NO: 521412 - RNA, 22 nt, Human
uagcuauuuggaaaauuccaau

SEQ ID NO: 521413 - RNA, 22 nt, Human
ggcagagacuggguuggcagag

SEQ ID NO: 521414 - RNA, 22 nt, Human
uugcugaaaagcuggccuuugu

SEQ ID NO: 521415 - RNA, 22 nt, Human
uggagggcuaagcugagggaua

SEQ ID NO: 521416 - RNA, 22 nt, Human
cuggacagaaagggcugcugug

SEQ ID NO: 521417 - RNA, 22 nt, Human
uaauuuugucacagugacaugc

SEQ ID NO: 521418 - RNA, 22 nt, Human
cauggccacaucuagcugcaag

SEQ ID NO: 521419 - RNA, 22 nt, Human
uauuuucauucugugugacugu

SEQ ID NO: 521420 - RNA, 22 nt, Human
aacauaauguggccaaagucac

SEQ ID NO: 521421 - RNA, 22 nt, Human
uauuaucauugguaauaugguc

SEQ ID NO: 521422 - RNA, 18 nt, Human
acucugggaccuguuauu

SEQ ID NO: 521423 - RNA, 21 nt, Human
gccaccccuggcacaggugcu

SEQ ID NO: 521424 - RNA, 22 nt, Human
auuucacucuuaauugcuuccu

SEQ ID NO: 521425 - RNA, 22 nt, Human
ggugggaggcaggcugcuccca

SEQ ID NO: 521426 - RNA, 22 nt, Human
agagcuuauaucuuggccaucc

SEQ ID NO: 521427 - RNA, 22 nt, Human
uaaagguaugucuuaaucaaac

SEQ ID NO: 521428 - RNA, 22 nt, Human
caggaugggauguagugggccc

SEQ ID NO: 521429 - RNA, 22 nt, Human
gagcugccuacauugccaagag

SEQ ID NO: 521430 - RNA, 22 nt, Human
ucaucacucauuggacaacaga

SEQ ID NO: 521431 - RNA, 22 nt, Human
cucaggaaccgcggcagcagcc

SEQ ID NO: 521432 - RNA, 22 nt, Human
ccugucugcagauaucucaggu

SEQ ID NO: 521433 - RNA, 22 nt, Human
aucucugguuguuuugcuccca

SEQ ID NO: 521434 - RNA, 22 nt, Human
ucccuggcugggggcugccuug

SEQ ID NO: 521435 - RNA, 22 nt, Human
cucucaguaaauuucugcccca

SEQ ID NO: 521436 - RNA, 22 nt, Human
aguauguagugcaaucagucag

SEQ ID NO: 521437 - RNA, 22 nt, Human
augauggugggagaugacccag

SEQ ID NO: 521438 - RNA, 22 nt, Human
aucuggaggccugucuuauccc

SEQ ID NO: 521439 - RNA, 22 nt, Human
ucagggcaccaaaaaagaugcc

SEQ ID NO: 521440 - RNA, 22 nt, Human
aagaaaggauauaugggaggua

SEQ ID NO: 521441 - RNA, 22 nt, Human
uuuugaaagaguccugcuacag

SEQ ID NO: 521442 - RNA, 22 nt, Human
gagggagagugauggaccauug

SEQ ID NO: 521443 - RNA, 22 nt, Human
cuuucccuuagccccauucuau

SEQ ID NO: 521444 - RNA, 22 nt, Human
gcaggcugagaguccaagaagg

SEQ ID NO: 521445 - RNA, 22 nt, Human
ucuggagggguuuagagggaca

SEQ ID NO: 521446 - RNA, 19 nt, Human
agcugcuggcccagggacc

SEQ ID NO: 521447 - RNA, 22 nt, Human
uugcuuuauucacaucuauauu

SEQ ID NO: 521448 - RNA, 22 nt, Human
ccagcuccagcauagccaccau

SEQ ID NO: 521449 - RNA, 22 nt, Human
gacauaaaauucaauaauuugu

SEQ ID NO: 521450 - RNA, 22 nt, Human
uggcugagagaagacggggaag

SEQ ID NO: 521451 - RNA, 23 nt, Human
aagauacagguguggaaugguuu

SEQ ID NO: 521452 - RNA, 22 nt, Human
gcagcaucaauccaugcuucuc

SEQ ID NO: 521453 - RNA, 22 nt, Human
cauaauauacuacauugaugaa

SEQ ID NO: 521454 - RNA, 22 nt, Human
aaggucauugguucugaauucu

SEQ ID NO: 521455 - RNA, 22 nt, Human
auuagcuuauuguaaggugaaa

SEQ ID NO: 521456 - RNA, 22 nt, Human
cccaggcauuuucaacuuuagu

SEQ ID NO: 521457 - RNA, 22 nt, Human
agagacuguacguggcaaguau

SEQ ID NO: 521458 - RNA, 22 nt, Human
cuugggcucagacuugaggaca

SEQ ID NO: 521459 - RNA, 20 nt, Human
ugcagggcugccucccagcu

SEQ ID NO: 521460 - RNA, 22 nt, Human
uugcauuuuuagaugcuucugu

SEQ ID NO: 521461 - RNA, 22 nt, Human
uucugggcacacaggcccuggu

SEQ ID NO: 521462 - RNA, 22 nt, Human
uuguaugaucccauuuagugaa

SEQ ID NO: 521463 - RNA, 22 nt, Human
gcugaggcuuagcuaaaaauuu

SEQ ID NO: 521464 - RNA, 22 nt, Human
gcucccaccuuugcuaucagua

SEQ ID NO: 521465 - RNA, 22 nt, Human
ggagacauauuccagagcuggg

SEQ ID NO: 521466 - RNA, 22 nt, Human
uuguuucagcuguaugcuaugu

SEQ ID NO: 521467 - RNA, 22 nt, Human
uuauuagguuauucucuguacu

SEQ ID NO: 521468 - RNA, 22 nt, Human
auaaggcagucccuuaacaagg

SEQ ID NO: 521469 - RNA, 22 nt, Human
ggcaaaaaccacaauuacuuuu

SEQ ID NO: 521470 - RNA, 22 nt, Human
uuauuuuuaaaaguucacacag

SEQ ID NO: 521471 - RNA, 23 nt, Human
uacauuguggauggaguccuggg

SEQ ID NO: 521472 - RNA, 22 nt, Human
gcaggcaguugcaguuuucuag

SEQ ID NO: 521473 - RNA, 22 nt, Human
gcugcagggagcuggaaggcuc

SEQ ID NO: 521474 - RNA, 20 nt, Human
ccaguccaccugagacaugu

SEQ ID NO: 521475 - RNA, 22 nt, Human
ucaguguagcagacuuguagcc

SEQ ID NO: 521476 - RNA, 22 nt, Human
ugccuggguguaaagggccaac

SEQ ID NO: 521477 - RNA, 22 nt, Human
gugggcuucuguuagggaggcu

SEQ ID NO: 521478 - RNA, 22 nt, Human
gagguucaguccugcucuguca

SEQ ID NO: 521479 - RNA, 23 nt, Human
ccgugaagacagacagacagcag

SEQ ID NO: 521480 - RNA, 22 nt, Human
ccagcuggggaaguggggcaua

SEQ ID NO: 521481 - RNA, 22 nt, Human
gcugucugucuucacaucucgc

SEQ ID NO: 521482 - RNA, 22 nt, Human
acaggcacugucaagucaugaa

SEQ ID NO: 521483 - RNA, 22 nt, Human
uuuggaaaguugucacuuuaga

SEQ ID NO: 521484 - RNA, 22 nt, Human
uuugugaaaugaagucacaacu

SEQ ID NO: 521485 - RNA, 22 nt, Human
ugggcaggauaauaucucaugu

SEQ ID NO: 521486 - RNA, 21 nt, Human
gcugcaucaaucuacccaggg

SEQ ID NO: 521487 - RNA, 22 nt, Human
acugggcuuaugcuguggagua

SEQ ID NO: 521488 - RNA, 22 nt, Human
uguggcaggaagagcuucugag

SEQ ID NO: 521489 - RNA, 23 nt, Human
gagguacagcaccagugaauagg

SEQ ID NO: 521490 - RNA, 22 nt, Human
uuuucuuacugucugugauccu

SEQ ID NO: 521491 - RNA, 22 nt, Human
uggggucuggaguugcccauga

SEQ ID NO: 521492 - RNA, 22 nt, Human
guacauuggcaacucucuuaga

SEQ ID NO: 521493 - RNA, 22 nt, Human
aaauuccagaaacucaguauau

SEQ ID NO: 521494 - RNA, 22 nt, Human
aaguuuguagcuggaugucugu

SEQ ID NO: 521495 - RNA, 22 nt, Human
gcagggaccuugcccacccucc

SEQ ID NO: 521496 - RNA, 22 nt, Human
agcaccugcuuaaugugcagug

SEQ ID NO: 521497 - RNA, 21 nt, Human
ugggagagggcucagcuaccc

SEQ ID NO: 521498 - RNA, 22 nt, Human
aguggggacaaugagagcaggu

SEQ ID NO: 521499 - RNA, 22 nt, Human
augggaguuuucucugaugcuc

SEQ ID NO: 521500 - RNA, 20 nt, Human
cuguggcucaugcaucugcc

SEQ ID NO: 521501 - RNA, 22 nt, Human
agcucagaagccuaugcauagu

SEQ ID NO: 521502 - RNA, 22 nt, Human
gagcagggagacaacucuggug

SEQ ID NO: 521503 - RNA, 22 nt, Human
cucugggcggcccaggccaacc

SEQ ID NO: 521504 - RNA, 22 nt, Human
gacuuucucuccucccaggugu

SEQ ID NO: 521505 - RNA, 21 nt, Human
ggccccagcccauggguucuc

SEQ ID NO: 521506 - RNA, 23 nt, Human
ugcugguguuuuugggaccaggg

SEQ ID NO: 521507 - RNA, 22 nt, Human
ccaaagugcugagauuacaggu

SEQ ID NO: 521508 - RNA, 22 nt, Human
uaaaugugggggccacgggcuu

SEQ ID NO: 521509 - RNA, 22 nt, Human
auauucacugagcauaaagcca

SEQ ID NO: 521510 - RNA, 22 nt, Human
ggcucugggaaauggucuuccu

SEQ ID NO: 521511 - RNA, 22 nt, Human
uggauauccuuguuaacuuucu

SEQ ID NO: 521512 - RNA, 22 nt, Human
aaaggugacacucugccagcug

SEQ ID NO: 521513 - RNA, 22 nt, Human
cagcaagauuuuuaaagcaagg

SEQ ID NO: 521514 - RNA, 22 nt, Human
cuccugagcucugaggaagcuu

SEQ ID NO: 521515 - RNA, 22 nt, Human
gcagaauuccuucuuccuuggg

SEQ ID NO: 521516 - RNA, 22 nt, Human
cccaguuucaacuuuccagugg

SEQ ID NO: 521517 - RNA, 21 nt, Human
cagugagguccccagccuagg

SEQ ID NO: 521518 - RNA, 22 nt, Human
agggcuuugauggcauucucau

SEQ ID NO: 521519 - RNA, 22 nt, Human
guuccauaucacagcagacgaa

SEQ ID NO: 521520 - RNA, 22 nt, Human
augcccuguggcaguacauauu

SEQ ID NO: 521521 - RNA, 22 nt, Human
caggucugaagagucacaugcc

SEQ ID NO: 521522 - RNA, 22 nt, Human
cuggcucauagagcagcuccaa

SEQ ID NO: 521523 - RNA, 22 nt, Human
cagggagcuuucccaggacccu

SEQ ID NO: 521524 - RNA, 23 nt, Human
ucagagaggcccccugcagagau

SEQ ID NO: 521525 - RNA, 22 nt, Human
auuuauuaugggauuuggcuca

SEQ ID NO: 521526 - RNA, 22 nt, Human
uguccugugccaccuuccugag

SEQ ID NO: 521527 - RNA, 23 nt, Human
agaggccaacuucuugccccucc

SEQ ID NO: 521528 - RNA, 22 nt, Human
gcaccugggacccagaggcacc

SEQ ID NO: 521529 - RNA, 22 nt, Human
ugcucuggcugggaugagugca

SEQ ID NO: 521530 - RNA, 22 nt, Human
uucauuuguugacagagacaug

SEQ ID NO: 521531 - RNA, 22 nt, Human
agcuucauggaaccugaggcua

SEQ ID NO: 521532 - RNA, 22 nt, Human
agucagugaaggcauugcucaa

SEQ ID NO: 521533 - RNA, 22 nt, Human
uccuccaggucuaggguggcuu

SEQ ID NO: 521534 - RNA, 22 nt, Human
uuguuuugcuaaagggucauca

SEQ ID NO: 521535 - RNA, 23 nt, Human
acaaugcacuuuaaaugguuccc

SEQ ID NO: 521536 - RNA, 22 nt, Human
gucuggcuagagacacccuccc

SEQ ID NO: 521537 - RNA, 22 nt, Human
uaugcacauuaucuaauccauu

SEQ ID NO: 521538 - RNA, 22 nt, Human
gguuucaaaguggacaguuagu

SEQ ID NO: 521539 - RNA, 22 nt, Human
gccuggagcccaguguggggcu

SEQ ID NO: 521540 - RNA, 22 nt, Human
agcccggcuuccccgguugcua

SEQ ID NO: 521541 - RNA, 22 nt, Human
gcggcccgagcaggacgggugg

SEQ ID NO: 521542 - RNA, 22 nt, Human
cugccccuggugauggacgcca

SEQ ID NO: 521543 - RNA, 22 nt, Human
gagaguucuaccucugaaggcg

SEQ ID NO: 521544 - RNA, 22 nt, Human
guggccucaugucuauaaagag

SEQ ID NO: 521545 - RNA, 22 nt, Human
gagaggcugaaaucacaggagc

SEQ ID NO: 521546 - RNA, 22 nt, Human
aguaaaauuucugcugaggaga

SEQ ID NO: 521547 - RNA, 22 nt, Human
agagucaccuuuuccucaggau

SEQ ID NO: 521548 - RNA, 22 nt, Human
ccagucccgcaugguccagaau

SEQ ID NO: 521549 - RNA, 22 nt, Human
aaauaagugugggccagucaaa

SEQ ID NO: 521550 - RNA, 22 nt, Human
cagaauaugacaagauuuuccu

SEQ ID NO: 521551 - RNA, 23 nt, Human
agagaaagggauaacacguugaa

SEQ ID NO: 521552 - RNA, 22 nt, Human
cagugaggcucugcugagcggu

SEQ ID NO: 521553 - RNA, 18 nt, Human
ugagagugugugcucuug

SEQ ID NO: 521554 - RNA, 22 nt, Human
agggcagagacaugcuuccuga

SEQ ID NO: 521555 - RNA, 22 nt, Human
auggaacaggcucagagaugcu

SEQ ID NO: 521556 - RNA, 22 nt, Human
ugucaccaguuccaggaaauaa

SEQ ID NO: 521557 - RNA, 22 nt, Human
aggaaauaggaccagacaaagc

SEQ ID NO: 521558 - RNA, 22 nt, Human
agcagcaaggaagcgaggaugg

SEQ ID NO: 521559 - RNA, 22 nt, Human
caggagcccguugcuccggcgg

SEQ ID NO: 521560 - RNA, 22 nt, Human
gcagcagagcuuuguccuggcu

SEQ ID NO: 521561 - RNA, 22 nt, Human
ucaggccuucagaccuggcccg

SEQ ID NO: 521562 - RNA, 22 nt, Human
cccagcagggucucugugucua

SEQ ID NO: 521563 - RNA, 22 nt, Human
agcaccuguggcucaugcucgu

SEQ ID NO: 521564 - RNA, 22 nt, Human
uccugggagcacaugguccugc

SEQ ID NO: 521565 - RNA, 22 nt, Human
ucucauucauacccuacaugcu

SEQ ID NO: 521566 - RNA, 22 nt, Human
aggccuguuccaggccccuuuu

SEQ ID NO: 521567 - RNA, 22 nt, Human
augagguaucucauuuccugaa

SEQ ID NO: 521568 - RNA, 22 nt, Human
cucuggacagcaggugcugugg

SEQ ID NO: 521569 - RNA, 21 nt, Human
agcagaacagucgagcacugc

SEQ ID NO: 521570 - RNA, 22 nt, Human
cagucuggaggucagcuggcuu

SEQ ID NO: 521571 - RNA, 22 nt, Human
cgaggcagggaagcugcaaaag

SEQ ID NO: 521572 - RNA, 22 nt, Human
agggcagccugagugcuggccc

SEQ ID NO: 521573 - RNA, 17 nt, Human
ggcuggagcagcucccc

SEQ ID NO: 521574 - RNA, 22 nt, Human
agcugccaccucugccuuuggg

SEQ ID NO: 521575 - RNA, 22 nt, Human
caaauucaaauuucaucagugu

SEQ ID NO: 521576 - RNA, 22 nt, Human
aggagucagauaugggaaaguu

SEQ ID NO: 521577 - RNA, 22 nt, Human
ucaaguguaguggugucagguc

SEQ ID NO: 521578 - RNA, 22 nt, Human
cuacaggucaagcaguagcucu

SEQ ID NO: 521579 - RNA, 22 nt, Human
uccuggggcucugagcgagaca

SEQ ID NO: 521580 - RNA, 22 nt, Human
ucaaaauuuuauuucucaagga

SEQ ID NO: 521581 - RNA, 22 nt, Human
cucuggaguuagugaucugggc

SEQ ID NO: 521582 - RNA, 21 nt, Human
ugccagggauuuacagagccu

SEQ ID NO: 521583 - RNA, 22 nt, Human
auacaaauuuauagaugcauuu

SEQ ID NO: 521584 - RNA, 22 nt, Human
aaacuguaaacacagcaguaca

SEQ ID NO: 521585 - RNA, 22 nt, Human
uucauaguguuuccuuccagug

SEQ ID NO: 521586 - RNA, 22 nt, Human
gccuguuuggaaucuguuuaau

SEQ ID NO: 521587 - RNA, 22 nt, Human
ggcuucagugagcugagcucac

SEQ ID NO: 521588 - RNA, 22 nt, Human
gggccuggggacaccaccauga

SEQ ID NO: 521589 - RNA, 22 nt, Human
gagggaagaaagaauugaugcg

SEQ ID NO: 521590 - RNA, 22 nt, Human
ucuggggguuaagugaggacaa

SEQ ID NO: 521591 - RNA, 22 nt, Human
ucuguucagcugccucagggua

SEQ ID NO: 521592 - RNA, 20 nt, Human
agugucuggugcagggccuc

SEQ ID NO: 521593 - RNA, 22 nt, Human
agaaauguaauugcaacugucu

SEQ ID NO: 521594 - RNA, 22 nt, Human
ugcuuuauaaccauuucugugg

SEQ ID NO: 521595 - RNA, 22 nt, Human
ugggccuccaauuccagcggga

SEQ ID NO: 521596 - RNA, 22 nt, Human
augccaggccccacgcugggca

SEQ ID NO: 521597 - RNA, 22 nt, Human
uuagaggggcugcugaauggga

SEQ ID NO: 521598 - RNA, 22 nt, Human
agaaugauagcuaguauuuacu

SEQ ID NO: 521599 - RNA, 22 nt, Human
acaggcugcugggcuccgugcu

SEQ ID NO: 521600 - RNA, 22 nt, Human
aagaaugauuacaaagcaacga

SEQ ID NO: 521601 - RNA, 23 nt, Human
gccugugccuaugcccagcucug

SEQ ID NO: 521602 - RNA, 22 nt, Human
gcaggcaguuugcuuuucccuc

SEQ ID NO: 521603 - RNA, 22 nt, Human
cagagccucccuccucugccau

SEQ ID NO: 521604 - RNA, 22 nt, Human
aggcuguguggaugagucuuac

SEQ ID NO: 521605 - RNA, 22 nt, Human
cugggccaucucucugcaagug

SEQ ID NO: 521606 - RNA, 22 nt, Human
aaggcuuuuguuccuauuuagu

SEQ ID NO: 521607 - RNA, 22 nt, Human
uacucaaacucacuaagacaga

SEQ ID NO: 521608 - RNA, 22 nt, Human
uuuccucuuugugacacagcug

SEQ ID NO: 521609 - RNA, 22 nt, Human
gaauaacauuggaacccugaag

SEQ ID NO: 521610 - RNA, 22 nt, Human
accuuaaaacugacacauggag

SEQ ID NO: 521611 - RNA, 23 nt, Human
ggugggagauuauccagaauuau

SEQ ID NO: 521612 - RNA, 22 nt, Human
cuggggaccagugucuguuugu

SEQ ID NO: 521613 - RNA, 22 nt, Human
cagcuggcgggcagagccgcca

SEQ ID NO: 521614 - RNA, 22 nt, Human
cuucagcagaugugcuagagau

SEQ ID NO: 521615 - RNA, 22 nt, Human
auucucugugucugcuuuccca

SEQ ID NO: 521616 - RNA, 22 nt, Human
agagccaggacugugucucacu

SEQ ID NO: 521617 - RNA, 22 nt, Human
ggagaggcuuccagagucgugc

SEQ ID NO: 521618 - RNA, 22 nt, Human
ccuguacacggucuaugccucc

SEQ ID NO: 521619 - RNA, 22 nt, Human
guccuggguccccgcaggucag

SEQ ID NO: 521620 - RNA, 22 nt, Human
caucacagaaauaaacauaccu

SEQ ID NO: 521621 - RNA, 22 nt, Human
aggagauuguacugucaucacu

SEQ ID NO: 521622 - RNA, 22 nt, Human
ggccuccucacccugcucaggc

SEQ ID NO: 521623 - RNA, 22 nt, Human
gcacauaacugaccacaucuaa

SEQ ID NO: 521624 - RNA, 22 nt, Human
gaccaccagagguccgugggua

SEQ ID NO: 521625 - RNA, 22 nt, Human
gguggccugaauuagcucaggg

SEQ ID NO: 521626 - RNA, 22 nt, Human
cucaaauguuuccacuucugcu

SEQ ID NO: 521627 - RNA, 22 nt, Human
cugguccucuccagcaggcauu

SEQ ID NO: 521628 - RNA, 22 nt, Human
aauguugaggauaucagaaaau

SEQ ID NO: 521629 - RNA, 22 nt, Human
agccaucauuucugucacuggc

SEQ ID NO: 521630 - RNA, 22 nt, Human
gucugcagagggaaggcuucag

SEQ ID NO: 521631 - RNA, 22 nt, Human
uggcuccucccugugugugcgu

SEQ ID NO: 521632 - RNA, 22 nt, Human
cagguccagaaaccaaaggauu

SEQ ID NO: 521633 - RNA, 22 nt, Human
cagcaauaaugucuacaaaucu

SEQ ID NO: 521634 - RNA, 22 nt, Human
gagguuagaggucagugcaguc

SEQ ID NO: 521635 - RNA, 22 nt, Human
uauguacaccaaggauugaaaa

SEQ ID NO: 521636 - RNA, 22 nt, Human
aaguuugagaagcuuauagaua

SEQ ID NO: 521637 - RNA, 22 nt, Human
cccucacuguccuugggcccuu

SEQ ID NO: 521638 - RNA, 22 nt, Human
uggauuucuccagcucuccauu

SEQ ID NO: 521639 - RNA, 22 nt, Human
gccuuggccaacaccuugcaaa

SEQ ID NO: 521640 - RNA, 22 nt, Human
agacacagaacacaaaagcaua

SEQ ID NO: 521641 - RNA, 22 nt, Human
cugcccuggguuuuaugggagu

SEQ ID NO: 521642 - RNA, 22 nt, Human
cucugggcaggacgccaggccu

SEQ ID NO: 521643 - RNA, 22 nt, Human
augggcagagcuggugggaggc

SEQ ID NO: 521644 - RNA, 22 nt, Human
aagagguugucugugaugaguu

SEQ ID NO: 521645 - RNA, 22 nt, Human
uccuggcuaguuuugcugaaau

SEQ ID NO: 521646 - RNA, 22 nt, Human
acaguaauauugaugcucguca

SEQ ID NO: 521647 - RNA, 22 nt, Human
aaacuguaggagggaaaggaag

SEQ ID NO: 521648 - RNA, 23 nt, Human
uuccugagugcuggagagagugc

SEQ ID NO: 521649 - RNA, 22 nt, Human
agcugggugcgguggcucaugc

SEQ ID NO: 521650 - RNA, 22 nt, Human
gggcuugcugauuugggcagga

SEQ ID NO: 521651 - RNA, 22 nt, Human
ugcugccagccaggccauggag

SEQ ID NO: 521652 - RNA, 22 nt, Human
guuagaauaaaaggucagagag

SEQ ID NO: 521653 - RNA, 22 nt, Human
ugccugucagggggagugggaa

SEQ ID NO: 521654 - RNA, 22 nt, Human
accuguuuaccugcaccuguuu

SEQ ID NO: 521655 - RNA, 22 nt, Human
cagagauuuuuaugcacaccaa

SEQ ID NO: 521656 - RNA, 22 nt, Human
uuucaaagguuuugucaugucu

SEQ ID NO: 521657 - RNA, 22 nt, Human
cuggagaggcugggaacagguu

SEQ ID NO: 521658 - RNA, 22 nt, Human
cugguccuugacgcgugggagg

SEQ ID NO: 521659 - RNA, 22 nt, Human
aucaauucuuaggaaaauagcu

SEQ ID NO: 521660 - RNA, 22 nt, Human
ggccuugguaaagggaugcaug

SEQ ID NO: 521661 - RNA, 22 nt, Human
cuggcucccgucugguggccau

SEQ ID NO: 521662 - RNA, 22 nt, Human
uuauuccauagaagucaaggaa

SEQ ID NO: 521663 - RNA, 18 nt, Human
aagaacugagguccuaga

SEQ ID NO: 521664 - RNA, 22 nt, Human
agcuccagaggcagugaugaag

SEQ ID NO: 521665 - RNA, 22 nt, Human
uccuggugaucaaaauucauuu

SEQ ID NO: 521666 - RNA, 20 nt, Human
aucccucuuccuagaguccc

SEQ ID NO: 521667 - RNA, 22 nt, Human
ugcagggcuacaggacuacaac

SEQ ID NO: 521668 - RNA, 21 nt, Human
ccuggacuaaaaccaggccac

SEQ ID NO: 521669 - RNA, 18 nt, Human
aagcugcccucaggcagg

SEQ ID NO: 521670 - RNA, 22 nt, Human
gugcccugggccuucagggcca

SEQ ID NO: 521671 - RNA, 22 nt, Human
gaagcacugcauuucaagauca

SEQ ID NO: 521672 - RNA, 22 nt, Human
uugggccacuuuaguuuccuua

SEQ ID NO: 521673 - RNA, 22 nt, Human
gcuguucaaaagccacaguuac

SEQ ID NO: 521674 - RNA, 22 nt, Human
gaauauuuuuaaagggacuaau

SEQ ID NO: 521675 - RNA, 22 nt, Human
uggagcccagggugagaaggag

SEQ ID NO: 521676 - RNA, 22 nt, Human
ucauccagccucaucaggagcu

SEQ ID NO: 521677 - RNA, 22 nt, Human
ggaacuccugcuccaagcagcu

SEQ ID NO: 521678 - RNA, 22 nt, Human
ggcaaacuacauuuuugaaaua

SEQ ID NO: 521679 - RNA, 22 nt, Human
uuuguuuucaaugugucauuca

SEQ ID NO: 521680 - RNA, 22 nt, Human
gcugcagcuuuaggauccagug

SEQ ID NO: 521681 - RNA, 22 nt, Human
gggggcuggacuuucccacaca

SEQ ID NO: 521682 - RNA, 22 nt, Human
cagggauggcugucaggaugua

SEQ ID NO: 521683 - RNA, 22 nt, Human
agaaaugccuacgagauaggga

SEQ ID NO: 521684 - RNA, 19 nt, Human
uugaggggccaggggagau

SEQ ID NO: 521685 - RNA, 22 nt, Human
ccaggcucugagaggaauguga

SEQ ID NO: 521686 - RNA, 22 nt, Human
uuagggacagcucuguagguga

SEQ ID NO: 521687 - RNA, 22 nt, Human
uggcucugccacuaacuuggua

SEQ ID NO: 521688 - RNA, 22 nt, Human
agguuccaggucuggguuaugu

SEQ ID NO: 521689 - RNA, 20 nt, Human
ugugugcacacaugacauuc

SEQ ID NO: 521690 - RNA, 17 nt, Human
acagggcagaaacagcu

SEQ ID NO: 521691 - RNA, 22 nt, Human
uucccacauucuuuacauucau

SEQ ID NO: 521692 - RNA, 22 nt, Human
aguucucuuuagcucauauggu

SEQ ID NO: 521693 - RNA, 22 nt, Human
gucucaguuguaucaccugguu

SEQ ID NO: 521694 - RNA, 23 nt, Human
gcagaggagcaagcuggacacca

SEQ ID NO: 521695 - RNA, 22 nt, Human
gagaaggaguagcugaccuggg

SEQ ID NO: 521696 - RNA, 22 nt, Human
uagaaaugcaguguacuguguc

SEQ ID NO: 521697 - RNA, 22 nt, Human
uucaagauccagcacaacagug

SEQ ID NO: 521698 - RNA, 22 nt, Human
cuugcaggcagggccuccugga

SEQ ID NO: 521699 - RNA, 22 nt, Human
uauguacuacacuagaacauuu

SEQ ID NO: 521700 - RNA, 22 nt, Human
gaggacaggagacucacuguuu

SEQ ID NO: 521701 - RNA, 22 nt, Human
aacugcauucagaaagcucacu

SEQ ID NO: 521702 - RNA, 22 nt, Human
ugcaggcuuuagccccauggcu

SEQ ID NO: 521703 - RNA, 22 nt, Human
acaaagucaaauugcagccgcc

SEQ ID NO: 521704 - RNA, 22 nt, Human
uaauaacaauuguaggacauga

SEQ ID NO: 521705 - RNA, 17 nt, Human
cccuggcucuaggugga

SEQ ID NO: 521706 - RNA, 22 nt, Human
uggguccacaaacaucagauau

SEQ ID NO: 521707 - RNA, 22 nt, Human
gccugggauagaggcaaugcau

SEQ ID NO: 521708 - RNA, 20 nt, Human
aggucugauuccagaaucag

SEQ ID NO: 521709 - RNA, 22 nt, Human
agauguaccagguauuacagga

SEQ ID NO: 521710 - RNA, 22 nt, Human
aaaucacuaaguuauagugugg

SEQ ID NO: 521711 - RNA, 21 nt, Human
cagaggggcuagccuggcugc

SEQ ID NO: 521712 - RNA, 22 nt, Human
cuuagcaugcaguguucugccc

SEQ ID NO: 521713 - RNA, 22 nt, Human
agccuggcuguaaccucauggu

SEQ ID NO: 521714 - RNA, 21 nt, Human
cucaggauggcggccuggugg

SEQ ID NO: 521715 - RNA, 21 nt, Human
cucacaggaugcaguguuacu

SEQ ID NO: 521716 - RNA, 22 nt, Human
uccuguaguugcuaaguuuguu

SEQ ID NO: 521717 - RNA, 22 nt, Human
cuggccagggugcgaucguggu

SEQ ID NO: 521718 - RNA, 22 nt, Human
ccagaggcuggguucaccucag

SEQ ID NO: 521719 - RNA, 22 nt, Human
uucaaugcauauagauauagaa

SEQ ID NO: 521720 - RNA, 22 nt, Human
guacauuucauuuaaaugaugu

SEQ ID NO: 521721 - RNA, 22 nt, Human
gucuuuauuugagauugucauu

SEQ ID NO: 521722 - RNA, 22 nt, Human
aggcagaggaaggguggauuug

SEQ ID NO: 521723 - RNA, 22 nt, Human
ugcuagaauaccuaccuggagg

SEQ ID NO: 521724 - RNA, 22 nt, Human
cagaagcauugacuccuugcuc

SEQ ID NO: 521725 - RNA, 22 nt, Human
acagcagguuacaguggcacag

SEQ ID NO: 521726 - RNA, 22 nt, Human
cagagccucaucauccacucca

SEQ ID NO: 521727 - RNA, 18 nt, Human
cauuguacaaugcuuuau

SEQ ID NO: 521728 - RNA, 22 nt, Human
uaaugagacucaauugugugug

SEQ ID NO: 521729 - RNA, 22 nt, Human
ccacagaggacaacugccuggc

SEQ ID NO: 521730 - RNA, 22 nt, Human
cuggugucugcucccucacagc

SEQ ID NO: 521731 - RNA, 22 nt, Human
ccccuucuguguccugucagcc

SEQ ID NO: 521732 - RNA, 22 nt, Human
ggagggcacaggaccagaaauc

SEQ ID NO: 521733 - RNA, 22 nt, Human
ugcucugcaagcaggagcaaga

SEQ ID NO: 521734 - RNA, 22 nt, Human
auuauuagacuuauaugguagu

SEQ ID NO: 521735 - RNA, 22 nt, Human
uugggccaaagauguccuuguu

SEQ ID NO: 521736 - RNA, 22 nt, Human
uggcugaacuaaugugcuguuu

SEQ ID NO: 521737 - RNA, 22 nt, Human
cagaagcuuugucuagucuuga

SEQ ID NO: 521738 - RNA, 22 nt, Human
gucucaguuugaagugaugcca

SEQ ID NO: 521739 - RNA, 22 nt, Human
cuggcucucugagauauugagu

SEQ ID NO: 521740 - RNA, 22 nt, Human
cacacaucaaccuagacauugu

SEQ ID NO: 521741 - RNA, 22 nt, Human
ugggcugaggggccuugaugac

SEQ ID NO: 521742 - RNA, 22 nt, Human
guucuaauauuuuaaaagccaa

SEQ ID NO: 521743 - RNA, 22 nt, Human
uagugaaacaguuaucaaucug

SEQ ID NO: 521744 - RNA, 22 nt, Human
uuuauuguguugaaacugaauu

SEQ ID NO: 521745 - RNA, 22 nt, Human
gcagggcagccacaggcccccu

SEQ ID NO: 521746 - RNA, 22 nt, Human
ucagcaguccuccaggaucaag

SEQ ID NO: 521747 - RNA, 22 nt, Human
ugaaucaauugucuuaagacau

SEQ ID NO: 521748 - RNA, 22 nt, Human
uggucaggggcuucugagcugu

SEQ ID NO: 521749 - RNA, 22 nt, Human
ucagugcauucuaccaaaaggc

SEQ ID NO: 521750 - RNA, 22 nt, Human
cagcuauuauuuucucuaaauu

SEQ ID NO: 521751 - RNA, 22 nt, Human
uguuccaucaguuuuugguuga

SEQ ID NO: 521752 - RNA, 22 nt, Human
gggaaacuggggacugaaucug

SEQ ID NO: 521753 - RNA, 23 nt, Human
agcuuccuagugaccuggagucu

SEQ ID NO: 521754 - RNA, 22 nt, Human
gcagggcucaacaggacacccc

SEQ ID NO: 521755 - RNA, 22 nt, Human
ugcucacagcccagaacauaau

SEQ ID NO: 521756 - RNA, 22 nt, Human
uaugagaauaaucugguaaaua

SEQ ID NO: 521757 - RNA, 22 nt, Human
aagcugccacacggugaguacu

SEQ ID NO: 521758 - RNA, 22 nt, Human
ugucagugaguuggguccugag

SEQ ID NO: 521759 - RNA, 22 nt, Human
cagagccacuuggagaugagaa

SEQ ID NO: 521760 - RNA, 22 nt, Human
uucuuauucuugaaauguggga

SEQ ID NO: 521761 - RNA, 22 nt, Human
ucaaagagcucuaucuucaaaa

SEQ ID NO: 521762 - RNA, 22 nt, Human
ucucccaggcugcccuguggac

SEQ ID NO: 521763 - RNA, 22 nt, Human
gauuagcucuagaucugggcua

SEQ ID NO: 521764 - RNA, 22 nt, Human
accugagggagauuaggccuga

SEQ ID NO: 521765 - RNA, 22 nt, Human
uugcagcuucuaccacuguuuc

SEQ ID NO: 521766 - RNA, 22 nt, Human
cgucuuccucuuacgaugcgcu

SEQ ID NO: 521767 - RNA, 22 nt, Human
ugucagaacucuauugaugucc

SEQ ID NO: 521768 - RNA, 22 nt, Human
aggugaaguugaggaggcagaa

SEQ ID NO: 521769 - RNA, 22 nt, Human
uaacuucuuugguuuaaagaga

SEQ ID NO: 521770 - RNA, 22 nt, Human
ugugaaagauacuaggcagagg

SEQ ID NO: 521771 - RNA, 22 nt, Human
ucagcucuguuuugaguggaac

SEQ ID NO: 521772 - RNA, 22 nt, Human
cuucaagauccauagauauugc

SEQ ID NO: 521773 - RNA, 22 nt, Human
acugugugaaacaucaaugugu

SEQ ID NO: 521774 - RNA, 22 nt, Human
gccuggccugaacuaggaggug

SEQ ID NO: 521775 - RNA, 22 nt, Human
agcuucucaggagucugaggca

SEQ ID NO: 521776 - RNA, 20 nt, Human
cccugagacaaaggaggggc

SEQ ID NO: 521777 - RNA, 22 nt, Human
ggagucugcucccagacaugau

SEQ ID NO: 521778 - RNA, 18 nt, Human
ggagggcuuuggggacug

SEQ ID NO: 521779 - RNA, 22 nt, Human
gagcuguggaaggcagggacca

SEQ ID NO: 521780 - RNA, 22 nt, Human
gcagaggccaucaacuuugcca

SEQ ID NO: 521781 - RNA, 22 nt, Human
agauacauauagaaaacaucaa

SEQ ID NO: 521782 - RNA, 22 nt, Human
uuucacauaugguuguugauug

SEQ ID NO: 521783 - RNA, 18 nt, Human
gaguguggcacugggccc

SEQ ID NO: 521784 - RNA, 22 nt, Human
gcggggcccccggccgagcucu

SEQ ID NO: 521785 - RNA, 22 nt, Human
acagcucuguguauugucaucu

SEQ ID NO: 521786 - RNA, 20 nt, Human
gggugagauguaggagaggg

SEQ ID NO: 521787 - RNA, 20 nt, Human
ccugggguacacuggcaugu

SEQ ID NO: 521788 - RNA, 19 nt, Human
gagcaggccacacaugugu

SEQ ID NO: 521789 - RNA, 22 nt, Human
uucugugugcuuacugguguuc

SEQ ID NO: 521790 - RNA, 22 nt, Human
ggagggggacugacacugauuu

SEQ ID NO: 521791 - RNA, 23 nt, Human
uggggccaagugaggaagggucu

SEQ ID NO: 521792 - RNA, 22 nt, Human
cuggcugccuauagucucccuu

SEQ ID NO: 521793 - RNA, 20 nt, Human
gagccuuccccucaccacug

SEQ ID NO: 521794 - RNA, 22 nt, Human
uaucuaaaggauuuaauuuagu

SEQ ID NO: 521795 - RNA, 22 nt, Human
cuacauuuggagaguauaggaa

SEQ ID NO: 521796 - RNA, 22 nt, Human
ccuccucugugcagcugugggu

SEQ ID NO: 521797 - RNA, 22 nt, Human
ggagcagagcugggcuuggcug

SEQ ID NO: 521798 - RNA, 21 nt, Human
cagcuccacuaaagcagcugu

SEQ ID NO: 521799 - RNA, 22 nt, Human
gagaaggaggcgaagcgugugc

SEQ ID NO: 521800 - RNA, 18 nt, Human
aaguaacagaagagcaca

SEQ ID NO: 521801 - RNA, 22 nt, Human
aggaagaggugugcaauggugu

SEQ ID NO: 521802 - RNA, 22 nt, Human
caguacuucuuggaaacuggau

SEQ ID NO: 521803 - RNA, 19 nt, Human
uugcugaaggaagccucug

SEQ ID NO: 521804 - RNA, 22 nt, Human
agcuuuuaguacguuaaaauug

SEQ ID NO: 521805 - RNA, 22 nt, Human
caggggcagucugugugcgugg

SEQ ID NO: 521806 - RNA, 22 nt, Human
ggcagcacugcagcuuguuggg

SEQ ID NO: 521807 - RNA, 22 nt, Human
guuucucacuuccaguagccaa

SEQ ID NO: 521808 - RNA, 22 nt, Human
ugggcagacgggagcuugccuu

SEQ ID NO: 521809 - RNA, 22 nt, Human
uuucacagguacaaacacuccu

SEQ ID NO: 521810 - RNA, 22 nt, Human
acugugugcuggacaugauguu

SEQ ID NO: 521811 - RNA, 21 nt, Human
gccugcaguuuugaagcccuu

SEQ ID NO: 521812 - RNA, 21 nt, Human
agcugagguaaggcaagagag

SEQ ID NO: 521813 - RNA, 22 nt, Human
gccacauuagcccucaccaucu

SEQ ID NO: 521814 - RNA, 22 nt, Human
aaguucaagagugacauauuag

SEQ ID NO: 521815 - RNA, 22 nt, Human
cuggcccucggaguccagcugc

SEQ ID NO: 521816 - RNA, 22 nt, Human
aguagaauaauuggauuacagu

SEQ ID NO: 521817 - RNA, 22 nt, Human
cugccugcuucugagccagagg

SEQ ID NO: 521818 - RNA, 22 nt, Human
cugucccucaucaccucugggu

SEQ ID NO: 521819 - RNA, 22 nt, Human
gugcaggguagcgacggcagga

SEQ ID NO: 521820 - RNA, 22 nt, Human
uccaggagugcugguuagagua

SEQ ID NO: 521821 - RNA, 22 nt, Human
aaacaaacaauuaguugugugg

SEQ ID NO: 521822 - RNA, 22 nt, Human
gcccagagagaugcuguagacc

SEQ ID NO: 521823 - RNA, 22 nt, Human
augaccccuaaaauuuacuguc

SEQ ID NO: 521824 - RNA, 22 nt, Human
uucucuggggacuugguuggag

SEQ ID NO: 521825 - RNA, 22 nt, Human
uugcuuauuugauuaaaugucu

SEQ ID NO: 521826 - RNA, 22 nt, Human
aacaaacaguuaaguguggaug

SEQ ID NO: 521827 - RNA, 20 nt, Human
uaacaguaagugauguuaca

SEQ ID NO: 521828 - RNA, 22 nt, Human
cuagcagcaucacaggaagacu

SEQ ID NO: 521829 - RNA, 23 nt, Human
gcugucaguuguuuuugucucua

SEQ ID NO: 521830 - RNA, 22 nt, Human
uggcacugaccccaggccugug

SEQ ID NO: 521831 - RNA, 22 nt, Human
ucuggcuccguguccgcuccca

SEQ ID NO: 521832 - RNA, 19 nt, Human
ugcucaggccaaggagccc

SEQ ID NO: 521833 - RNA, 22 nt, Human
aagcagugcgcucaucuaaggg

SEQ ID NO: 521834 - RNA, 21 nt, Human
uucugggccggagaaggggcg

SEQ ID NO: 521835 - RNA, 22 nt, Human
gaaugaauucagcacauggaau

SEQ ID NO: 521836 - RNA, 22 nt, Human
auaugaagaaucuaggauaggc

SEQ ID NO: 521837 - RNA, 22 nt, Human
ggagccuggccuggcucugugu

SEQ ID NO: 521838 - RNA, 22 nt, Human
guggggaggcauucuucucccu

SEQ ID NO: 521839 - RNA, 22 nt, Human
gugggagaagcccuguucguag

SEQ ID NO: 521840 - RNA, 22 nt, Human
gagcuggcaggaggcuccccga

SEQ ID NO: 521841 - RNA, 20 nt, Human
agcaggcugcagggugaaau

SEQ ID NO: 521842 - RNA, 22 nt, Human
ugauuucccuguagccucugaa

SEQ ID NO: 521843 - RNA, 22 nt, Human
guucagcaaguacucaguccac

SEQ ID NO: 521844 - RNA, 22 nt, Human
aggcacuggucuaccccuuagu

SEQ ID NO: 521845 - RNA, 21 nt, Human
uuugcauuuuacaugugggga

SEQ ID NO: 521846 - RNA, 22 nt, Human
aaagccagagcaagcugucaca

SEQ ID NO: 521847 - RNA, 22 nt, Human
cccaggagguggagguugcagu

SEQ ID NO: 521848 - RNA, 22 nt, Human
uccagagguauguagagaguau

SEQ ID NO: 521849 - RNA, 22 nt, Human
acagggccucagccagggcaga

SEQ ID NO: 521850 - RNA, 22 nt, Human
ucaggaagucucaauuagcuac

SEQ ID NO: 521851 - RNA, 23 nt, Human
cugucuccugggcuagguggaau

SEQ ID NO: 521852 - RNA, 22 nt, Human
gaaagaagcuuuagauggcuau

SEQ ID NO: 521853 - RNA, 22 nt, Human
ggcaguggcuccucucuacucc

SEQ ID NO: 521854 - RNA, 22 nt, Human
cugggcucaaauccuggcccug

SEQ ID NO: 521855 - RNA, 22 nt, Human
uauguuguggggugcaucaaaa

SEQ ID NO: 521856 - RNA, 22 nt, Human
cacacaggaugaagcagcagaa

SEQ ID NO: 521857 - RNA, 22 nt, Human
agaaauguacgauguuaugcag

SEQ ID NO: 521858 - RNA, 22 nt, Human
cugccgagugggucaugaggca

SEQ ID NO: 521859 - RNA, 22 nt, Human
aggucuaggagucugaaaguau

SEQ ID NO: 521860 - RNA, 22 nt, Human
aagacccacaaggcugaauguu

SEQ ID NO: 521861 - RNA, 22 nt, Human
gccccuggcuggccagcuccuc

SEQ ID NO: 521862 - RNA, 22 nt, Human
acagauauaugauuguguaaau

SEQ ID NO: 521863 - RNA, 22 nt, Human
ucucccacuggccuuguaugau

SEQ ID NO: 521864 - RNA, 19 nt, Human
uguguaaagucugugguca

SEQ ID NO: 521865 - RNA, 22 nt, Human
gauugaaucauaugaaauugug

SEQ ID NO: 521866 - RNA, 22 nt, Human
cugcuccacaccuccauuuccu

SEQ ID NO: 521867 - RNA, 22 nt, Human
ucuguacaacaaagggaugaga

SEQ ID NO: 521868 - RNA, 22 nt, Human
gcuggagcugaguucccugggc

SEQ ID NO: 521869 - RNA, 21 nt, Human
agaaaaacacgauauaagccc

SEQ ID NO: 521870 - RNA, 23 nt, Human
gcuguccuccugggcccagcagc

SEQ ID NO: 521871 - RNA, 20 nt, Human
acacaguagaugagugacug

SEQ ID NO: 521872 - RNA, 22 nt, Human
uguguccugcagacagacucag

SEQ ID NO: 521873 - RNA, 19 nt, Human
uccugggcugggccagguc

SEQ ID NO: 521874 - RNA, 23 nt, Human
ggcagcugggcagcacucauggg

SEQ ID NO: 521875 - RNA, 22 nt, Human
acaagcuccuuauucagcuggg

SEQ ID NO: 521876 - RNA, 17 nt, Human
uguggccuucugagcuu

SEQ ID NO: 521877 - RNA, 22 nt, Human
guccagggcuaaaucagguucc

SEQ ID NO: 521878 - RNA, 22 nt, Human
ucugucugcucauuuaccucag

SEQ ID NO: 521879 - RNA, 22 nt, Human
uggcucagugcauucacaguaa

SEQ ID NO: 521880 - RNA, 22 nt, Human
gcagcugggccccagccucucc

SEQ ID NO: 521881 - RNA, 22 nt, Human
ccucccuucaguagagcccaau

SEQ ID NO: 521882 - RNA, 22 nt, Human
acagaauucuaguauguggcuu

SEQ ID NO: 521883 - RNA, 22 nt, Human
gugccugguuuggggaauguuc

SEQ ID NO: 521884 - RNA, 19 nt, Human
uccaggcauccuucaggcu

SEQ ID NO: 521885 - RNA, 22 nt, Human
ccauuguaaauucuguggaagu

SEQ ID NO: 521886 - RNA, 22 nt, Human
uuuuuaagagauucuccagucu

SEQ ID NO: 521887 - RNA, 22 nt, Human
cuguaaaacugcuuaaguaugc

SEQ ID NO: 521888 - RNA, 22 nt, Human
ggucagguuuuuaggagugacc

SEQ ID NO: 521889 - RNA, 22 nt, Human
agcacaggaccaaggaagcugu

SEQ ID NO: 521890 - RNA, 22 nt, Human
aguuuuugagaauuuacuaugu

SEQ ID NO: 521891 - RNA, 22 nt, Human
agaaaucacaggaggcagaagg

SEQ ID NO: 521892 - RNA, 22 nt, Human
ugcuuccugaggccgucuucuc

SEQ ID NO: 521893 - RNA, 22 nt, Human
uuuaggagucaaauguuuuagg

SEQ ID NO: 521894 - RNA, 19 nt, Human
caguggccuggaggucucu

SEQ ID NO: 521895 - RNA, 22 nt, Human
ugcaguggugguaaagaugcuc

SEQ ID NO: 521896 - RNA, 22 nt, Human
aagugaauuucauuccaauucu

SEQ ID NO: 521897 - RNA, 22 nt, Human
uucagggacuuugauguaucag

SEQ ID NO: 521898 - RNA, 22 nt, Human
agccagcagggcuuagaggaca

SEQ ID NO: 521899 - RNA, 21 nt, Human
accuucugaauuaccuaccaa

SEQ ID NO: 521900 - RNA, 22 nt, Human
uucacaguuugcugggacagga

SEQ ID NO: 521901 - RNA, 22 nt, Human
gacagcuguggagaggcaugug

SEQ ID NO: 521902 - RNA, 22 nt, Human
agcuuuauagaaaggaucagug

SEQ ID NO: 521903 - RNA, 22 nt, Human
uagauguuuuaacucuugguua

SEQ ID NO: 521904 - RNA, 22 nt, Human
agagcuggagcagccccacugg

SEQ ID NO: 521905 - RNA, 22 nt, Human
auauuaggaguuaaauguauua

SEQ ID NO: 521906 - RNA, 22 nt, Human
agccacaggaaacagagacagc

SEQ ID NO: 521907 - RNA, 22 nt, Human
uucuaguucccacauaguugcc

SEQ ID NO: 521908 - RNA, 22 nt, Human
gagggcagugaauuuugaagcu

SEQ ID NO: 521909 - RNA, 22 nt, Human
aagcacugagcacaguggcuga

SEQ ID NO: 521910 - RNA, 22 nt, Human
uucaugugaucacagauuguaa

SEQ ID NO: 521911 - RNA, 22 nt, Human
cuguaugauuccauuucuauaa

SEQ ID NO: 521912 - RNA, 20 nt, Human
uacagucagggcacaggcag

SEQ ID NO: 521913 - RNA, 19 nt, Human
guggccugcgcugggugcg

SEQ ID NO: 521914 - RNA, 22 nt, Human
auucuguauuucuaauaagauc

SEQ ID NO: 521915 - RNA, 22 nt, Human
aauuucagaacccaaauuagcg

SEQ ID NO: 521916 - RNA, 22 nt, Human
cugugggcuccugcagcucagg

SEQ ID NO: 521917 - RNA, 22 nt, Human
agcagcugguaggaguggccac

SEQ ID NO: 521918 - RNA, 18 nt, Human
cccagcuccacuucccuc

SEQ ID NO: 521919 - RNA, 22 nt, Human
agccagaggccagccugccuca

SEQ ID NO: 521920 - RNA, 22 nt, Human
uuuaaauuauaguuaaugucug

SEQ ID NO: 521921 - RNA, 22 nt, Human
cacaucagggcugcuugggggu

SEQ ID NO: 521922 - RNA, 22 nt, Human
ugggggugaaagucuggacagu

SEQ ID NO: 521923 - RNA, 22 nt, Human
uaaguuacacuuaacuuacuag

SEQ ID NO: 521924 - RNA, 22 nt, Human
aggggcuggaguucgagguuac

SEQ ID NO: 521925 - RNA, 22 nt, Human
cugagccaugggucuaagcacu

SEQ ID NO: 521926 - RNA, 22 nt, Human
cccaagaucuuucgugcacuaa

SEQ ID NO: 521927 - RNA, 22 nt, Human
gaaggccacggaauggagcugg

SEQ ID NO: 521928 - RNA, 22 nt, Human
ccugccugcuuucugcuuugca

SEQ ID NO: 521929 - RNA, 22 nt, Human
acuuugcagggcuugauaucca

SEQ ID NO: 521930 - RNA, 21 nt, Human
ccuuuacaauuuugcauuccu

SEQ ID NO: 521931 - RNA, 22 nt, Human
gguuucaaugagaagugcuugu

SEQ ID NO: 521932 - RNA, 22 nt, Human
acaguguucucuuccuguauag

SEQ ID NO: 521933 - RNA, 22 nt, Human
ugaguucuuuccguuagguaug

SEQ ID NO: 521934 - RNA, 22 nt, Human
ugucuuuaaaauuaaacacauc

SEQ ID NO: 521935 - RNA, 21 nt, Human
agaauucuuaaguauucuaau

SEQ ID NO: 521936 - RNA, 22 nt, Human
uuagggaaggcugcugucagcu

SEQ ID NO: 521937 - RNA, 22 nt, Human
ucuggcccuauggcauguaccu

SEQ ID NO: 521938 - RNA, 22 nt, Human
ccuggccucuccgaguaaccug

SEQ ID NO: 521939 - RNA, 22 nt, Human
cuguccugggggugguccuugc

SEQ ID NO: 521940 - RNA, 19 nt, Human
ucugcagaaggcauacaug

SEQ ID NO: 521941 - RNA, 22 nt, Human
ugggcuggcugaacuucaaccu

SEQ ID NO: 521942 - RNA, 22 nt, Human
agcccaagcauaggagggaggc

SEQ ID NO: 521943 - RNA, 22 nt, Human
ucagaggagcaaaagaggggau

SEQ ID NO: 521944 - RNA, 23 nt, Human
caguggucagaacgugggagggu

SEQ ID NO: 521945 - RNA, 22 nt, Human
uuuuaucagcagggauaacaag

SEQ ID NO: 521946 - RNA, 22 nt, Human
agucccagccuguaggauuggg

SEQ ID NO: 521947 - RNA, 22 nt, Human
cugccaggccuccgcugucccc

SEQ ID NO: 521948 - RNA, 22 nt, Human
cucuggccccaguggccccuug

SEQ ID NO: 521949 - RNA, 22 nt, Human
gcccauccauggggucauggcc

SEQ ID NO: 521950 - RNA, 22 nt, Human
ggggcugauggaacucaggccu

SEQ ID NO: 521951 - RNA, 22 nt, Human
auacaaagcuuucugucuggua

SEQ ID NO: 521952 - RNA, 22 nt, Human
aguauuucugcucaugaaagag

SEQ ID NO: 521953 - RNA, 22 nt, Human
gguccuggaaguguaaguggca

SEQ ID NO: 521954 - RNA, 22 nt, Human
cucugcccucgcacaucugcca

SEQ ID NO: 521955 - RNA, 21 nt, Human
ugaaaguuggagucaaaugua

SEQ ID NO: 521956 - RNA, 19 nt, Human
agcuuccauauucucuagu

SEQ ID NO: 521957 - RNA, 22 nt, Human
aggccaggcaacauucugaagu

SEQ ID NO: 521958 - RNA, 22 nt, Human
cagccuccugggacacucaccg

SEQ ID NO: 521959 - RNA, 22 nt, Human
ugguuccacuaaccugagagcc

SEQ ID NO: 521960 - RNA, 22 nt, Human
guacuucccugggaggcaagca

SEQ ID NO: 521961 - RNA, 20 nt, Human
caccacagaauuggggacag

SEQ ID NO: 521962 - RNA, 22 nt, Human
ugcaaguaacuuguuugggagg

SEQ ID NO: 521963 - RNA, 22 nt, Human
cagcuucuuacgagcugguacu

SEQ ID NO: 521964 - RNA, 22 nt, Human
ggcuggcuggaugaauggauua

SEQ ID NO: 521965 - RNA, 20 nt, Human
uggguccugugggagaagaa

SEQ ID NO: 521966 - RNA, 22 nt, Human
ucagcagugcagggugaggcag

SEQ ID NO: 521967 - RNA, 21 nt, Human
agcuggaaucuggcugugcuu

SEQ ID NO: 521968 - RNA, 22 nt, Human
agguaucugguaagaggcagac

SEQ ID NO: 521969 - RNA, 22 nt, Human
aaagugcugggauuacaagcgu

SEQ ID NO: 521970 - RNA, 22 nt, Human
aaggcaguaggaucuuccacag

SEQ ID NO: 521971 - RNA, 22 nt, Human
aaugauuggcacuagauacaca

SEQ ID NO: 521972 - RNA, 22 nt, Human
ugcaggcuggcagugcugaaau

SEQ ID NO: 521973 - RNA, 22 nt, Human
agaccugcagggccaggccugc

SEQ ID NO: 521974 - RNA, 22 nt, Human
aagccagguguugugguaagag

SEQ ID NO: 521975 - RNA, 22 nt, Human
cagccucuaagcacagccucuc

SEQ ID NO: 521976 - RNA, 22 nt, Human
cugggcaguuuuacaucauugc

SEQ ID NO: 521977 - RNA, 22 nt, Human
ucagaagccggaagugcuccuc

SEQ ID NO: 521978 - RNA, 22 nt, Human
acugcaggagacacagcugcug

SEQ ID NO: 521979 - RNA, 22 nt, Human
gucccaggcuuauguggagcuu

SEQ ID NO: 521980 - RNA, 22 nt, Human
gaggcagcaucuauggugggaa

SEQ ID NO: 521981 - RNA, 22 nt, Human
uaugcaaaucauuagauuuccu

SEQ ID NO: 521982 - RNA, 22 nt, Human
uaagaaauuuaguuauagaaug

SEQ ID NO: 521983 - RNA, 22 nt, Human
ggguggcuccuaugggcauagc

SEQ ID NO: 521984 - RNA, 22 nt, Human
gugagcaggauaggggcucccu

SEQ ID NO: 521985 - RNA, 22 nt, Human
agcuggccuucggugucacugg

SEQ ID NO: 521986 - RNA, 22 nt, Human
aaggcugaggagggccugcagg

SEQ ID NO: 521987 - RNA, 22 nt, Human
aggcuggcgacaucuggcgggc

SEQ ID NO: 521988 - RNA, 22 nt, Human
auccuuggaugugucuuuuugu

SEQ ID NO: 521989 - RNA, 22 nt, Human
caucaaagcuuuuuucuguguu

SEQ ID NO: 521990 - RNA, 20 nt, Human
ugaaaaggucaggagacaug

SEQ ID NO: 521991 - RNA, 22 nt, Human
gcacugagcaccagccacagau

SEQ ID NO: 521992 - RNA, 22 nt, Human
cuccagggagcugcgggagcca

SEQ ID NO: 521993 - RNA, 22 nt, Human
agagcuggaaucagaccucagg

SEQ ID NO: 521994 - RNA, 19 nt, Human
cuugguuaugguaugaugc

SEQ ID NO: 521995 - RNA, 22 nt, Human
uuccagcccgcgacuuguucag

SEQ ID NO: 521996 - RNA, 22 nt, Human
aguuaaagucugaaauagagaa

SEQ ID NO: 521997 - RNA, 17 nt, Human
cauguguaugugggagu

SEQ ID NO: 521998 - RNA, 22 nt, Human
agccugcaggaugggcagcacc

SEQ ID NO: 521999 - RNA, 21 nt, Human
guggccugauuaugaaugggu

SEQ ID NO: 522000 - RNA, 22 nt, Human
agcccagccggauucccaguuc

SEQ ID NO: 522001 - RNA, 22 nt, Human
agagcugccgagcuggggccau

SEQ ID NO: 522002 - RNA, 22 nt, Human
ggcccuguccuggcugucuccg

SEQ ID NO: 522003 - RNA, 22 nt, Human
caguccugucuuuaugacuuca

SEQ ID NO: 522004 - RNA, 22 nt, Human
auauuaaugggauuuagucagg

SEQ ID NO: 522005 - RNA, 22 nt, Human
ucugaagcacagcaggaagggu

SEQ ID NO: 522006 - RNA, 18 nt, Human
uuccuucugauguauaug

SEQ ID NO: 522007 - RNA, 22 nt, Human
aguuuguaucaauuugcuuuau

SEQ ID NO: 522008 - RNA, 22 nt, Human
cuuagaaauuguuacucauuca

SEQ ID NO: 522009 - RNA, 21 nt, Human
ccagcuccaggaccuuggauc

SEQ ID NO: 522010 - RNA, 22 nt, Human
gcuggcaccugcaccaagcagg

SEQ ID NO: 522011 - RNA, 22 nt, Human
guuugaaugcaguaugcauuuu

SEQ ID NO: 522012 - RNA, 22 nt, Human
aguguucagugauugucaaccg

SEQ ID NO: 522013 - RNA, 22 nt, Human
cugcccugcuggagaucacagu

SEQ ID NO: 522014 - RNA, 22 nt, Human
aggcugggaaauguagucuucc

SEQ ID NO: 522015 - RNA, 22 nt, Human
ucagauggguuuugaaggaugu

SEQ ID NO: 522016 - RNA, 22 nt, Human
cuuguauuccccuaucucuaaa

SEQ ID NO: 522017 - RNA, 22 nt, Human
guauagaaggaucuggugaauu

SEQ ID NO: 522018 - RNA, 22 nt, Human
uagugauugcugauauuccauu

SEQ ID NO: 522019 - RNA, 22 nt, Human
ucagcucugccuguggaggcac

SEQ ID NO: 522020 - RNA, 22 nt, Human
ucucucagggggaaggcugaag

SEQ ID NO: 522021 - RNA, 22 nt, Human
gcaucaagacgaugugaaaucg

SEQ ID NO: 522022 - RNA, 23 nt, Human
gcagacagagcagacuaagacaa

SEQ ID NO: 522023 - RNA, 22 nt, Human
agggaugacucuuggcugauuc

SEQ ID NO: 522024 - RNA, 22 nt, Human
ucugccuuccccauaaucugau

SEQ ID NO: 522025 - RNA, 22 nt, Human
uguguccaucugacaggagagg

SEQ ID NO: 522026 - RNA, 22 nt, Human
cagcagcauugcucuggauucc

SEQ ID NO: 522027 - RNA, 22 nt, Human
ucuucagauugcacugagcaag

SEQ ID NO: 522028 - RNA, 22 nt, Human
gccuucaggaaaucaguccuug

SEQ ID NO: 522029 - RNA, 23 nt, Human
gccugccugaccugugcaaaguc

SEQ ID NO: 522030 - RNA, 22 nt, Human
ggcuuuauguuuuucauguggu

SEQ ID NO: 522031 - RNA, 22 nt, Human
aaugcuguauaucuuagcuaau

SEQ ID NO: 522032 - RNA, 22 nt, Human
accugccuucucaaggacauga

SEQ ID NO: 522033 - RNA, 22 nt, Human
gagacacaaacacauuuagagg

SEQ ID NO: 522034 - RNA, 22 nt, Human
cccucagcuucucccugcagcu

SEQ ID NO: 522035 - RNA, 22 nt, Human
ccagcagccaccuucucgaaau

SEQ ID NO: 522036 - RNA, 20 nt, Human
ggccugagcauggcuggcag

SEQ ID NO: 522037 - RNA, 22 nt, Human
ggcugccucugaugugcagacg

SEQ ID NO: 522038 - RNA, 22 nt, Human
gggagagagagcucauguugaa

SEQ ID NO: 522039 - RNA, 22 nt, Human
ugucacuuuggccaagccauug

SEQ ID NO: 522040 - RNA, 22 nt, Human
augcaaaugcuagagaauguug

SEQ ID NO: 522041 - RNA, 18 nt, Human
acaaaggaucaugaggga

SEQ ID NO: 522042 - RNA, 22 nt, Human
aguuuauguaaaauuaguaaug

SEQ ID NO: 522043 - RNA, 21 nt, Human
aaagaacaggcagauguucuu

SEQ ID NO: 522044 - RNA, 22 nt, Human
aucuggaggauucugggacuug

SEQ ID NO: 522045 - RNA, 22 nt, Human
agcagaugcgucugagugggag

SEQ ID NO: 522046 - RNA, 22 nt, Human
ucaggcugugggcacuggccau

SEQ ID NO: 522047 - RNA, 22 nt, Human
ccaguccuagaagaggagucga

SEQ ID NO: 522048 - RNA, 22 nt, Human
agguucagacgcauaauaggca

SEQ ID NO: 522049 - RNA, 22 nt, Human
gggaaggaaaguuauuagcaga

SEQ ID NO: 522050 - RNA, 22 nt, Human
uuuggaauguaguuuaaucauc

SEQ ID NO: 522051 - RNA, 22 nt, Human
acauguguacauauauaugugc

SEQ ID NO: 522052 - RNA, 22 nt, Human
caggucugagucacauguucau

SEQ ID NO: 522053 - RNA, 18 nt, Human
ugggcuugaaagcaaggu

SEQ ID NO: 522054 - RNA, 22 nt, Human
cuggaucuguccccuuuuuguu

SEQ ID NO: 522055 - RNA, 22 nt, Human
cagagcaccagugggagacaag

SEQ ID NO: 522056 - RNA, 18 nt, Human
cucaccauucugcccaau

SEQ ID NO: 522057 - RNA, 22 nt, Human
ugaaugauguauaauauugaga

SEQ ID NO: 522058 - RNA, 22 nt, Human
cugggcucccucaugugucugc

SEQ ID NO: 522059 - RNA, 22 nt, Human
gcaaauguuuuugaguguuuac

SEQ ID NO: 522060 - RNA, 22 nt, Human
acauacuaugaauacauguguc

SEQ ID NO: 522061 - RNA, 22 nt, Human
uacacaacugacaaccauucug

SEQ ID NO: 522062 - RNA, 22 nt, Human
ucugugugcccuaaagccugcu

SEQ ID NO: 522063 - RNA, 22 nt, Human
cagauuuaccuaacuccaaguu

SEQ ID NO: 522064 - RNA, 22 nt, Human
cugucuuugguccugucuguua

SEQ ID NO: 522065 - RNA, 23 nt, Human
ucugcagacgcuguucuauuguc

SEQ ID NO: 522066 - RNA, 22 nt, Human
cacaguguagacuaauaauaga

SEQ ID NO: 522067 - RNA, 22 nt, Human
ggggcagagagaaggaagcuug

SEQ ID NO: 522068 - RNA, 22 nt, Human
ugcaagcacucaaugcaaacag

SEQ ID NO: 522069 - RNA, 22 nt, Human
aaguuacuggcaagggcugcag

SEQ ID NO: 522070 - RNA, 22 nt, Human
gcuggccugggcucaagaccag

SEQ ID NO: 522071 - RNA, 22 nt, Human
cacugugggccugucgugggug

SEQ ID NO: 522072 - RNA, 20 nt, Human
gcuuucuaugagauggacug

SEQ ID NO: 522073 - RNA, 22 nt, Human
augugcacacagugucaugcaa

SEQ ID NO: 522074 - RNA, 22 nt, Human
acauuucuuccacaugcugcug

SEQ ID NO: 522075 - RNA, 22 nt, Human
agccacgucccugucaggguca

SEQ ID NO: 522076 - RNA, 21 nt, Human
agggaaagaaaaugagcuaau

SEQ ID NO: 522077 - RNA, 22 nt, Human
ccuggggaagucacuucucuuu

SEQ ID NO: 522078 - RNA, 22 nt, Human
ugugccagccucuggcuguguc

SEQ ID NO: 522079 - RNA, 19 nt, Human
uccuggggauguggucacc

SEQ ID NO: 522080 - RNA, 22 nt, Human
aggugcagcaugaguccaacgg

SEQ ID NO: 522081 - RNA, 22 nt, Human
ugucccagacauaaguggacau

SEQ ID NO: 522082 - RNA, 22 nt, Human
ggcaugggagugagcaaccuua

SEQ ID NO: 522083 - RNA, 22 nt, Human
aucaguuuuguucacuacuaua

SEQ ID NO: 522084 - RNA, 17 nt, Human
uccuguuuaucauugau

SEQ ID NO: 522085 - RNA, 22 nt, Human
auagcaaagaugucaauucccc

SEQ ID NO: 522086 - RNA, 20 nt, Human
ucugguccaggucuucaugg

SEQ ID NO: 522087 - RNA, 22 nt, Human
cuggguggcuguccagccagcc

SEQ ID NO: 522088 - RNA, 22 nt, Human
gcacauacccacugucaagcac

SEQ ID NO: 522089 - RNA, 22 nt, Human
gcucagagauggggaaugaaaa

SEQ ID NO: 522090 - RNA, 22 nt, Human
uuuccaggaaguaaggauaauc

SEQ ID NO: 522091 - RNA, 22 nt, Human
uaguacagaaaaccucaggguc

SEQ ID NO: 522092 - RNA, 22 nt, Human
ucaggccuuguccugaccuccu

SEQ ID NO: 522093 - RNA, 22 nt, Human
aauguacaauaagacaaagagg

SEQ ID NO: 522094 - RNA, 22 nt, Human
ccagaggugccacagaaagagc

SEQ ID NO: 522095 - RNA, 22 nt, Human
uccagcaugacuaguuccccau

SEQ ID NO: 522096 - RNA, 22 nt, Human
ucucuuaauuguaaugguuccu

SEQ ID NO: 522097 - RNA, 22 nt, Human
acacaguaggauaguuugagga

SEQ ID NO: 522098 - RNA, 22 nt, Human
cugagcugcucccgcugcagcg

SEQ ID NO: 522099 - RNA, 22 nt, Human
gcugccacuuggucaugucaug

SEQ ID NO: 522100 - RNA, 22 nt, Human
aucccuggacggcgccucccca

SEQ ID NO: 522101 - RNA, 22 nt, Human
agaaaugcaguuucaagacaaa

SEQ ID NO: 522102 - RNA, 22 nt, Human
ggagggacccacugcggugacc

SEQ ID NO: 522103 - RNA, 21 nt, Human
ggccugagcaccuguccaccu

SEQ ID NO: 522104 - RNA, 22 nt, Human
acauuucugucuuagggacugu

SEQ ID NO: 522105 - RNA, 22 nt, Human
uggaugugucgcccuggcucuc

SEQ ID NO: 522106 - RNA, 22 nt, Human
uugaaugaagucccuuuuuacu

SEQ ID NO: 522107 - RNA, 22 nt, Human
guauuugucuuguuggucucca

SEQ ID NO: 522108 - RNA, 22 nt, Human
uggcacugagcagccgcggcag

SEQ ID NO: 522109 - RNA, 22 nt, Human
aaggcugugucagaagcucccu

SEQ ID NO: 522110 - RNA, 22 nt, Human
gaaccucagugaaacuggaggu

SEQ ID NO: 522111 - RNA, 22 nt, Human
cuuggcagcuuuuggaggagcc

SEQ ID NO: 522112 - RNA, 19 nt, Human
aggcucugagcuccuggag

SEQ ID NO: 522113 - RNA, 22 nt, Human
uagcagcuggggcuauucauca

SEQ ID NO: 522114 - RNA, 22 nt, Human
aacaaauggggccuuguaugaa

SEQ ID NO: 522115 - RNA, 22 nt, Human
uggcucagcuuuccccaucugg

SEQ ID NO: 522116 - RNA, 22 nt, Human
gacccugauaggaguagaagaa

SEQ ID NO: 522117 - RNA, 22 nt, Human
aaggcaaaagaggugucaucac

SEQ ID NO: 522118 - RNA, 22 nt, Human
ugaaacaaaaguauguagcuug

SEQ ID NO: 522119 - RNA, 22 nt, Human
gccuuagcaucuuaaagcugug

SEQ ID NO: 522120 - RNA, 22 nt, Human
agagaagggguaaagaguccug

SEQ ID NO: 522121 - RNA, 22 nt, Human
cagcuggcuggucagugcacaa

SEQ ID NO: 522122 - RNA, 23 nt, Human
aggcuccacaugggcacuuugca

SEQ ID NO: 522123 - RNA, 22 nt, Human
agugcacaccuuaguacaaagu

SEQ ID NO: 522124 - RNA, 22 nt, Human
gccugggagaaugaccuccaac

SEQ ID NO: 522125 - RNA, 22 nt, Human
cucaguuucugacauuaaaauc

SEQ ID NO: 522126 - RNA, 22 nt, Human
gaggcaguccaguggguaagaa

SEQ ID NO: 522127 - RNA, 18 nt, Human
cguuuuuccgggauugca

SEQ ID NO: 522128 - RNA, 22 nt, Human
uuagaaacccagacucuuaggu

SEQ ID NO: 522129 - RNA, 22 nt, Human
ccugggcuucugucuagauguu

SEQ ID NO: 522130 - RNA, 20 nt, Human
uagugcaaaggcagccauag

SEQ ID NO: 522131 - RNA, 22 nt, Human
ugaaguuucuugaaucuuggag

SEQ ID NO: 522132 - RNA, 22 nt, Human
uccuggaguaggccuuagccau

SEQ ID NO: 522133 - RNA, 22 nt, Human
gcccacagcucguuccucuccu

SEQ ID NO: 522134 - RNA, 22 nt, Human
cugcuuuguggaaucacacugg

SEQ ID NO: 522135 - RNA, 19 nt, Human
ugcuauuugaagaagugua

SEQ ID NO: 522136 - RNA, 22 nt, Human
gcagcuuugucacggagugucg

SEQ ID NO: 522137 - RNA, 22 nt, Human
cuccaagucggcugcagcugga

SEQ ID NO: 522138 - RNA, 22 nt, Human
gacaagacaccucucuccaucc

SEQ ID NO: 522139 - RNA, 22 nt, Human
gcagcaggauggccaauugcca

SEQ ID NO: 522140 - RNA, 22 nt, Human
ucaguguuuccugugguacagc

SEQ ID NO: 522141 - RNA, 22 nt, Human
ugggcagaguugugaugaacug

SEQ ID NO: 522142 - RNA, 22 nt, Human
uacauuguucaugcaugagaaa

SEQ ID NO: 522143 - RNA, 20 nt, Human
ugggccuguggcagaagucu

SEQ ID NO: 522144 - RNA, 22 nt, Human
agguggagacccagagaaggcg

SEQ ID NO: 522145 - RNA, 22 nt, Human
uaagauguuuugguuugauaag

SEQ ID NO: 522146 - RNA, 22 nt, Human
ugcagcaggagccaggccuggu

SEQ ID NO: 522147 - RNA, 22 nt, Human
agugucuuugucucucaagcac

SEQ ID NO: 522148 - RNA, 22 nt, Human
cuggcccucgucaguuucacug

SEQ ID NO: 522149 - RNA, 22 nt, Human
augcaaaugcagccauugcaga

SEQ ID NO: 522150 - RNA, 22 nt, Human
gcagaggucuagcaccaagaau

SEQ ID NO: 522151 - RNA, 22 nt, Human
cuggcugugcugacugagaggg

SEQ ID NO: 522152 - RNA, 22 nt, Human
gcagugggagcuuaggcagugc

SEQ ID NO: 522153 - RNA, 23 nt, Human
cuguggcccugcuucaugcagcc

SEQ ID NO: 522154 - RNA, 22 nt, Human
gccuguuuaucuaucaugaacu

SEQ ID NO: 522155 - RNA, 22 nt, Human
cccagcccccgagugucuggaa

SEQ ID NO: 522156 - RNA, 22 nt, Human
uacaaaugaguuguaugaacca

SEQ ID NO: 522157 - RNA, 22 nt, Human
uagauuuguuuccuucucucca

SEQ ID NO: 522158 - RNA, 22 nt, Human
ccaggcuggauuuugcaguuca

SEQ ID NO: 522159 - RNA, 22 nt, Human
acagcauugcuccaucucaaga

SEQ ID NO: 522160 - RNA, 22 nt, Human
caauuagaggaggaagcucaua

SEQ ID NO: 522161 - RNA, 22 nt, Human
ucuuugaaaagggagauagaaa

SEQ ID NO: 522162 - RNA, 23 nt, Human
ugguggggucuuggagacagcac

SEQ ID NO: 522163 - RNA, 22 nt, Human
auucagaaauagaaaauuugau

SEQ ID NO: 522164 - RNA, 22 nt, Human
uccugggcuuaguggcuagguc

SEQ ID NO: 522165 - RNA, 22 nt, Human
agggauguaaauucuucuucuu

SEQ ID NO: 522166 - RNA, 22 nt, Human
auuggccauuugcauguauuau

SEQ ID NO: 522167 - RNA, 22 nt, Human
gcaggggcuacucugagcuucc

SEQ ID NO: 522168 - RNA, 22 nt, Human
aggcugguaguauuuagucaca

SEQ ID NO: 522169 - RNA, 22 nt, Human
agucccagaucuccauucgguc

SEQ ID NO: 522170 - RNA, 22 nt, Human
gugcuuucugcaugguuccuac

SEQ ID NO: 522171 - RNA, 22 nt, Human
uuuucuggucacauguuauuaa

SEQ ID NO: 522172 - RNA, 22 nt, Human
ucuggucccugcucacuucuug

SEQ ID NO: 522173 - RNA, 22 nt, Human
ggcuggucacaccacugcaggg

SEQ ID NO: 522174 - RNA, 22 nt, Human
gagagcaggcucucgggggcca

SEQ ID NO: 522175 - RNA, 22 nt, Human
aagaggggugugugucaaccca

SEQ ID NO: 522176 - RNA, 22 nt, Human
gcucugaggcugugaggugcug

SEQ ID NO: 522177 - RNA, 22 nt, Human
gagguccugucugagaauggag

SEQ ID NO: 522178 - RNA, 22 nt, Human
ccucugugucuugguuucaaga

SEQ ID NO: 522179 - RNA, 22 nt, Human
ccaaauauuaacaaaguaauuu

SEQ ID NO: 522180 - RNA, 22 nt, Human
augaaacugggauaacuauagc

SEQ ID NO: 522181 - RNA, 22 nt, Human
cuuggucauuucuuguccuguu

SEQ ID NO: 522182 - RNA, 22 nt, Human
uucacauuauaaucaguucugc

SEQ ID NO: 522183 - RNA, 22 nt, Human
gggugggagaaaugaguaucua

SEQ ID NO: 522184 - RNA, 18 nt, Human
ucugaaggaaugauucca

SEQ ID NO: 522185 - RNA, 22 nt, Human
uuuuagaaucagguugucuggg

SEQ ID NO: 522186 - RNA, 22 nt, Human
aaggcuuuuaacuacuguuuua

SEQ ID NO: 522187 - RNA, 22 nt, Human
agccuggauucgugcauccaca

SEQ ID NO: 522188 - RNA, 22 nt, Human
gagcucagcaaaggucugugug

SEQ ID NO: 522189 - RNA, 22 nt, Human
augaaacaaaccucuauggagu

SEQ ID NO: 522190 - RNA, 21 nt, Human
ucacagagccacagaauuggu

SEQ ID NO: 522191 - RNA, 22 nt, Human
cagagcaacacccuuuacaucg

SEQ ID NO: 522192 - RNA, 22 nt, Human
cuuucacaguccugacugagcg

SEQ ID NO: 522193 - RNA, 22 nt, Human
aauucacauauacauuauuccu

SEQ ID NO: 522194 - RNA, 22 nt, Human
uugauagguuuuauguauaguu

SEQ ID NO: 522195 - RNA, 22 nt, Human
aagaaaguggguaauaugauuu

SEQ ID NO: 522196 - RNA, 22 nt, Human
gcuggggaccagcugucucuga

SEQ ID NO: 522197 - RNA, 19 nt, Human
ggcugcugaagagaauuac

SEQ ID NO: 522198 - RNA, 22 nt, Human
uggccugaguugucugcaggcc

SEQ ID NO: 522199 - RNA, 19 nt, Human
ugaaacaaacuuaaaagga

SEQ ID NO: 522200 - RNA, 18 nt, Human
cagaggagagacauucag

SEQ ID NO: 522201 - RNA, 22 nt, Human
ggucaggguauaaucaagugag

SEQ ID NO: 522202 - RNA, 22 nt, Human
augagagguuucgucagaggaa

SEQ ID NO: 522203 - RNA, 22 nt, Human
cagagccauuauggagacuugc

SEQ ID NO: 522204 - RNA, 22 nt, Human
cugcccuggucccauggcugau

SEQ ID NO: 522205 - RNA, 22 nt, Human
gcaggguggauggcagggccag

SEQ ID NO: 522206 - RNA, 22 nt, Human
caaaguuuggcucucaugacau

SEQ ID NO: 522207 - RNA, 22 nt, Human
guggcagagguuccucagugug

SEQ ID NO: 522208 - RNA, 22 nt, Human
aaauaacuugguuucaucagag

SEQ ID NO: 522209 - RNA, 22 nt, Human
uaugagaagaacaggugacuuu

SEQ ID NO: 522210 - RNA, 22 nt, Human
aaggccagcuuguagggcuggu

SEQ ID NO: 522211 - RNA, 22 nt, Human
aggaauucaagaccagcugggc

SEQ ID NO: 522212 - RNA, 22 nt, Human
ccaggcucacugacuaccacau

SEQ ID NO: 522213 - RNA, 22 nt, Human
agcagccacacgccuccuucuc

SEQ ID NO: 522214 - RNA, 22 nt, Human
agagcuguucaacguagcaaug

SEQ ID NO: 522215 - RNA, 22 nt, Human
aaauagauugcugaggcauuac

SEQ ID NO: 522216 - RNA, 22 nt, Human
cuugaaagaagggucuuuuaau

SEQ ID NO: 522217 - RNA, 22 nt, Human
ugacaccacaacuagccauuga

SEQ ID NO: 522218 - RNA, 22 nt, Human
uuuuucaugagacuagaaguca

SEQ ID NO: 522219 - RNA, 19 nt, Human
gcuguauuaaagauacaug

SEQ ID NO: 522220 - RNA, 22 nt, Human
uggcuggcaaggcuggagucag

SEQ ID NO: 522221 - RNA, 22 nt, Human
acagucuugagcaucagccaga

SEQ ID NO: 522222 - RNA, 22 nt, Human
gacccugccaugagugacaggg

SEQ ID NO: 522223 - RNA, 22 nt, Human
uuuuucucuaaguagucccaaa

SEQ ID NO: 522224 - RNA, 22 nt, Human
gggagcuggagcuggaagacuc

SEQ ID NO: 522225 - RNA, 22 nt, Human
aaugaaagaaugaaacagccca

SEQ ID NO: 522226 - RNA, 22 nt, Human
uugauuuguaggaauggagacc

SEQ ID NO: 522227 - RNA, 22 nt, Human
uggucucugugcucgggcaugg

SEQ ID NO: 522228 - RNA, 22 nt, Human
uguccuagauccagcugugcug

SEQ ID NO: 522229 - RNA, 20 nt, Human
gucagugucuucaguaguga

SEQ ID NO: 522230 - RNA, 23 nt, Human
gcaggugguucgaacagaaguuu

SEQ ID NO: 522231 - RNA, 21 nt, Human
aagggagauaggaaucaggcc

SEQ ID NO: 522232 - RNA, 22 nt, Human
agcaggcuccuuccuucucugg

SEQ ID NO: 522233 - RNA, 22 nt, Human
auccaguuuaugucauauucuu

SEQ ID NO: 522234 - RNA, 22 nt, Human
ggaugggagcagaggacgacca

SEQ ID NO: 522235 - RNA, 22 nt, Human
ggcaggggugaggccacucuga

SEQ ID NO: 522236 - RNA, 22 nt, Human
cgcagaagagguugucuagucc

SEQ ID NO: 522237 - RNA, 22 nt, Human
gaagucuucaucugaugcucug

SEQ ID NO: 522238 - RNA, 22 nt, Human
cagaaauauuccaaguacugca

SEQ ID NO: 522239 - RNA, 22 nt, Human
cagaagcugcagugaucuggga

SEQ ID NO: 522240 - RNA, 22 nt, Human
aaaauagaugaaaggaagucug

SEQ ID NO: 522241 - RNA, 20 nt, Human
uggagcuguaaucuugucug

SEQ ID NO: 522242 - RNA, 20 nt, Human
gcagaugagacucacagagg

SEQ ID NO: 522243 - RNA, 22 nt, Human
agcugugggagaaucucugggu

SEQ ID NO: 522244 - RNA, 22 nt, Human
guucucucugcuuccaagaugg

SEQ ID NO: 522245 - RNA, 22 nt, Human
uacagcuuaaaagaugcauuua

SEQ ID NO: 522246 - RNA, 21 nt, Human
cacauuugaaccucacagcaa

SEQ ID NO: 522247 - RNA, 22 nt, Human
guuucgucaggcuuauucuauc

SEQ ID NO: 522248 - RNA, 22 nt, Human
gccaggcagacaggucaucagg

SEQ ID NO: 522249 - RNA, 22 nt, Human
auuagaauuaugcuugcuaaug

SEQ ID NO: 522250 - RNA, 22 nt, Human
uccauugucuuugguccuagcc

SEQ ID NO: 522251 - RNA, 22 nt, Human
cauuuagagucuugcaauuuua

SEQ ID NO: 522252 - RNA, 22 nt, Human
uuauuguuuggguauaauuuga

SEQ ID NO: 522253 - RNA, 23 nt, Human
caggaaaucaauucuuccagcau

SEQ ID NO: 522254 - RNA, 22 nt, Human
cagucuucuaaccuagcagccu

SEQ ID NO: 522255 - RNA, 22 nt, Human
ugccaccaucuggcuguguuga

SEQ ID NO: 522256 - RNA, 22 nt, Human
auguuuuacccuuugcacaaac

SEQ ID NO: 522257 - RNA, 22 nt, Human
cucaggauguacuacagaaggc

SEQ ID NO: 522258 - RNA, 22 nt, Human
caguagccacuagacacaugua

SEQ ID NO: 522259 - RNA, 22 nt, Human
agggucugacuccucuggcaag

SEQ ID NO: 522260 - RNA, 22 nt, Human
cauuuacuuaaaucuuuacaag

SEQ ID NO: 522261 - RNA, 22 nt, Human
uaauuucaccguugcuagaaau

SEQ ID NO: 522262 - RNA, 22 nt, Human
ccuagaugggauggcggccggg

SEQ ID NO: 522263 - RNA, 22 nt, Human
uucagcacuuuguuuugcucau

SEQ ID NO: 522264 - RNA, 22 nt, Human
uuuacaaggcaguuauuuuccu

SEQ ID NO: 522265 - RNA, 22 nt, Human
uaaguucauuagacuacagaua

SEQ ID NO: 522266 - RNA, 22 nt, Human
auuucucauguacaaaaacacu

SEQ ID NO: 522267 - RNA, 22 nt, Human
ucuggggauggucuacuuucug

SEQ ID NO: 522268 - RNA, 22 nt, Human
uggguccugucuccuuguucug

SEQ ID NO: 522269 - RNA, 22 nt, Human
ugcuuuauucagucucugccau

SEQ ID NO: 522270 - RNA, 22 nt, Human
ucuguucuuccuacauucacau

SEQ ID NO: 522271 - RNA, 22 nt, Human
agagcugcaccuaugcagaccu

SEQ ID NO: 522272 - RNA, 18 nt, Human
guaggucaguaccaagca

SEQ ID NO: 522273 - RNA, 22 nt, Human
gcucugcuggagggaaagagaa

SEQ ID NO: 522274 - RNA, 22 nt, Human
cagucuggcucagcacaaaggg

SEQ ID NO: 522275 - RNA, 22 nt, Human
ccagagaggcaaaacuccuucc

SEQ ID NO: 522276 - RNA, 20 nt, Human
agaagcauucaaagaaaacu

SEQ ID NO: 522277 - RNA, 22 nt, Human
gugggcuucccuuaagccagag

SEQ ID NO: 522278 - RNA, 22 nt, Human
ugcagcucugggcaagugccuu

SEQ ID NO: 522279 - RNA, 22 nt, Human
uuuguuaaauauuuauugagug

SEQ ID NO: 522280 - RNA, 22 nt, Human
uggccacagccucugccaguuc

SEQ ID NO: 522281 - RNA, 22 nt, Human
aauaucagcucugucacuuacu

SEQ ID NO: 522282 - RNA, 22 nt, Human
ggagagguguauucaguggguc

SEQ ID NO: 522283 - RNA, 23 nt, Human
acugggucuaucuccagagaaga

SEQ ID NO: 522284 - RNA, 22 nt, Human
gucugcccucacgccagcuggg

SEQ ID NO: 522285 - RNA, 22 nt, Human
ucaaaccugcugucuuguucau

SEQ ID NO: 522286 - RNA, 22 nt, Human
gcugagucuugagcacugagca

SEQ ID NO: 522287 - RNA, 22 nt, Human
uaggaagccuaaauuaaguggu

SEQ ID NO: 522288 - RNA, 22 nt, Human
uauugaaaugaaugacagugau

SEQ ID NO: 522289 - RNA, 22 nt, Human
guaauaagaaacagcaauuauu

SEQ ID NO: 522290 - RNA, 22 nt, Human
ugaaggccacuuccugugagcu

SEQ ID NO: 522291 - RNA, 22 nt, Human
uagugauuaaaggcagaauguu

SEQ ID NO: 522292 - RNA, 22 nt, Human
gcauggccuucagggacagcug

SEQ ID NO: 522293 - RNA, 22 nt, Human
ccuggcugguggcagcgacaag

SEQ ID NO: 522294 - RNA, 22 nt, Human
aaggcucucugauggcagcagu

SEQ ID NO: 522295 - RNA, 22 nt, Human
cucuguccuaugcuugauagaa

SEQ ID NO: 522296 - RNA, 22 nt, Human
uuauucagauuggcuacaggau

SEQ ID NO: 522297 - RNA, 18 nt, Human
aggcaggugcuggaaguc

SEQ ID NO: 522298 - RNA, 22 nt, Human
aguccuggcauauagguccuca

SEQ ID NO: 522299 - RNA, 22 nt, Human
cuuacauugucuuaguuuucaa

SEQ ID NO: 522300 - RNA, 22 nt, Human
ccaggaggugcuggaagaaagc

SEQ ID NO: 522301 - RNA, 23 nt, Human
aguggcugagaguguuucauaug

SEQ ID NO: 522302 - RNA, 22 nt, Human
cugccuggaaggagcaagggga

SEQ ID NO: 522303 - RNA, 22 nt, Human
agcugcucuugggugacuucaa

SEQ ID NO: 522304 - RNA, 19 nt, Human
ccuggaggugaagguucuc

SEQ ID NO: 522305 - RNA, 21 nt, Human
ugcauauauaagugcauacac

SEQ ID NO: 522306 - RNA, 22 nt, Human
aauagauacuacuuagauguag

SEQ ID NO: 522307 - RNA, 22 nt, Human
ggcaaagccuuccagcuguuac

SEQ ID NO: 522308 - RNA, 22 nt, Human
ccacuguaguuaugaugaaguu

SEQ ID NO: 522309 - RNA, 22 nt, Human
uaaauucuacaacuucaaagau

SEQ ID NO: 522310 - RNA, 22 nt, Human
acaguguuuggcaaugcaugca

SEQ ID NO: 522311 - RNA, 22 nt, Human
ugcauauuuuauaaagauggaa

SEQ ID NO: 522312 - RNA, 22 nt, Human
ugcugcagaucagcugaguccu

SEQ ID NO: 522313 - RNA, 19 nt, Human
agacucugccacucuucuc

SEQ ID NO: 522314 - RNA, 22 nt, Human
caggcacugugcugagcucugc

SEQ ID NO: 522315 - RNA, 20 nt, Human
cugaacacagaauaagcaca

SEQ ID NO: 522316 - RNA, 22 nt, Human
auagugguuggauaugucagag

SEQ ID NO: 522317 - RNA, 22 nt, Human
aggcugcagaacagucaggugc

SEQ ID NO: 522318 - RNA, 21 nt, Human
ccagagagagggaaguggguu

SEQ ID NO: 522319 - RNA, 22 nt, Human
ucccauguugugccuggcugca

SEQ ID NO: 522320 - RNA, 22 nt, Human
ucagcuccagaguugcacagug

SEQ ID NO: 522321 - RNA, 22 nt, Human
gcuguauuccugcacuguauag

SEQ ID NO: 522322 - RNA, 22 nt, Human
cagcacuaugacauuuaauucu

SEQ ID NO: 522323 - RNA, 22 nt, Human
uccugcuguuuucuggcccaca

SEQ ID NO: 522324 - RNA, 22 nt, Human
ugcccuguuaucuuggaagagu

SEQ ID NO: 522325 - RNA, 22 nt, Human
uuucaaagguggaagagugaau

SEQ ID NO: 522326 - RNA, 22 nt, Human
ucauggggcucuucaaguggag

SEQ ID NO: 522327 - RNA, 22 nt, Human
caauagcagcuucugaaugcaa

SEQ ID NO: 522328 - RNA, 22 nt, Human
uccuuuccagccucaccucagc

SEQ ID NO: 522329 - RNA, 22 nt, Human
cagcaggaaaaucaauucugug

SEQ ID NO: 522330 - RNA, 21 nt, Human
uccuucaguucugcacuuucu

SEQ ID NO: 522331 - RNA, 22 nt, Human
auuguggcuagacagucacaau

SEQ ID NO: 522332 - RNA, 22 nt, Human
gccagagcacaggcugguagua

SEQ ID NO: 522333 - RNA, 20 nt, Human
gcuguucacauuauuaguag

SEQ ID NO: 522334 - RNA, 22 nt, Human
gcuggccuugugucugaggaag

SEQ ID NO: 522335 - RNA, 22 nt, Human
acagcugggugcugcucagagc

SEQ ID NO: 522336 - RNA, 22 nt, Human
auuauuauauagggaaaguccc

SEQ ID NO: 522337 - RNA, 18 nt, Human
ugcucuggucucacuugg

SEQ ID NO: 522338 - RNA, 22 nt, Human
cugcccugcuugaugacagcga

SEQ ID NO: 522339 - RNA, 22 nt, Human
gggcugagaauucagcuuuccu

SEQ ID NO: 522340 - RNA, 22 nt, Human
agugaaauaugcccauugcugu

SEQ ID NO: 522341 - RNA, 22 nt, Human
agggagcuguggucagcucagu

SEQ ID NO: 522342 - RNA, 22 nt, Human
aggacaugugccuccagggcag

SEQ ID NO: 522343 - RNA, 22 nt, Human
gaggcaggcccugaaugaguca

SEQ ID NO: 522344 - RNA, 22 nt, Human
guucucaguggggagcaggguu

SEQ ID NO: 522345 - RNA, 23 nt, Human
agaauuguaaauagaauauaccu

SEQ ID NO: 522346 - RNA, 22 nt, Human
aagauggagcacgagcagaagc

SEQ ID NO: 522347 - RNA, 22 nt, Human
gggacuguaaauucauauggcc

SEQ ID NO: 522348 - RNA, 22 nt, Human
cagaaacacuuguagagaaguu

SEQ ID NO: 522349 - RNA, 22 nt, Human
cuuacaaaggagaggagauagg

SEQ ID NO: 522350 - RNA, 22 nt, Human
gcacaugucuuauucacuguua

SEQ ID NO: 522351 - RNA, 22 nt, Human
ugaugggaggugcugcaggacc

SEQ ID NO: 522352 - RNA, 22 nt, Human
ccugugcucccauagcuucugu

SEQ ID NO: 522353 - RNA, 22 nt, Human
cuuucauuugauaagaaugcca

SEQ ID NO: 522354 - RNA, 22 nt, Human
uuguuuuggaagaacuuacucu

SEQ ID NO: 522355 - RNA, 22 nt, Human
uggccuuccuggugacucauga

SEQ ID NO: 522356 - RNA, 22 nt, Human
uucuggcugcagucccuguaau

SEQ ID NO: 522357 - RNA, 22 nt, Human
acagauguaaucuauucacauu

SEQ ID NO: 522358 - RNA, 22 nt, Human
gcucugggauuaccagccuuag

SEQ ID NO: 522359 - RNA, 22 nt, Human
uucugggcuaccuucccggcag

SEQ ID NO: 522360 - RNA, 22 nt, Human
cugaaccaucucuguucuguau

SEQ ID NO: 522361 - RNA, 22 nt, Human
ugugaaggcagcagcucugucc

SEQ ID NO: 522362 - RNA, 22 nt, Human
gguggcugugagcauuauguga

SEQ ID NO: 522363 - RNA, 22 nt, Human
cacaggcugcccgcagcuggga

SEQ ID NO: 522364 - RNA, 22 nt, Human
gcugcaggcggccgugguggcg

SEQ ID NO: 522365 - RNA, 22 nt, Human
gcuggggcugggcugaggaaga

SEQ ID NO: 522366 - RNA, 22 nt, Human
gucugagcacccuggccuguca

SEQ ID NO: 522367 - RNA, 22 nt, Human
cuccagcuuuuucccaguuggc

SEQ ID NO: 522368 - RNA, 20 nt, Human
caagcccucuuuagccugcc

SEQ ID NO: 522369 - RNA, 22 nt, Human
ugaaacuuauucaguuucuacc

SEQ ID NO: 522370 - RNA, 22 nt, Human
agauuucccacuccauguauug

SEQ ID NO: 522371 - RNA, 22 nt, Human
uugcaagauguuaccauuguua

SEQ ID NO: 522372 - RNA, 22 nt, Human
aaaagggacuacucucagcucc

SEQ ID NO: 522373 - RNA, 22 nt, Human
augguguuuauaggcaaagauc

SEQ ID NO: 522374 - RNA, 22 nt, Human
uggagagcuccuauuugcuguc

SEQ ID NO: 522375 - RNA, 22 nt, Human
aggaaacuucagaguuuugguc

SEQ ID NO: 522376 - RNA, 22 nt, Human
gaggccuguagucauggaugua

SEQ ID NO: 522377 - RNA, 22 nt, Human
cgcuaggauuaggauuaauccu

SEQ ID NO: 522378 - RNA, 22 nt, Human
accaggcaacugugaaugggcu

SEQ ID NO: 522379 - RNA, 22 nt, Human
agugcugaacauagaauggaca

SEQ ID NO: 522380 - RNA, 22 nt, Human
aggaagcugggaaacugacauu

SEQ ID NO: 522381 - RNA, 23 nt, Human
uggcucugugucacauacaggau

SEQ ID NO: 522382 - RNA, 20 nt, Human
cuuagaaauuuuuacccugg

SEQ ID NO: 522383 - RNA, 22 nt, Human
uucagcacugacugagugguua

SEQ ID NO: 522384 - RNA, 22 nt, Human
gggcucugcgcucagcuccagc

SEQ ID NO: 522385 - RNA, 22 nt, Human
ugaaguccuagaacuccuggua

SEQ ID NO: 522386 - RNA, 18 nt, Human
guccugagcucugcugua

SEQ ID NO: 522387 - RNA, 22 nt, Human
uccuucaaucacccagugggga

SEQ ID NO: 522388 - RNA, 22 nt, Human
caguggcugugaccagggaccu

SEQ ID NO: 522389 - RNA, 22 nt, Human
aggcugucaucuuugcaggcag

SEQ ID NO: 522390 - RNA, 22 nt, Human
agcagugggugacagagcugag

SEQ ID NO: 522391 - RNA, 22 nt, Human
ggagucugauuuuuuaugggug

SEQ ID NO: 522392 - RNA, 18 nt, Human
gacacauccccaggccuc

SEQ ID NO: 522393 - RNA, 22 nt, Human
aacacaaaaauucucaggggca

SEQ ID NO: 522394 - RNA, 19 nt, Human
uagaggagaagggaagugg

SEQ ID NO: 522395 - RNA, 22 nt, Human
aagggcucuguugccauuucag

SEQ ID NO: 522396 - RNA, 22 nt, Human
cacagcuuugcuuuccuuaaua

SEQ ID NO: 522397 - RNA, 22 nt, Human
cuguacaggucaaugauaagau

SEQ ID NO: 522398 - RNA, 22 nt, Human
gcguuggggaccccgaagcugg

SEQ ID NO: 522399 - RNA, 22 nt, Human
gaugagggccugguggcugugc

SEQ ID NO: 522400 - RNA, 22 nt, Human
ugaggaaguuguuucucuucua

SEQ ID NO: 522401 - RNA, 22 nt, Human
gaaggaagacugguuuaaaugu

SEQ ID NO: 522402 - RNA, 22 nt, Human
gaguccaguaguuaggacagag

SEQ ID NO: 522403 - RNA, 22 nt, Human
cagcugccugcaacacaagcuu

SEQ ID NO: 522404 - RNA, 22 nt, Human
uuugaaaguccuaggagagucc

SEQ ID NO: 522405 - RNA, 22 nt, Human
acugggcccauauacucagucu

SEQ ID NO: 522406 - RNA, 22 nt, Human
cagcagcugcaaauggaaacag

SEQ ID NO: 522407 - RNA, 22 nt, Human
gcaguguuuuacagaccagcau

SEQ ID NO: 522408 - RNA, 22 nt, Human
acuaaagaagccaaaguuuucu

SEQ ID NO: 522409 - RNA, 22 nt, Human
gacagcagacaaaccauguuuu

SEQ ID NO: 522410 - RNA, 22 nt, Human
ugaacgcagguccacauggcuc

SEQ ID NO: 522411 - RNA, 22 nt, Human
auuccacagcuacaucaaucua

SEQ ID NO: 522412 - RNA, 19 nt, Human
acccucucagugccugagg

SEQ ID NO: 522413 - RNA, 22 nt, Human
cucccugggcagauguggcucu

SEQ ID NO: 522414 - RNA, 22 nt, Human
uucuuuaaaauagugagaaaga

SEQ ID NO: 522415 - RNA, 22 nt, Human
augucacagucugacucaguga

SEQ ID NO: 522416 - RNA, 22 nt, Human
uccuggauuaauagggagcugu

SEQ ID NO: 522417 - RNA, 22 nt, Human
ugucucaguacacuccgauguu

SEQ ID NO: 522418 - RNA, 22 nt, Human
uuggccacaauccaagccuugg

SEQ ID NO: 522419 - RNA, 19 nt, Human
uggaccugugcccauggcu

SEQ ID NO: 522420 - RNA, 22 nt, Human
acacaagaaguuaaugggcaaa

SEQ ID NO: 522421 - RNA, 22 nt, Human
ucaggggcccuucccucagcag

SEQ ID NO: 522422 - RNA, 22 nt, Human
uccugaggcuaaagugcagugg

SEQ ID NO: 522423 - RNA, 22 nt, Human
uggauuuauuagguuggugaaa

SEQ ID NO: 522424 - RNA, 19 nt, Human
ggagaggcuggagggaugc

SEQ ID NO: 522425 - RNA, 22 nt, Human
uuguuucaugaguguaaaggga

SEQ ID NO: 522426 - RNA, 23 nt, Human
cagagcuggcucagagcugccug

SEQ ID NO: 522427 - RNA, 22 nt, Human
gcaguguugguuugcucugcag

SEQ ID NO: 522428 - RNA, 22 nt, Human
guguaugauuucaaauggcuag

SEQ ID NO: 522429 - RNA, 22 nt, Human
aguguggguuuuauggagcccu

SEQ ID NO: 522430 - RNA, 22 nt, Human
acagaccaaaaaaggauauugg

SEQ ID NO: 522431 - RNA, 20 nt, Human
ggcauggguggggcucccag

SEQ ID NO: 522432 - RNA, 22 nt, Human
ggaugggaacuugguagggcau

SEQ ID NO: 522433 - RNA, 22 nt, Human
uggccugggccugccggugcaa

SEQ ID NO: 522434 - RNA, 22 nt, Human
ggccacagucucuggaaggaug

SEQ ID NO: 522435 - RNA, 22 nt, Human
ugaggcaguucuuacuuguauu

SEQ ID NO: 522436 - RNA, 22 nt, Human
ucuuggaacuuauuauuguaga

SEQ ID NO: 522437 - RNA, 22 nt, Human
aaaugcacaggagaaccaauuc

SEQ ID NO: 522438 - RNA, 22 nt, Human
gguacaaggagugaagguuugg

SEQ ID NO: 522439 - RNA, 22 nt, Human
agggccugggucuguacuccuc

SEQ ID NO: 522440 - RNA, 21 nt, Human
gcagcuggucucagagcuugc

SEQ ID NO: 522441 - RNA, 19 nt, Human
cagcugccuuuucuuugca

SEQ ID NO: 522442 - RNA, 22 nt, Human
gggaaggagguggaccugcccc

SEQ ID NO: 522443 - RNA, 22 nt, Human
cagucacauggaugauggauag

SEQ ID NO: 522444 - RNA, 22 nt, Human
guuuucucugagaugccuuucu

SEQ ID NO: 522445 - RNA, 22 nt, Human
guggaggacaaaagaagccuuu

SEQ ID NO: 522446 - RNA, 22 nt, Human
agcaggaacucagggaguucuc

SEQ ID NO: 522447 - RNA, 22 nt, Human
ugaaccaggaggcagccagcac

SEQ ID NO: 522448 - RNA, 22 nt, Human
ggaugcugcuaucaggcuucga

SEQ ID NO: 522449 - RNA, 22 nt, Human
ucugccuuggcaaccacagcuu

SEQ ID NO: 522450 - RNA, 22 nt, Human
aaaugcagcagcuaauugaaaa

SEQ ID NO: 522451 - RNA, 22 nt, Human
uuugaaagacagaauauuuuug

SEQ ID NO: 522452 - RNA, 22 nt, Human
gacaucaauucagcauuuuaag

SEQ ID NO: 522453 - RNA, 22 nt, Human
gaggcagcgggucaggaccgug

SEQ ID NO: 522454 - RNA, 22 nt, Human
uaacaguauugaagauaaacua

SEQ ID NO: 522455 - RNA, 22 nt, Human
ggcuucccagcagagggcgcac

SEQ ID NO: 522456 - RNA, 22 nt, Human
auuuauugagagggaggggaau

SEQ ID NO: 522457 - RNA, 22 nt, Human
cugagauggaguuuugcucuug

SEQ ID NO: 522458 - RNA, 22 nt, Human
uugcccugucuuaagcuggcaa

SEQ ID NO: 522459 - RNA, 22 nt, Human
gccugccaugagcuaaugacac

SEQ ID NO: 522460 - RNA, 22 nt, Human
caucuugcuucaucugcugugu

SEQ ID NO: 522461 - RNA, 22 nt, Human
accagcuguguccuggcugcag

SEQ ID NO: 522462 - RNA, 22 nt, Human
uacuucauuccuuuguaaaaug

SEQ ID NO: 522463 - RNA, 22 nt, Human
auuagcugaccucuaaggagcc

SEQ ID NO: 522464 - RNA, 22 nt, Human
gcugucacucaccaggccugca

SEQ ID NO: 522465 - RNA, 22 nt, Human
aucuuucuaugguacuuucucc

SEQ ID NO: 522466 - RNA, 22 nt, Human
uguuaaaguggauaagcugaau

SEQ ID NO: 522467 - RNA, 22 nt, Human
uguccuggccuccagaaagucg

SEQ ID NO: 522468 - RNA, 22 nt, Human
cugcagcuauauuuucccacag

SEQ ID NO: 522469 - RNA, 22 nt, Human
cugccuggcuaaacucaagucg

SEQ ID NO: 522470 - RNA, 22 nt, Human
agcugauuccacuuuuucccca

SEQ ID NO: 522471 - RNA, 23 nt, Human
ugaaugauggugcuccucaucuu

SEQ ID NO: 522472 - RNA, 22 nt, Human
gcucugucauuuugcagacacu

SEQ ID NO: 522473 - RNA, 22 nt, Human
gcaggcucuucuuucugcccag

SEQ ID NO: 522474 - RNA, 22 nt, Human
guguuuccuaguuuaaugaaug

SEQ ID NO: 522475 - RNA, 21 nt, Human
uccagcucuuauguucaugaa

SEQ ID NO: 522476 - RNA, 22 nt, Human
caguggucugugcuucuguaca

SEQ ID NO: 522477 - RNA, 22 nt, Human
uucucuaauacauuuugacaaa

SEQ ID NO: 522478 - RNA, 22 nt, Human
acauauauuacuaguaaagaca

SEQ ID NO: 522479 - RNA, 22 nt, Human
cuccugggagcagggauggaug

SEQ ID NO: 522480 - RNA, 22 nt, Human
agccagggaagaggccuaccuc

SEQ ID NO: 522481 - RNA, 22 nt, Human
ggcagucccagcccagaggcgc

SEQ ID NO: 522482 - RNA, 22 nt, Human
uguccucuuccagugcuccuuc

SEQ ID NO: 522483 - RNA, 22 nt, Human
ugugaaugucuagguuuuaugu

SEQ ID NO: 522484 - RNA, 22 nt, Human
cugagauggccacugggucuca

SEQ ID NO: 522485 - RNA, 22 nt, Human
uuaaagaugcagcuuuagagaa

SEQ ID NO: 522486 - RNA, 22 nt, Human
gccugcaggcuguaguuuguga

SEQ ID NO: 522487 - RNA, 22 nt, Human
agugaaaugauucugagcaaga

SEQ ID NO: 522488 - RNA, 18 nt, Human
auggucucauacugggag

SEQ ID NO: 522489 - RNA, 22 nt, Human
uucaagaucgaguuuaaaguga

SEQ ID NO: 522490 - RNA, 22 nt, Human
cagcagcucacugaauaaugac

SEQ ID NO: 522491 - RNA, 22 nt, Human
uguguacuugaaagggcagguc

SEQ ID NO: 522492 - RNA, 22 nt, Human
uaauuuuaacugugcuguuugg

SEQ ID NO: 522493 - RNA, 22 nt, Human
ccagaagggcuauugcagugac

SEQ ID NO: 522494 - RNA, 22 nt, Human
agacaggcagaggcugcagagg

SEQ ID NO: 522495 - RNA, 22 nt, Human
aauccugaggcaaagagaugag

SEQ ID NO: 522496 - RNA, 22 nt, Human
gauaaauugcacuuuuucuuac

SEQ ID NO: 522497 - RNA, 22 nt, Human
auucuccacacauccagaccuu

SEQ ID NO: 522498 - RNA, 22 nt, Human
agagccugaggaugucccagcu

SEQ ID NO: 522499 - RNA, 22 nt, Human
acagaggguuucuaaggauuug

SEQ ID NO: 522500 - RNA, 22 nt, Human
agagcuggaagcugcucuuaga

SEQ ID NO: 522501 - RNA, 22 nt, Human
gcccagugcugagggugcugcu

SEQ ID NO: 522502 - RNA, 22 nt, Human
gagagcugugguuugaccaggc

SEQ ID NO: 522503 - RNA, 22 nt, Human
ugagagguaggaaaugaacaag

SEQ ID NO: 522504 - RNA, 22 nt, Human
uccauaagcagguucuuccuga

SEQ ID NO: 522505 - RNA, 20 nt, Human
cucagcucuucagggcaagu

SEQ ID NO: 522506 - RNA, 22 nt, Human
agcugccagcaaguuucaaaca

SEQ ID NO: 522507 - RNA, 22 nt, Human
ugggcuguccagcaccugggcu

SEQ ID NO: 522508 - RNA, 22 nt, Human
gcucuggcuacuccacccuguu

SEQ ID NO: 522509 - RNA, 22 nt, Human
uuccuggggcgacuguaucuga

SEQ ID NO: 522510 - RNA, 22 nt, Human
ugaggaaugcugagcagaggaa

SEQ ID NO: 522511 - RNA, 22 nt, Human
uuauuauuuuguguacagcaaa

SEQ ID NO: 522512 - RNA, 22 nt, Human
cuaaaaauccacacuaggugaa

SEQ ID NO: 522513 - RNA, 22 nt, Human
uuucuucucacccaggacagag

SEQ ID NO: 522514 - RNA, 22 nt, Human
acagcuguguuuuauaaucagc

SEQ ID NO: 522515 - RNA, 22 nt, Human
acaguguucacuaagguuagcu

SEQ ID NO: 522516 - RNA, 22 nt, Human
ugcagaaggccugacauugcac

SEQ ID NO: 522517 - RNA, 18 nt, Human
ucuggaacaacuucaugu

SEQ ID NO: 522518 - RNA, 22 nt, Human
uauucauaguaaacaaaagugg

SEQ ID NO: 522519 - RNA, 22 nt, Human
auucucaguucacuaguuucuu

SEQ ID NO: 522520 - RNA, 21 nt, Human
uccaggaguggcugggcaggg

SEQ ID NO: 522521 - RNA, 22 nt, Human
gcauaauauacaugcuugaucc

SEQ ID NO: 522522 - RNA, 22 nt, Human
uccaaaggaagaggcugucagu

SEQ ID NO: 522523 - RNA, 22 nt, Human
ccaaagugcugggguuacaggc

SEQ ID NO: 522524 - RNA, 22 nt, Human
gaauaacauuuuuuccuuuaca

SEQ ID NO: 522525 - RNA, 22 nt, Human
gcauuguccugcuucugagugu

SEQ ID NO: 522526 - RNA, 22 nt, Human
aggcuuuaaguggccuacagcu

SEQ ID NO: 522527 - RNA, 22 nt, Human
cuagggaccucagcuccuggag

SEQ ID NO: 522528 - RNA, 22 nt, Human
auugacaagacaauggcucuua

SEQ ID NO: 522529 - RNA, 22 nt, Human
ccagucuggcaggagggggaac

SEQ ID NO: 522530 - RNA, 22 nt, Human
uggacucagaaguguucuuuua

SEQ ID NO: 522531 - RNA, 22 nt, Human
gggcggggggagcuggaaugaa

SEQ ID NO: 522532 - RNA, 21 nt, Human
ugcaggcugugcgcuccugcc

SEQ ID NO: 522533 - RNA, 22 nt, Human
gcuccuggucuggagcuucaag

SEQ ID NO: 522534 - RNA, 22 nt, Human
uagcugccuagacagcuauagc

SEQ ID NO: 522535 - RNA, 22 nt, Human
caaaggcaguuacugaaugaag

SEQ ID NO: 522536 - RNA, 21 nt, Human
aacuuguauuucuccuuauuc

SEQ ID NO: 522537 - RNA, 19 nt, Human
aggcaugggaagagaaguc

SEQ ID NO: 522538 - RNA, 22 nt, Human
aacagcuucaucacauggcaua

SEQ ID NO: 522539 - RNA, 22 nt, Human
ccugagcauuagacauccauca

SEQ ID NO: 522540 - RNA, 22 nt, Human
gucuuuggagaggugccauuuc

SEQ ID NO: 522541 - RNA, 22 nt, Human
cuuggcuggaacuccugagaaa

SEQ ID NO: 522542 - RNA, 22 nt, Human
agaaaguuuugugcuauauaug

SEQ ID NO: 522543 - RNA, 22 nt, Human
gcaaugauauugaagugaugaa

SEQ ID NO: 522544 - RNA, 22 nt, Human
augcugaacugagauguaacuu

SEQ ID NO: 522545 - RNA, 22 nt, Human
uacuuucuguccuucuguuaaa

SEQ ID NO: 522546 - RNA, 22 nt, Human
gcuggccauucucuuugagaug

SEQ ID NO: 522547 - RNA, 22 nt, Human
uggcagcaauuugugauguuga

SEQ ID NO: 522548 - RNA, 22 nt, Human
guacaauagcaguuuucccuuu

SEQ ID NO: 522549 - RNA, 22 nt, Human
aggccuggccccaguugcuagg

SEQ ID NO: 522550 - RNA, 20 nt, Human
caugcugccuccauugaugc

SEQ ID NO: 522551 - RNA, 22 nt, Human
gcaggagagccagcaggcuucc

SEQ ID NO: 522552 - RNA, 22 nt, Human
caggaggaggguacaccaucag

SEQ ID NO: 522553 - RNA, 22 nt, Human
agucucugcacaguaagaagca

SEQ ID NO: 522554 - RNA, 23 nt, Human
cagugcugguucugccugugggg

SEQ ID NO: 522555 - RNA, 22 nt, Human
gcagcucugacaaugccuggaa

SEQ ID NO: 522556 - RNA, 22 nt, Human
aaaugcuguguuuuaacauaga

SEQ ID NO: 522557 - RNA, 22 nt, Human
aaugucuacauucugaauucgu

SEQ ID NO: 522558 - RNA, 22 nt, Human
gggguugguuuaaaugcuugag

SEQ ID NO: 522559 - RNA, 22 nt, Human
uguaaagaaagacgcagaguua

SEQ ID NO: 522560 - RNA, 22 nt, Human
uggcucuggggacaguaagucc

SEQ ID NO: 522561 - RNA, 22 nt, Human
aagaguuugggcaagucauaaa

SEQ ID NO: 522562 - RNA, 22 nt, Human
gggcugggauugcuugcuguga

SEQ ID NO: 522563 - RNA, 22 nt, Human
aaagguaucauguccauacagu

SEQ ID NO: 522564 - RNA, 22 nt, Human
aagcgccacgagaagcuggacc

SEQ ID NO: 522565 - RNA, 22 nt, Human
ccuaggaacccccaggcuucug

SEQ ID NO: 522566 - RNA, 22 nt, Human
cugggcacuugcucacagcucu

SEQ ID NO: 522567 - RNA, 20 nt, Human
aaaugaugggaauaaucuau

SEQ ID NO: 522568 - RNA, 22 nt, Human
gcaggaugggagcuucacuuug

SEQ ID NO: 522569 - RNA, 22 nt, Human
uaguuacagcaggcaggauaua

SEQ ID NO: 522570 - RNA, 23 nt, Human
aguuuguaaagaaauauuugcac

SEQ ID NO: 522571 - RNA, 22 nt, Human
cgucccaguuccagccgcgcug

SEQ ID NO: 522572 - RNA, 22 nt, Human
ucagugugcacaugguagcagu

SEQ ID NO: 522573 - RNA, 22 nt, Human
aggauccuuuuucugcuguuug

SEQ ID NO: 522574 - RNA, 22 nt, Human
caucaagagucuuacuaucagu

SEQ ID NO: 522575 - RNA, 22 nt, Human
ugggcagauguggcucuccuug

SEQ ID NO: 522576 - RNA, 22 nt, Human
agugucugugaugaggucagga

SEQ ID NO: 522577 - RNA, 22 nt, Human
uuucaaggauguuauauaaaug

SEQ ID NO: 522578 - RNA, 21 nt, Human
gacaaagugaagcaggcagga

SEQ ID NO: 522579 - RNA, 22 nt, Human
augggcugugggacccuggacc

SEQ ID NO: 522580 - RNA, 22 nt, Human
caguucugacuuucauaauguc

SEQ ID NO: 522581 - RNA, 22 nt, Human
cucuuuuucaccucugucagcg

SEQ ID NO: 522582 - RNA, 22 nt, Human
guuuagaaugaaacuuuugagc

SEQ ID NO: 522583 - RNA, 22 nt, Human
aucuugaucaaggcuaucauga

SEQ ID NO: 522584 - RNA, 23 nt, Human
auacauacagucuuacugacuuu

SEQ ID NO: 522585 - RNA, 20 nt, Human
cagugcaacugaagaacuga

SEQ ID NO: 522586 - RNA, 22 nt, Human
aggagaggaaucauuauuacaa

SEQ ID NO: 522587 - RNA, 18 nt, Human
uuaauguggcuuacuaug

SEQ ID NO: 522588 - RNA, 22 nt, Human
uuucacaaguuucaggauucug

SEQ ID NO: 522589 - RNA, 22 nt, Human
uucaaacucuugcucugcuagu

SEQ ID NO: 522590 - RNA, 22 nt, Human
augaaauuuuaauuauaccucu

SEQ ID NO: 522591 - RNA, 21 nt, Human
guguuuccuguuuauggcuug

SEQ ID NO: 522592 - RNA, 22 nt, Human
gugcccugaugcaauugucuca

SEQ ID NO: 522593 - RNA, 22 nt, Human
acagcaagccagcuugucacug

SEQ ID NO: 522594 - RNA, 22 nt, Human
uggcugaggcuggagugcagug

SEQ ID NO: 522595 - RNA, 22 nt, Human
guggccucuguuggcuccuagg

SEQ ID NO: 522596 - RNA, 19 nt, Human
cacaucagcagggcugugg

SEQ ID NO: 522597 - RNA, 20 nt, Human
gccuggaggcaaugggaaga

SEQ ID NO: 522598 - RNA, 22 nt, Human
uuugaaagcaggugugggaggg

SEQ ID NO: 522599 - RNA, 22 nt, Human
acagcuuuucaauucugcugag

SEQ ID NO: 522600 - RNA, 22 nt, Human
uggcacaguccugggugccugc

SEQ ID NO: 522601 - RNA, 22 nt, Human
uggcugccaugacgccugggga

SEQ ID NO: 522602 - RNA, 22 nt, Human
uauugacaauuugugaaacuau

SEQ ID NO: 522603 - RNA, 22 nt, Human
agcagcauggagaaaccguuca

SEQ ID NO: 522604 - RNA, 22 nt, Human
gaaugauauuauuucgugcugg

SEQ ID NO: 522605 - RNA, 22 nt, Human
uccugugugggcaggaugagaa

SEQ ID NO: 522606 - RNA, 22 nt, Human
ggcagcugcugcauuacguugu

SEQ ID NO: 522607 - RNA, 22 nt, Human
cacugcuucuggaggaauuugg

SEQ ID NO: 522608 - RNA, 22 nt, Human
cuguccuggagggcauaggacg

SEQ ID NO: 522609 - RNA, 22 nt, Human
aguuuuucugggaggcacugcu

SEQ ID NO: 522610 - RNA, 22 nt, Human
uucauucccuuauauuagcauu

SEQ ID NO: 522611 - RNA, 22 nt, Human
guuuuucuagaaaucuccuccu

SEQ ID NO: 522612 - RNA, 17 nt, Human
ggagaucuggcagaggg

SEQ ID NO: 522613 - RNA, 20 nt, Human
ccuggaagagcuccccaggc

SEQ ID NO: 522614 - RNA, 22 nt, Human
cuggcccuggcuggagcccagg

SEQ ID NO: 522615 - RNA, 22 nt, Human
cuguccuaugaguacucacuag

SEQ ID NO: 522616 - RNA, 22 nt, Human
gagacauggcaaaagcacuggu

SEQ ID NO: 522617 - RNA, 22 nt, Human
aaaaacuguaauuacuuuugca

SEQ ID NO: 522618 - RNA, 22 nt, Human
ggccucugggguccugagccca

SEQ ID NO: 522619 - RNA, 22 nt, Human
guggcagcugugggacacuggu

SEQ ID NO: 522620 - RNA, 22 nt, Human
gugugccaccagucaaggugaa

SEQ ID NO: 522621 - RNA, 22 nt, Human
ccucugagagaaggccuucagc

SEQ ID NO: 522622 - RNA, 22 nt, Human
auggguuuauagguggacuuuu

SEQ ID NO: 522623 - RNA, 22 nt, Human
uuuguugacaucccuguacuuu

SEQ ID NO: 522624 - RNA, 22 nt, Human
agcaggcagcugggggaguuga

SEQ ID NO: 522625 - RNA, 19 nt, Human
agaggcugucaccuguagc

SEQ ID NO: 522626 - RNA, 22 nt, Human
cugaagauuauaaacagacaua

SEQ ID NO: 522627 - RNA, 22 nt, Human
gaaaaggaaauuuauagagauc

SEQ ID NO: 522628 - RNA, 22 nt, Human
agggaaaucuuucaacacuuca

SEQ ID NO: 522629 - RNA, 22 nt, Human
auauuuguauuucgugugugua

SEQ ID NO: 522630 - RNA, 17 nt, Human
ucacaucacacaagcaa

SEQ ID NO: 522631 - RNA, 22 nt, Human
gugguguaggucacaguuagga

SEQ ID NO: 522632 - RNA, 22 nt, Human
aagaaacugaaaguggcuucau

SEQ ID NO: 522633 - RNA, 22 nt, Human
cugcugcugagagcucagccug

SEQ ID NO: 522634 - RNA, 22 nt, Human
auagcagaaaccaagcuucuuc

SEQ ID NO: 522635 - RNA, 22 nt, Human
ucugagcuggagcccaucaccu

SEQ ID NO: 522636 - RNA, 20 nt, Human
uggcccuguuuucuccaggc

SEQ ID NO: 522637 - RNA, 22 nt, Human
ugauuucucauauuguucaaaa

SEQ ID NO: 522638 - RNA, 22 nt, Human
ccugggagguggagguugcagu

SEQ ID NO: 522639 - RNA, 22 nt, Human
uugaaaggugaacaugaugcac

SEQ ID NO: 522640 - RNA, 22 nt, Human
uguuccaugucuuuguaggacu

SEQ ID NO: 522641 - RNA, 22 nt, Human
uggaggucugcaaggcgcugga

SEQ ID NO: 522642 - RNA, 22 nt, Human
ucaugugucugccaguguuuau

SEQ ID NO: 522643 - RNA, 22 nt, Human
aaguuauugcagcaauccaagu

SEQ ID NO: 522644 - RNA, 22 nt, Human
ccugucucccuggcauggcuca

SEQ ID NO: 522645 - RNA, 22 nt, Human
ucacacgugagguucuauccug

SEQ ID NO: 522646 - RNA, 22 nt, Human
acaugcuaugagagauuacuuc

SEQ ID NO: 522647 - RNA, 22 nt, Human
cuagaaagauacuuaaaucaag

SEQ ID NO: 522648 - RNA, 22 nt, Human
gguggguauugaauacaggugu

SEQ ID NO: 522649 - RNA, 22 nt, Human
aggggagcuugccuggucaccc

SEQ ID NO: 522650 - RNA, 22 nt, Human
uguaugugcuugagaagguggg

SEQ ID NO: 522651 - RNA, 22 nt, Human
cugugcuuccaggauggcagcu

SEQ ID NO: 522652 - RNA, 22 nt, Human
uugcuuccucgaggccagcgug

SEQ ID NO: 522653 - RNA, 22 nt, Human
gggauggacuuggggacuccag

SEQ ID NO: 522654 - RNA, 22 nt, Human
ccagcaggggaauauuuuuagg

SEQ ID NO: 522655 - RNA, 22 nt, Human
cacaagucuguggucuccaaca

SEQ ID NO: 522656 - RNA, 22 nt, Human
ccucuggggugagugggccacu

SEQ ID NO: 522657 - RNA, 23 nt, Human
uuugaaaguaucaacucgccuga

SEQ ID NO: 522658 - RNA, 23 nt, Human
uggugccucagaagcagugggcu

SEQ ID NO: 522659 - RNA, 22 nt, Human
ccaguguuacggcuugaacuau

SEQ ID NO: 522660 - RNA, 18 nt, Human
ucauuuguuuugcaugaa

SEQ ID NO: 522661 - RNA, 22 nt, Human
auauuagggucucuaaauucua

SEQ ID NO: 522662 - RNA, 22 nt, Human
cucagugucuuauuguacacau

SEQ ID NO: 522663 - RNA, 22 nt, Human
uguccuguaggaggcagaacaa

SEQ ID NO: 522664 - RNA, 22 nt, Human
acacuagucucuucuugacuug

SEQ ID NO: 522665 - RNA, 22 nt, Human
ucucugggccuguuuucucauc

SEQ ID NO: 522666 - RNA, 22 nt, Human
cucagagcaaugaacaugcaaa

SEQ ID NO: 522667 - RNA, 22 nt, Human
uccucagugcuagccaacugcc

SEQ ID NO: 522668 - RNA, 22 nt, Human
ggaaggagggcggcaaugauga

SEQ ID NO: 522669 - RNA, 22 nt, Human
cauuacaaaguuauaaacaguu

SEQ ID NO: 522670 - RNA, 20 nt, Human
ccucaggaugagggugagca

SEQ ID NO: 522671 - RNA, 22 nt, Human
uauguacauacaugugcauacg

SEQ ID NO: 522672 - RNA, 22 nt, Human
cugagcugggaguggauagugg

SEQ ID NO: 522673 - RNA, 22 nt, Human
uuaucauugucgcagucuaauu

SEQ ID NO: 522674 - RNA, 22 nt, Human
uagcagcuaugccauuuugaca

SEQ ID NO: 522675 - RNA, 22 nt, Human
acagaugagguguuuggagagc

SEQ ID NO: 522676 - RNA, 22 nt, Human
cuggguuuagggucuccccuug

SEQ ID NO: 522677 - RNA, 22 nt, Human
ucuccccagggguauggguauu

SEQ ID NO: 522678 - RNA, 22 nt, Human
gcagggcuuuuugaaacauggu

SEQ ID NO: 522679 - RNA, 22 nt, Human
uucagugucaauuuuuaaauau

SEQ ID NO: 522680 - RNA, 22 nt, Human
uccaggagaggccugaccaggu

SEQ ID NO: 522681 - RNA, 22 nt, Human
ucagaggaauaaugcugcauuu

SEQ ID NO: 522682 - RNA, 21 nt, Human
uauuucuuugacucucucccu

SEQ ID NO: 522683 - RNA, 22 nt, Human
ggcuuccuuucacuacccucag

SEQ ID NO: 522684 - RNA, 22 nt, Human
aggcucccaagcacugacccca

SEQ ID NO: 522685 - RNA, 22 nt, Human
uucucuagguuuuagaugaaga

SEQ ID NO: 522686 - RNA, 22 nt, Human
cugggggcaauggucagagugu

SEQ ID NO: 522687 - RNA, 22 nt, Human
ucagcuuuuuggauugcccaag

SEQ ID NO: 522688 - RNA, 22 nt, Human
ugauugacuuuagaauagcacu

SEQ ID NO: 522689 - RNA, 22 nt, Human
gcugguccucaagggcacagcc

SEQ ID NO: 522690 - RNA, 20 nt, Human
ugucugaaaaggaagcuauc

SEQ ID NO: 522691 - RNA, 22 nt, Human
guuugaaaaaagcaguauguaa

SEQ ID NO: 522692 - RNA, 22 nt, Human
uuggaaaugauuucuauuauua

SEQ ID NO: 522693 - RNA, 22 nt, Human
ucugcagcuuacuuucacauga

SEQ ID NO: 522694 - RNA, 22 nt, Human
agcugccacagagccuggccag

SEQ ID NO: 522695 - RNA, 22 nt, Human
ccucagggccaucucugucccu

SEQ ID NO: 522696 - RNA, 22 nt, Human
aacuuucagcaaguaauucugg

SEQ ID NO: 522697 - RNA, 22 nt, Human
auuucuucaggucagaaauaga

SEQ ID NO: 522698 - RNA, 22 nt, Human
gaggcagcuuggggcugugggu

SEQ ID NO: 522699 - RNA, 22 nt, Human
gagcagcugcagugcagacccu

SEQ ID NO: 522700 - RNA, 22 nt, Human
ucacuguaccuuccauuucauu

SEQ ID NO: 522701 - RNA, 22 nt, Human
cccagacuccucuggcuggugg

SEQ ID NO: 522702 - RNA, 22 nt, Human
accagagcuggcagaguaucaa

SEQ ID NO: 522703 - RNA, 21 nt, Human
uuucugaaggcaacaucuauc

SEQ ID NO: 522704 - RNA, 22 nt, Human
gaaaucugaaucuucuguuggu

SEQ ID NO: 522705 - RNA, 22 nt, Human
agggaaggaaaagcugucgcuu

SEQ ID NO: 522706 - RNA, 22 nt, Human
aaagagcuaacauugccgagau

SEQ ID NO: 522707 - RNA, 22 nt, Human
auugaaaggcaaaguaggaagc

SEQ ID NO: 522708 - RNA, 22 nt, Human
gugcuuccucugccaacacucu

SEQ ID NO: 522709 - RNA, 22 nt, Human
ccuuugugagguccuguggggg

SEQ ID NO: 522710 - RNA, 22 nt, Human
ucucccucuuugucugcuuugg

SEQ ID NO: 522711 - RNA, 22 nt, Human
gggucucucaugcaguugcugu

SEQ ID NO: 522712 - RNA, 22 nt, Human
acagagcucccagccaucuccu

SEQ ID NO: 522713 - RNA, 22 nt, Human
gaggcuagagcaggggcucaau

SEQ ID NO: 522714 - RNA, 22 nt, Human
aaugcacauaaauauggucuua

SEQ ID NO: 522715 - RNA, 22 nt, Human
ccaggggaaacagggagcacuc

SEQ ID NO: 522716 - RNA, 22 nt, Human
agugugaccuuauuuggaaaca

SEQ ID NO: 522717 - RNA, 22 nt, Human
ugugugauugcaggagaugugg

SEQ ID NO: 522718 - RNA, 22 nt, Human
gaaggagagaaaggcaauucug

SEQ ID NO: 522719 - RNA, 22 nt, Human
uuuuguuuaaaauccuggaugg

SEQ ID NO: 522720 - RNA, 22 nt, Human
agcagggaauagcggaaagaau

SEQ ID NO: 522721 - RNA, 20 nt, Human
guggccuguccuguuguggg

SEQ ID NO: 522722 - RNA, 22 nt, Human
aaaguuacuaucacaaugaaau

SEQ ID NO: 522723 - RNA, 22 nt, Human
cacugcuuucacaguuuguucc

SEQ ID NO: 522724 - RNA, 22 nt, Human
agaaucaauucacugcugcagc

SEQ ID NO: 522725 - RNA, 22 nt, Human
gauggcagguaguggucucauc

SEQ ID NO: 522726 - RNA, 22 nt, Human
agccucugguccucccucagcu

SEQ ID NO: 522727 - RNA, 20 nt, Human
cucugggcugcacccucgcc

SEQ ID NO: 522728 - RNA, 22 nt, Human
gaccucagugaauggucaugua

SEQ ID NO: 522729 - RNA, 22 nt, Human
ccugaaugccugacauuucacu

SEQ ID NO: 522730 - RNA, 22 nt, Human
agaaacuucagcuauucuuuug

SEQ ID NO: 522731 - RNA, 22 nt, Human
gcugucuucacuuccugguuuc

SEQ ID NO: 522732 - RNA, 22 nt, Human
aggccuggcaugagaccugaga

SEQ ID NO: 522733 - RNA, 22 nt, Human
guuuccuggaaacauuaggaga

SEQ ID NO: 522734 - RNA, 22 nt, Human
aggcuccaaauuaccaagcucu

SEQ ID NO: 522735 - RNA, 19 nt, Human
uccucaggggcucacagac

SEQ ID NO: 522736 - RNA, 22 nt, Human
uguguguggggaggcagcagau

SEQ ID NO: 522737 - RNA, 22 nt, Human
aggccugaaggaagaugagcug

SEQ ID NO: 522738 - RNA, 22 nt, Human
auaguacacauccuacaauguu

SEQ ID NO: 522739 - RNA, 22 nt, Human
uuucaguguguaaauugaaaua

SEQ ID NO: 522740 - RNA, 22 nt, Human
gcugcaggcucugcaggaauug

SEQ ID NO: 522741 - RNA, 19 nt, Human
ugcagaagacacaguggug

SEQ ID NO: 522742 - RNA, 22 nt, Human
ugauuuccaugaagcugaaggc

SEQ ID NO: 522743 - RNA, 22 nt, Human
ucauagaagcacucagcucccu

SEQ ID NO: 522744 - RNA, 22 nt, Human
ccagacccugcucuggggcucu

SEQ ID NO: 522745 - RNA, 22 nt, Human
accuguggaucagauucuugua

SEQ ID NO: 522746 - RNA, 22 nt, Human
auuuuccaaaauaauuguuacu

SEQ ID NO: 522747 - RNA, 22 nt, Human
ugguggcaaaucaggacacuuc

SEQ ID NO: 522748 - RNA, 22 nt, Human
ucucacugggucacagcagagg

SEQ ID NO: 522749 - RNA, 22 nt, Human
ugcugugagguugagaaggaag

SEQ ID NO: 522750 - RNA, 17 nt, Human
ccuuucucuuucaucuc

SEQ ID NO: 522751 - RNA, 22 nt, Human
agguccugugguuuggguaaaa

SEQ ID NO: 522752 - RNA, 22 nt, Human
acagagguuuccauugagguuu

SEQ ID NO: 522753 - RNA, 22 nt, Human
acuguguccucauguggcagaa

SEQ ID NO: 522754 - RNA, 22 nt, Human
ccagcugguuaaaauagagaaa

SEQ ID NO: 522755 - RNA, 22 nt, Human
acagaugaguuaaagcagagug

SEQ ID NO: 522756 - RNA, 22 nt, Human
ggcccaucucuugcucuggguu

SEQ ID NO: 522757 - RNA, 22 nt, Human
ugguccagaugccuuggcuuua

SEQ ID NO: 522758 - RNA, 21 nt, Human
agagagggagaugaaacaucc

SEQ ID NO: 522759 - RNA, 22 nt, Human
ugugaaaggagccauagacagu

SEQ ID NO: 522760 - RNA, 22 nt, Human
uggcagccuggaaucucucagc

SEQ ID NO: 522761 - RNA, 22 nt, Human
agaaguauuuggcuaaaagaca

SEQ ID NO: 522762 - RNA, 22 nt, Human
accccagcccugcuucugggag

SEQ ID NO: 522763 - RNA, 22 nt, Human
auugacaauguauuuguaucug

SEQ ID NO: 522764 - RNA, 22 nt, Human
gcuggcuuuugaagucuagcua

SEQ ID NO: 522765 - RNA, 23 nt, Human
ggagaggggugugggcaucuuua

SEQ ID NO: 522766 - RNA, 22 nt, Human
cucugagauaguuucuaucaau

SEQ ID NO: 522767 - RNA, 22 nt, Human
gaaaguuugccucucucuugag

SEQ ID NO: 522768 - RNA, 22 nt, Human
agcaaggggcagugaaagugug

SEQ ID NO: 522769 - RNA, 23 nt, Human
uggcauagugaggggcacagaga

SEQ ID NO: 522770 - RNA, 22 nt, Human
cuuccuugugguccuucucauu

SEQ ID NO: 522771 - RNA, 21 nt, Human
cugcucugacagugaggccag

SEQ ID NO: 522772 - RNA, 22 nt, Human
gagcucuguguagccugagggu

SEQ ID NO: 522773 - RNA, 22 nt, Human
gagaaacuuggaguuauucugg

SEQ ID NO: 522774 - RNA, 22 nt, Human
ggcaaagcggcccuguggccag

SEQ ID NO: 522775 - RNA, 18 nt, Human
uggcucugccacucaccg

SEQ ID NO: 522776 - RNA, 22 nt, Human
ggaggaaaggcucccucccucu

SEQ ID NO: 522777 - RNA, 22 nt, Human
aagcugcccucauucccagugc

SEQ ID NO: 522778 - RNA, 22 nt, Human
ggagagagaugccgccuugcuc

SEQ ID NO: 522779 - RNA, 22 nt, Human
acaugucaauuuaguacucuua

SEQ ID NO: 522780 - RNA, 22 nt, Human
cugcccugugaggguccuuggg

SEQ ID NO: 522781 - RNA, 19 nt, Human
ugccugucaguagaucuca

SEQ ID NO: 522782 - RNA, 22 nt, Human
uauuuucuggacagucuugcuu

SEQ ID NO: 522783 - RNA, 22 nt, Human
uuuagcuuguuggaacaauuga

SEQ ID NO: 522784 - RNA, 22 nt, Human
agggccuggcuucacuuucuca

SEQ ID NO: 522785 - RNA, 22 nt, Human
uucuuacagcccuauuacuaaa

SEQ ID NO: 522786 - RNA, 22 nt, Human
cugugaggcggguggaguggag

SEQ ID NO: 522787 - RNA, 22 nt, Human
cugggaguguucuaggucacau

SEQ ID NO: 522788 - RNA, 22 nt, Human
cggcuggggcuguccccaugac

SEQ ID NO: 522789 - RNA, 22 nt, Human
gacagcagacagaacuaccugc

SEQ ID NO: 522790 - RNA, 22 nt, Human
uccuucagaaaaccucagucuu

SEQ ID NO: 522791 - RNA, 22 nt, Human
cugcccccaggcugcauggcug

SEQ ID NO: 522792 - RNA, 22 nt, Human
agcaggugaauuccuggaugug

SEQ ID NO: 522793 - RNA, 22 nt, Human
agacagagauacuauguuguca

SEQ ID NO: 522794 - RNA, 22 nt, Human
cagggaugagcagauggagcaa

SEQ ID NO: 522795 - RNA, 22 nt, Human
acaaaguuaacaguuggauagu

SEQ ID NO: 522796 - RNA, 22 nt, Human
ucucccagaggaucccagugga

SEQ ID NO: 522797 - RNA, 22 nt, Human
caggggcaagaaugcugucagc

SEQ ID NO: 522798 - RNA, 18 nt, Human
agucccaucuucagcucu

SEQ ID NO: 522799 - RNA, 23 nt, Human
ugaggaccucucaggggccaggc

SEQ ID NO: 522800 - RNA, 22 nt, Human
gucaaguuaagauaaggucaug

SEQ ID NO: 522801 - RNA, 22 nt, Human
caaguaugagaaagcuauuacc

SEQ ID NO: 522802 - RNA, 22 nt, Human
ugagcagcaggaucuucuggua

SEQ ID NO: 522803 - RNA, 22 nt, Human
accuggagucauuugaggagua

SEQ ID NO: 522804 - RNA, 22 nt, Human
ucucagagaacaguuggugcuu

SEQ ID NO: 522805 - RNA, 22 nt, Human
ucagggcucaccagccucugcc

SEQ ID NO: 522806 - RNA, 23 nt, Human
ccaggccucucagagggugugcc

SEQ ID NO: 522807 - RNA, 22 nt, Human
uuaugcuaguauaguccuuaga

SEQ ID NO: 522808 - RNA, 22 nt, Human
caggcucccugggcaguggcag

SEQ ID NO: 522809 - RNA, 22 nt, Human
guaacauaguuugugcuucauc

SEQ ID NO: 522810 - RNA, 17 nt, Human
ugcaggcuccugucccu

SEQ ID NO: 522811 - RNA, 22 nt, Human
agagucugauauuuguaccaga

SEQ ID NO: 522812 - RNA, 22 nt, Human
uaugagaacgggggcguguggg

SEQ ID NO: 522813 - RNA, 22 nt, Human
cuccucuguauugauugggacu

SEQ ID NO: 522814 - RNA, 22 nt, Human
ugcagggccagacuggguugga

SEQ ID NO: 522815 - RNA, 22 nt, Human
gacagaggagaagaugcugugg

SEQ ID NO: 522816 - RNA, 22 nt, Human
aggcccagagagccaguuagug

SEQ ID NO: 522817 - RNA, 22 nt, Human
guggcugcagcggcuguggaga

SEQ ID NO: 522818 - RNA, 22 nt, Human
aaaggucaagcuggacucaggu

SEQ ID NO: 522819 - RNA, 22 nt, Human
ggaggagcccacucaaagggga

SEQ ID NO: 522820 - RNA, 22 nt, Human
ccaguguuagagacugauacag

SEQ ID NO: 522821 - RNA, 22 nt, Human
gugaauggggcaggaaggaugg

SEQ ID NO: 522822 - RNA, 23 nt, Human
ccacagagcugccaauuccugug

SEQ ID NO: 522823 - RNA, 22 nt, Human
cgcuccuugagcgugucggccu

SEQ ID NO: 522824 - RNA, 22 nt, Human
gugcucuggcuggucucccggu

SEQ ID NO: 522825 - RNA, 22 nt, Human
cuguucacagaauccuccccug

SEQ ID NO: 522826 - RNA, 22 nt, Human
cccaggaggcagaaguugcagu

SEQ ID NO: 522827 - RNA, 22 nt, Human
gaaggagagggucaaggauaau

SEQ ID NO: 522828 - RNA, 22 nt, Human
uggcccugggcagaggcaacau

SEQ ID NO: 522829 - RNA, 22 nt, Human
uguggcuuuugcuagcuuugca

SEQ ID NO: 522830 - RNA, 22 nt, Human
auauuucucucagacauggaag

SEQ ID NO: 522831 - RNA, 20 nt, Human
agauggugaaggccagggag

SEQ ID NO: 522832 - RNA, 22 nt, Human
agaagccacaggaaagcagcuu

SEQ ID NO: 522833 - RNA, 21 nt, Human
ucccauuguuccccuccagug

SEQ ID NO: 522834 - RNA, 22 nt, Human
uguuugaauuuugcuaacgugu

SEQ ID NO: 522835 - RNA, 22 nt, Human
uugagucaguaauuccauuucu

SEQ ID NO: 522836 - RNA, 22 nt, Human
cagccaggacagggaaacuagu

SEQ ID NO: 522837 - RNA, 22 nt, Human
cugggaggugcagcaaaaauca

SEQ ID NO: 522838 - RNA, 22 nt, Human
cuguccuuacugcuucuggcuu

SEQ ID NO: 522839 - RNA, 21 nt, Human
guucuuaguuauauucucaau

SEQ ID NO: 522840 - RNA, 21 nt, Human
acagacagggccagugucccc

SEQ ID NO: 522841 - RNA, 22 nt, Human
auuauaaauauuuucuaggggu

SEQ ID NO: 522842 - RNA, 22 nt, Human
agguuucuccuuuaaagcaugg

SEQ ID NO: 522843 - RNA, 22 nt, Human
cugccgaguacagccauagaaa

SEQ ID NO: 522844 - RNA, 22 nt, Human
gccaccugugugggccuuugug

SEQ ID NO: 522845 - RNA, 22 nt, Human
acuuccuggcguagcugacauu

SEQ ID NO: 522846 - RNA, 22 nt, Human
aaucacaugugcucaauuuuaa

SEQ ID NO: 522847 - RNA, 22 nt, Human
uguuuaaucuauaaaauggaga

SEQ ID NO: 522848 - RNA, 22 nt, Human
ccauucugagucuuaugucuuu

SEQ ID NO: 522849 - RNA, 22 nt, Human
uggccccuggcacacggaggau

SEQ ID NO: 522850 - RNA, 19 nt, Human
ggcauccagaacuaccagu

SEQ ID NO: 522851 - RNA, 22 nt, Human
agaaugcaguuugaaauaaggu

SEQ ID NO: 522852 - RNA, 22 nt, Human
aauguacaaaagucagccaacu

SEQ ID NO: 522853 - RNA, 22 nt, Human
uuuugccuaagaaucucucuga

SEQ ID NO: 522854 - RNA, 22 nt, Human
gaggacagugugaucugccagc

SEQ ID NO: 522855 - RNA, 22 nt, Human
agauaauuugaguaaauuaauu

SEQ ID NO: 522856 - RNA, 22 nt, Human
uuugcauucuagaaaaauuucu

SEQ ID NO: 522857 - RNA, 22 nt, Human
uacauugacuuggauuguuaga

SEQ ID NO: 522858 - RNA, 22 nt, Human
aauggccagcugggagaguuga

SEQ ID NO: 522859 - RNA, 22 nt, Human
ggagagcaggguccugagauac

SEQ ID NO: 522860 - RNA, 23 nt, Human
aaaugacuaaauguucuuauaga

SEQ ID NO: 522861 - RNA, 22 nt, Human
ugcacuuuaaaaaauggugaug

SEQ ID NO: 522862 - RNA, 21 nt, Human
auccuugaucagaagagugcu

SEQ ID NO: 522863 - RNA, 22 nt, Human
agaauuuaggaugcaugugaau

SEQ ID NO: 522864 - RNA, 22 nt, Human
uggccucucuaccaggcagccu

SEQ ID NO: 522865 - RNA, 22 nt, Human
ucaagaaagggcuucaccagga

SEQ ID NO: 522866 - RNA, 20 nt, Human
ucagggcaugggacagcccc

SEQ ID NO: 522867 - RNA, 20 nt, Human
augucugaaguaauccauuu

SEQ ID NO: 522868 - RNA, 22 nt, Human
caggcuggucccagagcauugc

SEQ ID NO: 522869 - RNA, 22 nt, Human
agcuccugugugaagccucccu

SEQ ID NO: 522870 - RNA, 22 nt, Human
caaagugcugggauuagugcug

SEQ ID NO: 522871 - RNA, 22 nt, Human
augucuaaaagauaaaguuuaa

SEQ ID NO: 522872 - RNA, 22 nt, Human
acucugaaugugcauguaaauc

SEQ ID NO: 522873 - RNA, 22 nt, Human
acccuucauagaggagaagcug

SEQ ID NO: 522874 - RNA, 22 nt, Human
guguccugccacccugggcuuu

SEQ ID NO: 522875 - RNA, 22 nt, Human
uauuucuguaacucagggucug

SEQ ID NO: 522876 - RNA, 22 nt, Human
cucaaggaaagucuggagaaga

SEQ ID NO: 522877 - RNA, 22 nt, Human
ccugucaguugcugucagggau

SEQ ID NO: 522878 - RNA, 22 nt, Human
uccuucagcucucuauuuagau

SEQ ID NO: 522879 - RNA, 21 nt, Human
gcucccugcucagcuccuggg

SEQ ID NO: 522880 - RNA, 22 nt, Human
uagauuuccucuuccucauucc

SEQ ID NO: 522881 - RNA, 22 nt, Human
ggcuccuguggcaagacagcuu

SEQ ID NO: 522882 - RNA, 22 nt, Human
agcuggcauacuuugcuaggaa

SEQ ID NO: 522883 - RNA, 22 nt, Human
aaaacauuuuacugccaucuca

SEQ ID NO: 522884 - RNA, 22 nt, Human
aauuuguguuaguccacguuca

SEQ ID NO: 522885 - RNA, 22 nt, Human
cuggcucccuggacauggggcc

SEQ ID NO: 522886 - RNA, 20 nt, Human
gcaggcuccgggcuugggag

SEQ ID NO: 522887 - RNA, 22 nt, Human
aagcagccuggcaugaugcuuu

SEQ ID NO: 522888 - RNA, 22 nt, Human
cuguguguccucggacgaguuu

SEQ ID NO: 522889 - RNA, 22 nt, Human
aaauaauguuaggccuuugcuc

SEQ ID NO: 522890 - RNA, 22 nt, Human
aggggcuguggaaaccaacucu

SEQ ID NO: 522891 - RNA, 22 nt, Human
uccaauuuuacgucuguauaaa

SEQ ID NO: 522892 - RNA, 22 nt, Human
cacauugcagcuucuuuuggcu

SEQ ID NO: 522893 - RNA, 20 nt, Human
agugccagggcaggugagag

SEQ ID NO: 522894 - RNA, 22 nt, Human
aggaaacugauguuuuuuacaa

SEQ ID NO: 522895 - RNA, 22 nt, Human
ccagaggugcugggagaggucu

SEQ ID NO: 522896 - RNA, 22 nt, Human
agcagacagguaggaggauaaa

SEQ ID NO: 522897 - RNA, 22 nt, Human
aacagcuuugcuucuggagaca

SEQ ID NO: 522898 - RNA, 22 nt, Human
gcagccaggaaagcuggacccu

SEQ ID NO: 522899 - RNA, 22 nt, Human
ccaaaguccuuucuccaccugc

SEQ ID NO: 522900 - RNA, 22 nt, Human
aggacuccauguguccuggaga

SEQ ID NO: 522901 - RNA, 22 nt, Human
aaggcacucagccuugggacag

SEQ ID NO: 522902 - RNA, 22 nt, Human
ucuguucauguugggcuuuucc

SEQ ID NO: 522903 - RNA, 22 nt, Human
cugagaagcaaagaacugcacu

SEQ ID NO: 522904 - RNA, 22 nt, Human
aggcugcagugcagguaggauu

SEQ ID NO: 522905 - RNA, 22 nt, Human
uaaagaugcuauagugaaggag

SEQ ID NO: 522906 - RNA, 21 nt, Human
aguugcauaggccagccaucc

SEQ ID NO: 522907 - RNA, 21 nt, Human
uugaagcaaggguggcucuga

SEQ ID NO: 522908 - RNA, 17 nt, Human
guaaggcuugcagaugc

SEQ ID NO: 522909 - RNA, 22 nt, Human
cucucuguuaugcuuucaugaa

SEQ ID NO: 522910 - RNA, 22 nt, Human
aagcugccaccagcccagggca

SEQ ID NO: 522911 - RNA, 22 nt, Human
ucagcaggcagugggucacaau

SEQ ID NO: 522912 - RNA, 22 nt, Human
cuuaaagaugucaaggcuguuu

SEQ ID NO: 522913 - RNA, 22 nt, Human
ucauuucuguugugcaucacug

SEQ ID NO: 522914 - RNA, 22 nt, Human
uccaaacacccuccaugcugca

SEQ ID NO: 522915 - RNA, 22 nt, Human
uucugggcucacagagcagcag

SEQ ID NO: 522916 - RNA, 22 nt, Human
ccaguguugaacaguauuugga

SEQ ID NO: 522917 - RNA, 22 nt, Human
cucaaauauguggucagaaagc

SEQ ID NO: 522918 - RNA, 22 nt, Human
ugcacaggccuugaagggagag

SEQ ID NO: 522919 - RNA, 22 nt, Human
cuucuggguaauucuucuucau

SEQ ID NO: 522920 - RNA, 22 nt, Human
ccaggagcaaagaucacuggga

SEQ ID NO: 522921 - RNA, 22 nt, Human
ccagcccuccuccaucagagga

SEQ ID NO: 522922 - RNA, 22 nt, Human
uugaagcaaauucugugcagua

SEQ ID NO: 522923 - RNA, 22 nt, Human
ucccaggcaaaggcagcucauu

SEQ ID NO: 522924 - RNA, 22 nt, Human
uguaauauuguagugacaguac

SEQ ID NO: 522925 - RNA, 22 nt, Human
uguacaaggccaucuacaugcu

SEQ ID NO: 522926 - RNA, 22 nt, Human
agcaggaguguccccuggcugu

SEQ ID NO: 522927 - RNA, 22 nt, Human
ggaagggccucgggcgugggac

SEQ ID NO: 522928 - RNA, 22 nt, Human
ggauguucugggguucucuugu

SEQ ID NO: 522929 - RNA, 22 nt, Human
cugcagaggguuugagcauccu

SEQ ID NO: 522930 - RNA, 21 nt, Human
agcacagcauauccaauguca

SEQ ID NO: 522931 - RNA, 22 nt, Human
ccugugugauuggaagcugaga

SEQ ID NO: 522932 - RNA, 22 nt, Human
uaaauuauggcuggcagagcag

SEQ ID NO: 522933 - RNA, 23 nt, Human
ugcagccacucaggagcucagug

SEQ ID NO: 522934 - RNA, 22 nt, Human
uauguacacauacacuuguaau

SEQ ID NO: 522935 - RNA, 22 nt, Human
accaggcacucuuguggcagug

SEQ ID NO: 522936 - RNA, 22 nt, Human
ucccagacaaucauuggccacc

SEQ ID NO: 522937 - RNA, 22 nt, Human
caaaggcaggugcugaauauuc

SEQ ID NO: 522938 - RNA, 22 nt, Human
cagagcuuccugcugggcuucu

SEQ ID NO: 522939 - RNA, 22 nt, Human
ucucagugacacucuucauaca

SEQ ID NO: 522940 - RNA, 20 nt, Human
aagagcugacucacaguggu

SEQ ID NO: 522941 - RNA, 22 nt, Human
cauuaucucuucuauaugcuag

SEQ ID NO: 522942 - RNA, 22 nt, Human
accuguuuguguccauuaguga

SEQ ID NO: 522943 - RNA, 22 nt, Human
cuccuuccugccccagugauaa

SEQ ID NO: 522944 - RNA, 21 nt, Human
ugcagcugacacccuuuggga

SEQ ID NO: 522945 - RNA, 22 nt, Human
ucggggucuuugacacgcucug

SEQ ID NO: 522946 - RNA, 22 nt, Human
uggaaagacauucagccgcugg

SEQ ID NO: 522947 - RNA, 22 nt, Human
cugaggcagaaaaagcaagggu

SEQ ID NO: 522948 - RNA, 22 nt, Human
gagcuuuaggagaaggagguca

SEQ ID NO: 522949 - RNA, 22 nt, Human
ucagaacauugacauucuuauu

SEQ ID NO: 522950 - RNA, 22 nt, Human
agagaagagucuugucaaauua

SEQ ID NO: 522951 - RNA, 22 nt, Human
auggcagaccugggcuggagaa

SEQ ID NO: 522952 - RNA, 22 nt, Human
cauggccagggagagagaaugu

SEQ ID NO: 522953 - RNA, 22 nt, Human
acaguguucuuggcgcugagug

SEQ ID NO: 522954 - RNA, 20 nt, Human
uccagcauauaaacuccucu

SEQ ID NO: 522955 - RNA, 21 nt, Human
aaaggccauaaucacggagca

SEQ ID NO: 522956 - RNA, 22 nt, Human
gugucugaguuuggaaagucca

SEQ ID NO: 522957 - RNA, 22 nt, Human
cagcccugaaacaaccuccucu

SEQ ID NO: 522958 - RNA, 22 nt, Human
ucugagcuuuuauuaucaaccu

SEQ ID NO: 522959 - RNA, 22 nt, Human
uguaaaagacauuucuaagcaa

SEQ ID NO: 522960 - RNA, 22 nt, Human
gcagggaccugccacugcuguc

SEQ ID NO: 522961 - RNA, 23 nt, Human
ucacaggggccagcgcucugugg

SEQ ID NO: 522962 - RNA, 22 nt, Human
acagcuuugggcaaugcuauga

SEQ ID NO: 522963 - RNA, 22 nt, Human
aggucacacuuggaucauagaa

SEQ ID NO: 522964 - RNA, 22 nt, Human
uccauggggcccaggaugagag

SEQ ID NO: 522965 - RNA, 22 nt, Human
ucaaggaggugcuuggcuucac

SEQ ID NO: 522966 - RNA, 22 nt, Human
acagagagcugugauugaguua

SEQ ID NO: 522967 - RNA, 22 nt, Human
acugggaggcaaagagcaagga

SEQ ID NO: 522968 - RNA, 22 nt, Human
auuuuugcccugcaguacauaa

SEQ ID NO: 522969 - RNA, 22 nt, Human
ggcacucagagauucaggcugu

SEQ ID NO: 522970 - RNA, 22 nt, Human
cagguccaguaaaaagaguccu

SEQ ID NO: 522971 - RNA, 22 nt, Human
ucucccaggugggugccuggag

SEQ ID NO: 522972 - RNA, 22 nt, Human
uccacagauuaaaaacauacuu

SEQ ID NO: 522973 - RNA, 22 nt, Human
gcuaguccacagccauccaggc

SEQ ID NO: 522974 - RNA, 22 nt, Human
aguggcaguagaugagcugguu

SEQ ID NO: 522975 - RNA, 22 nt, Human
agcuccaggaucugaaaguucg

SEQ ID NO: 522976 - RNA, 22 nt, Human
ccuuccuuucagggcuaugccu

SEQ ID NO: 522977 - RNA, 22 nt, Human
aaaggucuacaucacugaaaga

SEQ ID NO: 522978 - RNA, 22 nt, Human
aaucuucauuuugacaagauuc

SEQ ID NO: 522979 - RNA, 22 nt, Human
uucuacacucacccagcuguaa

SEQ ID NO: 522980 - RNA, 22 nt, Human
uggcagaguuauggguauuuau

SEQ ID NO: 522981 - RNA, 18 nt, Human
uccuccuuuggccuuuuc

SEQ ID NO: 522982 - RNA, 20 nt, Human
aguagcagugugacauugac

SEQ ID NO: 522983 - RNA, 22 nt, Human
aauuucaaugcacucaugguug

SEQ ID NO: 522984 - RNA, 20 nt, Human
acaugaacagggcuacagca

SEQ ID NO: 522985 - RNA, 22 nt, Human
aaagucugaaagauaagaguga

SEQ ID NO: 522986 - RNA, 20 nt, Human
agcugguuaucuuaauucuu

SEQ ID NO: 522987 - RNA, 22 nt, Human
auccagggauaaaaguaagguu

SEQ ID NO: 522988 - RNA, 22 nt, Human
ggggggugcugaucaguggagc

SEQ ID NO: 522989 - RNA, 22 nt, Human
auuuagaaguuggagggcaaga

SEQ ID NO: 522990 - RNA, 22 nt, Human
ggcuccagggaguggagagaag

SEQ ID NO: 522991 - RNA, 19 nt, Human
uaccauguugacuuuccug

SEQ ID NO: 522992 - RNA, 22 nt, Human
uccacagugguugaacuaguuu

SEQ ID NO: 522993 - RNA, 22 nt, Human
auccuugaaugacucugcccuc

SEQ ID NO: 522994 - RNA, 22 nt, Human
auuugaaugcagguagcugagu

SEQ ID NO: 522995 - RNA, 22 nt, Human
ugguuugcccacucgagugauu

SEQ ID NO: 522996 - RNA, 18 nt, Human
gcugccugcauuccucac

SEQ ID NO: 522997 - RNA, 22 nt, Human
uucuuucucaacaugaauguuu

SEQ ID NO: 522998 - RNA, 22 nt, Human
cuggccuggcaggggaccucua

SEQ ID NO: 522999 - RNA, 20 nt, Human
uccaagcccuccuuccauuc

SEQ ID NO: 523000 - RNA, 20 nt, Human
ggcccagugaaccaggacgg

SEQ ID NO: 523001 - RNA, 22 nt, Human
gaaucacgguauucugcacggg

SEQ ID NO: 523002 - RNA, 22 nt, Human
ugccuggcccugacagcccugg

SEQ ID NO: 523003 - RNA, 22 nt, Human
gcugagaggcacuaucuccgga

SEQ ID NO: 523004 - RNA, 22 nt, Human
gaacagcugcuagagaucugug

SEQ ID NO: 523005 - RNA, 22 nt, Human
agaagauuuagguugacgcuau

SEQ ID NO: 523006 - RNA, 20 nt, Human
cugggaggucuuccaaauca

SEQ ID NO: 523007 - RNA, 22 nt, Human
caaggaaguuuuaggagaggaa

SEQ ID NO: 523008 - RNA, 22 nt, Human
aggcagguuacaaaaacuuuau

SEQ ID NO: 523009 - RNA, 22 nt, Human
cagugagggaagaucucagcac

SEQ ID NO: 523010 - RNA, 22 nt, Human
uucucugggcuuuucggauccg

SEQ ID NO: 523011 - RNA, 22 nt, Human
auucugagaggcacaaugugga

SEQ ID NO: 523012 - RNA, 23 nt, Human
guggagccacaucacaggcuccu

SEQ ID NO: 523013 - RNA, 22 nt, Human
gaagagcugcaguuuccugggc

SEQ ID NO: 523014 - RNA, 22 nt, Human
agcccaaggcuucccugcuggc

SEQ ID NO: 523015 - RNA, 22 nt, Human
acuguaaccaguguggugagag

SEQ ID NO: 523016 - RNA, 22 nt, Human
augagugugaaguuagcucagu

SEQ ID NO: 523017 - RNA, 23 nt, Human
ugggccacuauagaaaucucuca

SEQ ID NO: 523018 - RNA, 22 nt, Human
acaugaaaagacuaucugauua

SEQ ID NO: 523019 - RNA, 22 nt, Human
acagaaauaacuuuuuauguuu

SEQ ID NO: 523020 - RNA, 22 nt, Human
uuuacaguuccaugugauaggc

SEQ ID NO: 523021 - RNA, 22 nt, Human
ggaaagaccugagauaggaaua

SEQ ID NO: 523022 - RNA, 22 nt, Human
cuggcugcaggaugaggcugcc

SEQ ID NO: 523023 - RNA, 22 nt, Human
uuauuuauucauucugucuguc

SEQ ID NO: 523024 - RNA, 22 nt, Human
ccuggcugccgagugugcagcg

SEQ ID NO: 523025 - RNA, 22 nt, Human
ugggguggauagaaagugaugu

SEQ ID NO: 523026 - RNA, 22 nt, Human
uuucuagaggcuccaggggagu

SEQ ID NO: 523027 - RNA, 22 nt, Human
auugcugaaaguauuuuaugac

SEQ ID NO: 523028 - RNA, 22 nt, Human
ucaaggcaaaguaaauauucaa

SEQ ID NO: 523029 - RNA, 19 nt, Human
cugcucaggucagucuguc

SEQ ID NO: 523030 - RNA, 22 nt, Human
ccugucagcugauggcuaugua

SEQ ID NO: 523031 - RNA, 22 nt, Human
ugcagaagaaaacagcugugug

SEQ ID NO: 523032 - RNA, 22 nt, Human
aaguagacagucaucuacuuug

SEQ ID NO: 523033 - RNA, 22 nt, Human
uuguguuaaggugcaucuagug

SEQ ID NO: 523034 - RNA, 18 nt, Human
ugucauugccagggaagc

SEQ ID NO: 523035 - RNA, 22 nt, Human
ugggagcaagcuggugcuggag

SEQ ID NO: 523036 - RNA, 22 nt, Human
uuguugacgacuugacuuucuc

SEQ ID NO: 523037 - RNA, 22 nt, Human
cuauuagguaugcagccuauuu

SEQ ID NO: 523038 - RNA, 22 nt, Human
guguacaguuagccaccaaauu

SEQ ID NO: 523039 - RNA, 22 nt, Human
augcagagacagauguggcaug

SEQ ID NO: 523040 - RNA, 22 nt, Human
gccacauagaggaggauauuaa

SEQ ID NO: 523041 - RNA, 22 nt, Human
uucucuggcgcgcugugcuaug

SEQ ID NO: 523042 - RNA, 22 nt, Human
agccaugggagacugugggaga

SEQ ID NO: 523043 - RNA, 22 nt, Human
aucuggaagccagauacucagu

SEQ ID NO: 523044 - RNA, 17 nt, Human
gcccugccugcugcccu

SEQ ID NO: 523045 - RNA, 22 nt, Human
caaggccagagccagcgauaag

SEQ ID NO: 523046 - RNA, 22 nt, Human
ugggcagaggcucugaagucca

SEQ ID NO: 523047 - RNA, 22 nt, Human
augggcugagaaucaagaauau

SEQ ID NO: 523048 - RNA, 22 nt, Human
cugggcuuagcagcuccugguc

SEQ ID NO: 523049 - RNA, 22 nt, Human
gacagacaugggacuucauacu

SEQ ID NO: 523050 - RNA, 22 nt, Human
gcagcugaaagggaucucuaca

SEQ ID NO: 523051 - RNA, 20 nt, Human
acuccagguggcaugaggac

SEQ ID NO: 523052 - RNA, 22 nt, Human
aggccagacagcuagaaacagg

SEQ ID NO: 523053 - RNA, 22 nt, Human
ugccugcaagaguuggggcuac

SEQ ID NO: 523054 - RNA, 18 nt, Human
ucucaaaaauaauggcuu

SEQ ID NO: 523055 - RNA, 22 nt, Human
agguccugaagauuuuacuaga

SEQ ID NO: 523056 - RNA, 22 nt, Human
aucaguuuggaacauucaggcc

SEQ ID NO: 523057 - RNA, 22 nt, Human
ugggagaaagaacccugaguga

SEQ ID NO: 523058 - RNA, 22 nt, Human
ggcucacacaugacugggcucu

SEQ ID NO: 523059 - RNA, 22 nt, Human
agugguaacuaaguccugcuua

SEQ ID NO: 523060 - RNA, 22 nt, Human
ugcugccuggagccuuuuguuu

SEQ ID NO: 523061 - RNA, 22 nt, Human
uacaagaugacaggugcaugau

SEQ ID NO: 523062 - RNA, 22 nt, Human
uguuccuucacagcaguggaca

SEQ ID NO: 523063 - RNA, 22 nt, Human
uucuaacucuguuauguguuuc

SEQ ID NO: 523064 - RNA, 22 nt, Human
agagaauuacagaagaauguca

SEQ ID NO: 523065 - RNA, 22 nt, Human
caggcaaggaggcacugaggga

SEQ ID NO: 523066 - RNA, 22 nt, Human
gugcagggcuggcaccggaggc

SEQ ID NO: 523067 - RNA, 22 nt, Human
ggggcugaaccuggaggugguc

SEQ ID NO: 523068 - RNA, 18 nt, Human
cugaaggauccaggugua

SEQ ID NO: 523069 - RNA, 22 nt, Human
gcccggcagucacacacccagg

SEQ ID NO: 523070 - RNA, 22 nt, Human
aaugcaaauucuagggcccuau

SEQ ID NO: 523071 - RNA, 22 nt, Human
cugcucucuguuccccuggauc

SEQ ID NO: 523072 - RNA, 22 nt, Human
aaucaagaaaaugaggauucuu

SEQ ID NO: 523073 - RNA, 23 nt, Human
cgcccagccucagugaccugggc

SEQ ID NO: 523074 - RNA, 22 nt, Human
gccugugacucgucuugggcca

SEQ ID NO: 523075 - RNA, 23 nt, Human
aaggcauuggcuucucucauuuc

SEQ ID NO: 523076 - RNA, 22 nt, Human
aggagggagaugcccauccugg

SEQ ID NO: 523077 - RNA, 22 nt, Human
ugaagauccuaucugcaaauau

SEQ ID NO: 523078 - RNA, 22 nt, Human
acaguagaguaaaugguuagau

SEQ ID NO: 523079 - RNA, 22 nt, Human
ucuggagcuuguuucagauggu

SEQ ID NO: 523080 - RNA, 22 nt, Human
gaguuauucuagguccuuugua

SEQ ID NO: 523081 - RNA, 22 nt, Human
auacauacguacauacguaugu

SEQ ID NO: 523082 - RNA, 22 nt, Human
agcuucagcuugcagcugugau

SEQ ID NO: 523083 - RNA, 22 nt, Human
augcccuggggcuaccucugag

SEQ ID NO: 523084 - RNA, 22 nt, Human
uggcagaaagaaccaugugcaa

SEQ ID NO: 523085 - RNA, 22 nt, Human
accccagcucugagccacacca

SEQ ID NO: 523086 - RNA, 22 nt, Human
ugguuaaaaugcagauucagua

SEQ ID NO: 523087 - RNA, 22 nt, Human
cccagguagugagaaauggagg

SEQ ID NO: 523088 - RNA, 21 nt, Human
ggccucugucauccugggaag

SEQ ID NO: 523089 - RNA, 22 nt, Human
uccacauucucuguuacagaua

SEQ ID NO: 523090 - RNA, 22 nt, Human
ucuggaguagggucugggaauu

SEQ ID NO: 523091 - RNA, 22 nt, Human
ugaggggagaagcagcagccug

SEQ ID NO: 523092 - RNA, 16 nt, Human
agcagccagcacugga

SEQ ID NO: 523093 - RNA, 22 nt, Human
agagucugugcuuucaucagga

SEQ ID NO: 523094 - RNA, 22 nt, Human
accacugcccauggugaaaacu

SEQ ID NO: 523095 - RNA, 22 nt, Human
gguccaggggguagauauguga

SEQ ID NO: 523096 - RNA, 22 nt, Human
ccugggucuguauugguaggua

SEQ ID NO: 523097 - RNA, 22 nt, Human
acaggugguaaaauggacuguc

SEQ ID NO: 523098 - RNA, 22 nt, Human
ucagcagauggguuguguuggc

SEQ ID NO: 523099 - RNA, 22 nt, Human
aaccagagugacacucuacaga

SEQ ID NO: 523100 - RNA, 22 nt, Human
agaauucuccuucagggcagga

SEQ ID NO: 523101 - RNA, 22 nt, Human
uuggcccuuuaugggaugggca

SEQ ID NO: 523102 - RNA, 22 nt, Human
auuuaguuuaggaaaaguaggu

SEQ ID NO: 523103 - RNA, 22 nt, Human
ugccauuucuuucaauauucuu

SEQ ID NO: 523104 - RNA, 22 nt, Human
cggagccugcuuguugcagcug

SEQ ID NO: 523105 - RNA, 22 nt, Human
ucagcacuggcgcugggcaggu

SEQ ID NO: 523106 - RNA, 22 nt, Human
acaguaccugcucucaagcaaa

SEQ ID NO: 523107 - RNA, 22 nt, Human
ccagugggagggagcuaggcca

SEQ ID NO: 523108 - RNA, 22 nt, Human
auauggaaguuaccugacuuca

SEQ ID NO: 523109 - RNA, 22 nt, Human
caauucaaaugcauaguucaca

SEQ ID NO: 523110 - RNA, 22 nt, Human
ugauuuccacgugcacccaggu

SEQ ID NO: 523111 - RNA, 22 nt, Human
uaaggccaauuaacaaccaggg

SEQ ID NO: 523112 - RNA, 22 nt, Human
aucacaggugguaggaaaagaa

SEQ ID NO: 523113 - RNA, 22 nt, Human
gugcccugaggucuucacuuug

SEQ ID NO: 523114 - RNA, 22 nt, Human
uuuauuauccaguguugucaug

SEQ ID NO: 523115 - RNA, 22 nt, Human
aaaucaugugcagagaucagga

SEQ ID NO: 523116 - RNA, 22 nt, Human
uucuucaaauagcagggaguca

SEQ ID NO: 523117 - RNA, 22 nt, Human
gagccagcgccuugccucuggg

SEQ ID NO: 523118 - RNA, 22 nt, Human
ucaggcugauaggaggaacuga

SEQ ID NO: 523119 - RNA, 22 nt, Human
ugguuacccagucgcuggaguu

SEQ ID NO: 523120 - RNA, 22 nt, Human
ccagcuggucugugcucauguu

SEQ ID NO: 523121 - RNA, 22 nt, Human
gcagcauuuguggaaugggccc

SEQ ID NO: 523122 - RNA, 22 nt, Human
aucugucuauguggcuauguau

SEQ ID NO: 523123 - RNA, 22 nt, Human
cccagccuuugcuuccugguuc

SEQ ID NO: 523124 - RNA, 22 nt, Human
agggacuggcucucugagcagg

SEQ ID NO: 523125 - RNA, 22 nt, Human
cccugaggggaguggugaggug

SEQ ID NO: 523126 - RNA, 19 nt, Human
gucuucugaauguggcugc

SEQ ID NO: 523127 - RNA, 22 nt, Human
cucagcacaucuuuacauuucc

SEQ ID NO: 523128 - RNA, 22 nt, Human
augaaguucucaauaaucaugu

SEQ ID NO: 523129 - RNA, 22 nt, Human
uuuaagacuuagauuuauuggg

SEQ ID NO: 523130 - RNA, 22 nt, Human
uugaaaggugcugugugcugau

SEQ ID NO: 523131 - RNA, 22 nt, Human
cagccuguagaauacaguaaau

SEQ ID NO: 523132 - RNA, 22 nt, Human
ucaguuuucucaucugugaaau

SEQ ID NO: 523133 - RNA, 22 nt, Human
agcuuuauauguuguuucucca

SEQ ID NO: 523134 - RNA, 19 nt, Human
gcagaugaugaggcugguc

SEQ ID NO: 523135 - RNA, 22 nt, Human
uccacagggccuuucuggugug

SEQ ID NO: 523136 - RNA, 22 nt, Human
gagggaccuuuacacagacauu

SEQ ID NO: 523137 - RNA, 22 nt, Human
augauugaaaaugacauugcca

SEQ ID NO: 523138 - RNA, 21 nt, Human
gggugggaggacacagcaggc

SEQ ID NO: 523139 - RNA, 22 nt, Human
aguuacuugagacguuuaugaa

SEQ ID NO: 523140 - RNA, 23 nt, Human
uccaccccagcugaggcuuagcc

SEQ ID NO: 523141 - RNA, 22 nt, Human
gagagaggccuccauguacuga

SEQ ID NO: 523142 - RNA, 22 nt, Human
cagaaauucccauuucagauuc

SEQ ID NO: 523143 - RNA, 22 nt, Human
agucuugguccaggcucauuuc

SEQ ID NO: 523144 - RNA, 22 nt, Human
cagagcugguguuacaagucca

SEQ ID NO: 523145 - RNA, 22 nt, Human
caguagcacucugucagugaag

SEQ ID NO: 523146 - RNA, 22 nt, Human
ggucagugacuuuuuucugugg

SEQ ID NO: 523147 - RNA, 22 nt, Human
gucacuguuuccuauuauauuu

SEQ ID NO: 523148 - RNA, 22 nt, Human
ggcucugggucuguggggagcg

SEQ ID NO: 523149 - RNA, 22 nt, Human
ugucaccaugccagcuucugcc

SEQ ID NO: 523150 - RNA, 22 nt, Human
agcuucagugucaggcccgugg

SEQ ID NO: 523151 - RNA, 19 nt, Human
agccuggagggcuggucac

SEQ ID NO: 523152 - RNA, 22 nt, Human
cccugcagcauucucuaacugg

SEQ ID NO: 523153 - RNA, 20 nt, Human
gcucugaccauaucaagaca

SEQ ID NO: 523154 - RNA, 22 nt, Human
guagaauauaugguuaguauug

SEQ ID NO: 523155 - RNA, 22 nt, Human
ccucugaggucauggacuuggc

SEQ ID NO: 523156 - RNA, 22 nt, Human
uagggcagccacccaggcugcu

SEQ ID NO: 523157 - RNA, 22 nt, Human
ugaaacaaauuuggaaaaucua

SEQ ID NO: 523158 - RNA, 23 nt, Human
aaacuugcuauggcugaaaucau

SEQ ID NO: 523159 - RNA, 22 nt, Human
ucaggccacggcucacugagac

SEQ ID NO: 523160 - RNA, 22 nt, Human
acaagauuuuaugacucuuuuu

SEQ ID NO: 523161 - RNA, 22 nt, Human
gcugcucuuuucagagaugaga

SEQ ID NO: 523162 - RNA, 22 nt, Human
caaaugcuaugauuuugaguuu

SEQ ID NO: 523163 - RNA, 23 nt, Human
acagaugaaaguguggcucagag

SEQ ID NO: 523164 - RNA, 22 nt, Human
ugagggcugcuuccagagcuag

SEQ ID NO: 523165 - RNA, 22 nt, Human
ggaaccaggaguuacacgaguu

SEQ ID NO: 523166 - RNA, 19 nt, Human
ccucugccagcccgccucu

SEQ ID NO: 523167 - RNA, 22 nt, Human
cagagcucuauguucauggagg

SEQ ID NO: 523168 - RNA, 22 nt, Human
ugggcagacuaaggucaaagcu

SEQ ID NO: 523169 - RNA, 22 nt, Human
aaagcagccgguucccuggucu

SEQ ID NO: 523170 - RNA, 22 nt, Human
ucaaaugcugccuuugugugcc

SEQ ID NO: 523171 - RNA, 22 nt, Human
uuagaaaaauguucaguaguuu

SEQ ID NO: 523172 - RNA, 22 nt, Human
cccauuuaaacacaagcuuuca

SEQ ID NO: 523173 - RNA, 22 nt, Human
ccagccuggacugggucuugug

SEQ ID NO: 523174 - RNA, 22 nt, Human
gacagagguguccuugagucca

SEQ ID NO: 523175 - RNA, 18 nt, Human
uguuccugccuuucucug

SEQ ID NO: 523176 - RNA, 22 nt, Human
cugaaggauucaaaauggcagg

SEQ ID NO: 523177 - RNA, 22 nt, Human
gaggcaggguguugauuacaga

SEQ ID NO: 523178 - RNA, 22 nt, Human
gucccacaccuugaggggucuu

SEQ ID NO: 523179 - RNA, 23 nt, Human
ucuguucaaggcuuucuccuuga

SEQ ID NO: 523180 - RNA, 21 nt, Human
uuguugagaguuagaacaugg

SEQ ID NO: 523181 - RNA, 22 nt, Human
ccagggcaggagaaagacucac

SEQ ID NO: 523182 - RNA, 22 nt, Human
agcagcaucucuuauugcagug

SEQ ID NO: 523183 - RNA, 22 nt, Human
cugaauggcgaguuaguuaguu

SEQ ID NO: 523184 - RNA, 22 nt, Human
agccuggauccuaggcucagcu

SEQ ID NO: 523185 - RNA, 22 nt, Human
aguggguguagucuuccuccug

SEQ ID NO: 523186 - RNA, 22 nt, Human
cauuagaagaacaguuauauua

SEQ ID NO: 523187 - RNA, 22 nt, Human
auugucuuuggugcuuccagga

SEQ ID NO: 523188 - RNA, 19 nt, Human
agugucaucagcuacucag

SEQ ID NO: 523189 - RNA, 20 nt, Human
ggagggcagcugagaguugg

SEQ ID NO: 523190 - RNA, 22 nt, Human
auauuagcagugaucaaaaugg

SEQ ID NO: 523191 - RNA, 19 nt, Human
ucaaagcaagcauguucug

SEQ ID NO: 523192 - RNA, 18 nt, Human
uccugcagcuucuaugua

SEQ ID NO: 523193 - RNA, 22 nt, Human
ugaaggaaaugacggcagaaga

SEQ ID NO: 523194 - RNA, 21 nt, Human
cuugggcuuguagauggugga

SEQ ID NO: 523195 - RNA, 22 nt, Human
ucaaagcaucagucaauuuagg

SEQ ID NO: 523196 - RNA, 22 nt, Human
cagaaggcuuuguggaguagac

SEQ ID NO: 523197 - RNA, 22 nt, Human
ugcaaacaggagaguaaguaua

SEQ ID NO: 523198 - RNA, 22 nt, Human
uggaugagggcugagcacuggg

SEQ ID NO: 523199 - RNA, 22 nt, Human
ucuaauuuuaggcauuuguuca

SEQ ID NO: 523200 - RNA, 21 nt, Human
gaacauuuggguuguuucuac

SEQ ID NO: 523201 - RNA, 19 nt, Human
ccaggccugcgggcguugg

SEQ ID NO: 523202 - RNA, 22 nt, Human
ccugagacaugaaccaggcucc

SEQ ID NO: 523203 - RNA, 22 nt, Human
uacagcuuugggaaggccccau

SEQ ID NO: 523204 - RNA, 22 nt, Human
uucugggcuugaaaguuuaaua

SEQ ID NO: 523205 - RNA, 19 nt, Human
ggaggccuggguauuugcc

SEQ ID NO: 523206 - RNA, 22 nt, Human
cuccugaguaguagcauuguca

SEQ ID NO: 523207 - RNA, 22 nt, Human
uagaugauggaaaaaagcaaua

SEQ ID NO: 523208 - RNA, 21 nt, Human
gcucuuggaaggggcucagcu

SEQ ID NO: 523209 - RNA, 22 nt, Human
caaugauugcuauuuacauaaa

SEQ ID NO: 523210 - RNA, 22 nt, Human
ugauauuugcugacugcauugu

SEQ ID NO: 523211 - RNA, 22 nt, Human
uugguuuagagagugugguuac

SEQ ID NO: 523212 - RNA, 22 nt, Human
gugaacagauaauagaaaugaa

SEQ ID NO: 523213 - RNA, 17 nt, Human
agcagcuggguugaucu

SEQ ID NO: 523214 - RNA, 22 nt, Human
cugaagcaaaggaucgagcuaa

SEQ ID NO: 523215 - RNA, 22 nt, Human
cuagaaaugcucaagagaaagu

SEQ ID NO: 523216 - RNA, 22 nt, Human
cuuuacagauaggaacuacuca

SEQ ID NO: 523217 - RNA, 19 nt, Human
guagggacagugguucuga

SEQ ID NO: 523218 - RNA, 22 nt, Human
uccucugcuccaucuuuacugu

SEQ ID NO: 523219 - RNA, 22 nt, Human
uaaaugacauucuuaagucuug

SEQ ID NO: 523220 - RNA, 18 nt, Human
ggcugugcguggaggcug

SEQ ID NO: 523221 - RNA, 22 nt, Human
ugcagcuguaacagaggccuca

SEQ ID NO: 523222 - RNA, 22 nt, Human
auguacauuuagaucauuucug

SEQ ID NO: 523223 - RNA, 22 nt, Human
agaagcagaaggaagcagggcc

SEQ ID NO: 523224 - RNA, 22 nt, Human
aggggagcaucugugaugguua

SEQ ID NO: 523225 - RNA, 22 nt, Human
agggcagcuuccauagucuggc

SEQ ID NO: 523226 - RNA, 22 nt, Human
agggcagacuaggauggaagug

SEQ ID NO: 523227 - RNA, 22 nt, Human
agccacccauucccgagcccua

SEQ ID NO: 523228 - RNA, 22 nt, Human
gacagcaggagaucaugauaga

SEQ ID NO: 523229 - RNA, 20 nt, Human
uuccuggggaaugauagaag

SEQ ID NO: 523230 - RNA, 22 nt, Human
ggcugggcuccgggagcaugcg

SEQ ID NO: 523231 - RNA, 21 nt, Human
ugauuuccaucuuaaaauaaa

SEQ ID NO: 523232 - RNA, 22 nt, Human
uuucuuauacuauauugucauc

SEQ ID NO: 523233 - RNA, 22 nt, Human
agggcccucuggcaggccaggc

SEQ ID NO: 523234 - RNA, 22 nt, Human
ggcaggucaucaacuguaauuu

SEQ ID NO: 523235 - RNA, 22 nt, Human
ggcagcugagcauggcuaccuu

SEQ ID NO: 523236 - RNA, 23 nt, Human
ugguaauagggagcagaagguag

SEQ ID NO: 523237 - RNA, 22 nt, Human
caaaauuagggagugagcugga

SEQ ID NO: 523238 - RNA, 22 nt, Human
uagggcagcugcaucaggcacu

SEQ ID NO: 523239 - RNA, 22 nt, Human
gccaccagggggcuccagugag

SEQ ID NO: 523240 - RNA, 22 nt, Human
ucuuguccuaagagcuggauuc

SEQ ID NO: 523241 - RNA, 22 nt, Human
guggugcauccuugaguaagcu

SEQ ID NO: 523242 - RNA, 22 nt, Human
ggcucagguugggucacaugac

SEQ ID NO: 523243 - RNA, 22 nt, Human
ucuaccuggaguccguuguuaa

SEQ ID NO: 523244 - RNA, 20 nt, Human
auugucagccuucagaggag

SEQ ID NO: 523245 - RNA, 22 nt, Human
gagaggcugacuggcuguccug

SEQ ID NO: 523246 - RNA, 22 nt, Human
agagauucauguuuacuguagg

SEQ ID NO: 523247 - RNA, 22 nt, Human
uuagccauuaaauuacaaggug

SEQ ID NO: 523248 - RNA, 19 nt, Human
ucccaagauuucuguauca

SEQ ID NO: 523249 - RNA, 22 nt, Human
uccagggccugagguugaagug

SEQ ID NO: 523250 - RNA, 22 nt, Human
ucacagacaauuguuuuggugu

SEQ ID NO: 523251 - RNA, 22 nt, Human
aaaugagguuaauacagugcuu

SEQ ID NO: 523252 - RNA, 22 nt, Human
gcugugagcugccugugucaca

SEQ ID NO: 523253 - RNA, 22 nt, Human
gucugaggaagaugcaggggga

SEQ ID NO: 523254 - RNA, 22 nt, Human
gaagagcugcucagaacaugau

SEQ ID NO: 523255 - RNA, 22 nt, Human
cagaguuuugugaacaacuugg

SEQ ID NO: 523256 - RNA, 22 nt, Human
guucauauuuaacuaagauagg

SEQ ID NO: 523257 - RNA, 22 nt, Human
acacauuugcauaauaccucau

SEQ ID NO: 523258 - RNA, 22 nt, Human
cuggccugaggccgccuucaga

SEQ ID NO: 523259 - RNA, 22 nt, Human
ucacaaagugaagugugucaug

SEQ ID NO: 523260 - RNA, 22 nt, Human
ugcagauucaaaugaaaugcaa

SEQ ID NO: 523261 - RNA, 22 nt, Human
ggaugcugacuuuggagcaugg

SEQ ID NO: 523262 - RNA, 17 nt, Human
aggccagaugaggcaag

SEQ ID NO: 523263 - RNA, 22 nt, Human
ccagcugcugugaggaccacag

SEQ ID NO: 523264 - RNA, 22 nt, Human
uuuucuaauuuaguuacccucc

SEQ ID NO: 523265 - RNA, 22 nt, Human
cagucccagacauaguaaggga

SEQ ID NO: 523266 - RNA, 22 nt, Human
caggauggagaguuguugguug

SEQ ID NO: 523267 - RNA, 22 nt, Human
caucagagguacuuaaugaaug

SEQ ID NO: 523268 - RNA, 22 nt, Human
aguguuugucccguuagaaaug

SEQ ID NO: 523269 - RNA, 22 nt, Human
aaauggaguucuaaguauagua

SEQ ID NO: 523270 - RNA, 22 nt, Human
uuacuaggccaguuuucacuuu

SEQ ID NO: 523271 - RNA, 22 nt, Human
gcaggccucuguugagggccuu

SEQ ID NO: 523272 - RNA, 20 nt, Human
gccaacgcgcuggggcugcc

SEQ ID NO: 523273 - RNA, 18 nt, Human
cugagggcagccccuggg

SEQ ID NO: 523274 - RNA, 22 nt, Human
cuguacauauacauuuuuuucc

SEQ ID NO: 523275 - RNA, 22 nt, Human
acccugagucagacagccugac

SEQ ID NO: 523276 - RNA, 22 nt, Human
ugggcugagaguaccuuauaaa

SEQ ID NO: 523277 - RNA, 22 nt, Human
gccaccugccaacuugcuggaa

SEQ ID NO: 523278 - RNA, 22 nt, Human
gaggagagagggacugucugca

SEQ ID NO: 523279 - RNA, 22 nt, Human
aaacuguauauuuauggcaugu

SEQ ID NO: 523280 - RNA, 22 nt, Human
uuuacaguaagguggaugguac

SEQ ID NO: 523281 - RNA, 22 nt, Human
acacagccaggguaguaaggcu

SEQ ID NO: 523282 - RNA, 19 nt, Human
gagcgcagagggcagggga

SEQ ID NO: 523283 - RNA, 22 nt, Human
cagcauuggguuaccuuuguuu

SEQ ID NO: 523284 - RNA, 22 nt, Human
ccaggucugucuucuuagcuca

SEQ ID NO: 523285 - RNA, 22 nt, Human
ccagccagcugcccuuggggcc

SEQ ID NO: 523286 - RNA, 17 nt, Human
uggggaagcucagauuu

SEQ ID NO: 523287 - RNA, 22 nt, Human
guauucauauuaaacauaucaa

SEQ ID NO: 523288 - RNA, 22 nt, Human
guguaugaggggagaauguuuu

SEQ ID NO: 523289 - RNA, 22 nt, Human
ccagcuccuucugucuguggag

SEQ ID NO: 523290 - RNA, 22 nt, Human
gaggagcaagaaauagugccca

SEQ ID NO: 523291 - RNA, 22 nt, Human
auacuuacuuuucuucagacua

SEQ ID NO: 523292 - RNA, 22 nt, Human
aggccagccucaggcagggacc

SEQ ID NO: 523293 - RNA, 22 nt, Human
acagaugaaaaagcuuguggau

SEQ ID NO: 523294 - RNA, 22 nt, Human
aaguccagggaucaaaguaggc

SEQ ID NO: 523295 - RNA, 22 nt, Human
cauccagggcagccauggccug

SEQ ID NO: 523296 - RNA, 22 nt, Human
uuguggcugugcaccgcugccu

SEQ ID NO: 523297 - RNA, 22 nt, Human
auuguaucuugucauuaugcau

SEQ ID NO: 523298 - RNA, 22 nt, Human
uagcauuaaagguaagacauua

SEQ ID NO: 523299 - RNA, 22 nt, Human
gugggccacaucccagggcucu

SEQ ID NO: 523300 - RNA, 22 nt, Human
cagcaucuaaucuucaugccgg

SEQ ID NO: 523301 - RNA, 22 nt, Human
caucacagauguuguguggagu

SEQ ID NO: 523302 - RNA, 22 nt, Human
auuaaacaauguaaaguucuug

SEQ ID NO: 523303 - RNA, 20 nt, Human
uggccaccugcgucccagcc

SEQ ID NO: 523304 - RNA, 22 nt, Human
agagcuguucagcagccagguu

SEQ ID NO: 523305 - RNA, 17 nt, Human
ugcauuguuggaaauuu

SEQ ID NO: 523306 - RNA, 22 nt, Human
guggcagcugguaugcagacag

SEQ ID NO: 523307 - RNA, 22 nt, Human
augcaguggcagcuccuggugu

SEQ ID NO: 523308 - RNA, 22 nt, Human
ccugagaggcccucucacuguc

SEQ ID NO: 523309 - RNA, 22 nt, Human
uacccagggcuuuucugaugca

SEQ ID NO: 523310 - RNA, 22 nt, Human
ugcccaaguccuccaccgaggu

SEQ ID NO: 523311 - RNA, 19 nt, Human
agcaggcuaggcugccucu

SEQ ID NO: 523312 - RNA, 21 nt, Human
gaggccacuaauaggggcaga

SEQ ID NO: 523313 - RNA, 22 nt, Human
ugggggcugaguaagaugagau

SEQ ID NO: 523314 - RNA, 22 nt, Human
caagauggagaagcagcaaggg

SEQ ID NO: 523315 - RNA, 22 nt, Human
agagcagauggccagggggccu

SEQ ID NO: 523316 - RNA, 22 nt, Human
gaggcugagacucugaauuuuu

SEQ ID NO: 523317 - RNA, 22 nt, Human
gaaauauuguacuggagauguu

SEQ ID NO: 523318 - RNA, 22 nt, Human
uuuacagagaauguacauaaag

SEQ ID NO: 523319 - RNA, 22 nt, Human
caggcacaaauuucuagauaag

SEQ ID NO: 523320 - RNA, 22 nt, Human
uagaggcauaagagggaagcag

SEQ ID NO: 523321 - RNA, 22 nt, Human
cccaggcagcccuucugacgca

SEQ ID NO: 523322 - RNA, 22 nt, Human
acauauguguuguacaugcaug

SEQ ID NO: 523323 - RNA, 22 nt, Human
cauacauauguggaugucauau

SEQ ID NO: 523324 - RNA, 22 nt, Human
ugagguaggugguaagagauac

SEQ ID NO: 523325 - RNA, 22 nt, Human
augcacaauuaggauauagcuu

SEQ ID NO: 523326 - RNA, 22 nt, Human
ccagucccagcucugccaugcu

SEQ ID NO: 523327 - RNA, 22 nt, Human
ggcagcucugcuccacaugagu

SEQ ID NO: 523328 - RNA, 22 nt, Human
uucauuccugagcccauauuua

SEQ ID NO: 523329 - RNA, 22 nt, Human
gcuuagcaaugugacaagaugc

SEQ ID NO: 523330 - RNA, 22 nt, Human
agaggaugguugaggaagaccu

SEQ ID NO: 523331 - RNA, 22 nt, Human
gaaguucucaaggaucacagaa

SEQ ID NO: 523332 - RNA, 22 nt, Human
uguuuagaggaacuggaaucag

SEQ ID NO: 523333 - RNA, 22 nt, Human
acccagaggugucuagcaagcu

SEQ ID NO: 523334 - RNA, 21 nt, Human
ggauggauagggaagagauuu

SEQ ID NO: 523335 - RNA, 22 nt, Human
gggcuagcagauucuaccuaau

SEQ ID NO: 523336 - RNA, 22 nt, Human
uuucauguuuucuuaaauggca

SEQ ID NO: 523337 - RNA, 22 nt, Human
cugaggucuauuuugaaacugc

SEQ ID NO: 523338 - RNA, 22 nt, Human
agaaauuccuaagguacacaag

SEQ ID NO: 523339 - RNA, 22 nt, Human
ugcuucuggcacuugagggggu

SEQ ID NO: 523340 - RNA, 22 nt, Human
caggccugaguguggaagucuu

SEQ ID NO: 523341 - RNA, 22 nt, Human
ucucagagggaggauuacugcc

SEQ ID NO: 523342 - RNA, 22 nt, Human
gccuggaguuguggugaagcca

SEQ ID NO: 523343 - RNA, 19 nt, Human
cuuauuagagugagagcuu

SEQ ID NO: 523344 - RNA, 22 nt, Human
uugcacagaugagggugaugcu

SEQ ID NO: 523345 - RNA, 22 nt, Human
cuggggcccaucgagggcugag

SEQ ID NO: 523346 - RNA, 20 nt, Human
ccugccuguguuugugauga

SEQ ID NO: 523347 - RNA, 22 nt, Human
uggggcuguccuuagucugaga

SEQ ID NO: 523348 - RNA, 21 nt, Human
ccuggcuccagaacuuccggu

SEQ ID NO: 523349 - RNA, 22 nt, Human
ccugggagccaagccucugugu

SEQ ID NO: 523350 - RNA, 22 nt, Human
auuuacaguuuagcauuucaag

SEQ ID NO: 523351 - RNA, 22 nt, Human
aguaacuuaggagauacauggg

SEQ ID NO: 523352 - RNA, 22 nt, Human
aggccagcacgacagccgcagg

SEQ ID NO: 523353 - RNA, 22 nt, Human
gucucaguaagaaaggcuccug

SEQ ID NO: 523354 - RNA, 22 nt, Human
ggcucaggagaggggcuaaaag

SEQ ID NO: 523355 - RNA, 22 nt, Human
ugggcacagaauagauggccca

SEQ ID NO: 523356 - RNA, 22 nt, Human
caggguuucaccauguuagcag

SEQ ID NO: 523357 - RNA, 19 nt, Human
aauaauguucaugagauug

SEQ ID NO: 523358 - RNA, 22 nt, Human
ugggcuuccuggagccugugcu

SEQ ID NO: 523359 - RNA, 22 nt, Human
uuaagacauucagauauuucua

SEQ ID NO: 523360 - RNA, 22 nt, Human
uggcucagccuggcccuuucau

SEQ ID NO: 523361 - RNA, 22 nt, Human
ggcagcagcaagguuggagcug

SEQ ID NO: 523362 - RNA, 22 nt, Human
uggagcugggaguccugggcug

SEQ ID NO: 523363 - RNA, 22 nt, Human
gacccaggcccaaggcugccag

SEQ ID NO: 523364 - RNA, 22 nt, Human
gggcagguggccucuuguacua

SEQ ID NO: 523365 - RNA, 22 nt, Human
ugccugggagugaccaagacuc

SEQ ID NO: 523366 - RNA, 22 nt, Human
gcaagcaguuguggcuucugag

SEQ ID NO: 523367 - RNA, 22 nt, Human
ucagagaaguaagguggggugc

SEQ ID NO: 523368 - RNA, 23 nt, Human
agguucaggagauggaggaacaa

SEQ ID NO: 523369 - RNA, 22 nt, Human
ccagaaaguucagcugugaaug

SEQ ID NO: 523370 - RNA, 22 nt, Human
agucccagaugacccagcuacu

SEQ ID NO: 523371 - RNA, 22 nt, Human
ucugugugggauaguuugagga

SEQ ID NO: 523372 - RNA, 23 nt, Human
ugggggugcacgggccacaucuu

SEQ ID NO: 523373 - RNA, 21 nt, Human
uguggcugacacccuuuggga

SEQ ID NO: 523374 - RNA, 22 nt, Human
guauuuauaggggaaugagagu

SEQ ID NO: 523375 - RNA, 22 nt, Human
agcugagcugcagaugacugua

SEQ ID NO: 523376 - RNA, 22 nt, Human
cuuaauuuaaaauaguucaggc

SEQ ID NO: 523377 - RNA, 22 nt, Human
uggcagaaguacacaagcaugc

SEQ ID NO: 523378 - RNA, 22 nt, Human
uaucagcaccgcggacagcauc

SEQ ID NO: 523379 - RNA, 22 nt, Human
uucuggagauugagaaggcauu

SEQ ID NO: 523380 - RNA, 22 nt, Human
uggccuugggcagguggccugc

SEQ ID NO: 523381 - RNA, 22 nt, Human
uuucuguaaggacuuaaugcaa

SEQ ID NO: 523382 - RNA, 22 nt, Human
ugcugaaucaaaacaaagguuu

SEQ ID NO: 523383 - RNA, 22 nt, Human
ucuucaaauccuacagugucug

SEQ ID NO: 523384 - RNA, 22 nt, Human
gggcagguguugucaaucuaau

SEQ ID NO: 523385 - RNA, 22 nt, Human
ugccucagcugaggccgcucca

SEQ ID NO: 523386 - RNA, 22 nt, Human
cauuauguucaguagcuuaaaa

SEQ ID NO: 523387 - RNA, 22 nt, Human
uugaauaauguguauguuguua

SEQ ID NO: 523388 - RNA, 22 nt, Human
aaggaaccuggaguagagggag

SEQ ID NO: 523389 - RNA, 22 nt, Human
ggagcuggcagcgcaacccaga

SEQ ID NO: 523390 - RNA, 22 nt, Human
uggaaacugggaguuaaaugua

SEQ ID NO: 523391 - RNA, 22 nt, Human
cuguugcugggaacgcauguca

SEQ ID NO: 523392 - RNA, 22 nt, Human
uggcccugcuuaugucucucuu

SEQ ID NO: 523393 - RNA, 22 nt, Human
guccugguccugccuccccaug

SEQ ID NO: 523394 - RNA, 22 nt, Human
uccugggguuuagagggaagug

SEQ ID NO: 523395 - RNA, 22 nt, Human
uuucuaaggcuaggucuuaagg

SEQ ID NO: 523396 - RNA, 23 nt, Human
ucauaaauauuagcacaguagga

SEQ ID NO: 523397 - RNA, 22 nt, Human
uagcauuagagauagaaauagu

SEQ ID NO: 523398 - RNA, 22 nt, Human
ggcagccaugcacgcugccugg

SEQ ID NO: 523399 - RNA, 23 nt, Human
agcagccauagggaagcaauaca

SEQ ID NO: 523400 - RNA, 22 nt, Human
ucagagucauugcaaguagaag

SEQ ID NO: 523401 - RNA, 22 nt, Human
cacauaauacauguuccacuua

SEQ ID NO: 523402 - RNA, 23 nt, Human
aaguaacagggauaauagcaguu

SEQ ID NO: 523403 - RNA, 18 nt, Human
uggagccauugccaccau

SEQ ID NO: 523404 - RNA, 22 nt, Human
ucaggacagccagggugcagac

SEQ ID NO: 523405 - RNA, 22 nt, Human
ccaggagcagauauggacauaa

SEQ ID NO: 523406 - RNA, 22 nt, Human
agggcagagcugucuaaauggc

SEQ ID NO: 523407 - RNA, 22 nt, Human
aggcugcucugcgaagucagcu

SEQ ID NO: 523408 - RNA, 22 nt, Human
uacaagaaaguccaguggguuu

SEQ ID NO: 523409 - RNA, 23 nt, Human
ucuccuccuagauacagucaugg

SEQ ID NO: 523410 - RNA, 22 nt, Human
agcacugugauuuauaacauuu

SEQ ID NO: 523411 - RNA, 22 nt, Human
aagucuguagaaaaacaguuua

SEQ ID NO: 523412 - RNA, 22 nt, Human
aucaggaagaauuggaugcuac

SEQ ID NO: 523413 - RNA, 22 nt, Human
cagcagcuucuguugaucagaa

SEQ ID NO: 523414 - RNA, 22 nt, Human
cagcacugugauaacugagcca

SEQ ID NO: 523415 - RNA, 22 nt, Human
accugaggcuguuagucuaggu

SEQ ID NO: 523416 - RNA, 22 nt, Human
acagaauugaaaguauaaucug

SEQ ID NO: 523417 - RNA, 22 nt, Human
gagcuggggcggauacucagcu

SEQ ID NO: 523418 - RNA, 22 nt, Human
cuauuaaauacucuucaaauug

SEQ ID NO: 523419 - RNA, 22 nt, Human
gaucuugagcaaguugcauccc

SEQ ID NO: 523420 - RNA, 19 nt, Human
uagucucugaugaggcuuu

SEQ ID NO: 523421 - RNA, 22 nt, Human
gagaagggauauggcuucuuga

SEQ ID NO: 523422 - RNA, 22 nt, Human
ucugggagagggaaagaagacu

SEQ ID NO: 523423 - RNA, 22 nt, Human
ccagagagaguacugggcucug

SEQ ID NO: 523424 - RNA, 22 nt, Human
accaugggucagccaccucagc

SEQ ID NO: 523425 - RNA, 22 nt, Human
uaggacaggugaggggcugugg

SEQ ID NO: 523426 - RNA, 22 nt, Human
auggguuucccucugaaauuau

SEQ ID NO: 523427 - RNA, 22 nt, Human
cgccaggcuugguagcucaugc

SEQ ID NO: 523428 - RNA, 22 nt, Human
ggguccagagccucagcccaga

SEQ ID NO: 523429 - RNA, 22 nt, Human
cucaggaguaguucagcagcug

SEQ ID NO: 523430 - RNA, 22 nt, Human
ugagccagucugucugggugaa

SEQ ID NO: 523431 - RNA, 20 nt, Human
cuuggccuacuuagcuuugu

SEQ ID NO: 523432 - RNA, 21 nt, Human
uucaaugaaaacaaagugagg

SEQ ID NO: 523433 - RNA, 22 nt, Human
augcucuggaguacgugaaauu

SEQ ID NO: 523434 - RNA, 22 nt, Human
ucugggcucugcgaagcccuuc

SEQ ID NO: 523435 - RNA, 22 nt, Human
aggcacugugcuucuuauaugu

SEQ ID NO: 523436 - RNA, 22 nt, Human
ggaucugggcucugccaaucag

SEQ ID NO: 523437 - RNA, 22 nt, Human
agcaggaaguagucuguaagca

SEQ ID NO: 523438 - RNA, 22 nt, Human
ucugaaauguucucuuguuuug

SEQ ID NO: 523439 - RNA, 22 nt, Human
gauguggaugaucuuagauggu

SEQ ID NO: 523440 - RNA, 22 nt, Human
aaaguuuuagcuguccaguucc

SEQ ID NO: 523441 - RNA, 23 nt, Human
ccagccucugggucuucauccag

SEQ ID NO: 523442 - RNA, 22 nt, Human
aaaugcuacauacacaucaggg

SEQ ID NO: 523443 - RNA, 22 nt, Human
gcagggugacguugcccaccuc

SEQ ID NO: 523444 - RNA, 18 nt, Human
aguuuuuaggaagaaaug

SEQ ID NO: 523445 - RNA, 22 nt, Human
gcucagugugguccucagaugu

SEQ ID NO: 523446 - RNA, 22 nt, Human
uccuuagcaacacuguuauaau

SEQ ID NO: 523447 - RNA, 19 nt, Human
gggcacagccuccccccag

SEQ ID NO: 523448 - RNA, 22 nt, Human
gcaguguuucagugcuuuuucu

SEQ ID NO: 523449 - RNA, 22 nt, Human
gcucagaggagcaucauaagga

SEQ ID NO: 523450 - RNA, 22 nt, Human
gccucaguaaccuuaggggaua

SEQ ID NO: 523451 - RNA, 22 nt, Human
cauuuaaucuggcucaugagca

SEQ ID NO: 523452 - RNA, 22 nt, Human
gcugggucagaaucucccugug

SEQ ID NO: 523453 - RNA, 22 nt, Human
gcagaagcugggcagcgaggug

SEQ ID NO: 523454 - RNA, 22 nt, Human
gggcugcuacgagaacugaaua

SEQ ID NO: 523455 - RNA, 18 nt, Human
gaugaagcugcuggggau

SEQ ID NO: 523456 - RNA, 23 nt, Human
gccaggcacaugguggacacgca

SEQ ID NO: 523457 - RNA, 22 nt, Human
agcuuguuagaaauguagacuc

SEQ ID NO: 523458 - RNA, 22 nt, Human
gcucccugacucaguuccugag

SEQ ID NO: 523459 - RNA, 22 nt, Human
auggcaggcccagguguucauu

SEQ ID NO: 523460 - RNA, 22 nt, Human
aggcugaggcagguggaucacu

SEQ ID NO: 523461 - RNA, 22 nt, Human
gcugagagcaguguggccuuaa

SEQ ID NO: 523462 - RNA, 20 nt, Human
ugggcugaggaucaggugcc

SEQ ID NO: 523463 - RNA, 22 nt, Human
ucuggccccuggcaguccugga

SEQ ID NO: 523464 - RNA, 22 nt, Human
aauguguguauuucuaggcgag

SEQ ID NO: 523465 - RNA, 22 nt, Human
cagccuucaaggcuuagcucag

SEQ ID NO: 523466 - RNA, 22 nt, Human
aaaaguucccugguuagaaaag

SEQ ID NO: 523467 - RNA, 22 nt, Human
ucagcaggugaacaucaugcca

SEQ ID NO: 523468 - RNA, 22 nt, Human
augaugugugcugaucaagcuu

SEQ ID NO: 523469 - RNA, 22 nt, Human
accaaggaguuugguauuuuag

SEQ ID NO: 523470 - RNA, 22 nt, Human
acacacucaauugcauaagcac

SEQ ID NO: 523471 - RNA, 22 nt, Human
gucucagugcccaaugccauaa

SEQ ID NO: 523472 - RNA, 22 nt, Human
uccagggagauacuggcugcca

SEQ ID NO: 523473 - RNA, 22 nt, Human
guagggacuguucucaccugag

SEQ ID NO: 523474 - RNA, 22 nt, Human
uggcucagcgcggccuggucuu

SEQ ID NO: 523475 - RNA, 22 nt, Human
uccagggcuccccaacauccag

SEQ ID NO: 523476 - RNA, 22 nt, Human
uggcugagaaguucugguggga

SEQ ID NO: 523477 - RNA, 22 nt, Human
aaauaaguaguuuaguguugug

SEQ ID NO: 523478 - RNA, 22 nt, Human
agcugcaguaaagcucuccagg

SEQ ID NO: 523479 - RNA, 22 nt, Human
acaggccacaguggagucucug

SEQ ID NO: 523480 - RNA, 22 nt, Human
gcagagcuguuaauggagcuga

SEQ ID NO: 523481 - RNA, 22 nt, Human
ucugggcacugcugagccugua

SEQ ID NO: 523482 - RNA, 22 nt, Human
cacagggcagugauuguccaca

SEQ ID NO: 523483 - RNA, 22 nt, Human
ccuggcccuggaauagggcagg

SEQ ID NO: 523484 - RNA, 22 nt, Human
caaggccacguucugcaugcgg

SEQ ID NO: 523485 - RNA, 22 nt, Human
agcugggagcagagccacagcc

SEQ ID NO: 523486 - RNA, 21 nt, Human
ccuggcuucagggugcacugg

SEQ ID NO: 523487 - RNA, 22 nt, Human
agagugggccucugagucccag

SEQ ID NO: 523488 - RNA, 22 nt, Human
gcaggcagucaucuuucauauu

SEQ ID NO: 523489 - RNA, 22 nt, Human
auuccaguucuccucucuaaag

SEQ ID NO: 523490 - RNA, 22 nt, Human
ggccuuggugccauggccaguu

SEQ ID NO: 523491 - RNA, 22 nt, Human
agaucucaccucuguguauuau

SEQ ID NO: 523492 - RNA, 22 nt, Human
uuggcuuccaggggcuuuuaca

SEQ ID NO: 523493 - RNA, 22 nt, Human
agaagccauucccuguaggcuc

SEQ ID NO: 523494 - RNA, 22 nt, Human
aaauuucaagcaaaguagcuau

SEQ ID NO: 523495 - RNA, 22 nt, Human
agccaaagaucagugugcaagu

SEQ ID NO: 523496 - RNA, 22 nt, Human
uggccgggccgggcgccuccac

SEQ ID NO: 523497 - RNA, 22 nt, Human
uuucagauggagguuuaggaca

SEQ ID NO: 523498 - RNA, 22 nt, Human
auauacaguauguacugugguu

SEQ ID NO: 523499 - RNA, 22 nt, Human
gaaugcacuuccaacaucuauu

SEQ ID NO: 523500 - RNA, 22 nt, Human
agaaauguuuauggcugccuau

SEQ ID NO: 523501 - RNA, 22 nt, Human
aagcagcagaccugauuuugaa

SEQ ID NO: 523502 - RNA, 23 nt, Human
gaggaaagaauauagaugcaauc

SEQ ID NO: 523503 - RNA, 22 nt, Human
uaugagaaucugcaguaugcuu

SEQ ID NO: 523504 - RNA, 22 nt, Human
ccuuccuugagaagcaauuccu

SEQ ID NO: 523505 - RNA, 22 nt, Human
uagcagggaagaugaucagaau

SEQ ID NO: 523506 - RNA, 22 nt, Human
ggcugcagcggauuggggauug

SEQ ID NO: 523507 - RNA, 22 nt, Human
gcagcauugugagguccugccc

SEQ ID NO: 523508 - RNA, 22 nt, Human
cuggggccacaacggcgcacgc

SEQ ID NO: 523509 - RNA, 22 nt, Human
aggucauuacaauuaucauuuu

SEQ ID NO: 523510 - RNA, 22 nt, Human
ucaggcucuggguacaccugac

SEQ ID NO: 523511 - RNA, 23 nt, Human
uggauaaagcugugcugcauagg

SEQ ID NO: 523512 - RNA, 22 nt, Human
cugggcagcuaccaccacugcu

SEQ ID NO: 523513 - RNA, 22 nt, Human
uggccuccccuaacagccucuu

SEQ ID NO: 523514 - RNA, 22 nt, Human
gcacagaacacuggugaguccc

SEQ ID NO: 523515 - RNA, 22 nt, Human
uugaccauaccuccaggcaguu

SEQ ID NO: 523516 - RNA, 22 nt, Human
ucuucucccaucuccaggcagg

SEQ ID NO: 523517 - RNA, 22 nt, Human
agacauaagcgagcaucacagg

SEQ ID NO: 523518 - RNA, 22 nt, Human
agaaaucaugucuuauuucuau

SEQ ID NO: 523519 - RNA, 22 nt, Human
gggggcggagcacgugaccacg

SEQ ID NO: 523520 - RNA, 23 nt, Human
ccaaagucgaagucuaguccaga

SEQ ID NO: 523521 - RNA, 22 nt, Human
gggaaacucacaggugcagggg

SEQ ID NO: 523522 - RNA, 22 nt, Human
caaggccacugcucagguuucc

SEQ ID NO: 523523 - RNA, 22 nt, Human
ccaggccugauugggaaucuug

SEQ ID NO: 523524 - RNA, 22 nt, Human
aggauccugcgcuuugggggag

SEQ ID NO: 523525 - RNA, 22 nt, Human
cacuguugaagauacuuccucu

SEQ ID NO: 523526 - RNA, 22 nt, Human
aaugagaacugggaguuggugg

SEQ ID NO: 523527 - RNA, 22 nt, Human
ugguccugagcaccagccugac

SEQ ID NO: 523528 - RNA, 21 nt, Human
ucugggcccaugcugccucac

SEQ ID NO: 523529 - RNA, 17 nt, Human
acaagcaguggccaugg

SEQ ID NO: 523530 - RNA, 19 nt, Human
uucuuacaacacccuggga

SEQ ID NO: 523531 - RNA, 20 nt, Human
caucuugaaggucuuccaca

SEQ ID NO: 523532 - RNA, 23 nt, Human
ucaguccuguaggggcuccaggu

SEQ ID NO: 523533 - RNA, 22 nt, Human
uagugcaaucucuuccucagca

SEQ ID NO: 523534 - RNA, 22 nt, Human
ugcagguguagaguugggcucc

SEQ ID NO: 523535 - RNA, 22 nt, Human
cuggcuuuguucugauugcuuc

SEQ ID NO: 523536 - RNA, 22 nt, Human
cagagcugcucaugguggccag

SEQ ID NO: 523537 - RNA, 22 nt, Human
aaaguguacuaugucaugaaca

SEQ ID NO: 523538 - RNA, 22 nt, Human
gucucagggacugcuucugggg

SEQ ID NO: 523539 - RNA, 22 nt, Human
gggcuggcaucgguugcugaga

SEQ ID NO: 523540 - RNA, 22 nt, Human
ugucaugggucuaaacauugau

SEQ ID NO: 523541 - RNA, 22 nt, Human
agaugcugucacacacacuguu

SEQ ID NO: 523542 - RNA, 22 nt, Human
gcccugagacugagcauggguu

SEQ ID NO: 523543 - RNA, 22 nt, Human
gugcugucguggaacugggcug

SEQ ID NO: 523544 - RNA, 22 nt, Human
ccucacucugcacccugcagca

SEQ ID NO: 523545 - RNA, 22 nt, Human
aucuuugaagaggacuugaagu

SEQ ID NO: 523546 - RNA, 22 nt, Human
auguuacacauaggcauaaaug

SEQ ID NO: 523547 - RNA, 19 nt, Human
ccaggucuggggccagauu

SEQ ID NO: 523548 - RNA, 18 nt, Human
auauggaaugccuggcua

SEQ ID NO: 523549 - RNA, 22 nt, Human
uaguaaucagagguaaacuuua

SEQ ID NO: 523550 - RNA, 23 nt, Human
uucuuucaagaaguucacagugc

SEQ ID NO: 523551 - RNA, 22 nt, Human
gcagcuuuaaacauuggaaaua

SEQ ID NO: 523552 - RNA, 22 nt, Human
ucugggcugugggaauucaaca

SEQ ID NO: 523553 - RNA, 22 nt, Human
ccagccuuacugcccuucagug

SEQ ID NO: 523554 - RNA, 22 nt, Human
ugcaggcuggggaggcagacuu

SEQ ID NO: 523555 - RNA, 22 nt, Human
cugagcuguuacucuguccucg

SEQ ID NO: 523556 - RNA, 22 nt, Human
uauuccuauuucuaaacauaug

SEQ ID NO: 523557 - RNA, 22 nt, Human
uauuuucuggggagagugaacc

SEQ ID NO: 523558 - RNA, 22 nt, Human
ggagcugcauuuagggagccuu

SEQ ID NO: 523559 - RNA, 22 nt, Human
cucaggaaggaagcagggagcc

SEQ ID NO: 523560 - RNA, 22 nt, Human
uucuucaaagaugucuguugga

SEQ ID NO: 523561 - RNA, 22 nt, Human
aaaugcauguagaauaauagag

SEQ ID NO: 523562 - RNA, 22 nt, Human
ugggcagagucguggggaauag

SEQ ID NO: 523563 - RNA, 22 nt, Human
uagugugguaaauaaauguuuu

SEQ ID NO: 523564 - RNA, 22 nt, Human
uaggaagcucuuuguuuuguga

SEQ ID NO: 523565 - RNA, 19 nt, Human
uccagggcaggaacaugua

SEQ ID NO: 523566 - RNA, 19 nt, Human
gacuccaacuuuaagcaug

SEQ ID NO: 523567 - RNA, 22 nt, Human
gaggugagaagggggucagaug

SEQ ID NO: 523568 - RNA, 20 nt, Human
cccacacccuucccacuugg

SEQ ID NO: 523569 - RNA, 22 nt, Human
auucucuguuuccaagaugaaa

SEQ ID NO: 523570 - RNA, 22 nt, Human
acagaugaggaaacagggucag

SEQ ID NO: 523571 - RNA, 16 nt, Human
gcuggagggagggguu

SEQ ID NO: 523572 - RNA, 22 nt, Human
uggcacugggacagaugcucuc

SEQ ID NO: 523573 - RNA, 22 nt, Human
aaggcugggaaacaugcaggcc

SEQ ID NO: 523574 - RNA, 22 nt, Human
cuuagcagauaaaaaccuucag

SEQ ID NO: 523575 - RNA, 23 nt, Human
uggcuggcagaaacugaagcaug

SEQ ID NO: 523576 - RNA, 22 nt, Human
cucaggagagucuuauaucucc

SEQ ID NO: 523577 - RNA, 22 nt, Human
uggagccuguucugagaagccg

SEQ ID NO: 523578 - RNA, 22 nt, Human
accaggcacuccugaggucuga

SEQ ID NO: 523579 - RNA, 22 nt, Human
uaccuuuugcuuauuaugacac

SEQ ID NO: 523580 - RNA, 22 nt, Human
aaacucaaagucagaucagaga

SEQ ID NO: 523581 - RNA, 17 nt, Human
uuagcaaaauagcacuu

SEQ ID NO: 523582 - RNA, 18 nt, Human
uccugggaaaggcauaca

SEQ ID NO: 523583 - RNA, 22 nt, Human
aggagccaagcagaacuaagga

SEQ ID NO: 523584 - RNA, 21 nt, Human
ggcacugagccagauggacuc

SEQ ID NO: 523585 - RNA, 22 nt, Human
agaggcuggauugagcauagac

SEQ ID NO: 523586 - RNA, 22 nt, Human
gccaagcuuauaugaugcuuga

SEQ ID NO: 523587 - RNA, 22 nt, Human
uuucucugaggcuggccucccu

SEQ ID NO: 523588 - RNA, 22 nt, Human
gcuggaggauggacuggaagaa

SEQ ID NO: 523589 - RNA, 22 nt, Human
ugugaagguagcucuuggcacu

SEQ ID NO: 523590 - RNA, 22 nt, Human
gaagaagacauggaacaauagu

SEQ ID NO: 523591 - RNA, 22 nt, Human
cuggcuccaccccaggaggaug

SEQ ID NO: 523592 - RNA, 22 nt, Human
auucagaaagauaugccugguu

SEQ ID NO: 523593 - RNA, 22 nt, Human
ugagcagcaacuguccauggca

SEQ ID NO: 523594 - RNA, 22 nt, Human
ucugugcacuaacauuccuggu

SEQ ID NO: 523595 - RNA, 22 nt, Human
gaaggaggcuccccaaagucug

SEQ ID NO: 523596 - RNA, 22 nt, Human
ucuuagcauuuguuaauaccca

SEQ ID NO: 523597 - RNA, 22 nt, Human
ccugcagggaaucgaggcagaa

SEQ ID NO: 523598 - RNA, 21 nt, Human
uggcucuguucaauauaugga

SEQ ID NO: 523599 - RNA, 22 nt, Human
agaauucuggaguugggaggaa

SEQ ID NO: 523600 - RNA, 22 nt, Human
acuuaaaaagaaucuuuucacg

SEQ ID NO: 523601 - RNA, 21 nt, Human
acuguucaucuguucagaagc

SEQ ID NO: 523602 - RNA, 22 nt, Human
aggagucaggaccaaauggaaa

SEQ ID NO: 523603 - RNA, 22 nt, Human
cccagacugcagagcgggcaga

SEQ ID NO: 523604 - RNA, 22 nt, Human
auucacacuguauacacaggau

SEQ ID NO: 523605 - RNA, 22 nt, Human
aauacaguaauuuugaugaguu

SEQ ID NO: 523606 - RNA, 22 nt, Human
gaauauauuauucagcuuuuca

SEQ ID NO: 523607 - RNA, 22 nt, Human
uuuuaagaugcuaguauuucag

SEQ ID NO: 523608 - RNA, 22 nt, Human
ucaagcaggguagcaagcuggu

SEQ ID NO: 523609 - RNA, 22 nt, Human
ugcaguggaaucuggagagcag

SEQ ID NO: 523610 - RNA, 22 nt, Human
auuaagacugcccauguuuuua

SEQ ID NO: 523611 - RNA, 22 nt, Human
ugugaaggcagagccagugaaa

SEQ ID NO: 523612 - RNA, 22 nt, Human
cagacagaccugcaagggcaca

SEQ ID NO: 523613 - RNA, 22 nt, Human
ccugcccuaauccagagacuag

SEQ ID NO: 523614 - RNA, 22 nt, Human
uaauccaauggcacaauguaug

SEQ ID NO: 523615 - RNA, 22 nt, Human
gcaaggcagcgcggaguagcua

SEQ ID NO: 523616 - RNA, 22 nt, Human
uguacuuccccaaugacagcac

SEQ ID NO: 523617 - RNA, 22 nt, Human
gugcccaguccugccuugacag

SEQ ID NO: 523618 - RNA, 22 nt, Human
gcugggcuggccgccgagaucg

SEQ ID NO: 523619 - RNA, 22 nt, Human
agucugaaggcaaucugcugac

SEQ ID NO: 523620 - RNA, 22 nt, Human
caucuugaugcuuugacagguu

SEQ ID NO: 523621 - RNA, 22 nt, Human
ggggugagaucaaggaagcccu

SEQ ID NO: 523622 - RNA, 22 nt, Human
caugcuuuaccaaagcagugau

SEQ ID NO: 523623 - RNA, 22 nt, Human
agggcagagcacugaauuggga

SEQ ID NO: 523624 - RNA, 18 nt, Human
cagggccccagaauuauc

SEQ ID NO: 523625 - RNA, 22 nt, Human
ccaggcugccgaggaaagaaag

SEQ ID NO: 523626 - RNA, 22 nt, Human
ucuggucccuuuuccugcaguc

SEQ ID NO: 523627 - RNA, 22 nt, Human
agagccagcaacucuagcccug

SEQ ID NO: 523628 - RNA, 22 nt, Human
aggcccaguguggcuuccugga

SEQ ID NO: 523629 - RNA, 22 nt, Human
aaauguuccggguaaggagaaa

SEQ ID NO: 523630 - RNA, 22 nt, Human
gccacacugcuucuuugagccu

SEQ ID NO: 523631 - RNA, 22 nt, Human
agaggcucuggugcagcaugca

SEQ ID NO: 523632 - RNA, 22 nt, Human
ucugggagaagcugaugugaag

SEQ ID NO: 523633 - RNA, 21 nt, Human
guccagagagccggcuccuga

SEQ ID NO: 523634 - RNA, 22 nt, Human
guugaaugaaucauucuaugua

SEQ ID NO: 523635 - RNA, 22 nt, Human
uggcagguagucagaggcgaca

SEQ ID NO: 523636 - RNA, 22 nt, Human
uugcugaaguugcucagcucca

SEQ ID NO: 523637 - RNA, 22 nt, Human
ucuuuccuguaacugcuguuca

SEQ ID NO: 523638 - RNA, 22 nt, Human
acaggugucuaaggcagacagc

SEQ ID NO: 523639 - RNA, 22 nt, Human
aaauagcagcuuugacagcaca

SEQ ID NO: 523640 - RNA, 22 nt, Human
gcucagaaaagugaggcucagu

SEQ ID NO: 523641 - RNA, 22 nt, Human
aagcuucauauaugugugaguc

SEQ ID NO: 523642 - RNA, 22 nt, Human
uccugggcaaagaggggcagug

SEQ ID NO: 523643 - RNA, 22 nt, Human
agaaggguguauacauuuccug

SEQ ID NO: 523644 - RNA, 22 nt, Human
cagaggcuaagaugagugggug

SEQ ID NO: 523645 - RNA, 22 nt, Human
aacuucuugguccugagcuguu

SEQ ID NO: 523646 - RNA, 22 nt, Human
acacauaagaaacuacaaagag

SEQ ID NO: 523647 - RNA, 22 nt, Human
ggagggagcauccccuugcuga

SEQ ID NO: 523648 - RNA, 22 nt, Human
aaaaugugaucuacaaaugcaa

SEQ ID NO: 523649 - RNA, 22 nt, Human
gaacagcagcucguucucgaug

SEQ ID NO: 523650 - RNA, 22 nt, Human
aacucaguguguuucuuaguau

SEQ ID NO: 523651 - RNA, 22 nt, Human
agagagcauugaggaaaucuuc

SEQ ID NO: 523652 - RNA, 22 nt, Human
gaacaguaucaguagugccagu

SEQ ID NO: 523653 - RNA, 22 nt, Human
gccucugcggagcuguacauca

SEQ ID NO: 523654 - RNA, 21 nt, Human
gcagagccugagguucuugag

SEQ ID NO: 523655 - RNA, 22 nt, Human
ucagcaggcaggaggcaugcca

SEQ ID NO: 523656 - RNA, 22 nt, Human
ugcauuaagcacacuuuugaau

SEQ ID NO: 523657 - RNA, 22 nt, Human
agaugguuuugucuuuaugauu

SEQ ID NO: 523658 - RNA, 22 nt, Human
aaaagcaucucaaaggagcuuc

SEQ ID NO: 523659 - RNA, 18 nt, Human
cucauguguggucccagc

SEQ ID NO: 523660 - RNA, 23 nt, Human
cauaaaauauuaguaugguagca

SEQ ID NO: 523661 - RNA, 22 nt, Human
ugggaaugugagcauucauuca

SEQ ID NO: 523662 - RNA, 22 nt, Human
cuauuugucaguuuggcuuuaa

SEQ ID NO: 523663 - RNA, 22 nt, Human
gagaggcuaugagguucugugu

SEQ ID NO: 523664 - RNA, 22 nt, Human
gagggcucuaccaaguaacucu

SEQ ID NO: 523665 - RNA, 22 nt, Human
uuuucacauugucccagcacua

SEQ ID NO: 523666 - RNA, 22 nt, Human
aaaguagaggcauugaucaggu

SEQ ID NO: 523667 - RNA, 17 nt, Human
gagccacccugugcgag

SEQ ID NO: 523668 - RNA, 18 nt, Human
agcuggcccuggcugccg

SEQ ID NO: 523669 - RNA, 22 nt, Human
aaguuugagagccuuuaguaua

SEQ ID NO: 523670 - RNA, 22 nt, Human
agaaaugaauauguagugguua

SEQ ID NO: 523671 - RNA, 22 nt, Human
uaaaucuccuguuuuucaucua

SEQ ID NO: 523672 - RNA, 22 nt, Human
caggcagcauuuacucugauga

SEQ ID NO: 523673 - RNA, 22 nt, Human
uggccugucuuguugugcuaga

SEQ ID NO: 523674 - RNA, 22 nt, Human
auggccaccaucucuaaaacac

SEQ ID NO: 523675 - RNA, 22 nt, Human
ggcuggaaaagacaaagcuauu

SEQ ID NO: 523676 - RNA, 22 nt, Human
ucuagaaauuuugccuuguauu

SEQ ID NO: 523677 - RNA, 22 nt, Human
gaggggccuggcacugagcugg

SEQ ID NO: 523678 - RNA, 22 nt, Human
uaggccaggacagagcuuccag

SEQ ID NO: 523679 - RNA, 20 nt, Human
cucugcagcaaggccugggu

SEQ ID NO: 523680 - RNA, 22 nt, Human
uucuagcaugccuuuuagcaca

SEQ ID NO: 523681 - RNA, 22 nt, Human
auaugaaguuacagguaagaaa

SEQ ID NO: 523682 - RNA, 22 nt, Human
caggccaggguugagaagagaa

SEQ ID NO: 523683 - RNA, 22 nt, Human
ccagaauccaaaacguuuugag

SEQ ID NO: 523684 - RNA, 22 nt, Human
aaacagaaggguagguaaacau

SEQ ID NO: 523685 - RNA, 22 nt, Human
uguacacaaccuacagucugcu

SEQ ID NO: 523686 - RNA, 22 nt, Human
uguggcuguggaugcuuuccag

SEQ ID NO: 523687 - RNA, 22 nt, Human
ucaaguauaucuagucauuagg

SEQ ID NO: 523688 - RNA, 22 nt, Human
gacauuucaaucucauuauggg

SEQ ID NO: 523689 - RNA, 20 nt, Human
cucuccuugccgacuuggca

SEQ ID NO: 523690 - RNA, 17 nt, Human
uguuccauuugaccacc

SEQ ID NO: 523691 - RNA, 22 nt, Human
aggcagaaaauagucauccaaa

SEQ ID NO: 523692 - RNA, 22 nt, Human
uucaugaauguuccaugugagu

SEQ ID NO: 523693 - RNA, 22 nt, Human
ugcaaaggaggaugggaaagaa

SEQ ID NO: 523694 - RNA, 22 nt, Human
agcauuaagagagacugaacug

SEQ ID NO: 523695 - RNA, 22 nt, Human
ucuggagaacuugcaagaggau

SEQ ID NO: 523696 - RNA, 22 nt, Human
ucucuuucuauugcaccaugcu

SEQ ID NO: 523697 - RNA, 22 nt, Human
aauccaauccuacucagaaagu

SEQ ID NO: 523698 - RNA, 17 nt, Human
ggccacagagcuugggg

SEQ ID NO: 523699 - RNA, 22 nt, Human
ggcccagcacagugcuuggggg

SEQ ID NO: 523700 - RNA, 22 nt, Human
ugacuuccugcacucaggugau

SEQ ID NO: 523701 - RNA, 22 nt, Human
agaaauguauucuguauguuuu

SEQ ID NO: 523702 - RNA, 22 nt, Human
accccagggcugccagccuccu

SEQ ID NO: 523703 - RNA, 22 nt, Human
guucacaguguuuucuuugcau

SEQ ID NO: 523704 - RNA, 22 nt, Human
uauuuguccuuauuaagaucug

SEQ ID NO: 523705 - RNA, 22 nt, Human
cauauucuuuaagcaaugcucu

SEQ ID NO: 523706 - RNA, 22 nt, Human
acacagggggcauucuaggagu

SEQ ID NO: 523707 - RNA, 22 nt, Human
acaaguaguaaauuauuaggug

SEQ ID NO: 523708 - RNA, 22 nt, Human
auuauuagauucuuaauuguaa

SEQ ID NO: 523709 - RNA, 22 nt, Human
ugcuucuguuuguuucugucau

SEQ ID NO: 523710 - RNA, 22 nt, Human
cagugcugacagggaggaaccu

SEQ ID NO: 523711 - RNA, 21 nt, Human
ucugagaacuucugcugcagc

SEQ ID NO: 523712 - RNA, 22 nt, Human
ucugggccaacccuuccauggg

SEQ ID NO: 523713 - RNA, 22 nt, Human
uccuggagcuggugucuuuccc

SEQ ID NO: 523714 - RNA, 22 nt, Human
auuuagugaccugaacugaaac

SEQ ID NO: 523715 - RNA, 22 nt, Human
acaaauuuauugaagggcauau

SEQ ID NO: 523716 - RNA, 22 nt, Human
gagacagcagggccagggccug

SEQ ID NO: 523717 - RNA, 22 nt, Human
ccaucagugaaggagacagauu

SEQ ID NO: 523718 - RNA, 22 nt, Human
aagcauaaaacguuacaacaug

SEQ ID NO: 523719 - RNA, 22 nt, Human
ugcauuccuccaccuccugcac

SEQ ID NO: 523720 - RNA, 22 nt, Human
cagcaguguggaagcugagggg

SEQ ID NO: 523721 - RNA, 22 nt, Human
ugcauuaaaaccaucgaccauc

SEQ ID NO: 523722 - RNA, 17 nt, Human
uuucuccuuccaucuca

SEQ ID NO: 523723 - RNA, 22 nt, Human
ucuggcccagccccugagguca

SEQ ID NO: 523724 - RNA, 22 nt, Human
ugaggcaggagaauggcgggaa

SEQ ID NO: 523725 - RNA, 22 nt, Human
gcuucagccgggcacuuaauga

SEQ ID NO: 523726 - RNA, 22 nt, Human
ugaggagcaggguggcuuacuc

SEQ ID NO: 523727 - RNA, 23 nt, Human
auauuagggagauuagcccucua

SEQ ID NO: 523728 - RNA, 22 nt, Human
cucaggauauugggcuggagca

SEQ ID NO: 523729 - RNA, 22 nt, Human
agaaaaugugaacuugugaauu

SEQ ID NO: 523730 - RNA, 22 nt, Human
aguuuucaguaaauauuaguga

SEQ ID NO: 523731 - RNA, 22 nt, Human
gcagggacaucuuugucuagua

SEQ ID NO: 523732 - RNA, 22 nt, Human
acagccugagaguggagcuggc

SEQ ID NO: 523733 - RNA, 22 nt, Human
acagcauuuaaagaaaaugaac

SEQ ID NO: 523734 - RNA, 22 nt, Human
ugucccauggacacaacuucuu

SEQ ID NO: 523735 - RNA, 22 nt, Human
gagggagggacuagcauucucu

SEQ ID NO: 523736 - RNA, 22 nt, Human
gacccauauaggacccuccaaa

SEQ ID NO: 523737 - RNA, 22 nt, Human
uugccuugauucuucucaugug

SEQ ID NO: 523738 - RNA, 22 nt, Human
ccugccaggacauugcuugaag

SEQ ID NO: 523739 - RNA, 22 nt, Human
ggagccuuagacaucugauccu

SEQ ID NO: 523740 - RNA, 22 nt, Human
gccaggucucauaaaugcagcu

SEQ ID NO: 523741 - RNA, 22 nt, Human
cucuggaguucuucaagcuacu

SEQ ID NO: 523742 - RNA, 22 nt, Human
augcaaagcaccacacuaagau

SEQ ID NO: 523743 - RNA, 22 nt, Human
uuuugaaagccagguuuguaug

SEQ ID NO: 523744 - RNA, 22 nt, Human
aaagugcugggauuacaggcuu

SEQ ID NO: 523745 - RNA, 22 nt, Human
gcaggcuccaacuggaggaguu

SEQ ID NO: 523746 - RNA, 22 nt, Human
caaucacaaagagacaaguguc

SEQ ID NO: 523747 - RNA, 23 nt, Human
ugcagaggcaugaucacugcuca

SEQ ID NO: 523748 - RNA, 22 nt, Human
uuaaauauuauguugucugcaa

SEQ ID NO: 523749 - RNA, 22 nt, Human
auaguguuacccuucuuaaagu

SEQ ID NO: 523750 - RNA, 22 nt, Human
cauaaauuguacccauuccaac

SEQ ID NO: 523751 - RNA, 22 nt, Human
gccugccucaaaaucccaguuc

SEQ ID NO: 523752 - RNA, 22 nt, Human
aguuuagacaaagucuugcauu

SEQ ID NO: 523753 - RNA, 22 nt, Human
ucugggccuauagaagucuacc

SEQ ID NO: 523754 - RNA, 21 nt, Human
agcaggaggcagucacagcuc

SEQ ID NO: 523755 - RNA, 22 nt, Human
auguguauccaucugucuauuu

SEQ ID NO: 523756 - RNA, 22 nt, Human
ccuucuccugccuuggguucau

SEQ ID NO: 523757 - RNA, 22 nt, Human
cagcagcucccauccgcugagc

SEQ ID NO: 523758 - RNA, 22 nt, Human
caggggccaaggguccagaccu

SEQ ID NO: 523759 - RNA, 22 nt, Human
caucacugacgcugagauucca

SEQ ID NO: 523760 - RNA, 22 nt, Human
gucugggcagcagcauuucuua

SEQ ID NO: 523761 - RNA, 22 nt, Human
aguccaggcauuccagccauuc

SEQ ID NO: 523762 - RNA, 22 nt, Human
guccaggaaucaaaagauggaa

SEQ ID NO: 523763 - RNA, 22 nt, Human
guggcagcaaaauccugcauuc

SEQ ID NO: 523764 - RNA, 22 nt, Human
uuuuuuguuggguagaacggaa

SEQ ID NO: 523765 - RNA, 22 nt, Human
acucagaguuugcguuccauac

SEQ ID NO: 523766 - RNA, 22 nt, Human
ccaggcagagggauccccaucc

SEQ ID NO: 523767 - RNA, 22 nt, Human
agagcuaggaaugaccacucuc

SEQ ID NO: 523768 - RNA, 22 nt, Human
acagaauaguuggcccugcuau

SEQ ID NO: 523769 - RNA, 22 nt, Human
cuggcaggaagaggaaagguca

SEQ ID NO: 523770 - RNA, 20 nt, Human
aaguuacauuguauuguacc

SEQ ID NO: 523771 - RNA, 22 nt, Human
auuuaacaagacagagaacugg

SEQ ID NO: 523772 - RNA, 22 nt, Human
ggcaaguaauacaggauuauuu

SEQ ID NO: 523773 - RNA, 22 nt, Human
agagaugucgccuugcccaggg

SEQ ID NO: 523774 - RNA, 21 nt, Human
uggccaaaaccauauuauuaa

SEQ ID NO: 523775 - RNA, 22 nt, Human
aaagaugucaguuugaaauaac

SEQ ID NO: 523776 - RNA, 22 nt, Human
cugugccuccagucucgcuucu

SEQ ID NO: 523777 - RNA, 16 nt, Human
aggaggggaauuagga

SEQ ID NO: 523778 - RNA, 22 nt, Human
aaugcacaaaaauuguauguaa

SEQ ID NO: 523779 - RNA, 22 nt, Human
gggcacagcugcuacccagugc

SEQ ID NO: 523780 - RNA, 22 nt, Human
uuucuaagaauauugcucuuaa

SEQ ID NO: 523781 - RNA, 22 nt, Human
aggcacugaaggaagcuugcgc

SEQ ID NO: 523782 - RNA, 22 nt, Human
aucaaaauggaagaauuuggcu

SEQ ID NO: 523783 - RNA, 22 nt, Human
gucccugcccuccugggacuca

SEQ ID NO: 523784 - RNA, 22 nt, Human
ugaauggucacugagcaucugu

SEQ ID NO: 523785 - RNA, 22 nt, Human
ccucaggauacaggagccacag

SEQ ID NO: 523786 - RNA, 22 nt, Human
ggauucugccuuguugcuucaa

SEQ ID NO: 523787 - RNA, 20 nt, Human
ucagaggcugccagcugggg

SEQ ID NO: 523788 - RNA, 22 nt, Human
uuaggcaugcaagauuaagcuc

SEQ ID NO: 523789 - RNA, 22 nt, Human
guugcugauggcaagauuccag

SEQ ID NO: 523790 - RNA, 22 nt, Human
ccugggcucgcgcacuucaccc

SEQ ID NO: 523791 - RNA, 22 nt, Human
aauauuuaugacaggaaguagc

SEQ ID NO: 523792 - RNA, 22 nt, Human
ccagccuccauguagauagcug

SEQ ID NO: 523793 - RNA, 22 nt, Human
agcugguucacuaagcauaaua

SEQ ID NO: 523794 - RNA, 22 nt, Human
aggccucaguuugucaucugua

SEQ ID NO: 523795 - RNA, 22 nt, Human
uuaugaaggaucagguacuugg

SEQ ID NO: 523796 - RNA, 22 nt, Human
aaagcucuuuuccaaguauuga

SEQ ID NO: 523797 - RNA, 21 nt, Human
uauuaauaugucuaagcugau

SEQ ID NO: 523798 - RNA, 22 nt, Human
gagccuggacaucucaggccca

SEQ ID NO: 523799 - RNA, 22 nt, Human
augucuuuauuaauaucaugcc

SEQ ID NO: 523800 - RNA, 22 nt, Human
cuggcuccaaauucugauguuc

SEQ ID NO: 523801 - RNA, 22 nt, Human
uucugggcauguuacauucugu

SEQ ID NO: 523802 - RNA, 22 nt, Human
ugggacacccucacgccugcac

SEQ ID NO: 523803 - RNA, 22 nt, Human
agggcagcacaaggcauggacu

SEQ ID NO: 523804 - RNA, 22 nt, Human
uacaguaacauguuguacaagc

SEQ ID NO: 523805 - RNA, 22 nt, Human
uccugcaguuacaucccagcca

SEQ ID NO: 523806 - RNA, 22 nt, Human
uccugggccaagggcugugagg

SEQ ID NO: 523807 - RNA, 22 nt, Human
ugaggggcgcuggcagguuccu

SEQ ID NO: 523808 - RNA, 22 nt, Human
acucuggccccaggaucugugu

SEQ ID NO: 523809 - RNA, 22 nt, Human
uaggccagaggagcagcuuugg

SEQ ID NO: 523810 - RNA, 22 nt, Human
uccagggaagagcagaggcuac

SEQ ID NO: 523811 - RNA, 22 nt, Human
acaauguaggauauguacuugu

SEQ ID NO: 523812 - RNA, 22 nt, Human
ggacacaaaagugaauaaaaua

SEQ ID NO: 523813 - RNA, 17 nt, Human
cugucugcugcuuccuc

SEQ ID NO: 523814 - RNA, 22 nt, Human
caggcaugaucauaggaguuua

SEQ ID NO: 523815 - RNA, 22 nt, Human
aauggagacuucaaaauggauu

SEQ ID NO: 523816 - RNA, 22 nt, Human
acaaugcaccagcaucuucacc

SEQ ID NO: 523817 - RNA, 22 nt, Human
ccacagaguuacaaaacaguca

SEQ ID NO: 523818 - RNA, 22 nt, Human
gaccuggcuuugggccccggca

SEQ ID NO: 523819 - RNA, 22 nt, Human
cuguggcugcguaggucuggca

SEQ ID NO: 523820 - RNA, 19 nt, Human
aggcagaggcuuggcuagc

SEQ ID NO: 523821 - RNA, 21 nt, Human
aggugccaaggagaagcaggc

SEQ ID NO: 523822 - RNA, 22 nt, Human
ugccuucaccaggccuucagcc

SEQ ID NO: 523823 - RNA, 22 nt, Human
caaaugcaggucagcagguguc

SEQ ID NO: 523824 - RNA, 22 nt, Human
caggcccucgcccgcagcgacc

SEQ ID NO: 523825 - RNA, 22 nt, Human
aaagaacagauguguggugcau

SEQ ID NO: 523826 - RNA, 22 nt, Human
cuguccugcccacccugcaggg

SEQ ID NO: 523827 - RNA, 22 nt, Human
acagacauuuuaagacacuuua

SEQ ID NO: 523828 - RNA, 22 nt, Human
acaugcaugucuaugggcaggu

SEQ ID NO: 523829 - RNA, 22 nt, Human
aaugucaaaauggaaugagacu

SEQ ID NO: 523830 - RNA, 23 nt, Human
cccagagcacagccuccagaugc

SEQ ID NO: 523831 - RNA, 22 nt, Human
cuuugaaaacacacgaauagac

SEQ ID NO: 523832 - RNA, 22 nt, Human
ugcacuuuuauaucacucuggc

SEQ ID NO: 523833 - RNA, 22 nt, Human
agggcagcacagcugugcuccu

SEQ ID NO: 523834 - RNA, 22 nt, Human
ucuguggcuguuaucuuuauau

SEQ ID NO: 523835 - RNA, 23 nt, Human
caugggagugagaaugccagcuc

SEQ ID NO: 523836 - RNA, 22 nt, Human
ucaggauguuaauauagcauua

SEQ ID NO: 523837 - RNA, 22 nt, Human
agcugccuguccuaggccauca

SEQ ID NO: 523838 - RNA, 22 nt, Human
cagagcagaagcgguccucaca

SEQ ID NO: 523839 - RNA, 22 nt, Human
aagccucuggggccucaucugu

SEQ ID NO: 523840 - RNA, 22 nt, Human
agggggcuggagacaccuccuc

SEQ ID NO: 523841 - RNA, 22 nt, Human
aggauuuaaucaguuggcauuu

SEQ ID NO: 523842 - RNA, 22 nt, Human
agcagggaggcccagggcacug

SEQ ID NO: 523843 - RNA, 22 nt, Human
ucucaggaagugauauugagac

SEQ ID NO: 523844 - RNA, 23 nt, Human
ggguccagagaagccauuagggc

SEQ ID NO: 523845 - RNA, 22 nt, Human
aggucugucuggccccaugaau

SEQ ID NO: 523846 - RNA, 22 nt, Human
cuggggacucauucagagcaua

SEQ ID NO: 523847 - RNA, 22 nt, Human
gacaagacagcuugcagacaac

SEQ ID NO: 523848 - RNA, 22 nt, Human
gagagcuggauucuggauaggu

SEQ ID NO: 523849 - RNA, 22 nt, Human
ccuggcugaacaaagucccucc

SEQ ID NO: 523850 - RNA, 22 nt, Human
ccugggcuuucaaaaccagccu

SEQ ID NO: 523851 - RNA, 22 nt, Human
auaaaaacugacccauccuuug

SEQ ID NO: 523852 - RNA, 22 nt, Human
agaugcugugucuguucccuug

SEQ ID NO: 523853 - RNA, 22 nt, Human
gcagcucccaucagggcacaga

SEQ ID NO: 523854 - RNA, 18 nt, Human
agugucuggauauuuggg

SEQ ID NO: 523855 - RNA, 18 nt, Human
ucugucuguacaaguauc

SEQ ID NO: 523856 - RNA, 22 nt, Human
aaaaguauuuuggaucucagau

SEQ ID NO: 523857 - RNA, 22 nt, Human
uauaauccauucauugauuucu

SEQ ID NO: 523858 - RNA, 22 nt, Human
ugaggccugaagccuggagccu

SEQ ID NO: 523859 - RNA, 17 nt, Human
cagugcagagcccuuuc

SEQ ID NO: 523860 - RNA, 22 nt, Human
auaacaugaccugugcuucaca

SEQ ID NO: 523861 - RNA, 22 nt, Human
aauaauguugacgauagucuua

SEQ ID NO: 523862 - RNA, 22 nt, Human
gccuggcaaggcccuguugacu

SEQ ID NO: 523863 - RNA, 22 nt, Human
gcugccucaggcaccuccuggc

SEQ ID NO: 523864 - RNA, 22 nt, Human
aggucagaagugccagggaauu

SEQ ID NO: 523865 - RNA, 22 nt, Human
uugacagcuauuuugcuuugau

SEQ ID NO: 523866 - RNA, 22 nt, Human
aaaggaggccacauggcuagga

SEQ ID NO: 523867 - RNA, 22 nt, Human
cacagagacagaagcacuuaug

SEQ ID NO: 523868 - RNA, 22 nt, Human
agagccagaccauugccgugca

SEQ ID NO: 523869 - RNA, 22 nt, Human
gagagguagcaguaagaacagg

SEQ ID NO: 523870 - RNA, 22 nt, Human
uggcugcuuguuuuagugaggc

SEQ ID NO: 523871 - RNA, 22 nt, Human
gacccuccacucacugcugugu

SEQ ID NO: 523872 - RNA, 22 nt, Human
acauuaucccuggcacaacugc

SEQ ID NO: 523873 - RNA, 22 nt, Human
ugagugaggaagcgguggagga

SEQ ID NO: 523874 - RNA, 22 nt, Human
auccugggcagugugucacucu

SEQ ID NO: 523875 - RNA, 22 nt, Human
ccuccagcugccucagucucuu

SEQ ID NO: 523876 - RNA, 22 nt, Human
uaugagaaaauaaauaucuguu

SEQ ID NO: 523877 - RNA, 22 nt, Human
ucucagagugacaaugagaauu

SEQ ID NO: 523878 - RNA, 22 nt, Human
cugggugucaggagacaugaug

SEQ ID NO: 523879 - RNA, 21 nt, Human
aggguccuacagggcucagga

SEQ ID NO: 523880 - RNA, 22 nt, Human
uuuaaaaaacuagucugagucu

SEQ ID NO: 523881 - RNA, 22 nt, Human
cccuuccucccaggcuucugug

SEQ ID NO: 523882 - RNA, 22 nt, Human
aauguuguuuuucugcaugucu

SEQ ID NO: 523883 - RNA, 22 nt, Human
agggccugagaccguggcuuga

SEQ ID NO: 523884 - RNA, 22 nt, Human
aguagaauguucuaugucaaug

SEQ ID NO: 523885 - RNA, 22 nt, Human
ugauggcuaucccuggaagggc

SEQ ID NO: 523886 - RNA, 22 nt, Human
uauuuagugauagaagcaagga

SEQ ID NO: 523887 - RNA, 22 nt, Human
gaggucaggcuugcagcagggu

SEQ ID NO: 523888 - RNA, 20 nt, Human
cugaagagacuggaggggca

SEQ ID NO: 523889 - RNA, 22 nt, Human
cugucuuuuacuaucauuuacu

SEQ ID NO: 523890 - RNA, 20 nt, Human
caggucuucauguggcuguc

SEQ ID NO: 523891 - RNA, 22 nt, Human
gcuggccucuacaggccggcca

SEQ ID NO: 523892 - RNA, 22 nt, Human
uggcucagauuuuuguaggcuu

SEQ ID NO: 523893 - RNA, 23 nt, Human
agaugagccaacaccuccaugcc

SEQ ID NO: 523894 - RNA, 22 nt, Human
caguacugcuugugggagcaga

SEQ ID NO: 523895 - RNA, 22 nt, Human
cugaggcagagggcagaccaga

SEQ ID NO: 523896 - RNA, 22 nt, Human
ugcugaaugguaaagaaguaua

SEQ ID NO: 523897 - RNA, 22 nt, Human
ugcucugaaggggaagggaugg

SEQ ID NO: 523898 - RNA, 22 nt, Human
aauguguauaugaacauacagg

SEQ ID NO: 523899 - RNA, 19 nt, Human
agaggcaaggguggaagua

SEQ ID NO: 523900 - RNA, 21 nt, Human
uaaauaauaaguugcugagau

SEQ ID NO: 523901 - RNA, 22 nt, Human
agggaucacgguggacuuggau

SEQ ID NO: 523902 - RNA, 22 nt, Human
aggcucagaggugagcaucugc

SEQ ID NO: 523903 - RNA, 22 nt, Human
caggugaaaaagcaaccauauu

SEQ ID NO: 523904 - RNA, 22 nt, Human
acagaggccucguagguacaac

SEQ ID NO: 523905 - RNA, 18 nt, Human
guucaaggucaagagaga

SEQ ID NO: 523906 - RNA, 22 nt, Human
uucugggcucccacauauuuca

SEQ ID NO: 523907 - RNA, 22 nt, Human
gcuggcucccagaggccccagc

SEQ ID NO: 523908 - RNA, 22 nt, Human
acauguguggacaugaaucuac

SEQ ID NO: 523909 - RNA, 22 nt, Human
augcauaauguauguauugacu

SEQ ID NO: 523910 - RNA, 22 nt, Human
ugaggccaaugacccugggcag

SEQ ID NO: 523911 - RNA, 22 nt, Human
aaacuuuaagacaguccucaag

SEQ ID NO: 523912 - RNA, 22 nt, Human
gggcugcuuccuggggaaugcu

SEQ ID NO: 523913 - RNA, 22 nt, Human
cagaugugccuccagggcuuug

SEQ ID NO: 523914 - RNA, 22 nt, Human
ucuuagaaugucaacugauguu

SEQ ID NO: 523915 - RNA, 22 nt, Human
aaaaagguugauccagauuagg

SEQ ID NO: 523916 - RNA, 22 nt, Human
cuugccuucuuuuccuauagaa

SEQ ID NO: 523917 - RNA, 21 nt, Human
gcacagugccaggcacacagu

SEQ ID NO: 523918 - RNA, 22 nt, Human
gaugcaaacugugacauagagu

SEQ ID NO: 523919 - RNA, 22 nt, Human
cacucuccagcacaccccauuu

SEQ ID NO: 523920 - RNA, 22 nt, Human
gcugggcucauuugugugucug

SEQ ID NO: 523921 - RNA, 22 nt, Human
gugugcagggggccagcgcagc

SEQ ID NO: 523922 - RNA, 22 nt, Human
caggguccaucuuucaucacug

SEQ ID NO: 523923 - RNA, 22 nt, Human
cccagcucuggaagguggggga

SEQ ID NO: 523924 - RNA, 20 nt, Human
agucccaacauucagcucug

SEQ ID NO: 523925 - RNA, 22 nt, Human
cucaggagaugacagaagguau

SEQ ID NO: 523926 - RNA, 22 nt, Human
cugucugucaccaaaacagacu

SEQ ID NO: 523927 - RNA, 22 nt, Human
cccuggaguccuggcaguugau

SEQ ID NO: 523928 - RNA, 22 nt, Human
gcucagcugagcgaaggacaug

SEQ ID NO: 523929 - RNA, 22 nt, Human
gagcugaguuaccuccagauca

SEQ ID NO: 523930 - RNA, 17 nt, Human
ggcagcugugugcaugc

SEQ ID NO: 523931 - RNA, 22 nt, Human
cccagcuugcccaggacugagg

SEQ ID NO: 523932 - RNA, 22 nt, Human
ugugucugcacugaguccucac

SEQ ID NO: 523933 - RNA, 22 nt, Human
gcaccuggcugcccagguggag

SEQ ID NO: 523934 - RNA, 22 nt, Human
cugaggacauugaugaggcaau

SEQ ID NO: 523935 - RNA, 22 nt, Human
auauauuuugcggucacguggc

SEQ ID NO: 523936 - RNA, 22 nt, Human
guuuauuagaguuuucugucug

SEQ ID NO: 523937 - RNA, 22 nt, Human
gccuucaguagugucagcugua

SEQ ID NO: 523938 - RNA, 22 nt, Human
auaaggcaucucucaguuagca

SEQ ID NO: 523939 - RNA, 22 nt, Human
gagagugaaggcuucccagcaa

SEQ ID NO: 523940 - RNA, 22 nt, Human
agaggcugaaugaugucaucau

SEQ ID NO: 523941 - RNA, 22 nt, Human
gagagugaggcaucaggggcag

SEQ ID NO: 523942 - RNA, 22 nt, Human
uugaagauaggccaggaugagc

SEQ ID NO: 523943 - RNA, 22 nt, Human
uguguucugaaggagaagagug

SEQ ID NO: 523944 - RNA, 22 nt, Human
ugaacauauucaccucuaaaua

SEQ ID NO: 523945 - RNA, 22 nt, Human
uucauuacugcgguagucacac

SEQ ID NO: 523946 - RNA, 22 nt, Human
gcucuguguugucagaggcacc

SEQ ID NO: 523947 - RNA, 17 nt, Human
agcacuaaaaugcuucc

SEQ ID NO: 523948 - RNA, 21 nt, Human
aguuugaugcaauuucugaga

SEQ ID NO: 523949 - RNA, 22 nt, Human
auggacaggcugagcuuccuca

SEQ ID NO: 523950 - RNA, 22 nt, Human
caggcagcagaggaguguggga

SEQ ID NO: 523951 - RNA, 22 nt, Human
caggauggagggagggcuguua

SEQ ID NO: 523952 - RNA, 22 nt, Human
auuucuaaagagggugguuugg

SEQ ID NO: 523953 - RNA, 22 nt, Human
agaauacaauuguucaguaaua

SEQ ID NO: 523954 - RNA, 22 nt, Human
uuaugcaaaggggccucuuccu

SEQ ID NO: 523955 - RNA, 22 nt, Human
ucuguacuuuuauuuuggcacu

SEQ ID NO: 523956 - RNA, 22 nt, Human
cagagagagugggguguggauu

SEQ ID NO: 523957 - RNA, 22 nt, Human
uccagccaugacucggacagug

SEQ ID NO: 523958 - RNA, 22 nt, Human
uguguauucagcaagcgaaaca

SEQ ID NO: 523959 - RNA, 22 nt, Human
uuuauuuauaagccacuugcug

SEQ ID NO: 523960 - RNA, 22 nt, Human
uagaugauuuucagucaaagca

SEQ ID NO: 523961 - RNA, 22 nt, Human
ucagaagcagauauuucaaaau

SEQ ID NO: 523962 - RNA, 19 nt, Human
acaggggcuagcggaagca

SEQ ID NO: 523963 - RNA, 22 nt, Human
ucucugggaucagguggcccag

SEQ ID NO: 523964 - RNA, 22 nt, Human
caggcugcagcagcaguggccc

SEQ ID NO: 523965 - RNA, 22 nt, Human
ucucagaggugcccuggcaucu

SEQ ID NO: 523966 - RNA, 22 nt, Human
agugcuccuauggaucaguugu

SEQ ID NO: 523967 - RNA, 21 nt, Human
gagcugggcgaggcuccgggg

SEQ ID NO: 523968 - RNA, 22 nt, Human
gcaggcuccaggccggccccuu

SEQ ID NO: 523969 - RNA, 22 nt, Human
gacagcuucgaggaggugagcu

SEQ ID NO: 523970 - RNA, 22 nt, Human
cacaggcuccggccuugcagcc

SEQ ID NO: 523971 - RNA, 22 nt, Human
uacagauacagaucuagauaca

SEQ ID NO: 523972 - RNA, 22 nt, Human
auguaucagaaauagcauuggc

SEQ ID NO: 523973 - RNA, 22 nt, Human
agcugccauggccugaauuuac

SEQ ID NO: 523974 - RNA, 22 nt, Human
agugaaaacacuaguucuugcc

SEQ ID NO: 523975 - RNA, 23 nt, Human
gcugacugugaaauucuggagcu

SEQ ID NO: 523976 - RNA, 20 nt, Human
gcuucucagggcuucucuga

SEQ ID NO: 523977 - RNA, 22 nt, Human
acaggcuucucacagaaaaggg

SEQ ID NO: 523978 - RNA, 22 nt, Human
agccagcaucccuucagucucc

SEQ ID NO: 523979 - RNA, 22 nt, Human
uggcagguuucguuaaaaaugg

SEQ ID NO: 523980 - RNA, 19 nt, Human
uggaggagaggaaaaguca

SEQ ID NO: 523981 - RNA, 21 nt, Human
cuggacugaggagacagucgc

SEQ ID NO: 523982 - RNA, 22 nt, Human
agaggaugauuuuaaggacacu

SEQ ID NO: 523983 - RNA, 18 nt, Human
gugagcagagagcaucac

SEQ ID NO: 523984 - RNA, 22 nt, Human
uuuacaagaaaucaugaugcua

SEQ ID NO: 523985 - RNA, 22 nt, Human
acuagaaaguuuccagaguuau

SEQ ID NO: 523986 - RNA, 22 nt, Human
auaguaacuggcauguuuauga

SEQ ID NO: 523987 - RNA, 22 nt, Human
aguggcagagugcacucaggca

SEQ ID NO: 523988 - RNA, 22 nt, Human
ugacuugucucuuugggagaca

SEQ ID NO: 523989 - RNA, 22 nt, Human
uggccaggccucuuggugccca

SEQ ID NO: 523990 - RNA, 22 nt, Human
ugcccugggaguuggagcugcu

SEQ ID NO: 523991 - RNA, 22 nt, Human
uccagggcuguuacuuuacaua

SEQ ID NO: 523992 - RNA, 22 nt, Human
ugcacacacaugaaguagcaug

SEQ ID NO: 523993 - RNA, 22 nt, Human
acuaaauaguuuugacagaaca

SEQ ID NO: 523994 - RNA, 23 nt, Human
agcuggaggcugucuacucccaa

SEQ ID NO: 523995 - RNA, 17 nt, Human
uggcacagaggugcuau

SEQ ID NO: 523996 - RNA, 19 nt, Human
uccucugguaccacccuug

SEQ ID NO: 523997 - RNA, 22 nt, Human
caaacauugcuaccagagguuu

SEQ ID NO: 523998 - RNA, 22 nt, Human
uaaguuuaaauguacaugaagc

SEQ ID NO: 523999 - RNA, 22 nt, Human
gcccagcacuaaaagcuuugcu

SEQ ID NO: 524000 - RNA, 22 nt, Human
gcuucuggaagcauaugcaaga

SEQ ID NO: 524001 - RNA, 22 nt, Human
uugcugaaguauugugaauccu

SEQ ID NO: 524002 - RNA, 18 nt, Human
aggcacuggaauuaaggg

SEQ ID NO: 524003 - RNA, 22 nt, Human
ucucagaauuguguccacuggg

SEQ ID NO: 524004 - RNA, 22 nt, Human
ucucaguggcuuccucacuuuu

SEQ ID NO: 524005 - RNA, 17 nt, Human
uuccaguuuaguauugu

SEQ ID NO: 524006 - RNA, 22 nt, Human
aggcuguuuuguauaaacugga

SEQ ID NO: 524007 - RNA, 22 nt, Human
aaggcaguaaaaucuaccuugc

SEQ ID NO: 524008 - RNA, 19 nt, Human
auguaugaggucuucugcu

SEQ ID NO: 524009 - RNA, 22 nt, Human
auguagcaugaggcacugugcc

SEQ ID NO: 524010 - RNA, 22 nt, Human
agggaaacuagacugccuuucu

SEQ ID NO: 524011 - RNA, 22 nt, Human
auguacauuuguaguaauauca

SEQ ID NO: 524012 - RNA, 22 nt, Human
cuggccugagaaugcuacccuu

SEQ ID NO: 524013 - RNA, 22 nt, Human
acagaggcugcgcuugggaacg

SEQ ID NO: 524014 - RNA, 22 nt, Human
caggaaaauggaaucaccugua

SEQ ID NO: 524015 - RNA, 22 nt, Human
ggcugccaggagaagcucagug

SEQ ID NO: 524016 - RNA, 22 nt, Human
caaggccaguucaccaagggca

SEQ ID NO: 524017 - RNA, 22 nt, Human
cugugcuuucgagaugugaucu

SEQ ID NO: 524018 - RNA, 22 nt, Human
agcuguggcagcagccguggca

SEQ ID NO: 524019 - RNA, 22 nt, Human
aaaaguuaccucuguaauauaa

SEQ ID NO: 524020 - RNA, 22 nt, Human
aucaggaaagaguggaacucug

SEQ ID NO: 524021 - RNA, 22 nt, Human
uagacauuggccauuccugugg

SEQ ID NO: 524022 - RNA, 20 nt, Human
uauuucugggcaaccauuua

SEQ ID NO: 524023 - RNA, 22 nt, Human
ccacaucauggauacaguuaug

SEQ ID NO: 524024 - RNA, 21 nt, Human
ugcuggccucaagggugacuu

SEQ ID NO: 524025 - RNA, 22 nt, Human
uccaggagguuuggaggaagca

SEQ ID NO: 524026 - RNA, 22 nt, Human
gagcugggcacacgccacuuga

SEQ ID NO: 524027 - RNA, 22 nt, Human
gggcuccaacuacaucagccuu

SEQ ID NO: 524028 - RNA, 22 nt, Human
cuggcagguccagcuggacuca

SEQ ID NO: 524029 - RNA, 22 nt, Human
ugauacccuuuggcugcgagca

SEQ ID NO: 524030 - RNA, 22 nt, Human
uuucagugcuucuguuuaccgg

SEQ ID NO: 524031 - RNA, 22 nt, Human
ugauagaaaaugcugucaagcu

SEQ ID NO: 524032 - RNA, 22 nt, Human
cccagacucaucccugggagcu

SEQ ID NO: 524033 - RNA, 22 nt, Human
auugcugaaaugaaaggauaug

SEQ ID NO: 524034 - RNA, 22 nt, Human
uuaaguccuugguaauuuucuu

SEQ ID NO: 524035 - RNA, 17 nt, Human
accagccucuccugggg

SEQ ID NO: 524036 - RNA, 22 nt, Human
gugcugucaauugcuuucagua

SEQ ID NO: 524037 - RNA, 22 nt, Human
aaagaauacuccuuuugccuug

SEQ ID NO: 524038 - RNA, 22 nt, Human
uggcucagaaggcugccuucac

SEQ ID NO: 524039 - RNA, 22 nt, Human
cagaaauguucuaaugauucag

SEQ ID NO: 524040 - RNA, 22 nt, Human
guccagagccggaagagugaca

SEQ ID NO: 524041 - RNA, 22 nt, Human
ggggacagucgaucuagugauu

SEQ ID NO: 524042 - RNA, 22 nt, Human
ucaggaucaggggccuuuccuu

SEQ ID NO: 524043 - RNA, 22 nt, Human
gcugaggcggaaggauugcuag

SEQ ID NO: 524044 - RNA, 22 nt, Human
acauguggucaaucuguguagg

SEQ ID NO: 524045 - RNA, 22 nt, Human
guagaggacauuugacaugaug

SEQ ID NO: 524046 - RNA, 22 nt, Human
agucucugcugguugugccuau

SEQ ID NO: 524047 - RNA, 22 nt, Human
acaggggauugauuggaagucu

SEQ ID NO: 524048 - RNA, 22 nt, Human
gggcacagucuaaaguugggcc

SEQ ID NO: 524049 - RNA, 22 nt, Human
gagcuguccuaccaggaguccu

SEQ ID NO: 524050 - RNA, 22 nt, Human
ugucauuuucuaaucuguuguc

SEQ ID NO: 524051 - RNA, 22 nt, Human
uagcaucagccacaccuuguac

SEQ ID NO: 524052 - RNA, 22 nt, Human
uuucagagcucuaggcucucag

SEQ ID NO: 524053 - RNA, 22 nt, Human
ccagugcauaaucaauacagcc

SEQ ID NO: 524054 - RNA, 22 nt, Human
gugggagaagauuuggucaucu

SEQ ID NO: 524055 - RNA, 22 nt, Human
ggguucagagucaggugugaua

SEQ ID NO: 524056 - RNA, 19 nt, Human
aggagaagacucucucccc

SEQ ID NO: 524057 - RNA, 23 nt, Human
ucagggacaugaugugucauauc

SEQ ID NO: 524058 - RNA, 21 nt, Human
uugcuguuuucccaaugcagu

SEQ ID NO: 524059 - RNA, 22 nt, Human
uugcacagugguuuagagccug

SEQ ID NO: 524060 - RNA, 20 nt, Human
uccaggcagcucagaguguc

SEQ ID NO: 524061 - RNA, 22 nt, Human
acuggggccuccuccaugcucu

SEQ ID NO: 524062 - RNA, 22 nt, Human
uagccucuggaauccuuucucu

SEQ ID NO: 524063 - RNA, 22 nt, Human
ucuugggagucccaggacauag

SEQ ID NO: 524064 - RNA, 22 nt, Human
ugggccacuugaaaguggaugu

SEQ ID NO: 524065 - RNA, 22 nt, Human
acagugcaaacccucgggaaag

SEQ ID NO: 524066 - RNA, 19 nt, Human
acuuucuccaggaccuguu

SEQ ID NO: 524067 - RNA, 22 nt, Human
cagcugggagcuccauuagaua

SEQ ID NO: 524068 - RNA, 22 nt, Human
gucccaggaacauucuggcuag

SEQ ID NO: 524069 - RNA, 22 nt, Human
uguuucuucucacacaaacuca

SEQ ID NO: 524070 - RNA, 22 nt, Human
guuccugaaagaugaguaauua

SEQ ID NO: 524071 - RNA, 22 nt, Human
ugcuucagaggaaaggcaaaag

SEQ ID NO: 524072 - RNA, 22 nt, Human
gccaggcagcaggaagccagug

SEQ ID NO: 524073 - RNA, 22 nt, Human
agugucauuccagggacccucg

SEQ ID NO: 524074 - RNA, 23 nt, Human
acauacauggagauaaagugaug

SEQ ID NO: 524075 - RNA, 22 nt, Human
aggguggagggagucccugagc

SEQ ID NO: 524076 - RNA, 22 nt, Human
ucaucaaagcgcuuggaguagg

SEQ ID NO: 524077 - RNA, 22 nt, Human
agguacagggugaaaguuuaug

SEQ ID NO: 524078 - RNA, 22 nt, Human
ucugaagagcuuuggaaguaug

SEQ ID NO: 524079 - RNA, 22 nt, Human
agaguuuguauuuuucagugaa

SEQ ID NO: 524080 - RNA, 22 nt, Human
caguggaggccuugggaccuuu

SEQ ID NO: 524081 - RNA, 22 nt, Human
uggugguuaugcgcuuuguggg

SEQ ID NO: 524082 - RNA, 19 nt, Human
guucaaacacugauucagc

SEQ ID NO: 524083 - RNA, 22 nt, Human
agggggcaggagagaccugcug

SEQ ID NO: 524084 - RNA, 22 nt, Human
aggcagugcagaguccucuucu

SEQ ID NO: 524085 - RNA, 22 nt, Human
ugcaccccauuuuacauuuaca

SEQ ID NO: 524086 - RNA, 22 nt, Human
aagguuaaauagguauuuucca

SEQ ID NO: 524087 - RNA, 22 nt, Human
uauuggugggggcagagagaga

SEQ ID NO: 524088 - RNA, 22 nt, Human
agaugacagcuacgggaugaaa

SEQ ID NO: 524089 - RNA, 22 nt, Human
acaggaaaugaaaugguaucua

SEQ ID NO: 524090 - RNA, 22 nt, Human
uuagauaauguagagauaugag

SEQ ID NO: 524091 - RNA, 22 nt, Human
cagucucucuccuugcaggcgu

SEQ ID NO: 524092 - RNA, 22 nt, Human
cagagcagggugcaccuugggc

SEQ ID NO: 524093 - RNA, 22 nt, Human
uucaggaaaugucugccuacca

SEQ ID NO: 524094 - RNA, 22 nt, Human
aacucaguucuuuccacaaugc

SEQ ID NO: 524095 - RNA, 22 nt, Human
guuuagaauucuaacuuuaagg

SEQ ID NO: 524096 - RNA, 22 nt, Human
cagcaugguggagcugcucuuu

SEQ ID NO: 524097 - RNA, 22 nt, Human
accaugaugcauccuuaaggaa

SEQ ID NO: 524098 - RNA, 22 nt, Human
ccugcagguugcagaggcggaa

SEQ ID NO: 524099 - RNA, 22 nt, Human
ggagacagugguagggccuaag

SEQ ID NO: 524100 - RNA, 22 nt, Human
aguuacaaccaugacacaagca

SEQ ID NO: 524101 - RNA, 22 nt, Human
cagugcaguugguggcaggggu

SEQ ID NO: 524102 - RNA, 22 nt, Human
uguuaaauguauuauguguucu

SEQ ID NO: 524103 - RNA, 22 nt, Human
gagccugaaauacaggucacug

SEQ ID NO: 524104 - RNA, 22 nt, Human
ugauauuuaagcaaaaauaugg

SEQ ID NO: 524105 - RNA, 22 nt, Human
uggcacagggcuuggucgcuca

SEQ ID NO: 524106 - RNA, 22 nt, Human
acucugaggagugacuagaggu

SEQ ID NO: 524107 - RNA, 22 nt, Human
gcacacagccagcugagggcua

SEQ ID NO: 524108 - RNA, 22 nt, Human
cuuugcaauagaggcacacaug

SEQ ID NO: 524109 - RNA, 22 nt, Human
aggccagggucccacacucgca

SEQ ID NO: 524110 - RNA, 22 nt, Human
acagagcacauagauuggaguu

SEQ ID NO: 524111 - RNA, 23 nt, Human
agcagggccagaauacuugcugu

SEQ ID NO: 524112 - RNA, 22 nt, Human
auuugccuuuuaaacucacaau

SEQ ID NO: 524113 - RNA, 22 nt, Human
ucucauguauugcccuggugug

SEQ ID NO: 524114 - RNA, 22 nt, Human
ccugugugucugucacugcaca

SEQ ID NO: 524115 - RNA, 22 nt, Human
cuauugaaaguguacaauucaa

SEQ ID NO: 524116 - RNA, 22 nt, Human
gagcuugguguuauuucugugg

SEQ ID NO: 524117 - RNA, 22 nt, Human
ugguggcuucugaggauggcga

SEQ ID NO: 524118 - RNA, 20 nt, Human
cucuggcuccgcgugaccgc

SEQ ID NO: 524119 - RNA, 22 nt, Human
gcuccagguauuugcccuuuua

SEQ ID NO: 524120 - RNA, 20 nt, Human
ucuguacacucaucuucugc

SEQ ID NO: 524121 - RNA, 22 nt, Human
uaaaucaguuucucuuauuggu

SEQ ID NO: 524122 - RNA, 22 nt, Human
guuuuauuuccaugagagaccg

SEQ ID NO: 524123 - RNA, 17 nt, Human
ugcacaagagacaauag

SEQ ID NO: 524124 - RNA, 22 nt, Human
aggacaguguggaagagggugc

SEQ ID NO: 524125 - RNA, 22 nt, Human
uuuggaaugaaacagcagagcc

SEQ ID NO: 524126 - RNA, 22 nt, Human
uauguguaaucaaacacaugcu

SEQ ID NO: 524127 - RNA, 22 nt, Human
ugguuacacagcauguggacuu

SEQ ID NO: 524128 - RNA, 22 nt, Human
ccuggcuguggcggugcucuca

SEQ ID NO: 524129 - RNA, 22 nt, Human
caaacauuccgcuucucccagg

SEQ ID NO: 524130 - RNA, 22 nt, Human
cugggcucugcaguugauguuu

SEQ ID NO: 524131 - RNA, 22 nt, Human
gggaccugaggcccugcuccac

SEQ ID NO: 524132 - RNA, 22 nt, Human
ucacagaacacaaaugccacuu

SEQ ID NO: 524133 - RNA, 18 nt, Human
gagagggaucccucagga

SEQ ID NO: 524134 - RNA, 22 nt, Human
uucauuccuucccuaagcaacu

SEQ ID NO: 524135 - RNA, 22 nt, Human
uggucugggcaaauccuucuga

SEQ ID NO: 524136 - RNA, 22 nt, Human
ugaggcagaaauuccuguuuuc

SEQ ID NO: 524137 - RNA, 22 nt, Human
gcuguucccauguggggcucag

SEQ ID NO: 524138 - RNA, 22 nt, Human
uaugcauaauuggauaaguaga

SEQ ID NO: 524139 - RNA, 22 nt, Human
agcugagcacauucaaacaggu

SEQ ID NO: 524140 - RNA, 22 nt, Human
gaggccugucgcuaggccucug

SEQ ID NO: 524141 - RNA, 22 nt, Human
cccugagagugagugccaccuu

SEQ ID NO: 524142 - RNA, 22 nt, Human
agugugggugagggaggcccuc

SEQ ID NO: 524143 - RNA, 22 nt, Human
cugaagcaaaugaaacagcucu

SEQ ID NO: 524144 - RNA, 20 nt, Human
cucaggauugucuagccccu

SEQ ID NO: 524145 - RNA, 22 nt, Human
ucugagggcuugaggggaagua

SEQ ID NO: 524146 - RNA, 22 nt, Human
auauguguauggauuucuaucu

SEQ ID NO: 524147 - RNA, 22 nt, Human
ccugcuuaacauugccaugaca

SEQ ID NO: 524148 - RNA, 22 nt, Human
uugaagauggaucgccacucuc

SEQ ID NO: 524149 - RNA, 22 nt, Human
uuugaacugauaaucuucuguu

SEQ ID NO: 524150 - RNA, 22 nt, Human
cucagggcuugaguguccagga

SEQ ID NO: 524151 - RNA, 23 nt, Human
ggcuggaagaaaacagaauuguu

SEQ ID NO: 524152 - RNA, 22 nt, Human
guggcugcagagggcacagcau

SEQ ID NO: 524153 - RNA, 22 nt, Human
cuacacaguucugccuaauggc

SEQ ID NO: 524154 - RNA, 22 nt, Human
gggcuuggcacaugggcucagc

SEQ ID NO: 524155 - RNA, 22 nt, Human
ccagaagcaaaacagacaguuu

SEQ ID NO: 524156 - RNA, 22 nt, Human
agccagggucucucgcucuguu

SEQ ID NO: 524157 - RNA, 22 nt, Human
uacuuuuuagcacagugugugc

SEQ ID NO: 524158 - RNA, 22 nt, Human
auucacaaaugcugccccauuc

SEQ ID NO: 524159 - RNA, 22 nt, Human
gggauggggucgggacccugcu

SEQ ID NO: 524160 - RNA, 22 nt, Human
guacuuccguggacuaauuguu

SEQ ID NO: 524161 - RNA, 22 nt, Human
cuggugccauucuguggccuag

SEQ ID NO: 524162 - RNA, 22 nt, Human
ggagccagaggcugcugcugug

SEQ ID NO: 524163 - RNA, 22 nt, Human
agaaaugacacacaugagacau

SEQ ID NO: 524164 - RNA, 22 nt, Human
ccauggccgccgcugcucagga

SEQ ID NO: 524165 - RNA, 22 nt, Human
uagcuuuaauaagcugcugaau

SEQ ID NO: 524166 - RNA, 22 nt, Human
cucugcugucucagaugggcca

SEQ ID NO: 524167 - RNA, 22 nt, Human
uccagaggcuccaaagggagau

SEQ ID NO: 524168 - RNA, 22 nt, Human
cugaaggacuuggugauaguug

SEQ ID NO: 524169 - RNA, 22 nt, Human
uuccaaaguuaguuauuagaaa

SEQ ID NO: 524170 - RNA, 22 nt, Human
auugaaagcacaaagaacaagu

SEQ ID NO: 524171 - RNA, 22 nt, Human
cuggggaccgagcaagcucugg

SEQ ID NO: 524172 - RNA, 22 nt, Human
caggggcugagaaggaacgucc

SEQ ID NO: 524173 - RNA, 22 nt, Human
ucauuuaauugguuuugcucgu

SEQ ID NO: 524174 - RNA, 22 nt, Human
ugcacaucuuucagcaucauac

SEQ ID NO: 524175 - RNA, 22 nt, Human
uaaacauuuguuauucuuguuu

SEQ ID NO: 524176 - RNA, 22 nt, Human
cugggucuucagcagcaggcgg

SEQ ID NO: 524177 - RNA, 21 nt, Human
gacacaaaggguaguaauggu

SEQ ID NO: 524178 - RNA, 22 nt, Human
augcccugcucucgggaaggga

SEQ ID NO: 524179 - RNA, 22 nt, Human
caggguggcacucagcgcaucu

SEQ ID NO: 524180 - RNA, 19 nt, Human
cuggaccuggaggcccgga

SEQ ID NO: 524181 - RNA, 22 nt, Human
cugaaugaaaucaaggacugag

SEQ ID NO: 524182 - RNA, 22 nt, Human
aguugacauccagagacauucu

SEQ ID NO: 524183 - RNA, 22 nt, Human
caaagauaaucacagaauaccc

SEQ ID NO: 524184 - RNA, 22 nt, Human
ggcaguguggccugaguaaguc

SEQ ID NO: 524185 - RNA, 22 nt, Human
ggcacugaaguggguguugggu

SEQ ID NO: 524186 - RNA, 22 nt, Human
caaaacugucuagagagagaag

SEQ ID NO: 524187 - RNA, 22 nt, Human
uauaucaccaaaaacaguucug

SEQ ID NO: 524188 - RNA, 22 nt, Human
uggcuggacagugggcagugga

SEQ ID NO: 524189 - RNA, 22 nt, Human
aggaaaaauaaggcagcagggc

SEQ ID NO: 524190 - RNA, 22 nt, Human
ggcauccaaauaccaagaugua

SEQ ID NO: 524191 - RNA, 22 nt, Human
cagggcacaguuauggaggugg

SEQ ID NO: 524192 - RNA, 22 nt, Human
uaguagcaaaacucaucucuuu

SEQ ID NO: 524193 - RNA, 22 nt, Human
caaaugaagaaccuucucaccu

SEQ ID NO: 524194 - RNA, 22 nt, Human
cauuucuguucucuuccuguac

SEQ ID NO: 524195 - RNA, 22 nt, Human
cccagcuccaagggacagcgaa

SEQ ID NO: 524196 - RNA, 22 nt, Human
ucacauaaauuuaccagaugau

SEQ ID NO: 524197 - RNA, 20 nt, Human
ugcacagcugugaauaggau

SEQ ID NO: 524198 - RNA, 22 nt, Human
aggcuggugccugcagugaauc

SEQ ID NO: 524199 - RNA, 22 nt, Human
gcuggcuguguuucaucucuga

SEQ ID NO: 524200 - RNA, 22 nt, Human
ucuuuccuaggugauaugcaau

SEQ ID NO: 524201 - RNA, 22 nt, Human
cuugcaggauuuugcugcugua

SEQ ID NO: 524202 - RNA, 22 nt, Human
gaugugaggugguaaacaggga

SEQ ID NO: 524203 - RNA, 22 nt, Human
uuuccuuccuugcuagccugag

SEQ ID NO: 524204 - RNA, 22 nt, Human
cucccaggcacagggaggagcc

SEQ ID NO: 524205 - RNA, 22 nt, Human
ugucacagggauaccauggggc

SEQ ID NO: 524206 - RNA, 22 nt, Human
ggacagaggguugacagaguau

SEQ ID NO: 524207 - RNA, 22 nt, Human
ccaggcagccaagugugugugu

SEQ ID NO: 524208 - RNA, 22 nt, Human
aucaguuuugggggacauacug

SEQ ID NO: 524209 - RNA, 23 nt, Human
aucagucuugguagcugugccca

SEQ ID NO: 524210 - RNA, 22 nt, Human
agcccagugggccgaggcgggg

SEQ ID NO: 524211 - RNA, 22 nt, Human
gcagcuggagcaucuucucauc

SEQ ID NO: 524212 - RNA, 22 nt, Human
ggcuuucuaugaacucaaaggc

SEQ ID NO: 524213 - RNA, 22 nt, Human
aucagagaaguuucacuggcau

SEQ ID NO: 524214 - RNA, 22 nt, Human
acgugcaggaucugguuggcga

SEQ ID NO: 524215 - RNA, 22 nt, Human
ggcgcucaguguugccccagag

SEQ ID NO: 524216 - RNA, 23 nt, Human
uccagggauuaaugaagucaguc

SEQ ID NO: 524217 - RNA, 22 nt, Human
uugcccuguggggccuccagcc

SEQ ID NO: 524218 - RNA, 22 nt, Human
uuaaauuaggacucuaguucug

SEQ ID NO: 524219 - RNA, 22 nt, Human
gacacagauaucucugagauua

SEQ ID NO: 524220 - RNA, 22 nt, Human
augaaaaguucgaucuagaagg

SEQ ID NO: 524221 - RNA, 22 nt, Human
uagguucagcuuucauccugaa

SEQ ID NO: 524222 - RNA, 22 nt, Human
gccugagcaggcguggaccaug

SEQ ID NO: 524223 - RNA, 22 nt, Human
uauuucuuguuauucucguuga

SEQ ID NO: 524224 - RNA, 20 nt, Human
uuauguguaccugugcuccc

SEQ ID NO: 524225 - RNA, 22 nt, Human
cucuggaguaagagcuaugaaa

SEQ ID NO: 524226 - RNA, 22 nt, Human
ucagagugugacuuggucauga

SEQ ID NO: 524227 - RNA, 19 nt, Human
aggcugugagggaggacuc

SEQ ID NO: 524228 - RNA, 22 nt, Human
guuugcauauuugcacaggaau

SEQ ID NO: 524229 - RNA, 22 nt, Human
ucaguguuuccuagagcauaua

SEQ ID NO: 524230 - RNA, 22 nt, Human
ugcaggcucaccugccagggcc

SEQ ID NO: 524231 - RNA, 22 nt, Human
ggaagaaaucugguuaagagau

SEQ ID NO: 524232 - RNA, 22 nt, Human
uagccauuuuuauuaaugcugg

SEQ ID NO: 524233 - RNA, 22 nt, Human
cucugggugucuuaggagcuca

SEQ ID NO: 524234 - RNA, 22 nt, Human
agaugaagauaucugcaggggc

SEQ ID NO: 524235 - RNA, 22 nt, Human
cagaccugggucccuggccugu

SEQ ID NO: 524236 - RNA, 22 nt, Human
agcagggcaaagucaggcuaac

SEQ ID NO: 524237 - RNA, 22 nt, Human
cugcuucugggaugauggagua

SEQ ID NO: 524238 - RNA, 22 nt, Human
uuaaagcaucacacuauuaauu

SEQ ID NO: 524239 - RNA, 22 nt, Human
aguuuggaagucaggcuuuucu

SEQ ID NO: 524240 - RNA, 22 nt, Human
gccaggugggagacagacagca

SEQ ID NO: 524241 - RNA, 22 nt, Human
uggguaaacugggucuggagag

SEQ ID NO: 524242 - RNA, 22 nt, Human
ugaggcagcauucuucaagaca

SEQ ID NO: 524243 - RNA, 17 nt, Human
aaucucaguggcuuaag

SEQ ID NO: 524244 - RNA, 22 nt, Human
caaaaugaugugauuuuauugu

SEQ ID NO: 524245 - RNA, 22 nt, Human
uauggcuggaauacugaaaggc

SEQ ID NO: 524246 - RNA, 22 nt, Human
gcaggaggaucacuugagccca

SEQ ID NO: 524247 - RNA, 22 nt, Human
uguguucauuucucucugcugu

SEQ ID NO: 524248 - RNA, 22 nt, Human
agcuuccucaccucagaggucu

SEQ ID NO: 524249 - RNA, 22 nt, Human
guucucaguucaggaaggacau

SEQ ID NO: 524250 - RNA, 22 nt, Human
aucccaugagaccacguuggcu

SEQ ID NO: 524251 - RNA, 22 nt, Human
ugggcuggcguggagaguuuag

SEQ ID NO: 524252 - RNA, 22 nt, Human
aaguuaguggauaaacagcaaa

SEQ ID NO: 524253 - RNA, 21 nt, Human
agcuuccagagcacauuccau

SEQ ID NO: 524254 - RNA, 22 nt, Human
cagguccaccaugccucaagcc

SEQ ID NO: 524255 - RNA, 22 nt, Human
cuuuaauuaggaaguauaauga

SEQ ID NO: 524256 - RNA, 22 nt, Human
aaaaagacuuccaacucaggag

SEQ ID NO: 524257 - RNA, 22 nt, Human
cugagcuggucuauggacuugg

SEQ ID NO: 524258 - RNA, 22 nt, Human
uguccucacaggaaugaacuuu

SEQ ID NO: 524259 - RNA, 22 nt, Human
ccuaggcuuguuuucaucagcu

SEQ ID NO: 524260 - RNA, 22 nt, Human
caaguccuuagaugguucuuug

SEQ ID NO: 524261 - RNA, 22 nt, Human
caggaaauucuuuuguuugugc

SEQ ID NO: 524262 - RNA, 22 nt, Human
ugggugaggaugaugaggcagc

SEQ ID NO: 524263 - RNA, 22 nt, Human
gggcuucuugccauggggacgg

SEQ ID NO: 524264 - RNA, 22 nt, Human
uggcccugcuaugauccugcaa

SEQ ID NO: 524265 - RNA, 22 nt, Human
uuccugggguacuggagaaaau

SEQ ID NO: 524266 - RNA, 22 nt, Human
ugacaguuguauuacaugggaa

SEQ ID NO: 524267 - RNA, 22 nt, Human
uacauguauguuuaucuugaga

SEQ ID NO: 524268 - RNA, 22 nt, Human
gagcuuuucccgucuuucucgu

SEQ ID NO: 524269 - RNA, 22 nt, Human
uuuacauugcauuagguauuau

SEQ ID NO: 524270 - RNA, 22 nt, Human
cagcaguguacaaggugucaga

SEQ ID NO: 524271 - RNA, 22 nt, Human
cucucugagugagggacaagcu

SEQ ID NO: 524272 - RNA, 22 nt, Human
cagugcuggaggcuggagggaa

SEQ ID NO: 524273 - RNA, 22 nt, Human
ccagcccucacugaggccucuc

SEQ ID NO: 524274 - RNA, 22 nt, Human
uuucuaaggugauccuuucuua

SEQ ID NO: 524275 - RNA, 22 nt, Human
gccaggcuguggggaacuugaa

SEQ ID NO: 524276 - RNA, 20 nt, Human
gccaggcacuguucucaaua

SEQ ID NO: 524277 - RNA, 22 nt, Human
ggggccccuguggcuugaugcc

SEQ ID NO: 524278 - RNA, 22 nt, Human
cugggcuuaggaccuggugcgg

SEQ ID NO: 524279 - RNA, 22 nt, Human
ccugcagcuccggauuucuggg

SEQ ID NO: 524280 - RNA, 20 nt, Human
agguccugguucucugggau

SEQ ID NO: 524281 - RNA, 22 nt, Human
acucuggcacuggguaccucag

SEQ ID NO: 524282 - RNA, 22 nt, Human
auauacaguuuuacaggguuuc

SEQ ID NO: 524283 - RNA, 22 nt, Human
ggcugcuucucacucauuugca

SEQ ID NO: 524284 - RNA, 22 nt, Human
uccuguggucuggaaggaaugg

SEQ ID NO: 524285 - RNA, 22 nt, Human
cugggcuuucaggcccuaaggc

SEQ ID NO: 524286 - RNA, 22 nt, Human
cagcuuuagagaaaacauauuu

SEQ ID NO: 524287 - RNA, 22 nt, Human
caaagugcuaggauuacaggcc

SEQ ID NO: 524288 - RNA, 22 nt, Human
cuggccagacuacacaugugug

SEQ ID NO: 524289 - RNA, 22 nt, Human
cccaaggcauggcaugguggca

SEQ ID NO: 524290 - RNA, 21 nt, Human
uccaagccuucaacacauuca

SEQ ID NO: 524291 - RNA, 22 nt, Human
aggcucugaucagguggcugug

SEQ ID NO: 524292 - RNA, 22 nt, Human
ucagaggaggcauuuaaacaga

SEQ ID NO: 524293 - RNA, 22 nt, Human
uauugacagagggucagaagag

SEQ ID NO: 524294 - RNA, 22 nt, Human
gcagcucccuggcugcaaauga

SEQ ID NO: 524295 - RNA, 22 nt, Human
cucccacuccuggcucaccaca

SEQ ID NO: 524296 - RNA, 22 nt, Human
ucucagugagcuuuucuauguu

SEQ ID NO: 524297 - RNA, 22 nt, Human
ucacagaaugucagaguugggg

SEQ ID NO: 524298 - RNA, 22 nt, Human
cuggagggugagccucaucucu

SEQ ID NO: 524299 - RNA, 22 nt, Human
gaauuuccucuaaaccccugag

SEQ ID NO: 524300 - RNA, 22 nt, Human
ucaggaguccugccugcagccu

SEQ ID NO: 524301 - RNA, 22 nt, Human
gccccucuccuugugcaccugc

SEQ ID NO: 524302 - RNA, 22 nt, Human
uagggcucugagaguucagccu

SEQ ID NO: 524303 - RNA, 22 nt, Human
gggcacugaaugccaagcuagg

SEQ ID NO: 524304 - RNA, 22 nt, Human
ccacacugucuaacaaggcaua

SEQ ID NO: 524305 - RNA, 22 nt, Human
gguuucaacucagcuaguaagg

SEQ ID NO: 524306 - RNA, 22 nt, Human
agcaggcugagcacccaggggg

SEQ ID NO: 524307 - RNA, 22 nt, Human
ugaagcaggugaauggaugucg

SEQ ID NO: 524308 - RNA, 22 nt, Human
aagaucaagaucagagaacagc

SEQ ID NO: 524309 - RNA, 22 nt, Human
ugcagcucauugcuggggucug

SEQ ID NO: 524310 - RNA, 22 nt, Human
uaaagaacacagggaauagcac

SEQ ID NO: 524311 - RNA, 22 nt, Human
ugugugcauguuaaugagaaaa

SEQ ID NO: 524312 - RNA, 19 nt, Human
acagucagggaauaaagac

SEQ ID NO: 524313 - RNA, 21 nt, Human
cagggcaaccaaguccagaga

SEQ ID NO: 524314 - RNA, 22 nt, Human
ggacacagcugcagccacaccc

SEQ ID NO: 524315 - RNA, 22 nt, Human
uuaucacuuaugagcuuuuugc

SEQ ID NO: 524316 - RNA, 22 nt, Human
cuuucaaugugccugccuuggg

SEQ ID NO: 524317 - RNA, 22 nt, Human
ugugccuucucaguccugcuca

SEQ ID NO: 524318 - RNA, 22 nt, Human
uuucauuuugguuaugccauaa

SEQ ID NO: 524319 - RNA, 22 nt, Human
uagaaacagaaaacuguaauag

SEQ ID NO: 524320 - RNA, 23 nt, Human
cagaggcaucggauucaacauca

SEQ ID NO: 524321 - RNA, 18 nt, Human
ggguccugugggagacag

SEQ ID NO: 524322 - RNA, 22 nt, Human
gauauuuucgcagggagaauuc

SEQ ID NO: 524323 - RNA, 22 nt, Human
gggcagcugcagggauggugac

SEQ ID NO: 524324 - RNA, 22 nt, Human
augugcugaguguguauauaca

SEQ ID NO: 524325 - RNA, 22 nt, Human
cccaggaggcagagcuugcagu

SEQ ID NO: 524326 - RNA, 22 nt, Human
caggaacauguuggaaagaaau

SEQ ID NO: 524327 - RNA, 22 nt, Human
gcucuggcccaaacccuuucua

SEQ ID NO: 524328 - RNA, 22 nt, Human
uggggggcacuucagcacaaug

SEQ ID NO: 524329 - RNA, 22 nt, Human
cagagacaguuucacagggucu

SEQ ID NO: 524330 - RNA, 22 nt, Human
auugagaauccauuugagauga

SEQ ID NO: 524331 - RNA, 22 nt, Human
auuuugauaaucauguuagaga

SEQ ID NO: 524332 - RNA, 22 nt, Human
cucugggucuaccuguggccag

SEQ ID NO: 524333 - RNA, 22 nt, Human
agauaaaaugauuuucuggauc

SEQ ID NO: 524334 - RNA, 22 nt, Human
gaucaaaagcuggguucuaaaa

SEQ ID NO: 524335 - RNA, 18 nt, Human
agcugcagaccaggaggu

SEQ ID NO: 524336 - RNA, 22 nt, Human
uauacagauuaacagauuuaaa

SEQ ID NO: 524337 - RNA, 22 nt, Human
ccuccuuuccuguuuuccugag

SEQ ID NO: 524338 - RNA, 20 nt, Human
acugagcugcauggagagga

SEQ ID NO: 524339 - RNA, 22 nt, Human
cuuccaagaugaacagcaagcg

SEQ ID NO: 524340 - RNA, 22 nt, Human
gccucuguggcucagccuugcu

SEQ ID NO: 524341 - RNA, 22 nt, Human
ggccccucagcaucugagucag

SEQ ID NO: 524342 - RNA, 22 nt, Human
acagguggccccgagggagugg

SEQ ID NO: 524343 - RNA, 20 nt, Human
caugagaagggcagugugag

SEQ ID NO: 524344 - RNA, 22 nt, Human
aguaugaagaugaugaaaaaua

SEQ ID NO: 524345 - RNA, 22 nt, Human
aggguccugggugcaguugcuu

SEQ ID NO: 524346 - RNA, 22 nt, Human
ucucuggaguauaaccagggau

SEQ ID NO: 524347 - RNA, 22 nt, Human
ggcugggcaggucugcacaggg

SEQ ID NO: 524348 - RNA, 22 nt, Human
agugugggggcuuuggugucac

SEQ ID NO: 524349 - RNA, 22 nt, Human
uguauuagaucugagaacuucu

SEQ ID NO: 524350 - RNA, 22 nt, Human
cugggaggcccacguugggaag

SEQ ID NO: 524351 - RNA, 22 nt, Human
ucaaugaugcugaagguagcgu

SEQ ID NO: 524352 - RNA, 22 nt, Human
cucccuggaggcccagaccugg

SEQ ID NO: 524353 - RNA, 22 nt, Human
agugcgugguuuacagcuaguu

SEQ ID NO: 524354 - RNA, 18 nt, Human
uuccauaauguauguaac

SEQ ID NO: 524355 - RNA, 22 nt, Human
aagcagcauguggguuaucggg

SEQ ID NO: 524356 - RNA, 22 nt, Human
cagguucccuugcagcuaagug

SEQ ID NO: 524357 - RNA, 22 nt, Human
guauuuuucaguuaggagcuua

SEQ ID NO: 524358 - RNA, 22 nt, Human
agcuggggcugcagagaacagg

SEQ ID NO: 524359 - RNA, 20 nt, Human
aggagaaauucgggacaccu

SEQ ID NO: 524360 - RNA, 22 nt, Human
uggaggcauuuuagguugucac

SEQ ID NO: 524361 - RNA, 22 nt, Human
cacaggagguuaggaagugguc

SEQ ID NO: 524362 - RNA, 22 nt, Human
aggccugaggaccagauaaaug

SEQ ID NO: 524363 - RNA, 22 nt, Human
accuaauaaagguaaauucugu

SEQ ID NO: 524364 - RNA, 22 nt, Human
ggcagagcuugcagugagccga

SEQ ID NO: 524365 - RNA, 22 nt, Human
cuucucuucccagggacacagg

SEQ ID NO: 524366 - RNA, 22 nt, Human
gggugggguucaggaaucuuca

SEQ ID NO: 524367 - RNA, 22 nt, Human
agaaagggucacugaaagagga

SEQ ID NO: 524368 - RNA, 22 nt, Human
cagguccugcagggagaguaaa

SEQ ID NO: 524369 - RNA, 22 nt, Human
ccagcugguaagugauggagcc

SEQ ID NO: 524370 - RNA, 22 nt, Human
aucucccagccacagcauucuu

SEQ ID NO: 524371 - RNA, 22 nt, Human
aaaaaccuuucccauacuaaga

SEQ ID NO: 524372 - RNA, 22 nt, Human
gguaaaaugcagauucuuagcc

SEQ ID NO: 524373 - RNA, 19 nt, Human
cucagcacuuuuacacagg

SEQ ID NO: 524374 - RNA, 22 nt, Human
aggagaguaccauugggccgca

SEQ ID NO: 524375 - RNA, 22 nt, Human
aaagugcucggauuacagguau

SEQ ID NO: 524376 - RNA, 22 nt, Human
auacucaauuuguuggaaagca

SEQ ID NO: 524377 - RNA, 22 nt, Human
ggcccugagcugaaguacugug

SEQ ID NO: 524378 - RNA, 22 nt, Human
acuguucaagcaaaugacauug

SEQ ID NO: 524379 - RNA, 22 nt, Human
gagggcucuacucaccacccug

SEQ ID NO: 524380 - RNA, 22 nt, Human
cuugccuuugucuucaaaggcu

SEQ ID NO: 524381 - RNA, 17 nt, Human
uuccagcauguuacuaa

SEQ ID NO: 524382 - RNA, 22 nt, Human
uacaaagucaccagcuucuugc

SEQ ID NO: 524383 - RNA, 21 nt, Human
ugggaccuauuucaacuggau

SEQ ID NO: 524384 - RNA, 22 nt, Human
gguuugcaugugauguugggca

SEQ ID NO: 524385 - RNA, 22 nt, Human
auucuucugccuacuuucaucc

SEQ ID NO: 524386 - RNA, 22 nt, Human
gaaggagcuaccaagacugaau

SEQ ID NO: 524387 - RNA, 22 nt, Human
ucccagagucuucuccuguaau

SEQ ID NO: 524388 - RNA, 22 nt, Human
guuuuacacaccuaugaaagac

SEQ ID NO: 524389 - RNA, 22 nt, Human
auguguaggugaaucgaggcug

SEQ ID NO: 524390 - RNA, 22 nt, Human
ggcccugggaugcucagcagug

SEQ ID NO: 524391 - RNA, 22 nt, Human
aaaugcacucugcuucugugac

SEQ ID NO: 524392 - RNA, 22 nt, Human
cagauguuguuccugccuguag

SEQ ID NO: 524393 - RNA, 21 nt, Human
augaagucuaugcuucugugu

SEQ ID NO: 524394 - RNA, 22 nt, Human
acugugcaaugaguaauaaacu

SEQ ID NO: 524395 - RNA, 22 nt, Human
aaaagagucuuaggcagucaua

SEQ ID NO: 524396 - RNA, 22 nt, Human
ccucgaccuccccaggcucagg

SEQ ID NO: 524397 - RNA, 20 nt, Human
acucuggggcucauuagggg

SEQ ID NO: 524398 - RNA, 22 nt, Human
auguucuguuuuguaauucaua

SEQ ID NO: 524399 - RNA, 22 nt, Human
cuucugcaagagcaucaguugu

SEQ ID NO: 524400 - RNA, 21 nt, Human
uccuggcccacucuaucccca

SEQ ID NO: 524401 - RNA, 22 nt, Human
gcuuuuaauuaguugcuuccau

SEQ ID NO: 524402 - RNA, 22 nt, Human
agcacuagacauguaagugagc

SEQ ID NO: 524403 - RNA, 19 nt, Human
cccaaggcccugggcaggc

SEQ ID NO: 524404 - RNA, 23 nt, Human
cuggcccuggcucugugaucaug

SEQ ID NO: 524405 - RNA, 22 nt, Human
aaggcagcccuggcucagccug

SEQ ID NO: 524406 - RNA, 22 nt, Human
agagucuuccaggcagccugag

SEQ ID NO: 524407 - RNA, 22 nt, Human
cucuccuugcagauggcugccu

SEQ ID NO: 524408 - RNA, 22 nt, Human
caaaugaauagggagugugaug

SEQ ID NO: 524409 - RNA, 22 nt, Human
cuaagcaagaaugagugcaaca

SEQ ID NO: 524410 - RNA, 22 nt, Human
ggcaccugguaagugcucagua

SEQ ID NO: 524411 - RNA, 22 nt, Human
uauuagguaaaggacuugcagg

SEQ ID NO: 524412 - RNA, 22 nt, Human
gcgguagcucaagcuuguaauc

SEQ ID NO: 524413 - RNA, 22 nt, Human
cuuucuugcauaauuugaaacc

SEQ ID NO: 524414 - RNA, 22 nt, Human
ggguaccaagcugcuugggggc

SEQ ID NO: 524415 - RNA, 19 nt, Human
acagcagggauuuuuggag

SEQ ID NO: 524416 - RNA, 22 nt, Human
uacauuaucuuguuaucuuuca

SEQ ID NO: 524417 - RNA, 20 nt, Human
uguuccaugacuauuuggau

SEQ ID NO: 524418 - RNA, 22 nt, Human
agagcacaggcucuggagucua

SEQ ID NO: 524419 - RNA, 22 nt, Human
ccaggaggcagaaguugcagug

SEQ ID NO: 524420 - RNA, 23 nt, Human
agaguaauguuuuuacuguauuc

SEQ ID NO: 524421 - RNA, 22 nt, Human
ggccuggaagaggacagagaaa

SEQ ID NO: 524422 - RNA, 22 nt, Human
ugcuucugcaggagcuccugau

SEQ ID NO: 524423 - RNA, 22 nt, Human
ccucucaucauuaucgcuuugu

SEQ ID NO: 524424 - RNA, 22 nt, Human
agcagcauggaugggccucagc

SEQ ID NO: 524425 - RNA, 22 nt, Human
gcaggggaguggaugauggauu

SEQ ID NO: 524426 - RNA, 22 nt, Human
caguuucucucaauaagcaucg

SEQ ID NO: 524427 - RNA, 22 nt, Human
ugugaaaagcaggcuacuuucu

SEQ ID NO: 524428 - RNA, 22 nt, Human
caggagugagaugcgaucacuu

SEQ ID NO: 524429 - RNA, 22 nt, Human
ucauuccauuuccagcucugaa

SEQ ID NO: 524430 - RNA, 22 nt, Human
ccagcucugcuugcccagucag

SEQ ID NO: 524431 - RNA, 22 nt, Human
cauccagcuccugggggccacc

SEQ ID NO: 524432 - RNA, 22 nt, Human
gaagagaagguguaggccaucc

SEQ ID NO: 524433 - RNA, 22 nt, Human
auauaauaguuucauaaaggcu

SEQ ID NO: 524434 - RNA, 22 nt, Human
guauuuuauggcaugcaguggc

SEQ ID NO: 524435 - RNA, 22 nt, Human
acaggcagcgucauugcugcuc

SEQ ID NO: 524436 - RNA, 20 nt, Human
aagagucuuuacugagcuaa

SEQ ID NO: 524437 - RNA, 21 nt, Human
gggccuggcugcgcaggacgg

SEQ ID NO: 524438 - RNA, 22 nt, Human
uccuggcugcaccagugacccu

SEQ ID NO: 524439 - RNA, 23 nt, Human
uucucaguccugcccagggaggc

SEQ ID NO: 524440 - RNA, 23 nt, Human
ugcugggguaguuuguggcacag

SEQ ID NO: 524441 - RNA, 22 nt, Human
ccugggcaauauagugaggccc

SEQ ID NO: 524442 - RNA, 20 nt, Human
agagccuggaaaaagacauc

SEQ ID NO: 524443 - RNA, 22 nt, Human
ggcacugagcugccuuggggca

SEQ ID NO: 524444 - RNA, 20 nt, Human
gauaaauugucucuuaagug

SEQ ID NO: 524445 - RNA, 22 nt, Human
ggcuucuugugugucaggcucu

SEQ ID NO: 524446 - RNA, 22 nt, Human
cagcugugcuguauuaagcucu

SEQ ID NO: 524447 - RNA, 22 nt, Human
ccagcagcccacaggcgucccu

SEQ ID NO: 524448 - RNA, 22 nt, Human
uuucauuacguguuugacuugu

SEQ ID NO: 524449 - RNA, 22 nt, Human
ggggaucuaggauauuucauga

SEQ ID NO: 524450 - RNA, 22 nt, Human
ggacacaagcuccggggcugca

SEQ ID NO: 524451 - RNA, 22 nt, Human
gucugccugcuaguggcugccu

SEQ ID NO: 524452 - RNA, 22 nt, Human
acauuugugcaacguauccaca

SEQ ID NO: 524453 - RNA, 22 nt, Human
uaagcaaaguuuauaaggcucu

SEQ ID NO: 524454 - RNA, 22 nt, Human
ucccucagucccuggacaggca

SEQ ID NO: 524455 - RNA, 22 nt, Human
uugggugcugucauggggcacg

SEQ ID NO: 524456 - RNA, 18 nt, Human
gcagagcagaagcucaag

SEQ ID NO: 524457 - RNA, 23 nt, Human
ggccacugaauuuucugcaucuu

SEQ ID NO: 524458 - RNA, 22 nt, Human
cuugcugagauaaaugcugucu

SEQ ID NO: 524459 - RNA, 22 nt, Human
augcccugccaagcaggcuaaa

SEQ ID NO: 524460 - RNA, 22 nt, Human
agcuuuaugaggagaccuuagu

SEQ ID NO: 524461 - RNA, 22 nt, Human
auagugucagaaaaucauaaga

SEQ ID NO: 524462 - RNA, 22 nt, Human
aagaguuuaauuuugucuagac

SEQ ID NO: 524463 - RNA, 22 nt, Human
uagggcaguuucauguuaucuu

SEQ ID NO: 524464 - RNA, 22 nt, Human
ccuggcagcagcacaugccuuc

SEQ ID NO: 524465 - RNA, 22 nt, Human
auuuauuaagcaucugcuaugu

SEQ ID NO: 524466 - RNA, 20 nt, Human
guauuagguguuccucuuuc

SEQ ID NO: 524467 - RNA, 22 nt, Human
acugaaggcuuucccaagguca

SEQ ID NO: 524468 - RNA, 22 nt, Human
uaacagaauuugcuaaacuccg

SEQ ID NO: 524469 - RNA, 22 nt, Human
augaaucaagugagaacagcau

SEQ ID NO: 524470 - RNA, 22 nt, Human
gagcagggcuuguccuccucau

SEQ ID NO: 524471 - RNA, 22 nt, Human
uuaaagcaaaaacuaggaugga

SEQ ID NO: 524472 - RNA, 21 nt, Human
uggaucugugaucuggggcac

SEQ ID NO: 524473 - RNA, 22 nt, Human
guuuuccuguugaguaguauuc

SEQ ID NO: 524474 - RNA, 22 nt, Human
augucccaagauacagcuagag

SEQ ID NO: 524475 - RNA, 22 nt, Human
auuuuacauaaggaagguuuaa

SEQ ID NO: 524476 - RNA, 22 nt, Human
aggugcuggaguagaagaaaaa

SEQ ID NO: 524477 - RNA, 22 nt, Human
cgggcuccgggucuuugcaguc

SEQ ID NO: 524478 - RNA, 22 nt, Human
ccuccagcgcgauccacuccgg

SEQ ID NO: 524479 - RNA, 22 nt, Human
uggagcuggaauuucugggccu

SEQ ID NO: 524480 - RNA, 22 nt, Human
ugaggcaggaguucaggcugcg

SEQ ID NO: 524481 - RNA, 20 nt, Human
gcugaccccugcugucaugc

SEQ ID NO: 524482 - RNA, 22 nt, Human
ucacauguguggcagugcaagu

SEQ ID NO: 524483 - RNA, 22 nt, Human
ucaggaaaguguucucagagga

SEQ ID NO: 524484 - RNA, 22 nt, Human
aaguauucuacaaagaaauuga

SEQ ID NO: 524485 - RNA, 22 nt, Human
ucccuuguccucuucgucacug

SEQ ID NO: 524486 - RNA, 22 nt, Human
ugaaugauaugugaaaaggaac

SEQ ID NO: 524487 - RNA, 22 nt, Human
agggcuccugaggcccuucugg

SEQ ID NO: 524488 - RNA, 22 nt, Human
aagaggaguagaugugguuggu

SEQ ID NO: 524489 - RNA, 22 nt, Human
auuuucaucauggguuuaacau

SEQ ID NO: 524490 - RNA, 22 nt, Human
auaauaacaccugaauaggaaa

SEQ ID NO: 524491 - RNA, 22 nt, Human
aggcacugauucucagaguuac

SEQ ID NO: 524492 - RNA, 22 nt, Human
ccucacuuuccuuucuccuggg

SEQ ID NO: 524493 - RNA, 21 nt, Human
acagcagagaucaagacuaag

SEQ ID NO: 524494 - RNA, 22 nt, Human
ucucagagagaugaaacuucca

SEQ ID NO: 524495 - RNA, 22 nt, Human
aacuuuauuguuaggggcuaaa

SEQ ID NO: 524496 - RNA, 22 nt, Human
gcuggcccagugacccacagug

SEQ ID NO: 524497 - RNA, 22 nt, Human
ugcagcugaccagcaaguccug

SEQ ID NO: 524498 - RNA, 22 nt, Human
ugcuggccaauggcagaggcgg

SEQ ID NO: 524499 - RNA, 21 nt, Human
uucaauacuauuucaauaguc

SEQ ID NO: 524500 - RNA, 18 nt, Human
ggagagugacagagucgu

SEQ ID NO: 524501 - RNA, 22 nt, Human
cagggccauaucuugugcacca

SEQ ID NO: 524502 - RNA, 18 nt, Human
aaugcacacauuuacucc

SEQ ID NO: 524503 - RNA, 22 nt, Human
uacuguacugucuuuuuugcug

SEQ ID NO: 524504 - RNA, 22 nt, Human
agcccugcaggaugagggaggu

SEQ ID NO: 524505 - RNA, 22 nt, Human
aggaaagggguagguguggacg

SEQ ID NO: 524506 - RNA, 22 nt, Human
gggcuauagcacuauguauggg

SEQ ID NO: 524507 - RNA, 22 nt, Human
ucugccuggaugauggcagggc

SEQ ID NO: 524508 - RNA, 22 nt, Human
cacaccuguaauaccagcuacu

SEQ ID NO: 524509 - RNA, 22 nt, Human
acaugugugacaacagagguga

SEQ ID NO: 524510 - RNA, 22 nt, Human
cagcucugagacugaggcuaug

SEQ ID NO: 524511 - RNA, 22 nt, Human
ccagcagcuuuauuggcucucc

SEQ ID NO: 524512 - RNA, 22 nt, Human
acaccuuugccccaagucauag

SEQ ID NO: 524513 - RNA, 22 nt, Human
uguaaacauaccagagccaagu

SEQ ID NO: 524514 - RNA, 22 nt, Human
ugcaaggcccagacaagagcuc

SEQ ID NO: 524515 - RNA, 22 nt, Human
gcucagugugcacgaguacucu

SEQ ID NO: 524516 - RNA, 22 nt, Human
aucaggauuacacggggaugcu

SEQ ID NO: 524517 - RNA, 22 nt, Human
auuugucugcuugcugccuucc

SEQ ID NO: 524518 - RNA, 22 nt, Human
uuuucaugucauguccuugagg

SEQ ID NO: 524519 - RNA, 22 nt, Human
cugauauuauugaagcuggagu

SEQ ID NO: 524520 - RNA, 22 nt, Human
acaggccugugugcacacgagg

SEQ ID NO: 524521 - RNA, 22 nt, Human
cauuaaaucuuccagaccucac

SEQ ID NO: 524522 - RNA, 22 nt, Human
cagcagagacgguaagcagaac

SEQ ID NO: 524523 - RNA, 22 nt, Human
ucagcagcagcucagcauguuu

SEQ ID NO: 524524 - RNA, 22 nt, Human
cagucccacuagugccaauacc

SEQ ID NO: 524525 - RNA, 22 nt, Human
agcaauauuucagcuagcaggu

SEQ ID NO: 524526 - RNA, 22 nt, Human
ccaaggagcaaggcucaacaag

SEQ ID NO: 524527 - RNA, 22 nt, Human
cagaaccaggaacugauggaga

SEQ ID NO: 524528 - RNA, 22 nt, Human
aaacaguagaaguguauuuuau

SEQ ID NO: 524529 - RNA, 22 nt, Human
agcuucuggaaggcaaggcuug

SEQ ID NO: 524530 - RNA, 22 nt, Human
ucuuuucuugcauuauugcacu

SEQ ID NO: 524531 - RNA, 22 nt, Human
uuucauaugggcauuggcaaua

SEQ ID NO: 524532 - RNA, 22 nt, Human
cccaagagaucgcauguaguug

SEQ ID NO: 524533 - RNA, 22 nt, Human
ccugggcuuugcuggcaaggcc

SEQ ID NO: 524534 - RNA, 22 nt, Human
ggccugaggcaauagucagaca

SEQ ID NO: 524535 - RNA, 22 nt, Human
ccuggagcucacugggagccgg

SEQ ID NO: 524536 - RNA, 22 nt, Human
agagcuggggccagagucaagg

SEQ ID NO: 524537 - RNA, 22 nt, Human
uggcaggugaaguuguuaggga

SEQ ID NO: 524538 - RNA, 22 nt, Human
uuauaauucuggcauaggcugu

SEQ ID NO: 524539 - RNA, 22 nt, Human
auuuucaucgcuagguuggccu

SEQ ID NO: 524540 - RNA, 22 nt, Human
cagccucuugcacuuugaaggc

SEQ ID NO: 524541 - RNA, 22 nt, Human
ggaaugauggugccuagauuau

SEQ ID NO: 524542 - RNA, 22 nt, Human
ucacagaacaauguuuaguucu

SEQ ID NO: 524543 - RNA, 22 nt, Human
cuggcaggcggcagagcccagg

SEQ ID NO: 524544 - RNA, 22 nt, Human
ucacaaaagcuuuugaauuugg

SEQ ID NO: 524545 - RNA, 22 nt, Human
agaauaaaucaaauguccugag

SEQ ID NO: 524546 - RNA, 22 nt, Human
uuacaaggaggauagcauuucc

SEQ ID NO: 524547 - RNA, 22 nt, Human
caaagaaggaacuauaauccca

SEQ ID NO: 524548 - RNA, 22 nt, Human
auggagggugguaagacagaga

SEQ ID NO: 524549 - RNA, 22 nt, Human
auacacacugcuauccuuuuuu

SEQ ID NO: 524550 - RNA, 22 nt, Human
ugugcucuggaguugccuucac

SEQ ID NO: 524551 - RNA, 22 nt, Human
gcacccagagggcagggucucc

SEQ ID NO: 524552 - RNA, 22 nt, Human
ccuggggagaagagcuuccccc

SEQ ID NO: 524553 - RNA, 22 nt, Human
gcccagcugcacccuggugggu

SEQ ID NO: 524554 - RNA, 22 nt, Human
ccucaggaaccacauugcugcu

SEQ ID NO: 524555 - RNA, 22 nt, Human
cgggcagauugggaagguucau

SEQ ID NO: 524556 - RNA, 22 nt, Human
ggccgggcaggucucagccagc

SEQ ID NO: 524557 - RNA, 22 nt, Human
ucugggcagcagcagcuaguag

SEQ ID NO: 524558 - RNA, 17 nt, Human
gcugagugcagggaguc

SEQ ID NO: 524559 - RNA, 22 nt, Human
uagguccacagauuugguuucu

SEQ ID NO: 524560 - RNA, 22 nt, Human
uugcauugaucccagcuugggc

SEQ ID NO: 524561 - RNA, 22 nt, Human
ccuucuagcaaaucaacauaaa

SEQ ID NO: 524562 - RNA, 22 nt, Human
caaguagagauuacagugugca

SEQ ID NO: 524563 - RNA, 22 nt, Human
aaauuguugaucuacaguaagg

SEQ ID NO: 524564 - RNA, 22 nt, Human
gucugcucaugcuaccgcgggc

SEQ ID NO: 524565 - RNA, 22 nt, Human
ccaguggguaggccauggugag

SEQ ID NO: 524566 - RNA, 22 nt, Human
aaggucauuguugcauguucuc

SEQ ID NO: 524567 - RNA, 22 nt, Human
ucagcacuguguccagucuccc

SEQ ID NO: 524568 - RNA, 22 nt, Human
auaaaaaugagggcgguagcua

SEQ ID NO: 524569 - RNA, 22 nt, Human
gagguggguguaucacagguca

SEQ ID NO: 524570 - RNA, 22 nt, Human
guggcuucacauggcauuuggc

SEQ ID NO: 524571 - RNA, 22 nt, Human
ucucuggguuuuuguccuguac

SEQ ID NO: 524572 - RNA, 22 nt, Human
ccaaggagaaaugcugugcuuu

SEQ ID NO: 524573 - RNA, 22 nt, Human
uaaagcaagacacacccauagc

SEQ ID NO: 524574 - RNA, 22 nt, Human
uaucuuuaacuugcaguauuua

SEQ ID NO: 524575 - RNA, 17 nt, Human
ugagaaguaggcaucau

SEQ ID NO: 524576 - RNA, 22 nt, Human
caaucccaucaccaucugcucu

SEQ ID NO: 524577 - RNA, 22 nt, Human
ggaaagcucagaucuuguugga

SEQ ID NO: 524578 - RNA, 22 nt, Human
uuuagcaauuauuaaggguuga

SEQ ID NO: 524579 - RNA, 17 nt, Human
ugccugccagcauugga

SEQ ID NO: 524580 - RNA, 22 nt, Human
ugcaaaaaggcagacuggugau

SEQ ID NO: 524581 - RNA, 22 nt, Human
ugucuuccucuuggcuugagcu

SEQ ID NO: 524582 - RNA, 22 nt, Human
auauuucaugggguuccauacu

SEQ ID NO: 524583 - RNA, 22 nt, Human
cugcccuguagcuguucuagca

SEQ ID NO: 524584 - RNA, 19 nt, Human
ggcugccuggagcgagggc

SEQ ID NO: 524585 - RNA, 22 nt, Human
aacauucaaguucugguuuaug

SEQ ID NO: 524586 - RNA, 22 nt, Human
agugugugcaugcauucgugca

SEQ ID NO: 524587 - RNA, 22 nt, Human
uaauuuacucagauguucaauc

SEQ ID NO: 524588 - RNA, 22 nt, Human
ucagaggcuugaagcccaagcc

SEQ ID NO: 524589 - RNA, 22 nt, Human
ugaggaugacgauggcaauggc

SEQ ID NO: 524590 - RNA, 22 nt, Human
guggccagaagacugcaaugcu

SEQ ID NO: 524591 - RNA, 22 nt, Human
agaggcagaaguguucaaaccc

SEQ ID NO: 524592 - RNA, 22 nt, Human
cccagccucugggcucacccaa

SEQ ID NO: 524593 - RNA, 22 nt, Human
uggcucuggccaccgggagggc

SEQ ID NO: 524594 - RNA, 22 nt, Human
augucagagcuuccacaauagu

SEQ ID NO: 524595 - RNA, 19 nt, Human
uucugggcauucauauuua

SEQ ID NO: 524596 - RNA, 22 nt, Human
acagagaccaguuacagcgucc

SEQ ID NO: 524597 - RNA, 22 nt, Human
gagggauggugugagaggcuca

SEQ ID NO: 524598 - RNA, 21 nt, Human
uuugaaagugggugauucuuu

SEQ ID NO: 524599 - RNA, 22 nt, Human
gcagcuggcucugggaaaaacu

SEQ ID NO: 524600 - RNA, 22 nt, Human
cuuccucccggcccaugcucug

SEQ ID NO: 524601 - RNA, 22 nt, Human
ccugggugaaaucucuccugca

SEQ ID NO: 524602 - RNA, 22 nt, Human
aaaaugugcaguuuuuaagcug

SEQ ID NO: 524603 - RNA, 22 nt, Human
acuggggagugguuuugggaag

SEQ ID NO: 524604 - RNA, 22 nt, Human
uuuuguaagaaacugccaagcc

SEQ ID NO: 524605 - RNA, 22 nt, Human
ggagaggauguuuuaguaacuu

SEQ ID NO: 524606 - RNA, 22 nt, Human
guggcaggaucacggcucacug

SEQ ID NO: 524607 - RNA, 22 nt, Human
aguuggagugaacaugagauug

SEQ ID NO: 524608 - RNA, 22 nt, Human
aucuuguuaaaaugcagaaacu

SEQ ID NO: 524609 - RNA, 22 nt, Human
uuucuauuuacagugcuaggua

SEQ ID NO: 524610 - RNA, 18 nt, Human
uacaugcauaaaugaagc

SEQ ID NO: 524611 - RNA, 22 nt, Human
cccaggcugauguucagcgggu

SEQ ID NO: 524612 - RNA, 22 nt, Human
cagggccagccauccugcuggg

SEQ ID NO: 524613 - RNA, 17 nt, Human
ggacacagcucauggcu

SEQ ID NO: 524614 - RNA, 22 nt, Human
ggccugagucacaucaggagag

SEQ ID NO: 524615 - RNA, 22 nt, Human
gcacacagacuaaccauauuuc

SEQ ID NO: 524616 - RNA, 21 nt, Human
uggcucugcucagagcagucc

SEQ ID NO: 524617 - RNA, 22 nt, Human
acagagagaauuggguuuacag

SEQ ID NO: 524618 - RNA, 22 nt, Human
auugucugaauccaaagcucug

SEQ ID NO: 524619 - RNA, 22 nt, Human
ggggaaacugaggcacagacag

SEQ ID NO: 524620 - RNA, 22 nt, Human
uucuaccauugggaaaacagcc

SEQ ID NO: 524621 - RNA, 22 nt, Human
aaaauguaaagcuugaguguag

SEQ ID NO: 524622 - RNA, 20 nt, Human
gcucccagccugcagucccc

SEQ ID NO: 524623 - RNA, 22 nt, Human
ccuucugcuggucaucccagug

SEQ ID NO: 524624 - RNA, 22 nt, Human
ggagggcaucaaucaggccugg

SEQ ID NO: 524625 - RNA, 22 nt, Human
cugcuuccaugcaauggcaguc

SEQ ID NO: 524626 - RNA, 22 nt, Human
ggcaggugaucuagagucaaua

SEQ ID NO: 524627 - RNA, 22 nt, Human
ccagcagcccucuuccaagacu

SEQ ID NO: 524628 - RNA, 22 nt, Human
gcugcuggagcuuugcagaagg

SEQ ID NO: 524629 - RNA, 22 nt, Human
ugccagcaguagcaguaggcca

SEQ ID NO: 524630 - RNA, 20 nt, Human
gcaagugaaaacuaugggug

SEQ ID NO: 524631 - RNA, 22 nt, Human
cuuacagagaagaaaauguagu

SEQ ID NO: 524632 - RNA, 22 nt, Human
gugauaaaauagaaacaguggu

SEQ ID NO: 524633 - RNA, 19 nt, Human
ucucuggcauagacucaau

SEQ ID NO: 524634 - RNA, 22 nt, Human
agucccuguacuuuccacugcc

SEQ ID NO: 524635 - RNA, 22 nt, Human
cacagucccauucgagaguaau

SEQ ID NO: 524636 - RNA, 22 nt, Human
uccagcucuaacaugcugggcc

SEQ ID NO: 524637 - RNA, 22 nt, Human
ugcagaccucccauggcugccu

SEQ ID NO: 524638 - RNA, 22 nt, Human
aaauguauugcauaggauauuu

SEQ ID NO: 524639 - RNA, 22 nt, Human
ucaguuuuaagguuugagaauu

SEQ ID NO: 524640 - RNA, 22 nt, Human
ucaaacuagccugacugguauu

SEQ ID NO: 524641 - RNA, 22 nt, Human
uuaccuguguguuugauacaua

SEQ ID NO: 524642 - RNA, 22 nt, Human
gggcucuguguucuagcucucg

SEQ ID NO: 524643 - RNA, 22 nt, Human
cuucauuucaggcugaagaaua

SEQ ID NO: 524644 - RNA, 22 nt, Human
gcucccacugcagcccugagcc

SEQ ID NO: 524645 - RNA, 21 nt, Human
ucacuagugccuucugucauu

SEQ ID NO: 524646 - RNA, 22 nt, Human
gagauauguuagaaagcuauug

SEQ ID NO: 524647 - RNA, 22 nt, Human
ccuguacuagggucucauugcc

SEQ ID NO: 524648 - RNA, 22 nt, Human
caaguccaagaucaagaagcca

SEQ ID NO: 524649 - RNA, 23 nt, Human
agaugaggcuucuccauguuggu

SEQ ID NO: 524650 - RNA, 22 nt, Human
gucugggccaggcgagccgagg

SEQ ID NO: 524651 - RNA, 19 nt, Human
agccagaacuaguguuucu

SEQ ID NO: 524652 - RNA, 22 nt, Human
caggaagagaacauggaggcug

SEQ ID NO: 524653 - RNA, 22 nt, Human
aggccuguuccuuccugggcac

SEQ ID NO: 524654 - RNA, 22 nt, Human
gaauuucaagcagugcaauguu

SEQ ID NO: 524655 - RNA, 22 nt, Human
ugagcuucaaaauaugugaauc

SEQ ID NO: 524656 - RNA, 22 nt, Human
uaauuuuacuuccugagcaccu

SEQ ID NO: 524657 - RNA, 22 nt, Human
agaauuguaagcaauuugauua

SEQ ID NO: 524658 - RNA, 20 nt, Human
uuagcuuuggcaauagugac

SEQ ID NO: 524659 - RNA, 22 nt, Human
cagggcuggauccuccagacuc

SEQ ID NO: 524660 - RNA, 22 nt, Human
cugccugugugugccugcagaa

SEQ ID NO: 524661 - RNA, 22 nt, Human
auuccaaagacagaagcagcug

SEQ ID NO: 524662 - RNA, 22 nt, Human
uccucuggauauaagccucacc

SEQ ID NO: 524663 - RNA, 19 nt, Human
ggcuccuguggcugcagcc

SEQ ID NO: 524664 - RNA, 21 nt, Human
uaaaugugagcagggcugggc

SEQ ID NO: 524665 - RNA, 22 nt, Human
gggcacagccuaacuauggaga

SEQ ID NO: 524666 - RNA, 22 nt, Human
aagagcuggaugaagaaaucaa

SEQ ID NO: 524667 - RNA, 22 nt, Human
gggcugggaauggcuaaguaug

SEQ ID NO: 524668 - RNA, 22 nt, Human
ugccacauggugcauuuccuag

SEQ ID NO: 524669 - RNA, 22 nt, Human
auuccaaagcacaucagaacua

SEQ ID NO: 524670 - RNA, 22 nt, Human
uaaguucaguuggucgaaguag

SEQ ID NO: 524671 - RNA, 17 nt, Human
gccuucucugcccucac

SEQ ID NO: 524672 - RNA, 22 nt, Human
cagcaucaacauucucagcucu

SEQ ID NO: 524673 - RNA, 22 nt, Human
caaggccugacugcuugucuaa

SEQ ID NO: 524674 - RNA, 19 nt, Human
uggaacaaacugcaaugac

SEQ ID NO: 524675 - RNA, 22 nt, Human
uccugaggaugguugaagugca

SEQ ID NO: 524676 - RNA, 22 nt, Human
agggaguuagaaauccaggaua

SEQ ID NO: 524677 - RNA, 22 nt, Human
cagcagcaaaucuagaagagga

SEQ ID NO: 524678 - RNA, 22 nt, Human
caugaaaauaacauuguuguga

SEQ ID NO: 524679 - RNA, 22 nt, Human
gccuguuuguuaugucauggua

SEQ ID NO: 524680 - RNA, 22 nt, Human
gugccaggugcuaagcugugcu

SEQ ID NO: 524681 - RNA, 22 nt, Human
ccugaagaugcuguggccuggu

SEQ ID NO: 524682 - RNA, 22 nt, Human
uggagcugaacuuugaggccag

SEQ ID NO: 524683 - RNA, 22 nt, Human
agggcccauagaucgucagcuu

SEQ ID NO: 524684 - RNA, 22 nt, Human
agugucugccagcugccaggug

SEQ ID NO: 524685 - RNA, 22 nt, Human
gggagcugguuccugcccucca

SEQ ID NO: 524686 - RNA, 22 nt, Human
ccagcugguguuccuuaggacc

SEQ ID NO: 524687 - RNA, 22 nt, Human
aagaguuaagcaacagauacca

SEQ ID NO: 524688 - RNA, 22 nt, Human
ugcuucuggggacaggcugccu

SEQ ID NO: 524689 - RNA, 22 nt, Human
acaucacacgccuuccaggagg

SEQ ID NO: 524690 - RNA, 22 nt, Human
aguggcagaucucuggucugga

SEQ ID NO: 524691 - RNA, 22 nt, Human
uaaggagagaauuuagagguuu

SEQ ID NO: 524692 - RNA, 22 nt, Human
caaaugcaaaauauaacccugu

SEQ ID NO: 524693 - RNA, 22 nt, Human
guagaauuuuaauaauggagau

SEQ ID NO: 524694 - RNA, 22 nt, Human
ggggaggccaguggaccguccc

SEQ ID NO: 524695 - RNA, 22 nt, Human
ggaucuggggcucugcugcuca

SEQ ID NO: 524696 - RNA, 22 nt, Human
gcugucugacuccaaguuggag

SEQ ID NO: 524697 - RNA, 22 nt, Human
cuuuucuggaaucaucucuaac

SEQ ID NO: 524698 - RNA, 22 nt, Human
cagcaaaauuugaggauugccu

SEQ ID NO: 524699 - RNA, 21 nt, Human
cccaggucguggucuucccag

SEQ ID NO: 524700 - RNA, 22 nt, Human
uuacaagaugggaaagggaagu

SEQ ID NO: 524701 - RNA, 22 nt, Human
gagaggaaagaaccaaugaccc

SEQ ID NO: 524702 - RNA, 22 nt, Human
gcugugcacuaccuauacaucc

SEQ ID NO: 524703 - RNA, 23 nt, Human
ucucagaggauuccugggccuug

SEQ ID NO: 524704 - RNA, 22 nt, Human
uucuuguuuauuaagauauaaa

SEQ ID NO: 524705 - RNA, 22 nt, Human
caugggagcuaucuccaucacu

SEQ ID NO: 524706 - RNA, 22 nt, Human
aaggagugcaugacucagagua

SEQ ID NO: 524707 - RNA, 22 nt, Human
caggggcucuaaugcaugauca

SEQ ID NO: 524708 - RNA, 23 nt, Human
ucuuguuuccuuugcgcuaucca

SEQ ID NO: 524709 - RNA, 22 nt, Human
agcaggcuuaugguugaaggga

SEQ ID NO: 524710 - RNA, 22 nt, Human
uuuucaguaaugucuacauaau

SEQ ID NO: 524711 - RNA, 22 nt, Human
ccuggccacucagguguggggc

SEQ ID NO: 524712 - RNA, 22 nt, Human
uugcaaaagccgaggcacucca

SEQ ID NO: 524713 - RNA, 22 nt, Human
uauauguguggauucuuguaga

SEQ ID NO: 524714 - RNA, 22 nt, Human
aguguccccuacagaggcauuc

SEQ ID NO: 524715 - RNA, 22 nt, Human
auguguuuugguggaucauuca

SEQ ID NO: 524716 - RNA, 22 nt, Human
uacagugcauagaggcaugaua

SEQ ID NO: 524717 - RNA, 22 nt, Human
acaggcucgugcgcgcacgugu

SEQ ID NO: 524718 - RNA, 21 nt, Human
cuggagucauuuucugaguag

SEQ ID NO: 524719 - RNA, 22 nt, Human
aaguccugugcuagagacaccu

SEQ ID NO: 524720 - RNA, 22 nt, Human
gacuguguccaugugcuggauu

SEQ ID NO: 524721 - RNA, 22 nt, Human
acuuuuaugauaaucaauguuc

SEQ ID NO: 524722 - RNA, 22 nt, Human
uuccuuggauacaaguaacuuu

SEQ ID NO: 524723 - RNA, 22 nt, Human
cuuuacagaaagagaacucugg

SEQ ID NO: 524724 - RNA, 22 nt, Human
uccuggccgccgcguggggccg

SEQ ID NO: 524725 - RNA, 22 nt, Human
ucugucugcgcuugcccuggug

SEQ ID NO: 524726 - RNA, 22 nt, Human
ggcuggcucagggcuugagaga

SEQ ID NO: 524727 - RNA, 22 nt, Human
uuuggaaaauauugaacugguu

SEQ ID NO: 524728 - RNA, 22 nt, Human
aaauguaguauguugcauguau

SEQ ID NO: 524729 - RNA, 22 nt, Human
agggcagcagcuccuccuagcu

SEQ ID NO: 524730 - RNA, 22 nt, Human
ucucaaauuuauacagaguuca

SEQ ID NO: 524731 - RNA, 22 nt, Human
cugccuuugcccuugacacugu

SEQ ID NO: 524732 - RNA, 22 nt, Human
ggccuuggggaggauggugucc

SEQ ID NO: 524733 - RNA, 22 nt, Human
aggaggcuguggagcacuccau

SEQ ID NO: 524734 - RNA, 22 nt, Human
gccccuuccaucaugugaggac

SEQ ID NO: 524735 - RNA, 22 nt, Human
ucacauuuucauauucucugag

SEQ ID NO: 524736 - RNA, 22 nt, Human
ugcauguuaagaaaauauugag

SEQ ID NO: 524737 - RNA, 22 nt, Human
ugccucugugggccuuccuggc

SEQ ID NO: 524738 - RNA, 22 nt, Human
uucacauuucauaccacagcuu

SEQ ID NO: 524739 - RNA, 22 nt, Human
cugcucuguauaugagcaggaa

SEQ ID NO: 524740 - RNA, 22 nt, Human
uuauuugcccauguuuagcaga

SEQ ID NO: 524741 - RNA, 22 nt, Human
auaauucagguuuucuggcaca

SEQ ID NO: 524742 - RNA, 22 nt, Human
cugggccagucucggccgcucu

SEQ ID NO: 524743 - RNA, 22 nt, Human
uuuuccucuguauuugaaaugc

SEQ ID NO: 524744 - RNA, 19 nt, Human
uuuacucuccaaggugagu

SEQ ID NO: 524745 - RNA, 22 nt, Human
aggggagcaaggccguggugua

SEQ ID NO: 524746 - RNA, 22 nt, Human
gguggccugcccugaucccugg

SEQ ID NO: 524747 - RNA, 18 nt, Human
gcacagagcccaggcucu

SEQ ID NO: 524748 - RNA, 22 nt, Human
aggcaacaugggccaggcagaa

SEQ ID NO: 524749 - RNA, 22 nt, Human
caguuucuacgacuuaagcaca

SEQ ID NO: 524750 - RNA, 22 nt, Human
uguccuggccaaggccuugcuu

SEQ ID NO: 524751 - RNA, 22 nt, Human
gggcuucuagaccagcagugag

SEQ ID NO: 524752 - RNA, 22 nt, Human
gugugcagcagagacaggacuc

SEQ ID NO: 524753 - RNA, 22 nt, Human
gagacugcauagauggccacaa

SEQ ID NO: 524754 - RNA, 22 nt, Human
gccaggcaauguguuagaagcg

SEQ ID NO: 524755 - RNA, 22 nt, Human
aggcccuuaggaccccugcgug

SEQ ID NO: 524756 - RNA, 22 nt, Human
cagugcauaaucuaaauggggg

SEQ ID NO: 524757 - RNA, 22 nt, Human
uggcagagaugaagaguuguuu

SEQ ID NO: 524758 - RNA, 22 nt, Human
aggaagccaugguggacgucua

SEQ ID NO: 524759 - RNA, 20 nt, Human
guguuucaugugauacaaug

SEQ ID NO: 524760 - RNA, 22 nt, Human
aaccucaggcucucuggacaau

SEQ ID NO: 524761 - RNA, 22 nt, Human
ggucuggcacucaugcagcagg

SEQ ID NO: 524762 - RNA, 18 nt, Human
cccacacagcaguagcuc

SEQ ID NO: 524763 - RNA, 22 nt, Human
uccuguuucaacccuuacacug

SEQ ID NO: 524764 - RNA, 22 nt, Human
ugggcugaguguggaacuaguu

SEQ ID NO: 524765 - RNA, 22 nt, Human
uuugcugaguugaaguuugagg

SEQ ID NO: 524766 - RNA, 22 nt, Human
gccaagcuuugcaggaguguug

SEQ ID NO: 524767 - RNA, 22 nt, Human
guaggaagcucugaggcuaguu

SEQ ID NO: 524768 - RNA, 22 nt, Human
aaguuucauuguucauguaaca

SEQ ID NO: 524769 - RNA, 22 nt, Human
cucucccccacagcagccuucu

SEQ ID NO: 524770 - RNA, 22 nt, Human
cagcuucagcgugacaccagug

SEQ ID NO: 524771 - RNA, 22 nt, Human
ggagaguuguuuuugccuagau

SEQ ID NO: 524772 - RNA, 22 nt, Human
cuucuuuacuuucuagaaauaa

SEQ ID NO: 524773 - RNA, 22 nt, Human
cuggaaagucaggucagaaacu

SEQ ID NO: 524774 - RNA, 22 nt, Human
uggcacuuagaucagguugggu

SEQ ID NO: 524775 - RNA, 21 nt, Human
ucugucucuccacugcccugc

SEQ ID NO: 524776 - RNA, 22 nt, Human
aaaggcuaugagauagaagaua

SEQ ID NO: 524777 - RNA, 22 nt, Human
uuugggcaguagauguaucacu

SEQ ID NO: 524778 - RNA, 22 nt, Human
ucucagcaacgauccggaguaa

SEQ ID NO: 524779 - RNA, 22 nt, Human
cucggaauggaacaacagcggu

SEQ ID NO: 524780 - RNA, 22 nt, Human
gcuaggaagaagggugcuugaa

SEQ ID NO: 524781 - RNA, 21 nt, Human
uggcugccuggcucugugguu

SEQ ID NO: 524782 - RNA, 21 nt, Human
agcugccuccacuucugaggc

SEQ ID NO: 524783 - RNA, 22 nt, Human
ucugggaguuagaauacauggg

SEQ ID NO: 524784 - RNA, 22 nt, Human
ggagccagugcccucuggugga

SEQ ID NO: 524785 - RNA, 22 nt, Human
gaggaacccagcugggguugcc

SEQ ID NO: 524786 - RNA, 22 nt, Human
uggagggcucuuucaccuggua

SEQ ID NO: 524787 - RNA, 22 nt, Human
ccucccacauccuagcucugcu

SEQ ID NO: 524788 - RNA, 22 nt, Human
cccagcaguuguuggugcacau

SEQ ID NO: 524789 - RNA, 22 nt, Human
ccaugugcuugcucuggcaccu

SEQ ID NO: 524790 - RNA, 22 nt, Human
uaggaaaagcacaggauguucu

SEQ ID NO: 524791 - RNA, 21 nt, Human
cagugggcugcugcgcuccag

SEQ ID NO: 524792 - RNA, 22 nt, Human
uugcagggaccugcagaaagcu

SEQ ID NO: 524793 - RNA, 22 nt, Human
ggggaagaauggcagaaaacau

SEQ ID NO: 524794 - RNA, 22 nt, Human
ggcaggugagagcucuuugaaa

SEQ ID NO: 524795 - RNA, 22 nt, Human
cccauggagugccugagggcca

SEQ ID NO: 524796 - RNA, 22 nt, Human
caggcugagcucuggccugggc

SEQ ID NO: 524797 - RNA, 22 nt, Human
cauguacacucauguaacuaua

SEQ ID NO: 524798 - RNA, 22 nt, Human
caaggaaggagagaugaugggu

SEQ ID NO: 524799 - RNA, 23 nt, Human
agcauuagagaugccagcccugu

SEQ ID NO: 524800 - RNA, 22 nt, Human
cagccugcagggcugccuguug

SEQ ID NO: 524801 - RNA, 22 nt, Human
ggucacugcucuaaacaaaagu

SEQ ID NO: 524802 - RNA, 22 nt, Human
uugcauugggagugaggagacc

SEQ ID NO: 524803 - RNA, 22 nt, Human
cccuggagggcagacagaugcc

SEQ ID NO: 524804 - RNA, 22 nt, Human
uggaaauuaaaauuccucuuaa

SEQ ID NO: 524805 - RNA, 22 nt, Human
uggcuggggccugaauccugca

SEQ ID NO: 524806 - RNA, 22 nt, Human
aaauuugauaagccauuguuac

SEQ ID NO: 524807 - RNA, 18 nt, Human
gcucugcccaggcugccc

SEQ ID NO: 524808 - RNA, 22 nt, Human
aaggcacuuuucuaaagaccuu

SEQ ID NO: 524809 - RNA, 22 nt, Human
acguuuucagugacugugcuuc

SEQ ID NO: 524810 - RNA, 22 nt, Human
acauuuuaauaugcuuagugug

SEQ ID NO: 524811 - RNA, 22 nt, Human
cagcagguauguuuguucagca

SEQ ID NO: 524812 - RNA, 22 nt, Human
cucugagggucuaaggagucac

SEQ ID NO: 524813 - RNA, 20 nt, Human
gccauccagccucccaggag

SEQ ID NO: 524814 - RNA, 22 nt, Human
ucccaggcugggggccugaagu

SEQ ID NO: 524815 - RNA, 22 nt, Human
aaggcagauauaaagacuagag

SEQ ID NO: 524816 - RNA, 22 nt, Human
uuuuaucuaccuaugcucauuu

SEQ ID NO: 524817 - RNA, 22 nt, Human
aaaagguagauucuccuucuau

SEQ ID NO: 524818 - RNA, 22 nt, Human
gccaaagcagucuugccucugc

SEQ ID NO: 524819 - RNA, 22 nt, Human
cuuuuccucaggaggagacgcg

SEQ ID NO: 524820 - RNA, 22 nt, Human
ugacaaaacugcaauuacuuuu

SEQ ID NO: 524821 - RNA, 22 nt, Human
agguggcucugacagcucuggu

SEQ ID NO: 524822 - RNA, 22 nt, Human
caggaaauauaggaaaaggaac

SEQ ID NO: 524823 - RNA, 21 nt, Human
agaugcugugcuccaggagca

SEQ ID NO: 524824 - RNA, 22 nt, Human
ugugaagguuaaauaauaugau

SEQ ID NO: 524825 - RNA, 22 nt, Human
uauuugaugguucuaaaacagc

SEQ ID NO: 524826 - RNA, 22 nt, Human
uuggcagcauuccagccaagca

SEQ ID NO: 524827 - RNA, 22 nt, Human
uucaggauggaguaccuuuuau

SEQ ID NO: 524828 - RNA, 22 nt, Human
gcugucacacaugggaucucag

SEQ ID NO: 524829 - RNA, 22 nt, Human
gagccucguggcggccacugcg

SEQ ID NO: 524830 - RNA, 19 nt, Human
uggcagggagaguuugaag

SEQ ID NO: 524831 - RNA, 22 nt, Human
ucucuggggguagaacucaggc

SEQ ID NO: 524832 - RNA, 22 nt, Human
ucagaggcuuccuuccucggag

SEQ ID NO: 524833 - RNA, 22 nt, Human
ucaguguuuuccagggucuacu

SEQ ID NO: 524834 - RNA, 22 nt, Human
uguguuuacuucuaugcaguuu

SEQ ID NO: 524835 - RNA, 22 nt, Human
agaaggcucacuaagagugacu

SEQ ID NO: 524836 - RNA, 22 nt, Human
aguuuagaagaggaacuuguua

SEQ ID NO: 524837 - RNA, 17 nt, Human
gucugggcuuuagagac

SEQ ID NO: 524838 - RNA, 18 nt, Human
aagcaggguccauugugc

SEQ ID NO: 524839 - RNA, 22 nt, Human
aaaaucugguaauuugaaugug

SEQ ID NO: 524840 - RNA, 22 nt, Human
ggcucuggugaggguaggagau

SEQ ID NO: 524841 - RNA, 22 nt, Human
gagucuggugauggucauuguc

SEQ ID NO: 524842 - RNA, 22 nt, Human
aagaggaagucuccauggagag

SEQ ID NO: 524843 - RNA, 22 nt, Human
uauugaaauccauuacguucuu

SEQ ID NO: 524844 - RNA, 22 nt, Human
augaacacauguacacauuucu

SEQ ID NO: 524845 - RNA, 22 nt, Human
cagccaggagcucccccugcuc

SEQ ID NO: 524846 - RNA, 22 nt, Human
ucuggaguccagauccauuugg

SEQ ID NO: 524847 - RNA, 22 nt, Human
auggcugcccacguuggugcuu

SEQ ID NO: 524848 - RNA, 22 nt, Human
aaagaguucuaugaucuuucca

SEQ ID NO: 524849 - RNA, 22 nt, Human
cugggucuggcuacugcuuccu

SEQ ID NO: 524850 - RNA, 22 nt, Human
guaucuuuugguggaaaaauaa

SEQ ID NO: 524851 - RNA, 22 nt, Human
aaugcacauauauguguauaca

SEQ ID NO: 524852 - RNA, 22 nt, Human
agcucugcuucuugggaagaug

SEQ ID NO: 524853 - RNA, 22 nt, Human
agugccauggaggaacagaugc

SEQ ID NO: 524854 - RNA, 22 nt, Human
gaggagaaugcgcaccacauau

SEQ ID NO: 524855 - RNA, 17 nt, Human
gguguauggggagggaa

SEQ ID NO: 524856 - RNA, 22 nt, Human
aggugggcgcugcucccgcugg

SEQ ID NO: 524857 - RNA, 22 nt, Human
agugucugcuuugagucaggug

SEQ ID NO: 524858 - RNA, 22 nt, Human
uucacagaugagaaaauugagg

SEQ ID NO: 524859 - RNA, 22 nt, Human
gcagagcauguccucaggacag

SEQ ID NO: 524860 - RNA, 22 nt, Human
agguccaguugccagaauggcc

SEQ ID NO: 524861 - RNA, 22 nt, Human
uuguccugugauuucagggccu

SEQ ID NO: 524862 - RNA, 22 nt, Human
agccuaggggguccugggccac

SEQ ID NO: 524863 - RNA, 20 nt, Human
gcugggggugugcugaguga

SEQ ID NO: 524864 - RNA, 22 nt, Human
gccuggaguagcauggcaagcc

SEQ ID NO: 524865 - RNA, 22 nt, Human
aaaagguuuugaguacaaauau

SEQ ID NO: 524866 - RNA, 22 nt, Human
cugggagucuggccucuggucc

SEQ ID NO: 524867 - RNA, 22 nt, Human
ccugagauggggauuauuccaa

SEQ ID NO: 524868 - RNA, 22 nt, Human
ggagugaguacuggaguagcug

SEQ ID NO: 524869 - RNA, 22 nt, Human
cccucccugaagaaguuacucu

SEQ ID NO: 524870 - RNA, 18 nt, Human
aggccucugugugcccag

SEQ ID NO: 524871 - RNA, 22 nt, Human
acaaagcacgagugccauggac

SEQ ID NO: 524872 - RNA, 22 nt, Human
cugcugcucgaccagucccagg

SEQ ID NO: 524873 - RNA, 22 nt, Human
guagcuuccagaaagugucuuu

SEQ ID NO: 524874 - RNA, 22 nt, Human
guucagcacaggugcucagaca

SEQ ID NO: 524875 - RNA, 21 nt, Human
aggcuguccuuugccagcccu

SEQ ID NO: 524876 - RNA, 22 nt, Human
ucugggcucugggaauuaggga

SEQ ID NO: 524877 - RNA, 22 nt, Human
ucucaggaguagugggauccau

SEQ ID NO: 524878 - RNA, 22 nt, Human
acagaauucucucugcagaggc

SEQ ID NO: 524879 - RNA, 22 nt, Human
uuacaauaccacaucaccucau

SEQ ID NO: 524880 - RNA, 22 nt, Human
ugcagcuguuacggacccuguc

SEQ ID NO: 524881 - RNA, 22 nt, Human
acuauacauugaauguuaaggu

SEQ ID NO: 524882 - RNA, 22 nt, Human
aggccuggugaaugaaguaucu

SEQ ID NO: 524883 - RNA, 22 nt, Human
ugccagcuuuugacuaucuuag

SEQ ID NO: 524884 - RNA, 22 nt, Human
cauucauuagaauagauaugua

SEQ ID NO: 524885 - RNA, 22 nt, Human
ugggaccugcucuuggaaugag

SEQ ID NO: 524886 - RNA, 20 nt, Human
uccagcugggaacagcugau

SEQ ID NO: 524887 - RNA, 22 nt, Human
ugaaugauauauugggaauaau

SEQ ID NO: 524888 - RNA, 22 nt, Human
gugacuguuuuuaggaggagua

SEQ ID NO: 524889 - RNA, 22 nt, Human
ccagcccuuagauaaaccuggc

SEQ ID NO: 524890 - RNA, 22 nt, Human
acaaugaauaucaugaaguacu

SEQ ID NO: 524891 - RNA, 22 nt, Human
aucccacaccccuacaacauau

SEQ ID NO: 524892 - RNA, 22 nt, Human
acagcugggugucccacuucug

SEQ ID NO: 524893 - RNA, 19 nt, Human
uuugaaagaguuuuauugg

SEQ ID NO: 524894 - RNA, 22 nt, Human
ucccagagccaagcuauggaug

SEQ ID NO: 524895 - RNA, 22 nt, Human
cccagggaagggcuaccugagg

SEQ ID NO: 524896 - RNA, 22 nt, Human
uauaaaauggcaucagcuccaa

SEQ ID NO: 524897 - RNA, 22 nt, Human
ugaaaucauugccaaguauuga

SEQ ID NO: 524898 - RNA, 20 nt, Human
ccuuuauuauuuguaugaug

SEQ ID NO: 524899 - RNA, 22 nt, Human
auucaguuaaaaacuguacuuc

SEQ ID NO: 524900 - RNA, 22 nt, Human
aggcuaggccuugcccuggaac

SEQ ID NO: 524901 - RNA, 22 nt, Human
gcuuccagggcucagucacugc

SEQ ID NO: 524902 - RNA, 23 nt, Human
ccugaagggucaggguccucagc

SEQ ID NO: 524903 - RNA, 22 nt, Human
gacaaaacacauuaguuuaaaa

SEQ ID NO: 524904 - RNA, 22 nt, Human
ucaagauaccaccauuauaugu

SEQ ID NO: 524905 - RNA, 23 nt, Human
acauuacuuagccagagucucag

SEQ ID NO: 524906 - RNA, 22 nt, Human
gcagcaugagcuauacaaagua

SEQ ID NO: 524907 - RNA, 21 nt, Human
ggggcagagcuaggcccugca

SEQ ID NO: 524908 - RNA, 22 nt, Human
aauaagaauuuacuugucaaga

SEQ ID NO: 524909 - RNA, 22 nt, Human
uuuucaguuugcacugcagugc

SEQ ID NO: 524910 - RNA, 22 nt, Human
gcucuggccagacccucagugg

SEQ ID NO: 524911 - RNA, 22 nt, Human
aguaaaauuaauggaucagaag

SEQ ID NO: 524912 - RNA, 22 nt, Human
acuguacaaauauugcaaaaua

SEQ ID NO: 524913 - RNA, 22 nt, Human
aacacauggcaagagcaggaaa

SEQ ID NO: 524914 - RNA, 22 nt, Human
ucagcaggcccauccuccaggc

SEQ ID NO: 524915 - RNA, 22 nt, Human
caguccugggcacagcccuggg

SEQ ID NO: 524916 - RNA, 20 nt, Human
ucccagucagccagagugag

SEQ ID NO: 524917 - RNA, 22 nt, Human
cagccugacuauggcugcaggu

SEQ ID NO: 524918 - RNA, 22 nt, Human
auaauacaugguugaucuuuuc

SEQ ID NO: 524919 - RNA, 23 nt, Human
caugugugacaguaucacuguuu

SEQ ID NO: 524920 - RNA, 22 nt, Human
agaggugacauaggagaggcuc

SEQ ID NO: 524921 - RNA, 22 nt, Human
aaugucugcucuacucaggagg

SEQ ID NO: 524922 - RNA, 22 nt, Human
gcugccaugccacagcacucac

SEQ ID NO: 524923 - RNA, 21 nt, Human
auuuagaaggaaauuuugcaa

SEQ ID NO: 524924 - RNA, 22 nt, Human
cggcagcaaaggaagccagguc

SEQ ID NO: 524925 - RNA, 22 nt, Human
aucugguuuggggauccuugug

SEQ ID NO: 524926 - RNA, 22 nt, Human
ucccagagauuuccucuccuuc

SEQ ID NO: 524927 - RNA, 22 nt, Human
cauugaaauauggaaacugaug

SEQ ID NO: 524928 - RNA, 23 nt, Human
gcagagucaaguagucaugagug

SEQ ID NO: 524929 - RNA, 19 nt, Human
ccugggucugcagcauuca

SEQ ID NO: 524930 - RNA, 22 nt, Human
aacacauuuugccuaggcaaua

SEQ ID NO: 524931 - RNA, 22 nt, Human
cagcauggagacaaagugggca

SEQ ID NO: 524932 - RNA, 22 nt, Human
uggcagcuggagggcaauggcc

SEQ ID NO: 524933 - RNA, 22 nt, Human
caucagcacuaugauuaaagua

SEQ ID NO: 524934 - RNA, 17 nt, Human
cuggagccuccaacucc

SEQ ID NO: 524935 - RNA, 22 nt, Human
gagacacacacaggagguggca

SEQ ID NO: 524936 - RNA, 20 nt, Human
aggaagccaaaggcugucuu

SEQ ID NO: 524937 - RNA, 22 nt, Human
agcuccugcccaggaaggcucu

SEQ ID NO: 524938 - RNA, 22 nt, Human
ugaguucaaguccaaguugcug

SEQ ID NO: 524939 - RNA, 22 nt, Human
aggcagcguagcaaggcuagua

SEQ ID NO: 524940 - RNA, 22 nt, Human
ucuuuuucuuauucccacacug

SEQ ID NO: 524941 - RNA, 22 nt, Human
uugucugugaaauggaaauagu

SEQ ID NO: 524942 - RNA, 22 nt, Human
gcagauggacuguaugaccuga

SEQ ID NO: 524943 - RNA, 22 nt, Human
ugcuuuaucaaagcuauaguga

SEQ ID NO: 524944 - RNA, 22 nt, Human
cuggccuggagccucugggugg

SEQ ID NO: 524945 - RNA, 22 nt, Human
auacaguguacuauuuagcagu

SEQ ID NO: 524946 - RNA, 22 nt, Human
gaucuugaaauaucuuuuccua

SEQ ID NO: 524947 - RNA, 22 nt, Human
agugaauguccccgcgggucag

SEQ ID NO: 524948 - RNA, 22 nt, Human
gucugagaaucuugcauaucau

SEQ ID NO: 524949 - RNA, 22 nt, Human
uggcucugugcuucuaguaucu

SEQ ID NO: 524950 - RNA, 18 nt, Human
aggccugggaagcugagg

SEQ ID NO: 524951 - RNA, 22 nt, Human
acacaguaugacauuggcagag

SEQ ID NO: 524952 - RNA, 22 nt, Human
ccaaaauguuugaaugcaugug

SEQ ID NO: 524953 - RNA, 22 nt, Human
ugauuuccuagcugacaugaaa

SEQ ID NO: 524954 - RNA, 22 nt, Human
ccuuucucuuugcugaucaugu

SEQ ID NO: 524955 - RNA, 22 nt, Human
aagucauugguagcuugauagg

SEQ ID NO: 524956 - RNA, 22 nt, Human
ggcccacuugaaauggagcuca

SEQ ID NO: 524957 - RNA, 22 nt, Human
uuuuggcucugucuguaucuuu

SEQ ID NO: 524958 - RNA, 22 nt, Human
ggagccaggcauaucggggcac

SEQ ID NO: 524959 - RNA, 22 nt, Human
caugugugaagacugcgggcca

SEQ ID NO: 524960 - RNA, 22 nt, Human
auccaaaguagauuaagucaca

SEQ ID NO: 524961 - RNA, 22 nt, Human
cagggcagggccacacccccug

SEQ ID NO: 524962 - RNA, 22 nt, Human
ccauacacacaccaaauuugua

SEQ ID NO: 524963 - RNA, 23 nt, Human
ugucauugugacuacagaaccag

SEQ ID NO: 524964 - RNA, 22 nt, Human
gcccccucuuuggagccagcca

SEQ ID NO: 524965 - RNA, 22 nt, Human
uaugacaagguggaguaugagu

SEQ ID NO: 524966 - RNA, 22 nt, Human
uuucuaaguaucuugcaguuuu

SEQ ID NO: 524967 - RNA, 22 nt, Human
cugaaaauguuacacaggaaga

SEQ ID NO: 524968 - RNA, 22 nt, Human
aguguuucucagaagggccuau

SEQ ID NO: 524969 - RNA, 22 nt, Human
uauacaggaacuguuggcuccc

SEQ ID NO: 524970 - RNA, 22 nt, Human
cugucaggggcggguggagcgg

SEQ ID NO: 524971 - RNA, 22 nt, Human
agauuucaauggauauugcaag

SEQ ID NO: 524972 - RNA, 22 nt, Human
cagagucucugggaggcugggu

SEQ ID NO: 524973 - RNA, 22 nt, Human
cuucucuuccuuugucaacuga

SEQ ID NO: 524974 - RNA, 22 nt, Human
aucaguuuaacugucaagagcc

SEQ ID NO: 524975 - RNA, 21 nt, Human
agacagagugcagucuacaua

SEQ ID NO: 524976 - RNA, 22 nt, Human
ggcagcugugaagugccucaca

SEQ ID NO: 524977 - RNA, 22 nt, Human
uacauucuacuuuuucacuccc

SEQ ID NO: 524978 - RNA, 22 nt, Human
ucgcauuugggcaggagaugcu

SEQ ID NO: 524979 - RNA, 22 nt, Human
agguucuugguguccagauuuc

SEQ ID NO: 524980 - RNA, 22 nt, Human
ccuggccugcucggcucuuaag

SEQ ID NO: 524981 - RNA, 20 nt, Human
aggcagagcgcacuuuuaga

SEQ ID NO: 524982 - RNA, 22 nt, Human
aggcuggguaccugucauaugc

SEQ ID NO: 524983 - RNA, 22 nt, Human
ccucuggcaacuucacagccca

SEQ ID NO: 524984 - RNA, 22 nt, Human
guguacauagaauugugcuuug

SEQ ID NO: 524985 - RNA, 22 nt, Human
ccagacaggaacacacaucucc

SEQ ID NO: 524986 - RNA, 22 nt, Human
ugacccugcuucuuggugcagg

SEQ ID NO: 524987 - RNA, 22 nt, Human
cuacuucugugaugaaacuaca

SEQ ID NO: 524988 - RNA, 22 nt, Human
uagauaaaagggcaaagggcau

SEQ ID NO: 524989 - RNA, 22 nt, Human
gcaaacauucaggaguacagga

SEQ ID NO: 524990 - RNA, 22 nt, Human
aaggcaggaugcggacccaucu

SEQ ID NO: 524991 - RNA, 22 nt, Human
ggccugagcucuggggaggcaa

SEQ ID NO: 524992 - RNA, 22 nt, Human
gucauuguguggacauggagaa

SEQ ID NO: 524993 - RNA, 22 nt, Human
agggugaaucucacaacucuua

SEQ ID NO: 524994 - RNA, 22 nt, Human
aaauauuugucugaggcgguug

SEQ ID NO: 524995 - RNA, 20 nt, Human
uccuggccucccuggggcuc

SEQ ID NO: 524996 - RNA, 22 nt, Human
ugggcuacucugggagccuaac

SEQ ID NO: 524997 - RNA, 22 nt, Human
ucauugcaccccagucccagcu

SEQ ID NO: 524998 - RNA, 22 nt, Human
agagaauuuuaaaagccuugaa

SEQ ID NO: 524999 - RNA, 20 nt, Human
ugccaugguaacagagugug

SEQ ID NO: 525000 - RNA, 22 nt, Human
aggggagccgaggggcaucugu

SEQ ID NO: 525001 - RNA, 22 nt, Human
uggccuggggaccugugagacc

SEQ ID NO: 525002 - RNA, 22 nt, Human
gagcuuuaccuuagguucuguu

SEQ ID NO: 525003 - RNA, 22 nt, Human
gguguccaucaggcugugcuuc

SEQ ID NO: 525004 - RNA, 22 nt, Human
caguauuuguucccuaucaaug

SEQ ID NO: 525005 - RNA, 22 nt, Human
gcccagcacauugcugaggacc

SEQ ID NO: 525006 - RNA, 22 nt, Human
ggucacccaugaucacaucacc

SEQ ID NO: 525007 - RNA, 22 nt, Human
uuggcucaggaccccugugacu

SEQ ID NO: 525008 - RNA, 19 nt, Human
gccugcagaaaaggcaggg

SEQ ID NO: 525009 - RNA, 22 nt, Human
caguuugucuugauucagaaca

SEQ ID NO: 525010 - RNA, 22 nt, Human
aguuuauagcccagauucaugg

SEQ ID NO: 525011 - RNA, 22 nt, Human
gaggagaagcuaagaaacacag

SEQ ID NO: 525012 - RNA, 22 nt, Human
gaggucugggauggggccugaa

SEQ ID NO: 525013 - RNA, 22 nt, Human
gcucccagcuggagccucaaca

SEQ ID NO: 525014 - RNA, 22 nt, Human
uccucccuucucacugggaagg

SEQ ID NO: 525015 - RNA, 23 nt, Human
ccuggggcacuugaguccucauc

SEQ ID NO: 525016 - RNA, 22 nt, Human
gauucaauguugcagauggaau

SEQ ID NO: 525017 - RNA, 22 nt, Human
ucuuuuggguucuuaugauuua

SEQ ID NO: 525018 - RNA, 22 nt, Human
uuuggaauuccauuucugcauu

SEQ ID NO: 525019 - RNA, 22 nt, Human
guugaaagaugucuugguuccc

SEQ ID NO: 525020 - RNA, 22 nt, Human
cacauacuuguguguacauaug

SEQ ID NO: 525021 - RNA, 19 nt, Human
ucaaagucugagucacuuu

SEQ ID NO: 525022 - RNA, 22 nt, Human
uccagggaugccagccauguug

SEQ ID NO: 525023 - RNA, 22 nt, Human
auuccacauaggccuucaugac

SEQ ID NO: 525024 - RNA, 22 nt, Human
uccccuuggcuuggucaagagg

SEQ ID NO: 525025 - RNA, 22 nt, Human
aagaaacuguugcgugacagcg

SEQ ID NO: 525026 - RNA, 22 nt, Human
aagcuuuaagugucagucagcc

SEQ ID NO: 525027 - RNA, 22 nt, Human
uccucugcuggaagggcaagag

SEQ ID NO: 525028 - RNA, 22 nt, Human
uccaucagauucccuccugaga

SEQ ID NO: 525029 - RNA, 22 nt, Human
ucuggaucucccucauccuggg

SEQ ID NO: 525030 - RNA, 22 nt, Human
gggaaggacacagccaugacug

SEQ ID NO: 525031 - RNA, 23 nt, Human
uggcuaaacaguggagaaagcuu

SEQ ID NO: 525032 - RNA, 21 nt, Human
agaagccuggguggagguggg

SEQ ID NO: 525033 - RNA, 22 nt, Human
gcaggccugacuguagggggca

SEQ ID NO: 525034 - RNA, 22 nt, Human
caggaccccauauucacugaac

SEQ ID NO: 525035 - RNA, 22 nt, Human
ucuaccacuaagugugcuuuga

SEQ ID NO: 525036 - RNA, 22 nt, Human
uuaggaaaaucaugagagauga

SEQ ID NO: 525037 - RNA, 20 nt, Human
gcaaggcacagugaggaggg

SEQ ID NO: 525038 - RNA, 22 nt, Human
gauuucaaguaucuugggcgag

SEQ ID NO: 525039 - RNA, 22 nt, Human
agcauuuauuucuuagaaauug

SEQ ID NO: 525040 - RNA, 22 nt, Human
guuauguaugggggccuuauga

SEQ ID NO: 525041 - RNA, 18 nt, Human
uaugagaagauuagcaau

SEQ ID NO: 525042 - RNA, 22 nt, Human
uuuacagcuagacauaccugag

SEQ ID NO: 525043 - RNA, 18 nt, Human
ggccucuggacuggcagc

SEQ ID NO: 525044 - RNA, 20 nt, Human
ugcccagcaagagugcaguu

SEQ ID NO: 525045 - RNA, 22 nt, Human
acagugcagugugaugaguauu

SEQ ID NO: 525046 - RNA, 22 nt, Human
gggcagcagaggaucccuuaau

SEQ ID NO: 525047 - RNA, 22 nt, Human
uguuuaaauagaacauacugca

SEQ ID NO: 525048 - RNA, 22 nt, Human
uccuuggcaugccgucuucucc

SEQ ID NO: 525049 - RNA, 22 nt, Human
cagugcaauuacaagcuaauuc

SEQ ID NO: 525050 - RNA, 22 nt, Human
agaaguauucugcauguacuga

SEQ ID NO: 525051 - RNA, 22 nt, Human
uuucugaauuccuaggauguug

SEQ ID NO: 525052 - RNA, 22 nt, Human
cugucugaauccuaagcuuccu

SEQ ID NO: 525053 - RNA, 22 nt, Human
agagaaaguccugaucucucua

SEQ ID NO: 525054 - RNA, 19 nt, Human
cuggcagccugucuguguc

SEQ ID NO: 525055 - RNA, 22 nt, Human
ucagcugagcuccagcucauag

SEQ ID NO: 525056 - RNA, 22 nt, Human
ucugguuagccaauaaugccaa

SEQ ID NO: 525057 - RNA, 22 nt, Human
ccugguguugccaaucugugcc

SEQ ID NO: 525058 - RNA, 22 nt, Human
aguugcagacgcagagauguug

SEQ ID NO: 525059 - RNA, 22 nt, Human
gagccuggauugucaccgacuu

SEQ ID NO: 525060 - RNA, 19 nt, Human
ggaccagguccugggcagc

SEQ ID NO: 525061 - RNA, 22 nt, Human
ugaaugaguuuggcugcuguuc

SEQ ID NO: 525062 - RNA, 22 nt, Human
uucaguguuaaauucaaagagu

SEQ ID NO: 525063 - RNA, 22 nt, Human
ggaagagggaaccacgacugua

SEQ ID NO: 525064 - RNA, 22 nt, Human
uacagugugacauuucuacaaa

SEQ ID NO: 525065 - RNA, 22 nt, Human
caggccugucugcacaugaggc

SEQ ID NO: 525066 - RNA, 22 nt, Human
uguauuccaaaaugcugaggau

SEQ ID NO: 525067 - RNA, 22 nt, Human
cagagagagucaaaucuuugcu

SEQ ID NO: 525068 - RNA, 18 nt, Human
gcagcuuuugauucaccc

SEQ ID NO: 525069 - RNA, 22 nt, Human
uccugggcuugcuccuccagcu

SEQ ID NO: 525070 - RNA, 22 nt, Human
ugugccagaaaauaugcugagg

SEQ ID NO: 525071 - RNA, 22 nt, Human
ugagcugggcugggcugagcug

SEQ ID NO: 525072 - RNA, 22 nt, Human
uucccaguuagucauuuuuaca

SEQ ID NO: 525073 - RNA, 22 nt, Human
ggccugcuccgggggcugagcu

SEQ ID NO: 525074 - RNA, 22 nt, Human
guccuuggcugggcuugccucg

SEQ ID NO: 525075 - RNA, 22 nt, Human
cacauacaaggcacacuggagg

SEQ ID NO: 525076 - RNA, 22 nt, Human
ccccacucucggccagauaggc

SEQ ID NO: 525077 - RNA, 22 nt, Human
uuauuuugguaaauguuugccu

SEQ ID NO: 525078 - RNA, 22 nt, Human
acacugaguauugaguagggua

SEQ ID NO: 525079 - RNA, 20 nt, Human
gcccacucuaauccacuguc

SEQ ID NO: 525080 - RNA, 22 nt, Human
gaccugccugagcugccucugc

SEQ ID NO: 525081 - RNA, 22 nt, Human
uguccuggggacaagaggcccu

SEQ ID NO: 525082 - RNA, 22 nt, Human
uagaaaugauuuugaugcuuca

SEQ ID NO: 525083 - RNA, 22 nt, Human
ugucuuuauauauuuggaaaau

SEQ ID NO: 525084 - RNA, 22 nt, Human
agaugaaaauacgugacuuuaa

SEQ ID NO: 525085 - RNA, 22 nt, Human
aaaugcaugugcuauagaugug

SEQ ID NO: 525086 - RNA, 22 nt, Human
cucagaauuuagggcucugagg

SEQ ID NO: 525087 - RNA, 22 nt, Human
gagguucauucagcucugucac

SEQ ID NO: 525088 - RNA, 22 nt, Human
ccugggcagggcuggacucuca

SEQ ID NO: 525089 - RNA, 22 nt, Human
gggcugagggguaucucauggg

SEQ ID NO: 525090 - RNA, 22 nt, Human
caggcgggcaggugcggccccu

SEQ ID NO: 525091 - RNA, 22 nt, Human
caauuucucgaacucuaaucca

SEQ ID NO: 525092 - RNA, 22 nt, Human
guaacagaaagucaugcucauu

SEQ ID NO: 525093 - RNA, 22 nt, Human
gggaaggcugccugagggaugg

SEQ ID NO: 525094 - RNA, 22 nt, Human
uuugcauuaucucacuuauaua

SEQ ID NO: 525095 - RNA, 22 nt, Human
gcugggcuguaguuugcugacc

SEQ ID NO: 525096 - RNA, 22 nt, Human
ugcuggaguggcacuguguggc

SEQ ID NO: 525097 - RNA, 22 nt, Human
ugggcucugaagggucccggau

SEQ ID NO: 525098 - RNA, 22 nt, Human
gaugaggaaaccaaggcucagg

SEQ ID NO: 525099 - RNA, 22 nt, Human
uuauuuguggcauaugagacga

SEQ ID NO: 525100 - RNA, 22 nt, Human
aguauuuccuggcuuaucugcu

SEQ ID NO: 525101 - RNA, 22 nt, Human
uucagucuccucauuuuacaaa

SEQ ID NO: 525102 - RNA, 21 nt, Human
gugucaugguugacuuuggca

SEQ ID NO: 525103 - RNA, 22 nt, Human
gagaggcccuguggucccagcu

SEQ ID NO: 525104 - RNA, 22 nt, Human
cugagcucuaaugucagccuug

SEQ ID NO: 525105 - RNA, 22 nt, Human
ggcacagccacuuuggagaacu

SEQ ID NO: 525106 - RNA, 22 nt, Human
uugaagaucuuugcauugcagg

SEQ ID NO: 525107 - RNA, 22 nt, Human
cuucuggguauuccagauaccu

SEQ ID NO: 525108 - RNA, 22 nt, Human
ucugggucuaugaucucacuuc

SEQ ID NO: 525109 - RNA, 22 nt, Human
gucccagagagcacuaguccau

SEQ ID NO: 525110 - RNA, 22 nt, Human
guccagccagcugguccuugcc

SEQ ID NO: 525111 - RNA, 22 nt, Human
gccaccucccaggacgaggcug

SEQ ID NO: 525112 - RNA, 22 nt, Human
ucaucaguguccuuaucacuua

SEQ ID NO: 525113 - RNA, 22 nt, Human
aaugggaaaagaguaugauuua

SEQ ID NO: 525114 - RNA, 22 nt, Human
caguauuuauggcuugaguauu

SEQ ID NO: 525115 - RNA, 22 nt, Human
uauuuugacuauuaaaccaaca

SEQ ID NO: 525116 - RNA, 22 nt, Human
ccagcaccuugaucuuggaguu

SEQ ID NO: 525117 - RNA, 22 nt, Human
ucagcacuuggauuucagagau

SEQ ID NO: 525118 - RNA, 22 nt, Human
gacagcagccacagggagaggg

SEQ ID NO: 525119 - RNA, 22 nt, Human
ugcuggccugggcugcaccuug

SEQ ID NO: 525120 - RNA, 22 nt, Human
ugggaccuguuacauugaguua

SEQ ID NO: 525121 - RNA, 22 nt, Human
agacugggauucucccugauca

SEQ ID NO: 525122 - RNA, 22 nt, Human
aggucugggcaccacuggcugc

SEQ ID NO: 525123 - RNA, 22 nt, Human
cagcuguggggagcuugggcca

SEQ ID NO: 525124 - RNA, 22 nt, Human
guuuuguugcugcagagcucaa

SEQ ID NO: 525125 - RNA, 22 nt, Human
gggcugggauggcuugaagauu

SEQ ID NO: 525126 - RNA, 22 nt, Human
ugcucuggagggugaagcuuuu

SEQ ID NO: 525127 - RNA, 22 nt, Human
aggucauuuccuuagaggcaga

SEQ ID NO: 525128 - RNA, 22 nt, Human
ugagcuggucacuccuucugaa

SEQ ID NO: 525129 - RNA, 22 nt, Human
gcucagucuuugugggguacgg

SEQ ID NO: 525130 - RNA, 22 nt, Human
caguuuuucaaaauuacaugau

SEQ ID NO: 525131 - RNA, 22 nt, Human
gugaaugacauauuuuguacug

SEQ ID NO: 525132 - RNA, 22 nt, Human
agaaagggagagccagcacacg

SEQ ID NO: 525133 - RNA, 17 nt, Human
agugaggagauuggaag

SEQ ID NO: 525134 - RNA, 22 nt, Human
cccaggagauggagguugcagu

SEQ ID NO: 525135 - RNA, 17 nt, Human
agcugccagggagugug

SEQ ID NO: 525136 - RNA, 22 nt, Human
gggugaggcccauuugaggcca

SEQ ID NO: 525137 - RNA, 22 nt, Human
uccuguguaaauagaucugguu

SEQ ID NO: 525138 - RNA, 22 nt, Human
ugucuuuacuuagaaguucagg

SEQ ID NO: 525139 - RNA, 22 nt, Human
ggcaggugugagaucgaggcca

SEQ ID NO: 525140 - RNA, 22 nt, Human
uaaggccauuauggugggcccg

SEQ ID NO: 525141 - RNA, 20 nt, Human
uccuggagcugcuugaauuc

SEQ ID NO: 525142 - RNA, 22 nt, Human
gcugugugcucacguaguggaa

SEQ ID NO: 525143 - RNA, 22 nt, Human
auuugugauaauuuguuacagc

SEQ ID NO: 525144 - RNA, 22 nt, Human
gggcugucaugugucagugacc

SEQ ID NO: 525145 - RNA, 22 nt, Human
ccugggucccagccaggcuuug

SEQ ID NO: 525146 - RNA, 22 nt, Human
augcccaaugucacaauuuuug

SEQ ID NO: 525147 - RNA, 22 nt, Human
ucugucauuagccuugacugua

SEQ ID NO: 525148 - RNA, 22 nt, Human
caaaugugacuuuugggcuucu

SEQ ID NO: 525149 - RNA, 19 nt, Human
ggcagacacaguugacaug

SEQ ID NO: 525150 - RNA, 22 nt, Human
ucccuucaucagugagcaagcc

SEQ ID NO: 525151 - RNA, 22 nt, Human
agggcugggcugcuuguuguca

SEQ ID NO: 525152 - RNA, 22 nt, Human
ucagcacucgcuaccuaguaaa

SEQ ID NO: 525153 - RNA, 23 nt, Human
gggagaauaugaggaugauggug

SEQ ID NO: 525154 - RNA, 22 nt, Human
caggaacauuguagaauugaaa

SEQ ID NO: 525155 - RNA, 22 nt, Human
gggggcucugacucccucagcu

SEQ ID NO: 525156 - RNA, 22 nt, Human
cuuauguaaaacggaaagggaa

SEQ ID NO: 525157 - RNA, 22 nt, Human
gagguaucuuagagaguguaga

SEQ ID NO: 525158 - RNA, 22 nt, Human
aaugacaaauauggaagccuga

SEQ ID NO: 525159 - RNA, 22 nt, Human
ugcacagagagaugagacacgu

SEQ ID NO: 525160 - RNA, 19 nt, Human
gaggagcuaucggagacag

SEQ ID NO: 525161 - RNA, 22 nt, Human
aggcaggucacaugcuuggcga

SEQ ID NO: 525162 - RNA, 22 nt, Human
agcuggagaauguggaugaucc

SEQ ID NO: 525163 - RNA, 22 nt, Human
gagaacaggcucuggagucaga

SEQ ID NO: 525164 - RNA, 22 nt, Human
auuugcuuccuaauacucauau

SEQ ID NO: 525165 - RNA, 22 nt, Human
ggguggggcccaggaaaucuau

SEQ ID NO: 525166 - RNA, 22 nt, Human
ucgaacucauagucguagcugu

SEQ ID NO: 525167 - RNA, 22 nt, Human
aagggcuccacuugaaucacac

SEQ ID NO: 525168 - RNA, 22 nt, Human
aaguccaggcuggcguagaguc

SEQ ID NO: 525169 - RNA, 22 nt, Human
guccacagcuggccagggccuc

SEQ ID NO: 525170 - RNA, 22 nt, Human
guucauuuuucccuaaugagua

SEQ ID NO: 525171 - RNA, 22 nt, Human
cuguggggaagauagaaccgac

SEQ ID NO: 525172 - RNA, 22 nt, Human
gcugaggcaagauuugaaccca

SEQ ID NO: 525173 - RNA, 22 nt, Human
caguguggcugagacagaggcu

SEQ ID NO: 525174 - RNA, 22 nt, Human
agcugcuacugcucugccagag

SEQ ID NO: 525175 - RNA, 22 nt, Human
gguggcugguuuuauaagaggu

SEQ ID NO: 525176 - RNA, 22 nt, Human
gcuggcuugauaguuucugcuu

SEQ ID NO: 525177 - RNA, 21 nt, Human
ucagaggcugggggaaugccc

SEQ ID NO: 525178 - RNA, 22 nt, Human
augagguacuaguauauacgua

SEQ ID NO: 525179 - RNA, 22 nt, Human
uggguccucugagagggcagcg

SEQ ID NO: 525180 - RNA, 22 nt, Human
acauuucugcuagaauagguga

SEQ ID NO: 525181 - RNA, 19 nt, Human
ugucucagugucccuuccu

SEQ ID NO: 525182 - RNA, 22 nt, Human
cuucugggauuaauuuuuccug

SEQ ID NO: 525183 - RNA, 18 nt, Human
agcuccugaacucugugg

SEQ ID NO: 525184 - RNA, 22 nt, Human
ugggcaaaugucacuuucuuuu

SEQ ID NO: 525185 - RNA, 22 nt, Human
ccagcagcagcguccaaggaga

SEQ ID NO: 525186 - RNA, 22 nt, Human
cugagggcaugaacauuccaua

SEQ ID NO: 525187 - RNA, 22 nt, Human
aggaagcuuggggcagggcuac

SEQ ID NO: 525188 - RNA, 22 nt, Human
uuaaagcaaccaucaauuugga

SEQ ID NO: 525189 - RNA, 22 nt, Human
cccaggcuggcacugcugaagu

SEQ ID NO: 525190 - RNA, 22 nt, Human
gcugggcucugucaugccuucc

SEQ ID NO: 525191 - RNA, 22 nt, Human
ugagcuacacacuaggcauggg

SEQ ID NO: 525192 - RNA, 22 nt, Human
auggcagccuguggacagucaa

SEQ ID NO: 525193 - RNA, 22 nt, Human
cuuagcuuuuccagcuucuaga

SEQ ID NO: 525194 - RNA, 22 nt, Human
ccucauuaacacaaugucauuu

SEQ ID NO: 525195 - RNA, 22 nt, Human
cgcugauaaacgucacguuccc

SEQ ID NO: 525196 - RNA, 22 nt, Human
cuuauguacacacauauauugu

SEQ ID NO: 525197 - RNA, 22 nt, Human
agcuuccuacaaccaucucaga

SEQ ID NO: 525198 - RNA, 22 nt, Human
gcuccuggcuccaggcagccaa

SEQ ID NO: 525199 - RNA, 22 nt, Human
ggagucuuggccugcugagaaa

SEQ ID NO: 525200 - RNA, 22 nt, Human
ccugccugauuccaggauggcu

SEQ ID NO: 525201 - RNA, 22 nt, Human
aggccagggcacugcucuuuag

SEQ ID NO: 525202 - RNA, 22 nt, Human
uguggagcucagaaguagcagu

SEQ ID NO: 525203 - RNA, 22 nt, Human
cccagcacaggcaauuccauac

SEQ ID NO: 525204 - RNA, 22 nt, Human
ugacacauuaaaugcucacaaa

SEQ ID NO: 525205 - RNA, 22 nt, Human
uacacaaaggcacucuguuguu

SEQ ID NO: 525206 - RNA, 22 nt, Human
auuugucaauaagaugaacaua

SEQ ID NO: 525207 - RNA, 22 nt, Human
ucagggacagggugcugcugcg

SEQ ID NO: 525208 - RNA, 22 nt, Human
cccucuggcucuucucaggccg

SEQ ID NO: 525209 - RNA, 21 nt, Human
acuggcugccaugauccaggg

SEQ ID NO: 525210 - RNA, 22 nt, Human
uccagucaucucccuucacauu

SEQ ID NO: 525211 - RNA, 22 nt, Human
gguggcugcacccuggcuaacu

SEQ ID NO: 525212 - RNA, 22 nt, Human
ggugugccuggggcuuagcugc

SEQ ID NO: 525213 - RNA, 20 nt, Human
aaagucuuaugguuaauuuu

SEQ ID NO: 525214 - RNA, 22 nt, Human
uagcagcucacagccucccauu

SEQ ID NO: 525215 - RNA, 22 nt, Human
uggcuuccuccagagcaggagg

SEQ ID NO: 525216 - RNA, 22 nt, Human
agacaggcuuugcuguauauca

SEQ ID NO: 525217 - RNA, 22 nt, Human
aagcuuacaguuccacguagca

SEQ ID NO: 525218 - RNA, 22 nt, Human
aaguguagauuauggagugucu

SEQ ID NO: 525219 - RNA, 22 nt, Human
gggcuccaccuagggacacugg

SEQ ID NO: 525220 - RNA, 22 nt, Human
caugaagcucuugcaccucuag

SEQ ID NO: 525221 - RNA, 22 nt, Human
cauguaauccuggggagaugaa

SEQ ID NO: 525222 - RNA, 22 nt, Human
uuagaaaucaccucugaagauc

SEQ ID NO: 525223 - RNA, 22 nt, Human
auagucuuagucuauaguuuug

SEQ ID NO: 525224 - RNA, 18 nt, Human
aguuucagggcaggaaac

SEQ ID NO: 525225 - RNA, 22 nt, Human
aggcucaguucuguggugagcc

SEQ ID NO: 525226 - RNA, 22 nt, Human
gguccuggcagucuuugguugu

SEQ ID NO: 525227 - RNA, 22 nt, Human
gggccugacugagagcuccuca

SEQ ID NO: 525228 - RNA, 22 nt, Human
agccagcuggagaccacuguuu

SEQ ID NO: 525229 - RNA, 22 nt, Human
uagguucagcuuccacugccua

SEQ ID NO: 525230 - RNA, 19 nt, Human
ggucucagugcagcugcag

SEQ ID NO: 525231 - RNA, 22 nt, Human
cugcccugggccaggaagcggc

SEQ ID NO: 525232 - RNA, 22 nt, Human
cagucccaguuugagacucugg

SEQ ID NO: 525233 - RNA, 22 nt, Human
ggagccuggcaaugcugcgucc

SEQ ID NO: 525234 - RNA, 22 nt, Human
ucugcaucauuuuucagagccg

SEQ ID NO: 525235 - RNA, 22 nt, Human
aaacucuguugagauaauauuu

SEQ ID NO: 525236 - RNA, 21 nt, Human
agcaggcuuuggaguggggcu

SEQ ID NO: 525237 - RNA, 22 nt, Human
gaggaggcuuccgggaggcacg

SEQ ID NO: 525238 - RNA, 22 nt, Human
caggccucuccuuagucuggca

SEQ ID NO: 525239 - RNA, 22 nt, Human
gccucugcaccaguacugugcc

SEQ ID NO: 525240 - RNA, 22 nt, Human
agccccaguccgcugcgggcgg

SEQ ID NO: 525241 - RNA, 23 nt, Human
ugggccuggaaagccuuagagag

SEQ ID NO: 525242 - RNA, 21 nt, Human
gccucugcugucuuauuguga

SEQ ID NO: 525243 - RNA, 18 nt, Human
gcagcugcaguuguagcu

SEQ ID NO: 525244 - RNA, 19 nt, Human
uuccaggugcuguggggag

SEQ ID NO: 525245 - RNA, 22 nt, Human
cugagguggaacagaggugaag

SEQ ID NO: 525246 - RNA, 22 nt, Human
caugccugccuggugggcgugg

SEQ ID NO: 525247 - RNA, 22 nt, Human
uugaggcauuacuguaaugaga

SEQ ID NO: 525248 - RNA, 23 nt, Human
ucaggauauugugugccaaggug

SEQ ID NO: 525249 - RNA, 22 nt, Human
cccucucagucagagccagaua

SEQ ID NO: 525250 - RNA, 20 nt, Human
ugaaaggugggaauuguggg

SEQ ID NO: 525251 - RNA, 22 nt, Human
ucucugaguuuuaaggaugaug

SEQ ID NO: 525252 - RNA, 23 nt, Human
ccugcagcugcuggggcuccacc

SEQ ID NO: 525253 - RNA, 22 nt, Human
cugugcaagacuuacuuuaaua

SEQ ID NO: 525254 - RNA, 22 nt, Human
ucucuggggauggaccugggag

SEQ ID NO: 525255 - RNA, 22 nt, Human
gcaggucuguugauuacaguca

SEQ ID NO: 525256 - RNA, 22 nt, Human
ccaguguucaucaagaaaaugu

SEQ ID NO: 525257 - RNA, 22 nt, Human
aagcagaguuagcuugucaccu

SEQ ID NO: 525258 - RNA, 22 nt, Human
augcaaauaagugcaggcgugg

SEQ ID NO: 525259 - RNA, 22 nt, Human
aggcccuguuaugagccacugu

SEQ ID NO: 525260 - RNA, 22 nt, Human
cuggcuggccggaggcaucccu

SEQ ID NO: 525261 - RNA, 22 nt, Human
cuguagccaguuuggccucacc

SEQ ID NO: 525262 - RNA, 22 nt, Human
aagaauuauugcaauacuagau

SEQ ID NO: 525263 - RNA, 22 nt, Human
gcaguguuggcaggauggggcu

SEQ ID NO: 525264 - RNA, 21 nt, Human
ucaggcaggcgcagagggaag

SEQ ID NO: 525265 - RNA, 22 nt, Human
guggccagcugucagcacccuu

SEQ ID NO: 525266 - RNA, 23 nt, Human
gccaggcuccggucuguggccac

SEQ ID NO: 525267 - RNA, 19 nt, Human
gaucuuugccaauuuaagc

SEQ ID NO: 525268 - RNA, 22 nt, Human
aaggcacuuuuccugagaugau

SEQ ID NO: 525269 - RNA, 22 nt, Human
ugggacagggaaucugaucccc

SEQ ID NO: 525270 - RNA, 18 nt, Human
cugucuuuuuucucucca

SEQ ID NO: 525271 - RNA, 21 nt, Human
uagaaagucaaagcuaucagc

SEQ ID NO: 525272 - RNA, 22 nt, Human
ucuggcucauacaagccugcaa

SEQ ID NO: 525273 - RNA, 22 nt, Human
acagcagccuuguugguuucga

SEQ ID NO: 525274 - RNA, 22 nt, Human
gagcugggccucagaacacagu

SEQ ID NO: 525275 - RNA, 22 nt, Human
cuucaagauauuucuagaauca

SEQ ID NO: 525276 - RNA, 22 nt, Human
uucagagcaucucuaaagccag

SEQ ID NO: 525277 - RNA, 22 nt, Human
gccaccagguuagauccagccu

SEQ ID NO: 525278 - RNA, 22 nt, Human
aagggcugaaagaccuugggca

SEQ ID NO: 525279 - RNA, 22 nt, Human
cagaguggcagucccaggccca

SEQ ID NO: 525280 - RNA, 22 nt, Human
ccaggucuaucaaguugggcuc

SEQ ID NO: 525281 - RNA, 22 nt, Human
gcagcagcugacagugggugcc

SEQ ID NO: 525282 - RNA, 22 nt, Human
guucuguacuccaagcucuucc

SEQ ID NO: 525283 - RNA, 17 nt, Human
guccuggugugugagga

SEQ ID NO: 525284 - RNA, 22 nt, Human
uggugugggcguggcaggcaag

SEQ ID NO: 525285 - RNA, 22 nt, Human
agcuccugauacaugcaggaau

SEQ ID NO: 525286 - RNA, 22 nt, Human
ugugugugugcgcgcacgcaua

SEQ ID NO: 525287 - RNA, 22 nt, Human
gucugucucucuccagagugca

SEQ ID NO: 525288 - RNA, 22 nt, Human
uguauuuugugaggaucacucu

SEQ ID NO: 525289 - RNA, 22 nt, Human
uucauuuaaucagaaucucuaa

SEQ ID NO: 525290 - RNA, 22 nt, Human
guggcccucugauagggucagg

SEQ ID NO: 525291 - RNA, 22 nt, Human
uucuguccacugcuggggccuc

SEQ ID NO: 525292 - RNA, 22 nt, Human
ccuggcucugccguaaccacca

SEQ ID NO: 525293 - RNA, 22 nt, Human
ccagggcaaaugagaucauagc

SEQ ID NO: 525294 - RNA, 22 nt, Human
ccaggagcagggcuggcugcac

SEQ ID NO: 525295 - RNA, 22 nt, Human
cugggccagcaacugcaaugga

SEQ ID NO: 525296 - RNA, 22 nt, Human
accagggcggcuugaggaggca

SEQ ID NO: 525297 - RNA, 22 nt, Human
guguugaugacauuuuagaaac

SEQ ID NO: 525298 - RNA, 22 nt, Human
uacagucaauacuaggaccaua

SEQ ID NO: 525299 - RNA, 22 nt, Human
ucaaucaaagcacugggcuuug

SEQ ID NO: 525300 - RNA, 22 nt, Human
ugcuucugcucagcuuccuacu

SEQ ID NO: 525301 - RNA, 22 nt, Human
auucagcauaaucaguagcuug

SEQ ID NO: 525302 - RNA, 22 nt, Human
cagcuguuacucugaguaaaug

SEQ ID NO: 525303 - RNA, 22 nt, Human
gugaaggauaaggaucuaaauu

SEQ ID NO: 525304 - RNA, 22 nt, Human
uaaauuacucaaugcacauaaa

SEQ ID NO: 525305 - RNA, 22 nt, Human
cagacaugauguaagcagaggc

SEQ ID NO: 525306 - RNA, 22 nt, Human
uuauguguguacaugcauaugu

SEQ ID NO: 525307 - RNA, 22 nt, Human
cagagcugugauaaauagauau

SEQ ID NO: 525308 - RNA, 22 nt, Human
ucaaugcaaucauuggacaagu

SEQ ID NO: 525309 - RNA, 22 nt, Human
cuuagcagaagcuucagcuuca

SEQ ID NO: 525310 - RNA, 20 nt, Human
aggagcugaauuagaggguu

SEQ ID NO: 525311 - RNA, 22 nt, Human
uacaaagugaaauaauucugag

SEQ ID NO: 525312 - RNA, 22 nt, Human
acaaaguuugugguauuccaag

SEQ ID NO: 525313 - RNA, 22 nt, Human
aguggacucuucccagugcuug

SEQ ID NO: 525314 - RNA, 21 nt, Human
ugagccaggcugacggcugug

SEQ ID NO: 525315 - RNA, 22 nt, Human
ccagggaguuuccaaucugaga

SEQ ID NO: 525316 - RNA, 22 nt, Human
agggcuuugagaauaguggaac

SEQ ID NO: 525317 - RNA, 22 nt, Human
gccacguugccacccgggugac

SEQ ID NO: 525318 - RNA, 21 nt, Human
uauuugcugccaucuuugagg

SEQ ID NO: 525319 - RNA, 22 nt, Human
cauuucacgcacacucauuacu

SEQ ID NO: 525320 - RNA, 22 nt, Human
gaaagguuguaacaagacucuu

SEQ ID NO: 525321 - RNA, 22 nt, Human
cugguccagaauuuaugauucu

SEQ ID NO: 525322 - RNA, 20 nt, Human
aggcucagagcaguaguaca

SEQ ID NO: 525323 - RNA, 22 nt, Human
cagccucugagccuuggcagau

SEQ ID NO: 525324 - RNA, 22 nt, Human
gcuguacaucacaauuugcugu

SEQ ID NO: 525325 - RNA, 22 nt, Human
uagccauugacuuaaagcuuau

SEQ ID NO: 525326 - RNA, 22 nt, Human
uggcccuuugguuuaugacuga

SEQ ID NO: 525327 - RNA, 22 nt, Human
gugauaagacaguaggcacaag

SEQ ID NO: 525328 - RNA, 22 nt, Human
acacaucuuagacugaaauaug

SEQ ID NO: 525329 - RNA, 22 nt, Human
uggaaagaaaguaaaggcguau

SEQ ID NO: 525330 - RNA, 22 nt, Human
gugguaauagagcuccaaacua

SEQ ID NO: 525331 - RNA, 22 nt, Human
acuuagcaauuugauuaaaaga

SEQ ID NO: 525332 - RNA, 22 nt, Human
ugcagcagagugggccugggug

SEQ ID NO: 525333 - RNA, 19 nt, Human
ccuggcccugcugcgcggg

SEQ ID NO: 525334 - RNA, 23 nt, Human
aaagacugcugagaauuuuagga

SEQ ID NO: 525335 - RNA, 23 nt, Human
gggauauggaccuuggaggaguc

SEQ ID NO: 525336 - RNA, 22 nt, Human
aaauuauuaugccccucuauaa

SEQ ID NO: 525337 - RNA, 22 nt, Human
guagaggggugauucugugaga

SEQ ID NO: 525338 - RNA, 20 nt, Human
aggagccauugacugcagca

SEQ ID NO: 525339 - RNA, 23 nt, Human
auggagcugguacuagcuaccuc

SEQ ID NO: 525340 - RNA, 22 nt, Human
aggaacaacugauucagucaac

SEQ ID NO: 525341 - RNA, 22 nt, Human
aagcagccagccaucaugcccg

SEQ ID NO: 525342 - RNA, 22 nt, Human
cacagcuucuccuugauaucgc

SEQ ID NO: 525343 - RNA, 22 nt, Human
ccaaagucuggagcagcagagc

SEQ ID NO: 525344 - RNA, 22 nt, Human
acagcagcaauagcagugacau

SEQ ID NO: 525345 - RNA, 22 nt, Human
agguccuggugaccauggaguu

SEQ ID NO: 525346 - RNA, 22 nt, Human
guccuucagcuuuaucugaaca

SEQ ID NO: 525347 - RNA, 22 nt, Human
accaggcaaaaccacaggagca

SEQ ID NO: 525348 - RNA, 21 nt, Human
uuacaaagcaagugcuguguc

SEQ ID NO: 525349 - RNA, 22 nt, Human
agaugcuucaguguuuaauuua

SEQ ID NO: 525350 - RNA, 22 nt, Human
cagagcugcaaaugccccuccg

SEQ ID NO: 525351 - RNA, 23 nt, Human
cugggcuguccugaggucaccuc

SEQ ID NO: 525352 - RNA, 22 nt, Human
aagacaauauugcugugaacgu

SEQ ID NO: 525353 - RNA, 22 nt, Human
ucauugccauggcauuugcaga

SEQ ID NO: 525354 - RNA, 22 nt, Human
uauuuucaccuucucuggauau

SEQ ID NO: 525355 - RNA, 23 nt, Human
cugaggccugcugcguucagguu

SEQ ID NO: 525356 - RNA, 22 nt, Human
uggcuccucuucuggguguccc

SEQ ID NO: 525357 - RNA, 22 nt, Human
uauaaauuauuaggcugcuaaa

SEQ ID NO: 525358 - RNA, 22 nt, Human
gaaauguguuguucauuucuaa

SEQ ID NO: 525359 - RNA, 22 nt, Human
uaaugcacaugacugaacuauu

SEQ ID NO: 525360 - RNA, 22 nt, Human
ggaaggggagcuaaaucuacug

SEQ ID NO: 525361 - RNA, 17 nt, Human
agaugcuggccacaugu

SEQ ID NO: 525362 - RNA, 22 nt, Human
gguggcaguuacaggggcaaau

SEQ ID NO: 525363 - RNA, 22 nt, Human
agcuguucccucacugcaguca

SEQ ID NO: 525364 - RNA, 22 nt, Human
ugcagugguugagagcccagac

SEQ ID NO: 525365 - RNA, 22 nt, Human
agugcaugcgcuugggaggggu

SEQ ID NO: 525366 - RNA, 22 nt, Human
ugauuuccuaggucuggagaag

SEQ ID NO: 525367 - RNA, 21 nt, Human
ucagcagcuuuugcagucccu

SEQ ID NO: 525368 - RNA, 21 nt, Human
guagauaaagcauuuucauua

SEQ ID NO: 525369 - RNA, 22 nt, Human
agcuucaggaacaggcagccug

SEQ ID NO: 525370 - RNA, 22 nt, Human
cacagcuuccauuagaaugaga

SEQ ID NO: 525371 - RNA, 22 nt, Human
uagggcaggggaggaaucugaa

SEQ ID NO: 525372 - RNA, 22 nt, Human
auccucuguggauuacaccuag

SEQ ID NO: 525373 - RNA, 16 nt, Human
gggcugggggauucug

SEQ ID NO: 525374 - RNA, 22 nt, Human
auaaugcagcuuuucaauggcc

SEQ ID NO: 525375 - RNA, 22 nt, Human
cacugaguucccugacauuuca

SEQ ID NO: 525376 - RNA, 22 nt, Human
cagccucuguggcugccacacc

SEQ ID NO: 525377 - RNA, 22 nt, Human
agguccagaguugagauacaga

SEQ ID NO: 525378 - RNA, 20 nt, Human
cucugcuuuaggagagucag

SEQ ID NO: 525379 - RNA, 22 nt, Human
gaaaugcaggcuuggauucagc

SEQ ID NO: 525380 - RNA, 22 nt, Human
aggugagguuugggagguguca

SEQ ID NO: 525381 - RNA, 22 nt, Human
uuuccucugagugagcugggag

SEQ ID NO: 525382 - RNA, 22 nt, Human
auacaucaccuauauauucaca

SEQ ID NO: 525383 - RNA, 19 nt, Human
ucuggcugccaaggauuga

SEQ ID NO: 525384 - RNA, 22 nt, Human
aaggaagggaaauagugauguc

SEQ ID NO: 525385 - RNA, 22 nt, Human
uggaccucacugucugcuggua

SEQ ID NO: 525386 - RNA, 22 nt, Human
uggcacagagggacccagcagc

SEQ ID NO: 525387 - RNA, 22 nt, Human
uggguccuuuuuggacuucuuc

SEQ ID NO: 525388 - RNA, 22 nt, Human
aauuaguaaccuaauuccaucu

SEQ ID NO: 525389 - RNA, 22 nt, Human
augaggcaaucaugguccaguu

SEQ ID NO: 525390 - RNA, 22 nt, Human
cccagccugugacagccguccu

SEQ ID NO: 525391 - RNA, 22 nt, Human
uaggcugagcuaagagagcuua

SEQ ID NO: 525392 - RNA, 22 nt, Human
cuuagcuucauuauugguggcc

SEQ ID NO: 525393 - RNA, 22 nt, Human
aauucaaugguuuuuaggauau

SEQ ID NO: 525394 - RNA, 19 nt, Human
cagucccaaauucuuguca

SEQ ID NO: 525395 - RNA, 22 nt, Human
uugcauuucacuuucaguaggc

SEQ ID NO: 525396 - RNA, 22 nt, Human
cugggcucagcccaugcugucc

SEQ ID NO: 525397 - RNA, 22 nt, Human
ucccugcucagcucaccuggca

SEQ ID NO: 525398 - RNA, 22 nt, Human
gcagagccccucaagccagccu

SEQ ID NO: 525399 - RNA, 22 nt, Human
gcuacagguauauagaugaaac

SEQ ID NO: 525400 - RNA, 22 nt, Human
aggagcugcuuaaaugguuggu

SEQ ID NO: 525401 - RNA, 22 nt, Human
ccugaggcucgcgcgccccugg

SEQ ID NO: 525402 - RNA, 22 nt, Human
ugaaaguuacaggaaaacagau

SEQ ID NO: 525403 - RNA, 22 nt, Human
aaguagcaaucucauuaguugg

SEQ ID NO: 525404 - RNA, 22 nt, Human
ucagugucuugggcuugaaugc

SEQ ID NO: 525405 - RNA, 22 nt, Human
uuuucauuguaaaucaggaaac

SEQ ID NO: 525406 - RNA, 22 nt, Human
gagccugaauuugaccugcuua

SEQ ID NO: 525407 - RNA, 22 nt, Human
ggggaccuaggcucugucucuu

SEQ ID NO: 525408 - RNA, 22 nt, Human
gcuuagucaauuauaaauaggc

SEQ ID NO: 525409 - RNA, 22 nt, Human
ggcgaggccgggacaggcugga

SEQ ID NO: 525410 - RNA, 22 nt, Human
gcauuuuucuaaucauuggcau

SEQ ID NO: 525411 - RNA, 22 nt, Human
acugaaggucucagcaaggaug

SEQ ID NO: 525412 - RNA, 19 nt, Human
uuugugaagaaaaugaugc

SEQ ID NO: 525413 - RNA, 22 nt, Human
ggcccagccggcgagucucgcg

SEQ ID NO: 525414 - RNA, 22 nt, Human
ugcugccacaaauucagcugcc

SEQ ID NO: 525415 - RNA, 21 nt, Human
aggcucagcagguguauaaag

SEQ ID NO: 525416 - RNA, 19 nt, Human
ccagagcccgccagauggg

SEQ ID NO: 525417 - RNA, 22 nt, Human
gcuuuuguggugauggagaggc

SEQ ID NO: 525418 - RNA, 22 nt, Human
aguaaauaacagagaaaauggg

SEQ ID NO: 525419 - RNA, 22 nt, Human
ccagcagcuguggcuuugccuc

SEQ ID NO: 525420 - RNA, 22 nt, Human
uuuccucuaaacgcauuugcuu

SEQ ID NO: 525421 - RNA, 22 nt, Human
uccaagcuacugaagguuuggg

SEQ ID NO: 525422 - RNA, 22 nt, Human
cagcagcagcuuaguggucccc

SEQ ID NO: 525423 - RNA, 22 nt, Human
uaagcuauuccugaagaagguu

SEQ ID NO: 525424 - RNA, 22 nt, Human
ggaggccaggguggguggaucg

SEQ ID NO: 525425 - RNA, 22 nt, Human
ugggcagaaugugggauccaga

SEQ ID NO: 525426 - RNA, 22 nt, Human
ggcucuggagauguccgaccug

SEQ ID NO: 525427 - RNA, 22 nt, Human
aaucaguuucuuggcaaguuua

SEQ ID NO: 525428 - RNA, 22 nt, Human
gggcugacaccacccaggcgca

SEQ ID NO: 525429 - RNA, 22 nt, Human
ugagccugcaauaagcacagcc

SEQ ID NO: 525430 - RNA, 22 nt, Human
uagcuucuugagaaagggugcc

SEQ ID NO: 525431 - RNA, 22 nt, Human
uuugggaacucuaucauggaaa

SEQ ID NO: 525432 - RNA, 22 nt, Human
ucagugcagugaaagguuuacu

SEQ ID NO: 525433 - RNA, 22 nt, Human
gccugccuagaauugcagcuuu

SEQ ID NO: 525434 - RNA, 19 nt, Human
uucacauuggaagaaguag

SEQ ID NO: 525435 - RNA, 22 nt, Human
agcacagauggauguauucauu

SEQ ID NO: 525436 - RNA, 22 nt, Human
auuugccuugugauuuguaagu

SEQ ID NO: 525437 - RNA, 22 nt, Human
cagccacagcugggugccugac

SEQ ID NO: 525438 - RNA, 22 nt, Human
augggccaggcuugggaugaca

SEQ ID NO: 525439 - RNA, 22 nt, Human
uggcuaggacucauccuguuuc

SEQ ID NO: 525440 - RNA, 22 nt, Human
guugucagguaaaacaguaugg

SEQ ID NO: 525441 - RNA, 22 nt, Human
cugcuuccauggucuggagacu

SEQ ID NO: 525442 - RNA, 22 nt, Human
aagagagaacucccuucgccag

SEQ ID NO: 525443 - RNA, 22 nt, Human
ucgggguagacgccagcucgga

SEQ ID NO: 525444 - RNA, 22 nt, Human
gccaggggacgcggagcgacga

SEQ ID NO: 525445 - RNA, 22 nt, Human
acugucugcaaaacucauacuc

SEQ ID NO: 525446 - RNA, 22 nt, Human
gcacagagucacuagcuaagca

SEQ ID NO: 525447 - RNA, 22 nt, Human
acauuaacaccauaaguguguu

SEQ ID NO: 525448 - RNA, 19 nt, Human
gcccucaggcagcuccauc

SEQ ID NO: 525449 - RNA, 18 nt, Human
acugugguuuauguguag

SEQ ID NO: 525450 - RNA, 22 nt, Human
gccuggcucugagggagcuccu

SEQ ID NO: 525451 - RNA, 22 nt, Human
ugcugccacauuuaaagagggg

SEQ ID NO: 525452 - RNA, 22 nt, Human
ucacagacauggugagguaaca

SEQ ID NO: 525453 - RNA, 22 nt, Human
ucuaacauuguuuuucacagau

SEQ ID NO: 525454 - RNA, 22 nt, Human
uaggcagcgcuuggcugugcuu

SEQ ID NO: 525455 - RNA, 22 nt, Human
aguccugggucuggagaaugga

SEQ ID NO: 525456 - RNA, 22 nt, Human
cuugaaucuucugaguauuugc

SEQ ID NO: 525457 - RNA, 22 nt, Human
agaaucaaagagaaauacuuug

SEQ ID NO: 525458 - RNA, 22 nt, Human
cagggcucccuugcaaggaggg

SEQ ID NO: 525459 - RNA, 22 nt, Human
ucagugcauggacagauuuaga

SEQ ID NO: 525460 - RNA, 22 nt, Human
ugguggcuguugcagaacugag

SEQ ID NO: 525461 - RNA, 22 nt, Human
ucacauguauaugcagcacagc

SEQ ID NO: 525462 - RNA, 23 nt, Human
cagcccuggagaugugggaggca

SEQ ID NO: 525463 - RNA, 22 nt, Human
cugcugucuaguaucuuaaaaa

SEQ ID NO: 525464 - RNA, 22 nt, Human
agcaggcugaugggcaugcuug

SEQ ID NO: 525465 - RNA, 22 nt, Human
aguggguggcgcagaggaggaa

SEQ ID NO: 525466 - RNA, 22 nt, Human
cacagggccuugugugacugca

SEQ ID NO: 525467 - RNA, 18 nt, Human
uggcuggcagugggcagc

SEQ ID NO: 525468 - RNA, 23 nt, Human
uggcuucugccccauucucucca

SEQ ID NO: 525469 - RNA, 22 nt, Human
aaauagaaaccaacaaggucag

SEQ ID NO: 525470 - RNA, 22 nt, Human
gaggucaauaauaugugcuuua

SEQ ID NO: 525471 - RNA, 19 nt, Human
cgccuggcaggcccugcgc

SEQ ID NO: 525472 - RNA, 20 nt, Human
ccagcacccucucagcugaa

SEQ ID NO: 525473 - RNA, 22 nt, Human
ucugcagaauucgaggaagaaa

SEQ ID NO: 525474 - RNA, 22 nt, Human
agaauuguugggguaauaaaag

SEQ ID NO: 525475 - RNA, 20 nt, Human
gcaacucacccacagcagcu

SEQ ID NO: 525476 - RNA, 22 nt, Human
cugcccuguaucuucucccaau

SEQ ID NO: 525477 - RNA, 22 nt, Human
accucugcucaagaccccuccg

SEQ ID NO: 525478 - RNA, 22 nt, Human
cagggcaaagagagcacaugcu

SEQ ID NO: 525479 - RNA, 18 nt, Human
cucugcuaaugggcagcu

SEQ ID NO: 525480 - RNA, 22 nt, Human
uuccaaagucauguugcugaua

SEQ ID NO: 525481 - RNA, 22 nt, Human
uagcuuuaaaaaucaucaaagc

SEQ ID NO: 525482 - RNA, 22 nt, Human
ucaggagggugacaggcccugg

SEQ ID NO: 525483 - RNA, 22 nt, Human
acagcaggcacacaaggauaga

SEQ ID NO: 525484 - RNA, 22 nt, Human
uuagaaaggagcuuauuucuuu

SEQ ID NO: 525485 - RNA, 22 nt, Human
uccugccuuagagcaaggaaaa

SEQ ID NO: 525486 - RNA, 22 nt, Human
ugagccugggagauggaggcug

SEQ ID NO: 525487 - RNA, 22 nt, Human
cagcuuuuuagaaucuagggca

SEQ ID NO: 525488 - RNA, 22 nt, Human
ggagggggaagaagcuaaagac

SEQ ID NO: 525489 - RNA, 22 nt, Human
aggccugagcagaggaguggac

SEQ ID NO: 525490 - RNA, 22 nt, Human
uaauacagaaguguauuaaaau

SEQ ID NO: 525491 - RNA, 22 nt, Human
agagccuggggauuggcaaggg

SEQ ID NO: 525492 - RNA, 22 nt, Human
aauucauccaugaacaauucca

SEQ ID NO: 525493 - RNA, 22 nt, Human
gaagauaauuccuacuuauaac

SEQ ID NO: 525494 - RNA, 22 nt, Human
ugcagggaaaacccaggaugcu

SEQ ID NO: 525495 - RNA, 22 nt, Human
cuucaagagaaugcagggaugu

SEQ ID NO: 525496 - RNA, 22 nt, Human
uccucuucugcccaucagaggc

SEQ ID NO: 525497 - RNA, 22 nt, Human
caauguguuugcauauuaaaau

SEQ ID NO: 525498 - RNA, 22 nt, Human
caaugauguuuagauaaaaucc

SEQ ID NO: 525499 - RNA, 22 nt, Human
accaucagucacauguagagaa

SEQ ID NO: 525500 - RNA, 22 nt, Human
aagcagaaguugaucuaccaua

SEQ ID NO: 525501 - RNA, 22 nt, Human
caaugcugugcuccucaugagg

SEQ ID NO: 525502 - RNA, 22 nt, Human
uggcagagcaaaaagauagaau

SEQ ID NO: 525503 - RNA, 22 nt, Human
accacccauucagaaacacuga

SEQ ID NO: 525504 - RNA, 22 nt, Human
uaauuuuaugacaguguauuuu

SEQ ID NO: 525505 - RNA, 22 nt, Human
aagagcuggauugugcugcaga

SEQ ID NO: 525506 - RNA, 23 nt, Human
cacacccaucacuaagagcuccu

SEQ ID NO: 525507 - RNA, 22 nt, Human
ugcaaauauugggacagucuag

SEQ ID NO: 525508 - RNA, 19 nt, Human
cugccuguuauggagagaa

SEQ ID NO: 525509 - RNA, 22 nt, Human
uaugcacaccuggguccuuguc

SEQ ID NO: 525510 - RNA, 22 nt, Human
ucacagaauugacaugggaauc

SEQ ID NO: 525511 - RNA, 22 nt, Human
ucugggcugcuaugaggcagag

SEQ ID NO: 525512 - RNA, 22 nt, Human
gagaggagucccuaucacaguu

SEQ ID NO: 525513 - RNA, 22 nt, Human
gcuaggaagcuggggagaaguc

SEQ ID NO: 525514 - RNA, 22 nt, Human
gagagcuguguucauucuacca

SEQ ID NO: 525515 - RNA, 22 nt, Human
auuauuugcuuggcucaucuaa

SEQ ID NO: 525516 - RNA, 22 nt, Human
cugggacuuuacccuguggccc

SEQ ID NO: 525517 - RNA, 22 nt, Human
ugggaaggggagcuggaaagga

SEQ ID NO: 525518 - RNA, 22 nt, Human
uuugaaaauuuaagugcuacac

SEQ ID NO: 525519 - RNA, 22 nt, Human
uggcugggcccccaccugccuc

SEQ ID NO: 525520 - RNA, 22 nt, Human
cuggcaggucucgcugacgugu

SEQ ID NO: 525521 - RNA, 22 nt, Human
gaagggagaagguugggugacg

SEQ ID NO: 525522 - RNA, 22 nt, Human
uugagcccaggaggccugggug

SEQ ID NO: 525523 - RNA, 22 nt, Human
cagggcaggaugcugugauuau

SEQ ID NO: 525524 - RNA, 22 nt, Human
aucaguuugagugcugugucaa

SEQ ID NO: 525525 - RNA, 22 nt, Human
ugauuuaggaaacagcuacagg

SEQ ID NO: 525526 - RNA, 22 nt, Human
caggccacagcuaaagaggauu

SEQ ID NO: 525527 - RNA, 22 nt, Human
ucugcgcugccuugauccuugg

SEQ ID NO: 525528 - RNA, 22 nt, Human
aagaacaguugggaggugagcc

SEQ ID NO: 525529 - RNA, 22 nt, Human
ugaaugauacagaauuauguag

SEQ ID NO: 525530 - RNA, 22 nt, Human
ucaggauccauagacucccaaa

SEQ ID NO: 525531 - RNA, 22 nt, Human
ggccugugagcccuugcaugua

SEQ ID NO: 525532 - RNA, 22 nt, Human
cugggccagauccagccucaca

SEQ ID NO: 525533 - RNA, 23 nt, Human
ugauuacaggaaguucaaguguu

SEQ ID NO: 525534 - RNA, 22 nt, Human
ggagcagaugucuucauggccu

SEQ ID NO: 525535 - RNA, 22 nt, Human
cuggccagagguuccucugccc

SEQ ID NO: 525536 - RNA, 22 nt, Human
auuacuuucagaugugcuguaa

SEQ ID NO: 525537 - RNA, 22 nt, Human
uuuccucuucuucccaugucau

SEQ ID NO: 525538 - RNA, 22 nt, Human
caugccuguaaucccagcucuu

SEQ ID NO: 525539 - RNA, 22 nt, Human
ccuugggcuugggcauagcuuu

SEQ ID NO: 525540 - RNA, 21 nt, Human
agcuggcucucucuggagaga

SEQ ID NO: 525541 - RNA, 22 nt, Human
gucacuguauccagguuccagc

SEQ ID NO: 525542 - RNA, 22 nt, Human
uggaacaaauuacaauuaacuu

SEQ ID NO: 525543 - RNA, 22 nt, Human
gaggcuccccaugaggccccag

SEQ ID NO: 525544 - RNA, 20 nt, Human
uaagaacaagacuaggaagc

SEQ ID NO: 525545 - RNA, 22 nt, Human
cucaggccugaguggcaguccc

SEQ ID NO: 525546 - RNA, 22 nt, Human
agaaaucaauaucuauauguug

SEQ ID NO: 525547 - RNA, 19 nt, Human
ccagcccugucacuucuug

SEQ ID NO: 525548 - RNA, 22 nt, Human
uuccaggacaagauguuucagg

SEQ ID NO: 525549 - RNA, 22 nt, Human
uguauuagagcauauaauuuga

SEQ ID NO: 525550 - RNA, 22 nt, Human
cagguacauucguagacccauu

SEQ ID NO: 525551 - RNA, 21 nt, Human
cuacuuaaguaggggauuagg

SEQ ID NO: 525552 - RNA, 20 nt, Human
ugugaaagcaguagaaugac

SEQ ID NO: 525553 - RNA, 22 nt, Human
ugucuuuagccagcagucuucu

SEQ ID NO: 525554 - RNA, 22 nt, Human
cacugggcguguccugggugag

SEQ ID NO: 525555 - RNA, 22 nt, Human
ugugaggagaggcccagcuccc

SEQ ID NO: 525556 - RNA, 22 nt, Human
cugcaggggcuggaguuggcuu

SEQ ID NO: 525557 - RNA, 22 nt, Human
ucccucuaaacuguaagauucu

SEQ ID NO: 525558 - RNA, 22 nt, Human
acugccaggauggcacuagagg

SEQ ID NO: 525559 - RNA, 22 nt, Human
ggacaaaggguggagccucuga

SEQ ID NO: 525560 - RNA, 22 nt, Human
caggcagcugcuggguucagcc

SEQ ID NO: 525561 - RNA, 22 nt, Human
aacacauauuuauauaugcaca

SEQ ID NO: 525562 - RNA, 22 nt, Human
ucugggccagugauuuuuccag

SEQ ID NO: 525563 - RNA, 18 nt, Human
uggcuucuugagcuaaca

SEQ ID NO: 525564 - RNA, 22 nt, Human
acacagaguauuuagaaggggu

SEQ ID NO: 525565 - RNA, 22 nt, Human
aagggcugcuguagaagcagag

SEQ ID NO: 525566 - RNA, 22 nt, Human
uagaaauggguuacauuuagag

SEQ ID NO: 525567 - RNA, 22 nt, Human
gcuucucaauucucacccucca

SEQ ID NO: 525568 - RNA, 22 nt, Human
augcaaucauauggcauacagc

SEQ ID NO: 525569 - RNA, 22 nt, Human
acugggcuguuccuuauuucua

SEQ ID NO: 525570 - RNA, 22 nt, Human
uggcugaaucugcagcaggaag

SEQ ID NO: 525571 - RNA, 22 nt, Human
uucugggcuguccagaggguga

SEQ ID NO: 525572 - RNA, 22 nt, Human
cugcccgcugcuagagaggccg

SEQ ID NO: 525573 - RNA, 22 nt, Human
uccugggcccaggcugccaggg

SEQ ID NO: 525574 - RNA, 22 nt, Human
uuuccucuccggggccuccagg

SEQ ID NO: 525575 - RNA, 22 nt, Human
agcaaagcugauuaagagcaca

SEQ ID NO: 525576 - RNA, 22 nt, Human
uuccaagugcccauauuucauc

SEQ ID NO: 525577 - RNA, 22 nt, Human
uuguccugauuuauaaaaugaa

SEQ ID NO: 525578 - RNA, 22 nt, Human
gauuuucaugauaaacuuguga

SEQ ID NO: 525579 - RNA, 22 nt, Human
gaaaaugccucuggcauuaaac

SEQ ID NO: 525580 - RNA, 22 nt, Human
ggggcugacgggcauguggcuu

SEQ ID NO: 525581 - RNA, 22 nt, Human
agcaauauuuaaagguuugcaa

SEQ ID NO: 525582 - RNA, 22 nt, Human
auuugaagucuucaugauuucu

SEQ ID NO: 525583 - RNA, 22 nt, Human
cuccugucaauaggcuccuggc

SEQ ID NO: 525584 - RNA, 22 nt, Human
gccagggggucagcaggcacuu

SEQ ID NO: 525585 - RNA, 22 nt, Human
uggagcaugagagucuuuagcu

SEQ ID NO: 525586 - RNA, 22 nt, Human
cuuagcuucacugggucucagu

SEQ ID NO: 525587 - RNA, 22 nt, Human
guggccuggaaaggcuggucug

SEQ ID NO: 525588 - RNA, 22 nt, Human
guacucucuugaaggccuuucu

SEQ ID NO: 525589 - RNA, 22 nt, Human
gacacuguuauggugagguaag

SEQ ID NO: 525590 - RNA, 22 nt, Human
uggucugaggaacaccagcacu

SEQ ID NO: 525591 - RNA, 22 nt, Human
guuuuauaggcuguugcuauau

SEQ ID NO: 525592 - RNA, 22 nt, Human
aauaugcauguauacaugugua

SEQ ID NO: 525593 - RNA, 22 nt, Human
acagugucugacacauuguagc

SEQ ID NO: 525594 - RNA, 21 nt, Human
gugcucugggcagcagagggc

SEQ ID NO: 525595 - RNA, 18 nt, Human
gagagcugcuaccuagcu

SEQ ID NO: 525596 - RNA, 22 nt, Human
cuaggccagagagaccucauga

SEQ ID NO: 525597 - RNA, 22 nt, Human
aggcaacaggaaaccacaugau

SEQ ID NO: 525598 - RNA, 22 nt, Human
agagggagugaaauggaauaga

SEQ ID NO: 525599 - RNA, 22 nt, Human
cagcugccugucuggaggcaau

SEQ ID NO: 525600 - RNA, 22 nt, Human
auggccaggguggcacuguggu

SEQ ID NO: 525601 - RNA, 22 nt, Human
aauuaugagguagauaucacau

SEQ ID NO: 525602 - RNA, 22 nt, Human
gagcagugguugaacagaggca

SEQ ID NO: 525603 - RNA, 22 nt, Human
cccucagcuccacccucagcag

SEQ ID NO: 525604 - RNA, 22 nt, Human
auuugccuguaagacaaggccu

SEQ ID NO: 525605 - RNA, 22 nt, Human
uggccuggcucacagugagauu

SEQ ID NO: 525606 - RNA, 22 nt, Human
ggcugcagcagagggacucacg

SEQ ID NO: 525607 - RNA, 22 nt, Human
aaacacaccuuuggaacuguga

SEQ ID NO: 525608 - RNA, 22 nt, Human
aguuauauuccauagauucaga

SEQ ID NO: 525609 - RNA, 22 nt, Human
accauuuaauaaguauuuccau

SEQ ID NO: 525610 - RNA, 22 nt, Human
agucuccuuggccucaaugccu

SEQ ID NO: 525611 - RNA, 22 nt, Human
agcugcccuucucuugcccuug

SEQ ID NO: 525612 - RNA, 22 nt, Human
gcugucagaaggugaaggguaa

SEQ ID NO: 525613 - RNA, 22 nt, Human
ucacaugcuugaggaaagaaaa

SEQ ID NO: 525614 - RNA, 22 nt, Human
ugggccuggguuccuccugggc

SEQ ID NO: 525615 - RNA, 22 nt, Human
gaaaucaaggcuacauucaggu

SEQ ID NO: 525616 - RNA, 22 nt, Human
ccagcauggcaccugagaugag

SEQ ID NO: 525617 - RNA, 22 nt, Human
gauuucaaccuaacaguaugac

SEQ ID NO: 525618 - RNA, 22 nt, Human
acacagggcggaaagcaugaga

SEQ ID NO: 525619 - RNA, 21 nt, Human
ggguccugggaugggauccag

SEQ ID NO: 525620 - RNA, 22 nt, Human
uuggaaggcagcauuuguccau

SEQ ID NO: 525621 - RNA, 22 nt, Human
caaugguggugucagaagagau

SEQ ID NO: 525622 - RNA, 21 nt, Human
aguuuucugaguuauaaaaua

SEQ ID NO: 525623 - RNA, 22 nt, Human
gaggcugaauggccagaagcca

SEQ ID NO: 525624 - RNA, 22 nt, Human
acagggcagagugaaaugcuau

SEQ ID NO: 525625 - RNA, 22 nt, Human
ugcugagcgcauccggcggccg

SEQ ID NO: 525626 - RNA, 22 nt, Human
aaaguucagugccuucuauaca

SEQ ID NO: 525627 - RNA, 22 nt, Human
ccaggccucccuuuuccagcca

SEQ ID NO: 525628 - RNA, 18 nt, Human
aggcugcacugucuuaaa

SEQ ID NO: 525629 - RNA, 22 nt, Human
guccaggcugcccaggguccug

SEQ ID NO: 525630 - RNA, 22 nt, Human
caaggccacuccagagacuggu

SEQ ID NO: 525631 - RNA, 22 nt, Human
cauagcaacagcaucaagucaa

SEQ ID NO: 525632 - RNA, 22 nt, Human
uuguacaaaggauuuggaagag

SEQ ID NO: 525633 - RNA, 22 nt, Human
agcaggcugcuggcguugaagu

SEQ ID NO: 525634 - RNA, 22 nt, Human
gacuucugaauuccuaucaggu

SEQ ID NO: 525635 - RNA, 22 nt, Human
cagcagcuagaggaagggcaga

SEQ ID NO: 525636 - RNA, 22 nt, Human
uccuagaacagcccaccuggaa

SEQ ID NO: 525637 - RNA, 22 nt, Human
auguguguguuuaauccucaaa

SEQ ID NO: 525638 - RNA, 22 nt, Human
ggccaccaaaguccuguggcuu

SEQ ID NO: 525639 - RNA, 22 nt, Human
gggcagguggcaaagccagagg

SEQ ID NO: 525640 - RNA, 23 nt, Human
gucagggcuggggucagagugac

SEQ ID NO: 525641 - RNA, 22 nt, Human
gccugcagaggugcugcuagcu

SEQ ID NO: 525642 - RNA, 22 nt, Human
gaggagcugucaccgugacuca

SEQ ID NO: 525643 - RNA, 22 nt, Human
cugugggaacacugaggacuuc

SEQ ID NO: 525644 - RNA, 19 nt, Human
ucaggacugacuugaaguc

SEQ ID NO: 525645 - RNA, 22 nt, Human
aauuagcuuauguguacuuuuc

SEQ ID NO: 525646 - RNA, 22 nt, Human
aaagccuucaaguagauguaag

SEQ ID NO: 525647 - RNA, 22 nt, Human
agagccugcuguguaagucaca

SEQ ID NO: 525648 - RNA, 22 nt, Human
acagccagugacuggacaagcu

SEQ ID NO: 525649 - RNA, 22 nt, Human
gugugagcaucaaagccuguca

SEQ ID NO: 525650 - RNA, 22 nt, Human
guucugggaagguggaccuguu

SEQ ID NO: 525651 - RNA, 20 nt, Human
uccuggccuucucgggcagu

SEQ ID NO: 525652 - RNA, 22 nt, Human
uccugggcccuccggaucaggu

SEQ ID NO: 525653 - RNA, 22 nt, Human
guccugguagggcucugugucu

SEQ ID NO: 525654 - RNA, 22 nt, Human
uggcagguggagacagcagagc

SEQ ID NO: 525655 - RNA, 22 nt, Human
ggucccugcugaagccuuggug

SEQ ID NO: 525656 - RNA, 22 nt, Human
gagcugugauuggugucucacu

SEQ ID NO: 525657 - RNA, 22 nt, Human
uguguggcaagcuguaugcuag

SEQ ID NO: 525658 - RNA, 22 nt, Human
ggagggagggcuagaccaaaga

SEQ ID NO: 525659 - RNA, 22 nt, Human
cccuccagagcuugaccugcug

SEQ ID NO: 525660 - RNA, 22 nt, Human
cagugggguuucugugggugcu

SEQ ID NO: 525661 - RNA, 22 nt, Human
gauuuacagaucuaagggucac

SEQ ID NO: 525662 - RNA, 22 nt, Human
ucaaucaaagccagauguccuu

SEQ ID NO: 525663 - RNA, 22 nt, Human
uuguauaagaaguuggcagaua

SEQ ID NO: 525664 - RNA, 20 nt, Human
ggaggguggaagaaagcaag

SEQ ID NO: 525665 - RNA, 22 nt, Human
caggcaagauuagagaugagca

SEQ ID NO: 525666 - RNA, 22 nt, Human
agugcaauagcaaagaacaaca

SEQ ID NO: 525667 - RNA, 22 nt, Human
gcaguguuuggauccauagcga

SEQ ID NO: 525668 - RNA, 22 nt, Human
aaagcagggaugaggcuagagg

SEQ ID NO: 525669 - RNA, 19 nt, Human
ugggccugcaucugggucu

SEQ ID NO: 525670 - RNA, 22 nt, Human
cuggcugcuggccugaggaugc

SEQ ID NO: 525671 - RNA, 23 nt, Human
uggcaggugguuagauguuuugu

SEQ ID NO: 525672 - RNA, 19 nt, Human
ggcaggcuggauagagagg

SEQ ID NO: 525673 - RNA, 21 nt, Human
aaggcugagacaacucaggag

SEQ ID NO: 525674 - RNA, 22 nt, Human
ggagcaagagguggugaaaaau

SEQ ID NO: 525675 - RNA, 22 nt, Human
uuagaaauacaagugagguuga

SEQ ID NO: 525676 - RNA, 22 nt, Human
guguaaaucagcuuguguaaua

SEQ ID NO: 525677 - RNA, 22 nt, Human
ccaaggagcaaguuuacaccug

SEQ ID NO: 525678 - RNA, 22 nt, Human
cagaggcagacccuccagggcg

SEQ ID NO: 525679 - RNA, 21 nt, Human
uucccuucugguuuugagaga

SEQ ID NO: 525680 - RNA, 22 nt, Human
uuuaccaguguuaaacaccagc

SEQ ID NO: 525681 - RNA, 22 nt, Human
ucaguccuccacacaggcaccc

SEQ ID NO: 525682 - RNA, 22 nt, Human
uuacaaaguucugaguucaaac

SEQ ID NO: 525683 - RNA, 22 nt, Human
agguccugucuuaucucuguaa

SEQ ID NO: 525684 - RNA, 22 nt, Human
gccuucccacccugcgaggcug

SEQ ID NO: 525685 - RNA, 22 nt, Human
auagauacauuagguaacuugu

SEQ ID NO: 525686 - RNA, 22 nt, Human
uuccaugaagggcagccucuca

SEQ ID NO: 525687 - RNA, 23 nt, Human
ggaguuggauuguacuugcugcu

SEQ ID NO: 525688 - RNA, 22 nt, Human
cuuguuaaaaugcagauuccaa

SEQ ID NO: 525689 - RNA, 22 nt, Human
uaauagaaagguauuuuuugca

SEQ ID NO: 525690 - RNA, 22 nt, Human
ucauuucccuccuacaaagagg

SEQ ID NO: 525691 - RNA, 22 nt, Human
aggaagagcauucacaugguag

SEQ ID NO: 525692 - RNA, 22 nt, Human
ucugccuucgcugcucccugaa

SEQ ID NO: 525693 - RNA, 22 nt, Human
aagcugccugccacgcuagaua

SEQ ID NO: 525694 - RNA, 18 nt, Human
ggagagugagaucaaaca

SEQ ID NO: 525695 - RNA, 22 nt, Human
ccuugcuguuagccuacauuau

SEQ ID NO: 525696 - RNA, 22 nt, Human
uugccagggaacagggagaggc

SEQ ID NO: 525697 - RNA, 22 nt, Human
agggcuccgggcaggcgaugga

SEQ ID NO: 525698 - RNA, 22 nt, Human
ccaaggagaaugacaccaugga

SEQ ID NO: 525699 - RNA, 22 nt, Human
gcucucuggguggugggcaaca

SEQ ID NO: 525700 - RNA, 18 nt, Human
ugcaggcuguugaaacug

SEQ ID NO: 525701 - RNA, 22 nt, Human
aagagcugcaucuaagccauga

SEQ ID NO: 525702 - RNA, 22 nt, Human
ucauuuuuagcgcgcaaaaguu

SEQ ID NO: 525703 - RNA, 20 nt, Human
gcagggcaagggauaugaaa

SEQ ID NO: 525704 - RNA, 22 nt, Human
aauaauuuccagccaacuggaa

SEQ ID NO: 525705 - RNA, 19 nt, Human
ugaagcaauaccauuuuug

SEQ ID NO: 525706 - RNA, 20 nt, Human
uggcagguggccucaguucc

SEQ ID NO: 525707 - RNA, 22 nt, Human
ucaucacaauuuuaugacccuc

SEQ ID NO: 525708 - RNA, 22 nt, Human
gcagugguccaguucacaccca

SEQ ID NO: 525709 - RNA, 22 nt, Human
uuugcugaccccauucugaguc

SEQ ID NO: 525710 - RNA, 22 nt, Human
gcugugcuauaucucugagugu

SEQ ID NO: 525711 - RNA, 22 nt, Human
gcugaagagagaugcguccagc

SEQ ID NO: 525712 - RNA, 22 nt, Human
aacuguaagacaaaugacuucu

SEQ ID NO: 525713 - RNA, 22 nt, Human
uuguauuugauugucauaucgu

SEQ ID NO: 525714 - RNA, 22 nt, Human
uauccaaaguggcauauuauag

SEQ ID NO: 525715 - RNA, 22 nt, Human
ggccagagaauaugccuuacgu

SEQ ID NO: 525716 - RNA, 22 nt, Human
ugcagggcacacgcacgggugu

SEQ ID NO: 525717 - RNA, 22 nt, Human
uaguuauuauuguuacuaucag

SEQ ID NO: 525718 - RNA, 22 nt, Human
cagagcuggggacuguuggaug

SEQ ID NO: 525719 - RNA, 21 nt, Human
aggaaaggaaguccccagggu

SEQ ID NO: 525720 - RNA, 22 nt, Human
aucagagaaauggagggcgcuu

SEQ ID NO: 525721 - RNA, 22 nt, Human
ggcagcaguaggagcuaaucuu

SEQ ID NO: 525722 - RNA, 22 nt, Human
accuggcuucagagucuggcca

SEQ ID NO: 525723 - RNA, 22 nt, Human
gucuggcuuuauauuugcuauu

SEQ ID NO: 525724 - RNA, 22 nt, Human
uuucaagcauaacugggaagag

SEQ ID NO: 525725 - RNA, 22 nt, Human
cugagcuuccaguuccuccagg

SEQ ID NO: 525726 - RNA, 22 nt, Human
cagcucuuugaguauuccauuu

SEQ ID NO: 525727 - RNA, 22 nt, Human
uaugagaauuugcuaauuggcu

SEQ ID NO: 525728 - RNA, 22 nt, Human
gcuguucagggcacucaugggc

SEQ ID NO: 525729 - RNA, 19 nt, Human
agggaguuuauauuugcac

SEQ ID NO: 525730 - RNA, 22 nt, Human
aauccuggcugcguuggccagc

SEQ ID NO: 525731 - RNA, 22 nt, Human
gugcauuuggugacucucaccc

SEQ ID NO: 525732 - RNA, 22 nt, Human
cagacagagucuucccaucagu

SEQ ID NO: 525733 - RNA, 22 nt, Human
agagcacagugcaggauccccg

SEQ ID NO: 525734 - RNA, 22 nt, Human
ugcugccaaaugcgagcucugu

SEQ ID NO: 525735 - RNA, 22 nt, Human
uuauacagggaguuucccugca

SEQ ID NO: 525736 - RNA, 22 nt, Human
aaggcacuacgcugcuggggcg

SEQ ID NO: 525737 - RNA, 22 nt, Human
ucccauguaagaaggagacagg

SEQ ID NO: 525738 - RNA, 22 nt, Human
ccuccugggcuccugucugcac

SEQ ID NO: 525739 - RNA, 22 nt, Human
cagggcucagggacugcagaaa

SEQ ID NO: 525740 - RNA, 22 nt, Human
acugugugcccugacgccaggg

SEQ ID NO: 525741 - RNA, 22 nt, Human
agccuggcacugaggcagggcg

SEQ ID NO: 525742 - RNA, 22 nt, Human
ggcaucaggguaggaagguauc

SEQ ID NO: 525743 - RNA, 22 nt, Human
agcaagaagggcaaggaaguuu

SEQ ID NO: 525744 - RNA, 23 nt, Human
ugcuucucugcuugacaguucug

SEQ ID NO: 525745 - RNA, 22 nt, Human
cuggccugaucucaugcugucc

SEQ ID NO: 525746 - RNA, 22 nt, Human
gggcagcucuggcugugggaag

SEQ ID NO: 525747 - RNA, 22 nt, Human
cuugaaagucagcagaguggau

SEQ ID NO: 525748 - RNA, 22 nt, Human
cagcuuggcuuccgcuuuacug

SEQ ID NO: 525749 - RNA, 22 nt, Human
ggguggaguagaaagaugaauu

SEQ ID NO: 525750 - RNA, 22 nt, Human
gaggaggggcacuugucuccua

SEQ ID NO: 525751 - RNA, 22 nt, Human
uuguauuaauugaaaugaaugc

SEQ ID NO: 525752 - RNA, 18 nt, Human
guggccagccuggucuug

SEQ ID NO: 525753 - RNA, 22 nt, Human
gccucccuggcccacagcagcg

SEQ ID NO: 525754 - RNA, 22 nt, Human
uuguccugucaggcugggggcu

SEQ ID NO: 525755 - RNA, 22 nt, Human
cuaaaauuaccuaccaguuuag

SEQ ID NO: 525756 - RNA, 22 nt, Human
ugcaggagagugagucaguagg

SEQ ID NO: 525757 - RNA, 22 nt, Human
gcugaagguaugaguuuuaucu

SEQ ID NO: 525758 - RNA, 22 nt, Human
acauuugaggauguuaagaaug

SEQ ID NO: 525759 - RNA, 22 nt, Human
aauggcugggaguguauuuugg

SEQ ID NO: 525760 - RNA, 22 nt, Human
cagcaggagcagucagacuccu

SEQ ID NO: 525761 - RNA, 22 nt, Human
uaaagguagugugacauauugu

SEQ ID NO: 525762 - RNA, 22 nt, Human
ccacuugugaaauaaucaaaua

SEQ ID NO: 525763 - RNA, 22 nt, Human
cacauaaguggguuccauugca

SEQ ID NO: 525764 - RNA, 22 nt, Human
uggccugcagcucucagggaag

SEQ ID NO: 525765 - RNA, 22 nt, Human
uagcuuuaaugaguugguaaga

SEQ ID NO: 525766 - RNA, 22 nt, Human
acauuucuccuugcaggaguca

SEQ ID NO: 525767 - RNA, 22 nt, Human
agcugggaggugggcagugaga

SEQ ID NO: 525768 - RNA, 22 nt, Human
agcagaagugccuuagcaauca

SEQ ID NO: 525769 - RNA, 22 nt, Human
ccuggccucagacagagggugg

SEQ ID NO: 525770 - RNA, 22 nt, Human
uccugagauaaaucucauguga

SEQ ID NO: 525771 - RNA, 22 nt, Human
gaggcaagagaagccagcuuuc

SEQ ID NO: 525772 - RNA, 22 nt, Human
agcuuuauauuuaaugaauucu

SEQ ID NO: 525773 - RNA, 22 nt, Human
agugcaaaauucagaagcaauu

SEQ ID NO: 525774 - RNA, 22 nt, Human
agcugccugcuuaugagcucca

SEQ ID NO: 525775 - RNA, 22 nt, Human
gcagcuuuaaucugaauaagua

SEQ ID NO: 525776 - RNA, 22 nt, Human
aguuucaguguugacagauggu

SEQ ID NO: 525777 - RNA, 22 nt, Human
agcugccucugcugguuuagaa

SEQ ID NO: 525778 - RNA, 22 nt, Human
ucugggccucaguuucuucauc

SEQ ID NO: 525779 - RNA, 22 nt, Human
gaggggaaagugugaggcugcg

SEQ ID NO: 525780 - RNA, 22 nt, Human
ugcagaagaccuuccagggcug

SEQ ID NO: 525781 - RNA, 22 nt, Human
gagccagaaaagcugccugacu

SEQ ID NO: 525782 - RNA, 22 nt, Human
aaggcccuggcaggaagcagga

SEQ ID NO: 525783 - RNA, 22 nt, Human
cugaggcaugaaugugggcuuu

SEQ ID NO: 525784 - RNA, 21 nt, Human
uuguuuccucccaaaaugcca

SEQ ID NO: 525785 - RNA, 22 nt, Human
ucagccagugccuugaucuugc

SEQ ID NO: 525786 - RNA, 23 nt, Human
ugucacauuuaguuggcauuguu

SEQ ID NO: 525787 - RNA, 22 nt, Human
aaguugaagcaugaaccaaggu

SEQ ID NO: 525788 - RNA, 22 nt, Human
uggcccugaggggcugugcccc

SEQ ID NO: 525789 - RNA, 22 nt, Human
aagugguagacaaagauaauug

SEQ ID NO: 525790 - RNA, 22 nt, Human
gagcagcuugcgcugucuucac

SEQ ID NO: 525791 - RNA, 22 nt, Human
uugucugagagauggcagaggu

SEQ ID NO: 525792 - RNA, 22 nt, Human
cuaaaugccuuuccuaccuaac

SEQ ID NO: 525793 - RNA, 22 nt, Human
auuucucaguguacauuauguu

SEQ ID NO: 525794 - RNA, 22 nt, Human
gaaugcacucacccaucacuca

SEQ ID NO: 525795 - RNA, 22 nt, Human
ugcugcuccugccuggcuccca

SEQ ID NO: 525796 - RNA, 22 nt, Human
auuccuugcucucaucaaccuu

SEQ ID NO: 525797 - RNA, 22 nt, Human
ucagagugcagggaguagcagc

SEQ ID NO: 525798 - RNA, 18 nt, Human
cagcugccagcucaugga

SEQ ID NO: 525799 - RNA, 22 nt, Human
uuauuaggaaaaggucagaugu

SEQ ID NO: 525800 - RNA, 22 nt, Human
ucugccugcggcugcagguggc

SEQ ID NO: 525801 - RNA, 22 nt, Human
auugaauagaugcauuauacua

SEQ ID NO: 525802 - RNA, 22 nt, Human
ggcggguguaaguaggacagcg

SEQ ID NO: 525803 - RNA, 22 nt, Human
agcuugauuucucugcagugug

SEQ ID NO: 525804 - RNA, 22 nt, Human
aagauguugacuccuuugaugu

SEQ ID NO: 525805 - RNA, 22 nt, Human
ugcugcacgauaaauaauuucu

SEQ ID NO: 525806 - RNA, 22 nt, Human
uguuuuauuucuccaagaggga

SEQ ID NO: 525807 - RNA, 22 nt, Human
gcccaugcucucaggcgggccu

SEQ ID NO: 525808 - RNA, 22 nt, Human
ucaaagcaauuucaccagugcc

SEQ ID NO: 525809 - RNA, 22 nt, Human
gaaauucaggacaaagacucuu

SEQ ID NO: 525810 - RNA, 22 nt, Human
auuagauuguaaauguuuucac

SEQ ID NO: 525811 - RNA, 22 nt, Human
ccacagagagugucagccuuug

SEQ ID NO: 525812 - RNA, 22 nt, Human
ccugggaagagcugacaggagg

SEQ ID NO: 525813 - RNA, 22 nt, Human
cagcuggguuuaguggggugug

SEQ ID NO: 525814 - RNA, 22 nt, Human
uggaaacacucaagcuuauauu

SEQ ID NO: 525815 - RNA, 18 nt, Human
gcucuggcucaccuccag

SEQ ID NO: 525816 - RNA, 22 nt, Human
aaauuccauuaggaaacuucca

SEQ ID NO: 525817 - RNA, 22 nt, Human
caggcagagugagguggucuaa

SEQ ID NO: 525818 - RNA, 22 nt, Human
cuuuccaaugucacuaugaauc

SEQ ID NO: 525819 - RNA, 22 nt, Human
ucuccacacuuucucucccagg

SEQ ID NO: 525820 - RNA, 22 nt, Human
uccagggccccccaguugcacg

SEQ ID NO: 525821 - RNA, 22 nt, Human
ugaaggcccagccacagaaugg

SEQ ID NO: 525822 - RNA, 22 nt, Human
auccuggguuugugaguuuaug

SEQ ID NO: 525823 - RNA, 22 nt, Human
ucagagagaaauaguuuuugac

SEQ ID NO: 525824 - RNA, 22 nt, Human
ccugggcuguaccugugcgcgg

SEQ ID NO: 525825 - RNA, 22 nt, Human
uguaaugagaaagagagugaau

SEQ ID NO: 525826 - RNA, 22 nt, Human
gcugucagugaggugagacaug

SEQ ID NO: 525827 - RNA, 19 nt, Human
ccucuccgcccaccagccc

SEQ ID NO: 525828 - RNA, 22 nt, Human
ugcucuccggcuuccguggccu

SEQ ID NO: 525829 - RNA, 22 nt, Human
cugcagggcagggccuccuggc

SEQ ID NO: 525830 - RNA, 22 nt, Human
ugguggccuugauggcaucugc

SEQ ID NO: 525831 - RNA, 22 nt, Human
ugagacaguucugcagcugggu

SEQ ID NO: 525832 - RNA, 22 nt, Human
aggacauguaaauggagaggga

SEQ ID NO: 525833 - RNA, 22 nt, Human
ucaguguuacauuauauagaac

SEQ ID NO: 525834 - RNA, 22 nt, Human
caaaucuccuuaaagguaaaau

SEQ ID NO: 525835 - RNA, 22 nt, Human
gcagccacuuugcaaccaagag

SEQ ID NO: 525836 - RNA, 22 nt, Human
cuguggcugaacucugaagagg

SEQ ID NO: 525837 - RNA, 22 nt, Human
acaggugugagaacaugccuug

SEQ ID NO: 525838 - RNA, 22 nt, Human
ccaguguucccucggguucaug

SEQ ID NO: 525839 - RNA, 22 nt, Human
gaguuauuuguagggauuauau

SEQ ID NO: 525840 - RNA, 22 nt, Human
aauguacaaaccuucuuuguag

SEQ ID NO: 525841 - RNA, 22 nt, Human
gaaggcugaugacagauucugc

SEQ ID NO: 525842 - RNA, 22 nt, Human
auuuguacaaauuuauguuagu

SEQ ID NO: 525843 - RNA, 22 nt, Human
gcuggcucuucaguggagauag

SEQ ID NO: 525844 - RNA, 22 nt, Human
cuggcagcugugugaagaacug

SEQ ID NO: 525845 - RNA, 22 nt, Human
aucuguggcuggugagaggcag

SEQ ID NO: 525846 - RNA, 22 nt, Human
aaagacugggacugcagcaggc

SEQ ID NO: 525847 - RNA, 22 nt, Human
acagcucuguugccagaucugc

SEQ ID NO: 525848 - RNA, 22 nt, Human
agccaugcuccuuccccucugg

SEQ ID NO: 525849 - RNA, 22 nt, Human
acuguacuguguauuguagaau

SEQ ID NO: 525850 - RNA, 22 nt, Human
auuugagaugguaaauaacuuu

SEQ ID NO: 525851 - RNA, 19 nt, Human
ccugccugagcugucccuc

SEQ ID NO: 525852 - RNA, 22 nt, Human
ucaggcaggcagagggcaaaug

SEQ ID NO: 525853 - RNA, 22 nt, Human
uugucugucccagcuugugcau

SEQ ID NO: 525854 - RNA, 22 nt, Human
uagcacuacuuagguacagcca

SEQ ID NO: 525855 - RNA, 22 nt, Human
cccagaggugcuucagaggugc

SEQ ID NO: 525856 - RNA, 18 nt, Human
uucaccagugugaugggu

SEQ ID NO: 525857 - RNA, 22 nt, Human
uagucuuuugagaaguauaucu

SEQ ID NO: 525858 - RNA, 22 nt, Human
gcaguguucuuguugcuuuuau

SEQ ID NO: 525859 - RNA, 22 nt, Human
gaauaauauugacuuugcaggc

SEQ ID NO: 525860 - RNA, 22 nt, Human
uuacaaagcgcuuuaccucuga

SEQ ID NO: 525861 - RNA, 22 nt, Human
aucuggcugacuuugugggaca

SEQ ID NO: 525862 - RNA, 22 nt, Human
uccagccaccaccuugauugcc

SEQ ID NO: 525863 - RNA, 22 nt, Human
guuaaauucgaugauggauaaa

SEQ ID NO: 525864 - RNA, 22 nt, Human
gcaggagcccuggcauguucuu

SEQ ID NO: 525865 - RNA, 22 nt, Human
ugguaaagaaggcuagaucuga

SEQ ID NO: 525866 - RNA, 22 nt, Human
auguacaguggaaacuaacaaa

SEQ ID NO: 525867 - RNA, 19 nt, Human
gcagcugugggaagagcca

SEQ ID NO: 525868 - RNA, 22 nt, Human
ggcuagaacuuuacacuuugca

SEQ ID NO: 525869 - RNA, 22 nt, Human
ugcaggccucacaccuggcacc

SEQ ID NO: 525870 - RNA, 23 nt, Human
gggugggccaaauuagguagccu

SEQ ID NO: 525871 - RNA, 22 nt, Human
ccuccaggauaagucagggccu

SEQ ID NO: 525872 - RNA, 22 nt, Human
acuggcucagaguuccuagaga

SEQ ID NO: 525873 - RNA, 18 nt, Human
ucucagaggccauccuag

SEQ ID NO: 525874 - RNA, 22 nt, Human
gugccugcagcaauccauggca

SEQ ID NO: 525875 - RNA, 22 nt, Human
aaaugaugauuaaaaugaggua

SEQ ID NO: 525876 - RNA, 22 nt, Human
ccugggccaggcuugggaaugc

SEQ ID NO: 525877 - RNA, 22 nt, Human
uggaccugcuggaugggcaggu

SEQ ID NO: 525878 - RNA, 22 nt, Human
aaacauugagcacuugcuauuu

SEQ ID NO: 525879 - RNA, 18 nt, Human
agccugggcucugccugg

SEQ ID NO: 525880 - RNA, 22 nt, Human
ucugcaaacuuaaguugaaaua

SEQ ID NO: 525881 - RNA, 22 nt, Human
gggcucugugguugugcuuugu

SEQ ID NO: 525882 - RNA, 22 nt, Human
auguccaggaagucuuaacuca

SEQ ID NO: 525883 - RNA, 22 nt, Human
gggcugacaaucucuuuacuua

SEQ ID NO: 525884 - RNA, 20 nt, Human
gcugccuguuucuguaagua

SEQ ID NO: 525885 - RNA, 22 nt, Human
aaucuaaggacuuagcauugcu

SEQ ID NO: 525886 - RNA, 22 nt, Human
uuuucuuaugugcagcuauaug

SEQ ID NO: 525887 - RNA, 22 nt, Human
agucuucucauuucacaugcuu

SEQ ID NO: 525888 - RNA, 22 nt, Human
acaaaugcuuaguucaccaaaa

SEQ ID NO: 525889 - RNA, 22 nt, Human
augcaagauguauagaagacuu

SEQ ID NO: 525890 - RNA, 22 nt, Human
cacauugaaaugacccaauaau

SEQ ID NO: 525891 - RNA, 22 nt, Human
cccucccaggaguggccagaga

SEQ ID NO: 525892 - RNA, 22 nt, Human
gcaaguaggaaguguccuccuu

SEQ ID NO: 525893 - RNA, 22 nt, Human
ugcacaggugagacucaggaag

SEQ ID NO: 525894 - RNA, 22 nt, Human
cugggagauugcuagagaugca

SEQ ID NO: 525895 - RNA, 22 nt, Human
ugauguuuaauacuaugcuuuu

SEQ ID NO: 525896 - RNA, 22 nt, Human
gcucagagaaucagcagacacc

SEQ ID NO: 525897 - RNA, 22 nt, Human
ucuuugcauggacauguguuuu

SEQ ID NO: 525898 - RNA, 22 nt, Human
agggacuugaugucagggagau

SEQ ID NO: 525899 - RNA, 22 nt, Human
auccccacgauauagccaaagc

SEQ ID NO: 525900 - RNA, 22 nt, Human
ggcuucagugacuggugcccuc

SEQ ID NO: 525901 - RNA, 22 nt, Human
aauuucagaugucauaaauaua

SEQ ID NO: 525902 - RNA, 22 nt, Human
aaggcugagagucacaguccua

SEQ ID NO: 525903 - RNA, 22 nt, Human
cagggacccgcacagguagcau

SEQ ID NO: 525904 - RNA, 22 nt, Human
uuauugccugauugaggucauu

SEQ ID NO: 525905 - RNA, 22 nt, Human
uacaggaagucucaguacagua

SEQ ID NO: 525906 - RNA, 22 nt, Human
cucaccacagagccuguccagc

SEQ ID NO: 525907 - RNA, 17 nt, Human
ccaggcuccaucacugu

SEQ ID NO: 525908 - RNA, 22 nt, Human
cugcuggugcagaguggggcug

SEQ ID NO: 525909 - RNA, 22 nt, Human
cagggcuccccagagagccucu

SEQ ID NO: 525910 - RNA, 22 nt, Human
gcacacaggggaguucucagaa

SEQ ID NO: 525911 - RNA, 22 nt, Human
aggaccugcuaaugugccaagu

SEQ ID NO: 525912 - RNA, 19 nt, Human
uccaggaggcugccauuga

SEQ ID NO: 525913 - RNA, 17 nt, Human
acaggcagaucaccuga

SEQ ID NO: 525914 - RNA, 22 nt, Human
uccacauuauguuucuccuuuc

SEQ ID NO: 525915 - RNA, 22 nt, Human
cuauuucugccuaaugaccugu

SEQ ID NO: 525916 - RNA, 22 nt, Human
uccagggcuugacagggugccu

SEQ ID NO: 525917 - RNA, 22 nt, Human
cuggccaguuguccuggcuugg

SEQ ID NO: 525918 - RNA, 22 nt, Human
cauguacaaggaugcucagagu

SEQ ID NO: 525919 - RNA, 22 nt, Human
cugagagcagggacuugagcca

SEQ ID NO: 525920 - RNA, 22 nt, Human
guguaaggugaaaucaacaaau

SEQ ID NO: 525921 - RNA, 22 nt, Human
uuccaaacugccaauucagaag

SEQ ID NO: 525922 - RNA, 22 nt, Human
ggcgcacaaugugcagguuugu

SEQ ID NO: 525923 - RNA, 22 nt, Human
cagaggccauauuucuucacuc

SEQ ID NO: 525924 - RNA, 22 nt, Human
uagguucauauucuagaaucau

SEQ ID NO: 525925 - RNA, 20 nt, Human
aaauuuaggaaauuuuacgc

SEQ ID NO: 525926 - RNA, 22 nt, Human
ugcccuggggucuggagcagca

SEQ ID NO: 525927 - RNA, 16 nt, Human
ucaguguuccagaaua

SEQ ID NO: 525928 - RNA, 22 nt, Human
accugcagcugagaaaaugacu

SEQ ID NO: 525929 - RNA, 22 nt, Human
ggagauggcucugcaaggucua

SEQ ID NO: 525930 - RNA, 22 nt, Human
ggagucagccugucagagugua

SEQ ID NO: 525931 - RNA, 22 nt, Human
uuuucauuguuacuaugagcua

SEQ ID NO: 525932 - RNA, 23 nt, Human
agguucagcuuucuuacucuggg

SEQ ID NO: 525933 - RNA, 22 nt, Human
uucagaaagugaaucuuguuau

SEQ ID NO: 525934 - RNA, 22 nt, Human
gcagagcacccugcagugguau

SEQ ID NO: 525935 - RNA, 22 nt, Human
uuacaguagauacaaugaguaa

SEQ ID NO: 525936 - RNA, 22 nt, Human
ugucucugguauuaggugaaaa

SEQ ID NO: 525937 - RNA, 22 nt, Human
cucccaagauaaauaaggcagu

SEQ ID NO: 525938 - RNA, 21 nt, Human
ggccucugccuugccccacuc

SEQ ID NO: 525939 - RNA, 22 nt, Human
uaacucugaauccucacagcag

SEQ ID NO: 525940 - RNA, 22 nt, Human
cagccuucugaaugaacguacu

SEQ ID NO: 525941 - RNA, 22 nt, Human
aaaggaggaauggagagaugcu

SEQ ID NO: 525942 - RNA, 22 nt, Human
ucaguguuuuaacugucuuuua

SEQ ID NO: 525943 - RNA, 22 nt, Human
aguccuggacuuggagucaggg

SEQ ID NO: 525944 - RNA, 22 nt, Human
ucccucuacagggaagcgcuuu

SEQ ID NO: 525945 - RNA, 22 nt, Human
aggugaguccugggcacaggua

SEQ ID NO: 525946 - RNA, 22 nt, Human
ccugggcuguugcaucauccuu

SEQ ID NO: 525947 - RNA, 22 nt, Human
cuggagucucuucuguagcuac

SEQ ID NO: 525948 - RNA, 22 nt, Human
uauguguacaucugguugagca

SEQ ID NO: 525949 - RNA, 22 nt, Human
agggccuggugaccuggguccu

SEQ ID NO: 525950 - RNA, 22 nt, Human
uggcuggcccugggagugcaga

SEQ ID NO: 525951 - RNA, 22 nt, Human
agcucccagggcugggcaaguu

SEQ ID NO: 525952 - RNA, 22 nt, Human
ugucucugcuuuccuugcaggg

SEQ ID NO: 525953 - RNA, 22 nt, Human
cugaggaguuuggguuguucaa

SEQ ID NO: 525954 - RNA, 22 nt, Human
ccaggguggcguagaugcuggg

SEQ ID NO: 525955 - RNA, 22 nt, Human
ucucaguguuaucuaucugccu

SEQ ID NO: 525956 - RNA, 22 nt, Human
agagacaccgcgcaucauggcu

SEQ ID NO: 525957 - RNA, 22 nt, Human
auuccuuguuucacugaaaagg

SEQ ID NO: 525958 - RNA, 22 nt, Human
uaaaugauaauaaugcuagugu

SEQ ID NO: 525959 - RNA, 22 nt, Human
uggcaggguggcaacuuuuggu

SEQ ID NO: 525960 - RNA, 22 nt, Human
aaggccauuauucugauauauu

SEQ ID NO: 525961 - RNA, 22 nt, Human
ggcuuccagcugggccuuggag

SEQ ID NO: 525962 - RNA, 22 nt, Human
ugccuucaagacccauccucca

SEQ ID NO: 525963 - RNA, 22 nt, Human
gcucccugcagcugagaguucc

SEQ ID NO: 525964 - RNA, 22 nt, Human
ugacagaacagguugggagcaa

SEQ ID NO: 525965 - RNA, 20 nt, Human
gcaggcagggaaugggggug

SEQ ID NO: 525966 - RNA, 22 nt, Human
auggccagucaagccucuggcu

SEQ ID NO: 525967 - RNA, 22 nt, Human
agguucaggcacuugcccaaca

SEQ ID NO: 525968 - RNA, 22 nt, Human
agcucacaguguccuuccucaa

SEQ ID NO: 525969 - RNA, 22 nt, Human
acuuccuuuugggaaacuguuu

SEQ ID NO: 525970 - RNA, 22 nt, Human
cacugcaguaacucuaggacug

SEQ ID NO: 525971 - RNA, 18 nt, Human
agaguguucucagugaaa

SEQ ID NO: 525972 - RNA, 22 nt, Human
guuuccuguuucucagcagccc

SEQ ID NO: 525973 - RNA, 22 nt, Human
ucagacagagaaguacaaugag

SEQ ID NO: 525974 - RNA, 19 nt, Human
acaggcagaauugggugug

SEQ ID NO: 525975 - RNA, 22 nt, Human
uuuaauuuuccugguaggccug

SEQ ID NO: 525976 - RNA, 22 nt, Human
aguucacucuuuaugagaaagu

SEQ ID NO: 525977 - RNA, 22 nt, Human
ugcuucugaugugagcagcccc

SEQ ID NO: 525978 - RNA, 22 nt, Human
cagggcuguaaauuagugcuga

SEQ ID NO: 525979 - RNA, 22 nt, Human
ugggugaggagaggcugucuaa

SEQ ID NO: 525980 - RNA, 22 nt, Human
acuguucauauucuuagaaauu

SEQ ID NO: 525981 - RNA, 22 nt, Human
gcugcccaguucugcugcugcc

SEQ ID NO: 525982 - RNA, 22 nt, Human
ggccuggcucuugcccagccug

SEQ ID NO: 525983 - RNA, 22 nt, Human
gcucaggaaacagcagggcuug

SEQ ID NO: 525984 - RNA, 22 nt, Human
acaaagauguuuaaagcauuua

SEQ ID NO: 525985 - RNA, 18 nt, Human
agagaugggaguuggaaa

SEQ ID NO: 525986 - RNA, 22 nt, Human
uacacacuuacuggagaugaag

SEQ ID NO: 525987 - RNA, 22 nt, Human
ucagugcacccaauucucucca

SEQ ID NO: 525988 - RNA, 22 nt, Human
gcuggccuuugaggaagcugcg

SEQ ID NO: 525989 - RNA, 22 nt, Human
gaggaaggaaugcaguguaugc

SEQ ID NO: 525990 - RNA, 22 nt, Human
aaugcaaauuaucaggcuucuc

SEQ ID NO: 525991 - RNA, 22 nt, Human
gggcuuuaacacccagucaggg

SEQ ID NO: 525992 - RNA, 22 nt, Human
agccucugugacucacagguca

SEQ ID NO: 525993 - RNA, 22 nt, Human
auauacagggagaaacagcuua

SEQ ID NO: 525994 - RNA, 22 nt, Human
cuggggacugaaggauguugcu

SEQ ID NO: 525995 - RNA, 22 nt, Human
gcaaagauauuagaauagagua

SEQ ID NO: 525996 - RNA, 22 nt, Human
caagaagucauuuagccucuca

SEQ ID NO: 525997 - RNA, 22 nt, Human
uccugggauucugcauuucuaa

SEQ ID NO: 525998 - RNA, 22 nt, Human
caggccucuauggucagcugag

SEQ ID NO: 525999 - RNA, 22 nt, Human
gagcuggcuaauacugacuuau

SEQ ID NO: 526000 - RNA, 22 nt, Human
ggagcugcucagagccaguccc

SEQ ID NO: 526001 - RNA, 19 nt, Human
ucaaggcucccugagggau

SEQ ID NO: 526002 - RNA, 22 nt, Human
cuucagcaccauagcuccuucu

SEQ ID NO: 526003 - RNA, 22 nt, Human
ccagagagggcgccaccuggag

SEQ ID NO: 526004 - RNA, 22 nt, Human
gacagaagaggaacuuggacag

SEQ ID NO: 526005 - RNA, 22 nt, Human
acaggcagagaacucagccaga

SEQ ID NO: 526006 - RNA, 22 nt, Human
cacagaggaaugcaucagcaga

SEQ ID NO: 526007 - RNA, 22 nt, Human
ucagggaagacuucuuagagga

SEQ ID NO: 526008 - RNA, 22 nt, Human
aagcagauuggggauuuccaug

SEQ ID NO: 526009 - RNA, 21 nt, Human
gccugggaagagaaagguaag

SEQ ID NO: 526010 - RNA, 22 nt, Human
gggaccugggccagaggacagu

SEQ ID NO: 526011 - RNA, 22 nt, Human
cagagccuuaguucuccuagaa

SEQ ID NO: 526012 - RNA, 22 nt, Human
aaagauuucacaucccaagccu

SEQ ID NO: 526013 - RNA, 22 nt, Human
uaaguuugugucucuguuacuu

SEQ ID NO: 526014 - RNA, 22 nt, Human
guuuccugacuguggaauuaua

SEQ ID NO: 526015 - RNA, 22 nt, Human
uagcauuccaucacucagcacc

SEQ ID NO: 526016 - RNA, 22 nt, Human
agagccaggaaguggcgugggg

SEQ ID NO: 526017 - RNA, 22 nt, Human
uucaccuguguuuuguggcuga

SEQ ID NO: 526018 - RNA, 22 nt, Human
uucucugguaaacacaugcgua

SEQ ID NO: 526019 - RNA, 22 nt, Human
uuggaagacagugaaacagcac

SEQ ID NO: 526020 - RNA, 22 nt, Human
aagggcaggcacccacccucac

SEQ ID NO: 526021 - RNA, 20 nt, Human
agccaaaggagaacagugcu

SEQ ID NO: 526022 - RNA, 22 nt, Human
agacuucucaguuuuauuagua

SEQ ID NO: 526023 - RNA, 20 nt, Human
auaauuauuuacuuuugugc

SEQ ID NO: 526024 - RNA, 22 nt, Human
ucugcaggccucgacaaggcca

SEQ ID NO: 526025 - RNA, 22 nt, Human
aacucagucauaaagcgaaugc

SEQ ID NO: 526026 - RNA, 22 nt, Human
ucagaagacuacuaggacacau

SEQ ID NO: 526027 - RNA, 22 nt, Human
ccagaaaaugcagaacauagaa

SEQ ID NO: 526028 - RNA, 22 nt, Human
cucuggaaaaccacuagcagga

SEQ ID NO: 526029 - RNA, 23 nt, Human
aggaggaaaaguuaucugcugag

SEQ ID NO: 526030 - RNA, 19 nt, Human
gccaggagggcucuggcug

SEQ ID NO: 526031 - RNA, 22 nt, Human
ugccaaauuagaguucccaggc

SEQ ID NO: 526032 - RNA, 22 nt, Human
cacaggcuuccaguccccagcu

SEQ ID NO: 526033 - RNA, 20 nt, Human
ccagagaguagguuagugau

SEQ ID NO: 526034 - RNA, 18 nt, Human
gccugcucugcucucccc

SEQ ID NO: 526035 - RNA, 22 nt, Human
gguuucaaauuaaagucuuaag

SEQ ID NO: 526036 - RNA, 22 nt, Human
caagccugucucaccagugcua

SEQ ID NO: 526037 - RNA, 23 nt, Human
aggagaagagauuuccacaugca

SEQ ID NO: 526038 - RNA, 22 nt, Human
gcuuuuucaaaugaaagcuggu

SEQ ID NO: 526039 - RNA, 22 nt, Human
gaucucuggguccuguuggccu

SEQ ID NO: 526040 - RNA, 22 nt, Human
caaaaagcuuagguaacaagcc

SEQ ID NO: 526041 - RNA, 22 nt, Human
ugucaauaguuuugaguucucu

SEQ ID NO: 526042 - RNA, 22 nt, Human
gcuccccauugaucugcaggcu

SEQ ID NO: 526043 - RNA, 21 nt, Human
uccaggaguucuaauaggugu

SEQ ID NO: 526044 - RNA, 22 nt, Human
agagucuguuacuuguccccua

SEQ ID NO: 526045 - RNA, 21 nt, Human
gcagccacagccaccaagcua

SEQ ID NO: 526046 - RNA, 22 nt, Human
cuguggagaugcagaccaggcc

SEQ ID NO: 526047 - RNA, 22 nt, Human
guccucuggugaaagcauuccc

SEQ ID NO: 526048 - RNA, 22 nt, Human
uugaaaggugacauuguuagag

SEQ ID NO: 526049 - RNA, 22 nt, Human
cgucaucacggcaagcaucucc

SEQ ID NO: 526050 - RNA, 22 nt, Human
cugcucggcgcgcauggcugcc

SEQ ID NO: 526051 - RNA, 23 nt, Human
aaauauucuuuuuuaguaagugc

SEQ ID NO: 526052 - RNA, 22 nt, Human
gggcccagcgugguuccaucug

SEQ ID NO: 526053 - RNA, 22 nt, Human
cugagcugcuuugcuuuugggg

SEQ ID NO: 526054 - RNA, 22 nt, Human
ugggggagauugugcaucucua

SEQ ID NO: 526055 - RNA, 20 nt, Human
ggagcugcccugggcuggag

SEQ ID NO: 526056 - RNA, 22 nt, Human
uccuucagggcugaccacaggc

SEQ ID NO: 526057 - RNA, 22 nt, Human
uacaguuuguuacauuguuagu

SEQ ID NO: 526058 - RNA, 18 nt, Human
aaaauaacaaaguuggcu

SEQ ID NO: 526059 - RNA, 19 nt, Human
uguuggugcggauguggag

SEQ ID NO: 526060 - RNA, 22 nt, Human
agaggucauaucucagaagaga

SEQ ID NO: 526061 - RNA, 21 nt, Human
cuucagcaaauacuuggcagg

SEQ ID NO: 526062 - RNA, 22 nt, Human
cccagcucuuccugggagcuaa

SEQ ID NO: 526063 - RNA, 22 nt, Human
ucuggcucccuggagcuccaca

SEQ ID NO: 526064 - RNA, 23 nt, Human
ugcucugugaauaguuggugacu

SEQ ID NO: 526065 - RNA, 22 nt, Human
ucuuugcaucccuuccauaguu

SEQ ID NO: 526066 - RNA, 23 nt, Human
acugccugugccgaucucucuca

SEQ ID NO: 526067 - RNA, 22 nt, Human
uaugagaacaagaacaaucucc

SEQ ID NO: 526068 - RNA, 22 nt, Human
gguggggucacgacagagggaa

SEQ ID NO: 526069 - RNA, 22 nt, Human
gugcugugugauccaugcuggc

SEQ ID NO: 526070 - RNA, 22 nt, Human
agcagcauaucagagaaaguca

SEQ ID NO: 526071 - RNA, 22 nt, Human
cacuuggaggcccccugugccc

SEQ ID NO: 526072 - RNA, 21 nt, Human
cacaugugaauuacugaacug

SEQ ID NO: 526073 - RNA, 22 nt, Human
gccuggcaggccugggccagca

SEQ ID NO: 526074 - RNA, 22 nt, Human
cuggcaggaaguuagaugguaa

SEQ ID NO: 526075 - RNA, 22 nt, Human
uggcaggugcacuuuugguuuc

SEQ ID NO: 526076 - RNA, 20 nt, Human
aggaaggagaaucugagcaa

SEQ ID NO: 526077 - RNA, 22 nt, Human
ucugucacucccugaugaugaa

SEQ ID NO: 526078 - RNA, 22 nt, Human
ggcccagagucugcaauggagu

SEQ ID NO: 526079 - RNA, 22 nt, Human
ccagccagccuugaucugagua

SEQ ID NO: 526080 - RNA, 22 nt, Human
uaaaaguuuuaguuguacauaa

SEQ ID NO: 526081 - RNA, 22 nt, Human
gagaggaagccuucuguacuug

SEQ ID NO: 526082 - RNA, 22 nt, Human
agcugcuccuuuccugcaggcg

SEQ ID NO: 526083 - RNA, 22 nt, Human
uagugauuuucauauuacauua

SEQ ID NO: 526084 - RNA, 21 nt, Human
uccugccuuaguccagagcag

SEQ ID NO: 526085 - RNA, 22 nt, Human
uguaccuggagagcucuuggcc

SEQ ID NO: 526086 - RNA, 18 nt, Human
gguggcaggucagaugcc

SEQ ID NO: 526087 - RNA, 22 nt, Human
ggaggagacggagugauuagug

SEQ ID NO: 526088 - RNA, 22 nt, Human
aaggcagccucugccagccggg

SEQ ID NO: 526089 - RNA, 22 nt, Human
uacuuaaugccacugaauugua

SEQ ID NO: 526090 - RNA, 18 nt, Human
caaagcucacguuccauc

SEQ ID NO: 526091 - RNA, 22 nt, Human
gaggccuggucuaugagauguu

SEQ ID NO: 526092 - RNA, 22 nt, Human
cuccucuggcuuccuggaggca

SEQ ID NO: 526093 - RNA, 20 nt, Human
ggggcugcaugcagagaaga

SEQ ID NO: 526094 - RNA, 22 nt, Human
gcugccaguaguuggagcucca

SEQ ID NO: 526095 - RNA, 22 nt, Human
ugcauuugucuugucucaugaa

SEQ ID NO: 526096 - RNA, 22 nt, Human
uaggguccucaucuguaaauga

SEQ ID NO: 526097 - RNA, 22 nt, Human
ggcaggcugcuugggucauguc

SEQ ID NO: 526098 - RNA, 22 nt, Human
augaagauauucuuguuuucug

SEQ ID NO: 526099 - RNA, 22 nt, Human
agaagcuuccuacauuguucuu

SEQ ID NO: 526100 - RNA, 22 nt, Human
ucucuggccccauggcugagcu

SEQ ID NO: 526101 - RNA, 22 nt, Human
ucagcagggccaugcucucucu

SEQ ID NO: 526102 - RNA, 22 nt, Human
uuauuugccagaauuucucuug

SEQ ID NO: 526103 - RNA, 22 nt, Human
augaugguggguaauguguaaa

SEQ ID NO: 526104 - RNA, 22 nt, Human
gaggaaaugguuguucaggugg

SEQ ID NO: 526105 - RNA, 22 nt, Human
agagcagcugugacauggacag

SEQ ID NO: 526106 - RNA, 22 nt, Human
gaucaggaauauuggaaaguac

SEQ ID NO: 526107 - RNA, 22 nt, Human
ucacugggagagcugacaagga

SEQ ID NO: 526108 - RNA, 22 nt, Human
uucugugcccauuuuaaaaugg

SEQ ID NO: 526109 - RNA, 22 nt, Human
caccagggcucugagcucugaa

SEQ ID NO: 526110 - RNA, 22 nt, Human
ccagggaaaaucaacuucuacu

SEQ ID NO: 526111 - RNA, 22 nt, Human
aagaaaugcagaaaugugcugg

SEQ ID NO: 526112 - RNA, 22 nt, Human
cagagcugacccaaggauugaa

SEQ ID NO: 526113 - RNA, 22 nt, Human
auugacaauuagcccuuaggug

SEQ ID NO: 526114 - RNA, 22 nt, Human
gugcaaaaaucuaucaccagca

SEQ ID NO: 526115 - RNA, 22 nt, Human
ccucccugguggcucuggucua

SEQ ID NO: 526116 - RNA, 22 nt, Human
gcagcugccuauucagggcuug

SEQ ID NO: 526117 - RNA, 22 nt, Human
ucugucacccaggcuggagugc

SEQ ID NO: 526118 - RNA, 22 nt, Human
agucaguggauuuaccaugcgu

SEQ ID NO: 526119 - RNA, 22 nt, Human
aaauguuccauuauuguguaau

SEQ ID NO: 526120 - RNA, 22 nt, Human
cugccuguggucugugaucuaa

SEQ ID NO: 526121 - RNA, 22 nt, Human
cucaggaugaaagucaugguga

SEQ ID NO: 526122 - RNA, 22 nt, Human
aaguuugaugaguuucuggagg

SEQ ID NO: 526123 - RNA, 22 nt, Human
aauaugcagcaugaugaaguaa

SEQ ID NO: 526124 - RNA, 22 nt, Human
cuguguuuuuggucugaucuau

SEQ ID NO: 526125 - RNA, 22 nt, Human
gaugcaaaccuuacauggaccu

SEQ ID NO: 526126 - RNA, 22 nt, Human
auaagaaacauuauucuuucca

SEQ ID NO: 526127 - RNA, 20 nt, Human
acuuuggggucuuucucaga

SEQ ID NO: 526128 - RNA, 22 nt, Human
gcagagaggaaugaagccaucc

SEQ ID NO: 526129 - RNA, 22 nt, Human
cagugagggcauucagugcugg

SEQ ID NO: 526130 - RNA, 23 nt, Human
ucagagaacucgggcagaugacc

SEQ ID NO: 526131 - RNA, 22 nt, Human
gggacuggaacuacuggugcag

SEQ ID NO: 526132 - RNA, 22 nt, Human
aucuacaggcugaggugggagg

SEQ ID NO: 526133 - RNA, 22 nt, Human
gggcaggugccagcucccuguc

SEQ ID NO: 526134 - RNA, 20 nt, Human
ugcuugucaugcacucaggc

SEQ ID NO: 526135 - RNA, 22 nt, Human
uaacuucugcacagaaaauuug

SEQ ID NO: 526136 - RNA, 22 nt, Human
gccagguggcugagcagcugca

SEQ ID NO: 526137 - RNA, 22 nt, Human
ggugaggcuaagugacacaggg

SEQ ID NO: 526138 - RNA, 22 nt, Human
guggcacaggguuguuggucau

SEQ ID NO: 526139 - RNA, 22 nt, Human
uagauucaugcaguaugcuagu

SEQ ID NO: 526140 - RNA, 22 nt, Human
gugcagggagcccagaaggucc

SEQ ID NO: 526141 - RNA, 22 nt, Human
uggcuuccacugugugcccccu

SEQ ID NO: 526142 - RNA, 22 nt, Human
aggucacccguuugacuaucca

SEQ ID NO: 526143 - RNA, 22 nt, Human
guaccagucucugugggcaccu

SEQ ID NO: 526144 - RNA, 22 nt, Human
caaacauagugaagcaaugaca

SEQ ID NO: 526145 - RNA, 22 nt, Human
gggaguggagagcaauggauga

SEQ ID NO: 526146 - RNA, 22 nt, Human
gagaagggcuugggagucaaca

SEQ ID NO: 526147 - RNA, 22 nt, Human
ggcuggcuacauuggaggaagg

SEQ ID NO: 526148 - RNA, 19 nt, Human
acaaacugaguacacuugu

SEQ ID NO: 526149 - RNA, 22 nt, Human
aggcuauuuccacucuucucau

SEQ ID NO: 526150 - RNA, 22 nt, Human
gcacagagagggaagguaacuu

SEQ ID NO: 526151 - RNA, 22 nt, Human
aggguggggugcuacaucuuua

SEQ ID NO: 526152 - RNA, 22 nt, Human
ugcuggcccaguauggacugca

SEQ ID NO: 526153 - RNA, 22 nt, Human
accaaggagacaaagguguauu

SEQ ID NO: 526154 - RNA, 22 nt, Human
gucugaagccagugguaguccg

SEQ ID NO: 526155 - RNA, 22 nt, Human
ugcuuuauugcaucaguguggg

SEQ ID NO: 526156 - RNA, 22 nt, Human
cugagcugacaucuuccucuuu

SEQ ID NO: 526157 - RNA, 22 nt, Human
ugggccaggucugugucagcug

SEQ ID NO: 526158 - RNA, 22 nt, Human
ccucacuggccagccaggggug

SEQ ID NO: 526159 - RNA, 22 nt, Human
cuguagaacgauccaggcauuu

SEQ ID NO: 526160 - RNA, 22 nt, Human
aaggcugcuuuuaacaugcaua

SEQ ID NO: 526161 - RNA, 22 nt, Human
cccaggacucggcacucuccuu

SEQ ID NO: 526162 - RNA, 22 nt, Human
ugagaugaauaacuccugcuaa

SEQ ID NO: 526163 - RNA, 22 nt, Human
cagaacauucacucauaugugg

SEQ ID NO: 526164 - RNA, 22 nt, Human
ccaggccucuggcugcuuaguc

SEQ ID NO: 526165 - RNA, 22 nt, Human
uggccuuggagaggcacggccc

SEQ ID NO: 526166 - RNA, 22 nt, Human
cuaucuuucgauucuagcuuaa

SEQ ID NO: 526167 - RNA, 22 nt, Human
cagcaguacuucucagagguau

SEQ ID NO: 526168 - RNA, 22 nt, Human
uagagaaacagaaccaacaggg

SEQ ID NO: 526169 - RNA, 22 nt, Human
uguguucagaauuugcugcuuu

SEQ ID NO: 526170 - RNA, 23 nt, Human
gcagaaauucucacacugaggcc

SEQ ID NO: 526171 - RNA, 22 nt, Human
cugggaggcaccgcgucgugcu

SEQ ID NO: 526172 - RNA, 22 nt, Human
gccugcagggugaugggcugcc

SEQ ID NO: 526173 - RNA, 22 nt, Human
uggcucagcugacucggcuucu

SEQ ID NO: 526174 - RNA, 22 nt, Human
gcugccugccuaguuccacagu

SEQ ID NO: 526175 - RNA, 22 nt, Human
cagcugccuguauuguccucau

SEQ ID NO: 526176 - RNA, 22 nt, Human
cccaggacucugacacccccaa

SEQ ID NO: 526177 - RNA, 22 nt, Human
ugggagagauaggcuucuggac

SEQ ID NO: 526178 - RNA, 22 nt, Human
gagggccaaugugucccugagc

SEQ ID NO: 526179 - RNA, 22 nt, Human
aaagcacauuacaagcucaguc

SEQ ID NO: 526180 - RNA, 22 nt, Human
cuugacacugucacucaggcca

SEQ ID NO: 526181 - RNA, 22 nt, Human
agcuaguauuucauugaggauu

SEQ ID NO: 526182 - RNA, 21 nt, Human
cccagaaguuccauggggggc

SEQ ID NO: 526183 - RNA, 19 nt, Human
cucugccucuggcuguggc

SEQ ID NO: 526184 - RNA, 20 nt, Human
uucacagaggacucagguca

SEQ ID NO: 526185 - RNA, 22 nt, Human
ccaggaagaaacagucuuuaua

SEQ ID NO: 526186 - RNA, 22 nt, Human
agacacauuuucagcucugcca

SEQ ID NO: 526187 - RNA, 22 nt, Human
agagaagcagggagucaucugu

SEQ ID NO: 526188 - RNA, 22 nt, Human
ugguacauggguagguaucucu

SEQ ID NO: 526189 - RNA, 22 nt, Human
gccugagccgccugagcggcgg

SEQ ID NO: 526190 - RNA, 22 nt, Human
ugggcagacgggagcuugccuu

SEQ ID NO: 526191 - RNA, 22 nt, Human
gaggugaguggggucuccaggg

SEQ ID NO: 526192 - RNA, 22 nt, Human
uaaccuguuaagggcugaccca

SEQ ID NO: 526193 - RNA, 22 nt, Human
uaagccugcaugaaccaugaga

SEQ ID NO: 526194 - RNA, 22 nt, Human
agguaagguuuggaggcagugg

SEQ ID NO: 526195 - RNA, 23 nt, Human
uacugggcagcugcucugacacc

SEQ ID NO: 526196 - RNA, 22 nt, Human
gccagugccugcugcucagggc

SEQ ID NO: 526197 - RNA, 22 nt, Human
gagugggugaaugugcucauaa

SEQ ID NO: 526198 - RNA, 22 nt, Human
uccccaguaagccugcacugug

SEQ ID NO: 526199 - RNA, 22 nt, Human
cagcuggacugggauguagcga

SEQ ID NO: 526200 - RNA, 22 nt, Human
ccucuugauugguuggaagcgg

SEQ ID NO: 526201 - RNA, 22 nt, Human
cuuccugcaacaccuguguugc

SEQ ID NO: 526202 - RNA, 21 nt, Human
ucugaggagaaacucuuggug

SEQ ID NO: 526203 - RNA, 22 nt, Human
uuuauccaccuuacccuguucc

SEQ ID NO: 526204 - RNA, 22 nt, Human
agcugcaaguccaaaggaauua

SEQ ID NO: 526205 - RNA, 21 nt, Human
ucagcuugcuucauuauuaug

SEQ ID NO: 526206 - RNA, 22 nt, Human
gggcauuucuugucaauguagg

SEQ ID NO: 526207 - RNA, 19 nt, Human
gcacacccugcaccaccau

SEQ ID NO: 526208 - RNA, 22 nt, Human
gcugcccauugcucucccacuc

SEQ ID NO: 526209 - RNA, 22 nt, Human
ccaggcuccccaggaggcccuu

SEQ ID NO: 526210 - RNA, 21 nt, Human
ugugacagaggcggugccuac

SEQ ID NO: 526211 - RNA, 20 nt, Human
ucacuguaauugccuacauu

SEQ ID NO: 526212 - RNA, 22 nt, Human
cuucuccgacaaccgacgccgg

SEQ ID NO: 526213 - RNA, 22 nt, Human
ucgggcugcucgcugcggaacu

SEQ ID NO: 526214 - RNA, 22 nt, Human
uuucgagggauuagcuaggacu

SEQ ID NO: 526215 - RNA, 22 nt, Human
uggcugaggagagggcggaagu

SEQ ID NO: 526216 - RNA, 22 nt, Human
uuauuugcccauguuuagcaga

SEQ ID NO: 526217 - RNA, 22 nt, Human
cagaaacacuguauuuagggaa

SEQ ID NO: 526218 - RNA, 22 nt, Human
cagguuccaguugcagggacuu

SEQ ID NO: 526219 - RNA, 22 nt, Human
caggcacaaugagcgccaucuu

SEQ ID NO: 526220 - RNA, 22 nt, Human
gagguuggagggcuggccugca

SEQ ID NO: 526221 - RNA, 22 nt, Human
uggguccuggaaggcgacaggu

SEQ ID NO: 526222 - RNA, 22 nt, Human
gucugcccuuggccugggacuu

SEQ ID NO: 526223 - RNA, 22 nt, Human
aaugacaguggcacagucacuu

SEQ ID NO: 526224 - RNA, 22 nt, Human
guggcauugccuucugcaggaa

SEQ ID NO: 526225 - RNA, 20 nt, Human
cagagcagugcccaggcggc

SEQ ID NO: 526226 - RNA, 22 nt, Human
agacuucucuaacuugaggacc

SEQ ID NO: 526227 - RNA, 21 nt, Human
uuccuggaggcagaaacguga

SEQ ID NO: 526228 - RNA, 22 nt, Human
caugagaucugcagggaugggc

SEQ ID NO: 526229 - RNA, 22 nt, Human
uuuccagggaggaauguggggu

SEQ ID NO: 526230 - RNA, 22 nt, Human
gugcacagaaacauacaaugug

SEQ ID NO: 526231 - RNA, 22 nt, Human
aggccacaggaguacugucggu

SEQ ID NO: 526232 - RNA, 22 nt, Human
ggagugggaacaaugacauggu

SEQ ID NO: 526233 - RNA, 22 nt, Human
cugagauggaguuucgcucuuc

SEQ ID NO: 526234 - RNA, 22 nt, Human
cccuggaacccauggccagugu

SEQ ID NO: 526235 - RNA, 22 nt, Human
aguccagggcuuagucagcggg

SEQ ID NO: 526236 - RNA, 22 nt, Human
ccucuggccuaggccgggagag

SEQ ID NO: 526237 - RNA, 22 nt, Human
augcaguggcagcuccuggugu

SEQ ID NO: 526238 - RNA, 22 nt, Human
gggcccugcgacucgcggcgga

SEQ ID NO: 526239 - RNA, 22 nt, Human
augcccugggagugcuguacca

SEQ ID NO: 526240 - RNA, 22 nt, Human
guccuuucgagggugagugaaa

SEQ ID NO: 526241 - RNA, 20 nt, Human
guggcagugguggcagcagu

SEQ ID NO: 526242 - RNA, 22 nt, Human
uccagcagguccgagacaaguu

SEQ ID NO: 526243 - RNA, 22 nt, Human
gggagaguagcuggaagguucu

SEQ ID NO: 526244 - RNA, 22 nt, Human
ugaggaggugggcacacagagu

SEQ ID NO: 526245 - RNA, 22 nt, Human
ggccacuguuuccugggcaguu

SEQ ID NO: 526246 - RNA, 18 nt, Human
ggaaggugcuggagugca

SEQ ID NO: 526247 - RNA, 22 nt, Human
cagggcacuuaaauugccucgu

SEQ ID NO: 526248 - RNA, 22 nt, Human
aaacugaggcucccgagggugu

SEQ ID NO: 526249 - RNA, 22 nt, Human
gcagccuccgcacugcgagucc

SEQ ID NO: 526250 - RNA, 22 nt, Human
uuuccacacucacugcacucau

SEQ ID NO: 526251 - RNA, 19 nt, Human
agacaaguuuccagaagcc

SEQ ID NO: 526252 - RNA, 22 nt, Human
ggcacagcugaugcagacacac

SEQ ID NO: 526253 - RNA, 22 nt, Human
ucccagugggaagcagcacgcu

SEQ ID NO: 526254 - RNA, 22 nt, Human
uccaggcuccccugcgugcucc

SEQ ID NO: 526255 - RNA, 22 nt, Human
uccaggaguccuggguggcccc

SEQ ID NO: 526256 - RNA, 22 nt, Human
acaaacagaguugaaaaauagg

SEQ ID NO: 526257 - RNA, 20 nt, Human
gaacagucuucugagccaca

SEQ ID NO: 526258 - RNA, 22 nt, Human
gcaggguaggugacagguaguc

SEQ ID NO: 526259 - RNA, 22 nt, Human
ugaggaaugugacaaaaccaag

SEQ ID NO: 526260 - RNA, 22 nt, Human
cccccagcucugcugggucccg

SEQ ID NO: 526261 - RNA, 22 nt, Human
cuggagcuggcccaggcuggcc

SEQ ID NO: 526262 - RNA, 21 nt, Human
cugugauguugccgggguagg

SEQ ID NO: 526263 - RNA, 22 nt, Human
gcccagcugagaagcgcggggc

SEQ ID NO: 526264 - RNA, 20 nt, Human
ucauccaggacaggaguggc

SEQ ID NO: 526265 - RNA, 21 nt, Human
ccaugucagaugugggcugug

SEQ ID NO: 526266 - RNA, 22 nt, Human
uugcccacuggcuguuggucag

SEQ ID NO: 526267 - RNA, 22 nt, Human
ucugcuguuuacugugugauau

SEQ ID NO: 526268 - RNA, 22 nt, Human
cugagcugguucucuugugaaa

SEQ ID NO: 526269 - RNA, 22 nt, Human
gagcugggaagauagcuugagc

SEQ ID NO: 526270 - RNA, 22 nt, Human
cccaggcacacugaagugacau

SEQ ID NO: 526271 - RNA, 23 nt, Human
cagcugguugugggaguggcugc

SEQ ID NO: 526272 - RNA, 22 nt, Human
agucauaaagccagugggaggc

SEQ ID NO: 526273 - RNA, 22 nt, Human
ugcccguggccuggggcagcuu

SEQ ID NO: 526274 - RNA, 22 nt, Human
agucacuguuuaaucuagcuaa

SEQ ID NO: 526275 - RNA, 20 nt, Human
ugagucagcugcaugggugg

SEQ ID NO: 526276 - RNA, 19 nt, Human
ccuggcccugcugcgcggg

SEQ ID NO: 526277 - RNA, 22 nt, Human
gaaggcaagugagccaagagaa

SEQ ID NO: 526278 - RNA, 22 nt, Human
agauugucauugacgaugagca

SEQ ID NO: 526279 - RNA, 22 nt, Human
guggcauuugggagaugcgugg

SEQ ID NO: 526280 - RNA, 22 nt, Human
uugaagcauuugcuauagcauu

SEQ ID NO: 526281 - RNA, 21 nt, Human
gcugcucgagauccagugcuu

SEQ ID NO: 526282 - RNA, 22 nt, Human
ugucacagagcgugcaacagaa

SEQ ID NO: 526283 - RNA, 22 nt, Human
gaggcuggcagaaaagcacagg

SEQ ID NO: 526284 - RNA, 22 nt, Human
agaagugaguugugacuauggg

SEQ ID NO: 526285 - RNA, 22 nt, Human
aacacaguuucugcauugguag

SEQ ID NO: 526286 - RNA, 22 nt, Human
ucugugggcauuuauaaucugg

SEQ ID NO: 526287 - RNA, 22 nt, Human
cagggagaggccucuguugccc

SEQ ID NO: 526288 - RNA, 22 nt, Human
aagcagccagccaucaugcccg

SEQ ID NO: 526289 - RNA, 22 nt, Human
caggccacacggcggcucccug

SEQ ID NO: 526290 - RNA, 22 nt, Human
agcaggccugccaccucggggu

SEQ ID NO: 526291 - RNA, 22 nt, Human
gcuucuggaagcauaugcaaga

SEQ ID NO: 526292 - RNA, 19 nt, Human
ggccuggauuuagggcucc

SEQ ID NO: 526293 - RNA, 22 nt, Human
cuacuucuguggcucuaagaga

SEQ ID NO: 526294 - RNA, 22 nt, Human
aaggugccacuucccucagacu

SEQ ID NO: 526295 - RNA, 19 nt, Human
augggaagcggccagcgga

SEQ ID NO: 526296 - RNA, 22 nt, Human
gugcugauugggagcugggauu

SEQ ID NO: 526297 - RNA, 22 nt, Human
ugguuggauggcucuuguggcu

SEQ ID NO: 526298 - RNA, 22 nt, Human
uugcuugaacccaggaagugga

SEQ ID NO: 526299 - RNA, 22 nt, Human
uuccugagucgccgagucuaug

SEQ ID NO: 526300 - RNA, 22 nt, Human
aaggggaguuagugauaaaacc

SEQ ID NO: 526301 - RNA, 17 nt, Human
aggucugagaguaucug

SEQ ID NO: 526302 - RNA, 22 nt, Human
aagucccaucugccuccaugua

SEQ ID NO: 526303 - RNA, 22 nt, Human
agagaagagucuugucaaauua

SEQ ID NO: 526304 - RNA, 22 nt, Human
cugaaggacacgugaggagcca

SEQ ID NO: 526305 - RNA, 22 nt, Human
gccauguucuugaaucuggguc

SEQ ID NO: 526306 - RNA, 22 nt, Human
uugaggucuggcaguagcguug

SEQ ID NO: 526307 - RNA, 22 nt, Human
ugguccugagcaccagccugac

SEQ ID NO: 526308 - RNA, 21 nt, Human
acagaagcggcgaguggcccc

SEQ ID NO: 526309 - RNA, 22 nt, Human
aucugccuggcuccaggugagc

SEQ ID NO: 526310 - RNA, 20 nt, Human
cagagccaggguuuuguuuu

SEQ ID NO: 526311 - RNA, 22 nt, Human
acagggcaccugagguaggaag

SEQ ID NO: 526312 - RNA, 20 nt, Human
gcuccccuucucugggccuc

SEQ ID NO: 526313 - RNA, 22 nt, Human
ugaggagcaggguggcuuacuc

SEQ ID NO: 526314 - RNA, 22 nt, Human
agcaccauugcaaauauggcag

SEQ ID NO: 526315 - RNA, 22 nt, Human
caaagaagagauuuacagagcu

SEQ ID NO: 526316 - RNA, 22 nt, Human
uucuuucugggguccuucggcu

SEQ ID NO: 526317 - RNA, 22 nt, Human
augucccugagggucucucuga

SEQ ID NO: 526318 - RNA, 22 nt, Human
uagcuucccugcuggaucauaa

SEQ ID NO: 526319 - RNA, 22 nt, Human
ugcugugagaccauuuguugag

SEQ ID NO: 526320 - RNA, 22 nt, Human
cuucacugcagucauggcucug

SEQ ID NO: 526321 - RNA, 22 nt, Human
ugccuggauggcucugagcagg

SEQ ID NO: 526322 - RNA, 22 nt, Human
agaagagccacuguugacggca

SEQ ID NO: 526323 - RNA, 22 nt, Human
ggcgagcaugagucacucuggg

SEQ ID NO: 526324 - RNA, 22 nt, Human
cccuuguuuuugaguacaauag

SEQ ID NO: 526325 - RNA, 23 nt, Human
ucuggcugcuccuuucaaugcuc

SEQ ID NO: 526326 - RNA, 22 nt, Human
aaagagcucggaaaguguugaa

SEQ ID NO: 526327 - RNA, 22 nt, Human
accuuuaugaaacagcugucgu

SEQ ID NO: 526328 - RNA, 19 nt, Human
ucaaagucugagucacuuu

SEQ ID NO: 526329 - RNA, 22 nt, Human
ggagagagaccuccaugcccag

SEQ ID NO: 526330 - RNA, 23 nt, Human
ugacacccucauugugugucgca

SEQ ID NO: 526331 - RNA, 22 nt, Human
uucuccccgucucucugaggcc

SEQ ID NO: 526332 - RNA, 22 nt, Human
agggagcauugugacauaucac

SEQ ID NO: 526333 - RNA, 22 nt, Human
gcggagaggcagagacuccgcg

SEQ ID NO: 526334 - RNA, 22 nt, Human
cugcuguguggauucaauggcu

SEQ ID NO: 526335 - RNA, 22 nt, Human
cuuccucuguggccagagugua

SEQ ID NO: 526336 - RNA, 22 nt, Human
caugugaccgcugggugagcga

SEQ ID NO: 526337 - RNA, 22 nt, Human
ugugguuuugguucagaaacaa

SEQ ID NO: 526338 - RNA, 22 nt, Human
auagcaaaggacaauagucagu

SEQ ID NO: 526339 - RNA, 22 nt, Human
guucuucagauuccauuucagu

SEQ ID NO: 526340 - RNA, 22 nt, Human
gagcagcaucuccggcuuaaag

SEQ ID NO: 526341 - RNA, 22 nt, Human
gagugccuuccccaugcuuugg

SEQ ID NO: 526342 - RNA, 23 nt, Human
cuguggaucuagagggggcccua

SEQ ID NO: 526343 - RNA, 22 nt, Human
aauccagguggcggagguugug

SEQ ID NO: 526344 - RNA, 22 nt, Human
uaucaguagaacaauggacauu

SEQ ID NO: 526345 - RNA, 22 nt, Human
accaugucauuuauuggccaaa

SEQ ID NO: 526346 - RNA, 22 nt, Human
uucccuuucuuaaagaguuagg

SEQ ID NO: 526347 - RNA, 22 nt, Human
gcccucugguggccgccucggc

SEQ ID NO: 526348 - RNA, 22 nt, Human
ugagccuggagucguggagggg

SEQ ID NO: 526349 - RNA, 22 nt, Human
guguuuaaugcagaugugggug

SEQ ID NO: 526350 - RNA, 22 nt, Human
uuuuuggguccaggcuguaucu

SEQ ID NO: 526351 - RNA, 22 nt, Human
caggagcucaagaccacccugg

SEQ ID NO: 526352 - RNA, 22 nt, Human
uguccuguccuuccuggaaguc

SEQ ID NO: 526353 - RNA, 22 nt, Human
cucaguggggcgacagggugcu

SEQ ID NO: 526354 - RNA, 22 nt, Human
agcacugugagcaccagcacgc

SEQ ID NO: 526355 - RNA, 22 nt, Human
auucagaaauagaaaauuugau

SEQ ID NO: 526356 - RNA, 22 nt, Human
guccuggugcuggucauugucg

SEQ ID NO: 526357 - RNA, 22 nt, Human
uuucuucucacccaggacagag

SEQ ID NO: 526358 - RNA, 22 nt, Human
aggcucugucaggcggagcagc

SEQ ID NO: 526359 - RNA, 22 nt, Human
cagagguagccgagugcaaucg

SEQ ID NO: 526360 - RNA, 19 nt, Human
ugguggaggugcaccugac

SEQ ID NO: 526361 - RNA, 22 nt, Human
augcggagccccaagcuugaag

SEQ ID NO: 526362 - RNA, 22 nt, Human
auguaacauaugugaucgcauu

SEQ ID NO: 526363 - RNA, 22 nt, Human
acuggcaguagagggagcgcau

SEQ ID NO: 526364 - RNA, 22 nt, Human
guuuccaagucucucaacaccc

SEQ ID NO: 526365 - RNA, 22 nt, Human
uuuguagauuuucucuccagua

SEQ ID NO: 526366 - RNA, 18 nt, Human
gggguagaguguccuauu

SEQ ID NO: 526367 - RNA, 22 nt, Human
ggcuggcuggcuuagcagagga

SEQ ID NO: 526368 - RNA, 22 nt, Human
acaagauagcuuagaagauuca

SEQ ID NO: 526369 - RNA, 22 nt, Human
ccaggaaguaugacccaacaga

SEQ ID NO: 526370 - RNA, 22 nt, Human
uguccugugcacuguagcaugu

SEQ ID NO: 526371 - RNA, 22 nt, Human
caggacccaaccucccugcucu

SEQ ID NO: 526372 - RNA, 21 nt, Human
cuguccccagugagcaccccc

SEQ ID NO: 526373 - RNA, 22 nt, Human
guggcagcggcccaggccgucu

SEQ ID NO: 526374 - RNA, 22 nt, Human
uuuugguaauuaaguagauauu

SEQ ID NO: 526375 - RNA, 22 nt, Human
gccucugcaccaguacugugcc

SEQ ID NO: 526376 - RNA, 22 nt, Human
ucucauaauuguuucccagcua

SEQ ID NO: 526377 - RNA, 22 nt, Human
cccagagcaugugcugccuuug

SEQ ID NO: 526378 - RNA, 22 nt, Human
ggcacugggugagggucacugg

SEQ ID NO: 526379 - RNA, 22 nt, Human
guugggcugaagugugugcuua

SEQ ID NO: 526380 - RNA, 22 nt, Human
aauucaaggaucuguuaaaucu

SEQ ID NO: 526381 - RNA, 22 nt, Human
gcugggcaggccucgugagggc

SEQ ID NO: 526382 - RNA, 21 nt, Human
ccuguggugccagaucgccag

SEQ ID NO: 526383 - RNA, 22 nt, Human
ggcuucuuagaauuugacuuac

SEQ ID NO: 526384 - RNA, 22 nt, Human
cagcagcaacaacggaagccuu

SEQ ID NO: 526385 - RNA, 22 nt, Human
guucuucagcccucagguccua

SEQ ID NO: 526386 - RNA, 22 nt, Human
guggauggagcuggaagccauu

SEQ ID NO: 526387 - RNA, 22 nt, Human
ugcuccaucuagagcucugcag

SEQ ID NO: 526388 - RNA, 22 nt, Human
gcggggccauguccaacggccu

SEQ ID NO: 526389 - RNA, 22 nt, Human
uguuccucugaacuucuuccaa

SEQ ID NO: 526390 - RNA, 22 nt, Human
guggaaauuuuaggaucaucuu

SEQ ID NO: 526391 - RNA, 22 nt, Human
auggaggaugugcagcaugggc

SEQ ID NO: 526392 - RNA, 22 nt, Human
gccaggguggcagaaggcccca

SEQ ID NO: 526393 - RNA, 22 nt, Human
ucacaguucaacuaguucagau

SEQ ID NO: 526394 - RNA, 22 nt, Human
ugaggccugaagccuggagccu

SEQ ID NO: 526395 - RNA, 22 nt, Human
uagcccauggacuggucagcug

SEQ ID NO: 526396 - RNA, 22 nt, Human
aguggguguagucuuccuccug

SEQ ID NO: 526397 - RNA, 22 nt, Human
acccaggucucucgacuucugg

SEQ ID NO: 526398 - RNA, 22 nt, Human
cucacucaguuuuuaguucauc

SEQ ID NO: 526399 - RNA, 22 nt, Human
guccaggccugccucugaggag

SEQ ID NO: 526400 - RNA, 22 nt, Human
ucaaagcacuggggaaagccug

SEQ ID NO: 526401 - RNA, 22 nt, Human
gucucuaucauagcugaacccu

SEQ ID NO: 526402 - RNA, 22 nt, Human
cugucuggaaugcaguacauag

SEQ ID NO: 526403 - RNA, 22 nt, Human
acagcuggaggucugugagcac

SEQ ID NO: 526404 - RNA, 22 nt, Human
cucagcugucucaugggucugu

SEQ ID NO: 526405 - RNA, 22 nt, Human
cucagucucuugggcugugaag

SEQ ID NO: 526406 - RNA, 22 nt, Human
uaacuugagcucucagugcuau

SEQ ID NO: 526407 - RNA, 22 nt, Human
ccaagcuggacagcagcaagga

SEQ ID NO: 526408 - RNA, 22 nt, Human
gcuagcaaaugucauuuggaag

SEQ ID NO: 526409 - RNA, 22 nt, Human
uccggcggccggccugagcccg

SEQ ID NO: 526410 - RNA, 23 nt, Human
aggcagguuugggcucuucuugu

SEQ ID NO: 526411 - RNA, 22 nt, Human
aaguuauugguggagagcacug

SEQ ID NO: 526412 - RNA, 22 nt, Human
cggagaggugggggcagcaucu

SEQ ID NO: 526413 - RNA, 22 nt, Human
ccucucauagucuguauccuuu

SEQ ID NO: 526414 - RNA, 22 nt, Human
guuuccuuuuggaauuagagcu

SEQ ID NO: 526415 - RNA, 19 nt, Human
uccugcccaccagccaggg

SEQ ID NO: 526416 - RNA, 22 nt, Human
gccacguagaagugccgcgaga

SEQ ID NO: 526417 - RNA, 22 nt, Human
cugacucccaaagaggacgcgu

SEQ ID NO: 526418 - RNA, 22 nt, Human
cugagcaugcuacaugcagcac

SEQ ID NO: 526419 - RNA, 22 nt, Human
cuugggcuuagaagguaaguga

SEQ ID NO: 526420 - RNA, 22 nt, Human
cucccucaggccuuagcccugc

SEQ ID NO: 526421 - RNA, 22 nt, Human
gccuggaaugcaaugugacgaa

SEQ ID NO: 526422 - RNA, 22 nt, Human
cuggcagcucugagucccuucu

SEQ ID NO: 526423 - RNA, 19 nt, Human
acccagcccaggaguggca

SEQ ID NO: 526424 - RNA, 22 nt, Human
uagcaccggcagugguaggugc

SEQ ID NO: 526425 - RNA, 22 nt, Human
uugcucuauguuuguaaacaga

SEQ ID NO: 526426 - RNA, 22 nt, Human
caggguggcaggcaccauggcc

SEQ ID NO: 526427 - RNA, 22 nt, Human
uggcccugccgccacgacgucu

SEQ ID NO: 526428 - RNA, 19 nt, Human
aggaaggcggcggcugccc

SEQ ID NO: 526429 - RNA, 20 nt, Human
uuugauugccccucugacuu

SEQ ID NO: 526430 - RNA, 22 nt, Human
ucccacacagcccgcucaccgg

SEQ ID NO: 526431 - RNA, 22 nt, Human
ccugugcuucacucaacaagcc

SEQ ID NO: 526432 - RNA, 22 nt, Human
cuggcuccucaggacugcggga

SEQ ID NO: 526433 - RNA, 22 nt, Human
gccuggcucugaguuucucucc

SEQ ID NO: 526434 - RNA, 22 nt, Human
agccccaguucccuggaagucu

SEQ ID NO: 526435 - RNA, 22 nt, Human
gaggcauaaguagaagagauug

SEQ ID NO: 526436 - RNA, 22 nt, Human
augaggagucaaggagucggag

SEQ ID NO: 526437 - RNA, 22 nt, Human
ggcugcccucggggucgcaggc

SEQ ID NO: 526438 - RNA, 20 nt, Human
ucuggggaugaggucuagga

SEQ ID NO: 526439 - RNA, 22 nt, Human
agaaagcacccugcacuuucug

SEQ ID NO: 526440 - RNA, 22 nt, Human
gucugcacgugccagggagggg

SEQ ID NO: 526441 - RNA, 22 nt, Human
cuugggcaggggaaacagcugc

SEQ ID NO: 526442 - RNA, 22 nt, Human
ccaagaggggaagggccgcagc

SEQ ID NO: 526443 - RNA, 22 nt, Human
gagcucagccugaggccuggcu

SEQ ID NO: 526444 - RNA, 22 nt, Human
uggcagcagggccccuggagga

SEQ ID NO: 526445 - RNA, 21 nt, Human
uccugccuuaguccagagcag

SEQ ID NO: 526446 - RNA, 22 nt, Human
ugcuggcugggcugcuggagac

SEQ ID NO: 526447 - RNA, 22 nt, Human
cagagccacugucugccaggca

SEQ ID NO: 526448 - RNA, 22 nt, Human
cagggcucgcucgcucgcucgc

SEQ ID NO: 526449 - RNA, 22 nt, Human
ucgggguagacgccagcucgga

SEQ ID NO: 526450 - RNA, 22 nt, Human
gucaucaucaggcagaugcugc

SEQ ID NO: 526451 - RNA, 22 nt, Human
uggaggcagccgugaaccaccu

SEQ ID NO: 526452 - RNA, 22 nt, Human
aggccgugugagcaugugugag

SEQ ID NO: 526453 - RNA, 22 nt, Human
cugacagcgagagaguugcccc

SEQ ID NO: 526454 - RNA, 22 nt, Human
aggucccugcagcagacugcca

SEQ ID NO: 526455 - RNA, 22 nt, Human
uaaugccuuaugucaaauguaa

SEQ ID NO: 526456 - RNA, 22 nt, Human
ugguaaaugucuaacaaucacu

SEQ ID NO: 526457 - RNA, 22 nt, Human
gcccuguguguuugcacugauu

SEQ ID NO: 526458 - RNA, 22 nt, Human
agggggcuccuuggugugcaga

SEQ ID NO: 526459 - RNA, 22 nt, Human
aucccuggccacgaagcugccc

SEQ ID NO: 526460 - RNA, 22 nt, Human
uuuuguguugccauguuaagca

SEQ ID NO: 526461 - RNA, 22 nt, Human
aggcuuuaauuaucuacaggag

SEQ ID NO: 526462 - RNA, 22 nt, Human
ugcuggccucggcgcugggccu

SEQ ID NO: 526463 - RNA, 22 nt, Human
ccaggccuguguuguguggagg

SEQ ID NO: 526464 - RNA, 22 nt, Human
ccaaaauauuagugcuuaagua

SEQ ID NO: 526465 - RNA, 22 nt, Human
uugcugccagcgcccugcaggg

SEQ ID NO: 526466 - RNA, 22 nt, Human
ugugaagaucaggguccuagag

SEQ ID NO: 526467 - RNA, 22 nt, Human
ucucuccuccacaccgggugcu

SEQ ID NO: 526468 - RNA, 22 nt, Human
uccuggcccuguggccugcagu

SEQ ID NO: 526469 - RNA, 22 nt, Human
cucuggcaauugcugcugacuc

SEQ ID NO: 526470 - RNA, 22 nt, Human
gcugcugcuugaaggcucggag

SEQ ID NO: 526471 - RNA, 22 nt, Human
uaucaguccaggguuuugugac

SEQ ID NO: 526472 - RNA, 22 nt, Human
uccagcaguccaugugagacac

SEQ ID NO: 526473 - RNA, 22 nt, Human
cacaucucagggcuacaggcag

SEQ ID NO: 526474 - RNA, 22 nt, Human
gaaggagaggauugugaggcug

SEQ ID NO: 526475 - RNA, 22 nt, Human
ccacugcuaacuugcugcagcu

SEQ ID NO: 526476 - RNA, 22 nt, Human
gcuggccugcgagggcaggcug

SEQ ID NO: 526477 - RNA, 22 nt, Human
ggaauccugguguuuucugccu

SEQ ID NO: 526478 - RNA, 22 nt, Human
cagcugcucugguggucucucc

SEQ ID NO: 526479 - RNA, 22 nt, Human
ggcaguggcuccucucuacucc

SEQ ID NO: 526480 - RNA, 22 nt, Human
ucccacugcuuugcucugcuca

SEQ ID NO: 526481 - RNA, 22 nt, Human
ugcugaggagguggcugugcuu

SEQ ID NO: 526482 - RNA, 22 nt, Human
gagggugguggcuuaaggugcu

SEQ ID NO: 526483 - RNA, 22 nt, Human
aggcggcuccgggagugugggc

SEQ ID NO: 526484 - RNA, 22 nt, Human
gccuguuucuccuccuuggccc

SEQ ID NO: 526485 - RNA, 22 nt, Human
gggaugagagcugggacagaag

SEQ ID NO: 526486 - RNA, 22 nt, Human
ucagacaccgucuauuuugccu

SEQ ID NO: 526487 - RNA, 22 nt, Human
auguauacgugcaggucacagg

SEQ ID NO: 526488 - RNA, 22 nt, Human
uggugcagacaggagccccgcu

SEQ ID NO: 526489 - RNA, 22 nt, Human
ccagagcugcagguaaaaugcu

SEQ ID NO: 526490 - RNA, 22 nt, Human
aaggaggaauguagccagcucc

SEQ ID NO: 526491 - RNA, 22 nt, Human
cauggcaggugcagauucugug

SEQ ID NO: 526492 - RNA, 22 nt, Human
uagcagcacuauuuguuguagu

SEQ ID NO: 526493 - RNA, 22 nt, Human
ggaaugugcugacacgcgagag

SEQ ID NO: 526494 - RNA, 22 nt, Human
ccagcagcgauagggugagugc

SEQ ID NO: 526495 - RNA, 22 nt, Human
cccagccugaucucggccagcu

SEQ ID NO: 526496 - RNA, 22 nt, Human
uggggugugcucagagcagggg

SEQ ID NO: 526497 - RNA, 22 nt, Human
ccuguacuuguauuaaaggucc

SEQ ID NO: 526498 - RNA, 20 nt, Human
ucucccugcccaucucagau

SEQ ID NO: 526499 - RNA, 22 nt, Human
ugcccagucuccgggccagccc

SEQ ID NO: 526500 - RNA, 19 nt, Human
uuuaaugugugcugcaauc

SEQ ID NO: 526501 - RNA, 22 nt, Human
cucuggagcgcugcuucccgcg

SEQ ID NO: 526502 - RNA, 22 nt, Human
aucuucaaggaaaaaauacagu

SEQ ID NO: 526503 - RNA, 22 nt, Human
ucggugcgcgaggcgcgguccc

SEQ ID NO: 526504 - RNA, 21 nt, Human
gcucuguguuacaaguugggg

SEQ ID NO: 526505 - RNA, 22 nt, Human
acugagaacuuggggacagagg

SEQ ID NO: 526506 - RNA, 22 nt, Human
uggcuccguuguacaggcugga

SEQ ID NO: 526507 - RNA, 22 nt, Human
ucccaguggcuucauaaggcag

SEQ ID NO: 526508 - RNA, 22 nt, Human
uggucccugaagagagaccuug

SEQ ID NO: 526509 - RNA, 22 nt, Human
caggaacagcaccaggagcuag

SEQ ID NO: 526510 - RNA, 22 nt, Human
ucccggcgcugggagguggguc

SEQ ID NO: 526511 - RNA, 15 nt, Human
uggugguguugagac

SEQ ID NO: 526512 - RNA, 22 nt, Human
auguccaggaagucuuaacuca

SEQ ID NO: 526513 - RNA, 22 nt, Human
uaaaaucaugacagauugacau

SEQ ID NO: 526514 - RNA, 22 nt, Human
cuggcuccauccuugagcucug

SEQ ID NO: 526515 - RNA, 22 nt, Human
uccuccuuuccccgcuggagcc

SEQ ID NO: 526516 - RNA, 22 nt, Human
agacagcacuuuuguauggggg

SEQ ID NO: 526517 - RNA, 22 nt, Human
cuucauguacaguuauuggaga

SEQ ID NO: 526518 - RNA, 22 nt, Human
ggcaagagggcagauggagugc

SEQ ID NO: 526519 - RNA, 22 nt, Human
caggcgggcaggugcggccccu

SEQ ID NO: 526520 - RNA, 22 nt, Human
auguuugaaauuguaaguauau

SEQ ID NO: 526521 - RNA, 22 nt, Human
ugugugcucgauggcccugcag

SEQ ID NO: 526522 - RNA, 22 nt, Human
cagcuccccucuguggggcagu

SEQ ID NO: 526523 - RNA, 22 nt, Human
ccucccugccggcuggacuagu

SEQ ID NO: 526524 - RNA, 22 nt, Human
ugacaagagaccccuccgcagg

SEQ ID NO: 526525 - RNA, 22 nt, Human
uaaguauuggccuauagcuaga

SEQ ID NO: 526526 - RNA, 22 nt, Human
acuagaaacuaauggauuauua

SEQ ID NO: 526527 - RNA, 20 nt, Human
aucagguguucagccacugc

SEQ ID NO: 526528 - RNA, 22 nt, Human
gccccuucguggaagugcauuc

SEQ ID NO: 526529 - RNA, 22 nt, Human
aguucacagcaaaguggggacc

SEQ ID NO: 526530 - RNA, 22 nt, Human
gaggagagaagcuaacggugcu

SEQ ID NO: 526531 - RNA, 22 nt, Human
auguaagagcuuugcagggaaa

SEQ ID NO: 526532 - RNA, 21 nt, Human
gccaucaccaagcucuucccc

SEQ ID NO: 526533 - RNA, 22 nt, Human
gagcagcagcugggccagguuc

SEQ ID NO: 526534 - RNA, 22 nt, Human
gucccucugccugugguucucu

SEQ ID NO: 526535 - RNA, 22 nt, Human
uuauugagcacauaguaugugg

SEQ ID NO: 526536 - RNA, 21 nt, Human
agcauucaaaagaugccauaa

SEQ ID NO: 526537 - RNA, 22 nt, Human
acggagcccgugucagguggga

SEQ ID NO: 526538 - RNA, 22 nt, Human
gggcuggagagucccacguggg

SEQ ID NO: 526539 - RNA, 22 nt, Human
ggaccugcucucccaguucucu

SEQ ID NO: 526540 - RNA, 22 nt, Human
agggcacucugcagggaccacc

SEQ ID NO: 526541 - RNA, 22 nt, Human
ucuguggcuuucguguaagaug

SEQ ID NO: 526542 - RNA, 22 nt, Human
ggggaccuuuccauuucugaga

SEQ ID NO: 526543 - RNA, 20 nt, Human
gccaagaauaugcccgacuc

SEQ ID NO: 526544 - RNA, 22 nt, Human
ucccacugucuucucgugcucg

SEQ ID NO: 526545 - RNA, 22 nt, Human
ggggagaguauuuuauucaagu

SEQ ID NO: 526546 - RNA, 22 nt, Human
ggcuagggagacagagggcaug

SEQ ID NO: 526547 - RNA, 22 nt, Human
cagggccugccugguuccugga

SEQ ID NO: 526548 - RNA, 22 nt, Human
accugguaaccugccugacuaa

SEQ ID NO: 526549 - RNA, 22 nt, Human
gucccugauaagagccaucgau

SEQ ID NO: 526550 - RNA, 22 nt, Human
gggucagggaggccccaccaug

SEQ ID NO: 526551 - RNA, 22 nt, Human
cugggcccaggcggcucucgga

SEQ ID NO: 526552 - RNA, 21 nt, Human
uaaagcucguucaggaaaguc

SEQ ID NO: 526553 - RNA, 22 nt, Human
uggcaauguggaaugguccagg

SEQ ID NO: 526554 - RNA, 22 nt, Human
acagaauugggguucuugggga

SEQ ID NO: 526555 - RNA, 22 nt, Human
gucagaggggcagcugccaggc

SEQ ID NO: 526556 - RNA, 22 nt, Human
agcugcaccggcuggaccacug

SEQ ID NO: 526557 - RNA, 22 nt, Human
auauuuguuuggcagaguucag

SEQ ID NO: 526558 - RNA, 22 nt, Human
ucaguccuuaucugguguucag

SEQ ID NO: 526559 - RNA, 22 nt, Human
guggcagagagcaagugucuga

SEQ ID NO: 526560 - RNA, 22 nt, Human
acaaaggugagcagaagacaca

SEQ ID NO: 526561 - RNA, 22 nt, Human
guuauguaaucuaacacucagu

SEQ ID NO: 526562 - RNA, 22 nt, Human
aaaagagccacuuaugaccuca

SEQ ID NO: 526563 - RNA, 18 nt, Human
ggccucagccuggccgga

SEQ ID NO: 526564 - RNA, 22 nt, Human
uugaggucuucaggaucaggcu

SEQ ID NO: 526565 - RNA, 22 nt, Human
augaacugcaguauaaacuugg

SEQ ID NO: 526566 - RNA, 22 nt, Human
caggcucgguccaguggcaccc

SEQ ID NO: 526567 - RNA, 21 nt, Human
ugcuccaggagggggcagucc

SEQ ID NO: 526568 - RNA, 23 nt, Human
ggaagcucacguaguccugcacu

SEQ ID NO: 526569 - RNA, 22 nt, Human
cugguuuuccaauguuuugacu

SEQ ID NO: 526570 - RNA, 22 nt, Human
agcucugcuucuugggaagaug

SEQ ID NO: 526571 - RNA, 22 nt, Human
gcagggcugauggcuucccuca

SEQ ID NO: 526572 - RNA, 22 nt, Human
guguggcuaggauggcuuugcu

SEQ ID NO: 526573 - RNA, 22 nt, Human
gaccacugaaugcacuucuaau

SEQ ID NO: 526574 - RNA, 22 nt, Human
ucucagaguuccucuggagucc

SEQ ID NO: 526575 - RNA, 22 nt, Human
guccuggugccaccugcgggau

SEQ ID NO: 526576 - RNA, 22 nt, Human
uuaagguucagaaaucaauacc

SEQ ID NO: 526577 - RNA, 18 nt, Human
gaggcacauaguuggggc

SEQ ID NO: 526578 - RNA, 22 nt, Human
ugaaggccuccccgagcauuag

SEQ ID NO: 526579 - RNA, 22 nt, Human
ggcuagggaucuagaccaggac

SEQ ID NO: 526580 - RNA, 22 nt, Human
caauaguaaauuacggaggaga

SEQ ID NO: 526581 - RNA, 22 nt, Human
gcugccuggaauaacggcuggc

SEQ ID NO: 526582 - RNA, 22 nt, Human
uucucuaguuuugacgaggauu

SEQ ID NO: 526583 - RNA, 22 nt, Human
aucuaaagugucauaaguagcu

SEQ ID NO: 526584 - RNA, 22 nt, Human
gacaagaugacaucauggcuuc

SEQ ID NO: 526585 - RNA, 22 nt, Human
ugccagcaguagcaguaggcca

SEQ ID NO: 526586 - RNA, 22 nt, Human
ugacagugugcccggagguuag

SEQ ID NO: 526587 - RNA, 22 nt, Human
ugcuucucucuaggaagacgcu

SEQ ID NO: 526588 - RNA, 22 nt, Human
caaacugaacacgaaagucuuu

SEQ ID NO: 526589 - RNA, 22 nt, Human
ugaggccaagccuccucugcca

SEQ ID NO: 526590 - RNA, 22 nt, Human
augaugaagcaugguuacacug

SEQ ID NO: 526591 - RNA, 22 nt, Human
gccuuugcugugacaaugcugg

SEQ ID NO: 526592 - RNA, 22 nt, Human
uccagcugugcuccaggaggug

SEQ ID NO: 526593 - RNA, 22 nt, Human
uuugacucugggugcuuuuucg

SEQ ID NO: 526594 - RNA, 22 nt, Human
ggucuccugaccuuuagucccu

SEQ ID NO: 526595 - RNA, 22 nt, Human
aaagcagaacugagagagcugg

SEQ ID NO: 526596 - RNA, 20 nt, Human
uggcccagcacgacgaggac

SEQ ID NO: 526597 - RNA, 22 nt, Human
cggcagagcccugagucagccu

SEQ ID NO: 526598 - RNA, 22 nt, Human
aucagugacuucuuccaaaguu

SEQ ID NO: 526599 - RNA, 22 nt, Human
cagagcugucauuugccaguga

SEQ ID NO: 526600 - RNA, 21 nt, Human
ucugugcuuuuuuggcuccua

SEQ ID NO: 526601 - RNA, 22 nt, Human
gcccagcccagaaagguucgga

SEQ ID NO: 526602 - RNA, 22 nt, Human
aguggcugugaaauacauggga

SEQ ID NO: 526603 - RNA, 22 nt, Human
ugacaggcuugcuaagacauag

SEQ ID NO: 526604 - RNA, 22 nt, Human
gcggcuccgaagccaggccgcg

SEQ ID NO: 526605 - RNA, 22 nt, Human
ucacauguguggcagugcaagu

SEQ ID NO: 526606 - RNA, 22 nt, Human
ucaccucucuggccgucuaccu

SEQ ID NO: 526607 - RNA, 22 nt, Human
gccucugcacuguggcacacca

SEQ ID NO: 526608 - RNA, 19 nt, Human
ggggcccggggucugcgag

SEQ ID NO: 526609 - RNA, 22 nt, Human
ccaggacaagccagagggacag

SEQ ID NO: 526610 - RNA, 22 nt, Human
cacaauuuccauugagcagcag

SEQ ID NO: 526611 - RNA, 22 nt, Human
aaagcugggcuggccaacccag

SEQ ID NO: 526612 - RNA, 23 nt, Human
guccuagugcuuggugcccaggc

SEQ ID NO: 526613 - RNA, 22 nt, Human
cagcuccaucuugcuuauacca

SEQ ID NO: 526614 - RNA, 22 nt, Human
gaccaaggaagaggggagccag

SEQ ID NO: 526615 - RNA, 22 nt, Human
aagcagcauaugacagcaucca

SEQ ID NO: 526616 - RNA, 22 nt, Human
gaauuguacugcaaucagggga

SEQ ID NO: 526617 - RNA, 21 nt, Human
uuccuccucuggagaagaaga

SEQ ID NO: 526618 - RNA, 22 nt, Human
caggcuguguuccuggaacccc

SEQ ID NO: 526619 - RNA, 22 nt, Human
cugggaguugacgaggcuugua

SEQ ID NO: 526620 - RNA, 22 nt, Human
guguguggaaugcucauuuauu

SEQ ID NO: 526621 - RNA, 22 nt, Human
cucaggucuuaguucugucauc

SEQ ID NO: 526622 - RNA, 22 nt, Human
ggcaccuuucaucccaucuaga

SEQ ID NO: 526623 - RNA, 22 nt, Human
gcugcuuugucuguaaaaugga

SEQ ID NO: 526624 - RNA, 22 nt, Human
gcuguggcuccaauggugagcc

SEQ ID NO: 526625 - RNA, 22 nt, Human
cugagcaggacagugggagacc

SEQ ID NO: 526626 - RNA, 22 nt, Human
aggccugggacgggagccguga

SEQ ID NO: 526627 - RNA, 22 nt, Human
guaugucuuaggguucaguaac

SEQ ID NO: 526628 - RNA, 19 nt, Human
cacuaagaagcaggggagc

SEQ ID NO: 526629 - RNA, 22 nt, Human
agucuggagugauuauguggga

SEQ ID NO: 526630 - RNA, 22 nt, Human
ggcugagucugugacccaugcg

SEQ ID NO: 526631 - RNA, 18 nt, Human
acagggagggcgcugggg

SEQ ID NO: 526632 - RNA, 22 nt, Human
gugauuuucuccuccuagaagu

SEQ ID NO: 526633 - RNA, 22 nt, Human
gugcaggugguuggcccagccg

SEQ ID NO: 526634 - RNA, 22 nt, Human
uugcacagaugcacaugguugc

SEQ ID NO: 526635 - RNA, 22 nt, Human
cacaucauguuaauucauuaca

SEQ ID NO: 526636 - RNA, 22 nt, Human
guggcaggagggcaucacuugg

SEQ ID NO: 526637 - RNA, 22 nt, Human
ccagccagcugcccuuggggcc

SEQ ID NO: 526638 - RNA, 22 nt, Human
ucuggggucaccuggggugcuu

SEQ ID NO: 526639 - RNA, 22 nt, Human
gucugcccugcagacaugccuc

SEQ ID NO: 526640 - RNA, 22 nt, Human
uucuccagcucaucagggaggg

SEQ ID NO: 526641 - RNA, 22 nt, Human
cagugccagcugcuuggccuac

SEQ ID NO: 526642 - RNA, 22 nt, Human
ucuggcccaucuucugccacca

SEQ ID NO: 526643 - RNA, 22 nt, Human
ccugggacgacucuguacccuu

SEQ ID NO: 526644 - RNA, 22 nt, Human
uggaaacacccacgcaugcaua

SEQ ID NO: 526645 - RNA, 22 nt, Human
gagcacucuggcauguaaccuu

SEQ ID NO: 526646 - RNA, 16 nt, Human
ucucccuugucaccug

SEQ ID NO: 526647 - RNA, 22 nt, Human
ggagacucaccccgcauucuag

SEQ ID NO: 526648 - RNA, 22 nt, Human
ggcuggccuguguggccgccac

SEQ ID NO: 526649 - RNA, 22 nt, Human
gggcagagguucaacuucaaca

SEQ ID NO: 526650 - RNA, 22 nt, Human
cuguguacccacgugggcaccc

SEQ ID NO: 526651 - RNA, 22 nt, Human
ucgucugugaaauugggauaag

SEQ ID NO: 526652 - RNA, 22 nt, Human
gccugaucagguccucggcaua

SEQ ID NO: 526653 - RNA, 22 nt, Human
gacaguggagccacguugggag

SEQ ID NO: 526654 - RNA, 22 nt, Human
cccacugcaugaguugguauua

SEQ ID NO: 526655 - RNA, 17 nt, Human
gcuccagaauucuaguc

SEQ ID NO: 526656 - RNA, 23 nt, Human
ggucccaguggagaggccucacc

SEQ ID NO: 526657 - RNA, 22 nt, Human
gccagcuggcugcaggucccag

SEQ ID NO: 526658 - RNA, 22 nt, Human
ggcagagcuugcagugagccga

SEQ ID NO: 526659 - RNA, 22 nt, Human
agccagcuaccggggcuccugg

SEQ ID NO: 526660 - RNA, 22 nt, Human
uccuggcucaggccccuggugc

SEQ ID NO: 526661 - RNA, 22 nt, Human
cgccguccccuaggaaagagcu

SEQ ID NO: 526662 - RNA, 22 nt, Human
gccagcuagaggcugcagugca

SEQ ID NO: 526663 - RNA, 22 nt, Human
gggaccuggacaugugugugcu

SEQ ID NO: 526664 - RNA, 22 nt, Human
gcugugcagaggugagaaucca

SEQ ID NO: 526665 - RNA, 22 nt, Human
ggggcccagcaccccuccucgc

SEQ ID NO: 526666 - RNA, 22 nt, Human
uggcauuuuguagcuguguauc

SEQ ID NO: 526667 - RNA, 22 nt, Human
aagucaauuaguaaacuuggaa

SEQ ID NO: 526668 - RNA, 22 nt, Human
cagcccacugccucugugguag

SEQ ID NO: 526669 - RNA, 20 nt, Human
uugcaaagugaauagcaauu

SEQ ID NO: 526670 - RNA, 22 nt, Human
gaggcuguaacuugggcacugg

SEQ ID NO: 526671 - RNA, 22 nt, Human
ugggguccucucacuuggaggg

SEQ ID NO: 526672 - RNA, 22 nt, Human
ugcaagagcccaaacuauauac

SEQ ID NO: 526673 - RNA, 22 nt, Human
uuugacuccuguguuucuggaa

SEQ ID NO: 526674 - RNA, 22 nt, Human
aggugacaucccggcagcagag

SEQ ID NO: 526675 - RNA, 22 nt, Human
ggucuggccuccgggcaggugg

SEQ ID NO: 526676 - RNA, 22 nt, Human
ugugaacuggcagguggacggg

SEQ ID NO: 526677 - RNA, 22 nt, Human
cggucaggugcagcguuggcac

SEQ ID NO: 526678 - RNA, 22 nt, Human
caugaccagagaggacggccag

SEQ ID NO: 526679 - RNA, 22 nt, Human
uggccagaacucagacaugugg

SEQ ID NO: 526680 - RNA, 22 nt, Human
gacggagcugguugcugcggcu

SEQ ID NO: 526681 - RNA, 22 nt, Human
uauggcaagaugacauguucuc

SEQ ID NO: 526682 - RNA, 22 nt, Human
cacauuggcaaacgggguugca

SEQ ID NO: 526683 - RNA, 21 nt, Human
gucuuggcaccaggagagaga

SEQ ID NO: 526684 - RNA, 22 nt, Human
uuccagagaguuauuccccugg

SEQ ID NO: 526685 - RNA, 22 nt, Human
gcugcuggcuuccugcuguuuu

SEQ ID NO: 526686 - RNA, 21 nt, Human
accgucaguacuaguauugac

SEQ ID NO: 526687 - RNA, 22 nt, Human
gcagagauccaggguauagguu

SEQ ID NO: 526688 - RNA, 22 nt, Human
gccaugaacucgggcauggaga

SEQ ID NO: 526689 - RNA, 22 nt, Human
ccugggacuuggucugggguuu

SEQ ID NO: 526690 - RNA, 21 nt, Human
aggcagcgauuuucauauugc

SEQ ID NO: 526691 - RNA, 22 nt, Human
ucugcucagccgaucugcuccg

SEQ ID NO: 526692 - RNA, 22 nt, Human
gacagucccccagcagcaaacc

SEQ ID NO: 526693 - RNA, 22 nt, Human
ugugcuugucguggagccaggc

SEQ ID NO: 526694 - RNA, 22 nt, Human
ggagcugcucagagccaguccc

SEQ ID NO: 526695 - RNA, 22 nt, Human
cagcccuugcgacacccuggcu

SEQ ID NO: 526696 - RNA, 22 nt, Human
aggugcaucucguagcucuucu

SEQ ID NO: 526697 - RNA, 22 nt, Human
uucuacauugugaaguucuuua

SEQ ID NO: 526698 - RNA, 22 nt, Human
gaauguuauugaacuacgagcu

SEQ ID NO: 526699 - RNA, 22 nt, Human
aacacauggcaagagcaggaaa

SEQ ID NO: 526700 - RNA, 22 nt, Human
gucauggaggauugugaguggu

SEQ ID NO: 526701 - RNA, 18 nt, Human
uggggggcuugucugaag

SEQ ID NO: 526702 - RNA, 22 nt, Human
uccaggagcucauccacgucaa

SEQ ID NO: 526703 - RNA, 20 nt, Human
ugggguccuggaggggaucc

SEQ ID NO: 526704 - RNA, 22 nt, Human
auguacaaucuaucacaagaag

SEQ ID NO: 526705 - RNA, 22 nt, Human
ucagcacaggucuugcaaaaca

SEQ ID NO: 526706 - RNA, 22 nt, Human
caaggcuaagcuuuggcuuucu

SEQ ID NO: 526707 - RNA, 22 nt, Human
aagcacagggacucaggaccgg

SEQ ID NO: 526708 - RNA, 22 nt, Human
acacugagcuuccaagaugggg

SEQ ID NO: 526709 - RNA, 22 nt, Human
gcagcucucuggccugcccugg

SEQ ID NO: 526710 - RNA, 22 nt, Human
agacugugagaagauggcugcg

SEQ ID NO: 526711 - RNA, 22 nt, Human
guuuauuggguauuguggagcc

SEQ ID NO: 526712 - RNA, 22 nt, Human
gagaugugucagguccuggggg

SEQ ID NO: 526713 - RNA, 22 nt, Human
uaaguauguuagaaaaucaagu

SEQ ID NO: 526714 - RNA, 22 nt, Human
uggcuggcuguccagcugggca

SEQ ID NO: 526715 - RNA, 22 nt, Human
ucaucaucauucucccccacuu

SEQ ID NO: 526716 - RNA, 22 nt, Human
ugcauguuucuguauguuaaug

SEQ ID NO: 526717 - RNA, 21 nt, Human
ucccucagaagcucuugguca

SEQ ID NO: 526718 - RNA, 22 nt, Human
agcaaggcagcuuucacugcuu

SEQ ID NO: 526719 - RNA, 21 nt, Human
agagacugucacugcaguacc

SEQ ID NO: 526720 - RNA, 20 nt, Human
uugaggagauauugaauacu

SEQ ID NO: 526721 - RNA, 22 nt, Human
cagcacauggauggaguuagga

SEQ ID NO: 526722 - RNA, 23 nt, Human
uggggcugauggagacggaccag

SEQ ID NO: 526723 - RNA, 22 nt, Human
auggcucugcugggcaaagcaa

SEQ ID NO: 526724 - RNA, 22 nt, Human
gugcuaaugaauuggagugccu

SEQ ID NO: 526725 - RNA, 22 nt, Human
cacugcccuggggguugccauc

SEQ ID NO: 526726 - RNA, 21 nt, Human
caggaacauucuuuacauuua

SEQ ID NO: 526727 - RNA, 22 nt, Human
gaggggcucuugggcaugaagg

SEQ ID NO: 526728 - RNA, 22 nt, Human
ggagcgugcacuccaggcccuu

SEQ ID NO: 526729 - RNA, 22 nt, Human
cugggugagcuggccagagggu

SEQ ID NO: 526730 - RNA, 22 nt, Human
gccggacugcugcagcugcuag

SEQ ID NO: 526731 - RNA, 19 nt, Human
cacuguccuagucgaggcc

SEQ ID NO: 526732 - RNA, 22 nt, Human
ugagaugaagugauguaaaaca

SEQ ID NO: 526733 - RNA, 22 nt, Human
augcuuuauuggagacagucau

SEQ ID NO: 526734 - RNA, 22 nt, Human
ccagcagcucccucaggguccg

SEQ ID NO: 526735 - RNA, 17 nt, Human
uggcacagaggugcuau

SEQ ID NO: 526736 - RNA, 19 nt, Human
cuucuggauccgcagggcc

SEQ ID NO: 526737 - RNA, 22 nt, Human
uuuguaguuguggaugcugaag

SEQ ID NO: 526738 - RNA, 22 nt, Human
cucugcaggcacccaggguggg

SEQ ID NO: 526739 - RNA, 22 nt, Human
auugagaaaauucgagcaaguu

SEQ ID NO: 526740 - RNA, 22 nt, Human
uucucaggaacucagugucagc

SEQ ID NO: 526741 - RNA, 22 nt, Human
gggcagcaggcuccacguuccu

SEQ ID NO: 526742 - RNA, 21 nt, Human
ucugcccacacuggccacugc

SEQ ID NO: 526743 - RNA, 22 nt, Human
guccuguguaaguacuugcuca

SEQ ID NO: 526744 - RNA, 22 nt, Human
ucuauuaaugauucaauagugu

SEQ ID NO: 526745 - RNA, 22 nt, Human
gggggacaggaugaauaucugu

SEQ ID NO: 526746 - RNA, 22 nt, Human
cggucguaguucuucagcaggu

SEQ ID NO: 526747 - RNA, 22 nt, Human
cagacucuugagcugauuguau

SEQ ID NO: 526748 - RNA, 22 nt, Human
acugggcaaggauaugaugggu

SEQ ID NO: 526749 - RNA, 22 nt, Human
aaaucugagaaauauuguccag

SEQ ID NO: 526750 - RNA, 22 nt, Human
gacagcagccacagggagaggg

SEQ ID NO: 526751 - RNA, 22 nt, Human
ggcaguggugggaggcucgcuc

SEQ ID NO: 526752 - RNA, 22 nt, Human
gaggcugugugucccucuggac

SEQ ID NO: 526753 - RNA, 22 nt, Human
aucugucccuccucacagccuc

SEQ ID NO: 526754 - RNA, 20 nt, Human
uaugugcaguuugguuuauc

SEQ ID NO: 526755 - RNA, 21 nt, Human
gggcuggauauuggaaagagg

SEQ ID NO: 526756 - RNA, 22 nt, Human
ucuccaggcuuaaucucagcuu

SEQ ID NO: 526757 - RNA, 22 nt, Human
cugagcugcucccgcugcagcg

SEQ ID NO: 526758 - RNA, 23 nt, Human
ugaaagcaaugggucuauaguau

SEQ ID NO: 526759 - RNA, 22 nt, Human
uggccugauuuugcuaagagaa

SEQ ID NO: 526760 - RNA, 22 nt, Human
ggcacuggcaaagcaaagucug

SEQ ID NO: 526761 - RNA, 22 nt, Human
uuggcagugacugcgggccccg

SEQ ID NO: 526762 - RNA, 22 nt, Human
acagcuggccgaggcucaggga

SEQ ID NO: 526763 - RNA, 22 nt, Human
ucucugccacagcuucugccuu

SEQ ID NO: 526764 - RNA, 22 nt, Human
gcagcucacagucuccgccauc

SEQ ID NO: 526765 - RNA, 22 nt, Human
ugguccagacuuugaccucuca

SEQ ID NO: 526766 - RNA, 22 nt, Human
gccaggucgucuccauguccaa

SEQ ID NO: 526767 - RNA, 17 nt, Human
gugcuggccuggggcuc

SEQ ID NO: 526768 - RNA, 22 nt, Human
auauguggcauuauuucugagg

SEQ ID NO: 526769 - RNA, 22 nt, Human
auggugguagaagcacuaugug

SEQ ID NO: 526770 - RNA, 22 nt, Human
cagagggagcccuccaggagca

SEQ ID NO: 526771 - RNA, 22 nt, Human
aggaaaauggaccagaguuguu

SEQ ID NO: 526772 - RNA, 22 nt, Human
ucacacuuuauuuauuucaugc

SEQ ID NO: 526773 - RNA, 22 nt, Human
gacggggcagccagcugguggc

SEQ ID NO: 526774 - RNA, 22 nt, Human
uugggcccugcucugaguugcu

SEQ ID NO: 526775 - RNA, 22 nt, Human
agcucagggccaggcgcguuuc

SEQ ID NO: 526776 - RNA, 22 nt, Human
ccagaacagaccugccugaccu

SEQ ID NO: 526777 - RNA, 22 nt, Human
aaaccuguuaauagagcgaugc

SEQ ID NO: 526778 - RNA, 22 nt, Human
auugaagacuugguauccgugg

SEQ ID NO: 526779 - RNA, 22 nt, Human
aagcugccugggaggaagggcu

SEQ ID NO: 526780 - RNA, 22 nt, Human
gaaugcacacgugugugcaugc

SEQ ID NO: 526781 - RNA, 22 nt, Human
cagagaauaaaagggcauuccu

SEQ ID NO: 526782 - RNA, 22 nt, Human
ugccaggcugcccuccagucug

SEQ ID NO: 526783 - RNA, 22 nt, Human
aaucacagccacaaccuggggg

SEQ ID NO: 526784 - RNA, 22 nt, Human
acauuuuuggguugaugucuga

SEQ ID NO: 526785 - RNA, 22 nt, Human
gccggucuuaagcugacuguga

SEQ ID NO: 526786 - RNA, 22 nt, Human
uucuccacccacucuuuuguug

SEQ ID NO: 526787 - RNA, 17 nt, Human
aguuggcagccguugcu

SEQ ID NO: 526788 - RNA, 22 nt, Human
agcagcaggagccgugggguga

SEQ ID NO: 526789 - RNA, 22 nt, Human
accagucauagaaagcaguggu

SEQ ID NO: 526790 - RNA, 22 nt, Human
ccagcugggucccugcuggggc

SEQ ID NO: 526791 - RNA, 22 nt, Human
gcaggaguguggugggacaucc

SEQ ID NO: 526792 - RNA, 22 nt, Human
uggcauuggaauuuguguugca

SEQ ID NO: 526793 - RNA, 22 nt, Human
uucagcacuggacagcgagucu

SEQ ID NO: 526794 - RNA, 22 nt, Human
aggugcugccccgagaaggaug

SEQ ID NO: 526795 - RNA, 22 nt, Human
uugcuucacuacuucuaggcuc

SEQ ID NO: 526796 - RNA, 23 nt, Human
ggacaugucucuggguauuuuga

SEQ ID NO: 526797 - RNA, 22 nt, Human
cuggcuuugaucagagugaccu

SEQ ID NO: 526798 - RNA, 22 nt, Human
gagcugcuggccuccugcggga

SEQ ID NO: 526799 - RNA, 21 nt, Human
ugucagcaacaauacuuucuc

SEQ ID NO: 526800 - RNA, 22 nt, Human
uaccugagaagaaacccguguu

SEQ ID NO: 526801 - RNA, 22 nt, Human
ggaagccaguugcuuggugugg

SEQ ID NO: 526802 - RNA, 22 nt, Human
cugaggaucuaauuauuggguc

SEQ ID NO: 526803 - RNA, 22 nt, Human
cagaaagcaguugucaaugggc

SEQ ID NO: 526804 - RNA, 22 nt, Human
aggggagguggcagaaaugugc

SEQ ID NO: 526805 - RNA, 22 nt, Human
uaggauaugcauuuuuauacau

SEQ ID NO: 526806 - RNA, 20 nt, Human
ugcuggaggcgccggcgcuc

SEQ ID NO: 526807 - RNA, 22 nt, Human
cuccugcagcccucagcagcca

SEQ ID NO: 526808 - RNA, 20 nt, Human
uuuuccacuccucaaaacag

SEQ ID NO: 526809 - RNA, 22 nt, Human
cggagcagagccacucgggccg

SEQ ID NO: 526810 - RNA, 22 nt, Human
gagguauaguucuauuagauga

SEQ ID NO: 526811 - RNA, 22 nt, Human
ucugccaucaagaugcucuggc

SEQ ID NO: 526812 - RNA, 22 nt, Human
cucagcacauuccuaagggaug

SEQ ID NO: 526813 - RNA, 23 nt, Human
agacagaggcugaggcuggccgc

SEQ ID NO: 526814 - RNA, 22 nt, Human
gcucguugaaccuguccccgag

SEQ ID NO: 526815 - RNA, 22 nt, Human
cagggccagggcuauggugaag

SEQ ID NO: 526816 - RNA, 22 nt, Human
ugagcaccaggcaccacagcuc

SEQ ID NO: 526817 - RNA, 22 nt, Human
ggacugucuccuugcugguagg

SEQ ID NO: 526818 - RNA, 22 nt, Human
cccugacccuaucagagggcca

SEQ ID NO: 526819 - RNA, 22 nt, Human
aggaaagcucccaguagggcuc

SEQ ID NO: 526820 - RNA, 16 nt, Human
ccccucaggaaguaca

SEQ ID NO: 526821 - RNA, 23 nt, Human
aaggggauacuuccacuuucuuu

SEQ ID NO: 526822 - RNA, 22 nt, Human
gccuggaucccagggagucagg

SEQ ID NO: 526823 - RNA, 22 nt, Human
augcauaucuccuaucuccuca

SEQ ID NO: 526824 - RNA, 22 nt, Human
gguggcugugagcauuauguga

SEQ ID NO: 526825 - RNA, 22 nt, Human
cugagcaucauggcagaaucuu

SEQ ID NO: 526826 - RNA, 22 nt, Human
uaaaaguuagcuaggacaaagu

SEQ ID NO: 526827 - RNA, 22 nt, Human
ugcugcuuguuuuguaaauaaa

SEQ ID NO: 526828 - RNA, 22 nt, Human
ggcgaggugucugccaucaagc

SEQ ID NO: 526829 - RNA, 22 nt, Human
gcaggccugucuugcucgcccu

SEQ ID NO: 526830 - RNA, 22 nt, Human
augccccagugugugcuuccuu

SEQ ID NO: 526831 - RNA, 22 nt, Human
cucuccaggcgagguccuacug

SEQ ID NO: 526832 - RNA, 22 nt, Human
cuagcagcauucuucuaguuag

SEQ ID NO: 526833 - RNA, 22 nt, Human
ggaugacagaugcaggcuuuga

SEQ ID NO: 526834 - RNA, 22 nt, Human
ucucaggcuuccuggugcugug

SEQ ID NO: 526835 - RNA, 22 nt, Human
gaauguuaaugcacuucuagcu

SEQ ID NO: 526836 - RNA, 22 nt, Human
gugacaugguuugccgucccug

SEQ ID NO: 526837 - RNA, 17 nt, Human
ucugagaacuugaagca

SEQ ID NO: 526838 - RNA, 22 nt, Human
cagcugccuaugaccuagccuc

SEQ ID NO: 526839 - RNA, 17 nt, Human
agcagcuggguugaucu

SEQ ID NO: 526840 - RNA, 22 nt, Human
agguggagaagagaugggcagu

SEQ ID NO: 526841 - RNA, 22 nt, Human
ucaccuguucaacagcaauaau

SEQ ID NO: 526842 - RNA, 22 nt, Human
ggucagugccuaucaugugggc

SEQ ID NO: 526843 - RNA, 22 nt, Human
guuguuuuugaacggugguggc

SEQ ID NO: 526844 - RNA, 22 nt, Human
acagcuucgaggaucucauccc

SEQ ID NO: 526845 - RNA, 22 nt, Human
uccaugacagcgugagaguuug

SEQ ID NO: 526846 - RNA, 22 nt, Human
ggcagugaugucaaacagugaa

SEQ ID NO: 526847 - RNA, 22 nt, Human
ucccuggcacaagaaggcuguc

SEQ ID NO: 526848 - RNA, 22 nt, Human
uccguggggccuguggcuuccg

SEQ ID NO: 526849 - RNA, 22 nt, Human
caggggcggguaaaaggccucc

SEQ ID NO: 526850 - RNA, 22 nt, Human
gcagcccaggaggcgggagccc

SEQ ID NO: 526851 - RNA, 22 nt, Human
agcagcaccuguccucgcugcu

SEQ ID NO: 526852 - RNA, 22 nt, Human
gcucuccacugaccacggggca

SEQ ID NO: 526853 - RNA, 22 nt, Human
ucucugagaucagccacugacu

SEQ ID NO: 526854 - RNA, 22 nt, Human
cuccagagagaaaggaggccgc

SEQ ID NO: 526855 - RNA, 22 nt, Human
ugcugcacuuauggcucugagg

SEQ ID NO: 526856 - RNA, 22 nt, Human
agaccagugaguaggccuuaga

SEQ ID NO: 526857 - RNA, 22 nt, Human
aaauacaguggcagcagauaau

SEQ ID NO: 526858 - RNA, 22 nt, Human
uaaaguucuuagaacaaggccu

SEQ ID NO: 526859 - RNA, 22 nt, Human
gugcugccuccauauccgucag

SEQ ID NO: 526860 - RNA, 22 nt, Human
caggccuugaaggccugcggga

SEQ ID NO: 526861 - RNA, 22 nt, Human
gggagcugagcuggaagagaau

SEQ ID NO: 526862 - RNA, 22 nt, Human
gccagguugcugacgacgaucu

SEQ ID NO: 526863 - RNA, 22 nt, Human
cugggagggguagccaauccua

SEQ ID NO: 526864 - RNA, 22 nt, Human
agcagcaggugaccucgaugcc

SEQ ID NO: 526865 - RNA, 22 nt, Human
cuggccucacagaggcuaagcc

SEQ ID NO: 526866 - RNA, 22 nt, Human
acucagaguuugcguuccauac

SEQ ID NO: 526867 - RNA, 22 nt, Human
uggccucuuucuucccuuugac

SEQ ID NO: 526868 - RNA, 22 nt, Human
cucagaggggaugcuuggagaa

SEQ ID NO: 526869 - RNA, 22 nt, Human
auuuccaggaguugaggucuga

SEQ ID NO: 526870 - RNA, 22 nt, Human
ucaggggcuugaggugcauguc

SEQ ID NO: 526871 - RNA, 22 nt, Human
cucaugucggcaggacucgccc

SEQ ID NO: 526872 - RNA, 22 nt, Human
agaaggcaucagaaguguguag

SEQ ID NO: 526873 - RNA, 22 nt, Human
ccugguccccaucggcccagcg

SEQ ID NO: 526874 - RNA, 22 nt, Human
cgggcuccgggucuuugcaguc

SEQ ID NO: 526875 - RNA, 22 nt, Human
ucuguccauucagaauggcccu

SEQ ID NO: 526876 - RNA, 22 nt, Human
ccaggcauccauugcuuccucu

SEQ ID NO: 526877 - RNA, 22 nt, Human
ucugagaaugguggauguggug

SEQ ID NO: 526878 - RNA, 22 nt, Human
ggcagcugaagaggaacuuugg

SEQ ID NO: 526879 - RNA, 22 nt, Human
ugcagguggcagcggggcacca

SEQ ID NO: 526880 - RNA, 22 nt, Human
aacccuggggcugcucugccug

SEQ ID NO: 526881 - RNA, 22 nt, Human
uugggacaaagacuccuugaau

SEQ ID NO: 526882 - RNA, 22 nt, Human
ucagccagaggcuucuugguuu

SEQ ID NO: 526883 - RNA, 22 nt, Human
uuaguguccagaguuuuuauua

SEQ ID NO: 526884 - RNA, 22 nt, Human
auggccuuucucaguggugcuu

SEQ ID NO: 526885 - RNA, 22 nt, Human
auccucagagaacgaacacaau

SEQ ID NO: 526886 - RNA, 22 nt, Human
agcuuugggcagaagaggauuc

SEQ ID NO: 526887 - RNA, 22 nt, Human
cugggacacguugugcuuuaac

SEQ ID NO: 526888 - RNA, 22 nt, Human
ucacuugaaccugggaggcaga

SEQ ID NO: 526889 - RNA, 21 nt, Human
agcugugguuuuacaucuuuu

SEQ ID NO: 526890 - RNA, 22 nt, Human
gaaggcaguaaauggcuguuuu

SEQ ID NO: 526891 - RNA, 22 nt, Human
ggcuagcuuagagucaugcuag

SEQ ID NO: 526892 - RNA, 22 nt, Human
augagugcuuagagaguaaucc

SEQ ID NO: 526893 - RNA, 20 nt, Human
cugaccagcagccugucucc

SEQ ID NO: 526894 - RNA, 18 nt, Human
agguguguuucuaggagc

SEQ ID NO: 526895 - RNA, 18 nt, Human
ggguccccagcugcaggg

SEQ ID NO: 526896 - RNA, 21 nt, Human
acaaauuguuuauauaggaag

SEQ ID NO: 526897 - RNA, 22 nt, Human
uuauuccauagaagucaaggaa

SEQ ID NO: 526898 - RNA, 23 nt, Human
ugucuugguuucuucacccuagu

SEQ ID NO: 526899 - RNA, 22 nt, Human
gccgugcgugcgcaggugcugu

SEQ ID NO: 526900 - RNA, 22 nt, Human
ggccuuggaguccuccacugga

SEQ ID NO: 526901 - RNA, 22 nt, Human
gacuuugccacuugcuccagcu

SEQ ID NO: 526902 - RNA, 22 nt, Human
cugaccaguccuuagcaccugg

SEQ ID NO: 526903 - RNA, 22 nt, Human
ggaaacauuccaagaguugaaa

SEQ ID NO: 526904 - RNA, 22 nt, Human
cucuagcucccagggagcgucu

SEQ ID NO: 526905 - RNA, 22 nt, Human
ccacuguuuccuuucugcuggc

SEQ ID NO: 526906 - RNA, 22 nt, Human
agaggagguccuuuucugaugu

SEQ ID NO: 526907 - RNA, 22 nt, Human
auggaguguggccaggcaguaa

SEQ ID NO: 526908 - RNA, 22 nt, Human
ccaggugugcucugcaguggau

SEQ ID NO: 526909 - RNA, 22 nt, Human
ugauuuacaguagugucuaaac

SEQ ID NO: 526910 - RNA, 22 nt, Human
ccuguaccgcgaucugcugcgc

SEQ ID NO: 526911 - RNA, 22 nt, Human
uggaagguguggcaggucuagu

SEQ ID NO: 526912 - RNA, 22 nt, Human
uggaauuaucugaagugauuug

SEQ ID NO: 526913 - RNA, 22 nt, Human
caggcacaagaucggcuagaua

SEQ ID NO: 526914 - RNA, 22 nt, Human
agcaggaacucagggaguucuc

SEQ ID NO: 526915 - RNA, 22 nt, Human
caaguaugagaaagcuauuacc

SEQ ID NO: 526916 - RNA, 22 nt, Human
uaacauuucggugacaguggga

SEQ ID NO: 526917 - RNA, 22 nt, Human
uccagccauaucuuguagcccu

SEQ ID NO: 526918 - RNA, 22 nt, Human
agugccaaaucgagggcucuga

SEQ ID NO: 526919 - RNA, 22 nt, Human
uggagcugguucuggggaagcu

SEQ ID NO: 526920 - RNA, 22 nt, Human
ucagccuggcaggauggccugg

SEQ ID NO: 526921 - RNA, 22 nt, Human
ggcagcaggguagccauuucuc

SEQ ID NO: 526922 - RNA, 22 nt, Human
guccagaguagucgaguauucu

SEQ ID NO: 526923 - RNA, 22 nt, Human
gugggcaucuccuuggaagcca

SEQ ID NO: 526924 - RNA, 22 nt, Human
ugggucagauugagccccuggu

SEQ ID NO: 526925 - RNA, 22 nt, Human
cugcacagucauuuccucucaa

SEQ ID NO: 526926 - RNA, 20 nt, Human
uuacagaaaugauguuauuu

SEQ ID NO: 526927 - RNA, 22 nt, Human
cagagccuuaguucuccuagaa

SEQ ID NO: 526928 - RNA, 22 nt, Human
ugcccuguuccugccuccagcu

SEQ ID NO: 526929 - RNA, 22 nt, Human
cagacugaaaaucccugguagu

SEQ ID NO: 526930 - RNA, 22 nt, Human
ugaggcuggaugggaugccucc

SEQ ID NO: 526931 - RNA, 22 nt, Human
ucugagagcuguagaagccuau

SEQ ID NO: 526932 - RNA, 22 nt, Human
ugcuuguauucauaucacagcu

SEQ ID NO: 526933 - RNA, 22 nt, Human
gcucagguagaugggguugucc

SEQ ID NO: 526934 - RNA, 22 nt, Human
agcaggaggagagccuggcggu

SEQ ID NO: 526935 - RNA, 22 nt, Human
ggcagguguuuuuauauuaaag

SEQ ID NO: 526936 - RNA, 22 nt, Human
agugccucugcagguccgaguu

SEQ ID NO: 526937 - RNA, 22 nt, Human
ccugugguuuacucuguggcua

SEQ ID NO: 526938 - RNA, 22 nt, Human
ugaagcuagaauguccauauuu

SEQ ID NO: 526939 - RNA, 22 nt, Human
cauuuuccucugcugguguuca

SEQ ID NO: 526940 - RNA, 22 nt, Human
uggcccgggaguuuugaagagu

SEQ ID NO: 526941 - RNA, 20 nt, Human
ucucuggcaagaagcugcag

SEQ ID NO: 526942 - RNA, 22 nt, Human
gggcugacaccacccaggcgca

SEQ ID NO: 526943 - RNA, 22 nt, Human
ccauggccaggaaagccaaggu

SEQ ID NO: 526944 - RNA, 22 nt, Human
cacugguugccucuuucuguuc

SEQ ID NO: 526945 - RNA, 22 nt, Human
gugggccugaugcugccaugag

SEQ ID NO: 526946 - RNA, 22 nt, Human
augggagugacagggccacugg

SEQ ID NO: 526947 - RNA, 23 nt, Human
gccagagcugccugcccuugcug

SEQ ID NO: 526948 - RNA, 22 nt, Human
uaggaaauaauucacucuggcu

SEQ ID NO: 526949 - RNA, 22 nt, Human
agucaagguggaccagaaaaau

SEQ ID NO: 526950 - RNA, 22 nt, Human
gggcugagggguaucucauggg

SEQ ID NO: 526951 - RNA, 22 nt, Human
gauacuuuguggaauccuggau

SEQ ID NO: 526952 - RNA, 23 nt, Human
aagaaugcuucugaagagcugcc

SEQ ID NO: 526953 - RNA, 22 nt, Human
uuuucaguugugcucucuaguu

SEQ ID NO: 526954 - RNA, 22 nt, Human
ucuaaugcuugacugggggcuu

SEQ ID NO: 526955 - RNA, 22 nt, Human
agagacauagcacaguuuuucg

SEQ ID NO: 526956 - RNA, 22 nt, Human
cagaggauauaugguuuguaug

SEQ ID NO: 526957 - RNA, 22 nt, Human
ucccugagugggcugguaguau

SEQ ID NO: 526958 - RNA, 22 nt, Human
gcugggcccugggugcccuagc

SEQ ID NO: 526959 - RNA, 22 nt, Human
ggagggaguuucauuccugccc

SEQ ID NO: 526960 - RNA, 21 nt, Human
ucccacuggcccagggcucca

SEQ ID NO: 526961 - RNA, 22 nt, Human
uagucaccuguugugugaugcc

SEQ ID NO: 526962 - RNA, 22 nt, Human
gagcuguguaugcaucauucug

SEQ ID NO: 526963 - RNA, 22 nt, Human
ugggaagauaugagugaccaac

SEQ ID NO: 526964 - RNA, 20 nt, Human
ugagccugcuguaggaggcc

SEQ ID NO: 526965 - RNA, 22 nt, Human
uccacagggaugccugcggcuu

SEQ ID NO: 526966 - RNA, 20 nt, Human
ucagugggaaagugagagug

SEQ ID NO: 526967 - RNA, 22 nt, Human
gaaggaagcugucuggaugugu

SEQ ID NO: 526968 - RNA, 22 nt, Human
uggguaggaccagaaaugcacu

SEQ ID NO: 526969 - RNA, 22 nt, Human
ggugcccaaggaagguugccgu

SEQ ID NO: 526970 - RNA, 22 nt, Human
gcugcccucuguguuuguccuu

SEQ ID NO: 526971 - RNA, 22 nt, Human
caucucccacuuccuugggggu

SEQ ID NO: 526972 - RNA, 22 nt, Human
auggcauuugaaucugucuuuu

SEQ ID NO: 526973 - RNA, 22 nt, Human
cucagaguccauaguuuacagu

SEQ ID NO: 526974 - RNA, 22 nt, Human
cccacucccugcacgccugccg

SEQ ID NO: 526975 - RNA, 22 nt, Human
ggagccuggaguuucugauggg

SEQ ID NO: 526976 - RNA, 18 nt, Human
uggguggcuagggaguuu

SEQ ID NO: 526977 - RNA, 22 nt, Human
augaagcauuacaggaugacag

SEQ ID NO: 526978 - RNA, 22 nt, Human
gugcuggcuggggcaucaggca

SEQ ID NO: 526979 - RNA, 22 nt, Human
ccagucagccaagcugcagcgg

SEQ ID NO: 526980 - RNA, 19 nt, Human
agugagcauggcuugacug

SEQ ID NO: 526981 - RNA, 22 nt, Human
uuggaauuugagaccaagaaaa

SEQ ID NO: 526982 - RNA, 21 nt, Human
uccagcacagaugaccucccc

SEQ ID NO: 526983 - RNA, 22 nt, Human
cuggacacuggggaugcgcagu

SEQ ID NO: 526984 - RNA, 22 nt, Human
gcucuggcuacuguggcuaccg

SEQ ID NO: 526985 - RNA, 22 nt, Human
caggcuugaugugucuauacuu

SEQ ID NO: 526986 - RNA, 22 nt, Human
cagagcagaaaccugggugauu

SEQ ID NO: 526987 - RNA, 21 nt, Human
ucuuggggaggagggcugcac

SEQ ID NO: 526988 - RNA, 22 nt, Human
uggacucaccuugaguuagcca

SEQ ID NO: 526989 - RNA, 22 nt, Human
gcugcuccgcagagugugugug

SEQ ID NO: 526990 - RNA, 22 nt, Human
cagucccaguuugagacucugg

SEQ ID NO: 526991 - RNA, 22 nt, Human
uuaccacagugccugucuaaug

SEQ ID NO: 526992 - RNA, 22 nt, Human
auccaggcgaaugcagaaggcc

SEQ ID NO: 526993 - RNA, 22 nt, Human
cagacagagucuucccaucagu

SEQ ID NO: 526994 - RNA, 22 nt, Human
cagaccagccauuugccucuuc

SEQ ID NO: 526995 - RNA, 23 nt, Human
cagcacaguacauuuccugucuc

SEQ ID NO: 526996 - RNA, 22 nt, Human
uguggaauguccucagcauccu

SEQ ID NO: 526997 - RNA, 22 nt, Human
caacauuucaaggucuuuagga

SEQ ID NO: 526998 - RNA, 23 nt, Human
gagcugggauacaggcuuacugc

SEQ ID NO: 526999 - RNA, 22 nt, Human
uucuggagacccagcaacaggg

SEQ ID NO: 527000 - RNA, 22 nt, Human
gagugugucggucagcguggcg

SEQ ID NO: 527001 - RNA, 22 nt, Human
ucugagugggaacucucaugac

SEQ ID NO: 527002 - RNA, 22 nt, Human
gucccaggggagcucucugauu

SEQ ID NO: 527003 - RNA, 22 nt, Human
uucagaagguaggaaugucccu

SEQ ID NO: 527004 - RNA, 22 nt, Human
uugagcugccuggcuguggcuc

SEQ ID NO: 527005 - RNA, 19 nt, Human
aacuacagcgcacuguccu

SEQ ID NO: 527006 - RNA, 19 nt, Human
ccauucugucucugccaca

SEQ ID NO: 527007 - RNA, 22 nt, Human
gcucccuggaauguuggcugcc

SEQ ID NO: 527008 - RNA, 22 nt, Human
aaacacaucauucaugucguca

SEQ ID NO: 527009 - RNA, 22 nt, Human
ugcuugucacccugccugagug

SEQ ID NO: 527010 - RNA, 22 nt, Human
ggagccaguuuagaccucaguu

SEQ ID NO: 527011 - RNA, 22 nt, Human
auguacauuauucgagugaugg

SEQ ID NO: 527012 - RNA, 22 nt, Human
acucacagggccucaguuuucc

SEQ ID NO: 527013 - RNA, 22 nt, Human
agugauguagguggauucuggc

SEQ ID NO: 527014 - RNA, 22 nt, Human
acucuguuugcagguagcucag

SEQ ID NO: 527015 - RNA, 22 nt, Human
cugggcuguuuguucuggucuc

SEQ ID NO: 527016 - RNA, 22 nt, Human
aauggcaaaguguuuucauacc

SEQ ID NO: 527017 - RNA, 22 nt, Human
aggacagcagugcuggcacuug

SEQ ID NO: 527018 - RNA, 22 nt, Human
ccuuuguucacuggagagugga

SEQ ID NO: 527019 - RNA, 22 nt, Human
gguguggcaguggaccugugaa

SEQ ID NO: 527020 - RNA, 22 nt, Human
gcccagccccuggguggacgug

SEQ ID NO: 527021 - RNA, 22 nt, Human
gcggcgccugggacccgccagc

SEQ ID NO: 527022 - RNA, 22 nt, Human
uguccugugaccuggcaccaca

SEQ ID NO: 527023 - RNA, 18 nt, Human
gugacugccccaaaaggc

SEQ ID NO: 527024 - RNA, 22 nt, Human
acgccucugcagcugccgggcc

SEQ ID NO: 527025 - RNA, 22 nt, Human
caggacccaucagccaggcacu

SEQ ID NO: 527026 - RNA, 22 nt, Human
cagaaagugauuugcuauucca

SEQ ID NO: 527027 - RNA, 22 nt, Human
cuguuccuccaccucaacaaac

SEQ ID NO: 527028 - RNA, 23 nt, Human
uacagccaugucgcugauuuaac

SEQ ID NO: 527029 - RNA, 22 nt, Human
gggcagcaaaucugagucuggu

SEQ ID NO: 527030 - RNA, 22 nt, Human
gagccucguggcggccacugcg

SEQ ID NO: 527031 - RNA, 22 nt, Human
ucuccacaccagaaggagcuga

SEQ ID NO: 527032 - RNA, 22 nt, Human
uucugauugcugaugaggccca

SEQ ID NO: 527033 - RNA, 22 nt, Human
gcuguaacuuuuucauuuucaa

SEQ ID NO: 527034 - RNA, 20 nt, Human
gugcuaaguacugugaaggg

SEQ ID NO: 527035 - RNA, 20 nt, Human
ccacccuguccggggcggag

SEQ ID NO: 527036 - RNA, 20 nt, Human
gugcccaguuggugacagac

SEQ ID NO: 527037 - RNA, 22 nt, Human
uggaauguuaaaccucaaugau

SEQ ID NO: 527038 - RNA, 22 nt, Human
ugucuacaagccuuguucggca

SEQ ID NO: 527039 - RNA, 22 nt, Human
cuucuggcguuggaggucugag

SEQ ID NO: 527040 - RNA, 22 nt, Human
agcauggccucccgggccuggc

SEQ ID NO: 527041 - RNA, 22 nt, Human
cagaaccaggaacugauggaga

SEQ ID NO: 527042 - RNA, 21 nt, Human
agccaggcaagcacccccacu

SEQ ID NO: 527043 - RNA, 22 nt, Human
ucuccauggauuuggaaaugau

SEQ ID NO: 527044 - RNA, 22 nt, Human
guggcccaggcuuggcgcuggc

SEQ ID NO: 527045 - RNA, 22 nt, Human
cuggagcucuccagagccccgu

SEQ ID NO: 527046 - RNA, 22 nt, Human
cuccaaaggauaaaagcagagu

SEQ ID NO: 527047 - RNA, 21 nt, Human
agccugcaauguagguaccgg

SEQ ID NO: 527048 - RNA, 22 nt, Human
cugggaggcccacguugggaag

SEQ ID NO: 527049 - RNA, 22 nt, Human
ugugacagugccagcuucauag

SEQ ID NO: 527050 - RNA, 22 nt, Human
aaaaugcucaucagcgauggcu

SEQ ID NO: 527051 - RNA, 22 nt, Human
cagugcagccaaggacaggcac

SEQ ID NO: 527052 - RNA, 22 nt, Human
gugggccaguuccucacaggua

SEQ ID NO: 527053 - RNA, 22 nt, Human
aauucagguuauauuugcaacu

SEQ ID NO: 527054 - RNA, 22 nt, Human
uccaguggugguuugaagggca

SEQ ID NO: 527055 - RNA, 22 nt, Human
uuuaagguacagcuagcagcau

SEQ ID NO: 527056 - RNA, 19 nt, Human
cuggcuucaagcaguccuc

SEQ ID NO: 527057 - RNA, 22 nt, Human
agcugucuaccugcagaguccu

SEQ ID NO: 527058 - RNA, 22 nt, Human
agugacauuauuuuguguacua

SEQ ID NO: 527059 - RNA, 21 nt, Human
caagacauaugaguacucugg

SEQ ID NO: 527060 - RNA, 22 nt, Human
uggugcaggccaagcugcgagc

SEQ ID NO: 527061 - RNA, 22 nt, Human
uguaccacucuacuaaggguuc

SEQ ID NO: 527062 - RNA, 22 nt, Human
gcagcccaggcucgcucacugc

SEQ ID NO: 527063 - RNA, 22 nt, Human
gcugcaagugcauguugcaacu

SEQ ID NO: 527064 - RNA, 22 nt, Human
aguguauucugcaugggagacu

SEQ ID NO: 527065 - RNA, 22 nt, Human
ucaccggcagacguggccugau

SEQ ID NO: 527066 - RNA, 21 nt, Human
ggagucagggucuggcugggg

SEQ ID NO: 527067 - RNA, 22 nt, Human
ggccauggcgggagccggcguc

SEQ ID NO: 527068 - RNA, 22 nt, Human
cauggaaggcaaaagacacaga

SEQ ID NO: 527069 - RNA, 22 nt, Human
ugcagcugccuagggcuggcuu

SEQ ID NO: 527070 - RNA, 22 nt, Human
acuuggucguggugcagcaugg

SEQ ID NO: 527071 - RNA, 22 nt, Human
aaccagcacugcuggggccugc

SEQ ID NO: 527072 - RNA, 18 nt, Human
cuuuagcugucaucuuug

SEQ ID NO: 527073 - RNA, 22 nt, Human
ccagcagccaccuucucgaaau

SEQ ID NO: 527074 - RNA, 22 nt, Human
gcuagagaccagaggccuugaa

SEQ ID NO: 527075 - RNA, 22 nt, Human
ccugggcaaaugccagagacaa

SEQ ID NO: 527076 - RNA, 22 nt, Human
ucauccagccucaucaggagcu

SEQ ID NO: 527077 - RNA, 22 nt, Human
ucgggacgguggcauuugugcc

SEQ ID NO: 527078 - RNA, 22 nt, Human
ugaccguuuuggcacccaugcu

SEQ ID NO: 527079 - RNA, 22 nt, Human
cgaggaggaaacgcggagaacu

SEQ ID NO: 527080 - RNA, 22 nt, Human
aaaugccucauuuucucucacu

SEQ ID NO: 527081 - RNA, 22 nt, Human
uggaagggguuacgcagcagga

SEQ ID NO: 527082 - RNA, 22 nt, Human
ugcuggaguggcacuguguggc

SEQ ID NO: 527083 - RNA, 22 nt, Human
aaguuacacauuuucauuguaa

SEQ ID NO: 527084 - RNA, 22 nt, Human
cugcugccuuccaaaggccagg

SEQ ID NO: 527085 - RNA, 20 nt, Human
uccugggguaagccaugguc

SEQ ID NO: 527086 - RNA, 22 nt, Human
uggcugagugaacauguccauu

SEQ ID NO: 527087 - RNA, 22 nt, Human
auucccuuugacgaucccuagg

SEQ ID NO: 527088 - RNA, 22 nt, Human
acaggcgcacaugagggccgug

SEQ ID NO: 527089 - RNA, 22 nt, Human
ugugcugcucucagugacagcc

SEQ ID NO: 527090 - RNA, 22 nt, Human
uuuacagagaauguacauaaag

SEQ ID NO: 527091 - RNA, 22 nt, Human
uucucaaagugugcucccugga

SEQ ID NO: 527092 - RNA, 22 nt, Human
ugggaccugcucuuggaaugag

SEQ ID NO: 527093 - RNA, 22 nt, Human
cccuggcucugccucagagccc

SEQ ID NO: 527094 - RNA, 22 nt, Human
guagagcagggagcaggaagcu

SEQ ID NO: 527095 - RNA, 22 nt, Human
ggcaaucauuggcauucucugg

SEQ ID NO: 527096 - RNA, 22 nt, Human
gucccagaggacagggucacau

SEQ ID NO: 527097 - RNA, 22 nt, Human
uggcuacauuuauacucucauu

SEQ ID NO: 527098 - RNA, 22 nt, Human
ugcugugcuggcggcagaggcc

SEQ ID NO: 527099 - RNA, 22 nt, Human
gauauucauaggcagguauuua

SEQ ID NO: 527100 - RNA, 22 nt, Human
aacuagaaagaacauauuucca

SEQ ID NO: 527101 - RNA, 22 nt, Human
acccugccucugcuuccuguag

SEQ ID NO: 527102 - RNA, 21 nt, Human
cacuccacuuagaacaggguu

SEQ ID NO: 527103 - RNA, 22 nt, Human
ccaggagagcucucguucagug

SEQ ID NO: 527104 - RNA, 22 nt, Human
aaucuguuuuaaaguuugugcc

SEQ ID NO: 527105 - RNA, 22 nt, Human
uaaaguauaagcauuggaguau

SEQ ID NO: 527106 - RNA, 22 nt, Human
agcugggcuggagcuccaagcg

SEQ ID NO: 527107 - RNA, 22 nt, Human
cagcuauuguucuguauaauga

SEQ ID NO: 527108 - RNA, 22 nt, Human
ucaaagaucagaugguuguagg

SEQ ID NO: 527109 - RNA, 22 nt, Human
uugaggagucaggggcacggaa

SEQ ID NO: 527110 - RNA, 22 nt, Human
agacaagagcugaggacauauu

SEQ ID NO: 527111 - RNA, 22 nt, Human
uguacauauucaagcacuucua

SEQ ID NO: 527112 - RNA, 22 nt, Human
aagcccucagagccucuuugac

SEQ ID NO: 527113 - RNA, 22 nt, Human
gccaggcaggccacgcuguguu

SEQ ID NO: 527114 - RNA, 22 nt, Human
uccugaaaauaauuucacaaga

SEQ ID NO: 527115 - RNA, 21 nt, Human
uuggccgugcagaugaacagc

SEQ ID NO: 527116 - RNA, 22 nt, Human
cagaguggugcaagggcagugu

SEQ ID NO: 527117 - RNA, 22 nt, Human
aaugaacacuuagccuuucuau

SEQ ID NO: 527118 - RNA, 22 nt, Human
gcggcccgagcaggacgggugg

SEQ ID NO: 527119 - RNA, 22 nt, Human
gccggggcuggggagagacaug

SEQ ID NO: 527120 - RNA, 20 nt, Human
agcuuugguuaagccagugg

SEQ ID NO: 527121 - RNA, 22 nt, Human
ggcuguggucauuaggagguug

SEQ ID NO: 527122 - RNA, 23 nt, Human
uggccucuccccaccuggcagaa

SEQ ID NO: 527123 - RNA, 22 nt, Human
acaucguguaucacugaaccuu

SEQ ID NO: 527124 - RNA, 22 nt, Human
ggacaucuguugugguagagga

SEQ ID NO: 527125 - RNA, 22 nt, Human
uuugggaaacuuaggggucaga

SEQ ID NO: 527126 - RNA, 22 nt, Human
gcccuguuuucuggguuccuug

SEQ ID NO: 527127 - RNA, 22 nt, Human
gggacuggaguagaggccggug

SEQ ID NO: 527128 - RNA, 22 nt, Human
aguaaaaucaccaucucuuugu

SEQ ID NO: 527129 - RNA, 22 nt, Human
caggcuacauuugcucugagaa

SEQ ID NO: 527130 - RNA, 22 nt, Human
aggagcggauguguccugccag

SEQ ID NO: 527131 - RNA, 17 nt, Human
gagguaggaagugaguc

SEQ ID NO: 527132 - RNA, 22 nt, Human
auacaccaccuuggaucuuuca

SEQ ID NO: 527133 - RNA, 22 nt, Human
auggcuguguuguuccucugaa

SEQ ID NO: 527134 - RNA, 22 nt, Human
caggaacacaaugagucucaaa

SEQ ID NO: 527135 - RNA, 22 nt, Human
aggcuuucgaugaacgcuugcu

SEQ ID NO: 527136 - RNA, 22 nt, Human
cccauugugguuguugaggaua

SEQ ID NO: 527137 - RNA, 22 nt, Human
ucucuacagcacccgcaugcua

SEQ ID NO: 527138 - RNA, 22 nt, Human
cugagcagucuagccagguguu

SEQ ID NO: 527139 - RNA, 22 nt, Human
aggugggacccguggggugcga

SEQ ID NO: 527140 - RNA, 21 nt, Human
agaugcaguuugcaggugggu

SEQ ID NO: 527141 - RNA, 22 nt, Human
cccagcugaacuugcauuccaa

SEQ ID NO: 527142 - RNA, 22 nt, Human
accuuguuguagguacaaaaga

SEQ ID NO: 527143 - RNA, 20 nt, Human
cgggacacucaagcucuggg

SEQ ID NO: 527144 - RNA, 22 nt, Human
agcagccuugugacuccggggu

SEQ ID NO: 527145 - RNA, 22 nt, Human
cagggacugagauccagacugu

SEQ ID NO: 527146 - RNA, 23 nt, Human
uagauccuuccaacuacucuuac

SEQ ID NO: 527147 - RNA, 22 nt, Human
gauggaggagauggcagggugc

SEQ ID NO: 527148 - RNA, 22 nt, Human
gagcuaggauaucaugagggua

SEQ ID NO: 527149 - RNA, 22 nt, Human
gauggcgguggccaccuccuug

SEQ ID NO: 527150 - RNA, 22 nt, Human
ggacauggaaguauggagugga

SEQ ID NO: 527151 - RNA, 22 nt, Human
cagcagcucaggcuccuuccca

SEQ ID NO: 527152 - RNA, 22 nt, Human
uggcagcauuuuuuccagaaca

SEQ ID NO: 527153 - RNA, 22 nt, Human
aggcucagugauguaaaauaua

SEQ ID NO: 527154 - RNA, 22 nt, Human
gguauggagucugaguuucuag

SEQ ID NO: 527155 - RNA, 22 nt, Human
ugguuuacucuguaaaccagga

SEQ ID NO: 527156 - RNA, 22 nt, Human
uguucauaucauuuugaaagcu

SEQ ID NO: 527157 - RNA, 22 nt, Human
ugucuuacagcaaucuguucug

SEQ ID NO: 527158 - RNA, 22 nt, Human
gagagaagggggauaugagccu

SEQ ID NO: 527159 - RNA, 22 nt, Human
cagaggccccauuggcugugcg

SEQ ID NO: 527160 - RNA, 20 nt, Human
uacaauauucccacuuugcu

SEQ ID NO: 527161 - RNA, 22 nt, Human
cccucucccugcagaauguggc

SEQ ID NO: 527162 - RNA, 22 nt, Human
ggcuuuuguuucagcucugcua

SEQ ID NO: 527163 - RNA, 22 nt, Human
ugaguggacgugaggcugagua

SEQ ID NO: 527164 - RNA, 22 nt, Human
cuugucuaguuccuggugaugu

SEQ ID NO: 527165 - RNA, 22 nt, Human
gcaugcaggaagggcuugggga

SEQ ID NO: 527166 - RNA, 22 nt, Human
aaguguguauuuuucuucagug

SEQ ID NO: 527167 - RNA, 21 nt, Human
uuggaacaagcagcaguuugc

SEQ ID NO: 527168 - RNA, 22 nt, Human
caagcuuguuucuccugggggu

SEQ ID NO: 527169 - RNA, 20 nt, Human
cucaccagguguaggcugag

SEQ ID NO: 527170 - RNA, 20 nt, Human
gagcagugagccagggaaag

SEQ ID NO: 527171 - RNA, 22 nt, Human
auguccagaguaaagcacauuc

SEQ ID NO: 527172 - RNA, 22 nt, Human
cugcgugguaggacucaguucu

SEQ ID NO: 527173 - RNA, 22 nt, Human
gcugccaccguggagaugagug

SEQ ID NO: 527174 - RNA, 19 nt, Human
gcagcugugggaagagcca

SEQ ID NO: 527175 - RNA, 22 nt, Human
ggccuugguaaauuggcauuug

SEQ ID NO: 527176 - RNA, 22 nt, Human
ugguaugcuuauuaucuucaac

SEQ ID NO: 527177 - RNA, 23 nt, Human
aacucuggcuagcauagaauaga

SEQ ID NO: 527178 - RNA, 22 nt, Human
ugaguccagaugggccagcagg

SEQ ID NO: 527179 - RNA, 22 nt, Human
ccugaggcccuggcugugcuga

SEQ ID NO: 527180 - RNA, 22 nt, Human
agaaacaucgcuuaguccucau

SEQ ID NO: 527181 - RNA, 22 nt, Human
ucccucugcuagugcuugagcu

SEQ ID NO: 527182 - RNA, 22 nt, Human
ucaccggugacccucggcucgc

SEQ ID NO: 527183 - RNA, 22 nt, Human
ccuggccgacauggugaaacgc

SEQ ID NO: 527184 - RNA, 22 nt, Human
uaggcagggauuaggguugauu

SEQ ID NO: 527185 - RNA, 22 nt, Human
gacucugguugcggguucugcu

SEQ ID NO: 527186 - RNA, 22 nt, Human
uagugucuuccaggacauggua

SEQ ID NO: 527187 - RNA, 22 nt, Human
uccuggguccauggcagccgaa

SEQ ID NO: 527188 - RNA, 19 nt, Human
ccgucauggagaguggggu

SEQ ID NO: 527189 - RNA, 22 nt, Human
ccaugcccuugucaucuccagg

SEQ ID NO: 527190 - RNA, 22 nt, Human
cagcuccagccaccggggggug

SEQ ID NO: 527191 - RNA, 22 nt, Human
guggcuaggcccaacggcagga

SEQ ID NO: 527192 - RNA, 23 nt, Human
uuguccucuggaucgguuugguu

SEQ ID NO: 527193 - RNA, 22 nt, Human
ucaggcuagcccagugcuuggg

SEQ ID NO: 527194 - RNA, 22 nt, Human
acaggacagucuaguaacagua

SEQ ID NO: 527195 - RNA, 22 nt, Human
aggcugagccugggcguggugg

SEQ ID NO: 527196 - RNA, 17 nt, Human
ucuccuggcucuaucag

SEQ ID NO: 527197 - RNA, 22 nt, Human
ugggaagaguuagagacagcug

SEQ ID NO: 527198 - RNA, 22 nt, Human
auguggcuuucugcguuuucuc

SEQ ID NO: 527199 - RNA, 22 nt, Human
uggcuccuuccgcagcaugccu

SEQ ID NO: 527200 - RNA, 22 nt, Human
uaguggguuuauacaauuuaaa

SEQ ID NO: 527201 - RNA, 22 nt, Human
ugucuagaaaugcugagucuca

SEQ ID NO: 527202 - RNA, 22 nt, Human
gaguguuccagaaacuggcccu

SEQ ID NO: 527203 - RNA, 22 nt, Human
uggcggugacggcggcgccugg

SEQ ID NO: 527204 - RNA, 22 nt, Human
guccacauaggaacccagcuuc

SEQ ID NO: 527205 - RNA, 22 nt, Human
uuuucuuggaguggcuguccuu

SEQ ID NO: 527206 - RNA, 18 nt, Human
ucugagggugcgggagcu

SEQ ID NO: 527207 - RNA, 22 nt, Human
ucagauggucauucacuagggu

SEQ ID NO: 527208 - RNA, 22 nt, Human
gccugugcuuaacugacgugag

SEQ ID NO: 527209 - RNA, 22 nt, Human
gagaugggcgagaagguggacu

SEQ ID NO: 527210 - RNA, 20 nt, Human
gggugugugcagggccuggu

SEQ ID NO: 527211 - RNA, 22 nt, Human
cugugcuggcagaccuggaguu

SEQ ID NO: 527212 - RNA, 22 nt, Human
aggccagugguucucugugucc

SEQ ID NO: 527213 - RNA, 22 nt, Human
aacuuucugaaaagcuugauca

SEQ ID NO: 527214 - RNA, 22 nt, Human
uggcucaucuuuuuagacuuau

SEQ ID NO: 527215 - RNA, 23 nt, Human
uccugcagauaagcugguugaca

SEQ ID NO: 527216 - RNA, 22 nt, Human
uggccagucuuagcugugccug

SEQ ID NO: 527217 - RNA, 22 nt, Human
ccagcaggaaagugacguuuga

SEQ ID NO: 527218 - RNA, 22 nt, Human
uccugggcccuccggaucaggu

SEQ ID NO: 527219 - RNA, 22 nt, Human
ggucuggagcuaaucuuguugg

SEQ ID NO: 527220 - RNA, 22 nt, Human
ggccgugcuccaaagucaucgu

SEQ ID NO: 527221 - RNA, 22 nt, Human
uucucucaguuaaacuuuguga

SEQ ID NO: 527222 - RNA, 22 nt, Human
cuguguccaauggccuuagcag

SEQ ID NO: 527223 - RNA, 22 nt, Human
ucucacacuaaugcucuaucag

SEQ ID NO: 527224 - RNA, 22 nt, Human
cuccuucacgcaggcugccaug

SEQ ID NO: 527225 - RNA, 22 nt, Human
gcagcagugugggcugaaccua

SEQ ID NO: 527226 - RNA, 22 nt, Human
caacauggcgaaaccccaucuc

SEQ ID NO: 527227 - RNA, 22 nt, Human
gaccaggagauuugagcuaggc

SEQ ID NO: 527228 - RNA, 22 nt, Human
gggcagcaucaggaggggcuuu

SEQ ID NO: 527229 - RNA, 22 nt, Human
uugcaaauaauagccugaaacu

SEQ ID NO: 527230 - RNA, 22 nt, Human
ggcagcagaacuggcccuguau

SEQ ID NO: 527231 - RNA, 22 nt, Human
aggcccugcugaggccucccuc

SEQ ID NO: 527232 - RNA, 22 nt, Human
ucucgugcaggccuugcucgga

SEQ ID NO: 527233 - RNA, 22 nt, Human
ggcucuggcgagcuuuaguaca

SEQ ID NO: 527234 - RNA, 22 nt, Human
uggcacugucaccaaugcuguc

SEQ ID NO: 527235 - RNA, 22 nt, Human
gcgguauuugugugggugucga

SEQ ID NO: 527236 - RNA, 20 nt, Human
uugagcagcagugcuguguc

SEQ ID NO: 527237 - RNA, 22 nt, Human
ugcaguccuggugaggggacau

SEQ ID NO: 527238 - RNA, 22 nt, Human
uagcugcacaggaaguaagauu

SEQ ID NO: 527239 - RNA, 22 nt, Human
gaugcugauuuuacuguuuucu

SEQ ID NO: 527240 - RNA, 22 nt, Human
cucucugggcccaguuggcacc

SEQ ID NO: 527241 - RNA, 22 nt, Human
gaggcaaagcauguggcucagg

SEQ ID NO: 527242 - RNA, 22 nt, Human
agccugugaaaucucugccacu

SEQ ID NO: 527243 - RNA, 22 nt, Human
guuugagauggguuauugcucu

SEQ ID NO: 527244 - RNA, 22 nt, Human
ugcccauggcaggauuucugaa

SEQ ID NO: 527245 - RNA, 22 nt, Human
ugaagccagggacugacacuuc

SEQ ID NO: 527246 - RNA, 19 nt, Human
cccuggaggaguguuggcu

SEQ ID NO: 527247 - RNA, 22 nt, Human
uagcagaacaauagucaaugau

SEQ ID NO: 527248 - RNA, 22 nt, Human
uccuggccaaguagauguggcg

SEQ ID NO: 527249 - RNA, 22 nt, Human
acucaucuuugaauuuucagua

SEQ ID NO: 527250 - RNA, 22 nt, Human
cuuccagcugauuggcauccag

SEQ ID NO: 527251 - RNA, 19 nt, Human
ugcucucuggugcuucaug

SEQ ID NO: 527252 - RNA, 22 nt, Human
caaagaugccaaaaggaagaca

SEQ ID NO: 527253 - RNA, 22 nt, Human
ugucaccuugcucauccucgga

SEQ ID NO: 527254 - RNA, 21 nt, Human
ugacaguguggcauggaaggu

SEQ ID NO: 527255 - RNA, 22 nt, Human
caguuuuucaaaauuacaugau

SEQ ID NO: 527256 - RNA, 22 nt, Human
gaugucuggcuaccacucgcac

SEQ ID NO: 527257 - RNA, 22 nt, Human
uugugcccucaaagggugcguc

SEQ ID NO: 527258 - RNA, 22 nt, Human
gggcaugguggcaggcaccugu

SEQ ID NO: 527259 - RNA, 18 nt, Human
gcugaaauucuaaacaaa

SEQ ID NO: 527260 - RNA, 22 nt, Human
agggccacgugcaccgcggucu

SEQ ID NO: 527261 - RNA, 22 nt, Human
acgugcaggaucugguuggcga

SEQ ID NO: 527262 - RNA, 22 nt, Human
ccagcuggaacggcagcccagc

SEQ ID NO: 527263 - RNA, 22 nt, Human
gcccagaguuugaagauacagu

SEQ ID NO: 527264 - RNA, 22 nt, Human
gcacugagcuuuggaggagcag

SEQ ID NO: 527265 - RNA, 21 nt, Human
ugggcucuuuaacccaggcac

SEQ ID NO: 527266 - RNA, 22 nt, Human
ccagagacaaggagcuggaguc

SEQ ID NO: 527267 - RNA, 22 nt, Human
agagcaauuagcuuagguaaaa

SEQ ID NO: 527268 - RNA, 22 nt, Human
aaguccagguccucauuccauc

SEQ ID NO: 527269 - RNA, 22 nt, Human
ggcugagcuuuucaugaugguu

SEQ ID NO: 527270 - RNA, 22 nt, Human
gccaggaugacuauacaacagc

SEQ ID NO: 527271 - RNA, 22 nt, Human
cagugccaaggauggccuggga

SEQ ID NO: 527272 - RNA, 22 nt, Human
gagcucauccccaugguccguc

SEQ ID NO: 527273 - RNA, 22 nt, Human
cucugagguuccuuugcccucg

SEQ ID NO: 527274 - RNA, 22 nt, Human
cguggcucugggcuccuuugcc

SEQ ID NO: 527275 - RNA, 22 nt, Human
aaauucuguccugaaugccauu

SEQ ID NO: 527276 - RNA, 22 nt, Human
uggugcugccaccuccucugcu

SEQ ID NO: 527277 - RNA, 22 nt, Human
ccucugcccuuuuccuguauca

SEQ ID NO: 527278 - RNA, 22 nt, Human
cugucacagcccgcgucuccuc

SEQ ID NO: 527279 - RNA, 21 nt, Human
aggucccagguuugggcagca

SEQ ID NO: 527280 - RNA, 22 nt, Human
ucccagccugacagugcaucaa

SEQ ID NO: 527281 - RNA, 22 nt, Human
agcccugugugcuuguguuccu

SEQ ID NO: 527282 - RNA, 22 nt, Human
ugagacaaagcagcugacagaa

SEQ ID NO: 527283 - RNA, 22 nt, Human
acaugggcaucuaugaggcucu

SEQ ID NO: 527284 - RNA, 22 nt, Human
uggagugcaguugggaggacac

SEQ ID NO: 527285 - RNA, 22 nt, Human
aggccagaacagcucugcacca

SEQ ID NO: 527286 - RNA, 22 nt, Human
gccagcagcgagaguuuaaccu

SEQ ID NO: 527287 - RNA, 22 nt, Human
aaugauguuuuuaaagaacaua

SEQ ID NO: 527288 - RNA, 22 nt, Human
uggaucuugaugcuccaagagu

SEQ ID NO: 527289 - RNA, 22 nt, Human
gagccacaguggauugauucca

SEQ ID NO: 527290 - RNA, 22 nt, Human
cugaggcucugagaaagccaaa

SEQ ID NO: 527291 - RNA, 22 nt, Human
ccugcugaggucagccacccaa

SEQ ID NO: 527292 - RNA, 18 nt, Human
ucagacaaguuagacagg

SEQ ID NO: 527293 - RNA, 22 nt, Human
ucccuggcugguguagagggau

SEQ ID NO: 527294 - RNA, 22 nt, Human
ggugggugagcccugggagcug

SEQ ID NO: 527295 - RNA, 22 nt, Human
uuccaaguuaggcgagcuggug

SEQ ID NO: 527296 - RNA, 22 nt, Human
augacagcucuagcacacagua

SEQ ID NO: 527297 - RNA, 22 nt, Human
gcagagcugguacuugagccug

SEQ ID NO: 527298 - RNA, 22 nt, Human
cgugaugcucaggaggucauag

SEQ ID NO: 527299 - RNA, 22 nt, Human
aauacagugaaagugagcaagg

SEQ ID NO: 527300 - RNA, 22 nt, Human
ccugcgggcugugcugaagccu

SEQ ID NO: 527301 - RNA, 22 nt, Human
gaagaccccagagcgagguaag

SEQ ID NO: 527302 - RNA, 22 nt, Human
uacugucuuuuccuaaaugggu

SEQ ID NO: 527303 - RNA, 22 nt, Human
gccaagaaugcgacagccguca

SEQ ID NO: 527304 - RNA, 22 nt, Human
ccgcuguccuggagcugcugcu

SEQ ID NO: 527305 - RNA, 22 nt, Human
ucuugggcaauuucucuagagg

SEQ ID NO: 527306 - RNA, 22 nt, Human
accaaucuccuauuuuguuuca

SEQ ID NO: 527307 - RNA, 22 nt, Human
cccagccuuugcuuccugguuc

SEQ ID NO: 527308 - RNA, 22 nt, Human
uuacccagugaagccgaggcag

SEQ ID NO: 527309 - RNA, 22 nt, Human
ggagaugccuuguuucaggaac

SEQ ID NO: 527310 - RNA, 17 nt, Human
ucugagaaugcuggagg

SEQ ID NO: 527311 - RNA, 22 nt, Human
gacaaagcgccugcucgcgggc

SEQ ID NO: 527312 - RNA, 21 nt, Human
agggccucuguguacuggggg

SEQ ID NO: 527313 - RNA, 22 nt, Human
cuggcccugucagcacagaauc

SEQ ID NO: 527314 - RNA, 22 nt, Human
caacagcuggaggcuuggcccg

SEQ ID NO: 527315 - RNA, 22 nt, Human
aagguggugaucaucuugaagg

SEQ ID NO: 527316 - RNA, 20 nt, Human
gucagaggacccuagagcga

SEQ ID NO: 527317 - RNA, 22 nt, Human
cagugccauauugaaagacauu

SEQ ID NO: 527318 - RNA, 22 nt, Human
acccacagccgcugugcguccc

SEQ ID NO: 527319 - RNA, 22 nt, Human
gggagggcuuggacccagaugu

SEQ ID NO: 527320 - RNA, 22 nt, Human
gggagggucugagagcugcacc

SEQ ID NO: 527321 - RNA, 22 nt, Human
aaggcacauauuuuagagucac

SEQ ID NO: 527322 - RNA, 22 nt, Human
gugcucuagaaauugucagugg

SEQ ID NO: 527323 - RNA, 22 nt, Human
uggccaggcagguagaacggcc

SEQ ID NO: 527324 - RNA, 22 nt, Human
cagccuuugggucagaagauuc

SEQ ID NO: 527325 - RNA, 22 nt, Human
ccuugagacacagccaaagaug

SEQ ID NO: 527326 - RNA, 22 nt, Human
cugcagggcagggccuccuggc

SEQ ID NO: 527327 - RNA, 22 nt, Human
gucuccugaggcauccauugaa

SEQ ID NO: 527328 - RNA, 22 nt, Human
auuccaaagccugaauaaugga

SEQ ID NO: 527329 - RNA, 22 nt, Human
agcaggugucacuuucacucca

SEQ ID NO: 527330 - RNA, 22 nt, Human
uucagguuuuuaaguucugccu

SEQ ID NO: 527331 - RNA, 22 nt, Human
gggcggggcuuccguccuccac

SEQ ID NO: 527332 - RNA, 22 nt, Human
ggccuugggauguggcugcagc

SEQ ID NO: 527333 - RNA, 22 nt, Human
aggaggguggggucugccuguc

SEQ ID NO: 527334 - RNA, 22 nt, Human
uaaauacuuuuacuccacugau

SEQ ID NO: 527335 - RNA, 22 nt, Human
gcggggacagaaggcgguucuc

SEQ ID NO: 527336 - RNA, 22 nt, Human
gaagaaguguaagucuguuuca

SEQ ID NO: 527337 - RNA, 22 nt, Human
ugacagcccaccucacaggauu

SEQ ID NO: 527338 - RNA, 22 nt, Human
agucagucugcuagccugugga

SEQ ID NO: 527339 - RNA, 22 nt, Human
uguguccuucugggagucccag

SEQ ID NO: 527340 - RNA, 22 nt, Human
uuguaacaguagcugucagcuc

SEQ ID NO: 527341 - RNA, 22 nt, Human
ucuaugucucuggaaggagugu

SEQ ID NO: 527342 - RNA, 19 nt, Human
uugcuucaugucuuuugcu

SEQ ID NO: 527343 - RNA, 22 nt, Human
uauagugucucuagaucaaaga

SEQ ID NO: 527344 - RNA, 23 nt, Human
gggcugcuccaggccaaggcugg

SEQ ID NO: 527345 - RNA, 22 nt, Human
ugaaucaaugaauugcacuuca

SEQ ID NO: 527346 - RNA, 20 nt, Human
aaaaacaguaaugcugaaga

SEQ ID NO: 527347 - RNA, 22 nt, Human
caucaguuccugccccugcccc

SEQ ID NO: 527348 - RNA, 22 nt, Human
cagagcugagucuucaagguug

SEQ ID NO: 527349 - RNA, 19 nt, Human
cugaaacacagagagggcu

SEQ ID NO: 527350 - RNA, 22 nt, Human
cagcuuugccaaguaaggucuu

SEQ ID NO: 527351 - RNA, 22 nt, Human
gugcugagugcagagugcagag

SEQ ID NO: 527352 - RNA, 22 nt, Human
uggcaggaaaaagggccagagg

SEQ ID NO: 527353 - RNA, 22 nt, Human
uggcugagcugcagcguggcuu

SEQ ID NO: 527354 - RNA, 22 nt, Human
uggcccagcucagggugggcgg

SEQ ID NO: 527355 - RNA, 22 nt, Human
ccagguaggagagucaacaugu

SEQ ID NO: 527356 - RNA, 22 nt, Human
cgcugggcgcgcuccgaacccg

SEQ ID NO: 527357 - RNA, 22 nt, Human
uugacccgaguccuucuugggg

SEQ ID NO: 527358 - RNA, 22 nt, Human
agcuggguacacguugucacaa

SEQ ID NO: 527359 - RNA, 22 nt, Human
uuagcaaacaucuucgugugag

SEQ ID NO: 527360 - RNA, 22 nt, Human
ugguccucacccuacccagcug

SEQ ID NO: 527361 - RNA, 22 nt, Human
cagcgguggcaaggugacugug

SEQ ID NO: 527362 - RNA, 22 nt, Human
ugggugguugcugaggcuccuu

SEQ ID NO: 527363 - RNA, 22 nt, Human
uggcucaggccuacgacgccuu

SEQ ID NO: 527364 - RNA, 21 nt, Human
uaggugggagccccaguaugc

SEQ ID NO: 527365 - RNA, 22 nt, Human
cuccccacgccuggacuaagag

SEQ ID NO: 527366 - RNA, 22 nt, Human
agugaaaaccuaaucaugcagu

SEQ ID NO: 527367 - RNA, 22 nt, Human
ucucagucuuugcaaggaugcu

SEQ ID NO: 527368 - RNA, 22 nt, Human
gagcuuggugcugccuguuguc

SEQ ID NO: 527369 - RNA, 22 nt, Human
guugcaaaugggaagaugguua

SEQ ID NO: 527370 - RNA, 22 nt, Human
uccgcgcucucacccgcucccg

SEQ ID NO: 527371 - RNA, 22 nt, Human
cucugccagccaaagucaucac

SEQ ID NO: 527372 - RNA, 18 nt, Human
augggcagguaagaucca

SEQ ID NO: 527373 - RNA, 20 nt, Human
ggacccuggguucuucugag

SEQ ID NO: 527374 - RNA, 22 nt, Human
uccaggagugauaaggccacug

SEQ ID NO: 527375 - RNA, 22 nt, Human
guggacagacauaauccuaauu

SEQ ID NO: 527376 - RNA, 22 nt, Human
agggcagagauuaauuaagaca

SEQ ID NO: 527377 - RNA, 22 nt, Human
ugaaagcucugucaucauuccu

SEQ ID NO: 527378 - RNA, 22 nt, Human
agcagugugggcugcacgcugg

SEQ ID NO: 527379 - RNA, 22 nt, Human
accauccaaacugcuuucugug

SEQ ID NO: 527380 - RNA, 22 nt, Human
cuggcuuuuuucccauuaugca

SEQ ID NO: 527381 - RNA, 22 nt, Human
gcagcugcgcugguguggggca

SEQ ID NO: 527382 - RNA, 22 nt, Human
cuccaggacugaggacagagcu

SEQ ID NO: 527383 - RNA, 22 nt, Human
acaucucacuucuuugaaggcu

SEQ ID NO: 527384 - RNA, 22 nt, Human
cugguuaauccauaaacagaga

SEQ ID NO: 527385 - RNA, 22 nt, Human
ggcucuguaaguguugcaggua

SEQ ID NO: 527386 - RNA, 22 nt, Human
aggccaagcucccagagaagcu

SEQ ID NO: 527387 - RNA, 22 nt, Human
cagagcagcagagcuuccaugg

SEQ ID NO: 527388 - RNA, 22 nt, Human
gcaggccuccccugcuggagcu

SEQ ID NO: 527389 - RNA, 22 nt, Human
uagaagaacaugucaaacuaua

SEQ ID NO: 527390 - RNA, 22 nt, Human
aucccugugacgagcaucccua

SEQ ID NO: 527391 - RNA, 22 nt, Human
caugcaugccgggcugacagag

SEQ ID NO: 527392 - RNA, 22 nt, Human
ccugugucaucagcuguggcua

SEQ ID NO: 527393 - RNA, 22 nt, Human
uuuggcaagcgaguacuuucug

SEQ ID NO: 527394 - RNA, 22 nt, Human
cucccugggccucaguuucucu

SEQ ID NO: 527395 - RNA, 22 nt, Human
ugcagggcagcuagggagcuuu

SEQ ID NO: 527396 - RNA, 22 nt, Human
uucagagcuggugucuacagcu

SEQ ID NO: 527397 - RNA, 22 nt, Human
ccuccccacagcccaggagacu

SEQ ID NO: 527398 - RNA, 22 nt, Human
gggcuguaggagcuggaauggg

SEQ ID NO: 527399 - RNA, 22 nt, Human
ugccgcgcgcccagguuaggug

SEQ ID NO: 527400 - RNA, 22 nt, Human
agguggaguuaagugugaacug

SEQ ID NO: 527401 - RNA, 22 nt, Human
uguuccugacggccaaagaggu

SEQ ID NO: 527402 - RNA, 22 nt, Human
gcuguagguaaggauggcaaag

SEQ ID NO: 527403 - RNA, 22 nt, Human
ucuguggcaugguaucuggagg

SEQ ID NO: 527404 - RNA, 22 nt, Human
gcuucugcagagccguccugag

SEQ ID NO: 527405 - RNA, 22 nt, Human
auccugggaaguggccuccucc

SEQ ID NO: 527406 - RNA, 22 nt, Human
cccuggcucaggcagcuuuguu

SEQ ID NO: 527407 - RNA, 22 nt, Human
gccacccuggacgcacuguucg

SEQ ID NO: 527408 - RNA, 22 nt, Human
ucaggggacagccagcuggagg

SEQ ID NO: 527409 - RNA, 22 nt, Human
uuuguguuggaagaaaugcuac

SEQ ID NO: 527410 - RNA, 20 nt, Human
ugggaucgaaucaagucugu

SEQ ID NO: 527411 - RNA, 22 nt, Human
cauggggaugaggcugagacuu

SEQ ID NO: 527412 - RNA, 22 nt, Human
cuccacagccccuccaguggca

SEQ ID NO: 527413 - RNA, 22 nt, Human
uuugcagagugcagaagcaucu

SEQ ID NO: 527414 - RNA, 22 nt, Human
gugacagguauacucaccauug

SEQ ID NO: 527415 - RNA, 22 nt, Human
ucuucagacuguuguucuuuug

SEQ ID NO: 527416 - RNA, 19 nt, Human
acaguuugggaaaugagca

SEQ ID NO: 527417 - RNA, 22 nt, Human
ccaggcagccaagugugugugu

SEQ ID NO: 527418 - RNA, 17 nt, Human
gcaggcacugcugccug

SEQ ID NO: 527419 - RNA, 23 nt, Human
uggcuugcuaauguuccaaauaa

SEQ ID NO: 527420 - RNA, 22 nt, Human
cacauuuaaagguugaagcuga

SEQ ID NO: 527421 - RNA, 22 nt, Human
ccugucugaaggcagggggaug

SEQ ID NO: 527422 - RNA, 22 nt, Human
caggaggaaaguuccacucaac

SEQ ID NO: 527423 - RNA, 22 nt, Human
gacagcaggaugugaggggaug

SEQ ID NO: 527424 - RNA, 22 nt, Human
ugggaugggaucucgcuguguc

SEQ ID NO: 527425 - RNA, 22 nt, Human
ugccauagcaaugguaagcuga

SEQ ID NO: 527426 - RNA, 22 nt, Human
cacauuuaugggcugggaggca

SEQ ID NO: 527427 - RNA, 22 nt, Human
ugcucccaaaccugacaggcuc

SEQ ID NO: 527428 - RNA, 22 nt, Human
ccacccuuccauucuuccucuu

SEQ ID NO: 527429 - RNA, 22 nt, Human
gcaguugcaggauuuguguugu

SEQ ID NO: 527430 - RNA, 22 nt, Human
uuccaggcgcacgucggccuua

SEQ ID NO: 527431 - RNA, 22 nt, Human
acuccuggguuccggagauucu

SEQ ID NO: 527432 - RNA, 22 nt, Human
ugaaaugccuaugaagucagga

SEQ ID NO: 527433 - RNA, 18 nt, Human
uuugggauccucuuuucu

SEQ ID NO: 527434 - RNA, 22 nt, Human
aauugguuugaauaaauaaaga

SEQ ID NO: 527435 - RNA, 22 nt, Human
cuuggcauguucaucugcuugg

SEQ ID NO: 527436 - RNA, 22 nt, Human
ugugcucagucuuuggcuggga

SEQ ID NO: 527437 - RNA, 22 nt, Human
cucacagcugcuucaggaucca

SEQ ID NO: 527438 - RNA, 22 nt, Human
aggcugcugccuuggagagugu

SEQ ID NO: 527439 - RNA, 16 nt, Human
aggagcuggguaggag

SEQ ID NO: 527440 - RNA, 22 nt, Human
uguguacauguaucaacuaucg

SEQ ID NO: 527441 - RNA, 19 nt, Human
uggcagcauugguaccuug

SEQ ID NO: 527442 - RNA, 22 nt, Human
gcuaggaguggugggucaagga

SEQ ID NO: 527443 - RNA, 22 nt, Human
ggagguggagcuggaaguucca

SEQ ID NO: 527444 - RNA, 21 nt, Human
ggcagcucagcagauggggac

SEQ ID NO: 527445 - RNA, 22 nt, Human
aggcauuuaaagauguaagacu

SEQ ID NO: 527446 - RNA, 22 nt, Human
uagggcuguuaguaauucucag

SEQ ID NO: 527447 - RNA, 22 nt, Human
gagccaggcccguacuugcugu

SEQ ID NO: 527448 - RNA, 22 nt, Human
cagguagaggcugccaucagcu

SEQ ID NO: 527449 - RNA, 22 nt, Human
caugcauuucuaccaaggaaua

SEQ ID NO: 527450 - RNA, 22 nt, Human
ugcugcucuucaccauggccuc

SEQ ID NO: 527451 - RNA, 22 nt, Human
ugauauccuuuaaccuggaccg

SEQ ID NO: 527452 - RNA, 22 nt, Human
cucuggagggaggcugagcugg

SEQ ID NO: 527453 - RNA, 22 nt, Human
aagaagguugaaugacuacuuu

SEQ ID NO: 527454 - RNA, 22 nt, Human
gaugcgggcccgcuccacugcc

SEQ ID NO: 527455 - RNA, 22 nt, Human
acuggcccuggcugcuaggcug

SEQ ID NO: 527456 - RNA, 22 nt, Human
aucuggcucccuuggaauccgu

SEQ ID NO: 527457 - RNA, 22 nt, Human
acagcugggaacucacacagca

SEQ ID NO: 527458 - RNA, 22 nt, Human
uaucacauacuucucauccagg

SEQ ID NO: 527459 - RNA, 22 nt, Human
acaugcacagcaagggugagag

SEQ ID NO: 527460 - RNA, 22 nt, Human
agccccaggcccggacgccucu

SEQ ID NO: 527461 - RNA, 22 nt, Human
gagcugcagcggcugacgcaac

SEQ ID NO: 527462 - RNA, 22 nt, Human
agagaauuaacauuccauggcu

SEQ ID NO: 527463 - RNA, 19 nt, Human
gggucccacugcccgucug

SEQ ID NO: 527464 - RNA, 22 nt, Human
gguguugcaguugaagacuggu

SEQ ID NO: 527465 - RNA, 22 nt, Human
aaggcccacagaacugucucca

SEQ ID NO: 527466 - RNA, 22 nt, Human
uccagagaacgaugaaagcugg

SEQ ID NO: 527467 - RNA, 22 nt, Human
ccaaggcuggagggcuuaugua

SEQ ID NO: 527468 - RNA, 22 nt, Human
gucacccguuugacuauccacc

SEQ ID NO: 527469 - RNA, 20 nt, Human
gacuucaauuucuaucuuuu

SEQ ID NO: 527470 - RNA, 22 nt, Human
cugguuuuuagugcuuaggagu

SEQ ID NO: 527471 - RNA, 22 nt, Human
uuguacuuaaauaugcaaauag

SEQ ID NO: 527472 - RNA, 22 nt, Human
cccagaggcugaguugggagca

SEQ ID NO: 527473 - RNA, 22 nt, Human
cuguccauggcaaugaugcaga

SEQ ID NO: 527474 - RNA, 22 nt, Human
gagguggcugcuugcugggaaa

SEQ ID NO: 527475 - RNA, 22 nt, Human
gggcucuguuuagaccagagau

SEQ ID NO: 527476 - RNA, 20 nt, Human
uuucacaaugaacaugucuc

SEQ ID NO: 527477 - RNA, 22 nt, Human
gcugauggcuugcuggcugaca

SEQ ID NO: 527478 - RNA, 22 nt, Human
gaccacaguccagucaucaugg

SEQ ID NO: 527479 - RNA, 22 nt, Human
acagaagugacaauuucuuggg

SEQ ID NO: 527480 - RNA, 22 nt, Human
gcucagugaagggugccaagua

SEQ ID NO: 527481 - RNA, 20 nt, Human
ccuggagccuggaaggaguc

SEQ ID NO: 527482 - RNA, 19 nt, Human
ccugcugaagugaugcagc

SEQ ID NO: 527483 - RNA, 22 nt, Human
augcccucuguuucccaaggcc

SEQ ID NO: 527484 - RNA, 18 nt, Human
ccucuggguuuuguuccc

SEQ ID NO: 527485 - RNA, 19 nt, Human
agcagagcagggccguggg

SEQ ID NO: 527486 - RNA, 22 nt, Human
acagacacaggcguggagucgc

SEQ ID NO: 527487 - RNA, 22 nt, Human
uucagucuuguugaaaacuugg

SEQ ID NO: 527488 - RNA, 22 nt, Human
augaaacaacagacuuggucaa

SEQ ID NO: 527489 - RNA, 22 nt, Human
ugagaagcaguuucaguaagaa

SEQ ID NO: 527490 - RNA, 22 nt, Human
guuguacauaugaggauaaguu

SEQ ID NO: 527491 - RNA, 22 nt, Human
cggcuggagcugagaaaggagc

SEQ ID NO: 527492 - RNA, 22 nt, Human
ugagaacaaaguugaaaguuug

SEQ ID NO: 527493 - RNA, 22 nt, Human
ucuuugcauggacauguguuuu

SEQ ID NO: 527494 - RNA, 22 nt, Human
uagcaggacaugugcagagaag

SEQ ID NO: 527495 - RNA, 22 nt, Human
ucccacagcuucgugcuucccc

SEQ ID NO: 527496 - RNA, 22 nt, Human
gaggcugaacagguucucauga

SEQ ID NO: 527497 - RNA, 22 nt, Human
uuccaauaaaauguuauuugca

SEQ ID NO: 527498 - RNA, 22 nt, Human
cugcauaucaaauuacuccugg

SEQ ID NO: 527499 - RNA, 22 nt, Human
agcuggugauguggucccucac

SEQ ID NO: 527500 - RNA, 22 nt, Human
aguguguccaggaagcagaugg

SEQ ID NO: 527501 - RNA, 22 nt, Human
augcacacguacccuacaaggc

SEQ ID NO: 527502 - RNA, 22 nt, Human
uccugaaggccugaguuccacc

SEQ ID NO: 527503 - RNA, 22 nt, Human
ugaggauggaaugcugugcaag

SEQ ID NO: 527504 - RNA, 17 nt, Human
gccuggcccagccuggc

SEQ ID NO: 527505 - RNA, 22 nt, Human
aguggcaguagaugagcugguu

SEQ ID NO: 527506 - RNA, 22 nt, Human
gguccagcacaacacuggcaug

SEQ ID NO: 527507 - RNA, 19 nt, Human
acucaggcuuccucugagg

SEQ ID NO: 527508 - RNA, 19 nt, Human
ugguucuccuuccacaguc

SEQ ID NO: 527509 - RNA, 22 nt, Human
ccacuguuggcccgaagggguc

SEQ ID NO: 527510 - RNA, 22 nt, Human
gccccucuccuugugcaccugc

SEQ ID NO: 527511 - RNA, 22 nt, Human
ucccuguccugggcaaucccag

SEQ ID NO: 527512 - RNA, 22 nt, Human
uggcagccugcgugaaggagcu

SEQ ID NO: 527513 - RNA, 22 nt, Human
aaaugcacaauaaaguaaaggc

SEQ ID NO: 527514 - RNA, 22 nt, Human
aggucacguccugugaugucau

SEQ ID NO: 527515 - RNA, 23 nt, Human
guuauugcuggugcuggccagcc

SEQ ID NO: 527516 - RNA, 22 nt, Human
cccagccucuggguucugccgg

SEQ ID NO: 527517 - RNA, 22 nt, Human
uuuccaaggaugugucucucua

SEQ ID NO: 527518 - RNA, 22 nt, Human
cucccagccuucgccagucuga

SEQ ID NO: 527519 - RNA, 22 nt, Human
uccugaccacuaggaccaggcu

SEQ ID NO: 527520 - RNA, 19 nt, Human
cugggacaaugaaagcauc

SEQ ID NO: 527521 - RNA, 22 nt, Human
auaggacuuuguaucaggauga

SEQ ID NO: 527522 - RNA, 22 nt, Human
ucaauuuauguggcuauucauu

SEQ ID NO: 527523 - RNA, 22 nt, Human
ucaugcaccucuccaugucccc

SEQ ID NO: 527524 - RNA, 21 nt, Human
uagaccagcugugcuccucgg

SEQ ID NO: 527525 - RNA, 19 nt, Human
cucuggcuccugggcugcc

SEQ ID NO: 527526 - RNA, 18 nt, Human
cugccagugugcucuccg

SEQ ID NO: 527527 - RNA, 22 nt, Human
ccuacucccuuucuagaguaug

SEQ ID NO: 527528 - RNA, 22 nt, Human
gaugugucccuuucaacucaga

SEQ ID NO: 527529 - RNA, 22 nt, Human
caguguuuagcacagugcuugg

SEQ ID NO: 527530 - RNA, 22 nt, Human
gaucuguccuggcaguuaacac

SEQ ID NO: 527531 - RNA, 22 nt, Human
ugagcauuaccugaggccacug

SEQ ID NO: 527532 - RNA, 22 nt, Human
uggaaaauauuuaggugaauga

SEQ ID NO: 527533 - RNA, 21 nt, Human
agggaaaaggcugagugaggg

SEQ ID NO: 527534 - RNA, 22 nt, Human
cugccaucugagccaaaagugc

SEQ ID NO: 527535 - RNA, 22 nt, Human
cagaggccuggcuuggacaccu

SEQ ID NO: 527536 - RNA, 22 nt, Human
agccacugugugaccagcuguc

SEQ ID NO: 527537 - RNA, 22 nt, Human
aaaucaugguggaagaaacaga

SEQ ID NO: 527538 - RNA, 22 nt, Human
ucacuuuaccucauucaggcag

SEQ ID NO: 527539 - RNA, 22 nt, Human
ucaccgccuugcccggccgggc

SEQ ID NO: 527540 - RNA, 22 nt, Human
aaucuucaggguccuggggcuc

SEQ ID NO: 527541 - RNA, 22 nt, Human
acagccaggaauucuggagaag

SEQ ID NO: 527542 - RNA, 20 nt, Human
ggcagagcuaugucuguugc

SEQ ID NO: 527543 - RNA, 20 nt, Human
gcagcagacagacaggggac

SEQ ID NO: 527544 - RNA, 18 nt, Human
uucggcagauacgcuugg

SEQ ID NO: 527545 - RNA, 22 nt, Human
cuugaggcugcacuccagggcc

SEQ ID NO: 527546 - RNA, 22 nt, Human
uguuggcagugcuacagucagu

SEQ ID NO: 527547 - RNA, 22 nt, Human
gucaggaugagggaugaggagu

SEQ ID NO: 527548 - RNA, 22 nt, Human
uaucuguauucugacagucacu

SEQ ID NO: 527549 - RNA, 22 nt, Human
uuggccguuucacugggcaguu

SEQ ID NO: 527550 - RNA, 22 nt, Human
ucuucacaguccuggucagugg

SEQ ID NO: 527551 - RNA, 22 nt, Human
ugcccugcagacccugcagugu

SEQ ID NO: 527552 - RNA, 22 nt, Human
gcagauggauguggacggcgcc

SEQ ID NO: 527553 - RNA, 22 nt, Human
ccgggagguggagauugcggug

SEQ ID NO: 527554 - RNA, 22 nt, Human
ugggcccaucauugcugugggc

SEQ ID NO: 527555 - RNA, 22 nt, Human
ucacccagacugucugacucuu

SEQ ID NO: 527556 - RNA, 22 nt, Human
gggucugcuccaccugcagccc

SEQ ID NO: 527557 - RNA, 22 nt, Human
aguggcagggacuucauauaaa

SEQ ID NO: 527558 - RNA, 22 nt, Human
cuaagaaggaggaaaagugcca

SEQ ID NO: 527559 - RNA, 22 nt, Human
uccagaugcugcacauuccuga

SEQ ID NO: 527560 - RNA, 22 nt, Human
gagauuuccauauuuuguaaca

SEQ ID NO: 527561 - RNA, 22 nt, Human
uccuggggaggucgaggcugag

SEQ ID NO: 527562 - RNA, 19 nt, Human
agcagccaucgaccaugga

SEQ ID NO: 527563 - RNA, 21 nt, Human
ccaccaggucuucugcucggg

SEQ ID NO: 527564 - RNA, 21 nt, Human
ugcaaugcauugacagcagca

SEQ ID NO: 527565 - RNA, 22 nt, Human
agccaccaccacugaaagguua

SEQ ID NO: 527566 - RNA, 22 nt, Human
cuuugcagagggggugggagcu

SEQ ID NO: 527567 - RNA, 22 nt, Human
uuuauucucuaguuggucagau

SEQ ID NO: 527568 - RNA, 19 nt, Human
aaugcugcuucuuuuugca

SEQ ID NO: 527569 - RNA, 21 nt, Human
ccuuugaguguguuugaagua

SEQ ID NO: 527570 - RNA, 22 nt, Human
aagguccuguagccacagagcc

SEQ ID NO: 527571 - RNA, 22 nt, Human
cuggagggcugcagcgaggcug

SEQ ID NO: 527572 - RNA, 22 nt, Human
gucaggggccaugggccaagga

SEQ ID NO: 527573 - RNA, 22 nt, Human
caccgagugacaguagccauca

SEQ ID NO: 527574 - RNA, 22 nt, Human
aucagaagaaauggaugugacu

SEQ ID NO: 527575 - RNA, 22 nt, Human
aagaggaggacgguucccagaa

SEQ ID NO: 527576 - RNA, 22 nt, Human
acugaaauuuauauuuugggca

SEQ ID NO: 527577 - RNA, 22 nt, Human
gccugcuggcuggaaauucucc

SEQ ID NO: 527578 - RNA, 22 nt, Human
uggucccuagugugggagcuug

SEQ ID NO: 527579 - RNA, 22 nt, Human
ccaaacauuucaaauuuagaga

SEQ ID NO: 527580 - RNA, 22 nt, Human
uggcuggggccugaauccugca

SEQ ID NO: 527581 - RNA, 22 nt, Human
uggcuccaggggacacgcagua

SEQ ID NO: 527582 - RNA, 21 nt, Human
ucuccucccggggagaggccg

SEQ ID NO: 527583 - RNA, 22 nt, Human
gggagcuggagcuggaagacuc

SEQ ID NO: 527584 - RNA, 22 nt, Human
ucaccccuugugaaugcugcuc

SEQ ID NO: 527585 - RNA, 22 nt, Human
ugcagaauauucuggugacaau

SEQ ID NO: 527586 - RNA, 22 nt, Human
agucaacauuugagaugcaaug

SEQ ID NO: 527587 - RNA, 19 nt, Human
acccucuccccacuggguc

SEQ ID NO: 527588 - RNA, 22 nt, Human
ucagccaggccaggcauucaca

SEQ ID NO: 527589 - RNA, 19 nt, Human
gggaaugauggaagacuuc

SEQ ID NO: 527590 - RNA, 22 nt, Human
ccccaacccugguuccguggcg

SEQ ID NO: 527591 - RNA, 22 nt, Human
cugggaagggacgccagugccu

SEQ ID NO: 527592 - RNA, 22 nt, Human
ugaaauguggagaugguaagua

SEQ ID NO: 527593 - RNA, 22 nt, Human
ccugugcaugccaggguacacc

SEQ ID NO: 527594 - RNA, 22 nt, Human
ucaugucccguugcuggcugcc

SEQ ID NO: 527595 - RNA, 22 nt, Human
ugagaagcauuaggaagaacau

SEQ ID NO: 527596 - RNA, 22 nt, Human
caggguggaacaggcaauacuu

SEQ ID NO: 527597 - RNA, 22 nt, Human
cuguuuauucucaucuaaaaug

SEQ ID NO: 527598 - RNA, 22 nt, Human
ggaagcaaauuccagaaccaca

SEQ ID NO: 527599 - RNA, 22 nt, Human
augaucaagaauuuuguauucc

SEQ ID NO: 527600 - RNA, 22 nt, Human
acuggaaaguauucuuucacug

SEQ ID NO: 527601 - RNA, 22 nt, Human
acaacuuuaauggguuucagcu

SEQ ID NO: 527602 - RNA, 21 nt, Human
ucucugacccaggaagagggc

SEQ ID NO: 527603 - RNA, 22 nt, Human
ucucaguccaaaugagagguug

SEQ ID NO: 527604 - RNA, 21 nt, Human
gcuccuggugcugcguggcgc

SEQ ID NO: 527605 - RNA, 22 nt, Human
cagugcccuuccaggacugcag

SEQ ID NO: 527606 - RNA, 22 nt, Human
gugggaguggagcucagcaugu

SEQ ID NO: 527607 - RNA, 23 nt, Human
gguuggcuguacccaggcucccu

SEQ ID NO: 527608 - RNA, 22 nt, Human
ucugcuggaaaaccagggaauu

SEQ ID NO: 527609 - RNA, 22 nt, Human
uuaggcauccugucccuggauu

SEQ ID NO: 527610 - RNA, 22 nt, Human
agcuggguguagggcuggacaa

SEQ ID NO: 527611 - RNA, 22 nt, Human
uggcccagaucucugaccuuga

SEQ ID NO: 527612 - RNA, 22 nt, Human
ccugugauauuguucauaauau

SEQ ID NO: 527613 - RNA, 18 nt, Human
gguccugggccuggcuca

SEQ ID NO: 527614 - RNA, 22 nt, Human
acccagcucuuugauggucuug

SEQ ID NO: 527615 - RNA, 22 nt, Human
agaauguaagaaugcaaagauu

SEQ ID NO: 527616 - RNA, 22 nt, Human
gaggaggcuuccgggaggcacg

SEQ ID NO: 527617 - RNA, 22 nt, Human
cucucuccuuagcugcagacca

SEQ ID NO: 527618 - RNA, 22 nt, Human
cacagagagcuacgugcagcgu

SEQ ID NO: 527619 - RNA, 18 nt, Human
augcucuagucuuuccug

SEQ ID NO: 527620 - RNA, 22 nt, Human
cuggcccagguggucguugagg

SEQ ID NO: 527621 - RNA, 23 nt, Human
uugguuacuggauuugaggggcc

SEQ ID NO: 527622 - RNA, 22 nt, Human
ucugggccggagccgacggcag

SEQ ID NO: 527623 - RNA, 22 nt, Human
gccuggcgccgggcugccuguc

SEQ ID NO: 527624 - RNA, 22 nt, Human
uguucauucugugaccugguuc

SEQ ID NO: 527625 - RNA, 22 nt, Human
ccucuuccacugggccccaucc

SEQ ID NO: 527626 - RNA, 22 nt, Human
agagcagaggcauggccguggg

SEQ ID NO: 527627 - RNA, 22 nt, Human
gcccaguggcaucuucacugcu

SEQ ID NO: 527628 - RNA, 22 nt, Human
aggcucaguauagcuggcaagu

SEQ ID NO: 527629 - RNA, 22 nt, Human
ugugcccuccugccaggggcug

SEQ ID NO: 527630 - RNA, 17 nt, Human
aguuuuuggaccugugu

SEQ ID NO: 527631 - RNA, 17 nt, Human
ggugaguguccaggugg

SEQ ID NO: 527632 - RNA, 22 nt, Human
gagggcucaacuacuacuaggc

SEQ ID NO: 527633 - RNA, 22 nt, Human
cacgugcaggucuuaggagaca

SEQ ID NO: 527634 - RNA, 22 nt, Human
uuccaggccgggcaggaaacac

SEQ ID NO: 527635 - RNA, 22 nt, Human
ugagcagacuugaugaggcagc

SEQ ID NO: 527636 - RNA, 22 nt, Human
uuaaaagaauccuguuauccuc

SEQ ID NO: 527637 - RNA, 22 nt, Human
ccugguuugggugccagugagu

SEQ ID NO: 527638 - RNA, 22 nt, Human
uuuucaguuccaucucugcucu

SEQ ID NO: 527639 - RNA, 22 nt, Human
ucaccuguuggauguauacugu

SEQ ID NO: 527640 - RNA, 22 nt, Human
ucccgggcaggucgagcgagcc

SEQ ID NO: 527641 - RNA, 23 nt, Human
guguggccccagggccuccucgc

SEQ ID NO: 527642 - RNA, 22 nt, Human
cugcucaauuccggcacgcugg

SEQ ID NO: 527643 - RNA, 22 nt, Human
gcccagcaccucucucaggguu

SEQ ID NO: 527644 - RNA, 22 nt, Human
acagugcaaauaggacugucuu

SEQ ID NO: 527645 - RNA, 22 nt, Human
cagggaugggauggagucaguu

SEQ ID NO: 527646 - RNA, 22 nt, Human
acagcagguuauuguuauggca

SEQ ID NO: 527647 - RNA, 22 nt, Human
ccuggguccaauucuggcuugu

SEQ ID NO: 527648 - RNA, 22 nt, Human
caacuuuagaccccaaguagcu

SEQ ID NO: 527649 - RNA, 22 nt, Human
ggccccagggauuaggccaacc

SEQ ID NO: 527650 - RNA, 22 nt, Human
cagggucuuggcgccaucaccc

SEQ ID NO: 527651 - RNA, 22 nt, Human
cauuuugugcuagacacuaugg

SEQ ID NO: 527652 - RNA, 22 nt, Human
agggcccuagggaaugagacau

SEQ ID NO: 527653 - RNA, 22 nt, Human
ggcggcacgcaggcugcugucg

SEQ ID NO: 527654 - RNA, 22 nt, Human
gcagcagaaggccaaggggagc

SEQ ID NO: 527655 - RNA, 22 nt, Human
uggcagaaugaagacuggggcc

SEQ ID NO: 527656 - RNA, 22 nt, Human
ugagccuggccugcagagacca

SEQ ID NO: 527657 - RNA, 22 nt, Human
cagggagaucuuggcuccuggu

SEQ ID NO: 527658 - RNA, 20 nt, Human
caauaauuuacuucccuauu

SEQ ID NO: 527659 - RNA, 22 nt, Human
aaagcugcaagcuccugaggaa

SEQ ID NO: 527660 - RNA, 22 nt, Human
ucauuccuccagcgggagucca

SEQ ID NO: 527661 - RNA, 22 nt, Human
aaugucaacacaagagaaaugc

SEQ ID NO: 527662 - RNA, 22 nt, Human
gucuguggaguugcuugcugga

SEQ ID NO: 527663 - RNA, 22 nt, Human
aguuggcauuuuauuuaaguau

SEQ ID NO: 527664 - RNA, 22 nt, Human
uuagcacccugauacuagaaug

SEQ ID NO: 527665 - RNA, 22 nt, Human
ugucuuaugcugcauagacuau

SEQ ID NO: 527666 - RNA, 22 nt, Human
ccccagcagacucagggcaggu

SEQ ID NO: 527667 - RNA, 22 nt, Human
guucuucaggcugugcucuaga

SEQ ID NO: 527668 - RNA, 22 nt, Human
uuugugcaagagggccaccuua

SEQ ID NO: 527669 - RNA, 22 nt, Human
ugcaaauucuuuacucugugau

SEQ ID NO: 527670 - RNA, 22 nt, Human
cuccguggcuguggacgcagcc

SEQ ID NO: 527671 - RNA, 22 nt, Human
aggcuccaugguucucccucag

SEQ ID NO: 527672 - RNA, 22 nt, Human
accucccuaacccuuuuggcuc

SEQ ID NO: 527673 - RNA, 23 nt, Human
uggcucugagcuuccugguggcc

SEQ ID NO: 527674 - RNA, 22 nt, Human
agguuuggguucauugcuggcu

SEQ ID NO: 527675 - RNA, 22 nt, Human
auaacugagugagcagcgacuc

SEQ ID NO: 527676 - RNA, 22 nt, Human
uguacacauuaagcucuuuaga

SEQ ID NO: 527677 - RNA, 22 nt, Human
auacaggaugcugaacaucucu

SEQ ID NO: 527678 - RNA, 22 nt, Human
auuucagaguagaucguuauuu

SEQ ID NO: 527679 - RNA, 22 nt, Human
uccagugguggcucccggaccu

SEQ ID NO: 527680 - RNA, 22 nt, Human
gccugagauuggacauuauuua

SEQ ID NO: 527681 - RNA, 22 nt, Human
ucccugagcucacauggcagga

SEQ ID NO: 527682 - RNA, 22 nt, Human
cuggagccggcgagccccagcc

SEQ ID NO: 527683 - RNA, 22 nt, Human
ucuccucuauuucuguauguau

SEQ ID NO: 527684 - RNA, 21 nt, Human
ucugaugguagaugagaugug

SEQ ID NO: 527685 - RNA, 22 nt, Human
ucugcacccugugguccucuag

SEQ ID NO: 527686 - RNA, 22 nt, Human
cuggcagcugcccgagaugccc

SEQ ID NO: 527687 - RNA, 17 nt, Human
gugagcugagucaggac

SEQ ID NO: 527688 - RNA, 22 nt, Human
gucauuuuugacuuugaaguga

SEQ ID NO: 527689 - RNA, 22 nt, Human
uucacagaauugucuugacugg

SEQ ID NO: 527690 - RNA, 22 nt, Human
ccaucuucucuugaaccuccuu

SEQ ID NO: 527691 - RNA, 22 nt, Human
uccgguccggguacuccucucu

SEQ ID NO: 527692 - RNA, 22 nt, Human
acugggccaggugugggugagu

SEQ ID NO: 527693 - RNA, 22 nt, Human
acaaaugcuuaguucaccaaaa

SEQ ID NO: 527694 - RNA, 22 nt, Human
uaaaguuggaccugauuuuauu

SEQ ID NO: 527695 - RNA, 22 nt, Human
cucagcucauuguggauccggu

SEQ ID NO: 527696 - RNA, 22 nt, Human
ugcuggaagggucggcgugggc

SEQ ID NO: 527697 - RNA, 22 nt, Human
aagcaaaagguuacacuucugg

SEQ ID NO: 527698 - RNA, 22 nt, Human
aaacaucuucucuugauucuuu

SEQ ID NO: 527699 - RNA, 21 nt, Human
acugggcuagccugacuucug

SEQ ID NO: 527700 - RNA, 22 nt, Human
ugggaugagcuauauagaaagu

SEQ ID NO: 527701 - RNA, 18 nt, Human
uccaccgcgugcaccucu

SEQ ID NO: 527702 - RNA, 22 nt, Human
agauauguuaggcuuguucccu

SEQ ID NO: 527703 - RNA, 22 nt, Human
uagcuguucucuguaaauugga

SEQ ID NO: 527704 - RNA, 22 nt, Human
ccaggaggaaagaccagcccau

SEQ ID NO: 527705 - RNA, 22 nt, Human
ugucccuggacuccaggagcca

SEQ ID NO: 527706 - RNA, 22 nt, Human
uaagcuauuccugaagaagguu

SEQ ID NO: 527707 - RNA, 22 nt, Human
ccuuugagccugggcgcggacc

SEQ ID NO: 527708 - RNA, 22 nt, Human
gcugcagggagcuggaaggcuc

SEQ ID NO: 527709 - RNA, 22 nt, Human
uuugggcuguacaauuucugua

SEQ ID NO: 527710 - RNA, 23 nt, Human
uggugggcccugcuugcucacug

SEQ ID NO: 527711 - RNA, 22 nt, Human
aagagcuggcucuugcagcagc

SEQ ID NO: 527712 - RNA, 22 nt, Human
ucaggagaguguucaguggagg

SEQ ID NO: 527713 - RNA, 21 nt, Human
cuggagcuuggugagaagugu

SEQ ID NO: 527714 - RNA, 22 nt, Human
accaagaguccaagugagguug

SEQ ID NO: 527715 - RNA, 17 nt, Human
agcuuggagcagcauga

SEQ ID NO: 527716 - RNA, 22 nt, Human
uucucacguuauuggcugagag

SEQ ID NO: 527717 - RNA, 22 nt, Human
aaguuacaggagaaagagauca

SEQ ID NO: 527718 - RNA, 22 nt, Human
uggggcuccuccuggcaggagg

SEQ ID NO: 527719 - RNA, 22 nt, Human
uacuuucuagcucuccccaguu

SEQ ID NO: 527720 - RNA, 22 nt, Human
cacccucaagcaguggcacgug

SEQ ID NO: 527721 - RNA, 22 nt, Human
augccuguuugaaauuggaccu

SEQ ID NO: 527722 - RNA, 22 nt, Human
caucugcaggggaagccaguuu

SEQ ID NO: 527723 - RNA, 22 nt, Human
cagcaguacuucucagagguau

SEQ ID NO: 527724 - RNA, 22 nt, Human
ggcgcaguugagcgugcuguuc

SEQ ID NO: 527725 - RNA, 22 nt, Human
acaagguugauucuggcaucug

SEQ ID NO: 527726 - RNA, 22 nt, Human
uuugcaaaguccauugaaguua

SEQ ID NO: 527727 - RNA, 22 nt, Human
cuggcuuuuggaggagggucag

SEQ ID NO: 527728 - RNA, 22 nt, Human
ggccagccuggggcucccagac

SEQ ID NO: 527729 - RNA, 22 nt, Human
aaagaggcucaaggugggccag

SEQ ID NO: 527730 - RNA, 22 nt, Human
gggaggaaggcuugggugagua

SEQ ID NO: 527731 - RNA, 22 nt, Human
aaaugcacugaauauuccaaau

SEQ ID NO: 527732 - RNA, 22 nt, Human
gcguuggggaccccgaagcugg

SEQ ID NO: 527733 - RNA, 22 nt, Human
gugcuggggagauaggaagaga

SEQ ID NO: 527734 - RNA, 22 nt, Human
gaaguauuucugaguugcccag

SEQ ID NO: 527735 - RNA, 22 nt, Human
cccuugagguagacugaacacc

SEQ ID NO: 527736 - RNA, 22 nt, Human
cugagcagaagggugcacgugc

SEQ ID NO: 527737 - RNA, 22 nt, Human
auuucagcagcccauguuugga

SEQ ID NO: 527738 - RNA, 22 nt, Human
uggggugccgacagggagggca

SEQ ID NO: 527739 - RNA, 22 nt, Human
gcauaaaggacuauaaggauca

SEQ ID NO: 527740 - RNA, 22 nt, Human
aagcucucuguccccuggacug

SEQ ID NO: 527741 - RNA, 22 nt, Human
caggacagaaauaaggaauaua

SEQ ID NO: 527742 - RNA, 22 nt, Human
cucagugaauuggaggauggcc

SEQ ID NO: 527743 - RNA, 22 nt, Human
cuguucccgguggccgggccag

SEQ ID NO: 527744 - RNA, 22 nt, Human
cgaggagugugaaggcuugucg

SEQ ID NO: 527745 - RNA, 22 nt, Human
agagaugcuguggguagaggca

SEQ ID NO: 527746 - RNA, 22 nt, Human
auggucacuucacccaugagcu

SEQ ID NO: 527747 - RNA, 22 nt, Human
aagcagggugucuugacccaug

SEQ ID NO: 527748 - RNA, 22 nt, Human
aacacugugcccacccuagucc

SEQ ID NO: 527749 - RNA, 22 nt, Human
guggccuccuccguccgccucu

SEQ ID NO: 527750 - RNA, 22 nt, Human
agucagcuugucucuaggguug

SEQ ID NO: 527751 - RNA, 22 nt, Human
uacucugcaggauggacuaugg

SEQ ID NO: 527752 - RNA, 22 nt, Human
auggccugcagugcugccacag

SEQ ID NO: 527753 - RNA, 22 nt, Human
uugagcagaucgggcugugggg

SEQ ID NO: 527754 - RNA, 20 nt, Human
gcugugccaugacccucgag

SEQ ID NO: 527755 - RNA, 22 nt, Human
cccugccuacaggguuuucuuu

SEQ ID NO: 527756 - RNA, 22 nt, Human
aggagggagcuuaagccaggca

SEQ ID NO: 527757 - RNA, 22 nt, Human
uucccuucuaguuuugagagac

SEQ ID NO: 527758 - RNA, 22 nt, Human
augagagcugaugacuuuacaa

SEQ ID NO: 527759 - RNA, 22 nt, Human
cuaccugguacauagaaauguu

SEQ ID NO: 527760 - RNA, 20 nt, Human
ugugugaauuagggcauguu

SEQ ID NO: 527761 - RNA, 22 nt, Human
ucagaagcauguggggagccug

SEQ ID NO: 527762 - RNA, 18 nt, Human
ucaguccuccauagagcu

SEQ ID NO: 527763 - RNA, 22 nt, Human
gccagaggggcucgaaggcgcg

SEQ ID NO: 527764 - RNA, 22 nt, Human
gcugcaggcucugcaggaauug

SEQ ID NO: 527765 - RNA, 22 nt, Human
augaagcugguuuuggcuuggg

SEQ ID NO: 527766 - RNA, 22 nt, Human
ugaagacaguuuuacucaugag

SEQ ID NO: 527767 - RNA, 22 nt, Human
ugccuaggcuggaaugcagugg

SEQ ID NO: 527768 - RNA, 22 nt, Human
cugggucccggcuucuauccac

SEQ ID NO: 527769 - RNA, 21 nt, Human
gcagcaugagaaagccccaaa

SEQ ID NO: 527770 - RNA, 22 nt, Human
auguuuguguuucccauucagg

SEQ ID NO: 527771 - RNA, 22 nt, Human
gacacuacguggcucacauuuc

SEQ ID NO: 527772 - RNA, 18 nt, Human
auuugcaggcaugcaggc

SEQ ID NO: 527773 - RNA, 22 nt, Human
auuuggcauaggcagaggccca

SEQ ID NO: 527774 - RNA, 18 nt, Human
gccuggcuucggagccgc

SEQ ID NO: 527775 - RNA, 22 nt, Human
uuauuuaaaagugguaagauuc

SEQ ID NO: 527776 - RNA, 22 nt, Human
ggcucucuuaacuggccauccu

SEQ ID NO: 527777 - RNA, 22 nt, Human
uccugugccuccaccugcuccg

SEQ ID NO: 527778 - RNA, 22 nt, Human
caggaugccuuugaacucugga

SEQ ID NO: 527779 - RNA, 20 nt, Human
ggucacuguggcugcaggau

SEQ ID NO: 527780 - RNA, 22 nt, Human
cagcucugguuccugggcccag

SEQ ID NO: 527781 - RNA, 21 nt, Human
uggcaggcagcuggaagcuug

SEQ ID NO: 527782 - RNA, 22 nt, Human
ugggugugagcccgggagccgc

SEQ ID NO: 527783 - RNA, 22 nt, Human
uccgggagcugaacgucuugcg

SEQ ID NO: 527784 - RNA, 19 nt, Human
ggcugccuucugcucaucu

SEQ ID NO: 527785 - RNA, 22 nt, Human
ggugggucuuguggggcagcuu

SEQ ID NO: 527786 - RNA, 22 nt, Human
uccagcucugcugugcgccggu

SEQ ID NO: 527787 - RNA, 22 nt, Human
aaucugagggaacuugaacucc

SEQ ID NO: 527788 - RNA, 22 nt, Human
ggcucagaaaccucuggugucu

SEQ ID NO: 527789 - RNA, 22 nt, Human
agcauggcuuuggaggauagca

SEQ ID NO: 527790 - RNA, 22 nt, Human
uugggugcugucauggggcacg

SEQ ID NO: 527791 - RNA, 22 nt, Human
ggggucacacuguggugacugg

SEQ ID NO: 527792 - RNA, 21 nt, Human
uacaucaguuuucuuggcuca

SEQ ID NO: 527793 - RNA, 22 nt, Human
ucuguagcauucaccagcccug

SEQ ID NO: 527794 - RNA, 22 nt, Human
uacucuggaguugagaugcgag

SEQ ID NO: 527795 - RNA, 22 nt, Human
cucccagggucuaggcugcugg

SEQ ID NO: 527796 - RNA, 22 nt, Human
gcagagcuggaacugguacuca

SEQ ID NO: 527797 - RNA, 22 nt, Human
agggaagcagcagccgccuguc

SEQ ID NO: 527798 - RNA, 22 nt, Human
cuggagcagcagguggccaggg

SEQ ID NO: 527799 - RNA, 22 nt, Human
cuagagaaaaagcuuagguacg

SEQ ID NO: 527800 - RNA, 22 nt, Human
gccagccccagacauccuaucg

SEQ ID NO: 527801 - RNA, 22 nt, Human
ugcaggccuggacugauguggu

SEQ ID NO: 527802 - RNA, 22 nt, Human
cugaggagauccccccagaagu

SEQ ID NO: 527803 - RNA, 22 nt, Human
ccucaaaggccuggcaccagaa

SEQ ID NO: 527804 - RNA, 19 nt, Human
ugguggaggccccauguuc

SEQ ID NO: 527805 - RNA, 22 nt, Human
uaggugucuggacaacuuugua

SEQ ID NO: 527806 - RNA, 22 nt, Human
cuggagcucuguguguuccuga

SEQ ID NO: 527807 - RNA, 18 nt, Human
cuggucucccuucgcuuu

SEQ ID NO: 527808 - RNA, 22 nt, Human
aggcagccuauggggagcucag

SEQ ID NO: 527809 - RNA, 22 nt, Human
gaaaauaguucaucacaaugau

SEQ ID NO: 527810 - RNA, 22 nt, Human
cacaggaagcaagccuggggcc

SEQ ID NO: 527811 - RNA, 22 nt, Human
gcugacugguucaggucccgcu

SEQ ID NO: 527812 - RNA, 22 nt, Human
ugccuggcugggcugcucaugg

SEQ ID NO: 527813 - RNA, 22 nt, Human
gcuccugggcccugggcuaacu

SEQ ID NO: 527814 - RNA, 23 nt, Human
ugagagccuggcagccuggguuc

SEQ ID NO: 527815 - RNA, 17 nt, Human
ugaggccugcaucagug

SEQ ID NO: 527816 - RNA, 20 nt, Human
caucaacaccuugucagccu

SEQ ID NO: 527817 - RNA, 22 nt, Human
cacagaggaugcccaagcgauc

SEQ ID NO: 527818 - RNA, 22 nt, Human
aguggcuguuccaggugaggac

SEQ ID NO: 527819 - RNA, 22 nt, Human
gugccuccaggcucgacuaguc

SEQ ID NO: 527820 - RNA, 22 nt, Human
gggagacaaaggugagguucuu

SEQ ID NO: 527821 - RNA, 20 nt, Human
gggugugggcccggccaggc

SEQ ID NO: 527822 - RNA, 22 nt, Human
ucccaggauguuuauggcuggu

SEQ ID NO: 527823 - RNA, 22 nt, Human
gcaggaguuagagguuuaaucu

SEQ ID NO: 527824 - RNA, 22 nt, Human
uggcugaggucuggggcuucug

SEQ ID NO: 527825 - RNA, 22 nt, Human
gcagcugccgugagcucacgcc

SEQ ID NO: 527826 - RNA, 18 nt, Human
ugugccucugcaggacgu

SEQ ID NO: 527827 - RNA, 22 nt, Human
auggguggccccgugugcaguc

SEQ ID NO: 527828 - RNA, 22 nt, Human
gguggcagaggugcaucagccc

SEQ ID NO: 527829 - RNA, 22 nt, Human
cacacuguccccuucuccccag

SEQ ID NO: 527830 - RNA, 22 nt, Human
agggcaguguggugggacugac

SEQ ID NO: 527831 - RNA, 22 nt, Human
agcuccacucccugccuguuuc

SEQ ID NO: 527832 - RNA, 23 nt, Human
uuaacaggaucucgggcaagagg

SEQ ID NO: 527833 - RNA, 22 nt, Human
uucuccucagcaaggcagcuuu

SEQ ID NO: 527834 - RNA, 19 nt, Human
cgcacagccugccaggcgc

SEQ ID NO: 527835 - RNA, 22 nt, Human
ugucugccugcgggccggcaca

SEQ ID NO: 527836 - RNA, 22 nt, Human
guggccaucuuuggcccugacu

SEQ ID NO: 527837 - RNA, 22 nt, Human
cuccagcucgcgagcucugcuc

SEQ ID NO: 527838 - RNA, 22 nt, Human
uaguggauguucagagauuuga

SEQ ID NO: 527839 - RNA, 22 nt, Human
ucaucuguuaugggaguuuuug

SEQ ID NO: 527840 - RNA, 22 nt, Human
cucguugcugaagccaaaguca

SEQ ID NO: 527841 - RNA, 20 nt, Human
cuguuugcuaucaugagcug

SEQ ID NO: 527842 - RNA, 21 nt, Human
gcccacagugaggaggauccc

SEQ ID NO: 527843 - RNA, 22 nt, Human
aggcuaggccuugcccuggaac

SEQ ID NO: 527844 - RNA, 22 nt, Human
acaugaggaacucaggagucac

SEQ ID NO: 527845 - RNA, 21 nt, Human
uccaggagcacgggacuagga

SEQ ID NO: 527846 - RNA, 22 nt, Human
aggcuguccucucuugcucagu

SEQ ID NO: 527847 - RNA, 22 nt, Human
guguccagagccgggcugaaug

SEQ ID NO: 527848 - RNA, 22 nt, Human
cuggaaggagcccgggcggauc

SEQ ID NO: 527849 - RNA, 22 nt, Human
ugcacaguuggcuacaucgugg

SEQ ID NO: 527850 - RNA, 22 nt, Human
agcugggugcccgaagccacgu

SEQ ID NO: 527851 - RNA, 22 nt, Human
ccaggcccugcuccucacacca

SEQ ID NO: 527852 - RNA, 20 nt, Human
ucugccacuuuuucugucac

SEQ ID NO: 527853 - RNA, 22 nt, Human
ccucugagcuggccuguggggc

SEQ ID NO: 527854 - RNA, 22 nt, Human
caagauauguccuguuacuaag

SEQ ID NO: 527855 - RNA, 22 nt, Human
aagacagugacagucacaauug

SEQ ID NO: 527856 - RNA, 22 nt, Human
ucucugagguuguuuccagcac

SEQ ID NO: 527857 - RNA, 22 nt, Human
ucugguuucccaguuccuccgu

SEQ ID NO: 527858 - RNA, 22 nt, Human
gccaccagccccaugcgcugug

SEQ ID NO: 527859 - RNA, 22 nt, Human
gagguccacugaggcaacaggg

SEQ ID NO: 527860 - RNA, 22 nt, Human
aggcaguuguugcugagcagcu

SEQ ID NO: 527861 - RNA, 22 nt, Human
cagcugcuguucaguuuuguuu

SEQ ID NO: 527862 - RNA, 22 nt, Human
aacaggcuaaauuguccauuuc

SEQ ID NO: 527863 - RNA, 22 nt, Human
ucggagcuguagaugaaacccu

SEQ ID NO: 527864 - RNA, 22 nt, Human
ggcaagaaccucaauuaccuuu

SEQ ID NO: 527865 - RNA, 22 nt, Human
ucuuuuaucuguuguguaacaa

SEQ ID NO: 527866 - RNA, 22 nt, Human
ugacauuugagagagauauaca

SEQ ID NO: 527867 - RNA, 22 nt, Human
gccaggaccucagaugcagggc

SEQ ID NO: 527868 - RNA, 22 nt, Human
uguccagaucaaugcccacaug

SEQ ID NO: 527869 - RNA, 22 nt, Human
uggccgggaagggacagugugg

SEQ ID NO: 527870 - RNA, 22 nt, Human
cuguggcugcgcccugggggag

SEQ ID NO: 527871 - RNA, 22 nt, Human
cagggagcuggugccagccgac

SEQ ID NO: 527872 - RNA, 22 nt, Human
guggcauuuuagaacagcugac

SEQ ID NO: 527873 - RNA, 22 nt, Human
uugauucugcugaucucggacg

SEQ ID NO: 527874 - RNA, 22 nt, Human
uuucccaggcuggaaugcagug

SEQ ID NO: 527875 - RNA, 22 nt, Human
uguuaccauaggucagaacguu

SEQ ID NO: 527876 - RNA, 22 nt, Human
gcucaugggcccagagcagccc

SEQ ID NO: 527877 - RNA, 22 nt, Human
uugcaggucuggggguccuggu

SEQ ID NO: 527878 - RNA, 23 nt, Human
agguggagcugugcagccggggc

SEQ ID NO: 527879 - RNA, 22 nt, Human
cugccuuggcccuaguucaugg

SEQ ID NO: 527880 - RNA, 22 nt, Human
gaggugggaugugugugcuacu

SEQ ID NO: 527881 - RNA, 22 nt, Human
gcagcagcaggcgcucggccgu

SEQ ID NO: 527882 - RNA, 22 nt, Human
ucugaggcugaauggacuccgu

SEQ ID NO: 527883 - RNA, 22 nt, Human
uucucugaguacguuucagugu

SEQ ID NO: 527884 - RNA, 22 nt, Human
cuggagauaagcagucccaggc

SEQ ID NO: 527885 - RNA, 22 nt, Human
aaaggugccucuuacaaggcuu

SEQ ID NO: 527886 - RNA, 21 nt, Human
ggucaggcaugugcccugagc

SEQ ID NO: 527887 - RNA, 22 nt, Human
augcccagaacccccuggaugg

SEQ ID NO: 527888 - RNA, 22 nt, Human
gcuuggccagcagccgggaugc

SEQ ID NO: 527889 - RNA, 22 nt, Human
ccacccagccagaugcaggaag

SEQ ID NO: 527890 - RNA, 22 nt, Human
cugucuacagaugaaauaagca

SEQ ID NO: 527891 - RNA, 22 nt, Human
ccaggaugacccccacuuuccu

SEQ ID NO: 527892 - RNA, 22 nt, Human
uauagcagcaugauuuauaguc

SEQ ID NO: 527893 - RNA, 22 nt, Human
augaauuguccgauguugugca

SEQ ID NO: 527894 - RNA, 22 nt, Human
ccagcugcgggcaucgagaguu

SEQ ID NO: 527895 - RNA, 22 nt, Human
ugcucuguucaguguaucuugu

SEQ ID NO: 527896 - RNA, 22 nt, Human
ugaggucuguccugucuuugga

SEQ ID NO: 527897 - RNA, 22 nt, Human
gccuggcaaggcccuguugacu

SEQ ID NO: 527898 - RNA, 22 nt, Human
ccagaucccuguuugccucugg

SEQ ID NO: 527899 - RNA, 22 nt, Human
agugacagauuaccggcagagc

SEQ ID NO: 527900 - RNA, 22 nt, Human
acagaguaucuaucaggaguau

SEQ ID NO: 527901 - RNA, 22 nt, Human
agccagggacgcugcaggcuac

SEQ ID NO: 527902 - RNA, 22 nt, Human
cauuguuggcagagggacagag

SEQ ID NO: 527903 - RNA, 18 nt, Human
uggucacuguggauagug

SEQ ID NO: 527904 - RNA, 22 nt, Human
gaggggccuggcgaggacaugu

SEQ ID NO: 527905 - RNA, 22 nt, Human
ccaggagcccugccacaauggu

SEQ ID NO: 527906 - RNA, 22 nt, Human
ucugcuugugucuguccagccu

SEQ ID NO: 527907 - RNA, 22 nt, Human
ugugacuaggccugagcucuug

SEQ ID NO: 527908 - RNA, 22 nt, Human
cugaaggauguguggugggagu

SEQ ID NO: 527909 - RNA, 22 nt, Human
cugggcuccuaaccauccaggu

SEQ ID NO: 527910 - RNA, 22 nt, Human
aggaagccuggaguccugccca

SEQ ID NO: 527911 - RNA, 22 nt, Human
cuggccuggcaggggaccucua

SEQ ID NO: 527912 - RNA, 22 nt, Human
uguguccugugaucucuagggu

SEQ ID NO: 527913 - RNA, 18 nt, Human
gaaggcauucaguggcuu

SEQ ID NO: 527914 - RNA, 19 nt, Human
ucucccaugccugugucua

SEQ ID NO: 527915 - RNA, 22 nt, Human
cuggcaguguccagcucgugau

SEQ ID NO: 527916 - RNA, 22 nt, Human
gggaggugauuaggaccaugua

SEQ ID NO: 527917 - RNA, 22 nt, Human
acgugcuggagaagagcucgcc

SEQ ID NO: 527918 - RNA, 22 nt, Human
aggcagaugggagcuggaaguu

SEQ ID NO: 527919 - RNA, 22 nt, Human
agcaccaggucgcuggcacgcu

SEQ ID NO: 527920 - RNA, 21 nt, Human
ugaggccugccagucucagaa

SEQ ID NO: 527921 - RNA, 22 nt, Human
acauagcuuaaaugagaagaua

SEQ ID NO: 527922 - RNA, 22 nt, Human
agguccugucuuaucucuguaa

SEQ ID NO: 527923 - RNA, 22 nt, Human
gccccacuguggaaccuaaguc

SEQ ID NO: 527924 - RNA, 22 nt, Human
gucuguccacuuggaagcuccc

SEQ ID NO: 527925 - RNA, 22 nt, Human
uggcccaggugcacccagaggc

SEQ ID NO: 527926 - RNA, 22 nt, Human
ucagagaaguaggcuaauggug

SEQ ID NO: 527927 - RNA, 23 nt, Human herpesvirus 4 [Epstein-Barr virus]
aucagcaaauccaguuguauuca

SEQ ID NO: 527928 - RNA, 22 nt, Human herpesvirus 4 [Epstein-Barr virus]
ccagcuccugaacacggccccu

SEQ ID NO: 527929 - RNA, 22 nt, Human herpesvirus 4 [Epstein-Barr virus]
cagcguccugaggcugcugcuu

SEQ ID NO: 527930 - RNA, 17 nt, Human herpesvirus 4 [Epstein-Barr virus]
agcccugcucacgaaug

SEQ ID NO: 527931 - RNA, 22 nt, Human herpesvirus 4 [Epstein-Barr virus]
agcucgaguacgacugugaggu

SEQ ID NO: 527932 - RNA, 22 nt, Human herpesvirus 4 [Epstein-Barr virus]
aggcucucccaacacaauagaa

SEQ ID NO: 527933 - RNA, 22 nt, Human herpesvirus 4 [Epstein-Barr virus]
aguucauccugggcuuuguggc

SEQ ID NO: 527934 - RNA, 22 nt, Human herpesvirus 4 [Epstein-Barr virus]
cagcagcaggcgcagcgacugg

SEQ ID NO: 527935 - RNA, 22 nt, Human herpesvirus 4 [Epstein-Barr virus]
ucauggucuuuuuacaaacuca

SEQ ID NO: 527936 - RNA, 17 nt, Human herpesvirus 4 [Epstein-Barr virus]
ggccacaggggaggugg

SEQ ID NO: 527937 - RNA, 23 nt, Human herpesvirus 4 [Epstein-Barr virus]
gccugcacguccugccacgcccu

SEQ ID NO: 527938 - RNA, 22 nt, Human herpesvirus 4 [Epstein-Barr virus]
gccacguggccacgugacacac

SEQ ID NO: 527939 - RNA, 23 nt, Human herpesvirus 4 [Epstein-Barr virus]
gccacuagcacaggugagaagcg

SEQ ID NO: 527940 - RNA, 17 nt, Human herpesvirus 4 [Epstein-Barr virus]
uuauggcuagauuuccu

SEQ ID NO: 527941 - RNA, 22 nt, Human herpesvirus 4 [Epstein-Barr virus]
auccaggccuucgcuggcuucu

SEQ ID NO: 527942 - RNA, 22 nt, Human herpesvirus 4 [Epstein-Barr virus]
cagauagugaacguggagguug

SEQ ID NO: 527943 - RNA, 22 nt, Human herpesvirus 4 [Epstein-Barr virus]
cucacgccgcacgguccggcac

SEQ ID NO: 527944 - RNA, 22 nt, Human herpesvirus 4 [Epstein-Barr virus]
cuguacauccagcugcuguaug

SEQ ID NO: 527945 - RNA, 22 nt, Human herpesvirus 4 [Epstein-Barr virus]
gaggcccacgguggcggcagac

SEQ ID NO: 527946 - RNA, 22 nt, Human herpesvirus 4 [Epstein-Barr virus]
ucugggguccaggagucugcug

SEQ ID NO: 527947 - RNA, 17 nt, Human herpesvirus 4 [Epstein-Barr virus]
uggcagacgcccuccug

SEQ ID NO: 527948 - RNA, 22 nt, Human herpesvirus 4 [Epstein-Barr virus]
uggagcuccuuggugcaggaga

SEQ ID NO: 527949 - RNA, 22 nt, Human herpesvirus 4 [Epstein-Barr virus]
cggccacacggccggagcuccg

SEQ ID NO: 527950 - RNA, 22 nt, Human herpesvirus 4 [Epstein-Barr virus]
ugcgccugcugcugggaaccug

SEQ ID NO: 527951 - RNA, 22 nt, Human herpesvirus 4 [Epstein-Barr virus]
uggugcagagagccacacaguu

SEQ ID NO: 527952 - RNA, 22 nt, Human herpesvirus 4 [Epstein-Barr virus]
gaggucucugaugagcuggaag

SEQ ID NO: 527953 - RNA, 22 nt, Human herpesvirus 4 [Epstein-Barr virus]
uauuugcggcugggcuaaugau

SEQ ID NO: 527954 - RNA, 22 nt, Human herpesvirus 4 [Epstein-Barr virus]
uaugaggacauuuucccaaucu

SEQ ID NO: 527955 - RNA, 22 nt, Human herpesvirus 4 [Epstein-Barr virus]
uaggcauagagagugaugagcc

SEQ ID NO: 527956 - RNA, 22 nt, Human herpesvirus 4 [Epstein-Barr virus]
gaugcguguagcccagaagcgu

SEQ ID NO: 527957 - RNA, 22 nt, Human herpesvirus 4 [Epstein-Barr virus]
gagggggaucgcccgggucucu

SEQ ID NO: 527958 - RNA, 22 nt, Human herpesvirus 4 [Epstein-Barr virus]
gagcuccaaagccaggcucgag

SEQ ID NO: 527959 - RNA, 22 nt, Human herpesvirus 4 [Epstein-Barr virus]
cggggcaguauuuucgaccgag

SEQ ID NO: 527960 - RNA, 22 nt, Human herpesvirus 4 [Epstein-Barr virus]
uggagcguucucagggaucgcu

SEQ ID NO: 527961 - RNA, 22 nt, Human herpesvirus 4 [Epstein-Barr virus]
uggagggcaucuuccgggagua

SEQ ID NO: 527962 - RNA, 22 nt, Human herpesvirus 4 [Epstein-Barr virus]
uggcaaagugcugagagcaagg

SEQ ID NO: 527963 - RNA, 22 nt, Human herpesvirus 4 [Epstein-Barr virus]
uuguggaccucucagaguuuca

SEQ ID NO: 527964 - RNA, 22 nt, Human herpesvirus 4 [Epstein-Barr virus]
ccgggccguggaaugagggccu

SEQ ID NO: 527965 - RNA, 22 nt, Human herpesvirus 4 [Epstein-Barr virus]
ccauguguguccagugccuaau

SEQ ID NO: 527966 - RNA, 22 nt, Human herpesvirus 4 [Epstein-Barr virus]
gucaggagacacggcucuguca

SEQ ID NO: 527967 - RNA, 22 nt, Human herpesvirus 4 [Epstein-Barr virus]
ucggugggaggcauaggcccca

SEQ ID NO: 527968 - RNA, 22 nt, Human herpesvirus 4 [Epstein-Barr virus]
aacuguguggcucucugcacca

SEQ ID NO: 527969 - RNA, 22 nt, Human herpesvirus 4 [Epstein-Barr virus]
caggaggccccgcggcaggagg

SEQ ID NO: 527970 - RNA, 18 nt, Human herpesvirus 4 [Epstein-Barr virus]
ccagcguguuucuuaucc

SEQ ID NO: 527971 - RNA, 22 nt, Human herpesvirus 4 [Epstein-Barr virus]
agcaccaucagcccggggggac

SEQ ID NO: 527972 - RNA, 22 nt, Human herpesvirus 4 [Epstein-Barr virus]
gcuccacgcaaagucagauugc

SEQ ID NO: 527973 - RNA, 22 nt, Human herpesvirus 4 [Epstein-Barr virus]
cuguacauccagcugcuguaug

SEQ ID NO: 527974 - RNA, 22 nt, Human herpesvirus 4 [Epstein-Barr virus]
gaccacguccccccagacgcgc

SEQ ID NO: 527975 - RNA, 22 nt, Human
gagcugucucuauaugaaugcu

SEQ ID NO: 527976 - RNA, 22 nt, Human
auauaaagaaguggaaaaugag

SEQ ID NO: 527977 - RNA, 17 nt, Human
gcaaucucagucuccuu

SEQ ID NO: 527978 - RNA, 22 nt, Human
ugguccugucucaaggagccuu

SEQ ID NO: 527979 - RNA, 22 nt, Human
ccaggaccuggagcucuaugaa

SEQ ID NO: 527980 - RNA, 23 nt, Human
uccaggcaugagcucuggaugga

SEQ ID NO: 527981 - RNA, 22 nt, Human
gcaaaucaccaccuagcuggau

SEQ ID NO: 527982 - RNA, 22 nt, Human
cugugucggacgugggcagcag

SEQ ID NO: 527983 - RNA, 22 nt, Human
ucaaaacaaucauuggaugugc

SEQ ID NO: 527984 - RNA, 22 nt, Human
aguuauuuuggaaaaugaguca

SEQ ID NO: 527985 - RNA, 21 nt, Human
gccacguuucagucuucucag

SEQ ID NO: 527986 - RNA, 22 nt, Human
uggcucagccauucguguugcc

SEQ ID NO: 527987 - RNA, 22 nt, Human
accaggcagcacuuuccuugca

SEQ ID NO: 527988 - RNA, 22 nt, Human
aaaacacaagaagcaggguaca

SEQ ID NO: 527989 - RNA, 22 nt, Human
augauauagagaguagauuaaa

SEQ ID NO: 527990 - RNA, 22 nt, Human
cacauuuaagugcuuguucaga

SEQ ID NO: 527991 - RNA, 22 nt, Human
ucacauuuucauauucucugag

SEQ ID NO: 527992 - RNA, 22 nt, Human
caggugggagccacagcguaca

SEQ ID NO: 527993 - RNA, 22 nt, Human
auguuacaauccaacaaaauua

SEQ ID NO: 527994 - RNA, 22 nt, Human
aauaagaacuccauuuacucgu

SEQ ID NO: 527995 - RNA, 22 nt, Human
acucugaacuccaggaggcuca

SEQ ID NO: 527996 - RNA, 22 nt, Human
gaacuaaaagcuaacaucaggc

SEQ ID NO: 527997 - RNA, 22 nt, Human
cuuucacagcacaagccugccu

SEQ ID NO: 527998 - RNA, 21 nt, Human
gcccccuggacuccucaucca

SEQ ID NO: 527999 - RNA, 22 nt, Human
ugcaggcucugguuuauagugc

SEQ ID NO: 528000 - RNA, 22 nt, Human
ucuauuuaccaaauguaguucc

SEQ ID NO: 528001 - RNA, 22 nt, Human
cuucuuaaucccuuauauauuu

SEQ ID NO: 528002 - RNA, 22 nt, Human
aagaugcagcuuuacaauaagg

SEQ ID NO: 528003 - RNA, 22 nt, Human
cuucccuuggugaacagagcau

SEQ ID NO: 528004 - RNA, 22 nt, Human
ccugccuggcccaccuugccac

SEQ ID NO: 528005 - RNA, 22 nt, Human
agagugaaguucaucgugcagc

SEQ ID NO: 528006 - RNA, 22 nt, Human
auuuggcaacauuaauugaauc

SEQ ID NO: 528007 - RNA, 22 nt, Human
ccuccucugggaagauucagag

SEQ ID NO: 528008 - RNA, 22 nt, Human
uuucccaauugagagguucugu

SEQ ID NO: 528009 - RNA, 22 nt, Human
caugagacugccuuuucaaacc

SEQ ID NO: 528010 - RNA, 22 nt, Human
aaagucaucauuucuuuucaaa

SEQ ID NO: 528011 - RNA, 22 nt, Human
auuugucugcuugcugccuucc

SEQ ID NO: 528012 - RNA, 22 nt, Human
ggaagccacccagcuuugauag

SEQ ID NO: 528013 - RNA, 22 nt, Human
gccugguggugugcucaagugg

SEQ ID NO: 528014 - RNA, 22 nt, Human
ggaagaagggucauuggcagcc

SEQ ID NO: 528015 - RNA, 21 nt, Human
guuugcaugaacaagucagcc

SEQ ID NO: 528016 - RNA, 22 nt, Human
agggccagcagcuuggccaacc

SEQ ID NO: 528017 - RNA, 22 nt, Human
aggaaacuccccuacaucucaa

SEQ ID NO: 528018 - RNA, 22 nt, Human
uuauuccagcuaagaguccugg

SEQ ID NO: 528019 - RNA, 22 nt, Human
ucauuuugcagagcugaggaac

SEQ ID NO: 528020 - RNA, 22 nt, Human
gcugacucuuugacaaaaugca

SEQ ID NO: 528021 - RNA, 22 nt, Human
gggacccucaacaucugcuucu

SEQ ID NO: 528022 - RNA, 22 nt, Human
gaggaacccagcugggguugcc

SEQ ID NO: 528023 - RNA, 22 nt, Human
uaauguguugaauauuuguaca

SEQ ID NO: 528024 - RNA, 22 nt, Human
ugguccagacuuugaccucuca

SEQ ID NO: 528025 - RNA, 22 nt, Human
uuuucuuaggugcuccaaguag

SEQ ID NO: 528026 - RNA, 22 nt, Human
ugcaaauuuauauggugacugc

SEQ ID NO: 528027 - RNA, 22 nt, Human
ucagggugaaccaggcaggaau

SEQ ID NO: 528028 - RNA, 22 nt, Human
ugaggccugacagaccaagccu

SEQ ID NO: 528029 - RNA, 22 nt, Human
gccuucugauugcuggacugac

SEQ ID NO: 528030 - RNA, 22 nt, Human
uguaaguacauugaaacaucuu

SEQ ID NO: 528031 - RNA, 22 nt, Human
gaagccacccuccuuccagccc

SEQ ID NO: 528032 - RNA, 22 nt, Human
auuccaaaggcuggccuggagg

SEQ ID NO: 528033 - RNA, 18 nt, Human
cauuccaaguucuaccuc

SEQ ID NO: 528034 - RNA, 22 nt, Human
cucuucaaaugauuuccuuagg

SEQ ID NO: 528035 - RNA, 19 nt, Human
cugccuguuauggagagaa

SEQ ID NO: 528036 - RNA, 22 nt, Human
cagagacauguggccugcacgu

SEQ ID NO: 528037 - RNA, 23 nt, Human
gggagccauggguggucauggag

SEQ ID NO: 528038 - RNA, 22 nt, Human
gaggcucaguuaugucaucagg

SEQ ID NO: 528039 - RNA, 22 nt, Human
uugaauaauuaauuacacucag

SEQ ID NO: 528040 - RNA, 22 nt, Human
ucauccuuuugcaugggaaggc

SEQ ID NO: 528041 - RNA, 22 nt, Human
gcuuugcccaagggcccuaccc

SEQ ID NO: 528042 - RNA, 22 nt, Human
aaaggccaccaacaugaagcau

SEQ ID NO: 528043 - RNA, 22 nt, Human
gcagggcaucccugagcgggug

SEQ ID NO: 528044 - RNA, 22 nt, Human
acauuuagcuguacaaucuaug

SEQ ID NO: 528045 - RNA, 22 nt, Human
auuugaagucuucaugauuucu

SEQ ID NO: 528046 - RNA, 22 nt, Human
aaauacugguuuuggagaugcu

SEQ ID NO: 528047 - RNA, 18 nt, Human
ugcugggcauuaggcuua

SEQ ID NO: 528048 - RNA, 22 nt, Human
accugcaggggugcucucuggg

SEQ ID NO: 528049 - RNA, 22 nt, Human
acuuuacacaucuuuucucauu

SEQ ID NO: 528050 - RNA, 22 nt, Human
aaggacuaaugaauagaugaau

SEQ ID NO: 528051 - RNA, 22 nt, Human
uagggcucuggugggcucuguu

SEQ ID NO: 528052 - RNA, 22 nt, Human
ucagggcauccauugccuguug

SEQ ID NO: 528053 - RNA, 22 nt, Human
gcugggaggcagcaccuuuagc

SEQ ID NO: 528054 - RNA, 22 nt, Human
aggccugucuggggcucagcca

SEQ ID NO: 528055 - RNA, 22 nt, Human
acuguuuugugccuuaguuucc

SEQ ID NO: 528056 - RNA, 22 nt, Human
uuagcucagaaaauuuaaacuu

SEQ ID NO: 528057 - RNA, 22 nt, Human
ggagcugucuguagggcacagg

SEQ ID NO: 528058 - RNA, 22 nt, Human
uucaaacauucaaauaaaccgg

SEQ ID NO: 528059 - RNA, 22 nt, Human
uggugcugauaauggcaggauu

SEQ ID NO: 528060 - RNA, 22 nt, Human
ucuccccaaaggacucacucuc

SEQ ID NO: 528061 - RNA, 22 nt, Human
uuaagucauuucugauuauaga

SEQ ID NO: 528062 - RNA, 23 nt, Human
auuugaaacuuucuuguuuccag

SEQ ID NO: 528063 - RNA, 22 nt, Human
agugagguggggucacagggac

SEQ ID NO: 528064 - RNA, 22 nt, Human
cucaggaugcaauuccaucaag

SEQ ID NO: 528065 - RNA, 22 nt, Human
gaggccugcagcguggucccug

SEQ ID NO: 528066 - RNA, 22 nt, Human
guggccaauuuccaucuguaag

SEQ ID NO: 528067 - RNA, 22 nt, Human
cagcccugcacgcugccuccgc

SEQ ID NO: 528068 - RNA, 22 nt, Human
gaaugcuaagcaugugggaguu

SEQ ID NO: 528069 - RNA, 23 nt, Human
gccugccugaccugugcaaaguc

SEQ ID NO: 528070 - RNA, 22 nt, Human
ccucugugugugcaugcaugcg

SEQ ID NO: 528071 - RNA, 22 nt, Human
gagguucacaggcuaucacagu

SEQ ID NO: 528072 - RNA, 22 nt, Human
ccugggcugcucauggggauga

SEQ ID NO: 528073 - RNA, 21 nt, Human
ggcugcugggagagcugcgug

SEQ ID NO: 528074 - RNA, 22 nt, Human
uggaugagucugagauugggca

SEQ ID NO: 528075 - RNA, 22 nt, Human
gcaagcuggcuguuagaggaug

SEQ ID NO: 528076 - RNA, 22 nt, Human
auucuaaauguaauuuagaauu

SEQ ID NO: 528077 - RNA, 22 nt, Human
agucuagaggauggguccagau

SEQ ID NO: 528078 - RNA, 22 nt, Human
uuucuuuuccaauaucccuacu

SEQ ID NO: 528079 - RNA, 22 nt, Human
caggccagcagggccuccgugg

SEQ ID NO: 528080 - RNA, 22 nt, Human
gugccugggguugagcuaugaa

SEQ ID NO: 528081 - RNA, 22 nt, Human
aggcuaggcaugugcuaccaca

SEQ ID NO: 528082 - RNA, 22 nt, Human
uauguacagggauagaacuuga

SEQ ID NO: 528083 - RNA, 22 nt, Human
aagagucacuccauaaauccca

SEQ ID NO: 528084 - RNA, 22 nt, Human
cucccucugucuuguccagaaa

SEQ ID NO: 528085 - RNA, 22 nt, Human
agaaagggaugagguagcugcu

SEQ ID NO: 528086 - RNA, 22 nt, Human
ugugucagaaggcaauggggau

SEQ ID NO: 528087 - RNA, 22 nt, Human
aguguugucaaacggcucagca

SEQ ID NO: 528088 - RNA, 22 nt, Human
aggccucugcuggaaagaguug

SEQ ID NO: 528089 - RNA, 22 nt, Human
auuccagauguuacugaaaggc

SEQ ID NO: 528090 - RNA, 22 nt, Human
ugcaggcuccaugaggacaggc

SEQ ID NO: 528091 - RNA, 22 nt, Human
ggagggugcuuaaguuguguuu

SEQ ID NO: 528092 - RNA, 22 nt, Human
acauuugugggggaacaggaua

SEQ ID NO: 528093 - RNA, 22 nt, Human
ggugcaaaaguaaucacaguuu

SEQ ID NO: 528094 - RNA, 22 nt, Human
agcccucugcaaacaccugaua

SEQ ID NO: 528095 - RNA, 22 nt, Human
uucuggggcuaauacagagguc

SEQ ID NO: 528096 - RNA, 22 nt, Human
uguguuuuaucuauuguaucuu

SEQ ID NO: 528097 - RNA, 22 nt, Human
aaagcaauuacaaaagggauaa

SEQ ID NO: 528098 - RNA, 21 nt, Human
aaguaaaucagagaaauaacc

SEQ ID NO: 528099 - RNA, 22 nt, Human
aauaucaguauauuguaucagu

SEQ ID NO: 528100 - RNA, 22 nt, Human
gaaggcuguuucugguagugau

SEQ ID NO: 528101 - RNA, 22 nt, Human
aacaaaacauuugucuuguuuc

SEQ ID NO: 528102 - RNA, 22 nt, Human
ucugccugaggacugacaccag

SEQ ID NO: 528103 - RNA, 22 nt, Human
agcuggugcugaagcucuugag

SEQ ID NO: 528104 - RNA, 22 nt, Human
accuggcacacacuggggagug

SEQ ID NO: 528105 - RNA, 22 nt, Human
ggcacagcacaguggacccagg

SEQ ID NO: 528106 - RNA, 20 nt, Human
caguccaggcugcagcaucu

SEQ ID NO: 528107 - RNA, 22 nt, Human
uguggggaagaguaugacuugg

SEQ ID NO: 528108 - RNA, 22 nt, Human
aagcaaacaggagaagagcugu

SEQ ID NO: 528109 - RNA, 22 nt, Human
ugauguucuguauaucauauag

SEQ ID NO: 528110 - RNA, 22 nt, Human
uaaugaauaaacuugagaguca

SEQ ID NO: 528111 - RNA, 22 nt, Human
gcucugcugagauaucugggag

SEQ ID NO: 528112 - RNA, 21 nt, Human
aucugaaagguuaguguugag

SEQ ID NO: 528113 - RNA, 16 nt, Human
agcccugccguguacu

SEQ ID NO: 528114 - RNA, 22 nt, Human
uccucagggcggccuccgucuu

SEQ ID NO: 528115 - RNA, 22 nt, Human
uaaggccagcaugaaugcagca

SEQ ID NO: 528116 - RNA, 22 nt, Human
caaacauuuugagugguuucug

SEQ ID NO: 528117 - RNA, 22 nt, Human
uuuauucagcagcagcaguggu

SEQ ID NO: 528118 - RNA, 18 nt, Human
gcccaugguaaaugcugu

SEQ ID NO: 528119 - RNA, 22 nt, Human
aucaggauuacacggggaugcu

SEQ ID NO: 528120 - RNA, 22 nt, Human
acagaauuaucaggaaauguua

SEQ ID NO: 528121 - RNA, 22 nt, Human
cacacacucuuccuggcaccua

SEQ ID NO: 528122 - RNA, 22 nt, Human
augcaaaaguaacugugauuuu

SEQ ID NO: 528123 - RNA, 22 nt, Human
ugccagcacuucuggcugucug

SEQ ID NO: 528124 - RNA, 22 nt, Human
agggcucauugacauggaaaag

SEQ ID NO: 528125 - RNA, 22 nt, Human
acagagcaugauggaagaucga

SEQ ID NO: 528126 - RNA, 22 nt, Human
uucucaaggacaaaaugacaug

SEQ ID NO: 528127 - RNA, 22 nt, Human
ccuggcugcuuccucugccaug

SEQ ID NO: 528128 - RNA, 23 nt, Human
cacaacuaaucagaaucucuagg

SEQ ID NO: 528129 - RNA, 22 nt, Human
uuuacagagaauguacauaaag

SEQ ID NO: 528130 - RNA, 22 nt, Human
aaagcaguauaaguaacggaag

SEQ ID NO: 528131 - RNA, 23 nt, Human
gugugccaagcacugugccagga

SEQ ID NO: 528132 - RNA, 22 nt, Human
uguuauugagguuacuuauaag

SEQ ID NO: 528133 - RNA, 22 nt, Human
acagguggggcacuuggagccu

SEQ ID NO: 528134 - RNA, 22 nt, Human
uuggcucaccugucuacccaga

SEQ ID NO: 528135 - RNA, 22 nt, Human
gcagccugaggcccuuucuggc

SEQ ID NO: 528136 - RNA, 22 nt, Human
uuuccucugagugagcugggag

SEQ ID NO: 528137 - RNA, 22 nt, Human
ugcauuguugaccaguugugca

SEQ ID NO: 528138 - RNA, 22 nt, Human
uauauucauuuuaaagccaucu

SEQ ID NO: 528139 - RNA, 22 nt, Human
gggcagcagccacucauuuagc

SEQ ID NO: 528140 - RNA, 22 nt, Human
ugggaagauggagugacaggca

SEQ ID NO: 528141 - RNA, 22 nt, Human
cucuuaaagaauguuccagcug

SEQ ID NO: 528142 - RNA, 17 nt, Human
ucucuuucccuuucugc

SEQ ID NO: 528143 - RNA, 22 nt, Human
ucucugagguuguuuccagcac

SEQ ID NO: 528144 - RNA, 22 nt, Human
cacagcauaaugaaauauacuu

SEQ ID NO: 528145 - RNA, 22 nt, Human
cagcugccugucuggaggcaau

SEQ ID NO: 528146 - RNA, 22 nt, Human
gcagauggcgcaguggaaguuc

SEQ ID NO: 528147 - RNA, 22 nt, Human
ugcugagcgcauccggcggccg

SEQ ID NO: 528148 - RNA, 22 nt, Human
gcucuccaaacccuguggcuuu

SEQ ID NO: 528149 - RNA, 22 nt, Human
gagcaggcucugccuguguguc

SEQ ID NO: 528150 - RNA, 22 nt, Human
uucaaacuuaaggagcagcaga

SEQ ID NO: 528151 - RNA, 22 nt, Human
auauaguuggguuucauucuac

SEQ ID NO: 528152 - RNA, 22 nt, Human
guauuugauagauuucaaagga

SEQ ID NO: 528153 - RNA, 22 nt, Human
agagugggugaucucuguuguc

SEQ ID NO: 528154 - RNA, 22 nt, Human
uccuggcccacuaugccagcau

SEQ ID NO: 528155 - RNA, 22 nt, Human
aaauuuaaggaggugcucacuu

SEQ ID NO: 528156 - RNA, 21 nt, Human
ccuauugaauauaggaagauu

SEQ ID NO: 528157 - RNA, 23 nt, Human
ucugcucugaaguucggcugagc

SEQ ID NO: 528158 - RNA, 22 nt, Human
cuguucaugcugauucuguaug

SEQ ID NO: 528159 - RNA, 17 nt, Human
cuaaauacuugcguuuc

SEQ ID NO: 528160 - RNA, 22 nt, Human
auggggagagaagggcugagcu

SEQ ID NO: 528161 - RNA, 22 nt, Human
caggagaagguuuggagugcag

SEQ ID NO: 528162 - RNA, 22 nt, Human
ugaccaaaggugguuuauuugg

SEQ ID NO: 528163 - RNA, 22 nt, Human
ccagccuggguguuagaagaca

SEQ ID NO: 528164 - RNA, 22 nt, Human
gcugccacauuuucaggacuaa

SEQ ID NO: 528165 - RNA, 22 nt, Human
cagcugagaaauggggaaaggg

SEQ ID NO: 528166 - RNA, 22 nt, Human
gagcuagacagcaagggccugc

SEQ ID NO: 528167 - RNA, 22 nt, Human
gaaggcugucagagaggagggc

SEQ ID NO: 528168 - RNA, 22 nt, Human
cuggugagacucagggaugcuu

SEQ ID NO: 528169 - RNA, 21 nt, Human
ccuguucacagaucuguaacu

SEQ ID NO: 528170 - RNA, 22 nt, Human
aucaagaaaagugcuuucggcu

SEQ ID NO: 528171 - RNA, 22 nt, Human
ucaggaugaccacgagccucua

SEQ ID NO: 528172 - RNA, 21 nt, Human
ugcccacagcaaaugcagagg

SEQ ID NO: 528173 - RNA, 22 nt, Human
uagucucuggagacucuagggg

SEQ ID NO: 528174 - RNA, 22 nt, Human
uccuuccucggggacccagauc

SEQ ID NO: 528175 - RNA, 22 nt, Human
uugaaauagaugcgucagagau

SEQ ID NO: 528176 - RNA, 22 nt, Human
acugaguguaggacuuugaguu

SEQ ID NO: 528177 - RNA, 22 nt, Human
uguuaauauacuaaaauccacu

SEQ ID NO: 528178 - RNA, 22 nt, Human
uaaaugcaguuaguacuugcca

SEQ ID NO: 528179 - RNA, 22 nt, Human
ugaaguccuagaacuccuggua

SEQ ID NO: 528180 - RNA, 22 nt, Human
ugccuagcauaguauuugucac

SEQ ID NO: 528181 - RNA, 22 nt, Human
gggcuggagccagcuguggcug

SEQ ID NO: 528182 - RNA, 22 nt, Human
uugauagguuuuauguauaguu

SEQ ID NO: 528183 - RNA, 22 nt, Human
uucaacuagaggugauuuugcc

SEQ ID NO: 528184 - RNA, 22 nt, Human
uagcuagaaugcuucgugauau

SEQ ID NO: 528185 - RNA, 22 nt, Human
uccaggcucagcacuugcuacu

SEQ ID NO: 528186 - RNA, 21 nt, Human
uucaacaaagggaauaaguuu

SEQ ID NO: 528187 - RNA, 22 nt, Human
agggcacaucugcugggaaugg

SEQ ID NO: 528188 - RNA, 22 nt, Human
gagccaaggguugccauggaga

SEQ ID NO: 528189 - RNA, 22 nt, Human
uuuauggcacacaaauaucaaa

SEQ ID NO: 528190 - RNA, 22 nt, Human
gcuggaguuggcaaggcaugua

SEQ ID NO: 528191 - RNA, 22 nt, Human
cuuaauaaaugguagcuguuau

SEQ ID NO: 528192 - RNA, 23 nt, Human
uacaagguagcauuaguuucuuc

SEQ ID NO: 528193 - RNA, 22 nt, Human
accugccuucucaaggacauga

SEQ ID NO: 528194 - RNA, 22 nt, Human
aauuuucugaugaugaagcacg

SEQ ID NO: 528195 - RNA, 22 nt, Human
gagccucguggcggccacugcg

SEQ ID NO: 528196 - RNA, 22 nt, Human
aaauaaaggaacuguuuuccca

SEQ ID NO: 528197 - RNA, 22 nt, Human
ccgggccucgggacaccgggua

SEQ ID NO: 528198 - RNA, 20 nt, Human
aggggccuggaacaggccuu

SEQ ID NO: 528199 - RNA, 22 nt, Human
ucaaauaugugauagaagcuaa

SEQ ID NO: 528200 - RNA, 22 nt, Human
aaucaaaaccuacagagguaau

SEQ ID NO: 528201 - RNA, 22 nt, Human
ucccagagaagagcuggaugga

SEQ ID NO: 528202 - RNA, 22 nt, Human
uaacagaaaagaacugaguuug

SEQ ID NO: 528203 - RNA, 22 nt, Human
uacaguagacaauguuaguaug

SEQ ID NO: 528204 - RNA, 22 nt, Human
ugggcagacgggagcuugccuu

SEQ ID NO: 528205 - RNA, 22 nt, Human
gagaaccucuccacaagucugg

SEQ ID NO: 528206 - RNA, 22 nt, Human
gaaauucacuguauuucuuggg

SEQ ID NO: 528207 - RNA, 22 nt, Human
cugagggcccugaagcuuggca

SEQ ID NO: 528208 - RNA, 22 nt, Human
ugagcagaggccagcaccuggg

SEQ ID NO: 528209 - RNA, 22 nt, Human
uuuguagauucauugaacuuuu

SEQ ID NO: 528210 - RNA, 22 nt, Human
aucuuccuucacuuucucccac

SEQ ID NO: 528211 - RNA, 18 nt, Human
cuuuagcugucaucuuug

SEQ ID NO: 528212 - RNA, 22 nt, Human
aggucauuuccuuagaggcaga

SEQ ID NO: 528213 - RNA, 22 nt, Human
auuucacucuuaauugcuuccu

SEQ ID NO: 528214 - RNA, 22 nt, Human
agaagagccuggggaccauggc

SEQ ID NO: 528215 - RNA, 22 nt, Human
aaaugcagguucuugagccaag

SEQ ID NO: 528216 - RNA, 22 nt, Human
acagcuuuucaauucugcugag

SEQ ID NO: 528217 - RNA, 22 nt, Human
agcacacaucacuucugcucau

SEQ ID NO: 528218 - RNA, 22 nt, Human
acacacuucagauguaauuugu

SEQ ID NO: 528219 - RNA, 22 nt, Human
uucauucccuuauauuagcauu

SEQ ID NO: 528220 - RNA, 22 nt, Human
uacaguauuaugagugauugaa

SEQ ID NO: 528221 - RNA, 22 nt, Human
ucaugacaucuguuuaucucaa

SEQ ID NO: 528222 - RNA, 22 nt, Human
acaauagaguucucauaggaca

SEQ ID NO: 528223 - RNA, 22 nt, Human
uauggaaaguguuuucuucugu

SEQ ID NO: 528224 - RNA, 22 nt, Human
uguggucucguuauguugccca

SEQ ID NO: 528225 - RNA, 22 nt, Human
acagugauuauuaguugguggu

SEQ ID NO: 528226 - RNA, 22 nt, Human
uauauugcuagugguacuguaa

SEQ ID NO: 528227 - RNA, 22 nt, Human
auguucuuccuucaauuuggaa

SEQ ID NO: 528228 - RNA, 22 nt, Human
ccugccagggccuuggaagaaa

SEQ ID NO: 528229 - RNA, 22 nt, Human
gaaggccacaaaaaaugucaua

SEQ ID NO: 528230 - RNA, 22 nt, Human
agcacaaauauaaaaaugucug

SEQ ID NO: 528231 - RNA, 22 nt, Human
cuuuauguucaguacaaugcuu

SEQ ID NO: 528232 - RNA, 22 nt, Human
acacugcagaugaaagcauaag

SEQ ID NO: 528233 - RNA, 22 nt, Human
ggccuggaaugcuuuccuacca

SEQ ID NO: 528234 - RNA, 19 nt, Human
agcaguggagccaugccug

SEQ ID NO: 528235 - RNA, 20 nt, Human
ccaggcacugucccaugcag

SEQ ID NO: 528236 - RNA, 22 nt, Human
cucauuuacuguagaacaguua

SEQ ID NO: 528237 - RNA, 22 nt, Human
uaucauaaguuaauuaaacagu

SEQ ID NO: 528238 - RNA, 22 nt, Human
ccacugucugcaggccucagca

SEQ ID NO: 528239 - RNA, 22 nt, Human
agaagccaccagcugaggaaga

SEQ ID NO: 528240 - RNA, 22 nt, Human
ccagagcuccagggcuacagaa

SEQ ID NO: 528241 - RNA, 22 nt, Human
gaugaagccccaguguaaguaa

SEQ ID NO: 528242 - RNA, 22 nt, Human
gggagcugagcuggaagagaau

SEQ ID NO: 528243 - RNA, 22 nt, Human
ccacacagauaaguguuuucua

SEQ ID NO: 528244 - RNA, 22 nt, Human
gacaguuuuuaauccuuucaug

SEQ ID NO: 528245 - RNA, 22 nt, Human
gcagcaggcacggucucgacau

SEQ ID NO: 528246 - RNA, 20 nt, Human
cucucccagcacagcuuccu

SEQ ID NO: 528247 - RNA, 22 nt, Human
aauaaaggcaccauaaggcaaa

SEQ ID NO: 528248 - RNA, 22 nt, Human
uaauguguccugaaagcuucug

SEQ ID NO: 528249 - RNA, 22 nt, Human
uggcuuccacugugugcccccu

SEQ ID NO: 528250 - RNA, 22 nt, Human
gcugccuucaguucugauucau

SEQ ID NO: 528251 - RNA, 22 nt, Human
gccuggcaggggccugggagug

SEQ ID NO: 528252 - RNA, 22 nt, Human
uggagcugggguuugaaucugg

SEQ ID NO: 528253 - RNA, 22 nt, Human
uuuauucacuucagugccaaag

SEQ ID NO: 528254 - RNA, 22 nt, Human
aucauaauugcuccagugauau

SEQ ID NO: 528255 - RNA, 21 nt, Human
caggaugaugauaauucaugg

SEQ ID NO: 528256 - RNA, 22 nt, Human
ucaggauguuaauauagcauua

SEQ ID NO: 528257 - RNA, 21 nt, Human
guguuuccuguuuauggcuug

SEQ ID NO: 528258 - RNA, 20 nt, Human
ucaaagcacugccugucauc

SEQ ID NO: 528259 - RNA, 22 nt, Human
aggacucaucccugcuugucag

SEQ ID NO: 528260 - RNA, 23 nt, Human
acauuucaauacugagggucuga

SEQ ID NO: 528261 - RNA, 22 nt, Human
uccucugcuccaggcuggacuu

SEQ ID NO: 528262 - RNA, 22 nt, Human
ccucccuuggccauagccagcc

SEQ ID NO: 528263 - RNA, 22 nt, Human
gaagcaagugcaaggaagaggc

SEQ ID NO: 528264 - RNA, 22 nt, Human
uacaggcauguagcauggugau

SEQ ID NO: 528265 - RNA, 22 nt, Human
agcugccccaugagaggcaggu

SEQ ID NO: 528266 - RNA, 22 nt, Human
uccuccucuaucagacagugcc

SEQ ID NO: 528267 - RNA, 22 nt, Human
uagaaguuaaaggaauacagaa

SEQ ID NO: 528268 - RNA, 22 nt, Human
ccugcccagcuucaccucaggc

SEQ ID NO: 528269 - RNA, 22 nt, Human
agaaaugcauuagcacauauag

SEQ ID NO: 528270 - RNA, 22 nt, Human
ucuguaaagucuguguaaaguc

SEQ ID NO: 528271 - RNA, 22 nt, Human
guccaagagucaagaagggggc

SEQ ID NO: 528272 - RNA, 22 nt, Human
augcaguaaaauaggagguaau

SEQ ID NO: 528273 - RNA, 22 nt, Human
uacauugcuagaaauguauuuu

SEQ ID NO: 528274 - RNA, 22 nt, Human
agagcuguggauaguccuggau

SEQ ID NO: 528275 - RNA, 22 nt, Human
aaguauuucguucugaaaaagu

SEQ ID NO: 528276 - RNA, 22 nt, Human
agccuggagaagauguguauug

SEQ ID NO: 528277 - RNA, 22 nt, Human
ugcugggccucuucccuggaua

SEQ ID NO: 528278 - RNA, 22 nt, Human
caggccuugcgucccauggccu

SEQ ID NO: 528279 - RNA, 22 nt, Human
gcuggcagaauuucuucuugcu

SEQ ID NO: 528280 - RNA, 22 nt, Human
uguucuuaugaugaagcacuga

SEQ ID NO: 528281 - RNA, 22 nt, Human
aaugcacauguuguaauaaaua

SEQ ID NO: 528282 - RNA, 22 nt, Human
aguccagucucacucuuggcag

SEQ ID NO: 528283 - RNA, 22 nt, Human
gcugagacuggcagcaggaagu

SEQ ID NO: 528284 - RNA, 22 nt, Human
guggcagucaucaaggacagau

SEQ ID NO: 528285 - RNA, 22 nt, Human
cugagcugggaguggauagugg

SEQ ID NO: 528286 - RNA, 20 nt, Human
cagcccuccaguggaggcag

SEQ ID NO: 528287 - RNA, 22 nt, Human
ucuuagaaugucaacugauguu

SEQ ID NO: 528288 - RNA, 22 nt, Human
caucagaaucugagucucugcc

SEQ ID NO: 528289 - RNA, 22 nt, Human
ggcagcacugcagcuuguuggg

SEQ ID NO: 528290 - RNA, 21 nt, Human
cugcucuggggaccggcugug

SEQ ID NO: 528291 - RNA, 22 nt, Human
uaaagcaguguugggucggacg

SEQ ID NO: 528292 - RNA, 22 nt, Human
uggcagccacaucucguggauu

SEQ ID NO: 528293 - RNA, 22 nt, Human
ucuguucagguuucagagaacu

SEQ ID NO: 528294 - RNA, 22 nt, Human
aggcucagugauguaaaauaua

SEQ ID NO: 528295 - RNA, 22 nt, Human
cugccagccaggccagguaggc

SEQ ID NO: 528296 - RNA, 22 nt, Human
gcagcaggagaguuuguccugc

SEQ ID NO: 528297 - RNA, 22 nt, Human
aaucaaagaaugggcuaguugg

SEQ ID NO: 528298 - RNA, 22 nt, Human
gagccagcugagcugcacuguc

SEQ ID NO: 528299 - RNA, 22 nt, Human
aaggaagagcaaagaauuaugu

SEQ ID NO: 528300 - RNA, 22 nt, Human
ucccccacucuaaaggagccuu

SEQ ID NO: 528301 - RNA, 22 nt, Human
ggcaggcacauuugggggccgu

SEQ ID NO: 528302 - RNA, 22 nt, Human
aggagguguugauagaagguuu

SEQ ID NO: 528303 - RNA, 22 nt, Human
auuuacauuuauuugagaaggu

SEQ ID NO: 528304 - RNA, 22 nt, Human
ggcaguuucaucaggagaaaag

SEQ ID NO: 528305 - RNA, 22 nt, Human
agauuccagaucccaaaaauga

SEQ ID NO: 528306 - RNA, 17 nt, Human
agagauaaggcggagaa

SEQ ID NO: 528307 - RNA, 22 nt, Human
acauucuaugaagauaauuuua

SEQ ID NO: 528308 - RNA, 22 nt, Human
cuggcuucugggccagggcaga

SEQ ID NO: 528309 - RNA, 22 nt, Human
augcuuuggccaaugagaagug

SEQ ID NO: 528310 - RNA, 23 nt, Human
aagcugccuucgcaguuggucug

SEQ ID NO: 528311 - RNA, 22 nt, Human
cugcauguuuacauuuuugaga

SEQ ID NO: 528312 - RNA, 22 nt, Human
ucagaaaccccaacaauggaga

SEQ ID NO: 528313 - RNA, 23 nt, Human
gcacugggcucucagcaaggugu

SEQ ID NO: 528314 - RNA, 22 nt, Human
cuggccagagguuccucugccc

SEQ ID NO: 528315 - RNA, 22 nt, Human
acacaugagaaacaucaguugu

SEQ ID NO: 528316 - RNA, 22 nt, Human
cccagcuccaagggacagcgaa

SEQ ID NO: 528317 - RNA, 22 nt, Human
ggcuuuauauuguuugagcaga

SEQ ID NO: 528318 - RNA, 22 nt, Human
cagccaggccuggugaccaaag

SEQ ID NO: 528319 - RNA, 22 nt, Human
aaucaagucaaccaucaugugc

SEQ ID NO: 528320 - RNA, 22 nt, Human
acuggggaauggaacugggaau

SEQ ID NO: 528321 - RNA, 22 nt, Human
uggcagaguaggauggcccugu

SEQ ID NO: 528322 - RNA, 22 nt, Human
cauuuaauagaugcuguuucag

SEQ ID NO: 528323 - RNA, 22 nt, Human
aggagcuggaguccaggcaagu

SEQ ID NO: 528324 - RNA, 22 nt, Human
auucacaaagaagggaaguaca

SEQ ID NO: 528325 - RNA, 22 nt, Human
auaugguaagaguauauuuacu

SEQ ID NO: 528326 - RNA, 22 nt, Human
uuggaaggagucaaccagcuga

SEQ ID NO: 528327 - RNA, 22 nt, Human
gucacacucagaaugacuagag

SEQ ID NO: 528328 - RNA, 22 nt, Human
ugagccagccuugcagcugugc

SEQ ID NO: 528329 - RNA, 22 nt, Human
aaaugcauguagaauaauagag

SEQ ID NO: 528330 - RNA, 23 nt, Human
ggcacugaagcuacaauggugag

SEQ ID NO: 528331 - RNA, 21 nt, Human
uccagcucuuauguucaugaa

SEQ ID NO: 528332 - RNA, 22 nt, Human
aggcuuguggauuggagcgagu

SEQ ID NO: 528333 - RNA, 22 nt, Human
aagcagggugucuugacccaug

SEQ ID NO: 528334 - RNA, 22 nt, Human
uagggugccuuuuauugcugug

SEQ ID NO: 528335 - RNA, 19 nt, Human
uccuuugaauaucaguuga

SEQ ID NO: 528336 - RNA, 22 nt, Human
auuuggaaacaauuauauucuu

SEQ ID NO: 528337 - RNA, 22 nt, Human
agccuccaguagcugaagagac

SEQ ID NO: 528338 - RNA, 22 nt, Human
ucagcuuuuuacaugugaaaua

SEQ ID NO: 528339 - RNA, 22 nt, Human
gggcagugacaaaggggaugaa

SEQ ID NO: 528340 - RNA, 22 nt, Human
cucacagcugcuucaggaucca

SEQ ID NO: 528341 - RNA, 22 nt, Human
aaauaaguaguuuaguguugug

SEQ ID NO: 528342 - RNA, 22 nt, Human
cuggggacugaaggauguugcu

SEQ ID NO: 528343 - RNA, 22 nt, Human
aggagcugggcugcugcuggga

SEQ ID NO: 528344 - RNA, 21 nt, Human
ucauaaacuaguaucaaaguu

SEQ ID NO: 528345 - RNA, 22 nt, Human
ggcagaggaggggugaauuugc

SEQ ID NO: 528346 - RNA, 22 nt, Human
ggugggaaggggccagugugcg

SEQ ID NO: 528347 - RNA, 22 nt, Human
cuacaccuugaucuaacauuuu

SEQ ID NO: 528348 - RNA, 22 nt, Human
aggaugggccugggauaugcuu

SEQ ID NO: 528349 - RNA, 22 nt, Human
augcaguggcagcuccuggugu

SEQ ID NO: 528350 - RNA, 22 nt, Human
auugcugggaauauuuagccca

SEQ ID NO: 528351 - RNA, 22 nt, Human
agggcuagaguugagaugggga

SEQ ID NO: 528352 - RNA, 22 nt, Human
cuaugaaaugucagauucugca

SEQ ID NO: 528353 - RNA, 22 nt, Human
cuggacagugggcagaggagac

SEQ ID NO: 528354 - RNA, 22 nt, Human
cuucgauuuaauucuuaaccuu

SEQ ID NO: 528355 - RNA, 21 nt, Human
uccugcagaaugccuuccuac

SEQ ID NO: 528356 - RNA, 22 nt, Human
cugucugcuagaacaucuauac

SEQ ID NO: 528357 - RNA, 22 nt, Human
ccauuucauugccuguaaagug

SEQ ID NO: 528358 - RNA, 22 nt, Human
uaggccauuccuucucuugauc

SEQ ID NO: 528359 - RNA, 22 nt, Human
guguguccucaguaguggcaug

SEQ ID NO: 528360 - RNA, 22 nt, Human
ucuggcuccguguccgcuccca

SEQ ID NO: 528361 - RNA, 22 nt, Human
agacaggcuuugcuguauauca

SEQ ID NO: 528362 - RNA, 22 nt, Human
aaagaaguguugaauuugcaag

SEQ ID NO: 528363 - RNA, 22 nt, Human
ugagcugcaagaaaauuucagu

SEQ ID NO: 528364 - RNA, 22 nt, Human
agcuucuguucaucuuccaggc

SEQ ID NO: 528365 - RNA, 22 nt, Human
agagccuggucugagauaggac

SEQ ID NO: 528366 - RNA, 21 nt, Human
ugcucugguguuuuauuuaac

SEQ ID NO: 528367 - RNA, 22 nt, Human
gucucccaucguuugugaggaa

SEQ ID NO: 528368 - RNA, 22 nt, Human
ccagaggaguugaggcuuuggg

SEQ ID NO: 528369 - RNA, 22 nt, Human
uuuauugacccaaagcgagagu

SEQ ID NO: 528370 - RNA, 22 nt, Human
ucaagagacaggacguguuuca

SEQ ID NO: 528371 - RNA, 22 nt, Human
ugcagaagaaugagcuuggagu

SEQ ID NO: 528372 - RNA, 22 nt, Human
cuucuccucugaguccugggag

SEQ ID NO: 528373 - RNA, 22 nt, Human
uuucagugugagugucuuauuu

SEQ ID NO: 528374 - RNA, 22 nt, Human
ucacagcaacacuggggcagac

SEQ ID NO: 528375 - RNA, 22 nt, Human
cacagcuucuccuugauaucgc

SEQ ID NO: 528376 - RNA, 17 nt, Human
agugaggagauuggaag

SEQ ID NO: 528377 - RNA, 22 nt, Human
gucaggauuauaauccccaugg

SEQ ID NO: 528378 - RNA, 22 nt, Human
guguggcugccagccaagaggc

SEQ ID NO: 528379 - RNA, 22 nt, Human
gagggcucacugagaaagcagu

SEQ ID NO: 528380 - RNA, 22 nt, Human
aucaaagugauuuguaaacagg

SEQ ID NO: 528381 - RNA, 22 nt, Human
cagcucuguaaauuccuucauc

SEQ ID NO: 528382 - RNA, 22 nt, Human
auuugucuagugguauucacgu

SEQ ID NO: 528383 - RNA, 22 nt, Human
uucugagaggcagagcuuguga

SEQ ID NO: 528384 - RNA, 22 nt, Human
aggugggggcuguguccuugac

SEQ ID NO: 528385 - RNA, 22 nt, Human
ggcaauaaugacauuuuaaaaa

SEQ ID NO: 528386 - RNA, 22 nt, Human
ucuguucagcugccucagggua

SEQ ID NO: 528387 - RNA, 23 nt, Human
guuuucaacacaauaaauguaac

SEQ ID NO: 528388 - RNA, 20 nt, Human
ggcaggugcuguccccuccu

SEQ ID NO: 528389 - RNA, 22 nt, Human
agccaggaaccagcuacagucu

SEQ ID NO: 528390 - RNA, 22 nt, Human
auaaauagugugucauaaaguc

SEQ ID NO: 528391 - RNA, 22 nt, Human
gauguuucccguuaagagaaaa

SEQ ID NO: 528392 - RNA, 22 nt, Human
uucagauguggcuuugucaggc

SEQ ID NO: 528393 - RNA, 22 nt, Human
gaauguuuuuaggaauguuaug

SEQ ID NO: 528394 - RNA, 22 nt, Human
agcaccugcacaguggaggaaa

SEQ ID NO: 528395 - RNA, 22 nt, Human
uucaggauccccuugaugggcu

SEQ ID NO: 528396 - RNA, 22 nt, Human
cauuauguucaguagcuuaaaa

SEQ ID NO: 528397 - RNA, 22 nt, Human
augccaggaacaaacaguggug

SEQ ID NO: 528398 - RNA, 22 nt, Human
aauuugaaacauagucaccacu

SEQ ID NO: 528399 - RNA, 22 nt, Human
agcugggaugauaaccucaguc

SEQ ID NO: 528400 - RNA, 22 nt, Human
ccugcuggcugguagaguuccg

SEQ ID NO: 528401 - RNA, 22 nt, Human
agacagagauacuauguuguca

SEQ ID NO: 528402 - RNA, 22 nt, Human
acagcacuuauucagcacagug

SEQ ID NO: 528403 - RNA, 20 nt, Human
uauauuuucucuuuggccuu

SEQ ID NO: 528404 - RNA, 21 nt, Human
auccuugaucagaagagugcu

SEQ ID NO: 528405 - RNA, 22 nt, Human
gggucaggcucagcagggcagc

SEQ ID NO: 528406 - RNA, 22 nt, Human
aguaaaaucaccaucucuuugu

SEQ ID NO: 528407 - RNA, 22 nt, Human
uucacagggcagcagcugagcc

SEQ ID NO: 528408 - RNA, 17 nt, Human
ugaaacaccaagacugu

SEQ ID NO: 528409 - RNA, 22 nt, Human
ucagagaggcaauacuguuuaa

SEQ ID NO: 528410 - RNA, 22 nt, Human
agaaaauuacuccagagacaag

SEQ ID NO: 528411 - RNA, 19 nt, Human
uucaggauugacccuacug

SEQ ID NO: 528412 - RNA, 22 nt, Human
agccaggcagacucucuuucuu

SEQ ID NO: 528413 - RNA, 22 nt, Human
acagagccaaaaggacauagua

SEQ ID NO: 528414 - RNA, 22 nt, Human
uuucacaacguuguggugagag

SEQ ID NO: 528415 - RNA, 22 nt, Human
ccugcccuguguuuggggacua

SEQ ID NO: 528416 - RNA, 22 nt, Human
ugagcagauggaggcuucugca

SEQ ID NO: 528417 - RNA, 22 nt, Human
uugaaaaugguaagcaugauau

SEQ ID NO: 528418 - RNA, 22 nt, Human
gcaggagaacaaagcaagcugc

SEQ ID NO: 528419 - RNA, 22 nt, Human
ucagggaagacuucuuagagga

SEQ ID NO: 528420 - RNA, 22 nt, Human
uccagagucuccuguuguuguu

SEQ ID NO: 528421 - RNA, 20 nt, Human
agugggagagggcagacugc

SEQ ID NO: 528422 - RNA, 22 nt, Human
cugaaauuccauuucagccaca

SEQ ID NO: 528423 - RNA, 22 nt, Human
ccugucuggaacauggccuguu

SEQ ID NO: 528424 - RNA, 22 nt, Human
ggagcuguugcgcaugcgcucg

SEQ ID NO: 528425 - RNA, 22 nt, Human
caggucuguuuccaucagugcu

SEQ ID NO: 528426 - RNA, 22 nt, Human
aucuuugugaaucucaacuugg

SEQ ID NO: 528427 - RNA, 22 nt, Human
gagaagccgagucagcugagcc

SEQ ID NO: 528428 - RNA, 22 nt, Human
gcgggccaccuuggagagcgcu

SEQ ID NO: 528429 - RNA, 20 nt, Human
cugggcugcccagcuauggg

SEQ ID NO: 528430 - RNA, 22 nt, Human
ugguaucagagccaucuguauu

SEQ ID NO: 528431 - RNA, 22 nt, Human
uguuuacaaggaguuuauauug

SEQ ID NO: 528432 - RNA, 22 nt, Human
agcagguggauuuagacgggag

SEQ ID NO: 528433 - RNA, 22 nt, Human
ugccaggcaggacccuagaacc

SEQ ID NO: 528434 - RNA, 22 nt, Human
agggcaugaagcaguggacagc

SEQ ID NO: 528435 - RNA, 22 nt, Human
uggaaaaaacccagacucuaga

SEQ ID NO: 528436 - RNA, 22 nt, Human
uggagcucaaaggccuguggga

SEQ ID NO: 528437 - RNA, 22 nt, Human
aaugaugguauugaugagcuaa

SEQ ID NO: 528438 - RNA, 22 nt, Human
uucucuaauggugaugauuaga

SEQ ID NO: 528439 - RNA, 19 nt, Human
ccagagacauuggcaucuu

SEQ ID NO: 528440 - RNA, 22 nt, Human
uaaagcauaaugaauaucuaga

SEQ ID NO: 528441 - RNA, 23 nt, Human
ugcauuauccucucugaagacca

SEQ ID NO: 528442 - RNA, 22 nt, Human
aaauuccauuaugauaauuucg

SEQ ID NO: 528443 - RNA, 22 nt, Human
ccagcuaguuggguauuauaag

SEQ ID NO: 528444 - RNA, 22 nt, Human
uugcauuguugcaaugaaguau

SEQ ID NO: 528445 - RNA, 22 nt, Human
ccagaugguccagagucuagcc

SEQ ID NO: 528446 - RNA, 18 nt, Human
ucauucauuaaacuuggc

SEQ ID NO: 528447 - RNA, 22 nt, Human
acuugaaagaaguuuccuuaaa

SEQ ID NO: 528448 - RNA, 22 nt, Human
ucaguuuuuguuugccagauag

SEQ ID NO: 528449 - RNA, 22 nt, Human
acaggcagcgucauugcugcuc

SEQ ID NO: 528450 - RNA, 22 nt, Human
acacaguaugaaaagucuaguu

SEQ ID NO: 528451 - RNA, 22 nt, Human
gagaugagugggggaucucuca

SEQ ID NO: 528452 - RNA, 21 nt, Human
aguuggaggcaguuuggcaau

SEQ ID NO: 528453 - RNA, 22 nt, Human
gcccaugcucucaggcgggccu

SEQ ID NO: 528454 - RNA, 22 nt, Human
agagucugaggcagcugcagcc

SEQ ID NO: 528455 - RNA, 22 nt, Human
acagugucuccugguacccagu

SEQ ID NO: 528456 - RNA, 22 nt, Human
agugagggaugaagaacugcgg

SEQ ID NO: 528457 - RNA, 22 nt, Human
aacaugucuggguauucacaag

SEQ ID NO: 528458 - RNA, 22 nt, Human
agggcucccgcgguguccggga

SEQ ID NO: 528459 - RNA, 22 nt, Human
gcacagggcccugugcguaggu

SEQ ID NO: 528460 - RNA, 22 nt, Human
uugacaauguccuuugaauuuc

SEQ ID NO: 528461 - RNA, 22 nt, Human
ccagaugguuugcaugggaggg

SEQ ID NO: 528462 - RNA, 22 nt, Human
ggcaguguccuugcagcucuac

SEQ ID NO: 528463 - RNA, 20 nt, Human
ccagagaguagguuagugau

SEQ ID NO: 528464 - RNA, 22 nt, Human
cccuucucuuucacucacuauu

SEQ ID NO: 528465 - RNA, 22 nt, Human
uuugaauaucacaaacuuucaa

SEQ ID NO: 528466 - RNA, 22 nt, Human
gagcugagccuggguggaccgc

SEQ ID NO: 528467 - RNA, 22 nt, Human
agaggggacagccaccugcccg

SEQ ID NO: 528468 - RNA, 22 nt, Human
auccuucagcugcccuguuacc

SEQ ID NO: 528469 - RNA, 22 nt, Human
uauuugagcgaagcaguguuuu

SEQ ID NO: 528470 - RNA, 22 nt, Human
aaauguguuucgaaaacuggug

SEQ ID NO: 528471 - RNA, 22 nt, Human
cucuucaaaagucuaauccuua

SEQ ID NO: 528472 - RNA, 21 nt, Human
cugugcuucuuccuaagccag

SEQ ID NO: 528473 - RNA, 21 nt, Human
aggcagaaagagcccaggcug

SEQ ID NO: 528474 - RNA, 22 nt, Human
gagucacauuaauuuaauuuua

SEQ ID NO: 528475 - RNA, 22 nt, Human
aauuuauucccgucucugggcu

SEQ ID NO: 528476 - RNA, 22 nt, Human
cacaguaacuggcguguaguaa

SEQ ID NO: 528477 - RNA, 22 nt, Human
uguguacaaauuuagccagcag

SEQ ID NO: 528478 - RNA, 22 nt, Human
aaacagugacugguacauaaua

SEQ ID NO: 528479 - RNA, 22 nt, Human
uauacaaugaguacauucuggg

SEQ ID NO: 528480 - RNA, 22 nt, Human
agggaagaaaauccaucgcugc

SEQ ID NO: 528481 - RNA, 22 nt, Human
aggcuucagguuugcuuugcag

SEQ ID NO: 528482 - RNA, 22 nt, Human
uguuuccaaaugguauaaagac

SEQ ID NO: 528483 - RNA, 22 nt, Human
gcuucugcagccaaagaagccg

SEQ ID NO: 528484 - RNA, 22 nt, Human
ugggccuguugggguugaguua

SEQ ID NO: 528485 - RNA, 22 nt, Human
caacuacaggaaaagucauuca

SEQ ID NO: 528486 - RNA, 22 nt, Human
gcucacugcaaccucugcuucc

SEQ ID NO: 528487 - RNA, 22 nt, Human
uccuggagauaauugcagugaa

SEQ ID NO: 528488 - RNA, 22 nt, Human
caauguuuguuagagcucuaga

SEQ ID NO: 528489 - RNA, 22 nt, Human
cagagacaguuucacagggucu

SEQ ID NO: 528490 - RNA, 22 nt, Human
ugcuucugaguugcaggacuug

SEQ ID NO: 528491 - RNA, 22 nt, Human
ugguggcaauguccuggagaag

SEQ ID NO: 528492 - RNA, 22 nt, Human
cuuaauuuaaaauaguucaggc

SEQ ID NO: 528493 - RNA, 22 nt, Human
aagcagaggguauggccagguu

SEQ ID NO: 528494 - RNA, 22 nt, Human
gaguucaauuuccagcuguucu

SEQ ID NO: 528495 - RNA, 22 nt, Human
ucuguuccaguagaaaggugca

SEQ ID NO: 528496 - RNA, 22 nt, Human
agggcuccaaggaaguguagcu

SEQ ID NO: 528497 - RNA, 19 nt, Human
aucugccuguuaucacaua

SEQ ID NO: 528498 - RNA, 18 nt, Human
ggcucaggcuauccuaac

SEQ ID NO: 528499 - RNA, 22 nt, Human
auuaaauuggacgcugggggaa

SEQ ID NO: 528500 - RNA, 22 nt, Human
gccuggaaugcaaugugacgaa

SEQ ID NO: 528501 - RNA, 22 nt, Human
ucagggacuaggugcugccuga

SEQ ID NO: 528502 - RNA, 22 nt, Human
uagccaggcgaggucagugucg

SEQ ID NO: 528503 - RNA, 22 nt, Human
ccuggagcuuggucacgcugcg

SEQ ID NO: 528504 - RNA, 22 nt, Human
gaagaaggguaaggaguguuga

SEQ ID NO: 528505 - RNA, 22 nt, Human
aaagcaauggaugagaaucugu

SEQ ID NO: 528506 - RNA, 22 nt, Human
cacaggcuccggccuugcagcc

SEQ ID NO: 528507 - RNA, 22 nt, Human
uagcagcuuccagagagggcag

SEQ ID NO: 528508 - RNA, 22 nt, Human
agaugguucucagaaacucaac

SEQ ID NO: 528509 - RNA, 22 nt, Human
uggugagaaguuuugagauucu

SEQ ID NO: 528510 - RNA, 22 nt, Human
cagcagaacaguuaaagaaacc

SEQ ID NO: 528511 - RNA, 19 nt, Human
auauagcauuauucaauuu

SEQ ID NO: 528512 - RNA, 22 nt, Human
uccaggcccauggagcagagcu

SEQ ID NO: 528513 - RNA, 22 nt, Human
ugcuuuauaucucucuucuuag

SEQ ID NO: 528514 - RNA, 22 nt, Human
uccaguggcacuggagacuaga

SEQ ID NO: 528515 - RNA, 22 nt, Human
uggcagucuuguaggcaucucc

SEQ ID NO: 528516 - RNA, 22 nt, Human
aggcacugaccugcuuccuuga

SEQ ID NO: 528517 - RNA, 22 nt, Human
gcugaagcccacguggcuugua

SEQ ID NO: 528518 - RNA, 23 nt, Human
agcccugcugagacccagcuccc

SEQ ID NO: 528519 - RNA, 22 nt, Human
caauguuugaguaggagcauaa

SEQ ID NO: 528520 - RNA, 23 nt, Human
cucaacauccauucuugcccuuc

SEQ ID NO: 528521 - RNA, 21 nt, Human
cagaggcagguccugggacgg

SEQ ID NO: 528522 - RNA, 22 nt, Human
auagcaaaaggcaccagaguga

SEQ ID NO: 528523 - RNA, 22 nt, Human
ucuggagcuggagggcaaggca

SEQ ID NO: 528524 - RNA, 22 nt, Human
ggaaggggagcuggaaagggua

SEQ ID NO: 528525 - RNA, 22 nt, Human
uggcccuguucuguaccucaua

SEQ ID NO: 528526 - RNA, 22 nt, Human
aagaagcauggcuguagauucc

SEQ ID NO: 528527 - RNA, 22 nt, Human
ucccaaggugcucggcaacagg

SEQ ID NO: 528528 - RNA, 22 nt, Human
cacaucauguuaauucauuaca

SEQ ID NO: 528529 - RNA, 17 nt, Human
ccauacugacauauuga

SEQ ID NO: 528530 - RNA, 22 nt, Human
acacucucagcuuuucaacuua

SEQ ID NO: 528531 - RNA, 22 nt, Human
agaaguuaccacauacuucucu

SEQ ID NO: 528532 - RNA, 20 nt, Human
cauuaugguugggcacagug

SEQ ID NO: 528533 - RNA, 22 nt, Human
agagcagcguuuguggaacacu

SEQ ID NO: 528534 - RNA, 22 nt, Human
acaguacaccacuguguacagu

SEQ ID NO: 528535 - RNA, 22 nt, Human
guaaacaugcuguguacucagc

SEQ ID NO: 528536 - RNA, 22 nt, Human
uuuagaaauucaucuauggccu

SEQ ID NO: 528537 - RNA, 22 nt, Human
uucuuuucuuggcaggaguaga

SEQ ID NO: 528538 - RNA, 17 nt, Human
ugggguguugaaggguu

SEQ ID NO: 528539 - RNA, 22 nt, Human
ccucagaccccugcugagcuuc

SEQ ID NO: 528540 - RNA, 22 nt, Human
ucauuauaaacauaugcuaaag

SEQ ID NO: 528541 - RNA, 22 nt, Human
ugcauacacacaucaaauguuu

SEQ ID NO: 528542 - RNA, 22 nt, Human
cuacaucacuuaauucuuagaa

SEQ ID NO: 528543 - RNA, 22 nt, Human
aggcagccaguucagguuucuu

SEQ ID NO: 528544 - RNA, 22 nt, Human
cauguguagguauacaaaauuc

SEQ ID NO: 528545 - RNA, 22 nt, Human
ccuugcaggggaacaggcagug

SEQ ID NO: 528546 - RNA, 22 nt, Human
cgcugccaggauccccugccgg

SEQ ID NO: 528547 - RNA, 22 nt, Human
agugguggagagaugaggacac

SEQ ID NO: 528548 - RNA, 22 nt, Human
caggcagccaggggaccugucc

SEQ ID NO: 528549 - RNA, 22 nt, Human
ccaguguuuccccagaagagag

SEQ ID NO: 528550 - RNA, 22 nt, Human
cuauuagguaugcagccuauuu

SEQ ID NO: 528551 - RNA, 22 nt, Human
auggccagcccuucccgcagcu

SEQ ID NO: 528552 - RNA, 22 nt, Human
cacagggccacuuucccaguaa

SEQ ID NO: 528553 - RNA, 22 nt, Human
gcugaagcugcagcaggaggaa

SEQ ID NO: 528554 - RNA, 22 nt, Human
acacauacauggggaagaugag

SEQ ID NO: 528555 - RNA, 22 nt, Human
gggaagaagacauggugaaggc

SEQ ID NO: 528556 - RNA, 22 nt, Human
accauuaaagagauccugggga

SEQ ID NO: 528557 - RNA, 20 nt, Human
aacacagauaccaaagguug

SEQ ID NO: 528558 - RNA, 20 nt, Human
uucuaaacuguuaggcuugc

SEQ ID NO: 528559 - RNA, 22 nt, Human
auguuuaaggaacugguuugcu

SEQ ID NO: 528560 - RNA, 22 nt, Human
ucauuucuauugcuacugucug

SEQ ID NO: 528561 - RNA, 22 nt, Human
caggcugccuggaagaggacug

SEQ ID NO: 528562 - RNA, 22 nt, Human
uauacacaaggugugcauuugu

SEQ ID NO: 528563 - RNA, 22 nt, Human
ugcagcauugcaaagcagucuu

SEQ ID NO: 528564 - RNA, 22 nt, Human
gggcagcugcagggauggugac

SEQ ID NO: 528565 - RNA, 22 nt, Human
aucuacaggauuuuacagaguu

SEQ ID NO: 528566 - RNA, 22 nt, Human
ucugaaaucuguaagcacuagc

SEQ ID NO: 528567 - RNA, 19 nt, Human
gcuucccaccagccagccc

SEQ ID NO: 528568 - RNA, 22 nt, Human
uuuauuauucucuggagaaugu

SEQ ID NO: 528569 - RNA, 22 nt, Human
cuuccugcauugugccagaguu

SEQ ID NO: 528570 - RNA, 22 nt, Human
ugcugguggagaaaguggaggu

SEQ ID NO: 528571 - RNA, 22 nt, Human
gagucugagucuaauggcccca

SEQ ID NO: 528572 - RNA, 22 nt, Human
uccugggaccaggcaccuacug

SEQ ID NO: 528573 - RNA, 22 nt, Human
cugggccuagaggaagcugaca

SEQ ID NO: 528574 - RNA, 22 nt, Human
gacuauuuaguuucagauuagu

SEQ ID NO: 528575 - RNA, 20 nt, Human
ugucagugccugaggcacag

SEQ ID NO: 528576 - RNA, 22 nt, Human
uucacauuucauaccacagcuu

SEQ ID NO: 528577 - RNA, 22 nt, Human
ggccuugguaaagggaugcaug

SEQ ID NO: 528578 - RNA, 22 nt, Human
gagcugcagaguaaccuuugca

SEQ ID NO: 528579 - RNA, 22 nt, Human
augaaaugugaaugcuuuucau

SEQ ID NO: 528580 - RNA, 22 nt, Human
aaauuaagaguaacucuguaga

SEQ ID NO: 528581 - RNA, 22 nt, Human
cugggcugcagcgggagcgacg

SEQ ID NO: 528582 - RNA, 19 nt, Human
ucccuuccugucgggcucc

SEQ ID NO: 528583 - RNA, 22 nt, Human
guccugguuuucacagaccuuu

SEQ ID NO: 528584 - RNA, 22 nt, Human
gacuucagauauuuuuuaaguu

SEQ ID NO: 528585 - RNA, 22 nt, Human
aaguucaaucagaugaaaaagc

SEQ ID NO: 528586 - RNA, 20 nt, Human
gucucaaguaucucacaguc

SEQ ID NO: 528587 - RNA, 22 nt, Human
acagagcuucccagccugagca

SEQ ID NO: 528588 - RNA, 22 nt, Human
aaggaagggaaauagugauguc

SEQ ID NO: 528589 - RNA, 22 nt, Human
ccagguggcccugcccuacucu

SEQ ID NO: 528590 - RNA, 22 nt, Human
aaagucaucuguccuaggcucu

SEQ ID NO: 528591 - RNA, 22 nt, Human
acccugccgugggcugcuugug

SEQ ID NO: 528592 - RNA, 22 nt, Human
aggcaacacuugcauuuuuuag

SEQ ID NO: 528593 - RNA, 22 nt, Human
gcucugucuucagcacacagua

SEQ ID NO: 528594 - RNA, 22 nt, Human
ccuggcuccugccucugcaggg

SEQ ID NO: 528595 - RNA, 22 nt, Human
cucuggacacuggcaugggguc

SEQ ID NO: 528596 - RNA, 22 nt, Human
ucaguaaaugaaugaauauaug

SEQ ID NO: 528597 - RNA, 20 nt, Human
uaggacaggcagccgagggg

SEQ ID NO: 528598 - RNA, 22 nt, Human
caaggcugcuggcuucugagcu

SEQ ID NO: 528599 - RNA, 22 nt, Human
acaguguucacuuaacaaugga

SEQ ID NO: 528600 - RNA, 22 nt, Human
ggcuuuaugcagggauagaaau

SEQ ID NO: 528601 - RNA, 22 nt, Human
aagauuuccauuucuagcucau

SEQ ID NO: 528602 - RNA, 22 nt, Human
acagaugguagcauuauguugg

SEQ ID NO: 528603 - RNA, 22 nt, Human
acuaaaugaacuauuaauacuu

SEQ ID NO: 528604 - RNA, 22 nt, Human
aaggugaacugguaaugacaga

SEQ ID NO: 528605 - RNA, 22 nt, Human
uguaaaaccaaaucaaucuagu

SEQ ID NO: 528606 - RNA, 22 nt, Human
uugcaaggguguuuugaggugu

SEQ ID NO: 528607 - RNA, 19 nt, Human
gcaucagagcagaaggggu

SEQ ID NO: 528608 - RNA, 20 nt, Human
acauguacuaaugaauacag

SEQ ID NO: 528609 - RNA, 22 nt, Human
aggcugaguuucucauucucgc

SEQ ID NO: 528610 - RNA, 22 nt, Human
gaucaacaacuuuugaauagcu

SEQ ID NO: 528611 - RNA, 22 nt, Human
uuguacuuacauuuuaaagcua

SEQ ID NO: 528612 - RNA, 22 nt, Human
gcugucacaaauauuucucagc

SEQ ID NO: 528613 - RNA, 22 nt, Human
ugaaauuagaaauauguauggg

SEQ ID NO: 528614 - RNA, 22 nt, Human
acaaggaacaagcauguaguuu

SEQ ID NO: 528615 - RNA, 22 nt, Human
uugaagcaaauucugugcagua

SEQ ID NO: 528616 - RNA, 22 nt, Human
agcugcuacugcucugccagag

SEQ ID NO: 528617 - RNA, 22 nt, Human
cuuugaucuacucacuaaacaa

SEQ ID NO: 528618 - RNA, 22 nt, Human
cagggccuucguaaguguccgg

SEQ ID NO: 528619 - RNA, 22 nt, Human
caaagguauaaguuaauauaca

SEQ ID NO: 528620 - RNA, 22 nt, Human
gugguggucaccaaauugaggg

SEQ ID NO: 528621 - RNA, 22 nt, Human
ucuggcuccacaccucacugca

SEQ ID NO: 528622 - RNA, 22 nt, Human
uucuguuugccauauauaguag

SEQ ID NO: 528623 - RNA, 22 nt, Human
ggugaggguaaauauaggcaaa

SEQ ID NO: 528624 - RNA, 22 nt, Human
ggcucagcgcgcugggagggag

SEQ ID NO: 528625 - RNA, 22 nt, Human
ugcuggcuccaaccuggcaucu

SEQ ID NO: 528626 - RNA, 22 nt, Human
ggcagcagggcugucucccuac

SEQ ID NO: 528627 - RNA, 19 nt, Human
ccauggcaaugaucugaug

SEQ ID NO: 528628 - RNA, 22 nt, Human
acguuuucuagagaauaugcag

SEQ ID NO: 528629 - RNA, 22 nt, Human
uugcaaauauuguuuaccuuuc

SEQ ID NO: 528630 - RNA, 22 nt, Human
aucacaaaggguuuucucugag

SEQ ID NO: 528631 - RNA, 19 nt, Human
ucucagaggaaaaauugcu

SEQ ID NO: 528632 - RNA, 22 nt, Human
aggucaaguuuagauagaguua

SEQ ID NO: 528633 - RNA, 22 nt, Human
ucaggcuggaaugcaguggggc

SEQ ID NO: 528634 - RNA, 22 nt, Human
ucauggaagagguauuuuuugu

SEQ ID NO: 528635 - RNA, 22 nt, Human
ucagaauuggaacgugaagauu

SEQ ID NO: 528636 - RNA, 22 nt, Human
augaguucaauuguuucaguca

SEQ ID NO: 528637 - RNA, 22 nt, Human
gccagguggcugagugacugag

SEQ ID NO: 528638 - RNA, 22 nt, Human
ggcagugagaggucuccugguc

SEQ ID NO: 528639 - RNA, 22 nt, Human
ucuacugugguccuuguaacca

SEQ ID NO: 528640 - RNA, 23 nt, Human
agaaaucaucuccaccccauguc

SEQ ID NO: 528641 - RNA, 22 nt, Human
agaacagcaguuaugguucauu

SEQ ID NO: 528642 - RNA, 21 nt, Human
ggcugggucaugcagcuggcc

SEQ ID NO: 528643 - RNA, 22 nt, Human
cagauaaaggcuuacuaguagu

SEQ ID NO: 528644 - RNA, 22 nt, Human
aggagcagaacuguuguggagg

SEQ ID NO: 528645 - RNA, 22 nt, Human
uucauauauaugcacuacguac

SEQ ID NO: 528646 - RNA, 22 nt, Human
cugggccugggaggccaggucu

SEQ ID NO: 528647 - RNA, 22 nt, Human
aauuaaaagauaacccaugagu

SEQ ID NO: 528648 - RNA, 22 nt, Human
cuguccuccggccaccuacagu

SEQ ID NO: 528649 - RNA, 22 nt, Human
acaggggauugauuggaagucu

SEQ ID NO: 528650 - RNA, 22 nt, Human
aucugccugcaguggagguggg

SEQ ID NO: 528651 - RNA, 22 nt, Human
aucaagaacuuauuuuggaaau

SEQ ID NO: 528652 - RNA, 22 nt, Human
gcucaggagcucuugguggcgc

SEQ ID NO: 528653 - RNA, 22 nt, Human
aggcagugcagaguccucuucu

SEQ ID NO: 528654 - RNA, 22 nt, Human
ugacauuuuuauaagagucaaa

SEQ ID NO: 528655 - RNA, 22 nt, Human
auuauuaggacuacugggguug

SEQ ID NO: 528656 - RNA, 22 nt, Human
cacaauuuccuugcuucacuuu

SEQ ID NO: 528657 - RNA, 22 nt, Human
agggccugucagcgguguccug

SEQ ID NO: 528658 - RNA, 22 nt, Human
gaggaaaauauucagggagguu

SEQ ID NO: 528659 - RNA, 22 nt, Human
ucucugagaagcugaggcuggg

SEQ ID NO: 528660 - RNA, 22 nt, Human
caugcagugccucuggauucuu

SEQ ID NO: 528661 - RNA, 22 nt, Human
cugccugccacguucagcugua

SEQ ID NO: 528662 - RNA, 22 nt, Human
uacaaagugacaagcucugcug

SEQ ID NO: 528663 - RNA, 22 nt, Human
uaaagacaugcaaagucuaauu

SEQ ID NO: 528664 - RNA, 22 nt, Human
acucuugucucaacuuuuguau

SEQ ID NO: 528665 - RNA, 23 nt, Human
aaaaucauuaauuuacccugaaa

SEQ ID NO: 528666 - RNA, 22 nt, Human
ccuucugcucccuggccagggc

SEQ ID NO: 528667 - RNA, 22 nt, Human
uucucuggaacugaaacaagau

SEQ ID NO: 528668 - RNA, 22 nt, Human
ccugguggcuucuggguggacg

SEQ ID NO: 528669 - RNA, 22 nt, Human
gugcagcagggggaagacagug

SEQ ID NO: 528670 - RNA, 21 nt, Human
gaggccucagccucagcuccu

SEQ ID NO: 528671 - RNA, 22 nt, Human
ugaugguuuuauuaauaggacc

SEQ ID NO: 528672 - RNA, 22 nt, Human
aguggcagaagccaagucugca

SEQ ID NO: 528673 - RNA, 22 nt, Human
aacugaaaccaaacacuuuagg

SEQ ID NO: 528674 - RNA, 23 nt, Human
cagaccuggcagucauccucaac

SEQ ID NO: 528675 - RNA, 22 nt, Human
ggggcacacuuuugguagauau

SEQ ID NO: 528676 - RNA, 22 nt, Human
ugaugcugcugggaguggugcu

SEQ ID NO: 528677 - RNA, 22 nt, Human
aagagccagugggaaagucuug

SEQ ID NO: 528678 - RNA, 22 nt, Human
gaaagcagcuaagucuuaugau

SEQ ID NO: 528679 - RNA, 22 nt, Human
gcucaggacuggaggagcgggg

SEQ ID NO: 528680 - RNA, 22 nt, Human
ggguguguuccuaaggaaacca

SEQ ID NO: 528681 - RNA, 22 nt, Human
gcacacagccagcugagggcua

SEQ ID NO: 528682 - RNA, 22 nt, Human
uccuagccuggugagaaacugu

SEQ ID NO: 528683 - RNA, 22 nt, Human
caucuacaggagaaugucacug

SEQ ID NO: 528684 - RNA, 21 nt, Human
aaaauguagacuuuucccuga

SEQ ID NO: 528685 - RNA, 22 nt, Human
aauaaagccuuauugauuuuac

SEQ ID NO: 528686 - RNA, 22 nt, Human
cagcccagccuugucucuuuau

SEQ ID NO: 528687 - RNA, 22 nt, Human
aggcucuguuauucuagagggc

SEQ ID NO: 528688 - RNA, 22 nt, Human
aguguacaagaccuuauuguug

SEQ ID NO: 528689 - RNA, 22 nt, Human
uaaaaaguugaaaggacuuauc

SEQ ID NO: 528690 - RNA, 23 nt, Human
uuacaacaguguccauauuugua

SEQ ID NO: 528691 - RNA, 22 nt, Human
ugcuuuaacauaagauaucuuu

SEQ ID NO: 528692 - RNA, 22 nt, Human
ugguaaaguguacugaauauga

SEQ ID NO: 528693 - RNA, 22 nt, Human
aguggcugacaacuggguuaac

SEQ ID NO: 528694 - RNA, 20 nt, Human
gcugaccccugcugucaugc

SEQ ID NO: 528695 - RNA, 22 nt, Human
gcuuuauuuugugagggauuac

SEQ ID NO: 528696 - RNA, 23 nt, Human
aggcugagcucucccagcuucag

SEQ ID NO: 528697 - RNA, 22 nt, Human
ugacaugcuuguuuuccuugaa

SEQ ID NO: 528698 - RNA, 22 nt, Human
ggcaggcaguguggugugaaac

SEQ ID NO: 528699 - RNA, 22 nt, Human
agcagcuuacauguggccuauc

SEQ ID NO: 528700 - RNA, 22 nt, Human
cuggccacugauuccuccccug

SEQ ID NO: 528701 - RNA, 22 nt, Human
gccagccuucuguggccugcaa

SEQ ID NO: 528702 - RNA, 22 nt, Human
gcccaggaagugacucagaugu

SEQ ID NO: 528703 - RNA, 18 nt, Human
gugggguguugugaggau

SEQ ID NO: 528704 - RNA, 22 nt, Human
cuggauuuaggacuaguccaag

SEQ ID NO: 528705 - RNA, 18 nt, Human
ccagagcuggcuccucgc

SEQ ID NO: 528706 - RNA, 22 nt, Human
gccagguguaguggccacaccu

SEQ ID NO: 528707 - RNA, 22 nt, Human
aauagcauaagaugucaaauag

SEQ ID NO: 528708 - RNA, 22 nt, Human
ccugccugucuuuauccccugu

SEQ ID NO: 528709 - RNA, 22 nt, Human
ggguggggccaggcaauuugca

SEQ ID NO: 528710 - RNA, 22 nt, Human
cugcugaugaccucaaacucuu

SEQ ID NO: 528711 - RNA, 22 nt, Human
aggucagaagugccagggaauu

SEQ ID NO: 528712 - RNA, 22 nt, Human
ugcaccccauuuuacauuuaca

SEQ ID NO: 528713 - RNA, 22 nt, Human
gccuggcacugggcuccuggcc

SEQ ID NO: 528714 - RNA, 22 nt, Human
uaauauaccaaacuguaauuuu

SEQ ID NO: 528715 - RNA, 23 nt, Human
agcagugaguaaacagauaggau

SEQ ID NO: 528716 - RNA, 22 nt, Human
uguuuuaaucucccauugcucu

SEQ ID NO: 528717 - RNA, 22 nt, Human
aucagaaaaaugagaagagcug

SEQ ID NO: 528718 - RNA, 22 nt, Human
aaauccuaaggagaauaugauu

SEQ ID NO: 528719 - RNA, 21 nt, Human
gugcugggacacagccaggcu

SEQ ID NO: 528720 - RNA, 23 nt, Human
aggcagguuugggcucuucuugu

SEQ ID NO: 528721 - RNA, 22 nt, Human
gugugcaggccacaggccaggg

SEQ ID NO: 528722 - RNA, 22 nt, Human
gcucugcuggagggaaagagaa

SEQ ID NO: 528723 - RNA, 22 nt, Human
ugucagugaguuaguugcaagu

SEQ ID NO: 528724 - RNA, 22 nt, Human
uaaaagagaauggauaacagag

SEQ ID NO: 528725 - RNA, 22 nt, Human
ggggcagagagaaggaagcuug

SEQ ID NO: 528726 - RNA, 22 nt, Human
guaacaaacgguuccaagaugc

SEQ ID NO: 528727 - RNA, 21 nt, Human
gucuuucuaccucuauguggc

SEQ ID NO: 528728 - RNA, 23 nt, Human
uucaaaacuggaaaaucagaugc

SEQ ID NO: 528729 - RNA, 22 nt, Human
aaacaacaugguggguguguag

SEQ ID NO: 528730 - RNA, 23 nt, Human
gcccauggagucuggaucuggcc

SEQ ID NO: 528731 - RNA, 23 nt, Human
uccucccaaauuucagccucauu

SEQ ID NO: 528732 - RNA, 22 nt, Human
gcucaggagcugacagccucaa

SEQ ID NO: 528733 - RNA, 22 nt, Human
agccucagugucaccaucuacc

SEQ ID NO: 528734 - RNA, 19 nt, Human
auaaggcaggaggaaauuu

SEQ ID NO: 528735 - RNA, 22 nt, Human
uuuccauauucugcgucugcca

SEQ ID NO: 528736 - RNA, 22 nt, Human
ugcccaagcagaggagugauuc

SEQ ID NO: 528737 - RNA, 22 nt, Human
gcguccagggaaggcccagcug

SEQ ID NO: 528738 - RNA, 22 nt, Human
ucuagggggacagcuggcugug

SEQ ID NO: 528739 - RNA, 22 nt, Human
uaacuucucugagccucauucc

SEQ ID NO: 528740 - RNA, 22 nt, Human
auguacauuuguaguaauauca

SEQ ID NO: 528741 - RNA, 22 nt, Human
acucccuguacuugccucucuu

SEQ ID NO: 528742 - RNA, 22 nt, Human
uaggcugagguugaugccaggg

SEQ ID NO: 528743 - RNA, 23 nt, Human
acucaaaauuuggcauuugagga

SEQ ID NO: 528744 - RNA, 22 nt, Human
gguggccaggccagcucuggcc

SEQ ID NO: 528745 - RNA, 22 nt, Human
cucuggcuuugcucaugcaucc

SEQ ID NO: 528746 - RNA, 22 nt, Human
auguuuaaucggcugccuuucc

SEQ ID NO: 528747 - RNA, 22 nt, Human
cagcugugcuagaagccacgaa

SEQ ID NO: 528748 - RNA, 21 nt, Human
gcuuccaagauggcaccuuga

SEQ ID NO: 528749 - RNA, 22 nt, Human
aauucuagcauugugaaaauau

SEQ ID NO: 528750 - RNA, 22 nt, Human
uucucagggucuggauggccug

SEQ ID NO: 528751 - RNA, 22 nt, Human
guuauuagaagugaaggauugu

SEQ ID NO: 528752 - RNA, 22 nt, Human
guuucacagggccauggaggaa

SEQ ID NO: 528753 - RNA, 18 nt, Human
uggcagggaggaaauaua

SEQ ID NO: 528754 - RNA, 22 nt, Human
caacaucaguccucaugagaca

SEQ ID NO: 528755 - RNA, 22 nt, Human
ccucuggucccagcucugcugc

SEQ ID NO: 528756 - RNA, 21 nt, Human
aaacugaccuugccugagaca

SEQ ID NO: 528757 - RNA, 22 nt, Human
aggcuucuacguggucccaggg

SEQ ID NO: 528758 - RNA, 22 nt, Human
uuuguguggcguuggccggcgg

SEQ ID NO: 528759 - RNA, 22 nt, Human
cagcucugaagaaaggugucua

SEQ ID NO: 528760 - RNA, 22 nt, Human
uugaaauaaggaagcucgaaau

SEQ ID NO: 528761 - RNA, 22 nt, Human
agugcacaccuuaguacaaagu

SEQ ID NO: 528762 - RNA, 22 nt, Human
uggcugaauaauauucuguugu

SEQ ID NO: 528763 - RNA, 22 nt, Human
gaaagacuuccuuugagaguac

SEQ ID NO: 528764 - RNA, 22 nt, Human
ggccugcuuuccgagccugcag

SEQ ID NO: 528765 - RNA, 22 nt, Human
ggguccagcgacagcaggcuca

SEQ ID NO: 528766 - RNA, 22 nt, Human
aucaaaguaguagguuuuggac

SEQ ID NO: 528767 - RNA, 22 nt, Human
agcagcauguugggaugugaaa

SEQ ID NO: 528768 - RNA, 22 nt, Human
acccugagggguauagcagaag

SEQ ID NO: 528769 - RNA, 18 nt, Human
uuugcuuuccuucuucag

SEQ ID NO: 528770 - RNA, 22 nt, Human
ugcuuuaucugugagaaccuga

SEQ ID NO: 528771 - RNA, 22 nt, Human
ugcagcugguuuagaacuagau

SEQ ID NO: 528772 - RNA, 22 nt, Human
uguauacaggauuacucauagc

SEQ ID NO: 528773 - RNA, 22 nt, Human
agguggguccuggcucugccau

SEQ ID NO: 528774 - RNA, 22 nt, Human
aauguuugagcaucuacaugcu

SEQ ID NO: 528775 - RNA, 22 nt, Human
uauauauucuuaaguaguguag

SEQ ID NO: 528776 - RNA, 22 nt, Human
cccucagcuucucccugcagcu

SEQ ID NO: 528777 - RNA, 22 nt, Human
ucaggcagaggauggggagcgu

SEQ ID NO: 528778 - RNA, 22 nt, Human
auacuuuggucacuauuauugg

SEQ ID NO: 528779 - RNA, 22 nt, Human
uccucagaugcucuuggacgcc

SEQ ID NO: 528780 - RNA, 22 nt, Human
augucccagcugagagacaacu

SEQ ID NO: 528781 - RNA, 21 nt, Human
uauuuauuaauuuguaaggcu

SEQ ID NO: 528782 - RNA, 22 nt, Human
auuuuucucucacacuuaccag

SEQ ID NO: 528783 - RNA, 22 nt, Human
gaagccaguguuugaagaauuu

SEQ ID NO: 528784 - RNA, 22 nt, Human
cugggccuuggauugacacugu

SEQ ID NO: 528785 - RNA, 22 nt, Human
caaaguuaucaacugcaacauu

SEQ ID NO: 528786 - RNA, 22 nt, Human
uggcucaguagcagugugguca

SEQ ID NO: 528787 - RNA, 22 nt, Human
cucugagggcugucaggaaagg

SEQ ID NO: 528788 - RNA, 22 nt, Human
cccagcauuucugggcugcacu

SEQ ID NO: 528789 - RNA, 22 nt, Human
cugcagggaccacaagcagguu

SEQ ID NO: 528790 - RNA, 22 nt, Human
uuucaguguuaugacuuucauu

SEQ ID NO: 528791 - RNA, 22 nt, Human
uuuccaaaggcuaaacucaguu

SEQ ID NO: 528792 - RNA, 22 nt, Human
uccucuggggcgugguccugga

SEQ ID NO: 528793 - RNA, 23 nt, Human
uugaaagguagcuggcagcuaga

SEQ ID NO: 528794 - RNA, 22 nt, Human
acauguaaacauuuacaguauu

SEQ ID NO: 528795 - RNA, 22 nt, Human
acagcagagacacucaggaggc

SEQ ID NO: 528796 - RNA, 22 nt, Human
gccuggcacauugcaguggauu

SEQ ID NO: 528797 - RNA, 22 nt, Human
ugugguggcuauucuggucuca

SEQ ID NO: 528798 - RNA, 22 nt, Human
uacauaguguuuugaagaauua

SEQ ID NO: 528799 - RNA, 22 nt, Human
uggcagucuucaucaguucugg

SEQ ID NO: 528800 - RNA, 19 nt, Human
guccaguguuuuccaguca

SEQ ID NO: 528801 - RNA, 22 nt, Human
gcugucugcaucucuagagcuu

SEQ ID NO: 528802 - RNA, 22 nt, Human
acagaacagaggguuuuagaau

SEQ ID NO: 528803 - RNA, 22 nt, Human
gcucccagcauugcuucccagg

SEQ ID NO: 528804 - RNA, 22 nt, Human
ggauaagaaaauuguaauaacu

SEQ ID NO: 528805 - RNA, 22 nt, Human
uacaacaggaauuucaacuuug

SEQ ID NO: 528806 - RNA, 22 nt, Human
cugcaggguuuuucaaggacaa

SEQ ID NO: 528807 - RNA, 22 nt, Human
cugagcugaaacuugagaggcu

SEQ ID NO: 528808 - RNA, 22 nt, Human
guccaaggaugcaggaugcugu

SEQ ID NO: 528809 - RNA, 22 nt, Human
ugaaagggguugaguuacagcu

SEQ ID NO: 528810 - RNA, 22 nt, Human
gagaccaggaaguacagcagcc

SEQ ID NO: 528811 - RNA, 22 nt, Human
guggggcuuccuggggcaaguu

SEQ ID NO: 528812 - RNA, 22 nt, Human
gcaguggauggccagcaggggc

SEQ ID NO: 528813 - RNA, 22 nt, Human
ggagccaggcauaucggggcac

SEQ ID NO: 528814 - RNA, 22 nt, Human
gcaaaaauuccagggacgacuc

SEQ ID NO: 528815 - RNA, 21 nt, Human
agaaaaaccagcauguuuuca

SEQ ID NO: 528816 - RNA, 22 nt, Human
ucuuucaauccauucauauguc

SEQ ID NO: 528817 - RNA, 22 nt, Human
aaccauuugcaguuacugagac

SEQ ID NO: 528818 - RNA, 22 nt, Human
uuuaccuaguauaaugcaaccu

SEQ ID NO: 528819 - RNA, 21 nt, Human
uucauucauggcauaauauag

SEQ ID NO: 528820 - RNA, 22 nt, Human
agacauuuuacauucuuccauu

SEQ ID NO: 528821 - RNA, 17 nt, Human
cagagucugucugcauc

SEQ ID NO: 528822 - RNA, 22 nt, Human
acauagaaccuggcacauagua

SEQ ID NO: 528823 - RNA, 22 nt, Human
uuugaacuguucuaggauuuaa

SEQ ID NO: 528824 - RNA, 22 nt, Human
ucugagagcucuggggccccuu

SEQ ID NO: 528825 - RNA, 22 nt, Human
gaaacaugucugacaauuuacc

SEQ ID NO: 528826 - RNA, 22 nt, Human
uuucauggcuaggacuagagug

SEQ ID NO: 528827 - RNA, 22 nt, Human
cagcagagaugagauuccuaua

SEQ ID NO: 528828 - RNA, 22 nt, Human
aaaugguguuucuaaugcuaga

SEQ ID NO: 528829 - RNA, 22 nt, Human
uggguggcggccugguucugag

SEQ ID NO: 528830 - RNA, 23 nt, Human
uuugaaaguaucaacucgccuga

SEQ ID NO: 528831 - RNA, 22 nt, Human
ucaacauuggaggcaacauuca

SEQ ID NO: 528832 - RNA, 20 nt, Human
agauguuuugaagucuugga

SEQ ID NO: 528833 - RNA, 18 nt, Human
caagagcugcuccuggcc

SEQ ID NO: 528834 - RNA, 22 nt, Human
uugcauguuauuuaaucuguau

SEQ ID NO: 528835 - RNA, 22 nt, Human
uugauauucccgauuuaaggua

SEQ ID NO: 528836 - RNA, 22 nt, Human
agcucagggcgaucugucucgg

SEQ ID NO: 528837 - RNA, 22 nt, Human
agaggaggcuggguccagauaa

SEQ ID NO: 528838 - RNA, 22 nt, Human
ggcccagaauacuuuguaaaau

SEQ ID NO: 528839 - RNA, 22 nt, Human
gcagcuguucagcuggccagau

SEQ ID NO: 528840 - RNA, 22 nt, Human
ucauauaaguuuaaaacuaucu

SEQ ID NO: 528841 - RNA, 22 nt, Human
gucuccugagccuugacugcaa

SEQ ID NO: 528842 - RNA, 22 nt, Human
uguacauacauagauauacaca

SEQ ID NO: 528843 - RNA, 22 nt, Human
ucaaucauucuugccauuuauu

SEQ ID NO: 528844 - RNA, 21 nt, Human
uagggcaggcauuggaagaga

SEQ ID NO: 528845 - RNA, 22 nt, Human
ucuggcucacuucaggcuucac

SEQ ID NO: 528846 - RNA, 22 nt, Human
cauacuuuuuagaucugccuuc

SEQ ID NO: 528847 - RNA, 22 nt, Human
uccagaccuagggcaccccagu

SEQ ID NO: 528848 - RNA, 22 nt, Human
ugacucuguaccugucugccuu

SEQ ID NO: 528849 - RNA, 22 nt, Human
uggcuuucucccccagcuucuc

SEQ ID NO: 528850 - RNA, 22 nt, Human
cugaggucaauuaaucaacaac

SEQ ID NO: 528851 - RNA, 22 nt, Human
ggacucuguuuuccugaucacu

SEQ ID NO: 528852 - RNA, 22 nt, Human
uguucucucuggcugccaguac

SEQ ID NO: 528853 - RNA, 22 nt, Human
acagugaugccgggcgagaaug

SEQ ID NO: 528854 - RNA, 22 nt, Human
uaagaccaauccuguguaccuc

SEQ ID NO: 528855 - RNA, 21 nt, Human
uucagcaguccucuagagaua

SEQ ID NO: 528856 - RNA, 22 nt, Human
agucaggauaugccuugugggc

SEQ ID NO: 528857 - RNA, 22 nt, Human
acuuuucuuaucagaaaggcca

SEQ ID NO: 528858 - RNA, 22 nt, Human
aaaaucuggcaacacuaaguuu

SEQ ID NO: 528859 - RNA, 22 nt, Human
ccugccuggcacauaguacucu

SEQ ID NO: 528860 - RNA, 22 nt, Human
gcuggccugcaaagcccggcug

SEQ ID NO: 528861 - RNA, 22 nt, Human
gaauuguagagggaacagaagc

SEQ ID NO: 528862 - RNA, 22 nt, Human
ggcugggccgcggcuacccaga

SEQ ID NO: 528863 - RNA, 22 nt, Human
acucuucaagggccuagaggug

SEQ ID NO: 528864 - RNA, 22 nt, Human
gggcagguacaagaugcuucuu

SEQ ID NO: 528865 - RNA, 22 nt, Human
ggcugccugugcccaggcacac

SEQ ID NO: 528866 - RNA, 22 nt, Human
agcuuuaugaggagaccuuagu

SEQ ID NO: 528867 - RNA, 22 nt, Human
guuacacaggaaaacauuagca

SEQ ID NO: 528868 - RNA, 22 nt, Human
gugggcaggcccuaggcgauuu

SEQ ID NO: 528869 - RNA, 22 nt, Human
ugaagcagcaccauuuuagagc

SEQ ID NO: 528870 - RNA, 22 nt, Human
agagccuguacuuuucugugaa

SEQ ID NO: 528871 - RNA, 22 nt, Human
ucucuggguuuuuguccuguac

SEQ ID NO: 528872 - RNA, 19 nt, Human
uguggccaugguucagcug

SEQ ID NO: 528873 - RNA, 22 nt, Human
ugggaagaugaggugccauggg

SEQ ID NO: 528874 - RNA, 22 nt, Human
ggggugggguuacucauugugc

SEQ ID NO: 528875 - RNA, 22 nt, Human
gcugggcuuguggccagcuggg

SEQ ID NO: 528876 - RNA, 20 nt, Human
gagggcaggcacccauuuca

SEQ ID NO: 528877 - RNA, 22 nt, Human
gagugguaguuucuagaggugu

SEQ ID NO: 528878 - RNA, 17 nt, Human
caacuucacaaacuguc

SEQ ID NO: 528879 - RNA, 22 nt, Human
caaggucagcgugaaguucugu

SEQ ID NO: 528880 - RNA, 22 nt, Human
aacugggcccagucugaguugg

SEQ ID NO: 528881 - RNA, 22 nt, Human
uaguggaggguguagcugcugg

SEQ ID NO: 528882 - RNA, 22 nt, Human
caggccuggggcuggcuuccag

SEQ ID NO: 528883 - RNA, 22 nt, Human
ucaaaguauaucccuucgaaac

SEQ ID NO: 528884 - RNA, 19 nt, Human
acauucccaucagcaaugu

SEQ ID NO: 528885 - RNA, 22 nt, Human
cuggcuuccaugcuguaguggc

SEQ ID NO: 528886 - RNA, 22 nt, Human
agcugggcuggagcuccaagcg

SEQ ID NO: 528887 - RNA, 22 nt, Human
ggcaugggagugagcaaccuua

SEQ ID NO: 528888 - RNA, 22 nt, Human
uuguaaggguuacaagaaaaca

SEQ ID NO: 528889 - RNA, 22 nt, Human
cacagcugccauggcugcacuu

SEQ ID NO: 528890 - RNA, 22 nt, Human
aaaugguaugaaaagagauuuc

SEQ ID NO: 528891 - RNA, 22 nt, Human
uuguuucagcuguaugcuaugu

SEQ ID NO: 528892 - RNA, 22 nt, Human
cagaccagaaggaagccgacaa

SEQ ID NO: 528893 - RNA, 22 nt, Human
uaacuuuuacuuaccaucugag

SEQ ID NO: 528894 - RNA, 22 nt, Human
ucaugcccagagcaguaaauua

SEQ ID NO: 528895 - RNA, 17 nt, Human
aaggccauuuccaccca

SEQ ID NO: 528896 - RNA, 22 nt, Human
cuucaagaagacagcagagcau

SEQ ID NO: 528897 - RNA, 22 nt, Human
ucagggcacugucaccugauau

SEQ ID NO: 528898 - RNA, 22 nt, Human
acagagguguuccagaccuagg

SEQ ID NO: 528899 - RNA, 22 nt, Human
caggguggcacaucacagcauu

SEQ ID NO: 528900 - RNA, 22 nt, Human
gcagagucaggauuccauccca

SEQ ID NO: 528901 - RNA, 22 nt, Human
caggccaaaauucaggcauucu

SEQ ID NO: 528902 - RNA, 22 nt, Human
agagaagagcaaugauaaauuu

SEQ ID NO: 528903 - RNA, 22 nt, Human
cacagggcagaggguccguggc

SEQ ID NO: 528904 - RNA, 19 nt, Human
cccucaggucugagcaguc

SEQ ID NO: 528905 - RNA, 22 nt, Human
ugggaagggucaacagcuggaa

SEQ ID NO: 528906 - RNA, 22 nt, Human
aaacaaugaaauucauucuuca

SEQ ID NO: 528907 - RNA, 22 nt, Human
aaguuuguuuuagucuaaugau

SEQ ID NO: 528908 - RNA, 23 nt, Human
cugugcugggucccaucuugggc

SEQ ID NO: 528909 - RNA, 22 nt, Human
gcaagcugaugugauagugaaa

SEQ ID NO: 528910 - RNA, 22 nt, Human
cagaguguuagcgcugguuggg

SEQ ID NO: 528911 - RNA, 22 nt, Human
uuaaggcugauaagucagauau

SEQ ID NO: 528912 - RNA, 22 nt, Human
uuccuggugguggugacagcac

SEQ ID NO: 528913 - RNA, 22 nt, Human
uauuggaaggaagcaagagagg

SEQ ID NO: 528914 - RNA, 21 nt, Human
ccauaauuuuguuucagaagu

SEQ ID NO: 528915 - RNA, 18 nt, Human
gugugcaguugcaggggu

SEQ ID NO: 528916 - RNA, 22 nt, Human
caacagaaaucaauuuucccau

SEQ ID NO: 528917 - RNA, 22 nt, Human
aggugccagaugcacagcugaa

SEQ ID NO: 528918 - RNA, 22 nt, Human
aauuaccaggauuuuucaguau

SEQ ID NO: 528919 - RNA, 22 nt, Human
agugucauuccagggacccucg

SEQ ID NO: 528920 - RNA, 22 nt, Human
ucauuuaucauuugugcuguag

SEQ ID NO: 528921 - RNA, 22 nt, Human
ggagagaacugaccugaaagga

SEQ ID NO: 528922 - RNA, 22 nt, Human
aaucgguugaacccaggaagug

SEQ ID NO: 528923 - RNA, 19 nt, Human
ggcugucuggcguguggau

SEQ ID NO: 528924 - RNA, 22 nt, Human
cagcacugcuucgcagccaggg

SEQ ID NO: 528925 - RNA, 22 nt, Human
uaaacgugcuucauauuuuuag

SEQ ID NO: 528926 - RNA, 22 nt, Human
cuauuucuaaaccuauaaguga

SEQ ID NO: 528927 - RNA, 22 nt, Human
cacccaggcuagagugcagugg

SEQ ID NO: 528928 - RNA, 22 nt, Human
ggcauagcggcucagcguccag

SEQ ID NO: 528929 - RNA, 15 nt, Human
cagucccagggaccc

SEQ ID NO: 528930 - RNA, 22 nt, Human
gaagcccagggcguggccgggc

SEQ ID NO: 528931 - RNA, 22 nt, Human
cagggccucuccuccaggaacu

SEQ ID NO: 528932 - RNA, 22 nt, Human
cccagaguauuugugauguuag

SEQ ID NO: 528933 - RNA, 22 nt, Human
ggcacuuuucuccccggucaug

SEQ ID NO: 528934 - RNA, 22 nt, Human
gaaauauugggacucagagcuu

SEQ ID NO: 528935 - RNA, 20 nt, Human
ugcagcuucaccugugucau

SEQ ID NO: 528936 - RNA, 22 nt, Human
cuucuggauuuauucauuccuu

SEQ ID NO: 528937 - RNA, 22 nt, Human
acagguggcagaagcauuuacu

SEQ ID NO: 528938 - RNA, 23 nt, Human
ggccuccuggucuaggcuagacu

SEQ ID NO: 528939 - RNA, 22 nt, Human
ugaggggauacgguacacauug

SEQ ID NO: 528940 - RNA, 22 nt, Human
cacaggaggaggugcccgggcc

SEQ ID NO: 528941 - RNA, 22 nt, Human
aguacaaaggcccuugauuacu

SEQ ID NO: 528942 - RNA, 22 nt, Human
accucugccaagaugugcuccc

SEQ ID NO: 528943 - RNA, 22 nt, Human
ggacagaaaccauaugagugua

SEQ ID NO: 528944 - RNA, 22 nt, Human
gaaguuagucuugaaguuaguc

SEQ ID NO: 528945 - RNA, 20 nt, Human
cccagccccuaccuguugcc

SEQ ID NO: 528946 - RNA, 22 nt, Human
ugcuauugugaacagugccaca

SEQ ID NO: 528947 - RNA, 22 nt, Human
uccaggcaaagggacuagcagg

SEQ ID NO: 528948 - RNA, 22 nt, Human
aagguuaaauagguauuuucca

SEQ ID NO: 528949 - RNA, 22 nt, Human
uucuccagagggcucugcagga

SEQ ID NO: 528950 - RNA, 22 nt, Human
augaagucugcacaugcaugug

SEQ ID NO: 528951 - RNA, 22 nt, Human
ucuaauccuugcuaccugggug

SEQ ID NO: 528952 - RNA, 22 nt, Human
uuugaaacaggugauucagcua

SEQ ID NO: 528953 - RNA, 22 nt, Human
uguaaacaguaggacuaaagag

SEQ ID NO: 528954 - RNA, 22 nt, Human
ucacaucuuauuagaguaucuc

SEQ ID NO: 528955 - RNA, 22 nt, Human
aagcgcagacacagagagugga

SEQ ID NO: 528956 - RNA, 22 nt, Human
aggcagggaccaguuguuuucu

SEQ ID NO: 528957 - RNA, 22 nt, Human
ccagcuggggaaguggggcaua

SEQ ID NO: 528958 - RNA, 22 nt, Human
ggaaaacaagagaaugauguuu

SEQ ID NO: 528959 - RNA, 18 nt, Human
cagucccaaaccuuagga

SEQ ID NO: 528960 - RNA, 22 nt, Human
guggaggaaaagaaguugggug

SEQ ID NO: 528961 - RNA, 22 nt, Human
gacaaagugcuaaaccacagag

SEQ ID NO: 528962 - RNA, 22 nt, Human
aaaggcaagcauuuauauagga

SEQ ID NO: 528963 - RNA, 22 nt, Human
aaucagaacuucucaggguggg

SEQ ID NO: 528964 - RNA, 22 nt, Human
agaggcccucucucuccugaug

SEQ ID NO: 528965 - RNA, 22 nt, Human
uuagaaaugauuucaccucuuu

SEQ ID NO: 528966 - RNA, 22 nt, Human
uaugugcaguuugcucuuaaca

SEQ ID NO: 528967 - RNA, 22 nt, Human
uuuccaaauaaggucacauucu

SEQ ID NO: 528968 - RNA, 22 nt, Human
gggagcuguaguccagauaccg

SEQ ID NO: 528969 - RNA, 22 nt, Human
guuugcaaauuguguuaaagcu

SEQ ID NO: 528970 - RNA, 22 nt, Human
uggaagaccacaagcccuuaac

SEQ ID NO: 528971 - RNA, 22 nt, Human
cacagggcaggccccaggccuc

SEQ ID NO: 528972 - RNA, 22 nt, Human
auccucaguguuucugacaucu

SEQ ID NO: 528973 - RNA, 18 nt, Human
cuuguucuucucuuggcg

SEQ ID NO: 528974 - RNA, 22 nt, Human
ggcggguguaaguaggacagcg

SEQ ID NO: 528975 - RNA, 22 nt, Human
uguagcucuccagccagcaagg

SEQ ID NO: 528976 - RNA, 22 nt, Human
accucccagcucugagcuuggg

SEQ ID NO: 528977 - RNA, 22 nt, Human
cccuuucccuucuggcucaggg

SEQ ID NO: 528978 - RNA, 22 nt, Human
ucuucuuccucauuuauacaua

SEQ ID NO: 528979 - RNA, 22 nt, Human
aggccagguggucaugcuugcu

SEQ ID NO: 528980 - RNA, 22 nt, Human
ccagcagcucccucaggguccg

SEQ ID NO: 528981 - RNA, 22 nt, Human
gggccucucccuucucacgcau

SEQ ID NO: 528982 - RNA, 22 nt, Human
uuuacugagugaccuagaauaa

SEQ ID NO: 528983 - RNA, 22 nt, Human
gggcuggggcucaauaauuugu

SEQ ID NO: 528984 - RNA, 22 nt, Human
cuggacagaaagggcugcugug

SEQ ID NO: 528985 - RNA, 22 nt, Human
aaagcagucacuccagugugau

SEQ ID NO: 528986 - RNA, 22 nt, Human
cagacaggcaggugagagcucc

SEQ ID NO: 528987 - RNA, 22 nt, Human
ggggccagcacugugccuuugu

SEQ ID NO: 528988 - RNA, 22 nt, Human
uuccuauggcucaguugcauuu

SEQ ID NO: 528989 - RNA, 22 nt, Human
ugaggcucacaaaucugcauuu

SEQ ID NO: 528990 - RNA, 22 nt, Human
uuucaaguucuguuccuaaacu

SEQ ID NO: 528991 - RNA, 22 nt, Human
gugcuccuggccacaugaagcu

SEQ ID NO: 528992 - RNA, 22 nt, Human
gggaucagcaagccacugcacc

SEQ ID NO: 528993 - RNA, 22 nt, Human
accagccagccacaguggcucc

SEQ ID NO: 528994 - RNA, 22 nt, Human
ccuccagcgcgauccacuccgg

SEQ ID NO: 528995 - RNA, 22 nt, Human
gccuuuugaaauagaaaucuga

SEQ ID NO: 528996 - RNA, 22 nt, Human
caggaaaugaacaggaaugaac

SEQ ID NO: 528997 - RNA, 21 nt, Human
aucagcaaaugccugucuccc

SEQ ID NO: 528998 - RNA, 22 nt, Human
ucagcagggaggcucugugccc

SEQ ID NO: 528999 - RNA, 22 nt, Human
cugccugugugugccugcagaa

SEQ ID NO: 529000 - RNA, 22 nt, Human
auagcuguuagauuggggucga

SEQ ID NO: 529001 - RNA, 21 nt, Human
agcaggaggcagucacagcuc

SEQ ID NO: 529002 - RNA, 22 nt, Human
aaggccugggaggccucucuuc

SEQ ID NO: 529003 - RNA, 22 nt, Human
ggggcagggagguuaucgccga

SEQ ID NO: 529004 - RNA, 22 nt, Human
cagggaggcugucuuaugccug

SEQ ID NO: 529005 - RNA, 22 nt, Human
ugucucugugagaucugacgau

SEQ ID NO: 529006 - RNA, 22 nt, Human
agcugucucugguauuauguga

SEQ ID NO: 529007 - RNA, 22 nt, Human
cucuguccacagguuugucccu

SEQ ID NO: 529008 - RNA, 22 nt, Human
uacagauugagguuuuuaauau

SEQ ID NO: 529009 - RNA, 22 nt, Human
ccacauuuacuggaugcucagg

SEQ ID NO: 529010 - RNA, 23 nt, Human
ucucagaggauuccugggccuug

SEQ ID NO: 529011 - RNA, 22 nt, Human
gaaaagcuaggccaguucagcu

SEQ ID NO: 529012 - RNA, 22 nt, Human
auucuuuuaaauggcaguagua

SEQ ID NO: 529013 - RNA, 22 nt, Human
aucaguuuuuauuaauguagcu

SEQ ID NO: 529014 - RNA, 22 nt, Human
ucccacucccaggcaggccucu

SEQ ID NO: 529015 - RNA, 22 nt, Human
uucagcuucauuugucuuuaug

SEQ ID NO: 529016 - RNA, 22 nt, Human
uuaauauguugaaauuuauuag

SEQ ID NO: 529017 - RNA, 22 nt, Human
cauucauuuaugaaauaucuau

SEQ ID NO: 529018 - RNA, 22 nt, Human
cagggugcgccacucagaugua

SEQ ID NO: 529019 - RNA, 22 nt, Human
uagcagaguaucuugcaaauua

SEQ ID NO: 529020 - RNA, 22 nt, Human
gcuggggaggcagcagagaaca

SEQ ID NO: 529021 - RNA, 22 nt, Human
aagucacaagcauauaugcauu

SEQ ID NO: 529022 - RNA, 22 nt, Human
uggaaguggcagaaaaugaaca

SEQ ID NO: 529023 - RNA, 22 nt, Human
aagcagagccugagacagggau

SEQ ID NO: 529024 - RNA, 22 nt, Human
ugcuggggauccguaccaaccc

SEQ ID NO: 529025 - RNA, 22 nt, Human
caggugggccgggguuuguucu

SEQ ID NO: 529026 - RNA, 22 nt, Human
aggaccuguagggccugcaucc

SEQ ID NO: 529027 - RNA, 21 nt, Human
uucaaaguuugccuaaagauu

SEQ ID NO: 529028 - RNA, 22 nt, Human
uaaagaacacagggaauagcac

SEQ ID NO: 529029 - RNA, 22 nt, Human
gccugcagauauauaggauggu

SEQ ID NO: 529030 - RNA, 22 nt, Human
aaaaacugcaauuacuuuuguc

SEQ ID NO: 529031 - RNA, 22 nt, Human
ggcagggaggaggugaaaguga

SEQ ID NO: 529032 - RNA, 23 nt, Human
ccuggcuguggauuugggccugc

SEQ ID NO: 529033 - RNA, 21 nt, Human
ucuggagucaucuuuaccaua

SEQ ID NO: 529034 - RNA, 19 nt, Human
ucccuucuauaguaauaaa

SEQ ID NO: 529035 - RNA, 22 nt, Human
cagaaacuagauuuagacacaa

SEQ ID NO: 529036 - RNA, 22 nt, Human
uuuucauguuccuuguuaagug

SEQ ID NO: 529037 - RNA, 22 nt, Human
ucugggaguuagaauacauggg

SEQ ID NO: 529038 - RNA, 22 nt, Human
cugggagcaagaggcugcaaau

SEQ ID NO: 529039 - RNA, 22 nt, Human
auuuuguugaugguggaguagc

SEQ ID NO: 529040 - RNA, 22 nt, Human
agagcuguucaacguagcaaug

SEQ ID NO: 529041 - RNA, 22 nt, Human
uuauucagauuggcuacaggau

SEQ ID NO: 529042 - RNA, 20 nt, Human
acucuugagaaauucucugu

SEQ ID NO: 529043 - RNA, 22 nt, Human
gcagagaagaugcccaggcuuc

SEQ ID NO: 529044 - RNA, 22 nt, Human
gcucccaggaugaggagccagg

SEQ ID NO: 529045 - RNA, 22 nt, Human
gcagcuggauuucaagagggag

SEQ ID NO: 529046 - RNA, 22 nt, Human
cacuauuuauacuuccugaucc

SEQ ID NO: 529047 - RNA, 22 nt, Human
auuucuguuugcuacuauaagu

SEQ ID NO: 529048 - RNA, 22 nt, Human
uuugaaagagcugauacaugaa

SEQ ID NO: 529049 - RNA, 22 nt, Human
uggcagguuuccuccucauagu

SEQ ID NO: 529050 - RNA, 22 nt, Human
gccugccugcugucaucugccu

SEQ ID NO: 529051 - RNA, 22 nt, Human
ggagucagaacccaggcuucua

SEQ ID NO: 529052 - RNA, 18 nt, Human
uuacuguuaucaaaacag

SEQ ID NO: 529053 - RNA, 22 nt, Human
ucccuuaagcaccugaguaguc

SEQ ID NO: 529054 - RNA, 22 nt, Human
caggcagagcaacugguccaga

SEQ ID NO: 529055 - RNA, 22 nt, Human
gacauuuacugaauacugauua

SEQ ID NO: 529056 - RNA, 22 nt, Human
ggagauggcucugcaaggucua

SEQ ID NO: 529057 - RNA, 22 nt, Human
uuucucaacuguauuaugcaga

SEQ ID NO: 529058 - RNA, 22 nt, Human
uccagcagguccgagacaaguu

SEQ ID NO: 529059 - RNA, 22 nt, Human
acugucaauagugcugagcuug

SEQ ID NO: 529060 - RNA, 22 nt, Human
aaacuuuaagacaguccucaag

SEQ ID NO: 529061 - RNA, 22 nt, Human
augggaggaugcucgggugcuc

SEQ ID NO: 529062 - RNA, 23 nt, Human
aggcagugucucuuauccugucc

SEQ ID NO: 529063 - RNA, 21 nt, Human
ucgugcagcagcugaggcuug

SEQ ID NO: 529064 - RNA, 22 nt, Human
cugcugagaaaagacugaggga

SEQ ID NO: 529065 - RNA, 22 nt, Human
aggugagguuugggagguguca

SEQ ID NO: 529066 - RNA, 22 nt, Human
agaaacuaagucauaacucuuu

SEQ ID NO: 529067 - RNA, 21 nt, Human
ccaaaggcuauguaucuucug

SEQ ID NO: 529068 - RNA, 22 nt, Human
agugauuugggugucagaaagu

SEQ ID NO: 529069 - RNA, 22 nt, Human
gaaauacaggaaugccacacag

SEQ ID NO: 529070 - RNA, 21 nt, Human
ugcagugucccuaacaguggu

SEQ ID NO: 529071 - RNA, 22 nt, Human
agagacaggguuuugucguguu

SEQ ID NO: 529072 - RNA, 22 nt, Human
cagcaauaagguaagcuucucc

SEQ ID NO: 529073 - RNA, 22 nt, Human
cuggccagguuuugaacaguug

SEQ ID NO: 529074 - RNA, 22 nt, Human
guugugcagggcgaggaccuga

SEQ ID NO: 529075 - RNA, 22 nt, Human
cacugucuuuugugaagacaau

SEQ ID NO: 529076 - RNA, 22 nt, Human
uaguccaguaaaacagcuaacg

SEQ ID NO: 529077 - RNA, 22 nt, Human
gcagggaccucacuacccccag

SEQ ID NO: 529078 - RNA, 22 nt, Human
gagagucacugucugcauuucc

SEQ ID NO: 529079 - RNA, 21 nt, Human
cugagggccgcagcugggcuc

SEQ ID NO: 529080 - RNA, 22 nt, Human
cagccaggacagggaaacuagu

SEQ ID NO: 529081 - RNA, 22 nt, Human
acacuguguggucucucucgga

SEQ ID NO: 529082 - RNA, 22 nt, Human
uuucacauaaauggaguaaaga

SEQ ID NO: 529083 - RNA, 22 nt, Human
acaacaucagcugagaccuuca

SEQ ID NO: 529084 - RNA, 22 nt, Human
agggccagccaggcccuacaaa

SEQ ID NO: 529085 - RNA, 22 nt, Human
ggcugcuguacugaugucaguu

SEQ ID NO: 529086 - RNA, 22 nt, Human
acaguaauauugaugcucguca

SEQ ID NO: 529087 - RNA, 22 nt, Human
ggggucccugcaccagcauguc

SEQ ID NO: 529088 - RNA, 22 nt, Human
ugggccuuggaucgcuaagcug

SEQ ID NO: 529089 - RNA, 22 nt, Human
caugggcuacagaagcaugcug

SEQ ID NO: 529090 - RNA, 22 nt, Human
augguguagcaugugauaugac

SEQ ID NO: 529091 - RNA, 22 nt, Human
cccagcucaucaggagccgccc

SEQ ID NO: 529092 - RNA, 22 nt, Human
agauggggcucaguguggaggc

SEQ ID NO: 529093 - RNA, 22 nt, Human
agagccagagaccuggguucac

SEQ ID NO: 529094 - RNA, 22 nt, Human
cuggagguaauguuauuuuugu

SEQ ID NO: 529095 - RNA, 22 nt, Human
uaucuuuauuaugucuaucugc

SEQ ID NO: 529096 - RNA, 22 nt, Human
guuucacagucugcagaauuuu

SEQ ID NO: 529097 - RNA, 22 nt, Human
cucugggcaggaccaguggacc

SEQ ID NO: 529098 - RNA, 22 nt, Human
auggacaaugugaaacuacaag

SEQ ID NO: 529099 - RNA, 19 nt, Human
guuuuuaguuucugaacug

SEQ ID NO: 529100 - RNA, 22 nt, Human
aagucuggaagucucaguuuuc

SEQ ID NO: 529101 - RNA, 22 nt, Human
ccaaggagaaaugcugugcuuu

SEQ ID NO: 529102 - RNA, 22 nt, Human
cugccucaugcugccugcagcc

SEQ ID NO: 529103 - RNA, 22 nt, Human
cucacuggcaagacuacaggug

SEQ ID NO: 529104 - RNA, 22 nt, Human
aguggcugagugacugugacuc

SEQ ID NO: 529105 - RNA, 22 nt, Human
ucucagagaugucaagagucua

SEQ ID NO: 529106 - RNA, 22 nt, Human
agcaaaguagcugcuguucuua

SEQ ID NO: 529107 - RNA, 22 nt, Human
ugucuuuucuacuguaagcaua

SEQ ID NO: 529108 - RNA, 22 nt, Human
cccugcuuagcacccuugcacc

SEQ ID NO: 529109 - RNA, 22 nt, Human
auugugaauaaugcugcaauaa

SEQ ID NO: 529110 - RNA, 20 nt, Human
uuccacaucuuugcacaugc

SEQ ID NO: 529111 - RNA, 22 nt, Human
uuuagagaguguaaaaauauau

SEQ ID NO: 529112 - RNA, 22 nt, Human
uugcauugaucccagcuugggc

SEQ ID NO: 529113 - RNA, 19 nt, Human
ugcccugcacgcuguccug

SEQ ID NO: 529114 - RNA, 22 nt, Human
gugggcagcaccagggaagugu

SEQ ID NO: 529115 - RNA, 22 nt, Human
uucagcuauggagucuuaguua

SEQ ID NO: 529116 - RNA, 21 nt, Human
ucugucugguuuuagaguggc

SEQ ID NO: 529117 - RNA, 22 nt, Human
uugcccugcagcggugaguggu

SEQ ID NO: 529118 - RNA, 22 nt, Human
auauuagguuggugcaaaagua

SEQ ID NO: 529119 - RNA, 22 nt, Human
ucaguauuccuggaaauacaag

SEQ ID NO: 529120 - RNA, 22 nt, Human
ucaaugauagacaagaucuaag

SEQ ID NO: 529121 - RNA, 17 nt, Human
gcugagugcagggaguc

SEQ ID NO: 529122 - RNA, 22 nt, Human
uuggaauuuaguaaaauaaugc

SEQ ID NO: 529123 - RNA, 22 nt, Human
gaacucaacacaguauuuggua

SEQ ID NO: 529124 - RNA, 22 nt, Human
ccuggagcucacugggagccgg

SEQ ID NO: 529125 - RNA, 22 nt, Human
guugggaaggcaagaaguagaa

SEQ ID NO: 529126 - RNA, 21 nt, Human
aggaaguggccagauugggaa

SEQ ID NO: 529127 - RNA, 22 nt, Human
aaacacuguacaaucugcaggg

SEQ ID NO: 529128 - RNA, 22 nt, Human
guuuucaaggggauuuaacuga

SEQ ID NO: 529129 - RNA, 22 nt, Human
gaauuuaaggaccaagcauuuu

SEQ ID NO: 529130 - RNA, 22 nt, Human
augucagauuccuaaauaucuu

SEQ ID NO: 529131 - RNA, 22 nt, Human
aaucacauuacagcauaucugu

SEQ ID NO: 529132 - RNA, 22 nt, Human
uguucuuaugaauucaagacac

SEQ ID NO: 529133 - RNA, 19 nt, Human
gcugcucugggucucaucu

SEQ ID NO: 529134 - RNA, 22 nt, Human
uguuucagucccuguguucaau

SEQ ID NO: 529135 - RNA, 22 nt, Human
cugggaggugcagcaaaaauca

SEQ ID NO: 529136 - RNA, 22 nt, Human
ggugcccuggaagcugcugcau

SEQ ID NO: 529137 - RNA, 22 nt, Human
uuccaagugcugaggacaguag

SEQ ID NO: 529138 - RNA, 22 nt, Human
ucccagcauaacaaacugcccg

SEQ ID NO: 529139 - RNA, 22 nt, Human
cccccaaggccaggcugagacc

SEQ ID NO: 529140 - RNA, 23 nt, Human
aucuagaaaccugaugacucugu

SEQ ID NO: 529141 - RNA, 22 nt, Human
ucaggauguccaaaauccagcc

SEQ ID NO: 529142 - RNA, 21 nt, Human
gcugccugccccucgggggcu

SEQ ID NO: 529143 - RNA, 22 nt, Human
ggcuuccuggggccuccugcaa

SEQ ID NO: 529144 - RNA, 22 nt, Human
gauuucuuugaauuagagaggu

SEQ ID NO: 529145 - RNA, 22 nt, Human
gugcaggugaccuaauccaugu

SEQ ID NO: 529146 - RNA, 22 nt, Human
ccuuccuggcuguccgccugau

SEQ ID NO: 529147 - RNA, 22 nt, Human
cccauggguuuuccucccugcc

SEQ ID NO: 529148 - RNA, 22 nt, Human
ucuggaguccagauccauuugg

SEQ ID NO: 529149 - RNA, 22 nt, Human
caggaaaugcuaucauagcuga

SEQ ID NO: 529150 - RNA, 22 nt, Human
ccaggccucccuuuuccagcca

SEQ ID NO: 529151 - RNA, 22 nt, Human
agagggcugccucagucagcua

SEQ ID NO: 529152 - RNA, 18 nt, Human
aauuucuuugacaacuua

SEQ ID NO: 529153 - RNA, 22 nt, Human
cugcucugugcacuuguucagg

SEQ ID NO: 529154 - RNA, 22 nt, Human
gaauacaugauacaugaacugc

SEQ ID NO: 529155 - RNA, 18 nt, Human
aggccugggaagcugagg

SEQ ID NO: 529156 - RNA, 22 nt, Human
uguccucuaauuggccucuugc

SEQ ID NO: 529157 - RNA, 19 nt, Human
aaacacagauuucuuacca

SEQ ID NO: 529158 - RNA, 22 nt, Human
gccugcugaaccucaugcaguc

SEQ ID NO: 529159 - RNA, 22 nt, Human
agaccaagacuauaaugagagg

SEQ ID NO: 529160 - RNA, 22 nt, Human
cagcccaggucucucuuccagu

SEQ ID NO: 529161 - RNA, 22 nt, Human
ugcuagaauaccuaccuggagg

SEQ ID NO: 529162 - RNA, 22 nt, Human
ggcccugcaagguacccaggcc

SEQ ID NO: 529163 - RNA, 22 nt, Human
agagcuguagcuuccuagagcc

SEQ ID NO: 529164 - RNA, 22 nt, Human
acaggcugccuaccaaguauca

SEQ ID NO: 529165 - RNA, 22 nt, Human
uuucacauaugguuguugauug

SEQ ID NO: 529166 - RNA, 22 nt, Human
aagagaauaucgauagcacucu

SEQ ID NO: 529167 - RNA, 22 nt, Human
uagaaacaucagcuaaccaaaa

SEQ ID NO: 529168 - RNA, 22 nt, Human
ucucccaacauguggaggucag

SEQ ID NO: 529169 - RNA, 22 nt, Human
agcucugcaggcacagcugagg

SEQ ID NO: 529170 - RNA, 20 nt, Human
aggaacuggaagggaggaaa

SEQ ID NO: 529171 - RNA, 22 nt, Human
aaguaaaauguuuccuuuauua

SEQ ID NO: 529172 - RNA, 22 nt, Human
gggugcaggggacccuagggac

SEQ ID NO: 529173 - RNA, 22 nt, Human
gccuuuuuuguugcucugucac

SEQ ID NO: 529174 - RNA, 22 nt, Human
agugcagcuuauaaagcaucaa

SEQ ID NO: 529175 - RNA, 22 nt, Human
ugccacugggcaugcagauguc

SEQ ID NO: 529176 - RNA, 19 nt, Human
acagaagcauagaaaagga

SEQ ID NO: 529177 - RNA, 22 nt, Human
gggucagcugcugggggcugac

SEQ ID NO: 529178 - RNA, 22 nt, Human
cuguggaagguuuagauaggua

SEQ ID NO: 529179 - RNA, 22 nt, Human
uuugacagacauuuacuacauu

SEQ ID NO: 529180 - RNA, 22 nt, Human
guggggcugaguggagccagaa

SEQ ID NO: 529181 - RNA, 22 nt, Human
aacuguugcuuguaauaugugc

SEQ ID NO: 529182 - RNA, 22 nt, Human
ucagaagaaagauguuauuacu

SEQ ID NO: 529183 - RNA, 20 nt, Human
gggagaagggcugaugagag

SEQ ID NO: 529184 - RNA, 19 nt, Human
agcagcguuuaaaaaaugc

SEQ ID NO: 529185 - RNA, 22 nt, Human
agcauaaaauaaauaguuugca

SEQ ID NO: 529186 - RNA, 20 nt, Human
cccaggagugagcagcuuua

SEQ ID NO: 529187 - RNA, 22 nt, Human
ugagaauuuuuugucaugcauu

SEQ ID NO: 529188 - RNA, 22 nt, Human
augcuguguggucaaguuaauu

SEQ ID NO: 529189 - RNA, 22 nt, Human
cugcagcuuuggaaaccuguuu

SEQ ID NO: 529190 - RNA, 20 nt, Human
uccugagauuuaagggguuc

SEQ ID NO: 529191 - RNA, 22 nt, Human
uauuaucauugguaauaugguc

SEQ ID NO: 529192 - RNA, 22 nt, Human
aaguaacuuauuugcaaacagg

SEQ ID NO: 529193 - RNA, 22 nt, Human
ggaagcccagcugucuccuguc

SEQ ID NO: 529194 - RNA, 22 nt, Human
aaguuacaggagaaagagauca

SEQ ID NO: 529195 - RNA, 22 nt, Human
agagcuggauggucaagauggc

SEQ ID NO: 529196 - RNA, 22 nt, Human
gagccuccuccuggugugccga

SEQ ID NO: 529197 - RNA, 19 nt, Human
ucugcauggcaggaagaga

SEQ ID NO: 529198 - RNA, 22 nt, Human
uaggcugagcuuguagaucgua

SEQ ID NO: 529199 - RNA, 22 nt, Human
uccagucaagcuugagaauuuc

SEQ ID NO: 529200 - RNA, 22 nt, Human
gcugggagccccgagccagcgc

SEQ ID NO: 529201 - RNA, 22 nt, Human
ggagugggcagcacugcccugu

SEQ ID NO: 529202 - RNA, 19 nt, Human
agggaguuuauauuugcac

SEQ ID NO: 529203 - RNA, 22 nt, Human
cuucccagaccuuagagugcag

SEQ ID NO: 529204 - RNA, 20 nt, Human
gccucagccaacccaugggg

SEQ ID NO: 529205 - RNA, 22 nt, Human
ggcugccaggagggaggccagu

SEQ ID NO: 529206 - RNA, 22 nt, Human
aaaggcaggacugcagcauagg

SEQ ID NO: 529207 - RNA, 22 nt, Human
ucugccuguucccgauuccaug

SEQ ID NO: 529208 - RNA, 22 nt, Human
cagggugacugcccuggccacu

SEQ ID NO: 529209 - RNA, 22 nt, Human
ggggcagauggaacagagcaca

SEQ ID NO: 529210 - RNA, 22 nt, Human
gccuuccuuuuaccaccagcca

SEQ ID NO: 529211 - RNA, 20 nt, Human
uccugggguaagccaugguc

SEQ ID NO: 529212 - RNA, 22 nt, Human
ucaggcucccugcugggcucug

SEQ ID NO: 529213 - RNA, 22 nt, Human
uuugaaagcaccauuugaguag

SEQ ID NO: 529214 - RNA, 22 nt, Human
aaaugguaagacaacacauuau

SEQ ID NO: 529215 - RNA, 22 nt, Human
gcacagccugucccuguccugg

SEQ ID NO: 529216 - RNA, 22 nt, Human
ccaccagcuucagcagccgcgg

SEQ ID NO: 529217 - RNA, 22 nt, Human
agcagggcaugaauaaggguuu

SEQ ID NO: 529218 - RNA, 22 nt, Human
aauuaacagagggcuuauuacu

SEQ ID NO: 529219 - RNA, 22 nt, Human
uuauuuagucuagaugaauuuu

SEQ ID NO: 529220 - RNA, 21 nt, Human
ccaggcugggagggcaguucc

SEQ ID NO: 529221 - RNA, 22 nt, Human
gaggccagaaugagcugaaugc

SEQ ID NO: 529222 - RNA, 22 nt, Human
aaagauuuaagaauaauuugug

SEQ ID NO: 529223 - RNA, 22 nt, Human
uacugaaagaauacauaauuuc

SEQ ID NO: 529224 - RNA, 22 nt, Human
aggcaaaauuacaaaguuauua

SEQ ID NO: 529225 - RNA, 22 nt, Human
uuucuccaauguaucagcacac

SEQ ID NO: 529226 - RNA, 22 nt, Human
cagccagggagggcaaaugaga

SEQ ID NO: 529227 - RNA, 22 nt, Human
caggaggaacaagagguucugg

SEQ ID NO: 529228 - RNA, 22 nt, Human
gaaaauaggcugcaucuccuuc

SEQ ID NO: 529229 - RNA, 22 nt, Human
gugcccagcuccaccucacaga

SEQ ID NO: 529230 - RNA, 22 nt, Human
gcugucugcaagccaggaaaug

SEQ ID NO: 529231 - RNA, 22 nt, Human
aaagacagauggcaaggaugau

SEQ ID NO: 529232 - RNA, 22 nt, Human
auuuaaauuuucugauggagag

SEQ ID NO: 529233 - RNA, 22 nt, Human
uuuuccucugagcuuugaauaa

SEQ ID NO: 529234 - RNA, 22 nt, Human
cuuaaggcuucagcacagguau

SEQ ID NO: 529235 - RNA, 19 nt, Human
aggguacacgagagaagag

SEQ ID NO: 529236 - RNA, 22 nt, Human
caugggcaguuggcagggcuca

SEQ ID NO: 529237 - RNA, 22 nt, Human
aguuguaagagacagauauaaa

SEQ ID NO: 529238 - RNA, 22 nt, Human
gcugucacacauggccccagcu

SEQ ID NO: 529239 - RNA, 22 nt, Human
caauaauauccugugcuguuug

SEQ ID NO: 529240 - RNA, 22 nt, Human
aaacauuagacaccauaugcuc

SEQ ID NO: 529241 - RNA, 22 nt, Human
ucagcugcuucauguucugaau

SEQ ID NO: 529242 - RNA, 22 nt, Human
aucaguguauucauagggaaua

SEQ ID NO: 529243 - RNA, 22 nt, Human
gcugcucucagagcucaugcug

SEQ ID NO: 529244 - RNA, 22 nt, Human
acauuuguuucucuagaguagg

SEQ ID NO: 529245 - RNA, 22 nt, Human
aggacagugguguucuggagug

SEQ ID NO: 529246 - RNA, 22 nt, Human
ugauucuuucuccaccaauuca

SEQ ID NO: 529247 - RNA, 22 nt, Human
cagggcaggaauuugacauugc

SEQ ID NO: 529248 - RNA, 22 nt, Human
ccagaggcuggguucaccucag

SEQ ID NO: 529249 - RNA, 22 nt, Human
uucaacaugcuuuauuucuaaa

SEQ ID NO: 529250 - RNA, 22 nt, Human
ucagauuugaauauuccuuucg

SEQ ID NO: 529251 - RNA, 20 nt, Human
ggcagccaaucagcgugccg

SEQ ID NO: 529252 - RNA, 22 nt, Human
gaaggaaaggucucaugccuuu

SEQ ID NO: 529253 - RNA, 22 nt, Human
gagcugggacauggguccucuc

SEQ ID NO: 529254 - RNA, 22 nt, Human
cccaggcagugcugaucccuca

SEQ ID NO: 529255 - RNA, 22 nt, Human
ucucagggugaggaaagaauuu

SEQ ID NO: 529256 - RNA, 22 nt, Human
auaaggcagucccuuaacaagg

SEQ ID NO: 529257 - RNA, 22 nt, Human
gcagugcuaaguagcuggccca

SEQ ID NO: 529258 - RNA, 20 nt, Human
agacccuguguccuguggcc

SEQ ID NO: 529259 - RNA, 22 nt, Human
cuguaugauuccauuucuauaa

SEQ ID NO: 529260 - RNA, 22 nt, Human
aggaagccuggcauuaaaaagc

SEQ ID NO: 529261 - RNA, 22 nt, Human
gggcaugguggugcacaccugu

SEQ ID NO: 529262 - RNA, 22 nt, Human
aaagaucagucugaagcaacau

SEQ ID NO: 529263 - RNA, 22 nt, Human
cucugcaugccuugcucagaca

SEQ ID NO: 529264 - RNA, 22 nt, Human
cagaggcagaauggagauuugg

SEQ ID NO: 529265 - RNA, 22 nt, Human
acagauuuuaaaugacacuccc

SEQ ID NO: 529266 - RNA, 18 nt, Human
uaacaauccugagugucu

SEQ ID NO: 529267 - RNA, 21 nt, Human
uuuaauuugcauguaugacgc

SEQ ID NO: 529268 - RNA, 22 nt, Human
agggcacagccuaaagccuaug

SEQ ID NO: 529269 - RNA, 22 nt, Human
uucacagaugccugaugugugg

SEQ ID NO: 529270 - RNA, 22 nt, Human
ugaaaaugcccucuaugucuca

SEQ ID NO: 529271 - RNA, 22 nt, Human
agaaaucaugacuaagagcagu

SEQ ID NO: 529272 - RNA, 22 nt, Human
caagauauguccuguuacuaag

SEQ ID NO: 529273 - RNA, 22 nt, Human
aaacacagcauguccuugggga

SEQ ID NO: 529274 - RNA, 22 nt, Human
cugguccuccuugccuucagau

SEQ ID NO: 529275 - RNA, 22 nt, Human
ugccuuccuggagcugaaggcu

SEQ ID NO: 529276 - RNA, 22 nt, Human
aagauacugaugauguaggcua

SEQ ID NO: 529277 - RNA, 22 nt, Human
gcaguggauccaaugguaucuu

SEQ ID NO: 529278 - RNA, 22 nt, Human
ucagagagugcaaaauauagcu

SEQ ID NO: 529279 - RNA, 22 nt, Human
ccaugggaauugggagguccca

SEQ ID NO: 529280 - RNA, 18 nt, Human
uacagauuauagauacau

SEQ ID NO: 529281 - RNA, 22 nt, Human
gcagcuuugucacggagugucg

SEQ ID NO: 529282 - RNA, 22 nt, Human
uugcagcagggugaauucacuc

SEQ ID NO: 529283 - RNA, 23 nt, Human
ucugaguuauguccuuacauuug

SEQ ID NO: 529284 - RNA, 22 nt, Human
guucaugugacuacuaugaccu

SEQ ID NO: 529285 - RNA, 19 nt, Human
cagagccucagagcuagaa

SEQ ID NO: 529286 - RNA, 22 nt, Human
ggggacccucaggacugcgucu

SEQ ID NO: 529287 - RNA, 22 nt, Human
cccagcucugcagaccugcccu

SEQ ID NO: 529288 - RNA, 22 nt, Human
uaguuuuacuugcgaugauaau

SEQ ID NO: 529289 - RNA, 22 nt, Human
aaaugucuuucuucugcuacgu

SEQ ID NO: 529290 - RNA, 22 nt, Human
uuuccucuuauacaguguuuau

SEQ ID NO: 529291 - RNA, 22 nt, Human
cucccugguguccccuccagga

SEQ ID NO: 529292 - RNA, 22 nt, Human
uaggcugggccugccuuccagg

SEQ ID NO: 529293 - RNA, 22 nt, Human
cuauugaauagcccaaaucauu

SEQ ID NO: 529294 - RNA, 22 nt, Human
gcuccugucaucaaacaauccu

SEQ ID NO: 529295 - RNA, 22 nt, Human
uuuauccauaucauuaaaaucu

SEQ ID NO: 529296 - RNA, 22 nt, Human
ggcuuuauuuugcaugaaugcu

SEQ ID NO: 529297 - RNA, 22 nt, Human
uccuuggaguaguuguucuuua

SEQ ID NO: 529298 - RNA, 22 nt, Human
aggaccugacauuguguuuucu

SEQ ID NO: 529299 - RNA, 22 nt, Human
guuccaggcaagugggauagga

SEQ ID NO: 529300 - RNA, 22 nt, Human
gcaggcagagaaggaacauuua

SEQ ID NO: 529301 - RNA, 20 nt, Human
cauuucauugugucuucacu

SEQ ID NO: 529302 - RNA, 22 nt, Human
caggagugcagguggugaggca

SEQ ID NO: 529303 - RNA, 20 nt, Human
guggcagugguggcagcagu

SEQ ID NO: 529304 - RNA, 22 nt, Human
ugcaggcuguuugguggaucuc

SEQ ID NO: 529305 - RNA, 22 nt, Human
auguucuucuaucuuuauuaaa

SEQ ID NO: 529306 - RNA, 22 nt, Human
aaggcagaaagggaugugagug

SEQ ID NO: 529307 - RNA, 22 nt, Human
ccagggccucguguucugagug

SEQ ID NO: 529308 - RNA, 22 nt, Human
cucagggaggccucugcugguu

SEQ ID NO: 529309 - RNA, 22 nt, Human
cagucaggggugggaucaaggc

SEQ ID NO: 529310 - RNA, 22 nt, Human
aaaggccacacagagcagggag

SEQ ID NO: 529311 - RNA, 22 nt, Human
auucaaaguaauaaccagaacu

SEQ ID NO: 529312 - RNA, 22 nt, Human
ucagggcacaggccuguggguu

SEQ ID NO: 529313 - RNA, 22 nt, Human
gaaggaagggcuggcugucuug

SEQ ID NO: 529314 - RNA, 22 nt, Human
guccuggcccacuggcaggcug

SEQ ID NO: 529315 - RNA, 22 nt, Human
aguucugggaggugcacgucca

SEQ ID NO: 529316 - RNA, 22 nt, Human
gcuguggaaaugccuaacauga

SEQ ID NO: 529317 - RNA, 22 nt, Human
gacauauuugaaaccaagagaa

SEQ ID NO: 529318 - RNA, 22 nt, Human
gccuucaggaaaucaguccuug

SEQ ID NO: 529319 - RNA, 22 nt, Human
uugugcaugacugugaauagcu

SEQ ID NO: 529320 - RNA, 22 nt, Human
ucaguguuggucaagaaucagu

SEQ ID NO: 529321 - RNA, 19 nt, Human
ccagcagcuuugauucucu

SEQ ID NO: 529322 - RNA, 21 nt, Human
ucuacauaucaauauguaauu

SEQ ID NO: 529323 - RNA, 22 nt, Human
aaaagguagauucuccuucuau

SEQ ID NO: 529324 - RNA, 23 nt, Human
cuggcucauccugguugcagugg

SEQ ID NO: 529325 - RNA, 21 nt, Human
acaggcucuggggaugcuggg

SEQ ID NO: 529326 - RNA, 22 nt, Human
ccaaggcuccucagcuggucuu

SEQ ID NO: 529327 - RNA, 22 nt, Human
caggagacaaguuagcagcuga

SEQ ID NO: 529328 - RNA, 22 nt, Human
acauuucucauaggagagccac

SEQ ID NO: 529329 - RNA, 22 nt, Human
gagguuagaggucagugcaguc

SEQ ID NO: 529330 - RNA, 22 nt, Human
aaaugcagauugucauucagga

SEQ ID NO: 529331 - RNA, 22 nt, Human
cuaauacucauuucuguaacuc

SEQ ID NO: 529332 - RNA, 22 nt, Human
caggaagaccagggcuguggcu

SEQ ID NO: 529333 - RNA, 22 nt, Human
gucaccagucccagcuccugaa

SEQ ID NO: 529334 - RNA, 22 nt, Human
cuggccucauagccaagcugug

SEQ ID NO: 529335 - RNA, 22 nt, Human
uucaucaauguguuuaauaaug

SEQ ID NO: 529336 - RNA, 22 nt, Human
gcaaaauuaaacuuagcaucau

SEQ ID NO: 529337 - RNA, 22 nt, Human
gaaagccauagcccagcuuuac

SEQ ID NO: 529338 - RNA, 22 nt, Human
ugcugccuugaccuccugggcu

SEQ ID NO: 529339 - RNA, 22 nt, Human
ccagcugucacucagaaaggcc

SEQ ID NO: 529340 - RNA, 22 nt, Human
aggcuuaaugaguuaaaucacu

SEQ ID NO: 529341 - RNA, 22 nt, Human
acacauuaaaacgucuacaaug

SEQ ID NO: 529342 - RNA, 22 nt, Human
aguauguagugcaaucagucag

SEQ ID NO: 529343 - RNA, 22 nt, Human
auaaugaggauuugcauauuag

SEQ ID NO: 529344 - RNA, 22 nt, Human
ggagagcuagugccugccagua

SEQ ID NO: 529345 - RNA, 22 nt, Human
aacuucugaccucaagaacugu

SEQ ID NO: 529346 - RNA, 22 nt, Human
gccucugccaagggggcugcgg

SEQ ID NO: 529347 - RNA, 22 nt, Human
ucuggcucuccagugcucuuag

SEQ ID NO: 529348 - RNA, 22 nt, Human
uguggcugcucaggugcagacc

SEQ ID NO: 529349 - RNA, 22 nt, Human
gaagggagaagguugggugacg

SEQ ID NO: 529350 - RNA, 22 nt, Human
gggcugacucaaccuugcaaag

SEQ ID NO: 529351 - RNA, 22 nt, Human
auuuucugguugagguuuaaca

SEQ ID NO: 529352 - RNA, 22 nt, Human
ccuggcccacauggcuucuccc

SEQ ID NO: 529353 - RNA, 20 nt, Human
cguaaggcaagugcugcauc

SEQ ID NO: 529354 - RNA, 22 nt, Human
ggugggcaggcgaggcccaggu

SEQ ID NO: 529355 - RNA, 15 nt, Human
ggcagguggaucacu

SEQ ID NO: 529356 - RNA, 21 nt, Human
gggggaagaggaguugcuagu

SEQ ID NO: 529357 - RNA, 22 nt, Human
aaaguauucuugacuguuuuuc

SEQ ID NO: 529358 - RNA, 22 nt, Human
gugccagcaguuauggugauuu

SEQ ID NO: 529359 - RNA, 20 nt, Human
uuuuagcacuuguuauggug

SEQ ID NO: 529360 - RNA, 22 nt, Human
ggaggccuagccagcuccaguu

SEQ ID NO: 529361 - RNA, 22 nt, Human
uuucuuucucguaaacuuaguu

SEQ ID NO: 529362 - RNA, 22 nt, Human
ugcuuuauggagcccaucucau

SEQ ID NO: 529363 - RNA, 22 nt, Human
gggaaagagagguggacgcagg

SEQ ID NO: 529364 - RNA, 22 nt, Human
agcaggaguuugaugcuuuuau

SEQ ID NO: 529365 - RNA, 22 nt, Human
acacccagagcgccagugccga

SEQ ID NO: 529366 - RNA, 22 nt, Human
uagauuuugcauuucuaacaag

SEQ ID NO: 529367 - RNA, 22 nt, Human
caggccucagagaguggcgggg

SEQ ID NO: 529368 - RNA, 19 nt, Human
gcauuucucuuuacagcca

SEQ ID NO: 529369 - RNA, 22 nt, Human
uaagcacuuuauaugcuuuauc

SEQ ID NO: 529370 - RNA, 22 nt, Human
uuacauauugucuauuguucaa

SEQ ID NO: 529371 - RNA, 22 nt, Human
ucuuccaaggugcagaucuucu

SEQ ID NO: 529372 - RNA, 22 nt, Human
aaggaggacacccaggacuggg

SEQ ID NO: 529373 - RNA, 22 nt, Human
uggcugagaccaucagggugua

SEQ ID NO: 529374 - RNA, 22 nt, Human
agccacagagguugaugugguu

SEQ ID NO: 529375 - RNA, 21 nt, Human
guggcucugccaggacugaaa

SEQ ID NO: 529376 - RNA, 22 nt, Human
gcuggugccuuguuguuguuac

SEQ ID NO: 529377 - RNA, 22 nt, Human
uuacaguggucauuugggaaaa

SEQ ID NO: 529378 - RNA, 22 nt, Human
cuggugggagauaauugaauca

SEQ ID NO: 529379 - RNA, 22 nt, Human
augcaguacugauacaugccac

SEQ ID NO: 529380 - RNA, 22 nt, Human
auucucagaucuuagaggaaua

SEQ ID NO: 529381 - RNA, 22 nt, Human
uguaaaaggaaaucaaagcacu

SEQ ID NO: 529382 - RNA, 22 nt, Human
uggugcagguguugaugcagga

SEQ ID NO: 529383 - RNA, 22 nt, Human
cacagaauuaagggagaaauau

SEQ ID NO: 529384 - RNA, 22 nt, Human
uguauacauuuggugcauauuu

SEQ ID NO: 529385 - RNA, 19 nt, Human
ugccuggcaccagcuccac

SEQ ID NO: 529386 - RNA, 22 nt, Human
cugggaagcuucgagcaggaaa

SEQ ID NO: 529387 - RNA, 22 nt, Human
ggcugccuacuuucccagaguu

SEQ ID NO: 529388 - RNA, 22 nt, Human
auccagcuuugucuggucuucg

SEQ ID NO: 529389 - RNA, 22 nt, Human
auauuugucaauucacuguuca

SEQ ID NO: 529390 - RNA, 22 nt, Human
ugggccaggggccucuucugau

SEQ ID NO: 529391 - RNA, 18 nt, Human
ugugcaauauuaaccacc

SEQ ID NO: 529392 - RNA, 22 nt, Human
cugaagcaauugagagauguuu

SEQ ID NO: 529393 - RNA, 20 nt, Human
ucacacaugguaagcuauga

SEQ ID NO: 529394 - RNA, 22 nt, Human
uggcagagucugggcuugggca

SEQ ID NO: 529395 - RNA, 22 nt, Human
ucacacacauuugcugucugau

SEQ ID NO: 529396 - RNA, 22 nt, Human
ucucagaguuccucuggagucc

SEQ ID NO: 529397 - RNA, 22 nt, Human
uguggcugucuguucuccuagg

SEQ ID NO: 529398 - RNA, 22 nt, Human
aaaguuagcauucucucuugcu

SEQ ID NO: 529399 - RNA, 22 nt, Human
ugcuggagaggaaggugggguc

SEQ ID NO: 529400 - RNA, 20 nt, Human
uguggcaggaugagggcgga

SEQ ID NO: 529401 - RNA, 22 nt, Human
aggggcucaguuacuuuggcag

SEQ ID NO: 529402 - RNA, 22 nt, Human
ucagaguccucacccugaggau

SEQ ID NO: 529403 - RNA, 22 nt, Human
gccauuaacaagaauauaguag

SEQ ID NO: 529404 - RNA, 22 nt, Human
ucccagcuguguggaggagaug

SEQ ID NO: 529405 - RNA, 22 nt, Human
gguuggacacuagguaggagcg

SEQ ID NO: 529406 - RNA, 22 nt, Human
cacagagagcuacgugcagcgu

SEQ ID NO: 529407 - RNA, 22 nt, Human
uuaauuuauguccaaaccagau

SEQ ID NO: 529408 - RNA, 22 nt, Human
gaaggaagugcucauacuaguu

SEQ ID NO: 529409 - RNA, 22 nt, Human
gucuuguuugggauguggaugg

SEQ ID NO: 529410 - RNA, 22 nt, Human
ggaugcugcugcacauccugca

SEQ ID NO: 529411 - RNA, 22 nt, Human
gcagugauuggaucagagaugg

SEQ ID NO: 529412 - RNA, 19 nt, Human
ugggagaggcaacagagua

SEQ ID NO: 529413 - RNA, 22 nt, Human
agacucugcuaagaauauaauu

SEQ ID NO: 529414 - RNA, 22 nt, Human
uccuucaugaugcuuagcagag

SEQ ID NO: 529415 - RNA, 22 nt, Human
uguuaaauguuccuuuacugga

SEQ ID NO: 529416 - RNA, 22 nt, Human
ugugcaaauuaaguagauuuuc

SEQ ID NO: 529417 - RNA, 22 nt, Human
cuuuccuagauggccaucuuuc

SEQ ID NO: 529418 - RNA, 22 nt, Human
uggggagaagcaauagacucua

SEQ ID NO: 529419 - RNA, 22 nt, Human
ggagagagagauuguguuuauu

SEQ ID NO: 529420 - RNA, 22 nt, Human
gcagcugucacuuucacaaugc

SEQ ID NO: 529421 - RNA, 21 nt, Human
cgggcuggccgggcccucacc

SEQ ID NO: 529422 - RNA, 21 nt, Human
agaagagaagcaggacccucu

SEQ ID NO: 529423 - RNA, 22 nt, Human
uaugaguacaaggacucugucu

SEQ ID NO: 529424 - RNA, 23 nt, Human
uuacuuuugcaccaaccuaauau

SEQ ID NO: 529425 - RNA, 22 nt, Human
cagugcagacguggagggggca

SEQ ID NO: 529426 - RNA, 22 nt, Human
ugauuucaaguagugacaugcu

SEQ ID NO: 529427 - RNA, 22 nt, Human
gucagaggaauggaugagugau

SEQ ID NO: 529428 - RNA, 22 nt, Human
ucccagauuccugcucuuauau

SEQ ID NO: 529429 - RNA, 19 nt, Human
gcaggugugaauccguaga

SEQ ID NO: 529430 - RNA, 22 nt, Human
uaggaagccugcugugcacagc

SEQ ID NO: 529431 - RNA, 22 nt, Human
uuccuguauuuugcgaauuuuc

SEQ ID NO: 529432 - RNA, 18 nt, Human
ccuggaccugucuccuuu

SEQ ID NO: 529433 - RNA, 22 nt, Human
auaucaaaauaaacagcaugca

SEQ ID NO: 529434 - RNA, 22 nt, Human
ugugcaaucuugagcaauuuau

SEQ ID NO: 529435 - RNA, 22 nt, Human
gccuggcaggccucaugagggg

SEQ ID NO: 529436 - RNA, 21 nt, Human
acuggcugccaugauccaggg

SEQ ID NO: 529437 - RNA, 18 nt, Human
uccagcgugcuccagggc

SEQ ID NO: 529438 - RNA, 22 nt, Human
uaagaaggguacaauaaggcau

SEQ ID NO: 529439 - RNA, 22 nt, Human
uuccaaguagaagcauuugcau

SEQ ID NO: 529440 - RNA, 22 nt, Human
auggcugaggcuggagguggca

SEQ ID NO: 529441 - RNA, 22 nt, Human
ucugaacacugagugucaucac

SEQ ID NO: 529442 - RNA, 22 nt, Human
acauuucuccuacuuguuauuu

SEQ ID NO: 529443 - RNA, 18 nt, Human
agaagccacgaggagucc

SEQ ID NO: 529444 - RNA, 22 nt, Human
agacaugagaaacccaccagag

SEQ ID NO: 529445 - RNA, 22 nt, Human
accgggaaguccugcacugggc

SEQ ID NO: 529446 - RNA, 22 nt, Human
uagcagagaggggacaguggca

SEQ ID NO: 529447 - RNA, 22 nt, Human
gcugcccaguucugcugcugcc

SEQ ID NO: 529448 - RNA, 22 nt, Human
uuucuuuauccuccuuugcaca

SEQ ID NO: 529449 - RNA, 17 nt, Human
cucagaguugcuuuguc

SEQ ID NO: 529450 - RNA, 22 nt, Human
cuguggcauugccgaggcuggc

SEQ ID NO: 529451 - RNA, 22 nt, Human
gagcaugguuccauagguuggu

SEQ ID NO: 529452 - RNA, 22 nt, Human
cuucaaguccagcucaugcucu

SEQ ID NO: 529453 - RNA, 22 nt, Human
augcagaaggagccaugcuugc

SEQ ID NO: 529454 - RNA, 22 nt, Human
aagcagcuucccuggcuccugg

SEQ ID NO: 529455 - RNA, 19 nt, Human
gaucagagugucagcuugu

SEQ ID NO: 529456 - RNA, 22 nt, Human
gaucaacaaauguccuuuguga

SEQ ID NO: 529457 - RNA, 22 nt, Human
accacccauucagaaacacuga

SEQ ID NO: 529458 - RNA, 22 nt, Human
agauuuccaucuuuuucaugug

SEQ ID NO: 529459 - RNA, 22 nt, Human
gucuggagccacccuaagcauu

SEQ ID NO: 529460 - RNA, 22 nt, Human
gagccuggccuccugccucagc

SEQ ID NO: 529461 - RNA, 16 nt, Human
uagagagggcagggag

SEQ ID NO: 529462 - RNA, 22 nt, Human
cuggccaguuguccuggcuugg

SEQ ID NO: 529463 - RNA, 22 nt, Human
agaggugacauaggagaggcuc

SEQ ID NO: 529464 - RNA, 22 nt, Human
gcucugugggugaguagaaucu

SEQ ID NO: 529465 - RNA, 20 nt, Human
uuucacaucugucccuuuaa

SEQ ID NO: 529466 - RNA, 22 nt, Human
uacagucuuuggaaagagauag

SEQ ID NO: 529467 - RNA, 22 nt, Human
ugcaggcucucugcugccagau

SEQ ID NO: 529468 - RNA, 22 nt, Human
ugcaacaguggggcaugcugaa

SEQ ID NO: 529469 - RNA, 20 nt, Human
aguuugugugucuaugcgcu

SEQ ID NO: 529470 - RNA, 22 nt, Human
ggaagagaauuucucucuuuuu

SEQ ID NO: 529471 - RNA, 22 nt, Human
auuuucaagggagaggccucug

SEQ ID NO: 529472 - RNA, 22 nt, Human
agaucacaguggcaacucccuu

SEQ ID NO: 529473 - RNA, 22 nt, Human
gaggcagagguuguugcaguga

SEQ ID NO: 529474 - RNA, 22 nt, Human
auaagagcuagucuuuuccuug

SEQ ID NO: 529475 - RNA, 22 nt, Human
acugagagucuuagaaacacau

SEQ ID NO: 529476 - RNA, 22 nt, Human
gagcuagagggagaagggcacu

SEQ ID NO: 529477 - RNA, 22 nt, Human
ucugccugcuucuucauagucu

SEQ ID NO: 529478 - RNA, 22 nt, Human
agcaggguuccaggaguugcag

SEQ ID NO: 529479 - RNA, 22 nt, Human
uuuugaaagaguccugcuacag

SEQ ID NO: 529480 - RNA, 22 nt, Human
ccaggcugugguuuagauagag

SEQ ID NO: 529481 - RNA, 22 nt, Human
gcagcuggaagugacacucugu

SEQ ID NO: 529482 - RNA, 22 nt, Human
ggccaggccaagaggguuggaa

SEQ ID NO: 529483 - RNA, 18 nt, Human
uuccauaauguauguaac

SEQ ID NO: 529484 - RNA, 22 nt, Human
uucuggaguauuccuggcagcc

SEQ ID NO: 529485 - RNA, 22 nt, Human
aaggaagguucauagucaaaga

SEQ ID NO: 529486 - RNA, 20 nt, Human
ccagaagagaugaucaucca

SEQ ID NO: 529487 - RNA, 22 nt, Human
cagagugaaauaggggaucaag

SEQ ID NO: 529488 - RNA, 22 nt, Human
ugagugugcagggaaguggcgg

SEQ ID NO: 529489 - RNA, 22 nt, Human
acuagucugcauuacaaaauag

SEQ ID NO: 529490 - RNA, 22 nt, Human
ccagcucucagcgggagacuca

SEQ ID NO: 529491 - RNA, 22 nt, Human
gaggcucaccuagggagcacug

SEQ ID NO: 529492 - RNA, 22 nt, Human
gcagagugccgagauggaagcg

SEQ ID NO: 529493 - RNA, 22 nt, Human
ugucacauauauaauguucaau

SEQ ID NO: 529494 - RNA, 22 nt, Human
caagagcucccagaccugggca

SEQ ID NO: 529495 - RNA, 22 nt, Human
ugucccaggcugaaguacagug

SEQ ID NO: 529496 - RNA, 21 nt, Human
ugaaagaaggugcagucugaa

SEQ ID NO: 529497 - RNA, 22 nt, Human
cuggagccugcaguuuucacuu

SEQ ID NO: 529498 - RNA, 18 nt, Human
acauacauucugucugca

SEQ ID NO: 529499 - RNA, 21 nt, Human
gacaggcaaggagucacuuag

SEQ ID NO: 529500 - RNA, 22 nt, Human
agugugggugagggaggcccuc

SEQ ID NO: 529501 - RNA, 22 nt, Human
cugggaggcagucucucuagaa

SEQ ID NO: 529502 - RNA, 19 nt, Human
aucauacauguuacacucu

SEQ ID NO: 529503 - RNA, 22 nt, Human
cacuuaaaucuguugagaaaaa

SEQ ID NO: 529504 - RNA, 22 nt, Human
gcugccugggcuggcauuccca

SEQ ID NO: 529505 - RNA, 22 nt, Human
ccauuaaaauggaauguaguga

SEQ ID NO: 529506 - RNA, 22 nt, Human
ugucaugccaggaaauaguccc

SEQ ID NO: 529507 - RNA, 22 nt, Human
augaaacaugagaaauggagag

SEQ ID NO: 529508 - RNA, 22 nt, Human
ugucccagaucacaggagggga

SEQ ID NO: 529509 - RNA, 21 nt, Human
uuugggcuuuuacuggacgug

SEQ ID NO: 529510 - RNA, 22 nt, Human
uuggaaggugagucccuggguu

SEQ ID NO: 529511 - RNA, 22 nt, Human
uggccuggccacauccagcagg

SEQ ID NO: 529512 - RNA, 22 nt, Human
ugguuugagagugugagcuuuu

SEQ ID NO: 529513 - RNA, 22 nt, Human
cagcugucuaaguugagcagga

SEQ ID NO: 529514 - RNA, 22 nt, Human
guuucuaaauguucugaguuuu

SEQ ID NO: 529515 - RNA, 19 nt, Human
ugggcagguucaguaaugg

SEQ ID NO: 529516 - RNA, 22 nt, Human
caguauuuggaauauagcuaag

SEQ ID NO: 529517 - RNA, 17 nt, Human
accagccucuccugggg

SEQ ID NO: 529518 - RNA, 22 nt, Human
uuucuaaacuggauucagccug

SEQ ID NO: 529519 - RNA, 22 nt, Human
gcugagcugcuguucauccugc

SEQ ID NO: 529520 - RNA, 20 nt, Human
agacagaaucagagauaaag

SEQ ID NO: 529521 - RNA, 22 nt, Human
aaugcacagcuaaagugguucc

SEQ ID NO: 529522 - RNA, 21 nt, Human
acccuggguucuccauacccu

SEQ ID NO: 529523 - RNA, 22 nt, Human
caauguguuugcauauuaaaau

SEQ ID NO: 529524 - RNA, 22 nt, Human
uucaagaugcacaguggcauuc

SEQ ID NO: 529525 - RNA, 22 nt, Human
aguccugaugcucuggcaggag

SEQ ID NO: 529526 - RNA, 22 nt, Human
uguuccugguuccugcaugaug

SEQ ID NO: 529527 - RNA, 22 nt, Human
ucucugcucugugccucaguuu

SEQ ID NO: 529528 - RNA, 22 nt, Human
uugccugugucagcagguggaa

SEQ ID NO: 529529 - RNA, 22 nt, Human
cuccauugaacauccucucaga

SEQ ID NO: 529530 - RNA, 22 nt, Human
uucauauaaauggaaucagaau

SEQ ID NO: 529531 - RNA, 22 nt, Human
acuccugguuuguguccuggcu

SEQ ID NO: 529532 - RNA, 22 nt, Human
ggucucaggagacuggagagca

SEQ ID NO: 529533 - RNA, 22 nt, Human
agaauacaguaggagccugggc

SEQ ID NO: 529534 - RNA, 22 nt, Human
ugggcaggaugcguugauucuu

SEQ ID NO: 529535 - RNA, 22 nt, Human
uuucaaguuguugcauuaaaug

SEQ ID NO: 529536 - RNA, 23 nt, Human
ucuccuccuagauacagucaugg

SEQ ID NO: 529537 - RNA, 22 nt, Human
acacacaugccuuuccuaagua

SEQ ID NO: 529538 - RNA, 22 nt, Human
aaauguacugauacuuauuuua

SEQ ID NO: 529539 - RNA, 22 nt, Human
cagcugaguuuccaagucugcc

SEQ ID NO: 529540 - RNA, 22 nt, Human
gcuuucugauugcgaaaacaaa

SEQ ID NO: 529541 - RNA, 22 nt, Human
aagucauguggaagaauaaccu

SEQ ID NO: 529542 - RNA, 22 nt, Human
uggcugaggcuggagugcagug

SEQ ID NO: 529543 - RNA, 22 nt, Human
aguaaaauuucugcugaggaga

SEQ ID NO: 529544 - RNA, 22 nt, Human
cuuuuucuucuaggugugccug

SEQ ID NO: 529545 - RNA, 22 nt, Human
agggaggaucugcuccuugucu

SEQ ID NO: 529546 - RNA, 22 nt, Human
agccagagcagggaauuggaca

SEQ ID NO: 529547 - RNA, 22 nt, Human
uaacagaaauauuuccagguga

SEQ ID NO: 529548 - RNA, 22 nt, Human
uuuccuaagauagauacuucag

SEQ ID NO: 529549 - RNA, 22 nt, Human
ugcccuggcacacacacagcug

SEQ ID NO: 529550 - RNA, 22 nt, Human
gaaggaaggaaaaauauauuua

SEQ ID NO: 529551 - RNA, 23 nt, Human
ugcagccacucaggagcucagug

SEQ ID NO: 529552 - RNA, 22 nt, Human
uaggaacaaagagccucacauu

SEQ ID NO: 529553 - RNA, 22 nt, Human
ggguccaggucuucaggcagag

SEQ ID NO: 529554 - RNA, 22 nt, Human
gacacagagcucacagucuccu

SEQ ID NO: 529555 - RNA, 22 nt, Human
gggggccuuauucaucugccag

SEQ ID NO: 529556 - RNA, 22 nt, Human
aaggcauugagcaguuacagua

SEQ ID NO: 529557 - RNA, 22 nt, Human
uagauguugaagucauauuugg

SEQ ID NO: 529558 - RNA, 22 nt, Human
cagugcaggaagugagaugccu

SEQ ID NO: 529559 - RNA, 22 nt, Human
caaagcagaagguucuguggua

SEQ ID NO: 529560 - RNA, 22 nt, Human
aaaauaugacugugcuccuuaa

SEQ ID NO: 529561 - RNA, 22 nt, Human
agaaaucauugaauuauuugcu

SEQ ID NO: 529562 - RNA, 22 nt, Human
ccagcuccuucugucuguggag

SEQ ID NO: 529563 - RNA, 22 nt, Human
cagcaguggcugcaggcagcug

SEQ ID NO: 529564 - RNA, 22 nt, Human
gagcugggagcugggauuugga

SEQ ID NO: 529565 - RNA, 17 nt, Human
cugauuuauuagcagac

SEQ ID NO: 529566 - RNA, 22 nt, Human
cuggagcauccaugcccagggu

SEQ ID NO: 529567 - RNA, 22 nt, Human
ugcuaagucacucaagaccucu

SEQ ID NO: 529568 - RNA, 22 nt, Human
uaucauuuagaguauuucuuca

SEQ ID NO: 529569 - RNA, 22 nt, Human
gggcuggcaggaccugggcuga

SEQ ID NO: 529570 - RNA, 22 nt, Human
aaaugcaauuguauguacucca

SEQ ID NO: 529571 - RNA, 22 nt, Human
aaagcaaugggucuaagguaaa

SEQ ID NO: 529572 - RNA, 22 nt, Human
agucccagccuaggcugugcug

SEQ ID NO: 529573 - RNA, 19 nt, Human
acagauggaggaaucuggg

SEQ ID NO: 529574 - RNA, 22 nt, Human
ggaagagaaugauggcuauggg

SEQ ID NO: 529575 - RNA, 22 nt, Human
gaaggccugugguagugagacg

SEQ ID NO: 529576 - RNA, 22 nt, Human
cugggcacuugcucacagcucu

SEQ ID NO: 529577 - RNA, 22 nt, Human
uucaggauucuuucagacuggg

SEQ ID NO: 529578 - RNA, 22 nt, Human
ccaggugugcucugcaguggau

SEQ ID NO: 529579 - RNA, 22 nt, Human
gcgcaggugcugcuggagcagc

SEQ ID NO: 529580 - RNA, 21 nt, Human
gcuuucuguggacucugcacc

SEQ ID NO: 529581 - RNA, 22 nt, Human
gagcagugagugaauguugccu

SEQ ID NO: 529582 - RNA, 22 nt, Human
agcaggcuacuccuguguucgu

SEQ ID NO: 529583 - RNA, 19 nt, Human
ugagcugccgucuucccug

SEQ ID NO: 529584 - RNA, 22 nt, Human
agaaugcaagauaaacuuuauu

SEQ ID NO: 529585 - RNA, 22 nt, Human
agugucaaugccaacaguauau

SEQ ID NO: 529586 - RNA, 22 nt, Human
uucagaaugacuuauguaaggc

SEQ ID NO: 529587 - RNA, 22 nt, Human
gaaaauuuaauucucuucugug

SEQ ID NO: 529588 - RNA, 22 nt, Human
augcaucauggaaaacucaguu

SEQ ID NO: 529589 - RNA, 22 nt, Human
ggcuucccagcagagggcgcac

SEQ ID NO: 529590 - RNA, 22 nt, Human
uguccucaggaccuggcacagu

SEQ ID NO: 529591 - RNA, 22 nt, Human
uccugaggaaaguucaugaaug

SEQ ID NO: 529592 - RNA, 22 nt, Human
acaggcaggcgggacagcccga

SEQ ID NO: 529593 - RNA, 22 nt, Human
uuucacagucaauuuggaguca

SEQ ID NO: 529594 - RNA, 21 nt, Human
acaugucucuaaucucaguga

SEQ ID NO: 529595 - RNA, 22 nt, Human
aaggcuuuccuguaggaagaca

SEQ ID NO: 529596 - RNA, 22 nt, Human
gugcuuccugccuggugccuuu

SEQ ID NO: 529597 - RNA, 22 nt, Human
guucacauggcauuuucacauc

SEQ ID NO: 529598 - RNA, 22 nt, Human
gcagagugaagggagaggugug

SEQ ID NO: 529599 - RNA, 22 nt, Human
uuccagagaaaagguuuauuuc

SEQ ID NO: 529600 - RNA, 22 nt, Human
cuggcagcgcagcaugaagucg

SEQ ID NO: 529601 - RNA, 22 nt, Human
auccuucaaggggcugacagcu

SEQ ID NO: 529602 - RNA, 22 nt, Human
ugaacaacugcaaaaaucucca

SEQ ID NO: 529603 - RNA, 22 nt, Human
ucaacaauuuugagaugagaca

SEQ ID NO: 529604 - RNA, 22 nt, Human
uuuuuaagagucuggaaauagu

SEQ ID NO: 529605 - RNA, 22 nt, Human
ccuuggcccuagccucaggcaa

SEQ ID NO: 529606 - RNA, 22 nt, Human
auuucaucucuggaacauaacu

SEQ ID NO: 529607 - RNA, 21 nt, Human
ccucuggcuugugcugugccc

SEQ ID NO: 529608 - RNA, 22 nt, Human
acagguggcauaggcaguuuga

SEQ ID NO: 529609 - RNA, 22 nt, Human
agcauccagcauccuauagaaa

SEQ ID NO: 529610 - RNA, 22 nt, Human
gcagcugaauguccauugcugc

SEQ ID NO: 529611 - RNA, 22 nt, Human
uugaagcauuucuuugagcuuc

SEQ ID NO: 529612 - RNA, 22 nt, Human
auguguguaaacaaguauaauu

SEQ ID NO: 529613 - RNA, 22 nt, Human
ucugggagauccaagcagaacu

SEQ ID NO: 529614 - RNA, 22 nt, Human
gccaggugcauggcugagucuc

SEQ ID NO: 529615 - RNA, 22 nt, Human
ccaggcucagggcagacuuuca

SEQ ID NO: 529616 - RNA, 22 nt, Human
cagaauuuuucgaauguacugu

SEQ ID NO: 529617 - RNA, 22 nt, Human
ggcuggagauaugucuggaaca

SEQ ID NO: 529618 - RNA, 22 nt, Human
uacagaagcugagacacugaga

SEQ ID NO: 529619 - RNA, 22 nt, Human
gcuguucacggaggaggauggg

SEQ ID NO: 529620 - RNA, 20 nt, Human
uacauucaaaacaaacucug

SEQ ID NO: 529621 - RNA, 22 nt, Human
cucugugauuuugugagccaga

SEQ ID NO: 529622 - RNA, 22 nt, Human
uucacagauuucccugcacaug

SEQ ID NO: 529623 - RNA, 22 nt, Human
cuguccuggccgcccuugugag

SEQ ID NO: 529624 - RNA, 22 nt, Human
auauacuguaggccacuauaag

SEQ ID NO: 529625 - RNA, 22 nt, Human
cugggccucaagcucagauuuc

SEQ ID NO: 529626 - RNA, 22 nt, Human
gggcacagccuaacuauggaga

SEQ ID NO: 529627 - RNA, 22 nt, Human
gcaaaggcuagagacacaggga

SEQ ID NO: 529628 - RNA, 22 nt, Human
auaaaauuugcuacuguuaaau

SEQ ID NO: 529629 - RNA, 22 nt, Human
cugggcugucaauggcccucug

SEQ ID NO: 529630 - RNA, 22 nt, Human
ucaguguuuccugugguacagc

SEQ ID NO: 529631 - RNA, 22 nt, Human
cagugauggauauggagaaguc

SEQ ID NO: 529632 - RNA, 22 nt, Human
gcagggcagcugaagcuaggug

SEQ ID NO: 529633 - RNA, 22 nt, Human
accuauuuaugcaauuaugaaa

SEQ ID NO: 529634 - RNA, 22 nt, Human
ucucuuccaguaagagucuuua

SEQ ID NO: 529635 - RNA, 22 nt, Human
uccugccucaggcucuggagua

SEQ ID NO: 529636 - RNA, 22 nt, Human
ucagacagaaagaugaguaugg

SEQ ID NO: 529637 - RNA, 22 nt, Human
aaaucagaucuuacacaauugu

SEQ ID NO: 529638 - RNA, 21 nt, Human
agaggccuuacaggauagacc

SEQ ID NO: 529639 - RNA, 18 nt, Human
uggcaggggcaguacgcc

SEQ ID NO: 529640 - RNA, 22 nt, Human
uuugugcaauuuauguacuaua

SEQ ID NO: 529641 - RNA, 22 nt, Human
ggacacagcugcagccacaccc

SEQ ID NO: 529642 - RNA, 16 nt, Human
uccaggcauaucugag

SEQ ID NO: 529643 - RNA, 22 nt, Human
uuucauugcagagucugugugc

SEQ ID NO: 529644 - RNA, 22 nt, Human
aucagcuaauuagaauuaggau

SEQ ID NO: 529645 - RNA, 22 nt, Human
aagccacaaucugcaucagcau

SEQ ID NO: 529646 - RNA, 20 nt, Human
agaaggcuccuuuugccaag

SEQ ID NO: 529647 - RNA, 22 nt, Human
ucauucucagacucuuggccuc

SEQ ID NO: 529648 - RNA, 22 nt, Human
ggcuccuggggaggugagcuug

SEQ ID NO: 529649 - RNA, 22 nt, Human
acacauauauacauauuugugc

SEQ ID NO: 529650 - RNA, 22 nt, Human
aucaggaugcugucaguuacca

SEQ ID NO: 529651 - RNA, 22 nt, Human
cugggccuuaugaguaccugga

SEQ ID NO: 529652 - RNA, 22 nt, Human
agcaggaaggggccuagccugg

SEQ ID NO: 529653 - RNA, 22 nt, Human
ugccaggagagugcaugcaggg

SEQ ID NO: 529654 - RNA, 22 nt, Human
ucugugcaggaagucauuauga

SEQ ID NO: 529655 - RNA, 22 nt, Human
cagcuguuaugagguguacaug

SEQ ID NO: 529656 - RNA, 22 nt, Human
cugcagggaacugaggcccaga

SEQ ID NO: 529657 - RNA, 22 nt, Human
agggccucuaccauccaagguu

SEQ ID NO: 529658 - RNA, 21 nt, Human
uuguaaagguuuagaagaaug

SEQ ID NO: 529659 - RNA, 22 nt, Human
acuuuguaggaaaaagucacaa

SEQ ID NO: 529660 - RNA, 22 nt, Human
guggccuggcgagcuggcgcgg

SEQ ID NO: 529661 - RNA, 22 nt, Human
augugcaugcacuuacaugugu

SEQ ID NO: 529662 - RNA, 22 nt, Human
ucagcugcucuguugagcugaa

SEQ ID NO: 529663 - RNA, 22 nt, Human
ggcaagggacggccgugagaca

SEQ ID NO: 529664 - RNA, 22 nt, Human
cuggccuuuuguuucuggagaa

SEQ ID NO: 529665 - RNA, 22 nt, Human
uccagggcuuggcugggacggu

SEQ ID NO: 529666 - RNA, 22 nt, Human
acaaaugucuccucuuuuguua

SEQ ID NO: 529667 - RNA, 22 nt, Human
uuccugagggacuuuugagauu

SEQ ID NO: 529668 - RNA, 22 nt, Human
acaggcacaacugaguagacuc

SEQ ID NO: 529669 - RNA, 22 nt, Human
ggccugcuggcuccagcgcccg

SEQ ID NO: 529670 - RNA, 22 nt, Human
aucaggaucacagaaacuuuua

SEQ ID NO: 529671 - RNA, 22 nt, Human
augugagggaaaucagucagaa

SEQ ID NO: 529672 - RNA, 22 nt, Human
ccugggcugcaugauggcauuu

SEQ ID NO: 529673 - RNA, 22 nt, Human
aauaguguuguucacucaggag

SEQ ID NO: 529674 - RNA, 20 nt, Human
gagggcucguggauggauaa

SEQ ID NO: 529675 - RNA, 22 nt, Human
gggguggauuucaggcgguguc

SEQ ID NO: 529676 - RNA, 22 nt, Human
ccccuuccuuccucagacagcc

SEQ ID NO: 529677 - RNA, 22 nt, Human
uaaggccauuauggugggcccg

SEQ ID NO: 529678 - RNA, 22 nt, Human
ccugcuggacguggaggagggg

SEQ ID NO: 529679 - RNA, 22 nt, Human
ugcaccauuaauuuaugugaga

SEQ ID NO: 529680 - RNA, 22 nt, Human
guuuacaugcaugcaagaauga

SEQ ID NO: 529681 - RNA, 22 nt, Human
uggcuaggacucauccuguuuc

SEQ ID NO: 529682 - RNA, 19 nt, Human
ggagacucagcccaugccu

SEQ ID NO: 529683 - RNA, 22 nt, Human
uauauucaaugauuaguaucag

SEQ ID NO: 529684 - RNA, 22 nt, Human
ccuuguccucugguuuccuguu

SEQ ID NO: 529685 - RNA, 22 nt, Human
cacacauucaccaugacugaaa

SEQ ID NO: 529686 - RNA, 22 nt, Human
agaauuacagcuuuuagaauag

SEQ ID NO: 529687 - RNA, 22 nt, Human
caggauagaaaggccauggagu

SEQ ID NO: 529688 - RNA, 22 nt, Human
auuagggaaggauuuggccuga

SEQ ID NO: 529689 - RNA, 22 nt, Human
uuagccauugucagcacauggc

SEQ ID NO: 529690 - RNA, 22 nt, Human
agaaguaugugagaaauuaucc

SEQ ID NO: 529691 - RNA, 22 nt, Human
ucucuguggcaagcaugcugcu

SEQ ID NO: 529692 - RNA, 22 nt, Human
ccugccaggagcuggugcugca

SEQ ID NO: 529693 - RNA, 22 nt, Human
acccuggacuggggcugaggcu

SEQ ID NO: 529694 - RNA, 15 nt, Human
aaucuggcggcaagu

SEQ ID NO: 529695 - RNA, 22 nt, Human
gagccuguguuuccuguagcca

SEQ ID NO: 529696 - RNA, 22 nt, Human
agaaaugcucuuccugaccaga

SEQ ID NO: 529697 - RNA, 22 nt, Human
agcucagcccuccugugcagcu

SEQ ID NO: 529698 - RNA, 22 nt, Human
cuggggggagcugcguccagca

SEQ ID NO: 529699 - RNA, 20 nt, Human
acuggagccaucucagccua

SEQ ID NO: 529700 - RNA, 23 nt, Human
gggagccaggaccucgcgcccca

SEQ ID NO: 529701 - RNA, 19 nt, Human
aggaaagguggccuuagca

SEQ ID NO: 529702 - RNA, 22 nt, Human
ugagggaguuggguguauagga

SEQ ID NO: 529703 - RNA, 22 nt, Human
ccugucugagccagggugggca

SEQ ID NO: 529704 - RNA, 22 nt, Human
acacuuuagaaaaaagaauggu

SEQ ID NO: 529705 - RNA, 22 nt, Human
agaggccaucugcucugugggg

SEQ ID NO: 529706 - RNA, 22 nt, Human
ccaaagucagugcucagucguc

SEQ ID NO: 529707 - RNA, 20 nt, Human
acauccuggugacuagaacu

SEQ ID NO: 529708 - RNA, 22 nt, Human
gcagcugcuggaaguuccugcc

SEQ ID NO: 529709 - RNA, 22 nt, Human
gcaguguuuacauauuagaaac

SEQ ID NO: 529710 - RNA, 22 nt, Human
gcagccacagaggagggaugca

SEQ ID NO: 529711 - RNA, 22 nt, Human
cacagauaccuagugaaacaua

SEQ ID NO: 529712 - RNA, 22 nt, Human
gcugcugggcacccccugagcu

SEQ ID NO: 529713 - RNA, 18 nt, Human
augggaggggccaagaga

SEQ ID NO: 529714 - RNA, 22 nt, Human
ugaacaaacugcauucuucacu

SEQ ID NO: 529715 - RNA, 20 nt, Human
cuggggaggaggauguguuc

SEQ ID NO: 529716 - RNA, 22 nt, Human
aguaugaauggaaacuaccuau

SEQ ID NO: 529717 - RNA, 21 nt, Human
cucuucaguggugagcucuuc

SEQ ID NO: 529718 - RNA, 22 nt, Human
caggccuucucccucccucaac

SEQ ID NO: 529719 - RNA, 22 nt, Human
uuagggcuuuucugaauaggcc

SEQ ID NO: 529720 - RNA, 22 nt, Human
aaauagaauuaacuagcuacug

SEQ ID NO: 529721 - RNA, 22 nt, Human
uccauuuucuugcucuagguaa

SEQ ID NO: 529722 - RNA, 22 nt, Human
cugcuuuaaguauucaacaaag

SEQ ID NO: 529723 - RNA, 22 nt, Human
uugaaagcuccauauuguagag

SEQ ID NO: 529724 - RNA, 22 nt, Human
gaagcugggucgcugggauccu

SEQ ID NO: 529725 - RNA, 22 nt, Human
ccccuguguuguucaaggguca

SEQ ID NO: 529726 - RNA, 22 nt, Human
aggauugugccuccagucagaa

SEQ ID NO: 529727 - RNA, 22 nt, Human
acugggccuggauuggcguguc

SEQ ID NO: 529728 - RNA, 22 nt, Human
uuuauguacauauccacaagga

SEQ ID NO: 529729 - RNA, 22 nt, Human
caaagucuuggugaucaacuuu

SEQ ID NO: 529730 - RNA, 22 nt, Human
ccuccagguguuacauaugacu

SEQ ID NO: 529731 - RNA, 22 nt, Human
acagcuuuuuacuaauagauug

SEQ ID NO: 529732 - RNA, 20 nt, Human
uggagcuccagcguccaugu

SEQ ID NO: 529733 - RNA, 22 nt, Human
aacuucuggauguuucaaaugu

SEQ ID NO: 529734 - RNA, 22 nt, Human
gccugagcccaggugugcagag

SEQ ID NO: 529735 - RNA, 21 nt, Human
ugcagccauucagcccuaugc

SEQ ID NO: 529736 - RNA, 22 nt, Human
uaagcaguuuuucuuguauuaa

SEQ ID NO: 529737 - RNA, 22 nt, Human
uucagagagaccaaguggcgug

SEQ ID NO: 529738 - RNA, 22 nt, Human
gguggggcugcaagcaguucgg

SEQ ID NO: 529739 - RNA, 22 nt, Human
gggccugggaacuugcauuuag

SEQ ID NO: 529740 - RNA, 22 nt, Human
caaugaaagcaacugccuauaa

SEQ ID NO: 529741 - RNA, 22 nt, Human
auguggaaugaacaaaggaggc

SEQ ID NO: 529742 - RNA, 22 nt, Human
cagcuccuagaucggcgaagug

SEQ ID NO: 529743 - RNA, 23 nt, Human
ugccagaggcagucacaguggug

SEQ ID NO: 529744 - RNA, 22 nt, Human
auuuuuaugacaaaccauccuc

SEQ ID NO: 529745 - RNA, 22 nt, Human
ugcugcuccugccuggcuccca

SEQ ID NO: 529746 - RNA, 18 nt, Human
ucacagaauauugagugg

SEQ ID NO: 529747 - RNA, 22 nt, Human
gcucucugcagccuccuuggag

SEQ ID NO: 529748 - RNA, 22 nt, Human
agcagugaaacagcugcauaug

SEQ ID NO: 529749 - RNA, 22 nt, Human
aggaccagccuccaggucucuu

SEQ ID NO: 529750 - RNA, 22 nt, Human
ccugggcucaggcuugggcagc

SEQ ID NO: 529751 - RNA, 22 nt, Human
uguucauugcccccuguguaaa

SEQ ID NO: 529752 - RNA, 22 nt, Human
cccccaaaguuugcacggauaa

SEQ ID NO: 529753 - RNA, 22 nt, Human
cagcucaaguuucccaggucag

SEQ ID NO: 529754 - RNA, 22 nt, Human
uggagcugguaaacagugacau

SEQ ID NO: 529755 - RNA, 22 nt, Human
ugccaggcagugucagauugag

SEQ ID NO: 529756 - RNA, 21 nt, Human
gggaaauuaggauugcucauc

SEQ ID NO: 529757 - RNA, 22 nt, Human
uccaggagaggccugaccaggu

SEQ ID NO: 529758 - RNA, 22 nt, Human
cacaugaugguggaagccauag

SEQ ID NO: 529759 - RNA, 22 nt, Human
agggcccuuacgcaggcccuuc

SEQ ID NO: 529760 - RNA, 22 nt, Human
ucauuuguaccauuuuuuaaga

SEQ ID NO: 529761 - RNA, 22 nt, Human
gcugcccagcaggccccagggg

SEQ ID NO: 529762 - RNA, 21 nt, Human
gccagagcaguacaaugaggu

SEQ ID NO: 529763 - RNA, 22 nt, Human
uucugcauugacuuuuauuucc

SEQ ID NO: 529764 - RNA, 22 nt, Human
ugggccuuguccccucagcugu

SEQ ID NO: 529765 - RNA, 22 nt, Human
ccagcucccugaagccuggucu

SEQ ID NO: 529766 - RNA, 22 nt, Human
agaaucugcauuucuaauaagc

SEQ ID NO: 529767 - RNA, 20 nt, Human
aggaagccaaaggcugucuu

SEQ ID NO: 529768 - RNA, 19 nt, Human
agaaucaggucaggugaca

SEQ ID NO: 529769 - RNA, 22 nt, Human
acagaagagcacauuuaguaug

SEQ ID NO: 529770 - RNA, 22 nt, Human
uauauuaacacccacuugccuc

SEQ ID NO: 529771 - RNA, 22 nt, Human
cugugucucuccuuacaagacu

SEQ ID NO: 529772 - RNA, 18 nt, Human
acucaggaaaugaugaca

SEQ ID NO: 529773 - RNA, 22 nt, Human
uggccaggggaguuccccucca

SEQ ID NO: 529774 - RNA, 22 nt, Human
uuuuacuucauuccugacuuca

SEQ ID NO: 529775 - RNA, 22 nt, Human
aagggcagaaagggacgcuuug

SEQ ID NO: 529776 - RNA, 22 nt, Human
ccagagccucgcccggagccuc

SEQ ID NO: 529777 - RNA, 22 nt, Human
aaggaagaugaggugcugcuua

SEQ ID NO: 529778 - RNA, 22 nt, Human
ugugaaaucugaacucaaagau

SEQ ID NO: 529779 - RNA, 22 nt, Human
guauccuuugcggaaauuucua

SEQ ID NO: 529780 - RNA, 22 nt, Human
agacagcugcucgcagagcuau

SEQ ID NO: 529781 - RNA, 22 nt, Human
aaaguucuccuggauugugcug

SEQ ID NO: 529782 - RNA, 22 nt, Human
guccugggcccaggggcugccu

SEQ ID NO: 529783 - RNA, 22 nt, Human
cacagggccuggggcagcugcu

SEQ ID NO: 529784 - RNA, 22 nt, Human
ugucacagggauaccauggggc

SEQ ID NO: 529785 - RNA, 22 nt, Human
ugauuucccucaucauaacaga

SEQ ID NO: 529786 - RNA, 22 nt, Human
ggcugcucugcacaggggcugg

SEQ ID NO: 529787 - RNA, 20 nt, Human
guggcaggcagugaaggagc

SEQ ID NO: 529788 - RNA, 22 nt, Human
agcaccugcuuaaugugcagug

SEQ ID NO: 529789 - RNA, 22 nt, Human
agugcauugcaucucugcuuca

SEQ ID NO: 529790 - RNA, 22 nt, Human
gcuuugcagacaaaauuccagc

SEQ ID NO: 529791 - RNA, 17 nt, Human
ucaggcugugccuggua

SEQ ID NO: 529792 - RNA, 22 nt, Human
ucugccuguaccucuuuuuugc

SEQ ID NO: 529793 - RNA, 22 nt, Human
uuaacagauguuuauggagcau

SEQ ID NO: 529794 - RNA, 22 nt, Human
gagaaacaacacuugaugccuu

SEQ ID NO: 529795 - RNA, 22 nt, Human
gcagauggugccaugucuugug

SEQ ID NO: 529796 - RNA, 20 nt, Human
uguuccaugacuauuuggau

SEQ ID NO: 529797 - RNA, 22 nt, Human
ucagcagggagaggagaaugca

SEQ ID NO: 529798 - RNA, 22 nt, Human
uguguccuucugggagucccag

SEQ ID NO: 529799 - RNA, 22 nt, Human
aggcaggagcaagcccuacaag

SEQ ID NO: 529800 - RNA, 22 nt, Human
accaaacaaaauugugcacugu

SEQ ID NO: 529801 - RNA, 22 nt, Human
guauuuuauggcaugcaguggc

SEQ ID NO: 529802 - RNA, 22 nt, Human
augcacaucacucugaagaaaa

SEQ ID NO: 529803 - RNA, 20 nt, Human
guugaaaguaauaugaugcu

SEQ ID NO: 529804 - RNA, 22 nt, Human
cugcccugacugaccuuuugaa

SEQ ID NO: 529805 - RNA, 22 nt, Human
uauauuguagcugaugacaaau

SEQ ID NO: 529806 - RNA, 22 nt, Human
cuuggauuccgugaacuuaacc

SEQ ID NO: 529807 - RNA, 17 nt, Human
ucuggccuuccugaacu

SEQ ID NO: 529808 - RNA, 21 nt, Human
acaggcucacgauccauuucu

SEQ ID NO: 529809 - RNA, 22 nt, Human
ggcuuuauuauguggccaugug

SEQ ID NO: 529810 - RNA, 22 nt, Human
gcuccucuauuccccacauuuu

SEQ ID NO: 529811 - RNA, 22 nt, Human
uuuuagaaauacugauuuagug

SEQ ID NO: 529812 - RNA, 22 nt, Human
ugggagagucuaaaaccgaggu

SEQ ID NO: 529813 - RNA, 22 nt, Human
gcaccaggcuuagagccccagg

SEQ ID NO: 529814 - RNA, 22 nt, Human
auuucucaguguacauuauguu

SEQ ID NO: 529815 - RNA, 22 nt, Human
gauuucuuuagcucaucagauc

SEQ ID NO: 529816 - RNA, 22 nt, Human
aauguacaucucaguguaguac

SEQ ID NO: 529817 - RNA, 22 nt, Human
ccacccuggacaggccucugag

SEQ ID NO: 529818 - RNA, 19 nt, Human
ucugaauuauuuauguacc

SEQ ID NO: 529819 - RNA, 22 nt, Human
agggcuggcuaggugcguuccc

SEQ ID NO: 529820 - RNA, 22 nt, Human
uuugaaagggacaaagucacug

SEQ ID NO: 529821 - RNA, 22 nt, Human
uuugcugacuggaugcaguugg

SEQ ID NO: 529822 - RNA, 17 nt, Human
agccaggcauaugaagu

SEQ ID NO: 529823 - RNA, 22 nt, Human
cacaggagugcugcuauuguug

SEQ ID NO: 529824 - RNA, 22 nt, Human
acuucauuguaauauuauagca

SEQ ID NO: 529825 - RNA, 22 nt, Human
aaguuucauguggagguagacu

SEQ ID NO: 529826 - RNA, 22 nt, Human
gcuccccuugguccuccuggga

SEQ ID NO: 529827 - RNA, 22 nt, Human
gcauaauauacaugcuugaucc

SEQ ID NO: 529828 - RNA, 22 nt, Human
ucagcuuuuuggauugcccaag

SEQ ID NO: 529829 - RNA, 22 nt, Human
ucaagaauuuggauaagaaaug

SEQ ID NO: 529830 - RNA, 22 nt, Human
uuucaaagaguuguaaauuacu

SEQ ID NO: 529831 - RNA, 22 nt, Human
uuaaagggccgauuuccaggcc

SEQ ID NO: 529832 - RNA, 22 nt, Human
guggagcccugguagggacccc

SEQ ID NO: 529833 - RNA, 21 nt, Human
uucauuuguuauagacaaagu

SEQ ID NO: 529834 - RNA, 22 nt, Human
uucuguuuacucagaaauacaa

SEQ ID NO: 529835 - RNA, 22 nt, Human
gugggcagagcaagggaacuca

SEQ ID NO: 529836 - RNA, 22 nt, Human
aucacauuguuagcauagacug

SEQ ID NO: 529837 - RNA, 22 nt, Human
uacuuugucauucuaaccuucc

SEQ ID NO: 529838 - RNA, 22 nt, Human
ugaggccucauaaugagauuuc

SEQ ID NO: 529839 - RNA, 22 nt, Human
gccugguggacacugggcauca

SEQ ID NO: 529840 - RNA, 22 nt, Human
uuuggaaaguugucacuuuaga

SEQ ID NO: 529841 - RNA, 22 nt, Human
ccugugucagccccugccucca

SEQ ID NO: 529842 - RNA, 22 nt, Human
auaaaaguaggaccaacuuaca

SEQ ID NO: 529843 - RNA, 22 nt, Human
aaauucaguuuuaauaaucacu

SEQ ID NO: 529844 - RNA, 22 nt, Human
cagagaccccgcugcccuucug

SEQ ID NO: 529845 - RNA, 22 nt, Human
uuccagaaaucuuucagcucaa

SEQ ID NO: 529846 - RNA, 20 nt, Human
uuugagaccagucugcccaa

SEQ ID NO: 529847 - RNA, 22 nt, Human
agggccagaaucccucagucua

SEQ ID NO: 529848 - RNA, 22 nt, Human
ucagcuuuugucagaaauugua

SEQ ID NO: 529849 - RNA, 22 nt, Human
uucaugaaaguguaucuugugg

SEQ ID NO: 529850 - RNA, 23 nt, Human
guuaauaaugaacacuuucuccc

SEQ ID NO: 529851 - RNA, 22 nt, Human
cuucccuuucuggugacuucuc

SEQ ID NO: 529852 - RNA, 22 nt, Human
aaggaaccucuaagccucuguu

SEQ ID NO: 529853 - RNA, 22 nt, Human
uggccugggugcugcugacauc

SEQ ID NO: 529854 - RNA, 22 nt, Human
gucccuggaucugggacagcug

SEQ ID NO: 529855 - RNA, 22 nt, Human
ggaggaggggugacugaaugcu

SEQ ID NO: 529856 - RNA, 22 nt, Human
uuucaugugcaauuagcaauau

SEQ ID NO: 529857 - RNA, 22 nt, Human
ucaucacauaugucaugauuug

SEQ ID NO: 529858 - RNA, 22 nt, Human
uagauuuuuuggagacucucug

SEQ ID NO: 529859 - RNA, 22 nt, Human
agcagggcuuuggcuggcuuuc

SEQ ID NO: 529860 - RNA, 22 nt, Human
ugggagcacucuuugggaagca

SEQ ID NO: 529861 - RNA, 22 nt, Human
uguggcaaagaccauuucuuuc

SEQ ID NO: 529862 - RNA, 22 nt, Human
aaauuagauaugugugagacuc

SEQ ID NO: 529863 - RNA, 22 nt, Human
ggcaggagcucagguugguucc

SEQ ID NO: 529864 - RNA, 22 nt, Human
ucaugauuuccugguuaaggac

SEQ ID NO: 529865 - RNA, 22 nt, Human
acacuaaaugagucuacaguac

SEQ ID NO: 529866 - RNA, 23 nt, Human
auucuaagaugugaucuuauaac

SEQ ID NO: 529867 - RNA, 21 nt, Human
cugccuugaaugguacuggga

SEQ ID NO: 529868 - RNA, 22 nt, Human
agagugauggguugugcugacc

SEQ ID NO: 529869 - RNA, 22 nt, Human
ggcccagcacagugcuuggggg

SEQ ID NO: 529870 - RNA, 22 nt, Human
aagauggagcacgagcagaagc

SEQ ID NO: 529871 - RNA, 22 nt, Human
gcucugugcaguucagggacac

SEQ ID NO: 529872 - RNA, 17 nt, Human
agaggcagauacuugga

SEQ ID NO: 529873 - RNA, 22 nt, Human
uccaggccccugccugggccug

SEQ ID NO: 529874 - RNA, 22 nt, Human
ccugggaggcggagguugcagg

SEQ ID NO: 529875 - RNA, 22 nt, Human
gcagggugccgacuucagggau

SEQ ID NO: 529876 - RNA, 22 nt, Human
cuggauuuacugaguuuuauca

SEQ ID NO: 529877 - RNA, 23 nt, Human
agcugggccagguggucagaccu

SEQ ID NO: 529878 - RNA, 22 nt, Human
gccuggagcuacuggacacuga

SEQ ID NO: 529879 - RNA, 22 nt, Human
agccaggcuacuccuugcugac

SEQ ID NO: 529880 - RNA, 22 nt, Human
uguuucccuaaggucuggcucu

SEQ ID NO: 529881 - RNA, 22 nt, Human
cacugcaggucugagauggggg

SEQ ID NO: 529882 - RNA, 22 nt, Human
uagcauuuuagcuguuuucucu

SEQ ID NO: 529883 - RNA, 22 nt, Human
cucugggcacauuuuccaggac

SEQ ID NO: 529884 - RNA, 22 nt, Human
ggagccuggccuggcucugugu

SEQ ID NO: 529885 - RNA, 22 nt, Human
gggaccugaggcccugcuccac

SEQ ID NO: 529886 - RNA, 22 nt, Human
caagagcuggagaggcagucua

SEQ ID NO: 529887 - RNA, 22 nt, Human
uuuauuauucuguucucucuac

SEQ ID NO: 529888 - RNA, 20 nt, Human
aggagaaauucgggacaccu

SEQ ID NO: 529889 - RNA, 22 nt, Human
gggcugagucaucuggggccuc

SEQ ID NO: 529890 - RNA, 22 nt, Human
aucaaaguaucucaauauggua

SEQ ID NO: 529891 - RNA, 20 nt, Human
cugggcucaagugauccucc

SEQ ID NO: 529892 - RNA, 22 nt, Human
uuuaaaagggguauuaagucca

SEQ ID NO: 529893 - RNA, 22 nt, Human
caagcagagagguuagaacaca

SEQ ID NO: 529894 - RNA, 22 nt, Human
auagacuugguuaguaaauuug

SEQ ID NO: 529895 - RNA, 22 nt, Human
ugggccuggguuccuccugggc

SEQ ID NO: 529896 - RNA, 22 nt, Human
ucuucucaguuucucuaggaug

SEQ ID NO: 529897 - RNA, 22 nt, Human
ccagcagaagcucccgcugggu

SEQ ID NO: 529898 - RNA, 22 nt, Human
uaacuacaagggcggucucugu

SEQ ID NO: 529899 - RNA, 22 nt, Human
acggaaugagucuugaaaagug

SEQ ID NO: 529900 - RNA, 22 nt, Human
guguugaugacauuuuagaaac

SEQ ID NO: 529901 - RNA, 22 nt, Human
caggcucuuuugguggcaagga

SEQ ID NO: 529902 - RNA, 22 nt, Human
uagggcucagagaaguggggcc

SEQ ID NO: 529903 - RNA, 22 nt, Human
ucugcagauuuaucagcagcug

SEQ ID NO: 529904 - RNA, 22 nt, Human
uagauuuuacuucugucauuac

SEQ ID NO: 529905 - RNA, 22 nt, Human
uugcucuguccagccagcaggu

SEQ ID NO: 529906 - RNA, 22 nt, Human
accaaaaauuguggggcugaau

SEQ ID NO: 529907 - RNA, 20 nt, Human
gaagcagcuucauguagaca

SEQ ID NO: 529908 - RNA, 22 nt, Human
auuguaauuuuagagaaagugg

SEQ ID NO: 529909 - RNA, 22 nt, Human
uguuaacaucuuggacucguga

SEQ ID NO: 529910 - RNA, 22 nt, Human
gagccagguuugaaucucaguc

SEQ ID NO: 529911 - RNA, 22 nt, Human
gagugcaguaucuucugugucc

SEQ ID NO: 529912 - RNA, 22 nt, Human
acagcagcauaaacugacuaag

SEQ ID NO: 529913 - RNA, 22 nt, Human
cagcuuuaccuuuaggaguaac

SEQ ID NO: 529914 - RNA, 22 nt, Human
gccaccucggcuuucucugcuc

SEQ ID NO: 529915 - RNA, 22 nt, Human
gaacagcuucuugggagcuggg

SEQ ID NO: 529916 - RNA, 22 nt, Human
uaaauguguuagucaugguuuu

SEQ ID NO: 529917 - RNA, 22 nt, Human
agagcauccaucggccaggacc

SEQ ID NO: 529918 - RNA, 22 nt, Human
ucacagcauugucacaaggcug

SEQ ID NO: 529919 - RNA, 22 nt, Human
cauuuacuguugaaucccuagc

SEQ ID NO: 529920 - RNA, 22 nt, Human
uucuuucucagugggcagauac

SEQ ID NO: 529921 - RNA, 22 nt, Human
uuuauucaucaucuguucauau

SEQ ID NO: 529922 - RNA, 22 nt, Human
ggaccaaaauuacagucgcucc

SEQ ID NO: 529923 - RNA, 21 nt, Human
ucagaguggaagacaguuuga

SEQ ID NO: 529924 - RNA, 22 nt, Human
gccuuaggggucagacagagcu

SEQ ID NO: 529925 - RNA, 21 nt, Human
gcuccuggugcugcguggcgc

SEQ ID NO: 529926 - RNA, 22 nt, Human
uggcuagguagcuuucugcugu

SEQ ID NO: 529927 - RNA, 22 nt, Human
gaucaaaagcuggguucuaaaa

SEQ ID NO: 529928 - RNA, 22 nt, Human
gaagaacaccugcugcccagug

SEQ ID NO: 529929 - RNA, 22 nt, Human
uacagccacaggugacucucau

SEQ ID NO: 529930 - RNA, 22 nt, Human
cucugagcagaggccguggcua

SEQ ID NO: 529931 - RNA, 22 nt, Human
gugugcagcagagacaggacuc

SEQ ID NO: 529932 - RNA, 22 nt, Human
uuucacaguagaaaucauuaug

SEQ ID NO: 529933 - RNA, 22 nt, Human
caaaucugagucuacaauuuua

SEQ ID NO: 529934 - RNA, 22 nt, Human
ccaguguuuaggaauaaaaugu

SEQ ID NO: 529935 - RNA, 20 nt, Human
ccuggaagagcuccccaggc

SEQ ID NO: 529936 - RNA, 22 nt, Human
ccugcuggccacugcuccaccu

SEQ ID NO: 529937 - RNA, 22 nt, Human
uacauuuauaaggcuucucugu

SEQ ID NO: 529938 - RNA, 22 nt, Human
cauuaugugggaaaauguucuu

SEQ ID NO: 529939 - RNA, 22 nt, Human
uuguauuagcuguaaauuuucu

SEQ ID NO: 529940 - RNA, 21 nt, Human
guccucagcugaugggagcug

SEQ ID NO: 529941 - RNA, 18 nt, Human
cugcugugucgucugggc

SEQ ID NO: 529942 - RNA, 22 nt, Human
uuccaggacaagauguuucagg

SEQ ID NO: 529943 - RNA, 22 nt, Human
ggcccuguccuggcugucuccg

SEQ ID NO: 529944 - RNA, 22 nt, Human
ucaggcucugagcugaugcuaa

SEQ ID NO: 529945 - RNA, 22 nt, Human
cugcagagcauaaaucugaaua

SEQ ID NO: 529946 - RNA, 22 nt, Human
ggacuccucuagaaguugaggc

SEQ ID NO: 529947 - RNA, 22 nt, Human
uauuucuguaugcauaaaagga

SEQ ID NO: 529948 - RNA, 22 nt, Human
ucuuaacauauuauuuuagcac

SEQ ID NO: 529949 - RNA, 22 nt, Human
guguuuuaagaaagaagcucag

SEQ ID NO: 529950 - RNA, 20 nt, Human
ucaaagcaaagggagaugau

SEQ ID NO: 529951 - RNA, 22 nt, Human
gaggaggcacuaguuagugaca

SEQ ID NO: 529952 - RNA, 22 nt, Human
ccaggccaguguuugguccagg

SEQ ID NO: 529953 - RNA, 22 nt, Human
auuccugagacuuaucuguuuc

SEQ ID NO: 529954 - RNA, 22 nt, Human
acauuucauguuuuccagagca

SEQ ID NO: 529955 - RNA, 22 nt, Human
acugaugaaaacuaauaaauua

SEQ ID NO: 529956 - RNA, 22 nt, Human
aacagaauaguugauguacagu

SEQ ID NO: 529957 - RNA, 22 nt, Human
ucagccacuacccaccuuaaca

SEQ ID NO: 529958 - RNA, 22 nt, Human
cagcagugcuucagugugagau

SEQ ID NO: 529959 - RNA, 22 nt, Human
guguuuccucacuucucugacu

SEQ ID NO: 529960 - RNA, 23 nt, Human
uuucacagcuuuuauucugcauc

SEQ ID NO: 529961 - RNA, 22 nt, Human
gagcuggugugugcccgagcac

SEQ ID NO: 529962 - RNA, 22 nt, Human
ucucacagggcuaggcccugcc

SEQ ID NO: 529963 - RNA, 23 nt, Human
aaaugcagggucgcagguuacag

SEQ ID NO: 529964 - RNA, 22 nt, Human
gcacagcccuggucggggcccc

SEQ ID NO: 529965 - RNA, 18 nt, Human
agcugcagaccaggaggu

SEQ ID NO: 529966 - RNA, 22 nt, Human
uccaggcaaagccuuguagacg

SEQ ID NO: 529967 - RNA, 22 nt, Human
uguuacuuaucucacgugaugc

SEQ ID NO: 529968 - RNA, 20 nt, Human
gcacugaaauucaauguuug

SEQ ID NO: 529969 - RNA, 22 nt, Human
aaaccaucagauaauucauacu

SEQ ID NO: 529970 - RNA, 22 nt, Human
cucagaguccccaguggguuug

SEQ ID NO: 529971 - RNA, 22 nt, Human
ucucaggaaauaggauuugagu

SEQ ID NO: 529972 - RNA, 17 nt, Human
ggugagaccucccacuc

SEQ ID NO: 529973 - RNA, 23 nt, Human
uauugcacacauagaaacauaga

SEQ ID NO: 529974 - RNA, 22 nt, Human
ggaagccaugagggacaguucu

SEQ ID NO: 529975 - RNA, 22 nt, Human
uugguucaaagggauucaauuu

SEQ ID NO: 529976 - RNA, 22 nt, Human
cugggcuuagcagcuccugguc

SEQ ID NO: 529977 - RNA, 22 nt, Human
auucuucaucagagaugcacua

SEQ ID NO: 529978 - RNA, 22 nt, Human
ccugugugcacacgaggccaug

SEQ ID NO: 529979 - RNA, 22 nt, Human
gcaggcagguggcaucuuguga

SEQ ID NO: 529980 - RNA, 22 nt, Human
aauuucacuggaaaagauaauu

SEQ ID NO: 529981 - RNA, 22 nt, Human
uuguauuugauugucauaucgu

SEQ ID NO: 529982 - RNA, 22 nt, Human
caguggcugugaccagggaccu

SEQ ID NO: 529983 - RNA, 21 nt, Human
uugaagcaaggguggcucuga

SEQ ID NO: 529984 - RNA, 22 nt, Human
cuucuuggaagucguccuucca

SEQ ID NO: 529985 - RNA, 22 nt, Human
aaaaucugcuuccuuuuacaga

SEQ ID NO: 529986 - RNA, 22 nt, Human
cuaucaaacagccauuaauaua

SEQ ID NO: 529987 - RNA, 22 nt, Human
uuuauccauucaccaguugaac

SEQ ID NO: 529988 - RNA, 22 nt, Human
guccccugguggcuggagcugc

SEQ ID NO: 529989 - RNA, 22 nt, Human
aaagauuucacaucccaagccu

SEQ ID NO: 529990 - RNA, 18 nt, Human
ucagcuuuugaaaaccaa

SEQ ID NO: 529991 - RNA, 22 nt, Human
auggaagggacagaagggcaag

SEQ ID NO: 529992 - RNA, 22 nt, Human
auugcaaagaaauacaugcuua

SEQ ID NO: 529993 - RNA, 22 nt, Human
uuuguaagcaaguuaacauuuu

SEQ ID NO: 529994 - RNA, 22 nt, Human
aagaaauuaaggaaugcaacga

SEQ ID NO: 529995 - RNA, 22 nt, Human
acauacauggugcuuucuuggu

SEQ ID NO: 529996 - RNA, 22 nt, Human
aggagaaggaagugcaucacua

SEQ ID NO: 529997 - RNA, 22 nt, Human
cugggacacccaaggaaagagc

SEQ ID NO: 529998 - RNA, 22 nt, Human
gagggcucaacuacuacuaggc

SEQ ID NO: 529999 - RNA, 18 nt, Human
cuaacagggaaaauagaa

SEQ ID NO: 530000 - RNA, 22 nt, Human
ucauugcaagcucauuuaucug

SEQ ID NO: 530001 - RNA, 22 nt, Human
agggcugcccagugugagagcu

SEQ ID NO: 530002 - RNA, 22 nt, Human
gcaggcaguuugcuuuucccuc

SEQ ID NO: 530003 - RNA, 22 nt, Human
uguaugaaccuuuaauauagug

SEQ ID NO: 530004 - RNA, 22 nt, Human
gggcaguguggucgugccuuug

SEQ ID NO: 530005 - RNA, 22 nt, Human
uagaaaugugauaauagcuuaa

SEQ ID NO: 530006 - RNA, 22 nt, Human
acaaaugcaaguuuuaugucaa

SEQ ID NO: 530007 - RNA, 22 nt, Human
agucccagagaggucggggcca

SEQ ID NO: 530008 - RNA, 22 nt, Human
auuguacaugcagugagucauc

SEQ ID NO: 530009 - RNA, 22 nt, Human
aagugaaauugccauucuuaua

SEQ ID NO: 530010 - RNA, 22 nt, Human
uuaguaaauaaagucuacuuuc

SEQ ID NO: 530011 - RNA, 21 nt, Human
aggaggaacccguggcugggc

SEQ ID NO: 530012 - RNA, 22 nt, Human
uccuggaucagcgggggcaggc

SEQ ID NO: 530013 - RNA, 19 nt, Human
cugugcuuuaaacuccuau

SEQ ID NO: 530014 - RNA, 22 nt, Human
gggccucuccggccuuugcauc

SEQ ID NO: 530015 - RNA, 22 nt, Human
caaaguaauuuggagauauaua

SEQ ID NO: 530016 - RNA, 22 nt, Human
ugcucccaggcauucucuguug

SEQ ID NO: 530017 - RNA, 22 nt, Human
uuguguguacugguuaugggca

SEQ ID NO: 530018 - RNA, 22 nt, Human
uucaacauuugauacaagucag

SEQ ID NO: 530019 - RNA, 22 nt, Human
ugaaagggaaccugcuggacug

SEQ ID NO: 530020 - RNA, 22 nt, Human
ccugaauaauuugugaaaagau

SEQ ID NO: 530021 - RNA, 22 nt, Human
ugugaaauauuggcaauuucau

SEQ ID NO: 530022 - RNA, 22 nt, Human
caggcacagaguuauucauuua

SEQ ID NO: 530023 - RNA, 22 nt, Human
uuaacuugucagaaaauacagu

SEQ ID NO: 530024 - RNA, 22 nt, Human
gccagcuggagugagagugggc

SEQ ID NO: 530025 - RNA, 22 nt, Human
aacugaacugauaacauacacg

SEQ ID NO: 530026 - RNA, 22 nt, Human
uuucuaggcacagugucuuccc

SEQ ID NO: 530027 - RNA, 22 nt, Human
gagcucugccauggcucccacc

SEQ ID NO: 530028 - RNA, 22 nt, Human
aagacuaaauguguucuaaagu

SEQ ID NO: 530029 - RNA, 22 nt, Human
ggcugccuccacugcuuguccc

SEQ ID NO: 530030 - RNA, 22 nt, Human
ucccucagucccuggacaggca

SEQ ID NO: 530031 - RNA, 22 nt, Human
gggaaggacacagccaugacug

SEQ ID NO: 530032 - RNA, 22 nt, Human
ggggcugaaccuggaggugguc

SEQ ID NO: 530033 - RNA, 22 nt, Human
gggugcagagcuuaacuguagg

SEQ ID NO: 530034 - RNA, 22 nt, Human
gcaccaggcagcugagcaggcc

SEQ ID NO: 530035 - RNA, 18 nt, Human
cugugcagcaaacugagc

SEQ ID NO: 530036 - RNA, 22 nt, Human
ggacacuguauaaguuagagua

SEQ ID NO: 530037 - RNA, 22 nt, Human
ugcccauguuucucuguauccc

SEQ ID NO: 530038 - RNA, 22 nt, Human
cagagguaccagcagccucugg

SEQ ID NO: 530039 - RNA, 22 nt, Human
uguucuuagcaggagcaucuau

SEQ ID NO: 530040 - RNA, 22 nt, Human
aagagcugcccaaggugaacag

SEQ ID NO: 530041 - RNA, 22 nt, Human
ugcacacacggagauaggcuuu

SEQ ID NO: 530042 - RNA, 22 nt, Human
gaaacaaucaucaugugauuug

SEQ ID NO: 530043 - RNA, 22 nt, Human
cuuguuaaaaugcagauuccaa

SEQ ID NO: 530044 - RNA, 22 nt, Human
cagggacugagauccagacugu

SEQ ID NO: 530045 - RNA, 18 nt, Human
agucuucugauccauuuu

SEQ ID NO: 530046 - RNA, 22 nt, Human
agauuaucuccugauuuuaagg

SEQ ID NO: 530047 - RNA, 22 nt, Human
cauuuaguccuugacuucucuc

SEQ ID NO: 530048 - RNA, 22 nt, Human
augugugccccuuuuacucuuu

SEQ ID NO: 530049 - RNA, 22 nt, Human
uggcaaagacugcaaggacuuu

SEQ ID NO: 530050 - RNA, 21 nt, Human
uccuucucuaugauugucuga

SEQ ID NO: 530051 - RNA, 22 nt, Human
auguaucagaaauagcauuggc

SEQ ID NO: 530052 - RNA, 22 nt, Human
uauacagaacugcacgugcacg

SEQ ID NO: 530053 - RNA, 22 nt, Human
gcgagggcacgcgguugaaggc

SEQ ID NO: 530054 - RNA, 22 nt, Human
ucaugcaaucucuuguucagga

SEQ ID NO: 530055 - RNA, 22 nt, Human
aaguugaagcaugaaccaaggu

SEQ ID NO: 530056 - RNA, 22 nt, Human
ugcagagcagcaacugcgugcg

SEQ ID NO: 530057 - RNA, 22 nt, Human
cgcaggcaagagaguacaguua

SEQ ID NO: 530058 - RNA, 22 nt, Human
uuugcaaauaccaugaaacuug

SEQ ID NO: 530059 - RNA, 22 nt, Human
cugaagcaggccuacuucauug

SEQ ID NO: 530060 - RNA, 22 nt, Human
uauuuaaaaagaggccagcugg

SEQ ID NO: 530061 - RNA, 22 nt, Human
gcagggcuccccaggcccgagg

SEQ ID NO: 530062 - RNA, 22 nt, Human
acauuuugagaaaugacaagcu

SEQ ID NO: 530063 - RNA, 22 nt, Human
aaauauuauugcuuaaggggag

SEQ ID NO: 530064 - RNA, 22 nt, Human
cccugccuugggguccacaccg

SEQ ID NO: 530065 - RNA, 22 nt, Human
cugcucucuguuccccuggauc

SEQ ID NO: 530066 - RNA, 22 nt, Human
ucugaaauaagggagaagggaa

SEQ ID NO: 530067 - RNA, 22 nt, Human
agggcuggccacaugauuuggu

SEQ ID NO: 530068 - RNA, 22 nt, Human
cuggggaauagagcuggagacc

SEQ ID NO: 530069 - RNA, 21 nt, Human
ugcucacagaugugcucagug

SEQ ID NO: 530070 - RNA, 22 nt, Human
uucccacauucuuuacauucau

SEQ ID NO: 530071 - RNA, 19 nt, Human
uccucaggggcucacagac

SEQ ID NO: 530072 - RNA, 22 nt, Human
aauuuuaucucuaagcaggcuu

SEQ ID NO: 530073 - RNA, 22 nt, Human
cagggugcagugucgcugcuag

SEQ ID NO: 530074 - RNA, 22 nt, Human
ucauuguuucugcuuuucauga

SEQ ID NO: 530075 - RNA, 20 nt, Human
ucagagucaucaaagauggu

SEQ ID NO: 530076 - RNA, 22 nt, Human
ucagcagcagcucagcauguuu

SEQ ID NO: 530077 - RNA, 22 nt, Human
agcaccaagccuagagugaugu

SEQ ID NO: 530078 - RNA, 23 nt, Human
gccugugccuaugcccagcucug

SEQ ID NO: 530079 - RNA, 22 nt, Human
aaagcagaggugauaugacuua

SEQ ID NO: 530080 - RNA, 22 nt, Human
cugugggaauacugcgagugua

SEQ ID NO: 530081 - RNA, 22 nt, Human
aaaugucugagacuucugaacu

SEQ ID NO: 530082 - RNA, 23 nt, Human
uccagagugugagcuugccgugc

SEQ ID NO: 530083 - RNA, 22 nt, Human
ugggaggaagugcuaaugggag

SEQ ID NO: 530084 - RNA, 22 nt, Human
aacccaggguggagguugcagu

SEQ ID NO: 530085 - RNA, 22 nt, Human
agaagagaacugccaaacacuu

SEQ ID NO: 530086 - RNA, 22 nt, Human
aauaaaguguauucuuugucau

SEQ ID NO: 530087 - RNA, 22 nt, Human
uauccaaaguggcauauuauag

SEQ ID NO: 530088 - RNA, 22 nt, Human
ugggccuccaauuccagcggga

SEQ ID NO: 530089 - RNA, 22 nt, Human
guacaaaugagaguucuguuuu

SEQ ID NO: 530090 - RNA, 22 nt, Human
cugugucuaaucaggucaguca

SEQ ID NO: 530091 - RNA, 22 nt, Human
agacacaguguugaaggcuagu

SEQ ID NO: 530092 - RNA, 22 nt, Human
gcucugcucuugacuuaccagg

SEQ ID NO: 530093 - RNA, 22 nt, Human
cagagugggcugucagccacca

SEQ ID NO: 530094 - RNA, 22 nt, Human
cacaggagggagcgggcagcca

SEQ ID NO: 530095 - RNA, 22 nt, Human
uccugcacauuaguauuuuuua

SEQ ID NO: 530096 - RNA, 22 nt, Human
ucuggccagugaaaugcagaau

SEQ ID NO: 530097 - RNA, 22 nt, Human
cugaggagugggugggcaguga

SEQ ID NO: 530098 - RNA, 19 nt, Human
acccagagcccuuugcagg

SEQ ID NO: 530099 - RNA, 22 nt, Human
cacagaagaaucaugcuguguu

SEQ ID NO: 530100 - RNA, 20 nt, Human
ucuuacaaucguuacaucca

SEQ ID NO: 530101 - RNA, 22 nt, Human
uuuuaauacugcuauuguagga

SEQ ID NO: 530102 - RNA, 19 nt, Human
uuuuguguagcugcugguu

SEQ ID NO: 530103 - RNA, 21 nt, Human
gccaccccuggcacaggugcu

SEQ ID NO: 530104 - RNA, 22 nt, Human
caugaacagauucuucauuucu

SEQ ID NO: 530105 - RNA, 22 nt, Human
gaggcugcaggcaaugcugccc

SEQ ID NO: 530106 - RNA, 22 nt, Human
uuaauaugcugcuucuugaaaa

SEQ ID NO: 530107 - RNA, 17 nt, Human
agauggcaggaggcaga

SEQ ID NO: 530108 - RNA, 22 nt, Human
acuuuuaugauaaucaauguuc

SEQ ID NO: 530109 - RNA, 22 nt, Human
aagguaauccauaauaguuacu

SEQ ID NO: 530110 - RNA, 22 nt, Human
cacuuaagcaguuaauuuaucu

SEQ ID NO: 530111 - RNA, 22 nt, Human
cagggcugaaaucaagguguag

SEQ ID NO: 530112 - RNA, 22 nt, Human
ugaaaguugcacauaagagaau

SEQ ID NO: 530113 - RNA, 22 nt, Human
ucauauauuuuggcagugauca

SEQ ID NO: 530114 - RNA, 22 nt, Human
gcucaggaucagccaccucuuu

SEQ ID NO: 530115 - RNA, 22 nt, Human
uuguaacaaucugucauaaaug

SEQ ID NO: 530116 - RNA, 18 nt, Human
auuuugaacugggaauau

SEQ ID NO: 530117 - RNA, 19 nt, Human
aguuuauuauaggugauuc

SEQ ID NO: 530118 - RNA, 21 nt, Human
cuggagucauuuucugaguag

SEQ ID NO: 530119 - RNA, 19 nt, Human
uacagugaaccaggaggag

SEQ ID NO: 530120 - RNA, 22 nt, Human
uuuucaagggcagggaaaucau

SEQ ID NO: 530121 - RNA, 22 nt, Human
uuuuauuggagugauaccaagc

SEQ ID NO: 530122 - RNA, 22 nt, Human
caagucaucauagaaguucccc

SEQ ID NO: 530123 - RNA, 23 nt, Human
ggaguuggauuguacuugcugcu

SEQ ID NO: 530124 - RNA, 22 nt, Human
uaauagaauaguggaaacauug

SEQ ID NO: 530125 - RNA, 22 nt, Human
cagcuguuguuaugucugcagg

SEQ ID NO: 530126 - RNA, 22 nt, Human
aaacaaguuuguagacuagcca

SEQ ID NO: 530127 - RNA, 21 nt, Human
aaggccugcuuacugcuaguu

SEQ ID NO: 530128 - RNA, 22 nt, Human
aucaacauaaagaaguccucag

SEQ ID NO: 530129 - RNA, 19 nt, Human
cugcucccuccuucuggca

SEQ ID NO: 530130 - RNA, 22 nt, Human
gaggaagcugcguggcauuuca

SEQ ID NO: 530131 - RNA, 22 nt, Human
augcuuuuaugucacaugguca

SEQ ID NO: 530132 - RNA, 22 nt, Human
ucacuggggccuuuggucagga

SEQ ID NO: 530133 - RNA, 22 nt, Human
uggcccugucccuggagccugg

SEQ ID NO: 530134 - RNA, 19 nt, Human
uugaggggccaggggagau

SEQ ID NO: 530135 - RNA, 22 nt, Human
uauuuauaaucugccaaagaga

SEQ ID NO: 530136 - RNA, 22 nt, Human
ucugcaauguuuucccauccug

SEQ ID NO: 530137 - RNA, 22 nt, Human
ggcaggugacggggaugaguau

SEQ ID NO: 530138 - RNA, 22 nt, Human
uagagcugauaaugaggccaag

SEQ ID NO: 530139 - RNA, 22 nt, Human
uacacagaaccugguguacagu

SEQ ID NO: 530140 - RNA, 22 nt, Human
gggcugacauauuuggugcucu

SEQ ID NO: 530141 - RNA, 22 nt, Human
caagaaauuucuuaagaacuaa

SEQ ID NO: 530142 - RNA, 22 nt, Human
uuucuaaacaaagggaguuugg

SEQ ID NO: 530143 - RNA, 22 nt, Human
uucaagaagcccaaagacuagc

SEQ ID NO: 530144 - RNA, 22 nt, Human
acuacuuugggccauuuguuua

SEQ ID NO: 530145 - RNA, 22 nt, Human
acaguguauauuguuuaucugg

SEQ ID NO: 530146 - RNA, 22 nt, Human
uccaggagguuuggaggaagca

SEQ ID NO: 530147 - RNA, 20 nt, Human
cucugagguaucuguaaagu

SEQ ID NO: 530148 - RNA, 22 nt, Human
guuucaaagggaagacgcugga

SEQ ID NO: 530149 - RNA, 22 nt, Human
cagaaacacuguauuuagggaa

SEQ ID NO: 530150 - RNA, 22 nt, Human
uucagaaugugaccuuauuugg

SEQ ID NO: 530151 - RNA, 22 nt, Human
ggaggguuagcaaaggcacaga

SEQ ID NO: 530152 - RNA, 22 nt, Human
uggggcuguggauucucacgaa

SEQ ID NO: 530153 - RNA, 22 nt, Human
agagugagggggcacugagacg

SEQ ID NO: 530154 - RNA, 22 nt, Human
ggguggcagcuguugccaaggu

SEQ ID NO: 530155 - RNA, 22 nt, Human
aaguuauaucaucucauugacg

SEQ ID NO: 530156 - RNA, 22 nt, Human
cauuugaaugagauugcuguaa

SEQ ID NO: 530157 - RNA, 22 nt, Human
gccaccaggagcccaguccaaa

SEQ ID NO: 530158 - RNA, 22 nt, Human
agucaguggcuccgagccuggu

SEQ ID NO: 530159 - RNA, 22 nt, Human
gucuccagaauucuugggaggg

SEQ ID NO: 530160 - RNA, 22 nt, Human
ggcaggugugagcuguaaagga

SEQ ID NO: 530161 - RNA, 22 nt, Human
aggaggcuguggagcacuccau

SEQ ID NO: 530162 - RNA, 22 nt, Human
cugaaagaauaagauguuuaca

SEQ ID NO: 530163 - RNA, 22 nt, Human
uucagaaguuuucaaaacuaag

SEQ ID NO: 530164 - RNA, 22 nt, Human
uugcaagggcaugugugcgugu

SEQ ID NO: 530165 - RNA, 22 nt, Human
uucacauuaagccuccuccuac

SEQ ID NO: 530166 - RNA, 22 nt, Human
cucacuguuuaauagcuggauc

SEQ ID NO: 530167 - RNA, 22 nt, Human
cuagaaaaauacuuuauuguga

SEQ ID NO: 530168 - RNA, 22 nt, Human
ugcugcucuguaaagugaugag

SEQ ID NO: 530169 - RNA, 22 nt, Human
uuucccaggcccucagggcugc

SEQ ID NO: 530170 - RNA, 22 nt, Human
ucuagaaacaugacauugaucu

SEQ ID NO: 530171 - RNA, 21 nt, Human
uucugcuaagaaaacauuauu

SEQ ID NO: 530172 - RNA, 22 nt, Human
gucaggaucucccaguacauau

SEQ ID NO: 530173 - RNA, 22 nt, Human
uuauuugcccauguuuagcaga

SEQ ID NO: 530174 - RNA, 22 nt, Human
aguuggagugaacaugagauug

SEQ ID NO: 530175 - RNA, 22 nt, Human
agagugggcaggagccucgacu

SEQ ID NO: 530176 - RNA, 23 nt, Human
acacagaagaagacccaaggaag

SEQ ID NO: 530177 - RNA, 22 nt, Human
agggaugguggagguugcaagu

SEQ ID NO: 530178 - RNA, 22 nt, Human
gucauuuugcugcauauuuaga

SEQ ID NO: 530179 - RNA, 23 nt, Human
uggcagagacccagaaucuacau

SEQ ID NO: 530180 - RNA, 22 nt, Human
agcauggggcaaugcaugugcu

SEQ ID NO: 530181 - RNA, 22 nt, Human
augaaaacggaccagagcuauu

SEQ ID NO: 530182 - RNA, 22 nt, Human
ucagcauuguggcagagaaugg

SEQ ID NO: 530183 - RNA, 22 nt, Human
agcugagcacauucaaacaggu

SEQ ID NO: 530184 - RNA, 22 nt, Human
uucccaugccuggccccuaucc

SEQ ID NO: 530185 - RNA, 22 nt, Human
gacauuuagaaguuagauucaa

SEQ ID NO: 530186 - RNA, 19 nt, Human
uuuauuugagacaugccuu

SEQ ID NO: 530187 - RNA, 22 nt, Human
ucaggaagcauccugagguguc

SEQ ID NO: 530188 - RNA, 22 nt, Human
ugugacuaucauucuaaacauc

SEQ ID NO: 530189 - RNA, 22 nt, Human
agcucagguagacucagcaucu

SEQ ID NO: 530190 - RNA, 22 nt, Human
uacagugucccuuuuucagaca

SEQ ID NO: 530191 - RNA, 22 nt, Human
ugucagugguagacccagaggu

SEQ ID NO: 530192 - RNA, 22 nt, Human
ugcagcuucuccaucuccuugu

SEQ ID NO: 530193 - RNA, 22 nt, Human
auguuucaccagcaaauuaccu

SEQ ID NO: 530194 - RNA, 22 nt, Human
acaaagucaaauugcagccgcc

SEQ ID NO: 530195 - RNA, 22 nt, Human
aaaugucagaggaacauauuga

SEQ ID NO: 530196 - RNA, 22 nt, Human
ggagaaggaauauuggaguagg

SEQ ID NO: 530197 - RNA, 17 nt, Human
auuucacuuagcaugag

SEQ ID NO: 530198 - RNA, 22 nt, Human
ccaucuccacugucccugucaa

SEQ ID NO: 530199 - RNA, 22 nt, Human
ccaaagagcuagaauuauaggc

SEQ ID NO: 530200 - RNA, 22 nt, Human
augcucucuguccugcucagag

SEQ ID NO: 530201 - RNA, 22 nt, Human
acugcuuuucagagucugccug

SEQ ID NO: 530202 - RNA, 22 nt, Human
gguagcacauugcauuaggaga

SEQ ID NO: 530203 - RNA, 22 nt, Human
ccuucugcuggucaucccagug

SEQ ID NO: 530204 - RNA, 22 nt, Human
cuacccagcaccuaggcugccu

SEQ ID NO: 530205 - RNA, 22 nt, Human
caguggcaugguugacugcagu

SEQ ID NO: 530206 - RNA, 22 nt, Human
uagaaaagauaacauucugugc

SEQ ID NO: 530207 - RNA, 22 nt, Human
ccaguccacgucaagaagaggu

SEQ ID NO: 530208 - RNA, 22 nt, Human
ucacucagaaauagaaugaacc

SEQ ID NO: 530209 - RNA, 22 nt, Human
ugcaaaugaugaaacuaacuuu

SEQ ID NO: 530210 - RNA, 22 nt, Human
uuuucuauuaacucauuuugca

SEQ ID NO: 530211 - RNA, 22 nt, Human
uuuucaguaaugucuacauaau

SEQ ID NO: 530212 - RNA, 22 nt, Human
ugccuggcacuccuggagcuca

SEQ ID NO: 530213 - RNA, 22 nt, Human
agaggcuuggccucaguucugu

SEQ ID NO: 530214 - RNA, 22 nt, Human
gccagcugguaggcaccuagcc

SEQ ID NO: 530215 - RNA, 22 nt, Human
agcaaauacauuuuuagcauaa

SEQ ID NO: 530216 - RNA, 22 nt, Human
gcuggacucaggggacucaggg

SEQ ID NO: 530217 - RNA, 22 nt, Human
aauucacaauguguagucaugc

SEQ ID NO: 530218 - RNA, 22 nt, Human
gaaggaggcguuagcccuagga

SEQ ID NO: 530219 - RNA, 21 nt, Human
gcucccuggcugugugaccug

SEQ ID NO: 530220 - RNA, 22 nt, Human
aguggcagagccaagauaugau

SEQ ID NO: 530221 - RNA, 22 nt, Human
agcuaagacuuagugacuuagu

SEQ ID NO: 530222 - RNA, 20 nt, Human
aguguuccggaagacuggca

SEQ ID NO: 530223 - RNA, 22 nt, Human
ucaaaaucaaagauacuugaaa

SEQ ID NO: 530224 - RNA, 22 nt, Human
accuggcuuuggggauaggcuu

SEQ ID NO: 530225 - RNA, 22 nt, Human
gcagggcuguggacacuuuggu

SEQ ID NO: 530226 - RNA, 22 nt, Human
uaaguucaguuggucgaaguag

SEQ ID NO: 530227 - RNA, 22 nt, Human
gaaggcuugcagcucuguggca

SEQ ID NO: 530228 - RNA, 22 nt, Human
caagggcucacggucugcuggg

SEQ ID NO: 530229 - RNA, 22 nt, Human
uuuucaaagacuggaggcugau

SEQ ID NO: 530230 - RNA, 21 nt, Human
auaagcaugcugauuacauuu

SEQ ID NO: 530231 - RNA, 20 nt, Human
gucaucgccggcagcaaaga

SEQ ID NO: 530232 - RNA, 22 nt, Human
cugcuuugacuguuaagaacca

SEQ ID NO: 530233 - RNA, 22 nt, Human
aaauguguuuagaugguuuauu

SEQ ID NO: 530234 - RNA, 22 nt, Human
aguguccccuacagaggcauuc

SEQ ID NO: 530235 - RNA, 22 nt, Human
ucaaaguacuacucaguucagc

SEQ ID NO: 530236 - RNA, 23 nt, Human
aaaugcacaguauugauuuuuaa

SEQ ID NO: 530237 - RNA, 22 nt, Human
cacauuugaaggaauuagcauu

SEQ ID NO: 530238 - RNA, 22 nt, Human
uaguuuguaaugaggagaagua

SEQ ID NO: 530239 - RNA, 20 nt, Human
ucaauuucagguagcauagu

SEQ ID NO: 530240 - RNA, 22 nt, Human
aggcacugugcugaugucuuau

SEQ ID NO: 530241 - RNA, 22 nt, Human
aucucagucagguugaauuugg

SEQ ID NO: 530242 - RNA, 22 nt, Human
gaggagaagcuauuggaaggac

SEQ ID NO: 530243 - RNA, 22 nt, Human
auuuuacauaaggaagguuuaa

SEQ ID NO: 530244 - RNA, 22 nt, Human
cauccugguuaccccauaguca

SEQ ID NO: 530245 - RNA, 22 nt, Human
uuccagaggggagguggcagcc

SEQ ID NO: 530246 - RNA, 22 nt, Human
ugcuuuauaacuuaguuuaugg

SEQ ID NO: 530247 - RNA, 22 nt, Human
aagacaaagggguccuuggaug

SEQ ID NO: 530248 - RNA, 22 nt, Human
uucuaaacugaaguauuuuaaa

SEQ ID NO: 530249 - RNA, 22 nt, Human
caccucugcuguccacaggaug

SEQ ID NO: 530250 - RNA, 22 nt, Human
acuggcuugaaguagauucaaa

SEQ ID NO: 530251 - RNA, 22 nt, Human
ugggcuggcccaccacaccucg

SEQ ID NO: 530252 - RNA, 22 nt, Human
uuaacaaggugacugcauuaaa

SEQ ID NO: 530253 - RNA, 22 nt, Human
agggucaguucugugagguguu

SEQ ID NO: 530254 - RNA, 22 nt, Human
uuuucuuuaaucugguggggug

SEQ ID NO: 530255 - RNA, 17 nt, Human
auuucccagcagugcua

SEQ ID NO: 530256 - RNA, 22 nt, Human
agagcugggugguggugacuca

SEQ ID NO: 530257 - RNA, 22 nt, Human
cagggagaagucuggucagucc

SEQ ID NO: 530258 - RNA, 22 nt, Human
ugcagagaaaccaguggaggac

SEQ ID NO: 530259 - RNA, 22 nt, Human
acuggcugaaguuuacuuuuug

SEQ ID NO: 530260 - RNA, 19 nt, Human
gcuccugggccucacucau

SEQ ID NO: 530261 - RNA, 22 nt, Human
cugcaggauucucccaguugga

SEQ ID NO: 530262 - RNA, 22 nt, Human
ugaguaauaaacugucuugcuc

SEQ ID NO: 530263 - RNA, 22 nt, Human
acaugauuaaaagauuuuaaag

SEQ ID NO: 530264 - RNA, 22 nt, Human
aagggcuggaauaucucuuaga

SEQ ID NO: 530265 - RNA, 22 nt, Human
guuuuccauggaggucugaccu

SEQ ID NO: 530266 - RNA, 22 nt, Human
acagacauggaccaagcacugu

SEQ ID NO: 530267 - RNA, 22 nt, Human
cagggucuuauaaggccaauuu

SEQ ID NO: 530268 - RNA, 22 nt, Human
cugugcccauaaucugguauuu

SEQ ID NO: 530269 - RNA, 22 nt, Human
uccagagugacaaaugacugau

SEQ ID NO: 530270 - RNA, 22 nt, Human
gacagccaucagcacacgcugc

SEQ ID NO: 530271 - RNA, 22 nt, Human
acucaggaauggggcugggacu

SEQ ID NO: 530272 - RNA, 22 nt, Human
gcuucuggaagcugcuucugcc

SEQ ID NO: 530273 - RNA, 22 nt, Human
uugaaaggguuaaagugguaaa

SEQ ID NO: 530274 - RNA, 22 nt, Human
ugccaggcugaacagggucuua

SEQ ID NO: 530275 - RNA, 19 nt, Human
ccuuggaguuccaggugga

SEQ ID NO: 530276 - RNA, 22 nt, Human
aaguucaaggcagguccugagg

SEQ ID NO: 530277 - RNA, 22 nt, Human
gacaaagagaaguaacaguacc

SEQ ID NO: 530278 - RNA, 22 nt, Human
gucauuauaccauuauaauugu

SEQ ID NO: 530279 - RNA, 22 nt, Human
agcaguuuuagggagacacauu

SEQ ID NO: 530280 - RNA, 22 nt, Human
acugaaggcuuaacucuuucau

SEQ ID NO: 530281 - RNA, 22 nt, Human
gagagggcugccuggugugagg

SEQ ID NO: 530282 - RNA, 19 nt, Human
ggcucucuuaaagcuguuu

SEQ ID NO: 530283 - RNA, 22 nt, Human
cccuucagcugagugggacagc

SEQ ID NO: 530284 - RNA, 22 nt, Human
ugggcccugacuucaagcaucc

SEQ ID NO: 530285 - RNA, 22 nt, Human
ugaugcugagccugggacugac

SEQ ID NO: 530286 - RNA, 22 nt, Human
cagaagcaaaugccuugcugag

SEQ ID NO: 530287 - RNA, 22 nt, Human
aaacaucaccauuuuaccuaau

SEQ ID NO: 530288 - RNA, 22 nt, Human
ucagaaguaggagacauucuug

SEQ ID NO: 530289 - RNA, 20 nt, Human
cccuccagcaaccaggacuu

SEQ ID NO: 530290 - RNA, 22 nt, Human
cugguucaucgcggccacuuau

SEQ ID NO: 530291 - RNA, 22 nt, Human
aggcugagacugugcauuagug

SEQ ID NO: 530292 - RNA, 22 nt, Human
guggcccugucccaggccuccu

SEQ ID NO: 530293 - RNA, 22 nt, Human
aucugcuuuugagaauuuacuu

SEQ ID NO: 530294 - RNA, 22 nt, Human
agucaacaaaaauguggagccu

SEQ ID NO: 530295 - RNA, 22 nt, Human
ccugcccuagagaugacacaau

SEQ ID NO: 530296 - RNA, 22 nt, Human
agcugacauaagcacuuucuaa

SEQ ID NO: 530297 - RNA, 21 nt, Human
aacugcuggucuuuucugucu

SEQ ID NO: 530298 - RNA, 22 nt, Human
aaaggugacacucugccagcug

SEQ ID NO: 530299 - RNA, 19 nt, Human
cuccaagugccaaggacag

SEQ ID NO: 530300 - RNA, 22 nt, Human
aggcccagggcugcucucugaa

SEQ ID NO: 530301 - RNA, 22 nt, Human
uaugagaucccuuuuccuagag

SEQ ID NO: 530302 - RNA, 22 nt, Human
uuaauaacauuguguaucaccc

SEQ ID NO: 530303 - RNA, 22 nt, Human
cccagagucacaugggguguuc

SEQ ID NO: 530304 - RNA, 22 nt, Human
gaugggcguggcgcguuuggug

SEQ ID NO: 530305 - RNA, 22 nt, Human
ucuaggagcuuaaaggaggcca

SEQ ID NO: 530306 - RNA, 22 nt, Human
auauauacuuugacacauucug

SEQ ID NO: 530307 - RNA, 22 nt, Human
aauacugccugugagguaacuc

SEQ ID NO: 530308 - RNA, 22 nt, Human
ugugauuacugaauagaaaaua

SEQ ID NO: 530309 - RNA, 22 nt, Human
aagcauuuuagauaaagcauca

SEQ ID NO: 530310 - RNA, 22 nt, Human
cuguaugauauccaaauugaua

SEQ ID NO: 530311 - RNA, 22 nt, Human
acuggcagagguuggacaccau

SEQ ID NO: 530312 - RNA, 19 nt, Human
cuucugugauacaucaguc

SEQ ID NO: 530313 - RNA, 22 nt, Human
ugugauuagcugaauacacugg

SEQ ID NO: 530314 - RNA, 22 nt, Human
cauucugcauuuggaaggggca

SEQ ID NO: 530315 - RNA, 22 nt, Human
uaaacagaaugcguaagaagug

SEQ ID NO: 530316 - RNA, 22 nt, Human
gggcugagcacauacugacagc

SEQ ID NO: 530317 - RNA, 19 nt, Human
aggugaugugacucuagaa

SEQ ID NO: 530318 - RNA, 22 nt, Human
ugaggcagugugagauaauaaa

SEQ ID NO: 530319 - RNA, 22 nt, Human
cugccugcucaccagggcucug

SEQ ID NO: 530320 - RNA, 22 nt, Human
uuucacaaacugaggagacaau

SEQ ID NO: 530321 - RNA, 22 nt, Human
aggaaagauggaaggaggauaa

SEQ ID NO: 530322 - RNA, 22 nt, Human
cugcugcaggaugggcacucug

SEQ ID NO: 530323 - RNA, 22 nt, Human
uuugaaaguucuucugacacua

SEQ ID NO: 530324 - RNA, 22 nt, Human
cauugcacuccaucuugggcaa

SEQ ID NO: 530325 - RNA, 22 nt, Human
gaggccugggagccuguccucc

SEQ ID NO: 530326 - RNA, 19 nt, Human
cuugccuguuccuacagcu

SEQ ID NO: 530327 - RNA, 22 nt, Human
ccacugcccccugaagaccagg

SEQ ID NO: 530328 - RNA, 22 nt, Human
uuucuucuugaguaaccagauu

SEQ ID NO: 530329 - RNA, 22 nt, Human
uuucugaaaacugaaguagugc

SEQ ID NO: 530330 - RNA, 22 nt, Human
uuaagucacuggacuugccuag

SEQ ID NO: 530331 - RNA, 22 nt, Human
uaggugugggcucaggaaugug

SEQ ID NO: 530332 - RNA, 22 nt, Human
uccuguuuaucugugugacucg

SEQ ID NO: 530333 - RNA, 22 nt, Human
agcugugauuauccacuggaau

SEQ ID NO: 530334 - RNA, 22 nt, Human
ugaaugcaagucacacauuucu

SEQ ID NO: 530335 - RNA, 22 nt, Human
agagccuugaagaucuggaaaa

SEQ ID NO: 530336 - RNA, 22 nt, Human
uggaaguugaaucucagucaug

SEQ ID NO: 530337 - RNA, 22 nt, Human
gaaaauuucugccacaugugug

SEQ ID NO: 530338 - RNA, 22 nt, Human
ugaguggagacuguguguagag

SEQ ID NO: 530339 - RNA, 22 nt, Human
ccagcuuuucagaaucugccug

SEQ ID NO: 530340 - RNA, 22 nt, Human
uugguggguuaaugagugacug

SEQ ID NO: 530341 - RNA, 22 nt, Human
ucagaucauggaucuauuacuu

SEQ ID NO: 530342 - RNA, 22 nt, Human
ucugggagacguguguugucag

SEQ ID NO: 530343 - RNA, 22 nt, Human
uuuuaaaggauacucuugucua

SEQ ID NO: 530344 - RNA, 22 nt, Human
cagcagaguaauucucaccucu

SEQ ID NO: 530345 - RNA, 22 nt, Human
ccagcucuuuuggcugagugag

SEQ ID NO: 530346 - RNA, 22 nt, Human
aaggcauaugcuguguacaguu

SEQ ID NO: 530347 - RNA, 22 nt, Human
aguucugguugcccaugacauc

SEQ ID NO: 530348 - RNA, 22 nt, Human
ucucgacagccuggcacagugg

SEQ ID NO: 530349 - RNA, 22 nt, Human
uccaaagaacauugcugagacc

SEQ ID NO: 530350 - RNA, 22 nt, Human
aaugauauagcagacauagccu

SEQ ID NO: 530351 - RNA, 22 nt, Human
agucuucccugugccagagugu

SEQ ID NO: 530352 - RNA, 22 nt, Human
cuuugaaauucuucagcugaag

SEQ ID NO: 530353 - RNA, 22 nt, Human
caagggcauugcuugggaccuu

SEQ ID NO: 530354 - RNA, 22 nt, Human
gucucuggguuaagcagugcau

SEQ ID NO: 530355 - RNA, 22 nt, Human
ugaaaguucaauaccaauuugg

SEQ ID NO: 530356 - RNA, 22 nt, Human
aggcacugacucaagggagcca

SEQ ID NO: 530357 - RNA, 22 nt, Human
ucuaacuugaacucaugacugu

SEQ ID NO: 530358 - RNA, 22 nt, Human
ucccagagucuucuccuguaau

SEQ ID NO: 530359 - RNA, 22 nt, Human
aucauacauguaacuaaguaaa

SEQ ID NO: 530360 - RNA, 21 nt, Human
uuacuuuugcaccaaccuaau

SEQ ID NO: 530361 - RNA, 22 nt, Human
ucucaggggauucacuggcacc

SEQ ID NO: 530362 - RNA, 22 nt, Human
caguggcgugaucucugcucac

SEQ ID NO: 530363 - RNA, 19 nt, Human
uaugagcugacaaaggccu

SEQ ID NO: 530364 - RNA, 19 nt, Human
ucugccucuggucaggcuc

SEQ ID NO: 530365 - RNA, 22 nt, Human
ucuggcaguuccuuguugauau

SEQ ID NO: 530366 - RNA, 22 nt, Human
gccaaaucuggauuuagcaaga

SEQ ID NO: 530367 - RNA, 22 nt, Human
ucagcuaggcacuucucacuga

SEQ ID NO: 530368 - RNA, 22 nt, Human
ucagcuggauguggaagugcua

SEQ ID NO: 530369 - RNA, 22 nt, Human
gcuucucccuacagaugucagu

SEQ ID NO: 530370 - RNA, 22 nt, Human
cauauuuauagaucuggcauuu

SEQ ID NO: 530371 - RNA, 22 nt, Human
aaaauguaaagcuugaguguag

SEQ ID NO: 530372 - RNA, 22 nt, Human
aagaggugccagggguuuugua

SEQ ID NO: 530373 - RNA, 22 nt, Human
cuuguaaaauauccaguuaagg

SEQ ID NO: 530374 - RNA, 22 nt, Human
gcuggcaguaaaggguuuggca

SEQ ID NO: 530375 - RNA, 22 nt, Human
aagcuuuaagugucagucagcc

SEQ ID NO: 530376 - RNA, 22 nt, Human
cuccagugcacccagaggauuu

SEQ ID NO: 530377 - RNA, 22 nt, Human
uucugaugcaugggucucuguu

SEQ ID NO: 530378 - RNA, 23 nt, Human
ugcaagaguuccaaacuguucaa

SEQ ID NO: 530379 - RNA, 22 nt, Human
uaagaacaguguuucaucucua

SEQ ID NO: 530380 - RNA, 22 nt, Human
acagugauucugcaaaccauau

SEQ ID NO: 530381 - RNA, 22 nt, Human
uucuucuuucccccugugguac

SEQ ID NO: 530382 - RNA, 22 nt, Human
uucaaucauuagaaucucaggc

SEQ ID NO: 530383 - RNA, 22 nt, Human
ccagggcaauuauuuggagggu

SEQ ID NO: 530384 - RNA, 22 nt, Human
acuuucucaggaauucacagac

SEQ ID NO: 530385 - RNA, 22 nt, Human
aacaucagaauauccauguugg

SEQ ID NO: 530386 - RNA, 22 nt, Human
agaggcagaaguguucaaaccc

SEQ ID NO: 530387 - RNA, 22 nt, Human
aagcugccaccagcccagggca

SEQ ID NO: 530388 - RNA, 22 nt, Human
aucucaacuaagccuaacuuuu

SEQ ID NO: 530389 - RNA, 22 nt, Human
acauuuacagugcuagacaauc

SEQ ID NO: 530390 - RNA, 22 nt, Human
gaaagaagcuuuagauggcuau

SEQ ID NO: 530391 - RNA, 21 nt, Human
ccucaucaaacuuucacuugc

SEQ ID NO: 530392 - RNA, 18 nt, Human
caaauucucauugauuuc

SEQ ID NO: 530393 - RNA, 22 nt, Human
auuauuauuuuagagagaggcc

SEQ ID NO: 530394 - RNA, 22 nt, Human
guuuacaaauauuuuaaauggu

SEQ ID NO: 530395 - RNA, 22 nt, Human
acagaacuuggaacuuuucaca

SEQ ID NO: 530396 - RNA, 22 nt, Human
acacacuguugcucauccaggc

SEQ ID NO: 530397 - RNA, 22 nt, Human
uuuuugagauggauuuagcucu

SEQ ID NO: 530398 - RNA, 22 nt, Human
cuggagcagcagguggccaggg

SEQ ID NO: 530399 - RNA, 22 nt, Human
ggcagggcagcgcugauuaggg

SEQ ID NO: 530400 - RNA, 22 nt, Human
aaauacuguugaaugaaguaag

SEQ ID NO: 530401 - RNA, 22 nt, Human
ggcaccaggcugggcauaggcc

SEQ ID NO: 530402 - RNA, 22 nt, Human
uucacauuugaaaggaaagaua

SEQ ID NO: 530403 - RNA, 22 nt, Human
uuucacauguauauaggcauua

SEQ ID NO: 530404 - RNA, 22 nt, Human
aaaguccuagcgauccacagaa

SEQ ID NO: 530405 - RNA, 22 nt, Human
ccccaccagcacccucucuauc

SEQ ID NO: 530406 - RNA, 22 nt, Human
uauuuguugcgggaauugcuau

SEQ ID NO: 530407 - RNA, 22 nt, Human
agugacucacuagcucucagug

SEQ ID NO: 530408 - RNA, 22 nt, Human
gggcugacucugcacugagcca

SEQ ID NO: 530409 - RNA, 22 nt, Human
agccagacauggcuccugcucc

SEQ ID NO: 530410 - RNA, 22 nt, Human
aauguugaggauaucagaaaau

SEQ ID NO: 530411 - RNA, 22 nt, Human
uguuaucugagcaacgucgacg

SEQ ID NO: 530412 - RNA, 22 nt, Human
ggcuguggcagcuggaaguggu

SEQ ID NO: 530413 - RNA, 22 nt, Human
gccaggcaauguguuagaagcg

SEQ ID NO: 530414 - RNA, 22 nt, Human
aggcucagggacucccucccuc

SEQ ID NO: 530415 - RNA, 21 nt, Human
gggugggaggacacagcaggc

SEQ ID NO: 530416 - RNA, 22 nt, Human
uaugaaauugccauuuuuaugg

SEQ ID NO: 530417 - RNA, 22 nt, Human
uugcucugaacccagggcacca

SEQ ID NO: 530418 - RNA, 22 nt, Human
aaagucauuuagccuuaucucc

SEQ ID NO: 530419 - RNA, 22 nt, Human
uggaccugcguaggugcugggc

SEQ ID NO: 530420 - RNA, 22 nt, Human
ugaacucuccaggcaaaugauc

SEQ ID NO: 530421 - RNA, 22 nt, Human
ugggcaggauaauaucucaugu

SEQ ID NO: 530422 - RNA, 22 nt, Human
uuucuggaaccacaaaaguaug

SEQ ID NO: 530423 - RNA, 22 nt, Human
augcuuaacucuguacauaguu

SEQ ID NO: 530424 - RNA, 22 nt, Human
gcucucuggcuaguccaucggg

SEQ ID NO: 530425 - RNA, 17 nt, Human
gucugggcuuuagagac

SEQ ID NO: 530426 - RNA, 22 nt, Human
uuaauacauuucagacuguuau

SEQ ID NO: 530427 - RNA, 22 nt, Human
auguguaggugaaucgaggcug

SEQ ID NO: 530428 - RNA, 22 nt, Human
aggaacccugcgccauacuuug

SEQ ID NO: 530429 - RNA, 22 nt, Human
uccagaguuguaaguguugaca

SEQ ID NO: 530430 - RNA, 16 nt, Human
ugggcagaugagaaga

SEQ ID NO: 530431 - RNA, 22 nt, Human
aaggcaggagcuguaucuuauu

SEQ ID NO: 530432 - RNA, 21 nt, Human
aucagaaguuuuggucaguag

SEQ ID NO: 530433 - RNA, 22 nt, Human
acauaacaaucauaggacauag

SEQ ID NO: 530434 - RNA, 22 nt, Human
agaggcucugccgccucaggua

SEQ ID NO: 530435 - RNA, 22 nt, Human
guggcuucugcggugugcgcag

SEQ ID NO: 530436 - RNA, 22 nt, Human
aucuacaggauaguuuaauauu

SEQ ID NO: 530437 - RNA, 23 nt, Human
ggacagggcccugcccuauggcc

SEQ ID NO: 530438 - RNA, 17 nt, Human
agcagcugaagcagcca

SEQ ID NO: 530439 - RNA, 22 nt, Human
uauuugugagacugacugaagu

SEQ ID NO: 530440 - RNA, 19 nt, Human
aguagcagaaagugcagug

SEQ ID NO: 530441 - RNA, 22 nt, Human
auucugaaguugcaggagaagc

SEQ ID NO: 530442 - RNA, 22 nt, Human
cugaggcugcccagggccaggu

SEQ ID NO: 530443 - RNA, 22 nt, Human
acauuucagcgugcaugacaug

SEQ ID NO: 530444 - RNA, 22 nt, Human
acagacacaggcguggagucgc

SEQ ID NO: 530445 - RNA, 22 nt, Human
ggcuuaaaguuuucuagaauaa

SEQ ID NO: 530446 - RNA, 22 nt, Human
gggcccuggggccugauuugca

SEQ ID NO: 530447 - RNA, 22 nt, Human
ucaguuuuuaaaugauauaauu

SEQ ID NO: 530448 - RNA, 22 nt, Human
ugauuuccccagucuugcugcu

SEQ ID NO: 530449 - RNA, 22 nt, Human
gcugccugauuuacauagugaa

SEQ ID NO: 530450 - RNA, 20 nt, Human
gggcaguggcgcuaucucag

SEQ ID NO: 530451 - RNA, 22 nt, Human
agauguuuaaaaagaugacucu

SEQ ID NO: 530452 - RNA, 22 nt, Human
ggguccagacuaugaagaacuu

SEQ ID NO: 530453 - RNA, 22 nt, Human
acagugugugcuuucccuuacg

SEQ ID NO: 530454 - RNA, 22 nt, Human
ucugagaguacgggcugcgcgc

SEQ ID NO: 530455 - RNA, 22 nt, Human
acugggaaaagcuauggcaaau

SEQ ID NO: 530456 - RNA, 22 nt, Human
aaggucauugguucugaauucu

SEQ ID NO: 530457 - RNA, 22 nt, Human
gaguuaauucgaauauucuagc

SEQ ID NO: 530458 - RNA, 22 nt, Human
aaaugcacagguuuuaaauccu

SEQ ID NO: 530459 - RNA, 21 nt, Human
uugaaggaucacuucuguacc

SEQ ID NO: 530460 - RNA, 22 nt, Human
gaguccaguucuuuccagcagu

SEQ ID NO: 530461 - RNA, 22 nt, Human
cugcugccggcgagccucccuu

SEQ ID NO: 530462 - RNA, 22 nt, Human
ccaguguuauuuuagaguguga

SEQ ID NO: 530463 - RNA, 23 nt, Human
uccuggugacaugccugagcauc

SEQ ID NO: 530464 - RNA, 20 nt, Human
ggagagcagggaagacagua

SEQ ID NO: 530465 - RNA, 22 nt, Human
aagccaggaccaaacucauccu

SEQ ID NO: 530466 - RNA, 22 nt, Human
ggaccugcucucccaguucucu

SEQ ID NO: 530467 - RNA, 22 nt, Human
uccaggcaaaaggaacugcuug

SEQ ID NO: 530468 - RNA, 21 nt, Human
agcaggugaaccuccaguaca

SEQ ID NO: 530469 - RNA, 22 nt, Human
ccagggugggguccaggaacca

SEQ ID NO: 530470 - RNA, 22 nt, Human
agcaggagcugugggaagaugg

SEQ ID NO: 530471 - RNA, 18 nt, Human
cucagagaugcccuuauu

SEQ ID NO: 530472 - RNA, 22 nt, Human
uuucaaauaccauaaaccuaau

SEQ ID NO: 530473 - RNA, 20 nt, Human
cucuuuucacucucaguggu

SEQ ID NO: 530474 - RNA, 22 nt, Human
auggagugggccaauuuuagug

SEQ ID NO: 530475 - RNA, 22 nt, Human
uacauaauuaaucuuuaaguuc

SEQ ID NO: 530476 - RNA, 22 nt, Human
ggguguccugugccaagcuggg

SEQ ID NO: 530477 - RNA, 22 nt, Human
cagagcugauuggauccagaga

SEQ ID NO: 530478 - RNA, 22 nt, Human
gauuccuuggcucugucucagg

SEQ ID NO: 530479 - RNA, 22 nt, Human
gcaguggcuaggagucuggcgu

SEQ ID NO: 530480 - RNA, 22 nt, Human
aaaucaguuguuauauuaaaga

SEQ ID NO: 530481 - RNA, 22 nt, Human
cugggcucaguggcucauggcu

SEQ ID NO: 530482 - RNA, 22 nt, Human
ugugccaagaucaaacuuuucu

SEQ ID NO: 530483 - RNA, 22 nt, Human
agcugagagguggcaagcugua

SEQ ID NO: 530484 - RNA, 22 nt, Human
caauuucauggauaaaagaugu

SEQ ID NO: 530485 - RNA, 22 nt, Human
augggaguuuucucugaugcuc

SEQ ID NO: 530486 - RNA, 22 nt, Human
ggccugccucacagucagcacc

SEQ ID NO: 530487 - RNA, 22 nt, Human
gaagcacauggcugugagcaac

SEQ ID NO: 530488 - RNA, 22 nt, Human
agugggagagaagcaaguagua

SEQ ID NO: 530489 - RNA, 22 nt, Human
gggccucugugcagaggggccu

SEQ ID NO: 530490 - RNA, 22 nt, Human
cuacaaagcucuucuacaggca

SEQ ID NO: 530491 - RNA, 22 nt, Human
auuaauauccugcuggcuaaau

SEQ ID NO: 530492 - RNA, 20 nt, Human
uugcaaauaucuauugauug

SEQ ID NO: 530493 - RNA, 22 nt, Human
cugagagaucaagccacaggau

SEQ ID NO: 530494 - RNA, 22 nt, Human
acagugauuucugcaagggcuc

SEQ ID NO: 530495 - RNA, 22 nt, Human
aauucuauguucuugaguaaga

SEQ ID NO: 530496 - RNA, 22 nt, Human
agcuggagaugcccagcaccgg

SEQ ID NO: 530497 - RNA, 22 nt, Human
uccuucagcuacucaguuucca

SEQ ID NO: 530498 - RNA, 20 nt, Human
cccucugcuacacugggagc

SEQ ID NO: 530499 - RNA, 22 nt, Human
ucauuguuauguuuugcugucu

SEQ ID NO: 530500 - RNA, 17 nt, Human
gcaagggaugggagauu

SEQ ID NO: 530501 - RNA, 22 nt, Human
cuauuuauuguggguauccagg

SEQ ID NO: 530502 - RNA, 22 nt, Human
uggacaggaucugagacugaga

SEQ ID NO: 530503 - RNA, 19 nt, Human
guaagggcuaauggacuau

SEQ ID NO: 530504 - RNA, 22 nt, Human
uagugauuaaaggcagaauguu

SEQ ID NO: 530505 - RNA, 22 nt, Human
ugacagggcuagaggcaaugca

SEQ ID NO: 530506 - RNA, 22 nt, Human
gaggcucaaaccuggacagagc

SEQ ID NO: 530507 - RNA, 22 nt, Human
ucuggggaccauggcaucuaaa

SEQ ID NO: 530508 - RNA, 22 nt, Human
ggagccagcagggugacacuga

SEQ ID NO: 530509 - RNA, 22 nt, Human
agcaggcuuuccacagaaggag

SEQ ID NO: 530510 - RNA, 22 nt, Human
agcgcaggaacacgucugccuu

SEQ ID NO: 530511 - RNA, 22 nt, Human
aacaguaucuuuuaucagaaau

SEQ ID NO: 530512 - RNA, 17 nt, Human
uguuuucauucauugcu

SEQ ID NO: 530513 - RNA, 21 nt, Human
cugcaucucauagaacauguc

SEQ ID NO: 530514 - RNA, 22 nt, Human
ugaggcucuccaagcagaugag

SEQ ID NO: 530515 - RNA, 22 nt, Human
caaauuagagguuuguuuugau

SEQ ID NO: 530516 - RNA, 22 nt, Human
ucaguggauugacaugaaaaag

SEQ ID NO: 530517 - RNA, 22 nt, Human
aucauuuaaaacaagucucuau

SEQ ID NO: 530518 - RNA, 17 nt, Human
gcuggcugacccaugcc

SEQ ID NO: 530519 - RNA, 22 nt, Human
agucuggggucugguagaacga

SEQ ID NO: 530520 - RNA, 22 nt, Human
uguauuagaucugagaacuucu

SEQ ID NO: 530521 - RNA, 20 nt, Human
ucagagagagggugccacuu

SEQ ID NO: 530522 - RNA, 22 nt, Human
cuuucuucaagcuggucucaau

SEQ ID NO: 530523 - RNA, 22 nt, Human
cuguggaguccuggggaaugga

SEQ ID NO: 530524 - RNA, 22 nt, Human
cuaggaaucaccaagauucuag

SEQ ID NO: 530525 - RNA, 22 nt, Human
ucuaaaaugcagaucuacuggu

SEQ ID NO: 530526 - RNA, 22 nt, Human
cugaggcugggcauggggucca

SEQ ID NO: 530527 - RNA, 22 nt, Human
gggcuccagcccgggaccaggu

SEQ ID NO: 530528 - RNA, 21 nt, Human
aaagaaaucucccauugguag

SEQ ID NO: 530529 - RNA, 22 nt, Human
gaaggccacuuuguguugagaa

SEQ ID NO: 530530 - RNA, 22 nt, Human
ugcucacugaacucuugcuguc

SEQ ID NO: 530531 - RNA, 22 nt, Human
ucugggcagaagcagugcaaag

SEQ ID NO: 530532 - RNA, 22 nt, Human
aaucucuugggaggaaugaauu

SEQ ID NO: 530533 - RNA, 22 nt, Human
ccagcuugaagaugugcugguu

SEQ ID NO: 530534 - RNA, 22 nt, Human
cuggagcucuccagagccccgu

SEQ ID NO: 530535 - RNA, 23 nt, Human
ucuggcuccauccuuggggaucc

SEQ ID NO: 530536 - RNA, 22 nt, Human
ccugaagaugcuguggccuggu

SEQ ID NO: 530537 - RNA, 22 nt, Human
ggcaggugcuaagagagguaaa

SEQ ID NO: 530538 - RNA, 21 nt, Human
uccuggcuuuaugcuaccucu

SEQ ID NO: 530539 - RNA, 22 nt, Human
ucagucuuugcuuaugacaaua

SEQ ID NO: 530540 - RNA, 22 nt, Human
auaacagaugugaagugcuaau

SEQ ID NO: 530541 - RNA, 22 nt, Human
ggcucagaccucccagcuccag

SEQ ID NO: 530542 - RNA, 22 nt, Human
gucaggauuggggucaugaguc

SEQ ID NO: 530543 - RNA, 22 nt, Human
ggaagagagaucccauagaugu

SEQ ID NO: 530544 - RNA, 22 nt, Human
ggaaccaguggaaugauaugcu

SEQ ID NO: 530545 - RNA, 22 nt, Human
aucuggcugcugugcuuaagcu

SEQ ID NO: 530546 - RNA, 22 nt, Human
aagaauaaauuaagauacuuag

SEQ ID NO: 530547 - RNA, 22 nt, Human
ucuuaaaaguaugccaauugga

SEQ ID NO: 530548 - RNA, 22 nt, Human
gaaggaagucauuagugcagac

SEQ ID NO: 530549 - RNA, 22 nt, Human
auuauucauggucuuccacaau

SEQ ID NO: 530550 - RNA, 22 nt, Human
agcuggcagagcauuuguggcc

SEQ ID NO: 530551 - RNA, 22 nt, Human
cacaggcuuccaguccccagcu

SEQ ID NO: 530552 - RNA, 22 nt, Human
aucaaauauaauaauuuucgcu

SEQ ID NO: 530553 - RNA, 22 nt, Human
gagcuguccgccccugggccga

SEQ ID NO: 530554 - RNA, 23 nt, Human
agaaaagcuuggacacauggccu

SEQ ID NO: 530555 - RNA, 22 nt, Human
agauuacagaagaauaaguaga

SEQ ID NO: 530556 - RNA, 22 nt, Human
gaggcugaguagcuuugugcuc

SEQ ID NO: 530557 - RNA, 19 nt, Human
agccagaacuaguguuucu

SEQ ID NO: 530558 - RNA, 22 nt, Human
agcuuuaucacaauauuggcua

SEQ ID NO: 530559 - RNA, 22 nt, Human
cucuccuugcagauggcugccu

SEQ ID NO: 530560 - RNA, 22 nt, Human
acugccugaugugguucuaaau

SEQ ID NO: 530561 - RNA, 22 nt, Human
aagcauuuauagauaagaauuu

SEQ ID NO: 530562 - RNA, 22 nt, Human
cagggcugaagaaauucaaaag

SEQ ID NO: 530563 - RNA, 22 nt, Human
uguucuaaguguuuuguucaug

SEQ ID NO: 530564 - RNA, 22 nt, Human
cagugcccaagaugugccaugc

SEQ ID NO: 530565 - RNA, 22 nt, Human
accuggcaugaagcaugccuua

SEQ ID NO: 530566 - RNA, 22 nt, Human
aagcacagcagagccuugcuug

SEQ ID NO: 530567 - RNA, 22 nt, Human
auacagaacucucaguuguaua

SEQ ID NO: 530568 - RNA, 22 nt, Human
gugcugcgaugauuuuacagag

SEQ ID NO: 530569 - RNA, 22 nt, Human
ucuagaaaguuuguacugauuu

SEQ ID NO: 530570 - RNA, 22 nt, Human
gugggcuuguuuugaugagauc

SEQ ID NO: 530571 - RNA, 21 nt, Human
cucaaagaccaaaaguguaga

SEQ ID NO: 530572 - RNA, 22 nt, Human
uugcuucaguagcucuuuaaag

SEQ ID NO: 530573 - RNA, 22 nt, Human
acuucagugugguauaaaacgu

SEQ ID NO: 530574 - RNA, 22 nt, Human
uccuggagcuuccuucauggua

SEQ ID NO: 530575 - RNA, 22 nt, Human
cagaaugcaaauuuuauaauau

SEQ ID NO: 530576 - RNA, 22 nt, Human
ccagguggugaaagugggcccu

SEQ ID NO: 530577 - RNA, 22 nt, Human
cugggccagucucggccgcucu

SEQ ID NO: 530578 - RNA, 22 nt, Human
ggggcugauggaacucaggccu

SEQ ID NO: 530579 - RNA, 22 nt, Human
ugaugauguuuaucuugguauu

SEQ ID NO: 530580 - RNA, 22 nt, Human
gaaauacagaaagggcugaaug

SEQ ID NO: 530581 - RNA, 22 nt, Human
cugcuuccauaaauaaugugcu

SEQ ID NO: 530582 - RNA, 22 nt, Human
ugugcugguacaugugaggaug

SEQ ID NO: 530583 - RNA, 19 nt, Human
agggcuaggcacauagggc

SEQ ID NO: 530584 - RNA, 22 nt, Human
ggcagagguagcuggaaccagg

SEQ ID NO: 530585 - RNA, 22 nt, Human
cugugugcugaaaugcagugag

SEQ ID NO: 530586 - RNA, 22 nt, Human
uagauacaugaaauggcagaua

SEQ ID NO: 530587 - RNA, 22 nt, Human
auuuccacauaagggaaauaag

SEQ ID NO: 530588 - RNA, 22 nt, Human
uuacaacauauuuagcuugauu

SEQ ID NO: 530589 - RNA, 22 nt, Human
augugcauuaaaugucaauguu

SEQ ID NO: 530590 - RNA, 17 nt, Human
gcucugccccagccucu

SEQ ID NO: 530591 - RNA, 22 nt, Human
cuuguauuccccuaucucuaaa

SEQ ID NO: 530592 - RNA, 22 nt, Human
ccagcucugccaagcgucagcu

SEQ ID NO: 530593 - RNA, 22 nt, Human
uucuucaaacaaaaguggcaug

SEQ ID NO: 530594 - RNA, 22 nt, Human
uccaaacacccuccaugcugca

SEQ ID NO: 530595 - RNA, 20 nt, Human
uucuuucaucuacacguugu

SEQ ID NO: 530596 - RNA, 22 nt, Human
ggggaugguggcauuuguaaaa

SEQ ID NO: 530597 - RNA, 22 nt, Human
aucagaaaguucaucauguuug

SEQ ID NO: 530598 - RNA, 22 nt, Human
uccucccugaguggggacagcu

SEQ ID NO: 530599 - RNA, 22 nt, Human
ucuuuucuucuuaaugguuaau

SEQ ID NO: 530600 - RNA, 22 nt, Human
aaguguauauaugacuuauaaa

SEQ ID NO: 530601 - RNA, 22 nt, Human
auucauuuagguauucacuuac

SEQ ID NO: 530602 - RNA, 22 nt, Human
uuugucuugaggcuggggaagu

SEQ ID NO: 530603 - RNA, 20 nt, Human
ccuaggcaugcugagucucc

SEQ ID NO: 530604 - RNA, 22 nt, Human
agugggcagcccaggaggucuu

SEQ ID NO: 530605 - RNA, 22 nt, Human
cuuccagucuagagcuaucugu

SEQ ID NO: 530606 - RNA, 22 nt, Human
cagggcagugaagaacacacgu

SEQ ID NO: 530607 - RNA, 22 nt, Human
aaugcacauaaauauggucuua

SEQ ID NO: 530608 - RNA, 22 nt, Human
ugcaucuuucugcauauguaaa

SEQ ID NO: 530609 - RNA, 22 nt, Human
uuugcaaaaugaggugaagagu

SEQ ID NO: 530610 - RNA, 22 nt, Human
ggagcuggcuacagagaacucc

SEQ ID NO: 530611 - RNA, 22 nt, Human
gcagcuuuaaucugaauaagua

SEQ ID NO: 530612 - RNA, 20 nt, Human
cugcugugugugccucagcc

SEQ ID NO: 530613 - RNA, 22 nt, Human
gagguggcuccuucagggaaua

SEQ ID NO: 530614 - RNA, 22 nt, Human
uaaggccagccagcaaaucugu

SEQ ID NO: 530615 - RNA, 22 nt, Human
cagaggcauacucccagucuug

SEQ ID NO: 530616 - RNA, 22 nt, Human
ugcagcuagcgugccuagugaa

SEQ ID NO: 530617 - RNA, 22 nt, Human
gccaccagggggugcaaggucc

SEQ ID NO: 530618 - RNA, 22 nt, Human
uaaagucaucuuuacaucuuug

SEQ ID NO: 530619 - RNA, 22 nt, Human
ucaauaauggcaggauaaauuu

SEQ ID NO: 530620 - RNA, 22 nt, Human
cuucuuaacuguauauacuaug

SEQ ID NO: 530621 - RNA, 19 nt, Human
ucaguggagaaaggggaag

SEQ ID NO: 530622 - RNA, 22 nt, Human
gcagcagagcuuuguccuggcu

SEQ ID NO: 530623 - RNA, 22 nt, Human
acacauaugguugcugcaguga

SEQ ID NO: 530624 - RNA, 22 nt, Human
gggcagcaaaucugagucuggu

SEQ ID NO: 530625 - RNA, 22 nt, Human
uucaguuuuauuguacugcuau

SEQ ID NO: 530626 - RNA, 22 nt, Human
cuggcugcgucugcucugacag

SEQ ID NO: 530627 - RNA, 22 nt, Human
acuggcuggccgcgcucuucgc

SEQ ID NO: 530628 - RNA, 22 nt, Human
uuugaauguuggauugacuuag

SEQ ID NO: 530629 - RNA, 22 nt, Human
ccagggcucaggcucccagugg

SEQ ID NO: 530630 - RNA, 22 nt, Human
ucacaauucagaaaccaaguag

SEQ ID NO: 530631 - RNA, 22 nt, Human
cacucucagcauaaugaaugug

SEQ ID NO: 530632 - RNA, 22 nt, Human
cuauuauuauccuaauuucugu

SEQ ID NO: 530633 - RNA, 22 nt, Human
ugaaagcacugauucucaacuc

SEQ ID NO: 530634 - RNA, 22 nt, Human
agcucacagaaauccugcagga

SEQ ID NO: 530635 - RNA, 22 nt, Human
cugucaguucuuccagauagag

SEQ ID NO: 530636 - RNA, 22 nt, Human
uguaugugcuugagaagguggg

SEQ ID NO: 530637 - RNA, 22 nt, Human
agaauucugacaauagaauugg

SEQ ID NO: 530638 - RNA, 22 nt, Human
uuggcuucuugugaaaucugag

SEQ ID NO: 530639 - RNA, 22 nt, Human
ggagaagcaggugcuuuggguc

SEQ ID NO: 530640 - RNA, 22 nt, Human
uacauauuguccauaguugcuu

SEQ ID NO: 530641 - RNA, 22 nt, Human
caggcagaaggaaguaccaggc

SEQ ID NO: 530642 - RNA, 22 nt, Human
cuggggaacaauuugccacacu

SEQ ID NO: 530643 - RNA, 22 nt, Human
agcugagccagcagcaacagga

SEQ ID NO: 530644 - RNA, 22 nt, Human
uuucaacagcucucaaaugauc

SEQ ID NO: 530645 - RNA, 22 nt, Human
gagaaaaucuugggucaagaau

SEQ ID NO: 530646 - RNA, 22 nt, Human
ucucaggaagauuagggcuaag

SEQ ID NO: 530647 - RNA, 22 nt, Human
uguaugaagccagaaucuguuu

SEQ ID NO: 530648 - RNA, 22 nt, Human
agugcaaaaguaauuggaguuu

SEQ ID NO: 530649 - RNA, 22 nt, Human
cugaggcugggcuugccuucuu

SEQ ID NO: 530650 - RNA, 22 nt, Human
ucuuugaaaagauauuccuccu

SEQ ID NO: 530651 - RNA, 22 nt, Human
auuugucuucaguagguucuuc

SEQ ID NO: 530652 - RNA, 22 nt, Human
gcuuuacacagcugguucuugu

SEQ ID NO: 530653 - RNA, 22 nt, Human
auuucuguauccugcugucaga

SEQ ID NO: 530654 - RNA, 22 nt, Human
acugugcaugaaccgaaacaaa

SEQ ID NO: 530655 - RNA, 22 nt, Human
auaaaacuuggguaugaucccu

SEQ ID NO: 530656 - RNA, 22 nt, Human
cagucaggaaugccuccuuccu

SEQ ID NO: 530657 - RNA, 22 nt, Human
auuuuagagaaacaaacguagg

SEQ ID NO: 530658 - RNA, 22 nt, Human
cagcuuucaucagugacacuca

SEQ ID NO: 530659 - RNA, 22 nt, Human
aggagcuguuuuguucagcaaa

SEQ ID NO: 530660 - RNA, 22 nt, Human
uaaauuuacccaaggaacaugu

SEQ ID NO: 530661 - RNA, 22 nt, Human
auaugaagucagacaaacuggg

SEQ ID NO: 530662 - RNA, 22 nt, Human
gguggccucugcaggccucgac

SEQ ID NO: 530663 - RNA, 22 nt, Human
uuauucacucugaagccauccu

SEQ ID NO: 530664 - RNA, 20 nt, Human
caguuaaugacuaggcauca

SEQ ID NO: 530665 - RNA, 22 nt, Human
gaagaauauauaaugauuuugu

SEQ ID NO: 530666 - RNA, 22 nt, Human
uagcuuguacugcaguagagaa

SEQ ID NO: 530667 - RNA, 23 nt, Human
agcugaggcagaggggcauucuc

SEQ ID NO: 530668 - RNA, 22 nt, Human
cuaaacaagggauuauaauuga

SEQ ID NO: 530669 - RNA, 22 nt, Human
ccagaggucuccugcacgggau

SEQ ID NO: 530670 - RNA, 22 nt, Human
aagaaggccugguagacgucuu

SEQ ID NO: 530671 - RNA, 22 nt, Human
uauguacaucguugaauucaaa

SEQ ID NO: 530672 - RNA, 22 nt, Human
uugucccaggacuugcauagau

SEQ ID NO: 530673 - RNA, 22 nt, Human
ccagauggguuacuucaagcaa

SEQ ID NO: 530674 - RNA, 22 nt, Human
ccucagacgcaggccuaugggc

SEQ ID NO: 530675 - RNA, 22 nt, Human
auguaaaguaucugaaaugcug

SEQ ID NO: 530676 - RNA, 22 nt, Human
acaauauaguccaugagcaugc

SEQ ID NO: 530677 - RNA, 22 nt, Human
ugcuccagggccuccagugggg

SEQ ID NO: 530678 - RNA, 22 nt, Human
ucauuucuguugugcaucacug

SEQ ID NO: 530679 - RNA, 22 nt, Human
cucuccucagaacaggcccucu

SEQ ID NO: 530680 - RNA, 22 nt, Human
uccugcagaccucagucagguc

SEQ ID NO: 530681 - RNA, 22 nt, Human
ucaagaguuggucaaauccaaa

SEQ ID NO: 530682 - RNA, 22 nt, Human
aguuacaagcuauuuuacuuaa

SEQ ID NO: 530683 - RNA, 23 nt, Human
ugaauuuuggcauauucugaaau

SEQ ID NO: 530684 - RNA, 22 nt, Human
acaucccacagaaacauacaua

SEQ ID NO: 530685 - RNA, 22 nt, Human
ggaugcugggagacagcaggca

SEQ ID NO: 530686 - RNA, 22 nt, Human
gucagcaggguccccuugagug

SEQ ID NO: 530687 - RNA, 22 nt, Human
cauaucuuaugguuuucuaagu

SEQ ID NO: 530688 - RNA, 23 nt, Human
uguaacagagcacugauugacaa

SEQ ID NO: 530689 - RNA, 22 nt, Human
uggcugagguuaugcugguugu

SEQ ID NO: 530690 - RNA, 22 nt, Human
auaaagcaagcauaccauuaag

SEQ ID NO: 530691 - RNA, 22 nt, Human
auuguacuuuuauuacauguag

SEQ ID NO: 530692 - RNA, 22 nt, Human
aucagaaaaacauaauguuauu

SEQ ID NO: 530693 - RNA, 22 nt, Human
agagccagcauuugacacuggc

SEQ ID NO: 530694 - RNA, 22 nt, Human
aucaaaaccuugacuuuuaaug

SEQ ID NO: 530695 - RNA, 22 nt, Human
aguggggucuccuccagccccc

SEQ ID NO: 530696 - RNA, 22 nt, Human
uacuuugagaugaugcugaucg

SEQ ID NO: 530697 - RNA, 22 nt, Human
agggcugacaguaaaaguauga

SEQ ID NO: 530698 - RNA, 22 nt, Human
gcagauggauguggacggcgcc

SEQ ID NO: 530699 - RNA, 22 nt, Human
uugucuuucccagcuucuagag

SEQ ID NO: 530700 - RNA, 22 nt, Human
ccacagagagugucagccuuug

SEQ ID NO: 530701 - RNA, 22 nt, Human
caaggccaagguuuugugaacu

SEQ ID NO: 530702 - RNA, 22 nt, Human
cugcuguguuggcauuggauag

SEQ ID NO: 530703 - RNA, 22 nt, Human
uuuguaagcaguguuuuuacag

SEQ ID NO: 530704 - RNA, 22 nt, Human
agccaagcugaucuccugcuga

SEQ ID NO: 530705 - RNA, 22 nt, Human
gggaggugauuaggaccaugua

SEQ ID NO: 530706 - RNA, 22 nt, Human
ugcaugcaaaaaaaucugcauu

SEQ ID NO: 530707 - RNA, 22 nt, Human
cuuggaguagagauuuagugaa

SEQ ID NO: 530708 - RNA, 21 nt, Human
ccuggcugcacaguugcuggu

SEQ ID NO: 530709 - RNA, 22 nt, Human
caggacccaaccucccugcucu

SEQ ID NO: 530710 - RNA, 23 nt, Human
ugucacauuuaguuggcauuguu

SEQ ID NO: 530711 - RNA, 22 nt, Human
uggugggaguccgcugugcugc

SEQ ID NO: 530712 - RNA, 21 nt, Human
uccagaaaagaggucauuagc

SEQ ID NO: 530713 - RNA, 22 nt, Human
ggucccaguccucucccugcua

SEQ ID NO: 530714 - RNA, 22 nt, Human
uccaggagggauugggcugugg

SEQ ID NO: 530715 - RNA, 22 nt, Human
gcagagccaggcuggggcaggu

SEQ ID NO: 530716 - RNA, 22 nt, Human
gcagcuaguccaguuauguggc

SEQ ID NO: 530717 - RNA, 22 nt, Human
agggcagaccacgugcaaggau

SEQ ID NO: 530718 - RNA, 22 nt, Human
ucaaaguaagaauuuauuacaa

SEQ ID NO: 530719 - RNA, 22 nt, Human
acauugaagcugugaaaucaaa

SEQ ID NO: 530720 - RNA, 22 nt, Human
gccaggcagacaggucaucagg

SEQ ID NO: 530721 - RNA, 22 nt, Human
uucaagucugcccagagucagc

SEQ ID NO: 530722 - RNA, 22 nt, Human
cucuccagccacagaagcugcu

SEQ ID NO: 530723 - RNA, 22 nt, Human
cagugcagccaaggacaggcac

SEQ ID NO: 530724 - RNA, 22 nt, Human
cagaguacugggagaacagaag

SEQ ID NO: 530725 - RNA, 22 nt, Human
acagaauucuaguauguggcuu

SEQ ID NO: 530726 - RNA, 22 nt, Human
agccacagagagggagcugcaa

SEQ ID NO: 530727 - RNA, 23 nt, Human
ucugcuggugacacggucacauu

SEQ ID NO: 530728 - RNA, 22 nt, Human
auguuauuaaaguacagauucu

SEQ ID NO: 530729 - RNA, 22 nt, Human
caggccuugaguuuugggcuuu

SEQ ID NO: 530730 - RNA, 23 nt, Human
ucugucaccuauggcugcucuuc

SEQ ID NO: 530731 - RNA, 22 nt, Human
aaagacagagcuguaggggaaa

SEQ ID NO: 530732 - RNA, 22 nt, Human
ucaggccuuucuucagagcuuc

SEQ ID NO: 530733 - RNA, 22 nt, Human
agcagggggaguuagacuagau

SEQ ID NO: 530734 - RNA, 23 nt, Human
cugucuccugggcuagguggaau

SEQ ID NO: 530735 - RNA, 21 nt, Human
ucauggccagcaaguggcaga

SEQ ID NO: 530736 - RNA, 22 nt, Human
aaagucugaaagauaagaguga

SEQ ID NO: 530737 - RNA, 22 nt, Human
ugagcaggcgcagcaggagguc

SEQ ID NO: 530738 - RNA, 22 nt, Human
aaaauuuugcccuauccuucau

SEQ ID NO: 530739 - RNA, 22 nt, Human
ccuugcucaagcuagugacggg

SEQ ID NO: 530740 - RNA, 21 nt, Human
ggccucagccaccuggcucug

SEQ ID NO: 530741 - RNA, 22 nt, Human
guaauagguuuucuugcuccag

SEQ ID NO: 530742 - RNA, 22 nt, Human
caggggcaggugugagaucauc

SEQ ID NO: 530743 - RNA, 22 nt, Human
uugggugcugucauggggcacg

SEQ ID NO: 530744 - RNA, 22 nt, Human
uccaagaucuacagcaguuuag

SEQ ID NO: 530745 - RNA, 22 nt, Human
uagucuuaaguaauucauggaa

SEQ ID NO: 530746 - RNA, 22 nt, Human
ucaguguucuuauuuaauuagg

SEQ ID NO: 530747 - RNA, 22 nt, Human
ugucucaggggcauugaaauaa

SEQ ID NO: 530748 - RNA, 22 nt, Human
aagauggaguaguguaaugguu

SEQ ID NO: 530749 - RNA, 22 nt, Human
cucaggcccacagcagacccac

SEQ ID NO: 530750 - RNA, 22 nt, Human
uucagaaugagaauggaugggu

SEQ ID NO: 530751 - RNA, 22 nt, Human
ucauguuauugacucauaauau

SEQ ID NO: 530752 - RNA, 22 nt, Human
guauuuuucaguuaggagcuua

SEQ ID NO: 530753 - RNA, 22 nt, Human
auuggaaauacaguagaaaaau

SEQ ID NO: 530754 - RNA, 22 nt, Human
gccugggagaaugaccuccaac

SEQ ID NO: 530755 - RNA, 22 nt, Human
cugggcugucccagggcggcag

SEQ ID NO: 530756 - RNA, 22 nt, Human
gaaggccacaagagaaguuaag

SEQ ID NO: 530757 - RNA, 22 nt, Human
ggaaagaggauaguggguaggu

SEQ ID NO: 530758 - RNA, 17 nt, Human
aggcaggagauuggaga

SEQ ID NO: 530759 - RNA, 22 nt, Human
caggcugggcagccuccccggc

SEQ ID NO: 530760 - RNA, 22 nt, Human
gaugccuccaaaugagggcaga

SEQ ID NO: 530761 - RNA, 22 nt, Human
ugggcagaguugugaugaacug

SEQ ID NO: 530762 - RNA, 22 nt, Human
agacaaaugaacaaauauguga

SEQ ID NO: 530763 - RNA, 22 nt, Human
agggccacaguggggccugaga

SEQ ID NO: 530764 - RNA, 22 nt, Human
aaucacagaaggcagucuucua

SEQ ID NO: 530765 - RNA, 18 nt, Human
ucacagugcucuugccua

SEQ ID NO: 530766 - RNA, 22 nt, Human
gagcuggcagugguagacaugg

SEQ ID NO: 530767 - RNA, 22 nt, Human
agauggaguuaguaccagaguc

SEQ ID NO: 530768 - RNA, 22 nt, Human
uuucuaaggccagagacugcug

SEQ ID NO: 530769 - RNA, 22 nt, Human
gggaaggagccugcuugcuaga

SEQ ID NO: 530770 - RNA, 22 nt, Human
cucagagauauagucccugcuu

SEQ ID NO: 530771 - RNA, 22 nt, Human
ggcucuggcggcucuuucaaua

SEQ ID NO: 530772 - RNA, 22 nt, Human
gauuuauuuuuaaucagcaggg

SEQ ID NO: 530773 - RNA, 22 nt, Human
ugggaagggaguuucuuggagu

SEQ ID NO: 530774 - RNA, 22 nt, Human
aaaucugggucaagguggagug

SEQ ID NO: 530775 - RNA, 22 nt, Human
uauuuaucaagguaggagaaua

SEQ ID NO: 530776 - RNA, 22 nt, Human
ggcagcagggucuagauugaug

SEQ ID NO: 530777 - RNA, 22 nt, Human
ucuuuccuguaacugcuguuca

SEQ ID NO: 530778 - RNA, 22 nt, Human
gaggaaaauggaguguaauuaa

SEQ ID NO: 530779 - RNA, 22 nt, Human
uauaaaugcacuuuugaaauau

SEQ ID NO: 530780 - RNA, 22 nt, Human
uguuuuugucuccuugucugcu

SEQ ID NO: 530781 - RNA, 22 nt, Human
caagcucugggauagcagagag

SEQ ID NO: 530782 - RNA, 22 nt, Human
ccugccugcuuucugcuuugca

SEQ ID NO: 530783 - RNA, 21 nt, Human
gucagcagauccagcacuugu

SEQ ID NO: 530784 - RNA, 22 nt, Human
caguggagaggcaugcuuggca

SEQ ID NO: 530785 - RNA, 22 nt, Human
uuuuauugucaaugaagacaga

SEQ ID NO: 530786 - RNA, 22 nt, Human
ucuccaagaaaagaucucagcu

SEQ ID NO: 530787 - RNA, 22 nt, Human
agagccugaggccaggaaaaug

SEQ ID NO: 530788 - RNA, 22 nt, Human
uuugaauauacuucaaacaaag

SEQ ID NO: 530789 - RNA, 22 nt, Human
ucagaauuggacaauagaagca

SEQ ID NO: 530790 - RNA, 20 nt, Human
agcuggagaagggcccuucc

SEQ ID NO: 530791 - RNA, 22 nt, Human
cccucugccugcgcccuggugu

SEQ ID NO: 530792 - RNA, 22 nt, Human
agggccagcuagagcccucgcc

SEQ ID NO: 530793 - RNA, 22 nt, Human
acuuuucaaaugggaaacucag

SEQ ID NO: 530794 - RNA, 21 nt, Human
aagaggucaaauuauaaaugg

SEQ ID NO: 530795 - RNA, 19 nt, Human
cucuggccucuggaugcug

SEQ ID NO: 530796 - RNA, 22 nt, Human
caguuacagcugcaccagagcc

SEQ ID NO: 530797 - RNA, 22 nt, Human
uaaagcaaugaaaguuuugcag

SEQ ID NO: 530798 - RNA, 22 nt, Human
agcagguguauauaaggcugag

SEQ ID NO: 530799 - RNA, 18 nt, Human
uccugccugugccccagg

SEQ ID NO: 530800 - RNA, 19 nt, Human
cagauguuuucaguucauu

SEQ ID NO: 530801 - RNA, 18 nt, Human
gcuuccugaaagcugccc

SEQ ID NO: 530802 - RNA, 22 nt, Human
augucaccuucgguggcacggu

SEQ ID NO: 530803 - RNA, 19 nt, Human
uuugaauauaaugcagcua

SEQ ID NO: 530804 - RNA, 23 nt, Human
acauacauggagauaaagugaug

SEQ ID NO: 530805 - RNA, 22 nt, Human
uugguucaauacuaacuugaac

SEQ ID NO: 530806 - RNA, 22 nt, Human
aagcaguguucccagcuggccc

SEQ ID NO: 530807 - RNA, 22 nt, Human
gaggagggagaauuaggcuuaa

SEQ ID NO: 530808 - RNA, 22 nt, Human
ucucucagaggccaggguccug

SEQ ID NO: 530809 - RNA, 20 nt, Human
ggggcugcaugcagagaaga

SEQ ID NO: 530810 - RNA, 22 nt, Human
acagguggaggcuuuaggaggu

SEQ ID NO: 530811 - RNA, 22 nt, Human
agccaaggacacggagccuccu

SEQ ID NO: 530812 - RNA, 22 nt, Human
acagaaggacuugagaaagaca

SEQ ID NO: 530813 - RNA, 22 nt, Human
cagaggcuaagaugagugggug

SEQ ID NO: 530814 - RNA, 22 nt, Human
uucuaucauacuugaauacauu

SEQ ID NO: 530815 - RNA, 22 nt, Human
aaguuuauguucuuugaaggca

SEQ ID NO: 530816 - RNA, 22 nt, Human
gugcagagaaaugagaagucga

SEQ ID NO: 530817 - RNA, 22 nt, Human
gcaggugaugugaugugagcau

SEQ ID NO: 530818 - RNA, 22 nt, Human
ugggcucaggaccccagaggcc

SEQ ID NO: 530819 - RNA, 22 nt, Human
caaugugucaggaaaagggcca

SEQ ID NO: 530820 - RNA, 18 nt, Human
cauuguacaaugcuuuau

SEQ ID NO: 530821 - RNA, 22 nt, Human
aguggaguugaguugauggauu

SEQ ID NO: 530822 - RNA, 22 nt, Human
ucacaguaaaagcauggaagag

SEQ ID NO: 530823 - RNA, 22 nt, Human
ucuguugcaaugugcaugguga

SEQ ID NO: 530824 - RNA, 19 nt, Human
uaucuuuaugcaguggugg

SEQ ID NO: 530825 - RNA, 22 nt, Human
ucuugauucauguucccugcau

SEQ ID NO: 530826 - RNA, 22 nt, Human
ugucaccaguuccaggaaauaa

SEQ ID NO: 530827 - RNA, 22 nt, Human
uggugccuugggccuacagcgc

SEQ ID NO: 530828 - RNA, 22 nt, Human
ugauuacagucugacagauguu

SEQ ID NO: 530829 - RNA, 22 nt, Human
uuucagugaaagcuacuguuag

SEQ ID NO: 530830 - RNA, 22 nt, Human
gcugccuguguggccacucacu

SEQ ID NO: 530831 - RNA, 22 nt, Human
agcagccagaaagggcagucga

SEQ ID NO: 530832 - RNA, 22 nt, Human
cugggcacacagugacucugca

SEQ ID NO: 530833 - RNA, 22 nt, Human
augcucugggcaggagcccugg

SEQ ID NO: 530834 - RNA, 18 nt, Human
agcuggcccuggcugccg

SEQ ID NO: 530835 - RNA, 22 nt, Human
cccuuuaaggaaaggaaggaug

SEQ ID NO: 530836 - RNA, 22 nt, Human
ugaaaaggagccuuagguaggu

SEQ ID NO: 530837 - RNA, 22 nt, Human
gcucccagauuucagccuugug

SEQ ID NO: 530838 - RNA, 21 nt, Human
uauacagaggggaacaggaga

SEQ ID NO: 530839 - RNA, 19 nt, Human
aucuuacagagcagaguac

SEQ ID NO: 530840 - RNA, 22 nt, Human
cccagcccagcguucgaggggu

SEQ ID NO: 530841 - RNA, 22 nt, Human
uuacuaagagaaguaaauauuu

SEQ ID NO: 530842 - RNA, 21 nt, Human
gcagcagaggcuugacagaca

SEQ ID NO: 530843 - RNA, 22 nt, Human
auacaaguugugauaauguaaa

SEQ ID NO: 530844 - RNA, 22 nt, Human
ucugggagagcacguggcugac

SEQ ID NO: 530845 - RNA, 22 nt, Human
ccugggacuuggucugggguuu

SEQ ID NO: 530846 - RNA, 19 nt, Human
aggagaagacucucucccc

SEQ ID NO: 530847 - RNA, 17 nt, Human
gagauuuucguccugaa

SEQ ID NO: 530848 - RNA, 22 nt, Human
gaggcucagagugguuaaauaa

SEQ ID NO: 530849 - RNA, 22 nt, Human
aguuucauuucuuaguaccagu

SEQ ID NO: 530850 - RNA, 20 nt, Human
gaaaugugaccucuucugug

SEQ ID NO: 530851 - RNA, 22 nt, Human
aucaguuugauaauaaggcuug

SEQ ID NO: 530852 - RNA, 22 nt, Human
ucuuuagaguuaacaauaauga

SEQ ID NO: 530853 - RNA, 22 nt, Human
aggcugagcuggcccuugaaau

SEQ ID NO: 530854 - RNA, 22 nt, Human
ggcucccacccauagggcgagu

SEQ ID NO: 530855 - RNA, 22 nt, Human
ggcacugacacuagcauggcac

SEQ ID NO: 530856 - RNA, 17 nt, Human
uucagcuacucaacaca

SEQ ID NO: 530857 - RNA, 19 nt, Human
uggccagguacugucugcu

SEQ ID NO: 530858 - RNA, 22 nt, Human
cagaaauggaaguucugguuua

SEQ ID NO: 530859 - RNA, 22 nt, Human
uggccuggugucugcgaggccu

SEQ ID NO: 530860 - RNA, 22 nt, Human
aguacagaccugucucuuccug

SEQ ID NO: 530861 - RNA, 22 nt, Human
gcauuucugugcauacacauga

SEQ ID NO: 530862 - RNA, 22 nt, Human
cucuuuuucagccuuaccaaag

SEQ ID NO: 530863 - RNA, 22 nt, Human
cagagcuguuacuauucaugaa

SEQ ID NO: 530864 - RNA, 22 nt, Human
ucaaagcagcacauucgcaagc

SEQ ID NO: 530865 - RNA, 20 nt, Human
ugaaaaggucaggagacaug

SEQ ID NO: 530866 - RNA, 22 nt, Human
ucuuuacaagucacauuuucug

SEQ ID NO: 530867 - RNA, 22 nt, Human
agguaagaauagaggauugggg

SEQ ID NO: 530868 - RNA, 22 nt, Human
uucagaaaugaauauugguauu

SEQ ID NO: 530869 - RNA, 22 nt, Human
uuucacagcgucuuucucuugc

SEQ ID NO: 530870 - RNA, 22 nt, Human
agacauggauuucuuacauaaa

SEQ ID NO: 530871 - RNA, 21 nt, Human
cagaggccucaugcucugugc

SEQ ID NO: 530872 - RNA, 22 nt, Human
gaggcuggaggucaaagaugaa

SEQ ID NO: 530873 - RNA, 22 nt, Human
agcuguguagggaaucagagaa

SEQ ID NO: 530874 - RNA, 22 nt, Human
uggcccugaggacccagugugg

SEQ ID NO: 530875 - RNA, 22 nt, Human
ccaggcucugcgcuggacaugg

SEQ ID NO: 530876 - RNA, 22 nt, Human
gcucucugaggugcuggcagag

SEQ ID NO: 530877 - RNA, 22 nt, Human
gcuggccagggcugcucgcgga

SEQ ID NO: 530878 - RNA, 22 nt, Human
ccugccuggcugucagcagagc

SEQ ID NO: 530879 - RNA, 22 nt, Human
ugccaggccaaugaaggcaggg

SEQ ID NO: 530880 - RNA, 23 nt, Human
ucagagagcuguugagagcugcc

SEQ ID NO: 530881 - RNA, 22 nt, Human
agaagcagacucugaggcaagg

SEQ ID NO: 530882 - RNA, 22 nt, Human
ugcaggagacauaauagggacu

SEQ ID NO: 530883 - RNA, 22 nt, Human
ucaaucuagagauuaaaauagg

SEQ ID NO: 530884 - RNA, 22 nt, Human
cuuguguggucuggucuugcua

SEQ ID NO: 530885 - RNA, 22 nt, Human
gggcugagggccaauuccuacu

SEQ ID NO: 530886 - RNA, 22 nt, Human
gugcucuccuggcugcccugac

SEQ ID NO: 530887 - RNA, 22 nt, Human
auuuguaagcuagagccaugau

SEQ ID NO: 530888 - RNA, 22 nt, Human
ccuggguggcagagguugcagu

SEQ ID NO: 530889 - RNA, 22 nt, Human
acacauuugggcuccuacauaa

SEQ ID NO: 530890 - RNA, 22 nt, Human
cguguggucccggcaaggcaag

SEQ ID NO: 530891 - RNA, 22 nt, Human
cugaguccagggacagaggcgu

SEQ ID NO: 530892 - RNA, 22 nt, Human
ucagggaauaaguagaugagug

SEQ ID NO: 530893 - RNA, 22 nt, Human
gcucccagcaauugaggcagcc

SEQ ID NO: 530894 - RNA, 22 nt, Human
cagcugccacaccucuuucucu

SEQ ID NO: 530895 - RNA, 22 nt, Human
uaaauucuacaacuucaaagau

SEQ ID NO: 530896 - RNA, 22 nt, Human
cuaucuuucgauucuagcuuaa

SEQ ID NO: 530897 - RNA, 22 nt, Human
agaggcaggaagagcugauuuu

SEQ ID NO: 530898 - RNA, 22 nt, Human
cugagaaggaagccuccacucu

SEQ ID NO: 530899 - RNA, 22 nt, Human
acugcagcaaagcccgugucuu

SEQ ID NO: 530900 - RNA, 22 nt, Human
uaggagcuaaaauauuuuauau

SEQ ID NO: 530901 - RNA, 22 nt, Human
agucugucagucauucuaacaa

SEQ ID NO: 530902 - RNA, 22 nt, Human
gaguccagacaccauaccugau

SEQ ID NO: 530903 - RNA, 22 nt, Human
ucuggcucucaacaaauauuua

SEQ ID NO: 530904 - RNA, 20 nt, Human
gguagcagcugcugucaucc

SEQ ID NO: 530905 - RNA, 22 nt, Human
ucacuuauugcucaucucaugc

SEQ ID NO: 530906 - RNA, 22 nt, Human
gccagguggcugagcagcugca

SEQ ID NO: 530907 - RNA, 22 nt, Human
cuucuugcugggggccucagug

SEQ ID NO: 530908 - RNA, 22 nt, Human
gcugggcuggccgccgagaucg

SEQ ID NO: 530909 - RNA, 22 nt, Human
cuguagaacgauccaggcauuu

SEQ ID NO: 530910 - RNA, 22 nt, Human
uaaaaucauucuggugucagua

SEQ ID NO: 530911 - RNA, 22 nt, Human
gcugagguaggagguugcagug

SEQ ID NO: 530912 - RNA, 22 nt, Human
aagggagguaaagcuauuuaaa

SEQ ID NO: 530913 - RNA, 22 nt, Human
uuugagaagcaucugguccacu

SEQ ID NO: 530914 - RNA, 22 nt, Human
cauuugcaagagauaaauguuu

SEQ ID NO: 530915 - RNA, 22 nt, Human
cauggcugcgagaagagugggu

SEQ ID NO: 530916 - RNA, 22 nt, Human
guggcucuaggugagcauggag

SEQ ID NO: 530917 - RNA, 19 nt, Human
ccuuugaaucaggacacuu

SEQ ID NO: 530918 - RNA, 22 nt, Human
ggcucugcgcgguaaagugacu

SEQ ID NO: 530919 - RNA, 22 nt, Human
auuucugugcaguaaaugguga

SEQ ID NO: 530920 - RNA, 22 nt, Human
cuuucacagcugugcuuaugau

SEQ ID NO: 530921 - RNA, 22 nt, Human
acagugaugagccggcugaggc

SEQ ID NO: 530922 - RNA, 23 nt, Human
cuccaaggcccaacugucuaggc

SEQ ID NO: 530923 - RNA, 22 nt, Human
cuggagcaggcuugucccagcu

SEQ ID NO: 530924 - RNA, 22 nt, Human
cuggccugaggucggcuguagg

SEQ ID NO: 530925 - RNA, 22 nt, Human
cccagcaugcacgcugacacuc

SEQ ID NO: 530926 - RNA, 22 nt, Human
aauuauacaauugucaaguucu

SEQ ID NO: 530927 - RNA, 22 nt, Human
ucaguguuuacaugcauccuug

SEQ ID NO: 530928 - RNA, 22 nt, Human
uucuaccuacccucugcauaca

SEQ ID NO: 530929 - RNA, 22 nt, Human
acuuugcagggcuugauaucca

SEQ ID NO: 530930 - RNA, 22 nt, Human
aaagggagcauggcugcaggga

SEQ ID NO: 530931 - RNA, 22 nt, Human
guuuuucuaggaccaugugauu

SEQ ID NO: 530932 - RNA, 22 nt, Human
gguggaaggccuggaaggaggc

SEQ ID NO: 530933 - RNA, 17 nt, Human
guccuacccauggucua

SEQ ID NO: 530934 - RNA, 22 nt, Human
ggaggccaaggaggagcuugcc

SEQ ID NO: 530935 - RNA, 22 nt, Human
acauuucugucuuagggacugu

SEQ ID NO: 530936 - RNA, 22 nt, Human
ggagcugagguaacagugagug

SEQ ID NO: 530937 - RNA, 22 nt, Human
uauguguaggaggaggacaggg

SEQ ID NO: 530938 - RNA, 22 nt, Human
cagagccugccucuggcugugg

SEQ ID NO: 530939 - RNA, 19 nt, Human
aagggcugggcaccucacu

SEQ ID NO: 530940 - RNA, 22 nt, Human
ugacuuccugcacucaggugau

SEQ ID NO: 530941 - RNA, 20 nt, Human
caaagacaugcuaggggugg

SEQ ID NO: 530942 - RNA, 23 nt, Human
ucugcagacgcuguucuauuguc

SEQ ID NO: 530943 - RNA, 22 nt, Human
ucauuucuuaacuagagugaac

SEQ ID NO: 530944 - RNA, 22 nt, Human
ccugccucaggacucugcauau

SEQ ID NO: 530945 - RNA, 22 nt, Human
gcagaagcugggcagcgaggug

SEQ ID NO: 530946 - RNA, 22 nt, Human
acagcacaaucugagucccaga

SEQ ID NO: 530947 - RNA, 22 nt, Human
aauuugauucagcaaauguuca

SEQ ID NO: 530948 - RNA, 22 nt, Human
cauugcacagcccuguggugau

SEQ ID NO: 530949 - RNA, 21 nt, Human
uaauacugaaagugacaucug

SEQ ID NO: 530950 - RNA, 22 nt, Human
ggcaggcagaggcugagacagg

SEQ ID NO: 530951 - RNA, 22 nt, Human
augggcugaaagaguaagcugu

SEQ ID NO: 530952 - RNA, 22 nt, Human
ccagagccugcugagccccauu

SEQ ID NO: 530953 - RNA, 22 nt, Human
ucuucauguugcuguagggaga

SEQ ID NO: 530954 - RNA, 19 nt, Human
ugucuuaauuaacucagag

SEQ ID NO: 530955 - RNA, 22 nt, Human
uauauuaaacccucucuguagg

SEQ ID NO: 530956 - RNA, 22 nt, Human
aaagcaugcuacuuuauauagg

SEQ ID NO: 530957 - RNA, 17 nt, Human
agcagcuggguugaucu

SEQ ID NO: 530958 - RNA, 22 nt, Human
ccuucccuaaagcgucgcuuag

SEQ ID NO: 530959 - RNA, 22 nt, Human
uccagaaacugcugagauaaga

SEQ ID NO: 530960 - RNA, 22 nt, Human
gcucugcccagugcccugagac

SEQ ID NO: 530961 - RNA, 18 nt, Human
gcagcuagccaggggggc

SEQ ID NO: 530962 - RNA, 19 nt, Human
agccaggguccagacaugu

SEQ ID NO: 530963 - RNA, 22 nt, Human
auggauaauggugauaguugca

SEQ ID NO: 530964 - RNA, 19 nt, Human
uuccaguucuaaucucuuc

SEQ ID NO: 530965 - RNA, 22 nt, Human
cagcaggaggcauggcuucccu

SEQ ID NO: 530966 - RNA, 22 nt, Human
ucauugcagacuaacaaucuca

SEQ ID NO: 530967 - RNA, 22 nt, Human
gaagccagccuugucugccucu

SEQ ID NO: 530968 - RNA, 22 nt, Human
cacaauuuuccuuuaaguguau

SEQ ID NO: 530969 - RNA, 18 nt, Human
agggcucucugcuggguu

SEQ ID NO: 530970 - RNA, 22 nt, Human
aaauacuagaauucagaguuga

SEQ ID NO: 530971 - RNA, 22 nt, Human
gggagggaucugcuaggcaaug

SEQ ID NO: 530972 - RNA, 22 nt, Human
cuccugggagcuguggcagagc

SEQ ID NO: 530973 - RNA, 22 nt, Human
gcagcugccccgacugugaguc

SEQ ID NO: 530974 - RNA, 19 nt, Human
aucccaucugguuuuuccc

SEQ ID NO: 530975 - RNA, 22 nt, Human
ccaaaguuuuuauaguuagcau

SEQ ID NO: 530976 - RNA, 18 nt, Human
cacaauuuacagaugaca

SEQ ID NO: 530977 - RNA, 22 nt, Human
cagagcagggugcaccuugggc

SEQ ID NO: 530978 - RNA, 22 nt, Human
uaacagaauagcagaaacagaa

SEQ ID NO: 530979 - RNA, 22 nt, Human
aggcacugaauauccaguaaaa

SEQ ID NO: 530980 - RNA, 22 nt, Human
uaccauuugagagagaacauaa

SEQ ID NO: 530981 - RNA, 22 nt, Human
ggcuguccaccuaccaugccgg

SEQ ID NO: 530982 - RNA, 22 nt, Human
uccugccugcaaucccagcacu

SEQ ID NO: 530983 - RNA, 22 nt, Human
auucuggauauuacuuaucuau

SEQ ID NO: 530984 - RNA, 20 nt, Human
acaggagaucugaggaaagg

SEQ ID NO: 530985 - RNA, 22 nt, Human
cugagagucagcuucuccuccu

SEQ ID NO: 530986 - RNA, 22 nt, Human
agacucaagcagauaggaauua

SEQ ID NO: 530987 - RNA, 22 nt, Human
ggagccuguuaguugagugcuc

SEQ ID NO: 530988 - RNA, 22 nt, Human
uucacuuaacaucauaucauga

SEQ ID NO: 530989 - RNA, 22 nt, Human
cuaugaaaggauuuggaguugu

SEQ ID NO: 530990 - RNA, 22 nt, Human
gucaaguuaagauaaggucaug

SEQ ID NO: 530991 - RNA, 22 nt, Human
ugaugggaaaaugaggccuggg

SEQ ID NO: 530992 - RNA, 22 nt, Human
aguguaucaugguuggcagaca

SEQ ID NO: 530993 - RNA, 22 nt, Human
gcugucacucaccaggccugca

SEQ ID NO: 530994 - RNA, 19 nt, Human
ucugccugcuuguaggggc

SEQ ID NO: 530995 - RNA, 22 nt, Human
gucaaauaauuuucucaauagu

SEQ ID NO: 530996 - RNA, 22 nt, Human
cagcagguauguuuguucagca

SEQ ID NO: 530997 - RNA, 22 nt, Human
caggaccccauauucacugaac

SEQ ID NO: 530998 - RNA, 22 nt, Human
ucacauaaauuauacaauuuca

SEQ ID NO: 530999 - RNA, 22 nt, Human
gccccucucccuugaggcaggc

SEQ ID NO: 531000 - RNA, 22 nt, Human
gcaggguggauggcagggccag

SEQ ID NO: 531001 - RNA, 22 nt, Human
uugcauccgggcuacuuccaca

SEQ ID NO: 531002 - RNA, 22 nt, Human
uuucagaggaaaucucauugag

SEQ ID NO: 531003 - RNA, 22 nt, Human
gaagcagcuagcccacuaguca

SEQ ID NO: 531004 - RNA, 20 nt, Human
accucugcaucaauccuuug

SEQ ID NO: 531005 - RNA, 22 nt, Human
guaagggauuugaacauagguu

SEQ ID NO: 531006 - RNA, 22 nt, Human
ggcuuuauuucacuguaccaua

SEQ ID NO: 531007 - RNA, 22 nt, Human
gaaauguaggcauaauuauuuu

SEQ ID NO: 531008 - RNA, 22 nt, Human
uggcugcagaucaagggcaggc

SEQ ID NO: 531009 - RNA, 22 nt, Human
gaaauguguuguucauuucuaa

SEQ ID NO: 531010 - RNA, 22 nt, Human
guacaaguguauuuggcuugau

SEQ ID NO: 531011 - RNA, 22 nt, Human
aacagaaaucauuuagggcucu

SEQ ID NO: 531012 - RNA, 22 nt, Human
cguguacagucuaucuuuuuuc

SEQ ID NO: 531013 - RNA, 22 nt, Human
ugaguccauguggaggggaggu

SEQ ID NO: 531014 - RNA, 22 nt, Human
ggccugggcccacugucaagag

SEQ ID NO: 531015 - RNA, 22 nt, Human
aagaaggccucugcccuggcuu

SEQ ID NO: 531016 - RNA, 22 nt, Human
agcaggaaagaaaaaucugugu

SEQ ID NO: 531017 - RNA, 22 nt, Human
ggcucaguguuuguggaacaua

SEQ ID NO: 531018 - RNA, 22 nt, Human
uaaugcaguagguauuaaagaa

SEQ ID NO: 531019 - RNA, 20 nt, Human
ugcaggugggcccuucuggg

SEQ ID NO: 531020 - RNA, 22 nt, Human
auuauguauuugguauaguuug

SEQ ID NO: 531021 - RNA, 22 nt, Human
caacagagagaccagaaacagg

SEQ ID NO: 531022 - RNA, 22 nt, Human
ucaaagagcuauucaguugugg

SEQ ID NO: 531023 - RNA, 22 nt, Human
acagagucauucacugaugaag

SEQ ID NO: 531024 - RNA, 22 nt, Human
cuacaaagaauuucucuagcuc

SEQ ID NO: 531025 - RNA, 19 nt, Human
ugaaauggcaguugcuaaa

SEQ ID NO: 531026 - RNA, 22 nt, Human
agucccagacuccaguuuucug

SEQ ID NO: 531027 - RNA, 22 nt, Human
aagaaaagauguuugguuuuca

SEQ ID NO: 531028 - RNA, 22 nt, Human
uacccagggcuuuucugaugca

SEQ ID NO: 531029 - RNA, 22 nt, Human
agcagggccuggcacuccuggg

SEQ ID NO: 531030 - RNA, 22 nt, Human
cagcugcaggaacaaaaaugug

SEQ ID NO: 531031 - RNA, 22 nt, Human
aagcagccuggcaugaugcuuu

SEQ ID NO: 531032 - RNA, 22 nt, Human
ggcaggcuccguguuccauucc

SEQ ID NO: 531033 - RNA, 22 nt, Human
uggcccugccgccacgacgucu

SEQ ID NO: 531034 - RNA, 22 nt, Human
aggucauuccuugucuucuugc

SEQ ID NO: 531035 - RNA, 22 nt, Human
uuuuuccuagugcuuucuggua

SEQ ID NO: 531036 - RNA, 22 nt, Human
uugggaguuccuacugcgguuu

SEQ ID NO: 531037 - RNA, 22 nt, Human
aaacacugguaugauguauagu

SEQ ID NO: 531038 - RNA, 22 nt, Human
uuccaguuaaggaagcuauucu

SEQ ID NO: 531039 - RNA, 22 nt, Human
aagauacacggucaacucucaa

SEQ ID NO: 531040 - RNA, 22 nt, Human
aauguaaaguugggcacaaaug

SEQ ID NO: 531041 - RNA, 22 nt, Human
acaugaaaccugagucuaacuc

SEQ ID NO: 531042 - RNA, 22 nt, Human
ccaaaaauuagauacacauaua

SEQ ID NO: 531043 - RNA, 22 nt, Human
cggucaggugcagcguuggcac

SEQ ID NO: 531044 - RNA, 22 nt, Human
uggccugggcaugaagcaucgu

SEQ ID NO: 531045 - RNA, 22 nt, Human
acuaaacauucuugucucucaa

SEQ ID NO: 531046 - RNA, 22 nt, Human
uuucuaagaaaguaaugguuau

SEQ ID NO: 531047 - RNA, 22 nt, Human
acagcagcgucaacuuaaaauu

SEQ ID NO: 531048 - RNA, 22 nt, Human
acguggagagaauagggcacca

SEQ ID NO: 531049 - RNA, 22 nt, Human
agaaaucugacugcugugcaca

SEQ ID NO: 531050 - RNA, 19 nt, Human
ugccuguggcgagcaucuu

SEQ ID NO: 531051 - RNA, 20 nt, Human
cccucccagaugcuucccaa

SEQ ID NO: 531052 - RNA, 22 nt, Human
ugccuuaauuucccuguuuugu

SEQ ID NO: 531053 - RNA, 20 nt, Human
uugcaacuguaagaagcagg

SEQ ID NO: 531054 - RNA, 17 nt, Human
gccaaaggguuccaauc

SEQ ID NO: 531055 - RNA, 22 nt, Human
gaggcaguuccugagugacaag

SEQ ID NO: 531056 - RNA, 22 nt, Human
augcugaagagugcacaggcua

SEQ ID NO: 531057 - RNA, 22 nt, Human
aggcagggcucauuucuuaggc

SEQ ID NO: 531058 - RNA, 22 nt, Human
uuguccuaauuuauggccugga

SEQ ID NO: 531059 - RNA, 22 nt, Human
cuggguggcuguccagccagcc

SEQ ID NO: 531060 - RNA, 22 nt, Human
aauuucuucagcucuaaaaugg

SEQ ID NO: 531061 - RNA, 22 nt, Human
guaaaugugcuucuuuuaacuu

SEQ ID NO: 531062 - RNA, 18 nt, Human
ucugggcaaucucaguau

SEQ ID NO: 531063 - RNA, 22 nt, Human
aucagcaagcaugguuaggugu

SEQ ID NO: 531064 - RNA, 22 nt, Human
agcccaugguguacucuguggc

SEQ ID NO: 531065 - RNA, 22 nt, Human
agcagccagagaaugaugcagu

SEQ ID NO: 531066 - RNA, 22 nt, Human
uaguauaucuuuaguacauagu

SEQ ID NO: 531067 - RNA, 22 nt, Human
agaggcggagguugcagugagc

SEQ ID NO: 531068 - RNA, 22 nt, Human
ucagagaguuacacaaauuguu

SEQ ID NO: 531069 - RNA, 22 nt, Human
uuucauagccuucuaaugaguu

SEQ ID NO: 531070 - RNA, 22 nt, Human
aacgucauugauugaugguagu

SEQ ID NO: 531071 - RNA, 22 nt, Human
aauguuaaaaccuucagugcuu

SEQ ID NO: 531072 - RNA, 16 nt, Human
uggcagagguucagcc

SEQ ID NO: 531073 - RNA, 22 nt, Human
uuugcauuaucucacuuauaua

SEQ ID NO: 531074 - RNA, 22 nt, Human
aucuggagaucagcugguggca

SEQ ID NO: 531075 - RNA, 20 nt, Human
ugcuggggacauacagggug

SEQ ID NO: 531076 - RNA, 22 nt, Human
gcagggucgcucuaggagauca

SEQ ID NO: 531077 - RNA, 22 nt, Human
ucauugcaguagggagagaccc

SEQ ID NO: 531078 - RNA, 22 nt, Human
gccuccugacuuacacugagcu

SEQ ID NO: 531079 - RNA, 22 nt, Human
uguggcaggaagagcuucugag

SEQ ID NO: 531080 - RNA, 22 nt, Human
cacuuguagaggcauuauucca

SEQ ID NO: 531081 - RNA, 21 nt, Human
agcaggcuuuggaguggggcu

SEQ ID NO: 531082 - RNA, 22 nt, Human
uacauucuggaaaggcacagac

SEQ ID NO: 531083 - RNA, 22 nt, Human
uccaaucuaguaugauaaauga

SEQ ID NO: 531084 - RNA, 20 nt, Human
acaguuuauccaguuagcag

SEQ ID NO: 531085 - RNA, 22 nt, Human
acaugcuuuaacuuauuuugau

SEQ ID NO: 531086 - RNA, 22 nt, Human
agguauagaauugaaaggguuu

SEQ ID NO: 531087 - RNA, 21 nt, Human
uuaagagcuuagcaguaggcc

SEQ ID NO: 531088 - RNA, 22 nt, Human
gggcaggugcccagggccagag

SEQ ID NO: 531089 - RNA, 22 nt, Human
aggcuuaaccugaucacaugag

SEQ ID NO: 531090 - RNA, 22 nt, Human
acugccugugcacuggucuuuu

SEQ ID NO: 531091 - RNA, 22 nt, Human
ugcugccaccugguggcugaag

SEQ ID NO: 531092 - RNA, 22 nt, Human
caccagcuuugcccacugccca

SEQ ID NO: 531093 - RNA, 22 nt, Human
ggcucccugccuguccucaguc

SEQ ID NO: 531094 - RNA, 23 nt, Human
acugggcugaaauuuuucauggc

SEQ ID NO: 531095 - RNA, 22 nt, Human
acagagucauaagcggagcucg

SEQ ID NO: 531096 - RNA, 22 nt, Human
caccugccccagucuuggagcu

SEQ ID NO: 531097 - RNA, 22 nt, Human
aucugccuccaaguccaugugu

SEQ ID NO: 531098 - RNA, 22 nt, Human
ggcuucuuccugugaacauguu

SEQ ID NO: 531099 - RNA, 22 nt, Human
acauagcuuaaaugagaagaua

SEQ ID NO: 531100 - RNA, 22 nt, Human
acuccugguucccaguugagau

SEQ ID NO: 531101 - RNA, 19 nt, Human
aaggaauggcuuuaaguag

SEQ ID NO: 531102 - RNA, 22 nt, Human
uuuguacacaggucauucaggg

SEQ ID NO: 531103 - RNA, 22 nt, Human
acagcugugaaaauccacagga

SEQ ID NO: 531104 - RNA, 22 nt, Human
auaacagaauaagucauuaccg

SEQ ID NO: 531105 - RNA, 22 nt, Human
uccaggcaaagugcugggcugc

SEQ ID NO: 531106 - RNA, 22 nt, Human
agacugaaguaagaaugcagcu

SEQ ID NO: 531107 - RNA, 22 nt, Human
ggccagagagccgcuguuagga

SEQ ID NO: 531108 - RNA, 22 nt, Human
agcaucuggucaugagugagaa

SEQ ID NO: 531109 - RNA, 22 nt, Human
acaucagagggcucacaugauc

SEQ ID NO: 531110 - RNA, 22 nt, Human
ugcaguggugguaaagaugcuc

SEQ ID NO: 531111 - RNA, 22 nt, Human
agccuccaaaugucaggucccg

SEQ ID NO: 531112 - RNA, 22 nt, Human
agcuuccuuggcgcugaggccu

SEQ ID NO: 531113 - RNA, 22 nt, Human
augugaggcagcacggagauua

SEQ ID NO: 531114 - RNA, 21 nt, Human
gggccacaccuucugcagacc

SEQ ID NO: 531115 - RNA, 20 nt, Human
uccaggcccacucagcugaa

SEQ ID NO: 531116 - RNA, 22 nt, Human
uccuugagagccacugucuugg

SEQ ID NO: 531117 - RNA, 22 nt, Human
gagacagagaucuugcugaguc

SEQ ID NO: 531118 - RNA, 22 nt, Human
gaaauauacauugcaggaagag

SEQ ID NO: 531119 - RNA, 22 nt, Human
acagaaaaaugagggagcugga

SEQ ID NO: 531120 - RNA, 22 nt, Human
aagauuuuuuuccacagacuca

SEQ ID NO: 531121 - RNA, 22 nt, Human
ugccugcucuuaccacucuccc

SEQ ID NO: 531122 - RNA, 22 nt, Human
uggcccugacagguccugggca

SEQ ID NO: 531123 - RNA, 22 nt, Human
uugcugaggacgcagugcagug

SEQ ID NO: 531124 - RNA, 18 nt, Human
uucuuuaauucaguuuga

SEQ ID NO: 531125 - RNA, 22 nt, Human
ccacugccaugggcuaggcaug

SEQ ID NO: 531126 - RNA, 22 nt, Human
guauuagguuggugcaaaauug

SEQ ID NO: 531127 - RNA, 22 nt, Human
gaagggugugauuugccugaga

SEQ ID NO: 531128 - RNA, 22 nt, Human
agcugccacagagccuggccag

SEQ ID NO: 531129 - RNA, 22 nt, Human
gaaagacuaacuagaaagugca

SEQ ID NO: 531130 - RNA, 22 nt, Human
ucccuggcuguguucaggugcg

SEQ ID NO: 531131 - RNA, 22 nt, Human
ugggaggcagguaggugaugau

SEQ ID NO: 531132 - RNA, 22 nt, Human
aggcugagaaagugggaagaug

SEQ ID NO: 531133 - RNA, 22 nt, Human
acaagaauuuacauguagugga

SEQ ID NO: 531134 - RNA, 21 nt, Human
ucucuggaguuagcagagaga

SEQ ID NO: 531135 - RNA, 22 nt, Human
ccugggcuucugucuagauguu

SEQ ID NO: 531136 - RNA, 22 nt, Human
uuuuauuaucuuugaaugggac

SEQ ID NO: 531137 - RNA, 22 nt, Human
uggaggcaguaacugagcaaca

SEQ ID NO: 531138 - RNA, 22 nt, Human
uuucauugucaucuaucuuaga

SEQ ID NO: 531139 - RNA, 22 nt, Human
aagcugccugccacgcuagaua

SEQ ID NO: 531140 - RNA, 22 nt, Human
guccagugucuucuacauaaca

SEQ ID NO: 531141 - RNA, 22 nt, Human
cugcuuuagugugguguuagag

SEQ ID NO: 531142 - RNA, 23 nt, Human
cuguccuuggucuuggcugagug

SEQ ID NO: 531143 - RNA, 22 nt, Human
aggugcuggcgccccaggagac

SEQ ID NO: 531144 - RNA, 22 nt, Human
cuggaggagaacuugaggaagg

SEQ ID NO: 531145 - RNA, 22 nt, Human
ucagcaaugagaacuggcauuu

SEQ ID NO: 531146 - RNA, 22 nt, Human
ccuggccagcuaauugcccauc

SEQ ID NO: 531147 - RNA, 22 nt, Human
agcucuuugacuaaucuugcuu

SEQ ID NO: 531148 - RNA, 22 nt, Human
gcuugcauucuggaucuauggu

SEQ ID NO: 531149 - RNA, 22 nt, Human
aggaugaauauuuagugggaua

SEQ ID NO: 531150 - RNA, 22 nt, Human
aaguuaauuaaccucuccauca

SEQ ID NO: 531151 - RNA, 23 nt, Human
uauacacauguggcaguauagug

SEQ ID NO: 531152 - RNA, 22 nt, Human
uucaguuggccauaccccuaga

SEQ ID NO: 531153 - RNA, 22 nt, Human
cgcuggccauagccuccugugu

SEQ ID NO: 531154 - RNA, 22 nt, Human
agucagcagugaaagcacagcc

SEQ ID NO: 531155 - RNA, 20 nt, Human
ucucaggccccaguuuucuu

SEQ ID NO: 531156 - RNA, 22 nt, Human
ucagagcuuaucucuugcugga

SEQ ID NO: 531157 - RNA, 18 nt, Human
ccucacagacuuccaugu

SEQ ID NO: 531158 - RNA, 22 nt, Human
aguguacauguuuacagcaucu

SEQ ID NO: 531159 - RNA, 22 nt, Human
cagcauuuggaggagaggcuuu

SEQ ID NO: 531160 - RNA, 22 nt, Human
uccugggcagcgggacgcucag

SEQ ID NO: 531161 - RNA, 23 nt, Human
agguuacaguuguuaaguugcaa

SEQ ID NO: 531162 - RNA, 22 nt, Human
gucccacaccuugaggggucuu

SEQ ID NO: 531163 - RNA, 22 nt, Human
gacagguguguguauauuaggg

SEQ ID NO: 531164 - RNA, 22 nt, Human
agcuggagaucaugcugauacu

SEQ ID NO: 531165 - RNA, 22 nt, Human
uauuuuacagacuacuuuagau

SEQ ID NO: 531166 - RNA, 22 nt, Human
gggcugccugagcaucuccucc

SEQ ID NO: 531167 - RNA, 21 nt, Human
uuauaggcugggguuugcuuu

SEQ ID NO: 531168 - RNA, 22 nt, Human
uaccuugggcuauuaucuuuga

SEQ ID NO: 531169 - RNA, 22 nt, Human
ccaaggagcaaguuuacaccug

SEQ ID NO: 531170 - RNA, 22 nt, Human
aucaggaugacaacugcugggu

SEQ ID NO: 531171 - RNA, 22 nt, Human
uuuaacagaugcuaugucuacc

SEQ ID NO: 531172 - RNA, 22 nt, Human
aaguggagcuauaggcucagau

SEQ ID NO: 531173 - RNA, 22 nt, Human
guucuucaaagugacaacuaaa

SEQ ID NO: 531174 - RNA, 22 nt, Human
ccugcagguaaggcuaacugcc

SEQ ID NO: 531175 - RNA, 22 nt, Human
ugaguccacuuuaaaaugucag

SEQ ID NO: 531176 - RNA, 22 nt, Human
gcugaauagaagucuucaaagg

SEQ ID NO: 531177 - RNA, 19 nt, Human
uuuaaagugacugguauuu

SEQ ID NO: 531178 - RNA, 22 nt, Human
ggaaaggagauauuggagagug

SEQ ID NO: 531179 - RNA, 22 nt, Human
cagaagcaaguagugauucuuu

SEQ ID NO: 531180 - RNA, 22 nt, Human
agagaucaguuaaaaucuuuuu

SEQ ID NO: 531181 - RNA, 22 nt, Human
uccuuugguuguagacaggaau

SEQ ID NO: 531182 - RNA, 22 nt, Human
caaaguauauuucauagucuca

SEQ ID NO: 531183 - RNA, 22 nt, Human
acaggcugacuuccugccaugu

SEQ ID NO: 531184 - RNA, 22 nt, Human
cucuggaaaaccacuagcagga

SEQ ID NO: 531185 - RNA, 22 nt, Human
agucaauuaucucuaggucauc

SEQ ID NO: 531186 - RNA, 22 nt, Human
agugaaauugcuguaagaggaa

SEQ ID NO: 531187 - RNA, 22 nt, Human
uucauacauuuuuacuaacagc

SEQ ID NO: 531188 - RNA, 22 nt, Human
agagugaucagauaucaggugu

SEQ ID NO: 531189 - RNA, 22 nt, Human
acuagcagggauguuauuacuu

SEQ ID NO: 531190 - RNA, 22 nt, Human
gggagagguuacccgagcaacu

SEQ ID NO: 531191 - RNA, 22 nt, Human
gucccagggagguucagggcuu

SEQ ID NO: 531192 - RNA, 22 nt, Human
acagcuggaggccccauugucc

SEQ ID NO: 531193 - RNA, 22 nt, Human
ucucucugccaacucacagcca

SEQ ID NO: 531194 - RNA, 22 nt, Human
aggcccugcuuuccagagcuca

SEQ ID NO: 531195 - RNA, 22 nt, Human
guuacauuuauuagaggucucu

SEQ ID NO: 531196 - RNA, 20 nt, Human
uguuucuuuuaaugagcggc

SEQ ID NO: 531197 - RNA, 22 nt, Human
uggaagaggcccaugacugccu

SEQ ID NO: 531198 - RNA, 22 nt, Human
aggcagcauucaggggugauga

SEQ ID NO: 531199 - RNA, 22 nt, Human
uuguuacagcagugauuucaga

SEQ ID NO: 531200 - RNA, 22 nt, Human
gcugcuucucugauggagucca

SEQ ID NO: 531201 - RNA, 22 nt, Human
aagguacaguuuuaagaauaag

SEQ ID NO: 531202 - RNA, 22 nt, Human
ugagguaggugguaagagauac

SEQ ID NO: 531203 - RNA, 22 nt, Human
ggagagcugguagcuggcucca

SEQ ID NO: 531204 - RNA, 22 nt, Human
cuccagggcagcauggcagugg

SEQ ID NO: 531205 - RNA, 22 nt, Human
uggcucagugacauuccuccca

SEQ ID NO: 531206 - RNA, 20 nt, Human
uguugauuggugucaucuca

SEQ ID NO: 531207 - RNA, 22 nt, Human
gacauacaagcugguaccuccu

SEQ ID NO: 531208 - RNA, 22 nt, Human
cuccagggagcuuggaaagacc

SEQ ID NO: 531209 - RNA, 22 nt, Human
cugcugugugcuuacuuggguu

SEQ ID NO: 531210 - RNA, 22 nt, Human
ucuucauuuuacaggcagaccu

SEQ ID NO: 531211 - RNA, 22 nt, Human
aagucaaaccuugcucacagga

SEQ ID NO: 531212 - RNA, 22 nt, Human
uuguugcauuucaaguaugaga

SEQ ID NO: 531213 - RNA, 22 nt, Human
cuggccuggggccucagcugcu

SEQ ID NO: 531214 - RNA, 22 nt, Human
ugggcugcagggguugagagcu

SEQ ID NO: 531215 - RNA, 18 nt, Human
cccagccucuccuuucua

SEQ ID NO: 531216 - RNA, 22 nt, Human
aggagguggcugaacuugaggg

SEQ ID NO: 531217 - RNA, 22 nt, Human
agauuucagguuggggcagaag

SEQ ID NO: 531218 - RNA, 22 nt, Human
aaucaagaguuguguaauauuu

SEQ ID NO: 531219 - RNA, 20 nt, Human
uuguuuuaaauccuggauga

SEQ ID NO: 531220 - RNA, 23 nt, Human
acagacaacacugaugagagaaa

SEQ ID NO: 531221 - RNA, 22 nt, Human
uuuaucuuuaggacuuugcaga

SEQ ID NO: 531222 - RNA, 22 nt, Human
uuuucagagagcuuuuaugucc

SEQ ID NO: 531223 - RNA, 22 nt, Human
ucaaagucucugcuucuguaac

SEQ ID NO: 531224 - RNA, 22 nt, Human
cagcauuuagaauuugaagugu

SEQ ID NO: 531225 - RNA, 22 nt, Human
gguucuuuguauauaucacuuu

SEQ ID NO: 531226 - RNA, 19 nt, Human
gcuuuucuccuucaagcca

SEQ ID NO: 531227 - RNA, 22 nt, Human
aaacaguuaauugcuuucaguu

SEQ ID NO: 531228 - RNA, 22 nt, Human
ugaugcaauguuuacaucuuga

SEQ ID NO: 531229 - RNA, 22 nt, Human
cuggccagaguuggagggugug

SEQ ID NO: 531230 - RNA, 21 nt, Human
augacagaugcugcagaucgu

SEQ ID NO: 531231 - RNA, 19 nt, Human
ugagugggccccugcagac

SEQ ID NO: 531232 - RNA, 22 nt, Human
uuaauacagaagcaagacacug

SEQ ID NO: 531233 - RNA, 22 nt, Human
gcuuuuaauuaguugcuuccau

SEQ ID NO: 531234 - RNA, 22 nt, Human
ugucaugccaccguuucccaga

SEQ ID NO: 531235 - RNA, 22 nt, Human
uucauuacugcgguagucacac

SEQ ID NO: 531236 - RNA, 18 nt, Human
ucagcuggggcugcagcc

SEQ ID NO: 531237 - RNA, 21 nt, Human
agcagaacagucgagcacugc

SEQ ID NO: 531238 - RNA, 22 nt, Human
agaagccaauucugugugaguc

SEQ ID NO: 531239 - RNA, 22 nt, Human
guuauguacuuuuuaaaucuug

SEQ ID NO: 531240 - RNA, 22 nt, Human
ucuucauguugcuuauucuggg

SEQ ID NO: 531241 - RNA, 22 nt, Human
aggaagccuggaguccugccca

SEQ ID NO: 531242 - RNA, 20 nt, Human
cucaguguggccugaguguu

SEQ ID NO: 531243 - RNA, 23 nt, Human
aaacaaugucaucaggacuuggu

SEQ ID NO: 531244 - RNA, 22 nt, Human
uucagagacagcaaccaggaca

SEQ ID NO: 531245 - RNA, 22 nt, Human
agugcagagaccuggucaggca

SEQ ID NO: 531246 - RNA, 22 nt, Human
cacuggcaaagccuguuccuua

SEQ ID NO: 531247 - RNA, 22 nt, Human
auuucucagugaaaugacaggc

SEQ ID NO: 531248 - RNA, 22 nt, Human
uauuaggguaaauuugacaugc

SEQ ID NO: 531249 - RNA, 22 nt, Human
uuggaaaacuuacacagagcug

SEQ ID NO: 531250 - RNA, 22 nt, Human
cauucugugauucuaaaucccu

SEQ ID NO: 531251 - RNA, 22 nt, Human
uguaagaaaaguaaauagugac

SEQ ID NO: 531252 - RNA, 22 nt, Human
agauuucccaaauacuuguuau

SEQ ID NO: 531253 - RNA, 22 nt, Human
ugccugggggacuaaggccaaa

SEQ ID NO: 531254 - RNA, 22 nt, Human
aguccuucaagaaaucuggaaa

SEQ ID NO: 531255 - RNA, 22 nt, Human
uacagcuugauguuuguguguu

SEQ ID NO: 531256 - RNA, 22 nt, Human
gcuucuggaggagcugggcuga

SEQ ID NO: 531257 - RNA, 22 nt, Human
cuuccucaugugcaaugcaagc

SEQ ID NO: 531258 - RNA, 22 nt, Human
auguagcagauauuugugcaca

SEQ ID NO: 531259 - RNA, 22 nt, Human
uugugaguagugccgcaauaaa

SEQ ID NO: 531260 - RNA, 22 nt, Human
acagggcagagaggcaggcuug

SEQ ID NO: 531261 - RNA, 22 nt, Human
acagauuuaggacuguagcgau

SEQ ID NO: 531262 - RNA, 23 nt, Human
aaucaccagcagccaaugugcag

SEQ ID NO: 531263 - RNA, 22 nt, Human
gccaggaauggagagguggccu

SEQ ID NO: 531264 - RNA, 22 nt, Human
uaaaugugcacagguuagaagg

SEQ ID NO: 531265 - RNA, 22 nt, Human
gaacaucaugaagaaaacauau

SEQ ID NO: 531266 - RNA, 22 nt, Human
acauagcacgucucaauuugga

SEQ ID NO: 531267 - RNA, 22 nt, Human
uccuccagugucuggggccuug

SEQ ID NO: 531268 - RNA, 22 nt, Human
acuuuggaucugauguaaucag

SEQ ID NO: 531269 - RNA, 22 nt, Human
uuuauuauccaguguugucaug

SEQ ID NO: 531270 - RNA, 22 nt, Human
aaauauguaagauuagcacuag

SEQ ID NO: 531271 - RNA, 22 nt, Human
aagugguagagagagcauaagc

SEQ ID NO: 531272 - RNA, 22 nt, Human
auucucuguuuccaagaugaaa

SEQ ID NO: 531273 - RNA, 22 nt, Human
aauguuguuuuucugcaugucu

SEQ ID NO: 531274 - RNA, 22 nt, Human
agaggcuggauugagcauagac

SEQ ID NO: 531275 - RNA, 23 nt, Human
uuuauauuccuaaugucuugagc

SEQ ID NO: 531276 - RNA, 19 nt, Human
uagcugccuguuaccucca

SEQ ID NO: 531277 - RNA, 22 nt, Human
gcuggccucuacaggccggcca

SEQ ID NO: 531278 - RNA, 22 nt, Human
uguauguaaaguuuguaauaga

SEQ ID NO: 531279 - RNA, 23 nt, Human
gcccugcccuuagcacacucaca

SEQ ID NO: 531280 - RNA, 22 nt, Human
ugccaggcaacugcccagccau

SEQ ID NO: 531281 - RNA, 22 nt, Human
gaggcucugugaugugccaggc

SEQ ID NO: 531282 - RNA, 22 nt, Human
guaucuuucccaccaaucacaa

SEQ ID NO: 531283 - RNA, 22 nt, Human
uccuugaaugaagagaggugac

SEQ ID NO: 531284 - RNA, 22 nt, Human
gaggaacuggagcuuucauuuu

SEQ ID NO: 531285 - RNA, 22 nt, Human
cagccuguagaauacaguaaau

SEQ ID NO: 531286 - RNA, 22 nt, Human
gucccugcccuccugggacuca

SEQ ID NO: 531287 - RNA, 22 nt, Human
gaaaugugugacaaguuucaau

SEQ ID NO: 531288 - RNA, 22 nt, Human
gagagugaaggcuucccagcaa

SEQ ID NO: 531289 - RNA, 22 nt, Human
gcugucaguuuuacccacagac

SEQ ID NO: 531290 - RNA, 22 nt, Human
auaaauucucugauguauagua

SEQ ID NO: 531291 - RNA, 22 nt, Human
gauuuugucaaauuccaaaugu

SEQ ID NO: 531292 - RNA, 22 nt, Human
ccucugcaccauagccuucagc

SEQ ID NO: 531293 - RNA, 22 nt, Human
gacauguacuucaauuucucuu

SEQ ID NO: 531294 - RNA, 22 nt, Human
cugugcccuggccaggccucuc

SEQ ID NO: 531295 - RNA, 22 nt, Human
cuuuacauccuguuucccguuu

SEQ ID NO: 531296 - RNA, 22 nt, Human
cuucagggaggagcauggguuc

SEQ ID NO: 531297 - RNA, 22 nt, Human
cucuggaggccguuggcccuua

SEQ ID NO: 531298 - RNA, 22 nt, Human
aagugaugcuacgacuuugaca

SEQ ID NO: 531299 - RNA, 22 nt, Human
uccaggcaugucccaagccgga

SEQ ID NO: 531300 - RNA, 22 nt, Human
gaggucaggggagaggcugaug

SEQ ID NO: 531301 - RNA, 21 nt, Human
ucagcagcaucugccuagagu

SEQ ID NO: 531302 - RNA, 22 nt, Human
ugacauaaaucuaaaggaaagg

SEQ ID NO: 531303 - RNA, 22 nt, Human
cuuugacauccuuguuccucag

SEQ ID NO: 531304 - RNA, 22 nt, Human
gggcucucgauuagacccuggg

SEQ ID NO: 531305 - RNA, 22 nt, Human
cugggcucagaaccuuguuaag

SEQ ID NO: 531306 - RNA, 19 nt, Human
cagcugcaccgugaccauc

SEQ ID NO: 531307 - RNA, 22 nt, Human
ccaggccuuccaguacgcagaa

SEQ ID NO: 531308 - RNA, 22 nt, Human
aauucacaaaaccagauugcuu

SEQ ID NO: 531309 - RNA, 22 nt, Human
cacauaaauggugccauguuuu

SEQ ID NO: 531310 - RNA, 20 nt, Human
gcugcucuccacggucugca

SEQ ID NO: 531311 - RNA, 22 nt, Human
cacauuuaauugguuuagggug

SEQ ID NO: 531312 - RNA, 22 nt, Human
cagggcagggagcuuagaauga

SEQ ID NO: 531313 - RNA, 22 nt, Human
cacccacauuccaucacucugc

SEQ ID NO: 531314 - RNA, 22 nt, Human
aagaugauguuguguuuucacu

SEQ ID NO: 531315 - RNA, 20 nt, Human
cagcugccuggcucugggau

SEQ ID NO: 531316 - RNA, 22 nt, Human
gacagggaggagcagagcuucu

SEQ ID NO: 531317 - RNA, 22 nt, Human
gucaguaggaaccuagggucaa

SEQ ID NO: 531318 - RNA, 22 nt, Human
aacaguaauuugcgguuuuugc

SEQ ID NO: 531319 - RNA, 22 nt, Human
caagagcuuuagaaaugcucau

SEQ ID NO: 531320 - RNA, 22 nt, Human
cuuuggaagugaccacaauccu

SEQ ID NO: 531321 - RNA, 19 nt, Human
uuccugugcugcugugucc

SEQ ID NO: 531322 - RNA, 22 nt, Human
uucuuauuuuccugaggaagaa

SEQ ID NO: 531323 - RNA, 22 nt, Human
acauuucagaaucacacagcuu

SEQ ID NO: 531324 - RNA, 22 nt, Human
gcuggagugcugaggugcagug

SEQ ID NO: 531325 - RNA, 22 nt, Human
caaaguaaacuaccacuguuuc

SEQ ID NO: 531326 - RNA, 22 nt, Human
aagggcugaaugaaggguugaa

SEQ ID NO: 531327 - RNA, 22 nt, Human
ggaagaggcugguagugcccgu

SEQ ID NO: 531328 - RNA, 22 nt, Human
ugcccaaggucaccuaguuagu

SEQ ID NO: 531329 - RNA, 22 nt, Human
guaaacauuuucaucugugccc

SEQ ID NO: 531330 - RNA, 22 nt, Human
aggcaggugagucaaaacagac

SEQ ID NO: 531331 - RNA, 22 nt, Human
ugcauauuauguguaucugucu

SEQ ID NO: 531332 - RNA, 22 nt, Human
ucccugcccucagugcacccgg

SEQ ID NO: 531333 - RNA, 21 nt, Human
aagccucaagcagaagacaga

SEQ ID NO: 531334 - RNA, 22 nt, Human
uuguccuuggaugaagcuggga

SEQ ID NO: 531335 - RNA, 22 nt, Human
cucagacuugcuuuuuauggaa

SEQ ID NO: 531336 - RNA, 22 nt, Human
aaaguugugaaaccgaacaugu

SEQ ID NO: 531337 - RNA, 22 nt, Human
guucacagaaauuguguaccuc

SEQ ID NO: 531338 - RNA, 22 nt, Human
uuuguucauuuugagcucauca

SEQ ID NO: 531339 - RNA, 22 nt, Human
agcagcucugagaggccagcac

SEQ ID NO: 531340 - RNA, 22 nt, Human
caggaagcuggucagauccugu

SEQ ID NO: 531341 - RNA, 22 nt, Human
auaguggugagcugcauuuaug

SEQ ID NO: 531342 - RNA, 22 nt, Human
uuauuuguaucaaggacgguug

SEQ ID NO: 531343 - RNA, 22 nt, Human
ucagagcuaaggggagagcaaa

SEQ ID NO: 531344 - RNA, 22 nt, Human
ggcagcuggguuggccagaaac

SEQ ID NO: 531345 - RNA, 22 nt, Human
aagcuguuguucauccugaauu

SEQ ID NO: 531346 - RNA, 22 nt, Human
uaaaauguuugcaagagaccag

SEQ ID NO: 531347 - RNA, 22 nt, Human
cuguacauauacauuuuuuucc

SEQ ID NO: 531348 - RNA, 22 nt, Human
gcccagaaaugaacuugcugug

SEQ ID NO: 531349 - RNA, 22 nt, Human
uuccagcaggcagacaggagau

SEQ ID NO: 531350 - RNA, 22 nt, Human
ggaaccaggaguuacacgaguu

SEQ ID NO: 531351 - RNA, 22 nt, Human
ggugcugguucaggguggcugu

SEQ ID NO: 531352 - RNA, 19 nt, Human
agggcugcucuggccuggg

SEQ ID NO: 531353 - RNA, 22 nt, Human
ugugaaauguguguauaauuaa

SEQ ID NO: 531354 - RNA, 22 nt, Human
aaguaaauaucuguagucuuua

SEQ ID NO: 531355 - RNA, 22 nt, Human
uguccuuuaugaaaugguguuu

SEQ ID NO: 531356 - RNA, 22 nt, Human
augcuuuauuauuuugcaggga

SEQ ID NO: 531357 - RNA, 22 nt, Human
ucuggguuauuaugauggcuac

SEQ ID NO: 531358 - RNA, 22 nt, Human
ugaacgcagguccacauggcuc

SEQ ID NO: 531359 - RNA, 22 nt, Human
ucuaggagcaugaagggaaggc

SEQ ID NO: 531360 - RNA, 22 nt, Human
uggcagugggaagcuggaaguc

SEQ ID NO: 531361 - RNA, 22 nt, Human
ggcaguggaggacccugugucu

SEQ ID NO: 531362 - RNA, 23 nt, Human
uacugccuuguucauguguauuu

SEQ ID NO: 531363 - RNA, 22 nt, Human
uggccucugugggagcugagca

SEQ ID NO: 531364 - RNA, 22 nt, Human
ggaggagguggguuaaguugua

SEQ ID NO: 531365 - RNA, 22 nt, Human
gcagggccuuggucaucuuuuu

SEQ ID NO: 531366 - RNA, 22 nt, Human
uguaaauuggaaaucaaucaag

SEQ ID NO: 531367 - RNA, 18 nt, Human
acaguaaagaaaggaauu

SEQ ID NO: 531368 - RNA, 22 nt, Human
uucauucagguguauuuauggg

SEQ ID NO: 531369 - RNA, 22 nt, Human
auagaaaacagauguccuuaaa

SEQ ID NO: 531370 - RNA, 22 nt, Human
cccagcuccuuacagggccgaa

SEQ ID NO: 531371 - RNA, 22 nt, Human
uagcuuuaggcacguuugaauu

SEQ ID NO: 531372 - RNA, 22 nt, Human
ucuggcagcaagucuguuucuc

SEQ ID NO: 531373 - RNA, 23 nt, Human
caggcucccggaccaggauccgc

SEQ ID NO: 531374 - RNA, 22 nt, Human
gccaggugggagacagacagca

SEQ ID NO: 531375 - RNA, 22 nt, Human
gcauacaaagguuuacaacuga

SEQ ID NO: 531376 - RNA, 22 nt, Human
aucuggcuuuuaccccacggcc

SEQ ID NO: 531377 - RNA, 22 nt, Human
acagccuguuugaucuggugcu

SEQ ID NO: 531378 - RNA, 22 nt, Human
uaccauuucauucuuuccucau

SEQ ID NO: 531379 - RNA, 22 nt, Human
aucuggcucccuuggaauccgu

SEQ ID NO: 531380 - RNA, 22 nt, Human
acauucaugucccacuucuagc

SEQ ID NO: 531381 - RNA, 22 nt, Human
aagggcagccugacucacgguc

SEQ ID NO: 531382 - RNA, 22 nt, Human
uaagaacagugucugucucaca

SEQ ID NO: 531383 - RNA, 21 nt, Human
augggcagaggcagagaggcu

SEQ ID NO: 531384 - RNA, 22 nt, Human
gauuuucauuauagcuaguuuc

SEQ ID NO: 531385 - RNA, 22 nt, Human
ccaggagccacucaggcccaca

SEQ ID NO: 531386 - RNA, 22 nt, Human
ucuucaaauacagucauauuga

SEQ ID NO: 531387 - RNA, 22 nt, Human
aagggugggcccuggcagccau

SEQ ID NO: 531388 - RNA, 22 nt, Human
uaaaacuagugguugggacuaa

SEQ ID NO: 531389 - RNA, 22 nt, Human
ggcucuuuaacuugucuaaauu

SEQ ID NO: 531390 - RNA, 22 nt, Human
cagggcagggccacacccccug

SEQ ID NO: 531391 - RNA, 22 nt, Human
uaauacugaaaggaguaucagc

SEQ ID NO: 531392 - RNA, 22 nt, Human
gagaggcuuaagggcugugaag

SEQ ID NO: 531393 - RNA, 22 nt, Human
uuuguaagugguagaucuaaga

SEQ ID NO: 531394 - RNA, 20 nt, Human
ggcacuggaagcacacagga

SEQ ID NO: 531395 - RNA, 22 nt, Human
ucaacauuuaugaagcuguggc

SEQ ID NO: 531396 - RNA, 19 nt, Human
agauggggaagagugugag

SEQ ID NO: 531397 - RNA, 19 nt, Human
gccacuccugaugcugccc

SEQ ID NO: 531398 - RNA, 22 nt, Human
uuccaacuuugucauauauuau

SEQ ID NO: 531399 - RNA, 22 nt, Human
uuucuucucacccaggacagag

SEQ ID NO: 531400 - RNA, 22 nt, Human
ccugugcucccauagcuucugu

SEQ ID NO: 531401 - RNA, 22 nt, Human
cacauugaaaugacccaauaau

SEQ ID NO: 531402 - RNA, 22 nt, Human
aagauuucucuccuggaaagca

SEQ ID NO: 531403 - RNA, 22 nt, Human
uucagaaaaaacuucaauaagu

SEQ ID NO: 531404 - RNA, 22 nt, Human
guaaaguucuauuugaauuuag

SEQ ID NO: 531405 - RNA, 22 nt, Human
uucacauuaucaggauuguuuc

SEQ ID NO: 531406 - RNA, 22 nt, Human
aauaauuacccaucuuuuugua

SEQ ID NO: 531407 - RNA, 23 nt, Human
ccugcagcugcuggggcuccacc

SEQ ID NO: 531408 - RNA, 22 nt, Human
caguagcaggcacucagcacgu

SEQ ID NO: 531409 - RNA, 22 nt, Human
gcaggcucccuugcagagcagg

SEQ ID NO: 531410 - RNA, 22 nt, Human
ccagguggaaggucugugcucu

SEQ ID NO: 531411 - RNA, 22 nt, Human
cucagcuagggaagguuagcuu

SEQ ID NO: 531412 - RNA, 22 nt, Human
agggaaggaaaagcugucgcuu

SEQ ID NO: 531413 - RNA, 22 nt, Human
ucucugguggcuccaucaguag

SEQ ID NO: 531414 - RNA, 21 nt, Human
caggaaaagcggaagucuagc

SEQ ID NO: 531415 - RNA, 22 nt, Human
guucacagauccuugaagccag

SEQ ID NO: 531416 - RNA, 22 nt, Human
acccagagccagggucaggagc

SEQ ID NO: 531417 - RNA, 21 nt, Human
ugcaggcuacuucugacucua

SEQ ID NO: 531418 - RNA, 22 nt, Human
uuacauuagacccacuuucaug

SEQ ID NO: 531419 - RNA, 23 nt, Human
caacagcuguuagauaugggcuu

SEQ ID NO: 531420 - RNA, 18 nt, Human
ugcucuggucucacuugg

SEQ ID NO: 531421 - RNA, 22 nt, Human
agguggggcugggaaagauucc

SEQ ID NO: 531422 - RNA, 22 nt, Human
aaaguaaccuaguaauaguguc

SEQ ID NO: 531423 - RNA, 19 nt, Human
ccauuucauauguauugug

SEQ ID NO: 531424 - RNA, 22 nt, Human
uggaaaacauugagauaccaag

SEQ ID NO: 531425 - RNA, 22 nt, Human
ugucauuuccugaaugcugagu

SEQ ID NO: 531426 - RNA, 22 nt, Human
cacagcagaaaguguaggagga

SEQ ID NO: 531427 - RNA, 22 nt, Human
aaggagagagcuuugcuggaac

SEQ ID NO: 531428 - RNA, 23 nt, Human
aguuuguaaagaaauauuugcac

SEQ ID NO: 531429 - RNA, 22 nt, Human
agccagcagggcuuagaggaca

SEQ ID NO: 531430 - RNA, 22 nt, Human
uguacagaaggcacuaagguca

SEQ ID NO: 531431 - RNA, 19 nt, Human
uggcagaggcaguuuguac

SEQ ID NO: 531432 - RNA, 22 nt, Human
ucagggcagaauccaaagaauu

SEQ ID NO: 531433 - RNA, 22 nt, Human
auucaagaggaacaaugaagau

SEQ ID NO: 531434 - RNA, 22 nt, Human
uuuucuucuaccugcuguccaa

SEQ ID NO: 531435 - RNA, 22 nt, Human
uuuuuggcagcucagaaacuuc

SEQ ID NO: 531436 - RNA, 22 nt, Human
aacuacauuguccuuucugaag

SEQ ID NO: 531437 - RNA, 22 nt, Human
ugaggcagcuuuuucugugugu

SEQ ID NO: 531438 - RNA, 22 nt, Human
ugugaagaguagacauguggug

SEQ ID NO: 531439 - RNA, 22 nt, Human
gcugaaggucucuggagagguc

SEQ ID NO: 531440 - RNA, 22 nt, Human
uucaauucaauucuaaauauau

SEQ ID NO: 531441 - RNA, 22 nt, Human
aggcagucuaucucuggagccu

SEQ ID NO: 531442 - RNA, 22 nt, Human
gugccuggagcuaauguguaua

SEQ ID NO: 531443 - RNA, 22 nt, Human
aacaugaaaguugcuaagugca

SEQ ID NO: 531444 - RNA, 22 nt, Human
cauguccauuuaugcacagaaa

SEQ ID NO: 531445 - RNA, 22 nt, Human
ucuggggagugccuaaguggaa

SEQ ID NO: 531446 - RNA, 22 nt, Human
aagaugcagcuuccacuuuugc

SEQ ID NO: 531447 - RNA, 22 nt, Human
aacaauuacuaccaaggccugu

SEQ ID NO: 531448 - RNA, 22 nt, Human
ggagugugggauggagcucagg

SEQ ID NO: 531449 - RNA, 22 nt, Human
acauuucucccugcaugccugc

SEQ ID NO: 531450 - RNA, 19 nt, Human
cauaauacaguggaucuga

SEQ ID NO: 531451 - RNA, 22 nt, Human
ggggcggggcucugagaagcau

SEQ ID NO: 531452 - RNA, 22 nt, Human
aggaaauugucuuuuuccuugu

SEQ ID NO: 531453 - RNA, 22 nt, Human
cuggcaggaaguuagaugguaa

SEQ ID NO: 531454 - RNA, 22 nt, Human
cugccagcucucuggaggcucu

SEQ ID NO: 531455 - RNA, 19 nt, Human
augauacaggugaaaauug

SEQ ID NO: 531456 - RNA, 22 nt, Human
cucagggcaguauggcugagag

SEQ ID NO: 531457 - RNA, 22 nt, Human
cgccugggaguccacaccugcu

SEQ ID NO: 531458 - RNA, 22 nt, Human
cagcuggacuuuugauagaagu

SEQ ID NO: 531459 - RNA, 21 nt, Human
gcagaugggagucaucaggcu

SEQ ID NO: 531460 - RNA, 22 nt, Human
gcccuuccuuagacagcaggau

SEQ ID NO: 531461 - RNA, 22 nt, Human
aagcacuuagaagagugccugc

SEQ ID NO: 531462 - RNA, 22 nt, Human
agcccuccucacaucagcgucc

SEQ ID NO: 531463 - RNA, 22 nt, Human
gcauggugacaucaugugaaug

SEQ ID NO: 531464 - RNA, 22 nt, Human
auuugcuuucagguauaaaagg

SEQ ID NO: 531465 - RNA, 19 nt, Human
gcauaaaaugucaaugugu

SEQ ID NO: 531466 - RNA, 22 nt, Human
gaagccagcaguggagaaagga

SEQ ID NO: 531467 - RNA, 22 nt, Human
gccaggagagcuccuucagguu

SEQ ID NO: 531468 - RNA, 22 nt, Human
ggagggguggaaggagugccug

SEQ ID NO: 531469 - RNA, 22 nt, Human
ugauucaagcuacuguuacugg

SEQ ID NO: 531470 - RNA, 22 nt, Human
accgaaggaaacuggaaccguu

SEQ ID NO: 531471 - RNA, 22 nt, Human
ggccacagcaaugcugugaugu

SEQ ID NO: 531472 - RNA, 22 nt, Human
uagaacugcucucauacuugcu

SEQ ID NO: 531473 - RNA, 23 nt, Human
aacagcaggaugauagaggaggu

SEQ ID NO: 531474 - RNA, 22 nt, Human
gggugggguguaucggauccua

SEQ ID NO: 531475 - RNA, 22 nt, Human
uguuucauuaguacugacaaua

SEQ ID NO: 531476 - RNA, 22 nt, Human
cuggauuuuaucauuguaguuu

SEQ ID NO: 531477 - RNA, 22 nt, Human
cucugaagggagggccaagccc

SEQ ID NO: 531478 - RNA, 22 nt, Human
uaauguagggguguaacacaca

SEQ ID NO: 531479 - RNA, 22 nt, Human
uugcucaggcuuagagcuacua

SEQ ID NO: 531480 - RNA, 21 nt, Human
aagagcugucaggaaggcugc

SEQ ID NO: 531481 - RNA, 22 nt, Human
agccagagcugaugucauucuc

SEQ ID NO: 531482 - RNA, 22 nt, Human
aaacacaucauucaugucguca

SEQ ID NO: 531483 - RNA, 22 nt, Human
uuuauuauguacaggcacuaua

SEQ ID NO: 531484 - RNA, 22 nt, Human
ucagaaaagaccacauuauucu

SEQ ID NO: 531485 - RNA, 22 nt, Human
acauuucucuuagaguuggacu

SEQ ID NO: 531486 - RNA, 19 nt, Human
agacacacuugauaugugu

SEQ ID NO: 531487 - RNA, 21 nt, Human
uuuagggaggauauuuaacuu

SEQ ID NO: 531488 - RNA, 22 nt, Human
ggaugcugacuuuggagcaugg

SEQ ID NO: 531489 - RNA, 22 nt, Human
gugugggcugcagaggcacagc

SEQ ID NO: 531490 - RNA, 22 nt, Human
agggaccugcucacugccuggc

SEQ ID NO: 531491 - RNA, 22 nt, Human
ccaggcagggcucaaggaaccu

SEQ ID NO: 531492 - RNA, 22 nt, Human
aucagaauaauuagauuucaga

SEQ ID NO: 531493 - RNA, 22 nt, Human
gacauguaaauggcaauuaugg

SEQ ID NO: 531494 - RNA, 22 nt, Human
caucagagugguggccuggugu

SEQ ID NO: 531495 - RNA, 23 nt, Human
aaguaacagggauaauagcaguu

SEQ ID NO: 531496 - RNA, 22 nt, Human
uugcauaaaugcuuaaaauuug

SEQ ID NO: 531497 - RNA, 22 nt, Human
cuuucuaaauguuccuugauua

SEQ ID NO: 531498 - RNA, 22 nt, Human
ugcugaaucaaaacaaagguuu

SEQ ID NO: 531499 - RNA, 22 nt, Human
cagaaauucccauuucagauuc

SEQ ID NO: 531500 - RNA, 22 nt, Human
uagaaagacuguccagauuuca

SEQ ID NO: 531501 - RNA, 20 nt, Human
gcucugaccauaucaagaca

SEQ ID NO: 531502 - RNA, 22 nt, Human
uucaaacucuugcucugcuagu

SEQ ID NO: 531503 - RNA, 19 nt, Human
uuuugaaguaugagacagg

SEQ ID NO: 531504 - RNA, 22 nt, Human
ucccagaguucaaugggaaggu

SEQ ID NO: 531505 - RNA, 22 nt, Human
augaaaauacugugguugauag

SEQ ID NO: 531506 - RNA, 22 nt, Human
ggcucuguuuacuuucagaggc

SEQ ID NO: 531507 - RNA, 22 nt, Human
gccaggcagcugggagggugcc

SEQ ID NO: 531508 - RNA, 22 nt, Human
agugauuaauuguaaaaauucu

SEQ ID NO: 531509 - RNA, 22 nt, Human
cagagcugagaauguugaugcu

SEQ ID NO: 531510 - RNA, 22 nt, Human
gggacagcuguagugcuuggcu

SEQ ID NO: 531511 - RNA, 22 nt, Human
agaggcugaaugaugucaucau

SEQ ID NO: 531512 - RNA, 22 nt, Human
ugccaaauugcccuauaaauga

SEQ ID NO: 531513 - RNA, 21 nt, Human
acacagaggcaucaucacuuu

SEQ ID NO: 531514 - RNA, 22 nt, Human
ccucccucuuucagucccacag

SEQ ID NO: 531515 - RNA, 22 nt, Human
cagcuugcuaauuuugacuuca

SEQ ID NO: 531516 - RNA, 22 nt, Human
gaagccaagugcaaaugccuua

SEQ ID NO: 531517 - RNA, 22 nt, Human
auacuaaaguauagaacuuagu

SEQ ID NO: 531518 - RNA, 23 nt, Human
agaggcaggaguggcuugcccgg

SEQ ID NO: 531519 - RNA, 22 nt, Human
caggcuggagugcaguugugca

SEQ ID NO: 531520 - RNA, 22 nt, Human
ucuguggcacgauugcacugca

SEQ ID NO: 531521 - RNA, 22 nt, Human
ugaaaugaaacagaacauauca

SEQ ID NO: 531522 - RNA, 22 nt, Human
acccuggggguggccagugcca

SEQ ID NO: 531523 - RNA, 22 nt, Human
ggaccagagaagugagcaccug

SEQ ID NO: 531524 - RNA, 22 nt, Human
uuuguaagagcauauguaaagg

SEQ ID NO: 531525 - RNA, 19 nt, Human
gagcccucuccauggccac

SEQ ID NO: 531526 - RNA, 22 nt, Human
aauguguguucggggcccagag

SEQ ID NO: 531527 - RNA, 22 nt, Human
cugguccuugcuacccagcaag

SEQ ID NO: 531528 - RNA, 20 nt, Human
uccucagaagacauuugggg

SEQ ID NO: 531529 - RNA, 22 nt, Human
acugggccaggggcuuuggagc

SEQ ID NO: 531530 - RNA, 18 nt, Human
gccagagggaagcaggug

SEQ ID NO: 531531 - RNA, 22 nt, Human
agaacaauugccccaaagcuug

SEQ ID NO: 531532 - RNA, 22 nt, Human
cggggccuaccgcugcguggcc

SEQ ID NO: 531533 - RNA, 20 nt, Human
agggucagagagcgugagug

SEQ ID NO: 531534 - RNA, 22 nt, Human
auuuuagauuuaagaauaaggu

SEQ ID NO: 531535 - RNA, 22 nt, Human
gcgcaagccacacagccugggg

SEQ ID NO: 531536 - RNA, 22 nt, Human
uucaaagagaaauuguauuuuc

SEQ ID NO: 531537 - RNA, 22 nt, Human
ccuuuugcucucccauccagaa

SEQ ID NO: 531538 - RNA, 22 nt, Human
aagcagagaccggcuaauggag

SEQ ID NO: 531539 - RNA, 22 nt, Human
aauucacaggaucacaggagag

SEQ ID NO: 531540 - RNA, 22 nt, Human
uuucuuauacuauauugucauc

SEQ ID NO: 531541 - RNA, 22 nt, Human
uuuacauuucccucugucaguu

SEQ ID NO: 531542 - RNA, 22 nt, Human
gccuggccgcuccgagcuccgc

SEQ ID NO: 531543 - RNA, 22 nt, Human
ucucuuucuauugcaccaugcu

SEQ ID NO: 531544 - RNA, 22 nt, Human
gcuauuuauuaaaauggugaag

SEQ ID NO: 531545 - RNA, 22 nt, Human
cugagcuuggccaggaaugaau

SEQ ID NO: 531546 - RNA, 22 nt, Human
cggcuggguucggcugcaggcc

SEQ ID NO: 531547 - RNA, 22 nt, Human
uuuauguaguuacggacuauca

SEQ ID NO: 531548 - RNA, 22 nt, Human
uuccggaagguucucuagaauu

SEQ ID NO: 531549 - RNA, 22 nt, Human
ugcauugcaguuaacucaguau

SEQ ID NO: 531550 - RNA, 22 nt, Human
uuccagaacucaagaaaugccc

SEQ ID NO: 531551 - RNA, 22 nt, Human
gcuggggagggcgucaaggcca

SEQ ID NO: 531552 - RNA, 22 nt, Human
uucuggcuuugaccaaguucaa

SEQ ID NO: 531553 - RNA, 22 nt, Human
gcauuuuaaugagguuuaugag

SEQ ID NO: 531554 - RNA, 22 nt, Human
gauuuucugagccuucaaauuu

SEQ ID NO: 531555 - RNA, 22 nt, Human
cgggcaguguggcuccagaguc

SEQ ID NO: 531556 - RNA, 22 nt, Human
aaagucaucuaggagcagauuu

SEQ ID NO: 531557 - RNA, 19 nt, Human
uggaggagaggaaaaguca

SEQ ID NO: 531558 - RNA, 22 nt, Human
uagauggcguccauggccgcag

SEQ ID NO: 531559 - RNA, 21 nt, Human
auugaaagucaacaaucaguu

SEQ ID NO: 531560 - RNA, 22 nt, Human
ucacauuuucuuaggaaacuua

SEQ ID NO: 531561 - RNA, 22 nt, Human
gguuugcauucugaaaggcuca

SEQ ID NO: 531562 - RNA, 22 nt, Human
gagaaacuaacaucugaaggug

SEQ ID NO: 531563 - RNA, 22 nt, Human
uggcuaacaguuaagauuucau

SEQ ID NO: 531564 - RNA, 22 nt, Human
acugccuuauaugcugugugug

SEQ ID NO: 531565 - RNA, 22 nt, Human
cugugccuuuguagcugugccu

SEQ ID NO: 531566 - RNA, 22 nt, Human
uccucugccaaagggaguugcc

SEQ ID NO: 531567 - RNA, 22 nt, Human
cagcaucccucaggggccucug

SEQ ID NO: 531568 - RNA, 22 nt, Human
cuuuagauguugcuuuaacuau

SEQ ID NO: 531569 - RNA, 22 nt, Human
cuucagggugacgcaggcugca

SEQ ID NO: 531570 - RNA, 20 nt, Human
caguagcaauaauuagaagc

SEQ ID NO: 531571 - RNA, 21 nt, Human
ccagcuuucccaagucccuuu

SEQ ID NO: 531572 - RNA, 22 nt, Human
acauugaagggaaugcaaagau

SEQ ID NO: 531573 - RNA, 22 nt, Human
gaagggugcauggagggaaguc

SEQ ID NO: 531574 - RNA, 22 nt, Human
cacagauuucuggucuucaccc

SEQ ID NO: 531575 - RNA, 22 nt, Human
uaccacagacagauuucaguaa

SEQ ID NO: 531576 - RNA, 22 nt, Human
uuccaauugugagauuuuuuaa

SEQ ID NO: 531577 - RNA, 22 nt, Human
ucacuucacacccacuaucaug

SEQ ID NO: 531578 - RNA, 22 nt, Human
ugccuuuuaccuuguaauucug

SEQ ID NO: 531579 - RNA, 22 nt, Human
cugccucugguuuuggucccug

SEQ ID NO: 531580 - RNA, 22 nt, Human
aaacagcagcuguuuaauuugc

SEQ ID NO: 531581 - RNA, 17 nt, Human
ucuguucaagugagagg

SEQ ID NO: 531582 - RNA, 22 nt, Human
uugaggcugcacaguacaggcu

SEQ ID NO: 531583 - RNA, 22 nt, Human
acugugugcccugacgccaggg

SEQ ID NO: 531584 - RNA, 22 nt, Human
aggcagcagucaugaggaaaga

SEQ ID NO: 531585 - RNA, 22 nt, Human
cuuggcagcuuuuggaggagcc

SEQ ID NO: 531586 - RNA, 22 nt, Human
aaucaccaucucucuugucccc

SEQ ID NO: 531587 - RNA, 22 nt, Human
aguguuucucagaagggccuau

SEQ ID NO: 531588 - RNA, 22 nt, Human
ugagaagcugcugacuuagccu

SEQ ID NO: 531589 - RNA, 22 nt, Human
uuauauguuucuguuuggaggc

SEQ ID NO: 531590 - RNA, 22 nt, Human
ccuggauagcuacuggccaggc

SEQ ID NO: 531591 - RNA, 22 nt, Human
cuccucccugcgauugcucugc

SEQ ID NO: 531592 - RNA, 22 nt, Human
agaaagggucacugaaagagga

SEQ ID NO: 531593 - RNA, 22 nt, Human
gccugccuuuguaugacccuga

SEQ ID NO: 531594 - RNA, 22 nt, Human
agacucaagacugcagaagacg

SEQ ID NO: 531595 - RNA, 22 nt, Human
uccagagccuauauguucaacu

SEQ ID NO: 531596 - RNA, 22 nt, Human
cuccagggagcugcgggagcca

SEQ ID NO: 531597 - RNA, 22 nt, Human
aagcagaaagaacaacugagug

SEQ ID NO: 531598 - RNA, 22 nt, Human
gccaccuguuucgcuugcccag

SEQ ID NO: 531599 - RNA, 22 nt, Human
uuucuguagggauuucacaguu

SEQ ID NO: 531600 - RNA, 22 nt, Human
uauuugaagggagaaagugcca

SEQ ID NO: 531601 - RNA, 21 nt, Human
gcaugccugcaucuuaguguu

SEQ ID NO: 531602 - RNA, 22 nt, Human
aagagccagcuagugaagaggc

SEQ ID NO: 531603 - RNA, 22 nt, Human
guuuuacacaccuaugaaagac

SEQ ID NO: 531604 - RNA, 22 nt, Human
ggcucacgcaauuaucccggcc

SEQ ID NO: 531605 - RNA, 22 nt, Human
uauguacacacacaugcaugua

SEQ ID NO: 531606 - RNA, 19 nt, Human
gggcuucugggaucaagag

SEQ ID NO: 531607 - RNA, 21 nt, Human
agccuggcccagggggaggcu

SEQ ID NO: 531608 - RNA, 22 nt, Human
aagccaggguuuguggaucuau

SEQ ID NO: 531609 - RNA, 22 nt, Human
uucaggaugaaagugugcaaca

SEQ ID NO: 531610 - RNA, 22 nt, Human
uggcucagccuggcccuuucau

SEQ ID NO: 531611 - RNA, 22 nt, Human
guacccagaggcaugaucccag

SEQ ID NO: 531612 - RNA, 22 nt, Human
ccugcuggcagaggggguuacu

SEQ ID NO: 531613 - RNA, 22 nt, Human
cacaggagaaaggggaagcucg

SEQ ID NO: 531614 - RNA, 22 nt, Human
ugcugcugaaaaggugugcuua

SEQ ID NO: 531615 - RNA, 22 nt, Human
ggaggccaaggcgggcggauca

SEQ ID NO: 531616 - RNA, 22 nt, Human
uaauguuuccagucuaugaugg

SEQ ID NO: 531617 - RNA, 22 nt, Human
ucuuagcauuucauaacaacug

SEQ ID NO: 531618 - RNA, 17 nt, Human
ugcauguccuuuguucc

SEQ ID NO: 531619 - RNA, 22 nt, Human
cugggaggugaacagaaaaacu

SEQ ID NO: 531620 - RNA, 22 nt, Human
cugcuucuaagaaccugcagcu

SEQ ID NO: 531621 - RNA, 22 nt, Human
cuucaauugccaccagcuagca

SEQ ID NO: 531622 - RNA, 22 nt, Human
caaaaaacaccugugugaguau

SEQ ID NO: 531623 - RNA, 22 nt, Human
aucuuucagagcuccaucaggg

SEQ ID NO: 531624 - RNA, 22 nt, Human
cuggcucaggaaaguugcugcu

SEQ ID NO: 531625 - RNA, 22 nt, Human
augaaauauuucagagcagagu

SEQ ID NO: 531626 - RNA, 22 nt, Human
aauaagaugugcuugaguuugg

SEQ ID NO: 531627 - RNA, 22 nt, Human
uuaaagcauccugucagucugu

SEQ ID NO: 531628 - RNA, 22 nt, Human
guggggcggcagaugcucccug

SEQ ID NO: 531629 - RNA, 22 nt, Human
aaggucauuuuuuccucuguug

SEQ ID NO: 531630 - RNA, 22 nt, Human
ugccucagaguugucccuacca

SEQ ID NO: 531631 - RNA, 19 nt, Human
cucuccagcuccaguagcu

SEQ ID NO: 531632 - RNA, 22 nt, Human
ccuccuagaggaaccccagggc

SEQ ID NO: 531633 - RNA, 22 nt, Human
caguguuuguauagaauaugca

SEQ ID NO: 531634 - RNA, 22 nt, Human
ucagaggaauuugcuuuucaug

SEQ ID NO: 531635 - RNA, 22 nt, Human
cuggaugcuuccucucugcuag

SEQ ID NO: 531636 - RNA, 22 nt, Human
agugucugugcuuugcagcaaa

SEQ ID NO: 531637 - RNA, 22 nt, Human
gcucaggauuucauccaugugu

SEQ ID NO: 531638 - RNA, 21 nt, Human
uuagaaagcucacuacaguua

SEQ ID NO: 531639 - RNA, 22 nt, Human
ugggccaggucugugucagcug

SEQ ID NO: 531640 - RNA, 22 nt, Human
cuggcuggcaaguagaacacaa

SEQ ID NO: 531641 - RNA, 22 nt, Human
ccuggcucucugcagauccugg

SEQ ID NO: 531642 - RNA, 22 nt, Human
acaggcucucagccaguuggca

SEQ ID NO: 531643 - RNA, 22 nt, Human
ucauugcacuccagccugggca

SEQ ID NO: 531644 - RNA, 22 nt, Human
cagagucauaucagagaauaug

SEQ ID NO: 531645 - RNA, 22 nt, Human
ugugccugucacccucagagag

SEQ ID NO: 531646 - RNA, 22 nt, Human
uaaugccuagauuauucuguuu

SEQ ID NO: 531647 - RNA, 22 nt, Human
aaguaccaaguuuguuugacgc

SEQ ID NO: 531648 - RNA, 22 nt, Human
gaagacauguuuuuaauaugua

SEQ ID NO: 531649 - RNA, 21 nt, Human
aacaaagggaugcucaucuuu

SEQ ID NO: 531650 - RNA, 22 nt, Human
ggcuccacugcugaccacucca

SEQ ID NO: 531651 - RNA, 22 nt, Human
ccagcuccucuucccaguguca

SEQ ID NO: 531652 - RNA, 22 nt, Human
cacaguacgcacccgauacaug

SEQ ID NO: 531653 - RNA, 19 nt, Human
ccagguggaacugagguag

SEQ ID NO: 531654 - RNA, 16 nt, Human
aaggcugauuuucccu

SEQ ID NO: 531655 - RNA, 22 nt, Human
ggcagcaguuacaaaugugcag

SEQ ID NO: 531656 - RNA, 22 nt, Human
uguguacagcaugguccagcag

SEQ ID NO: 531657 - RNA, 22 nt, Human
ucccagaggacuguuggugcua

SEQ ID NO: 531658 - RNA, 22 nt, Human
ugagcccagucugucugacaug

SEQ ID NO: 531659 - RNA, 22 nt, Human
gcaggguauaauacuuagguga

SEQ ID NO: 531660 - RNA, 22 nt, Human
auaugaaaagaagucaccauug

SEQ ID NO: 531661 - RNA, 22 nt, Human
uaaagacauaggaucagggaga

SEQ ID NO: 531662 - RNA, 22 nt, Human
ucuccugcucccaacugcugca

SEQ ID NO: 531663 - RNA, 22 nt, Human
cauguacaguuuuucuguccug

SEQ ID NO: 531664 - RNA, 22 nt, Human
agugauggggcccugcacugau

SEQ ID NO: 531665 - RNA, 22 nt, Human
guugggcuuauguaauuuuaag

SEQ ID NO: 531666 - RNA, 22 nt, Human
ggucccagcuggucacugucag

SEQ ID NO: 531667 - RNA, 22 nt, Human
acugcaggagacacagcugcug

SEQ ID NO: 531668 - RNA, 22 nt, Human
gagacaaaaguuggagugcaag

SEQ ID NO: 531669 - RNA, 23 nt, Human
ggccuguguuuugucugaaguac

SEQ ID NO: 531670 - RNA, 23 nt, Human
acagaucaucucgaaacaacuau

SEQ ID NO: 531671 - RNA, 22 nt, Human
uuaagucaauaucaaucucagc

SEQ ID NO: 531672 - RNA, 14 nt, Human
gcagguggaucacu

SEQ ID NO: 531673 - RNA, 23 nt, Human
aagaauaaaugacauuaaaggug

SEQ ID NO: 531674 - RNA, 22 nt, Human
agccacaggaaacagagacagc

SEQ ID NO: 531675 - RNA, 22 nt, Human
aguguccaacucagcuugucaa

SEQ ID NO: 531676 - RNA, 22 nt, Human
auugaaaggcaaaguaggaagc

SEQ ID NO: 531677 - RNA, 18 nt, Human
agacccucuaagggcagu

SEQ ID NO: 531678 - RNA, 22 nt, Human
ggagccuugggcgcucucccau

SEQ ID NO: 531679 - RNA, 22 nt, Human
uaggcugaaaggagaggugaag

SEQ ID NO: 531680 - RNA, 22 nt, Human
gcaggagucacugacuuggucc

SEQ ID NO: 531681 - RNA, 22 nt, Human
accaggcacucuuguggcagug

SEQ ID NO: 531682 - RNA, 22 nt, Human
uuacuacaagauucuguuuuau

SEQ ID NO: 531683 - RNA, 22 nt, Human
uugauguacagaauuguucaca

SEQ ID NO: 531684 - RNA, 22 nt, Human
cagccuguggcagaggucuaau

SEQ ID NO: 531685 - RNA, 22 nt, Human
gaggacagcuuagggcuuccug

SEQ ID NO: 531686 - RNA, 22 nt, Human
agagcagucaggcuaggacacu

SEQ ID NO: 531687 - RNA, 22 nt, Human
uaaaugugcacuuuacuuuuca

SEQ ID NO: 531688 - RNA, 22 nt, Human
uguggcucucaugcacucccag

SEQ ID NO: 531689 - RNA, 22 nt, Human
cagguccugcagggagaguaaa

SEQ ID NO: 531690 - RNA, 22 nt, Human
ccagggaaugugggaugacucu

SEQ ID NO: 531691 - RNA, 22 nt, Human
uaugaagaaguucugugaaaug

SEQ ID NO: 531692 - RNA, 22 nt, Human
uuuugcuuuuguaacacagugu

SEQ ID NO: 531693 - RNA, 22 nt, Human
uggcaguggugucugcacaggc

SEQ ID NO: 531694 - RNA, 22 nt, Human
ucugaagggcugaguggaggag

SEQ ID NO: 531695 - RNA, 21 nt, Human
ucccagagugcuugggacugc

SEQ ID NO: 531696 - RNA, 22 nt, Human
acuuucucccacccacccgucu

SEQ ID NO: 531697 - RNA, 22 nt, Human
gcacaacaccaagggagguauc

SEQ ID NO: 531698 - RNA, 22 nt, Human
uggcucugggcaccguguccac

SEQ ID NO: 531699 - RNA, 19 nt, Human
ggcugucucggcccagcca

SEQ ID NO: 531700 - RNA, 22 nt, Human
uaucacacucggaaaucuagga

SEQ ID NO: 531701 - RNA, 22 nt, Human
gccucugcaucaucacuccagc

SEQ ID NO: 531702 - RNA, 22 nt, Human
gugcaugugucuuuauaguagc

SEQ ID NO: 531703 - RNA, 21 nt, Human
cugggcuuucucucaaagaca

SEQ ID NO: 531704 - RNA, 22 nt, Human
aggucauuacaauuaucauuuu

SEQ ID NO: 531705 - RNA, 22 nt, Human
aaagaagggacagacugccucu

SEQ ID NO: 531706 - RNA, 22 nt, Human
ucagagugugagacauauugga

SEQ ID NO: 531707 - RNA, 22 nt, Human
ucacauuucucagcacugauga

SEQ ID NO: 531708 - RNA, 22 nt, Human
gcuucaugccaggagguuuaag

SEQ ID NO: 531709 - RNA, 22 nt, Human
uuaagauuuucuucaguauuau

SEQ ID NO: 531710 - RNA, 22 nt, Human
ucacaguagacuucucaagagc

SEQ ID NO: 531711 - RNA, 22 nt, Human
agaaaacacugcccccucucuc

SEQ ID NO: 531712 - RNA, 22 nt, Human
gcaggcucuucuuucugcccag

SEQ ID NO: 531713 - RNA, 22 nt, Human
ucaaaacacuauuaccuuuaau

SEQ ID NO: 531714 - RNA, 22 nt, Human
cugggaggcggagguuguagug

SEQ ID NO: 531715 - RNA, 22 nt, Human
agcuugucuuucaaaggaguuu

SEQ ID NO: 531716 - RNA, 20 nt, Human
ggcucugcuugugagcagcc

SEQ ID NO: 531717 - RNA, 22 nt, Human
uucuaagaaugcuuugcaaaau

SEQ ID NO: 531718 - RNA, 22 nt, Human
gaagagcugacagugucauccu

SEQ ID NO: 531719 - RNA, 22 nt, Human
aggccaggaccauuagcccaga

SEQ ID NO: 531720 - RNA, 22 nt, Human
accaugggucagccaccucagc

SEQ ID NO: 531721 - RNA, 22 nt, Human
agggagcuuccgaacuacagcu

SEQ ID NO: 531722 - RNA, 22 nt, Human
caguguguggauccucccagga

SEQ ID NO: 531723 - RNA, 21 nt, Human
auuucauggugcuuuuaagaa

SEQ ID NO: 531724 - RNA, 23 nt, Human
ucucaggacacacaugucuauca

SEQ ID NO: 531725 - RNA, 22 nt, Human
ugccugugaucagcugaguuca

SEQ ID NO: 531726 - RNA, 22 nt, Human
gcugcugggaaugaacaguguu

SEQ ID NO: 531727 - RNA, 22 nt, Human
uuacagauucaagcucuuugaa

SEQ ID NO: 531728 - RNA, 22 nt, Human
caucacuguccucagcauucca

SEQ ID NO: 531729 - RNA, 22 nt, Human
uggcucugaccagguagaggag

SEQ ID NO: 531730 - RNA, 22 nt, Human
gccagcccagcuccaggggaaa

SEQ ID NO: 531731 - RNA, 22 nt, Human
cugccuggaaugccagcuucuc

SEQ ID NO: 531732 - RNA, 23 nt, Human
ucuuuucaaugguucuuuaugug

SEQ ID NO: 531733 - RNA, 22 nt, Human
uacacauuucucuuagagacac

SEQ ID NO: 531734 - RNA, 22 nt, Human
ugaguagagaauucagcuaagg

SEQ ID NO: 531735 - RNA, 22 nt, Human
agcuuuaucuucaccugggaau

SEQ ID NO: 531736 - RNA, 22 nt, Human
uuccaggagacuuccagaaaua

SEQ ID NO: 531737 - RNA, 22 nt, Human
agcaggaaggucugugugaguc

SEQ ID NO: 531738 - RNA, 22 nt, Human
uuuauccagaaucaggauuuuu

SEQ ID NO: 531739 - RNA, 22 nt, Human
agagacaaugccaaugcacacg

SEQ ID NO: 531740 - RNA, 22 nt, Human
caucaaagcuuuuuucuguguu

SEQ ID NO: 531741 - RNA, 23 nt, Human
acuuuauugaccccaggucaguu

SEQ ID NO: 531742 - RNA, 22 nt, Human
auuuucuauguuguaauuguua

SEQ ID NO: 531743 - RNA, 22 nt, Human
uccaggcauuccagccauucca

SEQ ID NO: 531744 - RNA, 19 nt, Human
gcuggggaauggauauuga

SEQ ID NO: 531745 - RNA, 22 nt, Human
acagagucuuacguggugauaa

SEQ ID NO: 531746 - RNA, 22 nt, Human
ggcaggugaguucauuaucugc

SEQ ID NO: 531747 - RNA, 22 nt, Human
aaaugguaaugucuuucuguuu

SEQ ID NO: 531748 - RNA, 22 nt, Human
cuauugaauuaacuauuaaagu

SEQ ID NO: 531749 - RNA, 22 nt, Human
gaguuauuucagaaggaaagau

SEQ ID NO: 531750 - RNA, 17 nt, Human
auucucaguguacagug

SEQ ID NO: 531751 - RNA, 22 nt, Human
ugaaaucuucacuaagucucuu

SEQ ID NO: 531752 - RNA, 22 nt, Human
cccaggacucggcacucuccuu

SEQ ID NO: 531753 - RNA, 22 nt, Human
gccuucaggaggguuccagaca

SEQ ID NO: 531754 - RNA, 22 nt, Human
aagcuguucucuaaguuucaug

SEQ ID NO: 531755 - RNA, 22 nt, Human
cgugagcaaaauggacacuccc

SEQ ID NO: 531756 - RNA, 22 nt, Human
cccagcucuuccugggagcuaa

SEQ ID NO: 531757 - RNA, 22 nt, Human
aaguguuuacuuaaagucaugg

SEQ ID NO: 531758 - RNA, 22 nt, Human
guuugaaaguggcaaguccuug

SEQ ID NO: 531759 - RNA, 22 nt, Human
uggcccugcagaacuagccugg

SEQ ID NO: 531760 - RNA, 22 nt, Human
ccugucuggccaccagggcgau

SEQ ID NO: 531761 - RNA, 22 nt, Human
aaagaggaaccaagagcacgug

SEQ ID NO: 531762 - RNA, 22 nt, Human
uugguucaggacauauuugagu

SEQ ID NO: 531763 - RNA, 20 nt, Human
ccucaagcagacugacagcu

SEQ ID NO: 531764 - RNA, 22 nt, Human
ugacauuuaucuucuacaauga

SEQ ID NO: 531765 - RNA, 22 nt, Human
guggauggacaugggcaagagg

SEQ ID NO: 531766 - RNA, 22 nt, Human
ucugcagcuucuugccagagag

SEQ ID NO: 531767 - RNA, 22 nt, Human
aucagaagcuuguagucucucu

SEQ ID NO: 531768 - RNA, 22 nt, Human
cggagaggaccugcaacucgcu

SEQ ID NO: 531769 - RNA, 22 nt, Human
ccugccagucacuaugucaccu

SEQ ID NO: 531770 - RNA, 22 nt, Human
uuacuugauuguggagucugag

SEQ ID NO: 531771 - RNA, 22 nt, Human
guuucuaauuggaacuuugagg

SEQ ID NO: 531772 - RNA, 22 nt, Human
ccagcucuggcuucuugcuggg

SEQ ID NO: 531773 - RNA, 22 nt, Human
gcuggggaccagcugucucuga

SEQ ID NO: 531774 - RNA, 22 nt, Human
ggccauggaccccgagcugacc

SEQ ID NO: 531775 - RNA, 22 nt, Human
uuuccaaagcugaguugagcaa

SEQ ID NO: 531776 - RNA, 22 nt, Human
ugagcuggucuugaguguagcu

SEQ ID NO: 531777 - RNA, 22 nt, Human
gucuaaaccucaaaucaguguc

SEQ ID NO: 531778 - RNA, 22 nt, Human
ugaaugaaugaauuaauagagu

SEQ ID NO: 531779 - RNA, 22 nt, Human
uaacaaagguugccaaacuaag

SEQ ID NO: 531780 - RNA, 22 nt, Human
agagccugcagcugugaagaaa

SEQ ID NO: 531781 - RNA, 22 nt, Human
aguggcagagugcacucaggca

SEQ ID NO: 531782 - RNA, 22 nt, Human
gcugucaggccaugugggccuu

SEQ ID NO: 531783 - RNA, 22 nt, Human
cccagggaagggcuaccugagg

SEQ ID NO: 531784 - RNA, 20 nt, Human
cccuuuaagcuuuaguaugc

SEQ ID NO: 531785 - RNA, 23 nt, Human
ugucaucuccagacucccagugc

SEQ ID NO: 531786 - RNA, 22 nt, Human
acauucuagaagucuuugcaau

SEQ ID NO: 531787 - RNA, 22 nt, Human
ucccagggacaccaagcuguuu

SEQ ID NO: 531788 - RNA, 22 nt, Human
ugugggaggaauuagaauggga

SEQ ID NO: 531789 - RNA, 22 nt, Human
uuugaacagggaauguuccaca

SEQ ID NO: 531790 - RNA, 22 nt, Human
gagcucugacugcugggugaca

SEQ ID NO: 531791 - RNA, 22 nt, Human
uuguuuucacagcuuugcccgg

SEQ ID NO: 531792 - RNA, 22 nt, Human
auccuugagaaaauaaaugacc

SEQ ID NO: 531793 - RNA, 22 nt, Human
gccaggcugcuggcugcugucc

SEQ ID NO: 531794 - RNA, 22 nt, Human
agcaggaaggcuuuggggguuc

SEQ ID NO: 531795 - RNA, 22 nt, Human
caugccucugcagcuguuuauu

SEQ ID NO: 531796 - RNA, 22 nt, Human
gggcccugcguccggaagucug

SEQ ID NO: 531797 - RNA, 22 nt, Human
acuugcauuauauuuaucacaa

SEQ ID NO: 531798 - RNA, 19 nt, Human
agugguagaugagcaggag

SEQ ID NO: 531799 - RNA, 22 nt, Human
agcaggcuccaggcuggccauc

SEQ ID NO: 531800 - RNA, 22 nt, Human
ccagcugggauuaagggaaaau

SEQ ID NO: 531801 - RNA, 22 nt, Human
aagcagaauuucccacuaguug

SEQ ID NO: 531802 - RNA, 22 nt, Human
uggccucugcaauggauucacc

SEQ ID NO: 531803 - RNA, 19 nt, Human
uggggccuccugucccugg

SEQ ID NO: 531804 - RNA, 22 nt, Human
aauuuguuacacagcaauauaa

SEQ ID NO: 531805 - RNA, 22 nt, Human
gccuuccuuacaccugcucagc

SEQ ID NO: 531806 - RNA, 22 nt, Human
ugcagagggacagccacagcuc

SEQ ID NO: 531807 - RNA, 19 nt, Human
ccagcccacagugacuuuc

SEQ ID NO: 531808 - RNA, 22 nt, Human
ggccagaggccauccuccugcu

SEQ ID NO: 531809 - RNA, 22 nt, Human
ccaggagucuggaugagguguc

SEQ ID NO: 531810 - RNA, 19 nt, Human
aggcagucauuggaauaua

SEQ ID NO: 531811 - RNA, 22 nt, Human
cccugugccuaguuggccuaaa

SEQ ID NO: 531812 - RNA, 22 nt, Human
ucauuucagaugcauuuagaau

SEQ ID NO: 531813 - RNA, 22 nt, Human
uuugcauuugcaaauaaugaaa

SEQ ID NO: 531814 - RNA, 22 nt, Human
cauuuaaucuggcucaugagca

SEQ ID NO: 531815 - RNA, 18 nt, Human
gcccugguggagcuggug

SEQ ID NO: 531816 - RNA, 22 nt, Human
aaaaguuuaagacucauucuag

SEQ ID NO: 531817 - RNA, 22 nt, Human
cuggagugaagucuggcagcuu

SEQ ID NO: 531818 - RNA, 21 nt, Human
ggccuuggcgggggccgaauu

SEQ ID NO: 531819 - RNA, 22 nt, Human
aagagcuggaagugaagauaac

SEQ ID NO: 531820 - RNA, 23 nt, Human
uguggccugcagcucugguuugg

SEQ ID NO: 531821 - RNA, 23 nt, Human
agaauuucuaacucuagcucugu

SEQ ID NO: 531822 - RNA, 22 nt, Human
auugacaauguauuuguaucug

SEQ ID NO: 531823 - RNA, 22 nt, Human
ggcauguuucaucacaucaaga

SEQ ID NO: 531824 - RNA, 22 nt, Human
cucacugugaccucagcagaca

SEQ ID NO: 531825 - RNA, 22 nt, Human
agccucuggcccuagacugcuu

SEQ ID NO: 531826 - RNA, 22 nt, Human
agggcaguucaacuucauagug

SEQ ID NO: 531827 - RNA, 22 nt, Human
gccuggagaauuaaaaggaagg

SEQ ID NO: 531828 - RNA, 22 nt, Human
uaacaguaccauuaacuuugau

SEQ ID NO: 531829 - RNA, 22 nt, Human
gaggaagcagggcuuggcugag

SEQ ID NO: 531830 - RNA, 22 nt, Human
uuuccaaagguggcaggaacaa

SEQ ID NO: 531831 - RNA, 18 nt, Human
gucaccuggaucagauua

SEQ ID NO: 531832 - RNA, 22 nt, Human
aguacauauaguaauuuagcca

SEQ ID NO: 531833 - RNA, 22 nt, Human
uuugcauuaguuuagauuucaa

SEQ ID NO: 531834 - RNA, 22 nt, Human
agggcagcacagcugugcuccu

SEQ ID NO: 531835 - RNA, 22 nt, Human
agcaggagagcagugcgugguc

SEQ ID NO: 531836 - RNA, 22 nt, Human
agaauaauacugaaaugcugaa

SEQ ID NO: 531837 - RNA, 22 nt, Human
uguguacucaauugagccauuu

SEQ ID NO: 531838 - RNA, 22 nt, Human
gauggggaugagaagugagcag

SEQ ID NO: 531839 - RNA, 22 nt, Human
ugaaagcagcaccaauaccauu

SEQ ID NO: 531840 - RNA, 22 nt, Human
ugagaacaaaguugaaaguuug

SEQ ID NO: 531841 - RNA, 22 nt, Human
augauuuuuucuaacacagucg

SEQ ID NO: 531842 - RNA, 22 nt, Human
caaaugauacuguuuuuagucu

SEQ ID NO: 531843 - RNA, 22 nt, Human
aggggagcuugaggcauggccu

SEQ ID NO: 531844 - RNA, 22 nt, Human
ucuucacaggagccugccugcc

SEQ ID NO: 531845 - RNA, 22 nt, Human
cugccucucaggucccugagau

SEQ ID NO: 531846 - RNA, 23 nt, Human
agucacaucuuagcagccagguc

SEQ ID NO: 531847 - RNA, 22 nt, Human
caaaauuagaaaugcagcuguu

SEQ ID NO: 531848 - RNA, 22 nt, Human
gugggcagugguuugcgcgguc

SEQ ID NO: 531849 - RNA, 22 nt, Human
caccugcugagcugcugggggu

SEQ ID NO: 531850 - RNA, 22 nt, Human
gcuggcugaggucuagcucuuu

SEQ ID NO: 531851 - RNA, 22 nt, Human
uuauuuauguuaacagucgaga

SEQ ID NO: 531852 - RNA, 22 nt, Human
auguguccacaggugugagaga

SEQ ID NO: 531853 - RNA, 22 nt, Human
acaacaaaaugaggaagugguc

SEQ ID NO: 531854 - RNA, 22 nt, Human
agcaaaagauagauuaacaaga

SEQ ID NO: 531855 - RNA, 22 nt, Human
gugggagcauggucccagugcc

SEQ ID NO: 531856 - RNA, 22 nt, Human
gagcuggugaucagcuggagga

SEQ ID NO: 531857 - RNA, 22 nt, Human
uguucuggagauaagagguaga

SEQ ID NO: 531858 - RNA, 18 nt, Human
aauguuuguccucucuaa

SEQ ID NO: 531859 - RNA, 22 nt, Human
uugauacccaaguguuaugggu

SEQ ID NO: 531860 - RNA, 22 nt, Human
ccaaggagcaaggcucaacaag

SEQ ID NO: 531861 - RNA, 22 nt, Human
agguggguaucaugagagauua

SEQ ID NO: 531862 - RNA, 22 nt, Human
ucugucugagggagugacauuu

SEQ ID NO: 531863 - RNA, 22 nt, Human
uucaaaauuguucuaagcucug

SEQ ID NO: 531864 - RNA, 22 nt, Human
ucugggcagcagcagcuaguag

SEQ ID NO: 531865 - RNA, 22 nt, Human
gggcacuggaaggcucucaggc

SEQ ID NO: 531866 - RNA, 22 nt, Human
uugucuaaugagcuccacuuca

SEQ ID NO: 531867 - RNA, 22 nt, Human
gggucccaggaaggagcagugu

SEQ ID NO: 531868 - RNA, 22 nt, Human
uugaaaaccgugggaggcugaa

SEQ ID NO: 531869 - RNA, 22 nt, Human
ccagagccuaagaucugauccu

SEQ ID NO: 531870 - RNA, 22 nt, Human
ggcagccagagggcagcuggau

SEQ ID NO: 531871 - RNA, 22 nt, Human
ugcucuguaaggucagaaaagg

SEQ ID NO: 531872 - RNA, 22 nt, Human
ccagaaagguaaacacuggauu

SEQ ID NO: 531873 - RNA, 22 nt, Human
uucccacaguguugaauccucu

SEQ ID NO: 531874 - RNA, 22 nt, Human
gucccagaaacauauugcuggu

SEQ ID NO: 531875 - RNA, 22 nt, Human
uucuaagauucaugaggacagg

SEQ ID NO: 531876 - RNA, 22 nt, Human
aggaagccuggggcugcccucg

SEQ ID NO: 531877 - RNA, 22 nt, Human
uguuugugcugccuggugggca

SEQ ID NO: 531878 - RNA, 22 nt, Human
gcagugguggagcuuacauauc

SEQ ID NO: 531879 - RNA, 19 nt, Human
uauauuugagugugcaugc

SEQ ID NO: 531880 - RNA, 22 nt, Human
ugcaggcuccacguuguugucc

SEQ ID NO: 531881 - RNA, 23 nt, Human
aggagccaggugcagcccuugug

SEQ ID NO: 531882 - RNA, 22 nt, Human
gaaaauguuuguccggagcuga

SEQ ID NO: 531883 - RNA, 22 nt, Human
ucauggaaacagcaaugcuaau

SEQ ID NO: 531884 - RNA, 22 nt, Human
uccagugguuugaaaggggugu

SEQ ID NO: 531885 - RNA, 22 nt, Human
ucuaagaucuacuauacaugug

SEQ ID NO: 531886 - RNA, 22 nt, Human
cuucaaagauuauugaaaacaa

SEQ ID NO: 531887 - RNA, 22 nt, Human
uggcagcagggaggccaguguu

SEQ ID NO: 531888 - RNA, 22 nt, Human
acuuccaaauaccaucacauug

SEQ ID NO: 531889 - RNA, 22 nt, Human
acugaugucuggggcagagucu

SEQ ID NO: 531890 - RNA, 22 nt, Human
aaagaaauagauggcauuuaaa

SEQ ID NO: 531891 - RNA, 22 nt, Human
ccaggaaagaggaagaacgcau

SEQ ID NO: 531892 - RNA, 18 nt, Human
ggcucagcaggcucucuc

SEQ ID NO: 531893 - RNA, 22 nt, Human
gccaaagcagucuugccucugc

SEQ ID NO: 531894 - RNA, 22 nt, Human
cuguggcuuucucugccuccuu

SEQ ID NO: 531895 - RNA, 22 nt, Human
aaggccugcucagcugucugug

SEQ ID NO: 531896 - RNA, 22 nt, Human
ucugggcuuuugcacuggccau

SEQ ID NO: 531897 - RNA, 22 nt, Human
gaauucugguuuugaaaugaau

SEQ ID NO: 531898 - RNA, 22 nt, Human
ccuuucucuaucgacccaucgc

SEQ ID NO: 531899 - RNA, 22 nt, Human
gcugccugaaugaaccuuguuc

SEQ ID NO: 531900 - RNA, 22 nt, Human
aauaccuuuccugccauucacu

SEQ ID NO: 531901 - RNA, 22 nt, Human
uaauuauucuagucacauagca

SEQ ID NO: 531902 - RNA, 22 nt, Human
ccagagcccagggucaugcagg

SEQ ID NO: 531903 - RNA, 22 nt, Human
uuacaaagcaggucagcugaaa

SEQ ID NO: 531904 - RNA, 22 nt, Human
cccaggcagugugugcaugcgu

SEQ ID NO: 531905 - RNA, 22 nt, Human
auuuacuuugcugagauccauc

SEQ ID NO: 531906 - RNA, 22 nt, Human
gauggcaggcaggugaguagag

SEQ ID NO: 531907 - RNA, 22 nt, Human
gagcccagguucugcuuccagc

SEQ ID NO: 531908 - RNA, 22 nt, Human
uuucagagucagcuccucucua

SEQ ID NO: 531909 - RNA, 21 nt, Human
uguuccuguucucuaggaucc

SEQ ID NO: 531910 - RNA, 22 nt, Human
guggcagagguuccucagugug

SEQ ID NO: 531911 - RNA, 22 nt, Human
ucccacaccugucuauuccuag

SEQ ID NO: 531912 - RNA, 22 nt, Human
accaucaguacuggaugcugac

SEQ ID NO: 531913 - RNA, 22 nt, Human
gggaggucagggugccugcugg

SEQ ID NO: 531914 - RNA, 22 nt, Human
uugaaaguuuauggagucugca

SEQ ID NO: 531915 - RNA, 23 nt, Human
ugaguucucaucuuggcuucuau

SEQ ID NO: 531916 - RNA, 18 nt, Human
cagaggagagacauucag

SEQ ID NO: 531917 - RNA, 22 nt, Human
cuuguccuuuacuugagacuca

SEQ ID NO: 531918 - RNA, 22 nt, Human
agggccaggaacaccugaaggg

SEQ ID NO: 531919 - RNA, 22 nt, Human
cugcugugaguuuggaggucua

SEQ ID NO: 531920 - RNA, 22 nt, Human
aaguccagaacuccugugauag

SEQ ID NO: 531921 - RNA, 22 nt, Human
gccagccugugcuuggccaggc

SEQ ID NO: 531922 - RNA, 22 nt, Human
uucauuccuucccuaagcaacu

SEQ ID NO: 531923 - RNA, 22 nt, Human
auuuugcuggucugaauuacuu

SEQ ID NO: 531924 - RNA, 22 nt, Human
agugcaugccuuccuguggaug

SEQ ID NO: 531925 - RNA, 22 nt, Human
ucuggagagucacagugccaga

SEQ ID NO: 531926 - RNA, 16 nt, Human
cuacccagugagaagg

SEQ ID NO: 531927 - RNA, 22 nt, Human
aggcacugggaauaugcugagg

SEQ ID NO: 531928 - RNA, 22 nt, Human
caggcagcugggucaccguccc

SEQ ID NO: 531929 - RNA, 22 nt, Human
uccagaaaauuuuacagugccu

SEQ ID NO: 531930 - RNA, 22 nt, Human
aguguccuccucugggagccag

SEQ ID NO: 531931 - RNA, 22 nt, Human
uuugcaaaguccauugaaguua

SEQ ID NO: 531932 - RNA, 22 nt, Human
aggaaaaagaguugcugccuuc

SEQ ID NO: 531933 - RNA, 22 nt, Human
gaggcaggcagauugcuugagg

SEQ ID NO: 531934 - RNA, 22 nt, Human
uguguauuucuggaacagacua

SEQ ID NO: 531935 - RNA, 22 nt, Human
ucacgugagggaccugugucug

SEQ ID NO: 531936 - RNA, 22 nt, Human
gggaguggauuauguggaccca

SEQ ID NO: 531937 - RNA, 22 nt, Human
uacauuacaggaaagauaaaga

SEQ ID NO: 531938 - RNA, 22 nt, Human
caauagaaaacucaauacuuaa

SEQ ID NO: 531939 - RNA, 21 nt, Human
aggugcagagccagggaccag

SEQ ID NO: 531940 - RNA, 22 nt, Human
acacaaacagucuauagcacca

SEQ ID NO: 531941 - RNA, 22 nt, Human
ucuuuucugccagcugagcccu

SEQ ID NO: 531942 - RNA, 22 nt, Human
uuacaaagagugccagagugug

SEQ ID NO: 531943 - RNA, 20 nt, Human
cccagagccauagccagaca

SEQ ID NO: 531944 - RNA, 22 nt, Human
auggaaauguaacuucugauuc

SEQ ID NO: 531945 - RNA, 22 nt, Human
guacaaaaguuauugcgguuuu

SEQ ID NO: 531946 - RNA, 22 nt, Human
guucacauccuugugaggauuu

SEQ ID NO: 531947 - RNA, 22 nt, Human
cagcccuggugccaagguuccc

SEQ ID NO: 531948 - RNA, 22 nt, Human
uacagcuugacccauaaugucu

SEQ ID NO: 531949 - RNA, 22 nt, Human
cauuugaugacucaacucauaa

SEQ ID NO: 531950 - RNA, 22 nt, Human
acagcaggauuuggcgauguug

SEQ ID NO: 531951 - RNA, 22 nt, Human
gaguggguccacagaggugaca

SEQ ID NO: 531952 - RNA, 22 nt, Human
cugccugaagaauuguguugca

SEQ ID NO: 531953 - RNA, 22 nt, Human
ugcccaugcaugacagauggcu

SEQ ID NO: 531954 - RNA, 22 nt, Human
gcagggucuugagaggcagcca

SEQ ID NO: 531955 - RNA, 22 nt, Human
ucauggauggccgggaggugau

SEQ ID NO: 531956 - RNA, 22 nt, Human
ccugcagguugcagaggcggaa

SEQ ID NO: 531957 - RNA, 17 nt, Human
ugcaggcuccugucccu

SEQ ID NO: 531958 - RNA, 21 nt, Human
uauuugcugccaucuuugagg

SEQ ID NO: 531959 - RNA, 22 nt, Human
gcuaagggacccuuucuaaugu

SEQ ID NO: 531960 - RNA, 23 nt, Human
ggggaaagaccaugcuugaggac

SEQ ID NO: 531961 - RNA, 22 nt, Human
aggaagcaccggaaugaugacu

SEQ ID NO: 531962 - RNA, 21 nt, Human
gguugguguguccaguggcca

SEQ ID NO: 531963 - RNA, 22 nt, Human
ucuccaggccuuucccaucuua

SEQ ID NO: 531964 - RNA, 22 nt, Human
cagagccaggccugcccucuuu

SEQ ID NO: 531965 - RNA, 22 nt, Human
gcuucucucucagacugcaagc

SEQ ID NO: 531966 - RNA, 16 nt, Human
gaaggagauucagaaa

SEQ ID NO: 531967 - RNA, 22 nt, Human
cacagaaaaaggcuugaaaauc

SEQ ID NO: 531968 - RNA, 23 nt, Human
ucauuucauccagccuugagagu

SEQ ID NO: 531969 - RNA, 22 nt, Human
agagucccagggacacuccaga

SEQ ID NO: 531970 - RNA, 22 nt, Human
uuucuucaauugcuaacaagga

SEQ ID NO: 531971 - RNA, 22 nt, Human
ugaaagaagugucacauugcca

SEQ ID NO: 531972 - RNA, 22 nt, Human
ggagucaggagcaggcugggcu

SEQ ID NO: 531973 - RNA, 22 nt, Human
gggagggaggugaugcuuggcu

SEQ ID NO: 531974 - RNA, 23 nt, Human
uggaagcaguuccagcacaaaua

SEQ ID NO: 531975 - RNA, 22 nt, Human
gacauuuguuccucuaagugac

SEQ ID NO: 531976 - RNA, 22 nt, Human
ucucuggaauuggcugaggcaa

SEQ ID NO: 531977 - RNA, 22 nt, Human
uucuuacaaguaugacguagca

SEQ ID NO: 531978 - RNA, 22 nt, Human
cuuuuuccagcuucaggguggg

SEQ ID NO: 531979 - RNA, 22 nt, Human
uuucuucuccauggcagguccu

SEQ ID NO: 531980 - RNA, 22 nt, Human
ucaauuauuuuggcuaugcuaa

SEQ ID NO: 531981 - RNA, 18 nt, Human
acagaacucaggggcacc

SEQ ID NO: 531982 - RNA, 22 nt, Human
augaaaauguacauguguauaa

SEQ ID NO: 531983 - RNA, 21 nt, Human
cuucaauucaacacugccaug

SEQ ID NO: 531984 - RNA, 22 nt, Human
gccugagaaggacacagcaggu

SEQ ID NO: 531985 - RNA, 22 nt, Human
uuccucagccagcacuuagggg

SEQ ID NO: 531986 - RNA, 22 nt, Human
ucaucucaaaacccaaggggca

SEQ ID NO: 531987 - RNA, 22 nt, Human
auguuucagauacagaucaaau

SEQ ID NO: 531988 - RNA, 22 nt, Human
uguuccugaaugccuggcuggc

SEQ ID NO: 531989 - RNA, 22 nt, Human
aucaggauuauuaaaucuggau

SEQ ID NO: 531990 - RNA, 22 nt, Human
uaaggguucagaaugcaguggu

SEQ ID NO: 531991 - RNA, 22 nt, Human
auggaaaaggcugauuucauua

SEQ ID NO: 531992 - RNA, 22 nt, Human
aaucagaauuuguccccugagu

SEQ ID NO: 531993 - RNA, 22 nt, Human
gcagcuguggguuccaagucua

SEQ ID NO: 531994 - RNA, 22 nt, Human
ugagaaauccagaugugcaguu

SEQ ID NO: 531995 - RNA, 22 nt, Human
ugggaagggagaguguccugga

SEQ ID NO: 531996 - RNA, 22 nt, Human
cucacagaugcugugggucagg

SEQ ID NO: 531997 - RNA, 22 nt, Human
cauuuguaucauauguaucuua

SEQ ID NO: 531998 - RNA, 22 nt, Human
accagagcuuacaugcuagaaa

SEQ ID NO: 531999 - RNA, 22 nt, Human
aaacuguauauuuauggcaugu

SEQ ID NO: 532000 - RNA, 22 nt, Human
aagcaggcauuccagagacaau

SEQ ID NO: 532001 - RNA, 22 nt, Human
gcugucccgcugacuuccagcu

SEQ ID NO: 532002 - RNA, 22 nt, Human
ugcaguuuugccaggcaaugga

SEQ ID NO: 532003 - RNA, 22 nt, Human
uaccaaauguaaucauucuaau

SEQ ID NO: 532004 - RNA, 19 nt, Human
ugaggccaaggucacagau

SEQ ID NO: 532005 - RNA, 22 nt, Human
aucuuucaaucaggaaaaaucu

SEQ ID NO: 532006 - RNA, 22 nt, Human
gucacuggggccacaugcagaa

SEQ ID NO: 532007 - RNA, 22 nt, Human
ucuguccuguuuccuccugaca

SEQ ID NO: 532008 - RNA, 22 nt, Human
aguggggccgcgguccugcccu

SEQ ID NO: 532009 - RNA, 22 nt, Human
caggagccccaggcugacaaua

SEQ ID NO: 532010 - RNA, 23 nt, Human
uggagcugacagucagagggagg

SEQ ID NO: 532011 - RNA, 21 nt, Human
agaagccaugugguggagaac

SEQ ID NO: 532012 - RNA, 22 nt, Human
auguuuuaugcuucagaugagg

SEQ ID NO: 532013 - RNA, 22 nt, Human
ugucacuucaggaaugcaggga

SEQ ID NO: 532014 - RNA, 19 nt, Human
gcacacccugcaccaccau

SEQ ID NO: 532015 - RNA, 20 nt, Human
caggcagaggaugcugacca

SEQ ID NO: 532016 - RNA, 22 nt, Human
agggcugcaggcaagauauggc

SEQ ID NO: 532017 - RNA, 22 nt, Human
ggcugcagaaguacuuccggau

SEQ ID NO: 532018 - RNA, 22 nt, Human
ugccucugguuaucugguaccu

SEQ ID NO: 532019 - RNA, 22 nt, Human
uggccuccccuaacagccucuu

SEQ ID NO: 532020 - RNA, 22 nt, Human
gagaagcaaucaguggccaccc

SEQ ID NO: 532021 - RNA, 22 nt, Human
ucucccaagugaccaggaaaga

SEQ ID NO: 532022 - RNA, 22 nt, Human
uaacagaaaggcucaggugcuc

SEQ ID NO: 532023 - RNA, 22 nt, Human
cuauaagacagauacugacuuu

SEQ ID NO: 532024 - RNA, 22 nt, Human
cacagcccugcgccccaguuug

SEQ ID NO: 532025 - RNA, 22 nt, Human
gggcuggagccuggcggugguu

SEQ ID NO: 532026 - RNA, 17 nt, Human
aggugcuggagcaucag

SEQ ID NO: 532027 - RNA, 22 nt, Human
ucauaaaaauagacucuaaagu

SEQ ID NO: 532028 - RNA, 22 nt, Human
ccugagugcuuccagagucaug

SEQ ID NO: 532029 - RNA, 22 nt, Human
uaugaagaaaucuuugaaaauc

SEQ ID NO: 532030 - RNA, 22 nt, Human
cccuggaagguucucuggcuca

SEQ ID NO: 532031 - RNA, 22 nt, Human
agggcucacuacaacccuggga

SEQ ID NO: 532032 - RNA, 22 nt, Human
ugaggcuguucuaccagggcca

SEQ ID NO: 532033 - RNA, 22 nt, Human
aaagucauacauggugcuuacu

SEQ ID NO: 532034 - RNA, 22 nt, Human
cuguuaaucugcuugcaugaug

SEQ ID NO: 532035 - RNA, 22 nt, Human
ugcaguggcgccaucucagcuc

SEQ ID NO: 532036 - RNA, 22 nt, Human
uuuccuuccagguuccuaaggc

SEQ ID NO: 532037 - RNA, 22 nt, Human
agaaaaacacaaucgggccucc

SEQ ID NO: 532038 - RNA, 22 nt, Human
ucaucaguuuagaaaaaauaug

SEQ ID NO: 532039 - RNA, 22 nt, Human
acuggggagagucaugccagca

SEQ ID NO: 532040 - RNA, 22 nt, Human
agggaagugaaugacagauauc

SEQ ID NO: 532041 - RNA, 22 nt, Human
gaggggcugcccuggugucagg

SEQ ID NO: 532042 - RNA, 22 nt, Human
acugggcucccaggcuugucau

SEQ ID NO: 532043 - RNA, 22 nt, Human
ugugggcuguacugagggcagg

SEQ ID NO: 532044 - RNA, 22 nt, Human
ucauugaacgaagagcuccauu

SEQ ID NO: 532045 - RNA, 22 nt, Human
guucauauuacuuugagugcag

SEQ ID NO: 532046 - RNA, 22 nt, Human
gccauuaaugagaucaagaauc

SEQ ID NO: 532047 - RNA, 22 nt, Human
auagugguuggauaugucagag

SEQ ID NO: 532048 - RNA, 22 nt, Human
cacagggcagguacucucagag

SEQ ID NO: 532049 - RNA, 22 nt, Human
agcuuccuguugagagagggag

SEQ ID NO: 532050 - RNA, 22 nt, Human
ugugcuucagguugucgccacg

SEQ ID NO: 532051 - RNA, 22 nt, Human
cagcugccugcaacacaagcuu

SEQ ID NO: 532052 - RNA, 22 nt, Human
gcagguggggcugcuaccagaa

SEQ ID NO: 532053 - RNA, 22 nt, Human
aaucagaacuccuaccacagag

SEQ ID NO: 532054 - RNA, 22 nt, Human
gucagcuaggcagcugcgaugg

SEQ ID NO: 532055 - RNA, 22 nt, Human
ccaggaagccucagaugcugag

SEQ ID NO: 532056 - RNA, 22 nt, Human
uaaaacuagaccgugagucuaa

SEQ ID NO: 532057 - RNA, 22 nt, Human
agugcaaacuuuauugugaccu

SEQ ID NO: 532058 - RNA, 22 nt, Human
ggucucagcaguugcuuugacu

SEQ ID NO: 532059 - RNA, 22 nt, Human
aaguaacaaugcuguugaauug

SEQ ID NO: 532060 - RNA, 22 nt, Human
acacauuugcauaauaccucau

SEQ ID NO: 532061 - RNA, 22 nt, Human
guuucuuagguaaauucuuuga

SEQ ID NO: 532062 - RNA, 22 nt, Human
uuuuuuccagcuucuagaggcc

SEQ ID NO: 532063 - RNA, 19 nt, Human
agguggucuaggcuggaga

SEQ ID NO: 532064 - RNA, 22 nt, Human
cugggcaguuuauucaguucug

SEQ ID NO: 532065 - RNA, 22 nt, Human
gcucugagccgggggccugucc

SEQ ID NO: 532066 - RNA, 21 nt, Human
ccuggcuucagggugcacugg

SEQ ID NO: 532067 - RNA, 22 nt, Human
gugaagcauaugcuucucugcc

SEQ ID NO: 532068 - RNA, 22 nt, Human
aaagaugucaguuugaaauaac

SEQ ID NO: 532069 - RNA, 22 nt, Human
cuauugaaaguguacaauucaa

SEQ ID NO: 532070 - RNA, 22 nt, Human
cagagguguuggugaauggaga

SEQ ID NO: 532071 - RNA, 22 nt, Human
cauuuacauuuaagguuaauau

SEQ ID NO: 532072 - RNA, 22 nt, Human
cacagaggaaaggcaguuggua

SEQ ID NO: 532073 - RNA, 23 nt, Human
agccacuucuaucuugcuccugg

SEQ ID NO: 532074 - RNA, 22 nt, Human
uuacuugacauaaaugaguuua

SEQ ID NO: 532075 - RNA, 20 nt, Human
uucuauacauaucacugaaa

SEQ ID NO: 532076 - RNA, 22 nt, Human
uauuccagguauucuucaagag

SEQ ID NO: 532077 - RNA, 21 nt, Human
ccccugggagcccugucagua

SEQ ID NO: 532078 - RNA, 22 nt, Human
ugggccuggcccuguggaggag

SEQ ID NO: 532079 - RNA, 22 nt, Human
aacaaacaaacauuuugucauc

SEQ ID NO: 532080 - RNA, 22 nt, Human
agaguuggagaaauuaaaauuu

SEQ ID NO: 532081 - RNA, 22 nt, Human
gaagaucaagugucauucugug

SEQ ID NO: 532082 - RNA, 22 nt, Human
gaaauacaaagccagccauuuu

SEQ ID NO: 532083 - RNA, 22 nt, Human
agaaauacuuuguaaaucucac

SEQ ID NO: 532084 - RNA, 22 nt, Human
aguaaaaucuuaagcacagugg

SEQ ID NO: 532085 - RNA, 22 nt, Human
uauacaguuaaguuucuucagu

SEQ ID NO: 532086 - RNA, 22 nt, Human
ucagggaaaccuaaggaagcca

SEQ ID NO: 532087 - RNA, 22 nt, Human
gugguccuuacaggaggcuuac

SEQ ID NO: 532088 - RNA, 20 nt, Human
auaugcugagugaaggcaga

SEQ ID NO: 532089 - RNA, 22 nt, Human
gugaaaaaucaucaugacuuga

SEQ ID NO: 532090 - RNA, 22 nt, Human
gaucaccaguuguagguauuuu

SEQ ID NO: 532091 - RNA, 22 nt, Human
cugaauaucauuuacauuugga

SEQ ID NO: 532092 - RNA, 22 nt, Human
gccuuccugcagcucugagcgu

SEQ ID NO: 532093 - RNA, 22 nt, Human
cagauuuaccuaacuccaaguu

SEQ ID NO: 532094 - RNA, 22 nt, Human
aaauaacuuucuguguauaguc

SEQ ID NO: 532095 - RNA, 22 nt, Human
agcacuuuaagcaacagaucaa

SEQ ID NO: 532096 - RNA, 22 nt, Human
uuugagguuagcuagcagauca

SEQ ID NO: 532097 - RNA, 22 nt, Human
ucagccagguaauguggagaug

SEQ ID NO: 532098 - RNA, 22 nt, Human
cuggcagguggauggggacucc

SEQ ID NO: 532099 - RNA, 22 nt, Human
uuugucaauaacuaccaacagg

SEQ ID NO: 532100 - RNA, 22 nt, Human
agcaggugucggcgagggucuu

SEQ ID NO: 532101 - RNA, 22 nt, Human
uacaagauaagaauuggcaagg

SEQ ID NO: 532102 - RNA, 22 nt, Human
gcaaauacauguugagcaccua

SEQ ID NO: 532103 - RNA, 22 nt, Human
cgugggccccagccacucccuc

SEQ ID NO: 532104 - RNA, 22 nt, Human
aaggcauagucuuuaaguucug

SEQ ID NO: 532105 - RNA, 22 nt, Human
uuccucagaaaauacuguccaa

SEQ ID NO: 532106 - RNA, 20 nt, Human
ggcucuggaaucuggugggc

SEQ ID NO: 532107 - RNA, 22 nt, Human
ugaagccaucaggaagccagca

SEQ ID NO: 532108 - RNA, 22 nt, Human
cuauuauuagauaaucuacuug

SEQ ID NO: 532109 - RNA, 22 nt, Human
ggcaggagcucuccaguuugcc

SEQ ID NO: 532110 - RNA, 22 nt, Human
ugcagggcccucauuccugucc

SEQ ID NO: 532111 - RNA, 22 nt, Human
aacacuguggucuuuucaguaa

SEQ ID NO: 532112 - RNA, 22 nt, Human
uuuaaaaggcagcuucuuuugu

SEQ ID NO: 532113 - RNA, 22 nt, Human
uggcaguccucuuccucgggcg

SEQ ID NO: 532114 - RNA, 22 nt, Human
ugaaaucaguaugucuuucuca

SEQ ID NO: 532115 - RNA, 22 nt, Human
ugcuuuauguuaucagaagggu

SEQ ID NO: 532116 - RNA, 20 nt, Human
ggggcagguuuuuauggcua

SEQ ID NO: 532117 - RNA, 22 nt, Human
aucaguuuggaacauucaggcc

SEQ ID NO: 532118 - RNA, 22 nt, Human
caggggaagaugccaagggaga

SEQ ID NO: 532119 - RNA, 22 nt, Human
ugcaggugucucugucuagcgu

SEQ ID NO: 532120 - RNA, 22 nt, Human
ugagcugggcugggcugagcug

SEQ ID NO: 532121 - RNA, 22 nt, Human
uucuugauucuuccuugaagga

SEQ ID NO: 532122 - RNA, 22 nt, Human
cugggcacaggggagcagaguc

SEQ ID NO: 532123 - RNA, 22 nt, Human
ggaugcaggaguugaagaagga

SEQ ID NO: 532124 - RNA, 22 nt, Human
agagggcuuugauucucaguuc

SEQ ID NO: 532125 - RNA, 22 nt, Human
uggcucuggugcgggcuccugc

SEQ ID NO: 532126 - RNA, 22 nt, Human
ugguacauaaauggauguuuuc

SEQ ID NO: 532127 - RNA, 22 nt, Human
ucagggaacaauguuauggcuu

SEQ ID NO: 532128 - RNA, 22 nt, Human
gauuaaguaacugaacacuuug

SEQ ID NO: 532129 - RNA, 22 nt, Human
gaaggagagggucaaggauaau

SEQ ID NO: 532130 - RNA, 22 nt, Human
gcccauggacacccaagugcca

SEQ ID NO: 532131 - RNA, 22 nt, Human
caguguguggauugcccuugca

SEQ ID NO: 532132 - RNA, 22 nt, Human
ucuacaaagaagaauuaauguc

SEQ ID NO: 532133 - RNA, 22 nt, Human
gcuggcuguaucaccuggccag

SEQ ID NO: 532134 - RNA, 22 nt, Human
gcuucugggguucuggcaugcu

SEQ ID NO: 532135 - RNA, 22 nt, Human
cugugcaaaggccuuauguuuu

SEQ ID NO: 532136 - RNA, 22 nt, Human
uuuguucacaugucauguacaa

SEQ ID NO: 532137 - RNA, 22 nt, Human
ccaggcucugccaggcccuuga

SEQ ID NO: 532138 - RNA, 22 nt, Human
guuagggagucagguggcucuu

SEQ ID NO: 532139 - RNA, 22 nt, Human
gagccagguuggaggcugcagu

SEQ ID NO: 532140 - RNA, 22 nt, Human
cagcucugcugggaggaugcag

SEQ ID NO: 532141 - RNA, 22 nt, Human
ggccucagagaaggcugugcgg

SEQ ID NO: 532142 - RNA, 22 nt, Human
aggcagagcugauguucuguga

SEQ ID NO: 532143 - RNA, 23 nt, Human
agggccugauggcucccgcuggc

SEQ ID NO: 532144 - RNA, 22 nt, Human
gagagucuagugcaccuaguuu

SEQ ID NO: 532145 - RNA, 22 nt, Human
ucagggcaggacaguguaggcc

SEQ ID NO: 532146 - RNA, 20 nt, Human
uaaaugcaugaauguaaggc

SEQ ID NO: 532147 - RNA, 22 nt, Human
caggaaagccgagugccauagg

SEQ ID NO: 532148 - RNA, 22 nt, Human
ugaggcucaagaauagacagua

SEQ ID NO: 532149 - RNA, 22 nt, Human
cuuccugguuugaagcucgccg

SEQ ID NO: 532150 - RNA, 22 nt, Human
augcaaugguauauggucaccu

SEQ ID NO: 532151 - RNA, 22 nt, Human
ucauauuuauauguuggcacag

SEQ ID NO: 532152 - RNA, 21 nt, Human
ugcaggcuguuuaagaggcaa

SEQ ID NO: 532153 - RNA, 22 nt, Human
gcucuguguugucagaggcacc

SEQ ID NO: 532154 - RNA, 22 nt, Human
ucuuugaauucaaacuguucaa

SEQ ID NO: 532155 - RNA, 22 nt, Human
cuucacagucuuuauuuccucc

SEQ ID NO: 532156 - RNA, 22 nt, Human
cauuuguaucugggcugcugug

SEQ ID NO: 532157 - RNA, 22 nt, Human
aaaauucuaacaugcagccaag

SEQ ID NO: 532158 - RNA, 22 nt, Human
gcucuggacuggggccugagaa

SEQ ID NO: 532159 - RNA, 19 nt, Human
ucauaaggagagaggaaau

SEQ ID NO: 532160 - RNA, 22 nt, Human
ccaggaggcggaagguacagug

SEQ ID NO: 532161 - RNA, 22 nt, Human
ugcugggcagugugcccucgag

SEQ ID NO: 532162 - RNA, 22 nt, Human
ccagcuuuccaggguugacugg

SEQ ID NO: 532163 - RNA, 20 nt, Human
uaaagcagccguggagggua

SEQ ID NO: 532164 - RNA, 22 nt, Human
aguuuagaguucaaauuaguuc

SEQ ID NO: 532165 - RNA, 22 nt, Human
gagagugauucccucccauaga

SEQ ID NO: 532166 - RNA, 22 nt, Human
cugucaacauuggugucuguca

SEQ ID NO: 532167 - RNA, 22 nt, Human
aauaugacauagaauugagaug

SEQ ID NO: 532168 - RNA, 22 nt, Human
gaggcgagaagcuggagauggu

SEQ ID NO: 532169 - RNA, 22 nt, Human
gcaggcaguugcaguuuucuag

SEQ ID NO: 532170 - RNA, 22 nt, Human
cuguggcugcguaggucuggca

SEQ ID NO: 532171 - RNA, 22 nt, Human
cagguggggcagcugugggagc

SEQ ID NO: 532172 - RNA, 22 nt, Human
agggaccuugauggguuuggga

SEQ ID NO: 532173 - RNA, 22 nt, Human
ggcugcugugaccucaggugau

SEQ ID NO: 532174 - RNA, 22 nt, Human
uggcugaaucugcagcaggaag

SEQ ID NO: 532175 - RNA, 22 nt, Human
uugaaagaacucuucagagaua

SEQ ID NO: 532176 - RNA, 22 nt, Human
gaaugugucacccugucccaug

SEQ ID NO: 532177 - RNA, 22 nt, Human
ucaaaggcuugugguucuggga

SEQ ID NO: 532178 - RNA, 19 nt, Human
gcgaggaagucacuguggu

SEQ ID NO: 532179 - RNA, 22 nt, Human
uugcugaauugaauccuuuggu

SEQ ID NO: 532180 - RNA, 22 nt, Human
gaccauuucuaggaaucagacu

SEQ ID NO: 532181 - RNA, 22 nt, Human
ccugaggcuuaaucugucccaa

SEQ ID NO: 532182 - RNA, 22 nt, Human
gagcucagcaaaggucugugug

SEQ ID NO: 532183 - RNA, 22 nt, Human
cuggcaugccuugggugccucu

SEQ ID NO: 532184 - RNA, 22 nt, Human
aauauuuuaggcuuuccaggcu

SEQ ID NO: 532185 - RNA, 22 nt, Human
ucaaacauccccaccagggacu

SEQ ID NO: 532186 - RNA, 22 nt, Human
uuuuaaagagaugcugugcaua

SEQ ID NO: 532187 - RNA, 22 nt, Human
uugcugcuuucauuuauacagu

SEQ ID NO: 532188 - RNA, 22 nt, Human
gacaggugcuaagggaccuggc

SEQ ID NO: 532189 - RNA, 22 nt, Human
acagugauuucauccuucuggg

SEQ ID NO: 532190 - RNA, 22 nt, Human
ugacuuuuggaccucacugucc

SEQ ID NO: 532191 - RNA, 17 nt, Human
aggcauggucuggggug

SEQ ID NO: 532192 - RNA, 22 nt, Human
cugagcagcaacccagagccuc

SEQ ID NO: 532193 - RNA, 20 nt, Human
agggccugcucugugguguc

SEQ ID NO: 532194 - RNA, 22 nt, Human
uugggccaagugauucucugcc

SEQ ID NO: 532195 - RNA, 21 nt, Human
ggggcagagcuaggcccugca

SEQ ID NO: 532196 - RNA, 22 nt, Human
gacaaaggaucagagguuggga

SEQ ID NO: 532197 - RNA, 17 nt, Human
ccaggugggaggugggg

SEQ ID NO: 532198 - RNA, 22 nt, Human
gcucucuguuauuaagaucuuu

SEQ ID NO: 532199 - RNA, 22 nt, Human
uguggggccaaagcccagccac

SEQ ID NO: 532200 - RNA, 22 nt, Human
uggagcuggaauuugagcugga

SEQ ID NO: 532201 - RNA, 22 nt, Human
cuggccucaccucagacuuacu

SEQ ID NO: 532202 - RNA, 22 nt, Human
ccaguguucaucaagaaaaugu

SEQ ID NO: 532203 - RNA, 20 nt, Human
ccuggcugcauucaggacgg

SEQ ID NO: 532204 - RNA, 23 nt, Human
aaugauuucaugaugauagcagc

SEQ ID NO: 532205 - RNA, 22 nt, Human
gaggcugaacagguucucauga

SEQ ID NO: 532206 - RNA, 19 nt, Human
acagaaauuaguuauuuuc

SEQ ID NO: 532207 - RNA, 22 nt, Human
ugggggacugcacuggcgucag

SEQ ID NO: 532208 - RNA, 22 nt, Human
uaaaugugucuauggacccgcc

SEQ ID NO: 532209 - RNA, 18 nt, Human
aacaguuuccagauucuc

SEQ ID NO: 532210 - RNA, 22 nt, Human
ucuaaaaaagucuguucacuug

SEQ ID NO: 532211 - RNA, 22 nt, Human
uuucacaggaguccuuucuaua

SEQ ID NO: 532212 - RNA, 22 nt, Human
aggccagaaauuuggaguaugu

SEQ ID NO: 532213 - RNA, 22 nt, Human
acauuaaugaggugaugacaca

SEQ ID NO: 532214 - RNA, 22 nt, Human
ugggaagggccugcccuuccuc

SEQ ID NO: 532215 - RNA, 21 nt, Human
ucuuugcaucaguuguuuucu

SEQ ID NO: 532216 - RNA, 22 nt, Human
cugugggaacacugaggacuuc

SEQ ID NO: 532217 - RNA, 18 nt, Human
caaagcaggugacagugu

SEQ ID NO: 532218 - RNA, 22 nt, Human
cacugaagccugggaguaagac

SEQ ID NO: 532219 - RNA, 22 nt, Human
gacagggccgcagauggagacu

SEQ ID NO: 532220 - RNA, 22 nt, Human
cacccagccuucacacaggagu

SEQ ID NO: 532221 - RNA, 22 nt, Human
ccugcagacacuuguccagcaa

SEQ ID NO: 532222 - RNA, 22 nt, Human
ugcugcucaaugagaugccauc

SEQ ID NO: 532223 - RNA, 22 nt, Human
ccucagggccaucucugucccu

SEQ ID NO: 532224 - RNA, 22 nt, Human
gacucuuucccugugacagagu

SEQ ID NO: 532225 - RNA, 22 nt, Human
gaaacacucaauuuaguaauuc

SEQ ID NO: 532226 - RNA, 22 nt, Human
cuggcuggccggagcgaggcgg

SEQ ID NO: 532227 - RNA, 22 nt, Human
agucucuuuguggacucugccu

SEQ ID NO: 532228 - RNA, 22 nt, Human
gcaaaugcucuccuuggucagg

SEQ ID NO: 532229 - RNA, 22 nt, Human
gagcaguugggcucuaggaagu

SEQ ID NO: 532230 - RNA, 22 nt, Human
uucauguauuuaucauguaaau

SEQ ID NO: 532231 - RNA, 19 nt, Human
caguuuaacuaauuuuauc

SEQ ID NO: 532232 - RNA, 22 nt, Human
uuugacaauucaugacauuuau

SEQ ID NO: 532233 - RNA, 22 nt, Human
cuggcaagugguugggauggau

SEQ ID NO: 532234 - RNA, 22 nt, Human
ucagggaccccucugaguggag

SEQ ID NO: 532235 - RNA, 22 nt, Human
uuuguaaaaggaggaagcaugg

SEQ ID NO: 532236 - RNA, 22 nt, Human
gggaagggagcuggguauuuag

SEQ ID NO: 532237 - RNA, 22 nt, Human
ccucugaguagacuggacauga

SEQ ID NO: 532238 - RNA, 22 nt, Human
ccacauuuacugauguauguau

SEQ ID NO: 532239 - RNA, 22 nt, Human
cugggaggcccacguugggaag

SEQ ID NO: 532240 - RNA, 22 nt, Human
uucaccuugaauaugucuuaaa

SEQ ID NO: 532241 - RNA, 21 nt, Human
aucucacagcccagagaagcc

SEQ ID NO: 532242 - RNA, 22 nt, Human
uuaaagcaaaaacuaggaugga

SEQ ID NO: 532243 - RNA, 22 nt, Human
uggcagcaaguucuugggaggu

SEQ ID NO: 532244 - RNA, 21 nt, Human
gcagccacugccuucaacaau

SEQ ID NO: 532245 - RNA, 22 nt, Human
uguguacaagaguguuuacugu

SEQ ID NO: 532246 - RNA, 22 nt, Human
uagcauuuggacauugucaccu

SEQ ID NO: 532247 - RNA, 22 nt, Human
aaaugguccauccuaaagaagu

SEQ ID NO: 532248 - RNA, 22 nt, Human
acaggaagaaagugcaguagau

SEQ ID NO: 532249 - RNA, 22 nt, Human
gaugugagugguagcugggauu

SEQ ID NO: 532250 - RNA, 22 nt, Human
gccugugacucgucuugggcca

SEQ ID NO: 532251 - RNA, 22 nt, Human
ggagccagggaagcugcuuccu

SEQ ID NO: 532252 - RNA, 22 nt, Human
gugccagcucuccccacaucug

SEQ ID NO: 532253 - RNA, 22 nt, Human
aaagacauugaagaaggacuua

SEQ ID NO: 532254 - RNA, 22 nt, Human
ccugccagcccgcguucaugcc

SEQ ID NO: 532255 - RNA, 22 nt, Human
gagauguacaauguguauuaau

SEQ ID NO: 532256 - RNA, 22 nt, Human
aaaugcaaggauuuuguuaggc

SEQ ID NO: 532257 - RNA, 22 nt, Human
uuaucauugucgcagucuaauu

SEQ ID NO: 532258 - RNA, 22 nt, Human
caugaaaauaacauuguuguga

SEQ ID NO: 532259 - RNA, 23 nt, Human
ugcuucucugcuugacaguucug

SEQ ID NO: 532260 - RNA, 22 nt, Human
cugugccuccagucucgcuucu

SEQ ID NO: 532261 - RNA, 22 nt, Human
auucaaguccagcuucucuaca

SEQ ID NO: 532262 - RNA, 22 nt, Human
uuucacagcugauaccucuucc

SEQ ID NO: 532263 - RNA, 22 nt, Human
agauaaauuccuaagauuucag

SEQ ID NO: 532264 - RNA, 22 nt, Human
aagccaguguuuuugagaguug

SEQ ID NO: 532265 - RNA, 22 nt, Human
ccugggcuccacuccaagagca

SEQ ID NO: 532266 - RNA, 22 nt, Human
uccuuacaacuuguuauuuuuc

SEQ ID NO: 532267 - RNA, 22 nt, Human
cugaggccucucuccugggcuu

SEQ ID NO: 532268 - RNA, 22 nt, Human
guggggggacguuggucacuuu

SEQ ID NO: 532269 - RNA, 22 nt, Human
uauacacaccuccaaagcagga

SEQ ID NO: 532270 - RNA, 22 nt, Human
uuguaacagguacuaaauaacu

SEQ ID NO: 532271 - RNA, 19 nt, Human
ugcuuugccuugauuagcu

SEQ ID NO: 532272 - RNA, 22 nt, Human
agggcagaaaucgauuacaccu

SEQ ID NO: 532273 - RNA, 22 nt, Human
cuucccuuuagcauauaguagu

SEQ ID NO: 532274 - RNA, 22 nt, Human
ugcauacacaugugcacauacg

SEQ ID NO: 532275 - RNA, 22 nt, Human
agcagcugaccagugaguccug

SEQ ID NO: 532276 - RNA, 22 nt, Human
caaagacugcauaacacaugaa

SEQ ID NO: 532277 - RNA, 21 nt, Human
uggccaaaaccauauuauuaa

SEQ ID NO: 532278 - RNA, 22 nt, Human
gccacauagaggaggauauuaa

SEQ ID NO: 532279 - RNA, 22 nt, Human
aucagaagcaggaggaaugaag

SEQ ID NO: 532280 - RNA, 22 nt, Human
augggcugcuucuccagcaccu

SEQ ID NO: 532281 - RNA, 22 nt, Human
agcuggcuuugagcugggaggu

SEQ ID NO: 532282 - RNA, 22 nt, Human
uguuaacagaggucauuuuggg

SEQ ID NO: 532283 - RNA, 22 nt, Human
ccaggacuuuaaguccagcacu

SEQ ID NO: 532284 - RNA, 22 nt, Human
acauguaaaagauaaauuaaca

SEQ ID NO: 532285 - RNA, 22 nt, Human
ugcuucugcaggagcuccugau

SEQ ID NO: 532286 - RNA, 22 nt, Human
auccagaguaauacagaaugca

SEQ ID NO: 532287 - RNA, 22 nt, Human
gaagccaggggccugacaggca

SEQ ID NO: 532288 - RNA, 22 nt, Human
aacuuuauuguuaggggcuaaa

SEQ ID NO: 532289 - RNA, 22 nt, Human
aguaaaauuguauuggaaaaca

SEQ ID NO: 532290 - RNA, 22 nt, Human
ccaaaauuaagccucuuauguu

SEQ ID NO: 532291 - RNA, 22 nt, Human
aggcugcuuucauggccgcccc

SEQ ID NO: 532292 - RNA, 23 nt, Human
uggggccaagugaggaagggucu

SEQ ID NO: 532293 - RNA, 22 nt, Human
guuuccauggcucuguuaaugg

SEQ ID NO: 532294 - RNA, 22 nt, Human
aggcacugauucucagaguuac

SEQ ID NO: 532295 - RNA, 22 nt, Human
acacuuuacagaauguuuugau

SEQ ID NO: 532296 - RNA, 22 nt, Human
acaaguuagguuuuaauccaaa

SEQ ID NO: 532297 - RNA, 22 nt, Human
cauuuauuaguuaguucgaugu

SEQ ID NO: 532298 - RNA, 22 nt, Human
agggacccauagagagaccagu

SEQ ID NO: 532299 - RNA, 22 nt, Human
uccaauggggccucucugucag

SEQ ID NO: 532300 - RNA, 22 nt, Human
ucauuuguacuugugugcuugu

SEQ ID NO: 532301 - RNA, 21 nt, Human
uuacuaaacaaaacaugcagg

SEQ ID NO: 532302 - RNA, 22 nt, Human
cuguccuguagcuccaucaguc

SEQ ID NO: 532303 - RNA, 22 nt, Human
cagugcagguuuagggcugggg

SEQ ID NO: 532304 - RNA, 22 nt, Human
uggcucaguuucaguccugguu

SEQ ID NO: 532305 - RNA, 22 nt, Human
uaauacaauggaguugggcccc

SEQ ID NO: 532306 - RNA, 22 nt, Human
aacaugcucuggauugcuguga

SEQ ID NO: 532307 - RNA, 21 nt, Human
caugaagccgguucccuguuu

SEQ ID NO: 532308 - RNA, 22 nt, Human
gcaggagcucguuuccaggcug

SEQ ID NO: 532309 - RNA, 22 nt, Human
uggcucaguuucugcccagcug

SEQ ID NO: 532310 - RNA, 22 nt, Human
caucagugguaacugaaugguu

SEQ ID NO: 532311 - RNA, 22 nt, Human
auauccuuuucggaagagcagc

SEQ ID NO: 532312 - RNA, 22 nt, Human
caggggcuuaagugacagaagg

SEQ ID NO: 532313 - RNA, 22 nt, Human
ugucaccucuuuggcugcagcu

SEQ ID NO: 532314 - RNA, 22 nt, Human
ucaauucugguccucaggaacu

SEQ ID NO: 532315 - RNA, 22 nt, Human
uagcuuuaggaugguucucuug

SEQ ID NO: 532316 - RNA, 22 nt, Human
uggccugccuucgcugagcuga

SEQ ID NO: 532317 - RNA, 22 nt, Human
uuugacagauccuuaacucagc

SEQ ID NO: 532318 - RNA, 22 nt, Human
ugggacugcucuugcugggguc

SEQ ID NO: 532319 - RNA, 22 nt, Human
ugcuggccaauggcagaggcgg

SEQ ID NO: 532320 - RNA, 22 nt, Human
ugcagggaccccgaggcucucu

SEQ ID NO: 532321 - RNA, 22 nt, Human
aucagaaugcagccagcaguua

SEQ ID NO: 532322 - RNA, 22 nt, Human
uggcuucugggacuugugagca

SEQ ID NO: 532323 - RNA, 22 nt, Human
uagauuuuaggagauuuuacug

SEQ ID NO: 532324 - RNA, 22 nt, Human
aagaugguuauuucaucaccua

SEQ ID NO: 532325 - RNA, 22 nt, Human
aguccaguguguucuggcagca

SEQ ID NO: 532326 - RNA, 22 nt, Human
caagcuggcugggagaggcacg

SEQ ID NO: 532327 - RNA, 22 nt, Human
accugagaaugggggcaugugu

SEQ ID NO: 532328 - RNA, 22 nt, Human
ccuucauugcaucuuuaagaga

SEQ ID NO: 532329 - RNA, 22 nt, Human
uuuucuuauggugaagcacaaa

SEQ ID NO: 532330 - RNA, 23 nt, Human
uggcagcagaucuuaaagugacc

SEQ ID NO: 532331 - RNA, 22 nt, Human
augaaacaaggguauuuucucu

SEQ ID NO: 532332 - RNA, 22 nt, Human
uaaaugcagauuccugagccua

SEQ ID NO: 532333 - RNA, 22 nt, Human
auuuugaaaagcauuugaguaa

SEQ ID NO: 532334 - RNA, 22 nt, Human
uucuaacucuguuauguguuuc

SEQ ID NO: 532335 - RNA, 22 nt, Human
cagggacccuacuagcucacac

SEQ ID NO: 532336 - RNA, 22 nt, Human
ggcucugguggcaauugacugg

SEQ ID NO: 532337 - RNA, 22 nt, Human
gagacugauggggcucccagaa

SEQ ID NO: 532338 - RNA, 22 nt, Human
agaugaugauaauugaaaggca

SEQ ID NO: 532339 - RNA, 22 nt, Human
uacacauuagucaagaguuuga

SEQ ID NO: 532340 - RNA, 22 nt, Human
aggagccaagauggggcaagua

SEQ ID NO: 532341 - RNA, 22 nt, Human
aaguacaugcuguaaugauugg

SEQ ID NO: 532342 - RNA, 22 nt, Human
cugggagauugaggccauggug

SEQ ID NO: 532343 - RNA, 22 nt, Human
ucacacagcugacagagccuuu

SEQ ID NO: 532344 - RNA, 22 nt, Human
ccaaaugcuccacugacuuugg

SEQ ID NO: 532345 - RNA, 22 nt, Human
aggccaaagcacagagcuggaa

SEQ ID NO: 532346 - RNA, 22 nt, Human
agaaaacauuacauaggugugu

SEQ ID NO: 532347 - RNA, 22 nt, Human
ccccagccuuccaugggaauug

SEQ ID NO: 532348 - RNA, 22 nt, Human
cuuacauacugagaaaauaucc

SEQ ID NO: 532349 - RNA, 22 nt, Human
uuuguucaacaucacuuccacc

SEQ ID NO: 532350 - RNA, 22 nt, Human
ugcaggugguccauuugggaac

SEQ ID NO: 532351 - RNA, 22 nt, Human
aaauuucuguuguuuugagcca

SEQ ID NO: 532352 - RNA, 22 nt, Human
uagggaggcuacuucuuguagg

SEQ ID NO: 532353 - RNA, 22 nt, Human
auaacagaguugggaagugaaa

SEQ ID NO: 532354 - RNA, 22 nt, Human
aaguuucaugauguaauuauug

SEQ ID NO: 532355 - RNA, 22 nt, Human
augaaacucuaacuuaacaagu

SEQ ID NO: 532356 - RNA, 22 nt, Human
ucucuggagggcuccaggcggg

SEQ ID NO: 532357 - RNA, 22 nt, Human
ucuguucaguugauuagacaga

SEQ ID NO: 532358 - RNA, 22 nt, Human
cucccaggcacagggaggagcc

SEQ ID NO: 532359 - RNA, 20 nt, Human
ugccagggccagcagaggcu

SEQ ID NO: 532360 - RNA, 22 nt, Human
cucugcccucgcacaucugcca

SEQ ID NO: 532361 - RNA, 22 nt, Human
uuucuuuguuguuaucacauca

SEQ ID NO: 532362 - RNA, 22 nt, Human
uccuauugguagacauuucugu

SEQ ID NO: 532363 - RNA, 22 nt, Human
acagcuauagacgauguauaga

SEQ ID NO: 532364 - RNA, 22 nt, Human
gugagaguguuuggaaauagaa

SEQ ID NO: 532365 - RNA, 22 nt, Human
gagcagcagguggggcuggcuu

SEQ ID NO: 532366 - RNA, 22 nt, Human
ugcuggggguucagaugaguaa

SEQ ID NO: 532367 - RNA, 22 nt, Human
uagggcucacugagaugaauau

SEQ ID NO: 532368 - RNA, 22 nt, Human
ugaggaugacgauggcaauggc

SEQ ID NO: 532369 - RNA, 22 nt, Human
gaggcacaucacuuggugcauu

SEQ ID NO: 532370 - RNA, 22 nt, Human
uugauuacuauguguugaaagc

SEQ ID NO: 532371 - RNA, 22 nt, Human
guaauuaggaauaaaaugggaa

SEQ ID NO: 532372 - RNA, 19 nt, Human
cagauggccaccuacuugc

SEQ ID NO: 532373 - RNA, 22 nt, Human
ccagaugggccagggguuuguu

SEQ ID NO: 532374 - RNA, 19 nt, Human
uucuggggccuggccuugg

SEQ ID NO: 532375 - RNA, 22 nt, Human
uuccaggaggagguacuagagg

SEQ ID NO: 532376 - RNA, 22 nt, Human
agaggcuccuagccacuggcuu

SEQ ID NO: 532377 - RNA, 22 nt, Human
ugcagcugaggccagcuaugcc

SEQ ID NO: 532378 - RNA, 19 nt, Human
ggacacagaaagcugcauu

SEQ ID NO: 532379 - RNA, 22 nt, Human
ugugaaaugcuauugugacaaa

SEQ ID NO: 532380 - RNA, 16 nt, Human
ccaccugcagcucuca

SEQ ID NO: 532381 - RNA, 23 nt, Human
acagaaaguucugcuggacagag

SEQ ID NO: 532382 - RNA, 22 nt, Human
uaacagaaauuuuaguuagggg

SEQ ID NO: 532383 - RNA, 22 nt, Human
ggaaggagggcggcaaugauga

SEQ ID NO: 532384 - RNA, 22 nt, Human
uggaccugggguggccuccucu

SEQ ID NO: 532385 - RNA, 22 nt, Human
uucagcuauuauacccacuuuu

SEQ ID NO: 532386 - RNA, 22 nt, Human
cauuaucugccauugacaccau

SEQ ID NO: 532387 - RNA, 22 nt, Human
accuuuuuucagaacucuaaag

SEQ ID NO: 532388 - RNA, 22 nt, Human
ucaggcucuacacuugacacac

SEQ ID NO: 532389 - RNA, 22 nt, Human
cuggagugauacucagaaugug

SEQ ID NO: 532390 - RNA, 21 nt, Human
aaggaaaagcuuggucucuga

SEQ ID NO: 532391 - RNA, 22 nt, Human
uagcuuuaagaugagaugugga

SEQ ID NO: 532392 - RNA, 22 nt, Human
acacacagaaggaagccccacu

SEQ ID NO: 532393 - RNA, 22 nt, Human
gcugcucuggcucugcaguguc

SEQ ID NO: 532394 - RNA, 22 nt, Human
uaaaacugaauacauacugagg

SEQ ID NO: 532395 - RNA, 22 nt, Human
caaauguuuuuauucuacaaca

SEQ ID NO: 532396 - RNA, 22 nt, Human
ccagagcuucggggcggcugua

SEQ ID NO: 532397 - RNA, 22 nt, Human
aaauguaguauguugcauguau

SEQ ID NO: 532398 - RNA, 22 nt, Human
ccucauggccuugagcugaggg

SEQ ID NO: 532399 - RNA, 22 nt, Human
uuuugaaagccagguuuguaug

SEQ ID NO: 532400 - RNA, 22 nt, Human
ucaacauucauauauagccaca

SEQ ID NO: 532401 - RNA, 22 nt, Human
agcagggcugugcuccuuccga

SEQ ID NO: 532402 - RNA, 22 nt, Human
gacuauuuauuuacagaaagcu

SEQ ID NO: 532403 - RNA, 22 nt, Human
gcaccacaucaaugaggggagc

SEQ ID NO: 532404 - RNA, 22 nt, Human
uucuuaagcaguuuggcauguu

SEQ ID NO: 532405 - RNA, 22 nt, Human
ggccucuguucugcauuccucc

SEQ ID NO: 532406 - RNA, 22 nt, Human
uuggaggcaaugggaaggaggc

SEQ ID NO: 532407 - RNA, 22 nt, Human
cauuugaacuaauaacugugcu

SEQ ID NO: 532408 - RNA, 22 nt, Human
aauagcaauuacccuucaacuc

SEQ ID NO: 532409 - RNA, 22 nt, Human
uucaauaucauuguuuagucuc

SEQ ID NO: 532410 - RNA, 23 nt, Human
agcagcaaaaauuuaucuuucug

SEQ ID NO: 532411 - RNA, 22 nt, Human
gguggccugaauuagcucaggg

SEQ ID NO: 532412 - RNA, 22 nt, Human
gcuggaaggcuaggcucaguug

SEQ ID NO: 532413 - RNA, 20 nt, Human
gaggcugcggacugcuggac

SEQ ID NO: 532414 - RNA, 22 nt, Human
agcugggcuccaagagggaucu

SEQ ID NO: 532415 - RNA, 22 nt, Human
ucuuuauaaaagucauuauguc

SEQ ID NO: 532416 - RNA, 22 nt, Human
ggugcuggacacguggcacucc

SEQ ID NO: 532417 - RNA, 22 nt, Human
agcagggccaacaguaaacacc

SEQ ID NO: 532418 - RNA, 22 nt, Human
ggcugaguggcugggucuaguu

SEQ ID NO: 532419 - RNA, 22 nt, Human
agacuucucaguuuuauuagua

SEQ ID NO: 532420 - RNA, 22 nt, Human
gaggcagagucacaaagagucu

SEQ ID NO: 532421 - RNA, 22 nt, Human
aaagcagugcugugagaacacu

SEQ ID NO: 532422 - RNA, 22 nt, Human
agggcuccuaugccccauggac

SEQ ID NO: 532423 - RNA, 22 nt, Human
gaggaggcuguuucucugcauu

SEQ ID NO: 532424 - RNA, 22 nt, Human
agaggggaaguaaugaaugaua

SEQ ID NO: 532425 - RNA, 22 nt, Human
cagacagaaggaaggccaacau

SEQ ID NO: 532426 - RNA, 22 nt, Human
aucaggaucagggcuagcagag

SEQ ID NO: 532427 - RNA, 22 nt, Human
ucaagucauuugacuguguguu

SEQ ID NO: 532428 - RNA, 22 nt, Human
acauguuugccugcaggcuuag

SEQ ID NO: 532429 - RNA, 17 nt, Human
aaugaaugaauucuuug

SEQ ID NO: 532430 - RNA, 22 nt, Human
uucacagggccacuggcaggag

SEQ ID NO: 532431 - RNA, 22 nt, Human
aaacaaagcaucuugcuaugca

SEQ ID NO: 532432 - RNA, 22 nt, Human
cucuggagaugguucucaauug

SEQ ID NO: 532433 - RNA, 22 nt, Human
uggcccuggguggaauguccca

SEQ ID NO: 532434 - RNA, 22 nt, Human
uuuguaaagucuguucugaguu

SEQ ID NO: 532435 - RNA, 22 nt, Human
gggggcuggacuuucccacaca

SEQ ID NO: 532436 - RNA, 22 nt, Human
ugaggcuggaugggaugccucc

SEQ ID NO: 532437 - RNA, 22 nt, Human
cguggccuuugagugagcuccc

SEQ ID NO: 532438 - RNA, 23 nt, Human
ccuccugggcacaggccugaugg

SEQ ID NO: 532439 - RNA, 22 nt, Human
agcagauguuucagagcaggcu

SEQ ID NO: 532440 - RNA, 22 nt, Human
cagagguagccgagugcaaucg

SEQ ID NO: 532441 - RNA, 22 nt, Human
ugaaauuuaggugcagauaaau

SEQ ID NO: 532442 - RNA, 21 nt, Human
ucuuuucucagcuuugugguu

SEQ ID NO: 532443 - RNA, 22 nt, Human
gcuucuggugaggccucaggaa

SEQ ID NO: 532444 - RNA, 22 nt, Human
aaaacauaaacugacagcccau

SEQ ID NO: 532445 - RNA, 22 nt, Human
aaugggagagaacacaaagucc

SEQ ID NO: 532446 - RNA, 22 nt, Human
agccagugcaacagcagugaag

SEQ ID NO: 532447 - RNA, 22 nt, Human
cggcagagcuuccugcucagcg

SEQ ID NO: 532448 - RNA, 22 nt, Human
aggagccaugagugacaucaca

SEQ ID NO: 532449 - RNA, 22 nt, Human
gggcugagcuaagcuggguuga

SEQ ID NO: 532450 - RNA, 22 nt, Human
cuggccuuggugcuugcagaca

SEQ ID NO: 532451 - RNA, 17 nt, Human
uccagagcacagagcuc

SEQ ID NO: 532452 - RNA, 22 nt, Human
agguccagaacgugccuacucu

SEQ ID NO: 532453 - RNA, 22 nt, Human
ucuggcucaaaauacguacucu

SEQ ID NO: 532454 - RNA, 22 nt, Human
cccugcuuugcacccaggcugg

SEQ ID NO: 532455 - RNA, 22 nt, Human
caacuuuagaccccaaguagcu

SEQ ID NO: 532456 - RNA, 22 nt, Human
uauguacauggagagcaauuga

SEQ ID NO: 532457 - RNA, 22 nt, Human
ccuccaguacuccaguccagcg

SEQ ID NO: 532458 - RNA, 22 nt, Human
caugaagucacuggagcuuuca

SEQ ID NO: 532459 - RNA, 20 nt, Human
ugucauuguuucuaggaccu

SEQ ID NO: 532460 - RNA, 22 nt, Human
ucacaguucaacuaguucagau

SEQ ID NO: 532461 - RNA, 22 nt, Human
cuuuccaaugucacuaugaauc

SEQ ID NO: 532462 - RNA, 22 nt, Human
gagccagggcugugagcugagc

SEQ ID NO: 532463 - RNA, 21 nt, Human
uucuucaaagaagaaggcaca

SEQ ID NO: 532464 - RNA, 22 nt, Human
gagccagccgcaagagcuguga

SEQ ID NO: 532465 - RNA, 22 nt, Human
gacaggaggcagagcucaggug

SEQ ID NO: 532466 - RNA, 22 nt, Human
uagagcagauagugaaacagaa

SEQ ID NO: 532467 - RNA, 22 nt, Human
uuuaacacuaguuucuuuaacu

SEQ ID NO: 532468 - RNA, 18 nt, Human
ggguccugugggagacag

SEQ ID NO: 532469 - RNA, 22 nt, Human
aagaacauucgaacuauuuucu

SEQ ID NO: 532470 - RNA, 22 nt, Human
uucuuaacuggaaaaugucaga

SEQ ID NO: 532471 - RNA, 22 nt, Human
ugaauaaacuaugaggaggaau

SEQ ID NO: 532472 - RNA, 22 nt, Human
ugucugucugcaagccagaaag

SEQ ID NO: 532473 - RNA, 18 nt, Human
gaggauggaaggagaugc

SEQ ID NO: 532474 - RNA, 22 nt, Human
uucuuucacucaagaaggaucu

SEQ ID NO: 532475 - RNA, 22 nt, Human
cuuauucaaugcuggaaauguu

SEQ ID NO: 532476 - RNA, 22 nt, Human
cauuagggacugaggaauaagg

SEQ ID NO: 532477 - RNA, 22 nt, Human
uaaauagggaauagaagaggaa

SEQ ID NO: 532478 - RNA, 22 nt, Human
gaugcacuugccccuccucaga

SEQ ID NO: 532479 - RNA, 22 nt, Human
cacauuuaauccuuuauaagua

SEQ ID NO: 532480 - RNA, 22 nt, Human
cucugggcaccaaagagcagcu

SEQ ID NO: 532481 - RNA, 22 nt, Human
auucuucauuguugauucaugu

SEQ ID NO: 532482 - RNA, 22 nt, Human
ugaaaacagaauccuuguuuuc

SEQ ID NO: 532483 - RNA, 22 nt, Human
gcuguucuguccccauggguaa

SEQ ID NO: 532484 - RNA, 22 nt, Human
ugcauuuucuuccaccaauauc

SEQ ID NO: 532485 - RNA, 22 nt, Human
uggcucagaggggaagugguuu

SEQ ID NO: 532486 - RNA, 22 nt, Human
uggcuucugcuuucaguggagg

SEQ ID NO: 532487 - RNA, 22 nt, Human
uccauuuuguagguaugcuaca

SEQ ID NO: 532488 - RNA, 22 nt, Human
aagccuuccugagugcaaggcc

SEQ ID NO: 532489 - RNA, 22 nt, Human
acuggaaaacacuacuacaugc

SEQ ID NO: 532490 - RNA, 22 nt, Human
agaggcggagcuugcagugagc

SEQ ID NO: 532491 - RNA, 22 nt, Human
gccucugcccuccugggacugc

SEQ ID NO: 532492 - RNA, 22 nt, Human
auugaaaaauucacaauucugg

SEQ ID NO: 532493 - RNA, 22 nt, Human
cugaggccuaagacaugaauga

SEQ ID NO: 532494 - RNA, 22 nt, Human
cugggcaggagaggugguugga

SEQ ID NO: 532495 - RNA, 22 nt, Human
ugauaugcauguaagggagaca

SEQ ID NO: 532496 - RNA, 22 nt, Human
agccuggccacucagggccuga

SEQ ID NO: 532497 - RNA, 22 nt, Human
uucacaggaauguaggggucuu

SEQ ID NO: 532498 - RNA, 19 nt, Human
gggcucuggccucaguggg

SEQ ID NO: 532499 - RNA, 22 nt, Human
aagcauuuuucacagcaacagc

SEQ ID NO: 532500 - RNA, 18 nt, Human
gcaggagauggguggggu

SEQ ID NO: 532501 - RNA, 22 nt, Human
aauggccagcaacaggagugaa

SEQ ID NO: 532502 - RNA, 22 nt, Human
acagccagaggagccaggcugg

SEQ ID NO: 532503 - RNA, 22 nt, Human
gggugcaggcagcccaggcagg

SEQ ID NO: 532504 - RNA, 23 nt, Human
ugcuuauucaaaaggugcuuuca

SEQ ID NO: 532505 - RNA, 22 nt, Human
gaucauuugcaggaaacauuaa

SEQ ID NO: 532506 - RNA, 22 nt, Human
guguccagagaaacucacagcu

SEQ ID NO: 532507 - RNA, 22 nt, Human
agucugccuuuccaaucccgug

SEQ ID NO: 532508 - RNA, 22 nt, Human
auaucacaguaguuguuuaguu

SEQ ID NO: 532509 - RNA, 22 nt, Human
uguggcagaaagcauguggaca

SEQ ID NO: 532510 - RNA, 22 nt, Human
cugccgagugggucaugaggca

SEQ ID NO: 532511 - RNA, 22 nt, Human
auauuucuugagcaccugguau

SEQ ID NO: 532512 - RNA, 22 nt, Human
gcaggagugacauggaugugga

SEQ ID NO: 532513 - RNA, 22 nt, Human
caguuuuuagauuaguuggugg

SEQ ID NO: 532514 - RNA, 22 nt, Human
gggugggguucaggaaucuuca

SEQ ID NO: 532515 - RNA, 22 nt, Human
caucuuuucagaagccauucug

SEQ ID NO: 532516 - RNA, 22 nt, Human
aaauucugauuuaauaagugua

SEQ ID NO: 532517 - RNA, 22 nt, Human
gcaagauguuaacauagggaga

SEQ ID NO: 532518 - RNA, 22 nt, Human
cuuccuggccauugccauggca

SEQ ID NO: 532519 - RNA, 22 nt, Human
ucagcaauccucccacaggugg

SEQ ID NO: 532520 - RNA, 22 nt, Human
guccuggggaauacagaagccg

SEQ ID NO: 532521 - RNA, 22 nt, Human
ugcucuguaacaaauugacaug

SEQ ID NO: 532522 - RNA, 22 nt, Human
agagacuggagaugggcagugu

SEQ ID NO: 532523 - RNA, 22 nt, Human
uucuuuauccuauuuguaggug

SEQ ID NO: 532524 - RNA, 22 nt, Human
ggugcagggagaggcaggcccc

SEQ ID NO: 532525 - RNA, 22 nt, Human
agcagcauucucugguaugggg

SEQ ID NO: 532526 - RNA, 22 nt, Human
gccugagccgccugagcggcgg

SEQ ID NO: 532527 - RNA, 22 nt, Human
ucagaacagaagcuggcuauaa

SEQ ID NO: 532528 - RNA, 22 nt, Human
agucucagaaaagaagcaugga

SEQ ID NO: 532529 - RNA, 21 nt, Human
agaaaaguagaguuuucagag

SEQ ID NO: 532530 - RNA, 22 nt, Human
cagggcugguuugucgaagaaa

SEQ ID NO: 532531 - RNA, 22 nt, Human
uuugaaacucugaacauguuuc

SEQ ID NO: 532532 - RNA, 22 nt, Human
gccagucugcucccacaaguuc

SEQ ID NO: 532533 - RNA, 18 nt, Human
cugggccuuuguauuuuu

SEQ ID NO: 532534 - RNA, 22 nt, Human
cugggccaagaaguuguguaug

SEQ ID NO: 532535 - RNA, 22 nt, Human
agucagauuuaaagcuguuuga

SEQ ID NO: 532536 - RNA, 22 nt, Human
caaacuauuuacaauggaauca

SEQ ID NO: 532537 - RNA, 22 nt, Human
gcugggagcaaguacucaucuu

SEQ ID NO: 532538 - RNA, 22 nt, Human
ugagaagcaguuucaguaagaa

SEQ ID NO: 532539 - RNA, 22 nt, Human
ugggagugauacaguauggaau

SEQ ID NO: 532540 - RNA, 22 nt, Human
gggugcagggucuccagcagcu

SEQ ID NO: 532541 - RNA, 22 nt, Human
gcucaggaucccaggggugugc

SEQ ID NO: 532542 - RNA, 22 nt, Human
uguaugcagggcuuguaugcag

SEQ ID NO: 532543 - RNA, 22 nt, Human
accuccuggcuuaucauggaca

SEQ ID NO: 532544 - RNA, 18 nt, Human
uugagggaggggcagagu

SEQ ID NO: 532545 - RNA, 22 nt, Human
ugggagcaagcuggugcuggag

SEQ ID NO: 532546 - RNA, 22 nt, Human
gggcaguggcucacgccuguaa

SEQ ID NO: 532547 - RNA, 22 nt, Human
auucaaguggcugcuauguuaa

SEQ ID NO: 532548 - RNA, 22 nt, Human
cagggugccaaagaacaaauau

SEQ ID NO: 532549 - RNA, 22 nt, Human
ugucauugaggaaaacuaggug

SEQ ID NO: 532550 - RNA, 22 nt, Human
cuaggaaugguaccucuuacaa

SEQ ID NO: 532551 - RNA, 22 nt, Human
agguuuaugccuuggagcuggg

SEQ ID NO: 532552 - RNA, 22 nt, Human
gaguggagaucgugccacugca

SEQ ID NO: 532553 - RNA, 22 nt, Human
aggcaggugggucacuugaguc

SEQ ID NO: 532554 - RNA, 21 nt, Human
cauaugaaagaaguaucugac

SEQ ID NO: 532555 - RNA, 23 nt, Human
aaauaugucugagggcaaagaau

SEQ ID NO: 532556 - RNA, 22 nt, Human
aggccagcucacccuggcuccu

SEQ ID NO: 532557 - RNA, 22 nt, Human
cagcucucacacccuccuccca

SEQ ID NO: 532558 - RNA, 22 nt, Human
uccuuggcaugccgucuucucc

SEQ ID NO: 532559 - RNA, 22 nt, Human
auggacagugugucuguuucca

SEQ ID NO: 532560 - RNA, 22 nt, Human
acacucuuucugugggucacau

SEQ ID NO: 532561 - RNA, 22 nt, Human
uggugcagagagggaucuaggg

SEQ ID NO: 532562 - RNA, 22 nt, Human
cagguggguguaugaaugcaaa

SEQ ID NO: 532563 - RNA, 22 nt, Human
uugcauaaaagaguauaucuua

SEQ ID NO: 532564 - RNA, 22 nt, Human
gugguaauagagcuccaaacua

SEQ ID NO: 532565 - RNA, 22 nt, Human
caagucaaagacuagaacuagu

SEQ ID NO: 532566 - RNA, 22 nt, Human
agccucugcacgggcacgggug

SEQ ID NO: 532567 - RNA, 21 nt, Human
cauuucuauugaugagaaaag

SEQ ID NO: 532568 - RNA, 22 nt, Human
uauuauguagaguaaggguuaa

SEQ ID NO: 532569 - RNA, 22 nt, Human
cugagccauccauaccagcuua

SEQ ID NO: 532570 - RNA, 22 nt, Human
cuaggcaaaguauuaaugagug

SEQ ID NO: 532571 - RNA, 22 nt, Human
cuaagucauggaaagugugugu

SEQ ID NO: 532572 - RNA, 20 nt, Human
uuacaaagaggcaucgcuuu

SEQ ID NO: 532573 - RNA, 22 nt, Human
uuuccucugacugcuccccugc

SEQ ID NO: 532574 - RNA, 22 nt, Human
aggaggcugaacuagggucugg

SEQ ID NO: 532575 - RNA, 22 nt, Human
acuguucacuagugaggguuga

SEQ ID NO: 532576 - RNA, 22 nt, Human
ucacauuuguguuuuauuagag

SEQ ID NO: 532577 - RNA, 16 nt, Human
cucagcuaaggagagg

SEQ ID NO: 532578 - RNA, 22 nt, Human
uagggugcuuaauacuagauuu

SEQ ID NO: 532579 - RNA, 22 nt, Human
aggacugggugcagagggcauc

SEQ ID NO: 532580 - RNA, 21 nt, Human
uccuccuucaaguccuggccu

SEQ ID NO: 532581 - RNA, 22 nt, Human
cugagcuuccaguuccuccagg

SEQ ID NO: 532582 - RNA, 20 nt, Human
ccaaauguggagaaaaagua

SEQ ID NO: 532583 - RNA, 20 nt, Human
cuguggcaucugucauggug

SEQ ID NO: 532584 - RNA, 22 nt, Human
agggcagaaguacagacacuua

SEQ ID NO: 532585 - RNA, 22 nt, Human
agaagcaggccucacagaucug

SEQ ID NO: 532586 - RNA, 22 nt, Human
guuauugcaguauagaggucua

SEQ ID NO: 532587 - RNA, 22 nt, Human
uauaguacauggaaucuucaua

SEQ ID NO: 532588 - RNA, 22 nt, Human
ugggccugugaugcugggcuau

SEQ ID NO: 532589 - RNA, 19 nt, Human
aagaagcaauaagcuguga

SEQ ID NO: 532590 - RNA, 22 nt, Human
agccucucuguuagucacuggg

SEQ ID NO: 532591 - RNA, 22 nt, Human
aauucaaggaucuguuaaaucu

SEQ ID NO: 532592 - RNA, 22 nt, Human
uguguuugaggcauguugcaga

SEQ ID NO: 532593 - RNA, 22 nt, Human
auguccagggcacacagcagug

SEQ ID NO: 532594 - RNA, 22 nt, Human
ugaaaugagauagauaaucagg

SEQ ID NO: 532595 - RNA, 22 nt, Human
aauauaaauuccugggcccagc

SEQ ID NO: 532596 - RNA, 22 nt, Human
uuagucaauagugaauauagag

SEQ ID NO: 532597 - RNA, 22 nt, Human
agacacauuuuacauuaacugu

SEQ ID NO: 532598 - RNA, 22 nt, Human
caguaugagaguugaaucaagg

SEQ ID NO: 532599 - RNA, 22 nt, Human
cccaggcugaugggaugggcca

SEQ ID NO: 532600 - RNA, 23 nt, Human
uggaccugaaccagugccucugu

SEQ ID NO: 532601 - RNA, 22 nt, Human
uuugcaaacacuuaagaagaga

SEQ ID NO: 532602 - RNA, 22 nt, Human
cacacuuuuggcauguuugguu

SEQ ID NO: 532603 - RNA, 19 nt, Human
ucugcccaguugucugccc

SEQ ID NO: 532604 - RNA, 22 nt, Human
ugcugggcuagaagcugaggcc

SEQ ID NO: 532605 - RNA, 22 nt, Human
uggcucugugucucccagcagc

SEQ ID NO: 532606 - RNA, 22 nt, Human
augguacuggggucccggaguu

SEQ ID NO: 532607 - RNA, 20 nt, Human
cagaaugcuguaaucaagaa

SEQ ID NO: 532608 - RNA, 22 nt, Human
uuucauaaccucaagcuacagu

SEQ ID NO: 532609 - RNA, 22 nt, Human
gaggucaauaauaugugcuuua

SEQ ID NO: 532610 - RNA, 22 nt, Human
uuuagacuaauuccuaaagggc

SEQ ID NO: 532611 - RNA, 22 nt, Human
ugauucacagacuucacaaggc

SEQ ID NO: 532612 - RNA, 22 nt, Human
gugagacucgccuuuguguagc

SEQ ID NO: 532613 - RNA, 22 nt, Human
cccagcuccuuggaugggcagg

SEQ ID NO: 532614 - RNA, 22 nt, Human
ucaggcagaaaaaucacuaauu

SEQ ID NO: 532615 - RNA, 22 nt, Human
cagauggcaacagcucugugac

SEQ ID NO: 532616 - RNA, 22 nt, Human
aaacaccagcacuguuuacaaa

SEQ ID NO: 532617 - RNA, 23 nt, Human
cccuggaguaaauucuuggaagg

SEQ ID NO: 532618 - RNA, 22 nt, Human
cugcagagcagccaguccccca

SEQ ID NO: 532619 - RNA, 22 nt, Human
ccagcuuuggaguguuguugcu

SEQ ID NO: 532620 - RNA, 17 nt, Human
agcuccugcccauggcu

SEQ ID NO: 532621 - RNA, 22 nt, Human
caauaaagaagauuuuugcaau

SEQ ID NO: 532622 - RNA, 22 nt, Human
ugguggcuguugcagaacugag

SEQ ID NO: 532623 - RNA, 22 nt, Human
acuuucaaaagagaagucauga

SEQ ID NO: 532624 - RNA, 22 nt, Human
gaguggggucugggcaucaguc

SEQ ID NO: 532625 - RNA, 22 nt, Human
cccagccucugggcucacccaa

SEQ ID NO: 532626 - RNA, 22 nt, Human
uugcaaauucauggaucugaau

SEQ ID NO: 532627 - RNA, 22 nt, Human
ccucugcucccuggugucugag

SEQ ID NO: 532628 - RNA, 22 nt, Human
ugcccugcuguggcucugccca

SEQ ID NO: 532629 - RNA, 22 nt, Human
gaggcaggcacuguuaucagca

SEQ ID NO: 532630 - RNA, 22 nt, Human
uuuuccucuguuauuaguguga

SEQ ID NO: 532631 - RNA, 22 nt, Human
aaacaguuuauaacaugauacu

SEQ ID NO: 532632 - RNA, 20 nt, Human
cucuccucacccgugucagg

SEQ ID NO: 532633 - RNA, 22 nt, Human
ucuuuagccaguaucauaauga

SEQ ID NO: 532634 - RNA, 22 nt, Human
aggaaaggugagagcggccgcg

SEQ ID NO: 532635 - RNA, 22 nt, Human
aaggcucucugauggcagcagu

SEQ ID NO: 532636 - RNA, 22 nt, Human
guguggcuaccucagaggagca

SEQ ID NO: 532637 - RNA, 21 nt, Human
aacuuuagaaagacugggaag

SEQ ID NO: 532638 - RNA, 21 nt, Human
gcaaagugugggcauaaacag

SEQ ID NO: 532639 - RNA, 22 nt, Human
ugcauauuuguaugauguuuag

SEQ ID NO: 532640 - RNA, 22 nt, Human
cuccuggacauggagcggagga

SEQ ID NO: 532641 - RNA, 22 nt, Human
uuauacagcauugcuagugaug

SEQ ID NO: 532642 - RNA, 22 nt, Human
gcaaagaaaugucagugagagg

SEQ ID NO: 532643 - RNA, 22 nt, Human
uccaagcuugcuuuagccacag

SEQ ID NO: 532644 - RNA, 20 nt, Human
agggcagcuugaggagccgg

SEQ ID NO: 532645 - RNA, 22 nt, Human
cagucuggaggucagcuggcuu

SEQ ID NO: 532646 - RNA, 22 nt, Human
cccuggugguacggcacuggca

SEQ ID NO: 532647 - RNA, 22 nt, Human
ggaagcuuucucuguuuccuua

SEQ ID NO: 532648 - RNA, 22 nt, Human
auacaucauuuauggaauaagg

SEQ ID NO: 532649 - RNA, 22 nt, Human
aggaacugauuuauaacuuuag

SEQ ID NO: 532650 - RNA, 22 nt, Human
uaagaacaagauguuccuguuu

SEQ ID NO: 532651 - RNA, 22 nt, Human
gaaauacaguugggaggaggua

SEQ ID NO: 532652 - RNA, 22 nt, Human
gcugucuugcucacucuugcag

SEQ ID NO: 532653 - RNA, 22 nt, Human
gaauauuuuuaaagggacuaau

SEQ ID NO: 532654 - RNA, 20 nt, Human
augggcugguuaggaagugu

SEQ ID NO: 532655 - RNA, 22 nt, Human
acauuucuuucuauucaguagc

SEQ ID NO: 532656 - RNA, 22 nt, Human
uggcaugggccagggagagcug

SEQ ID NO: 532657 - RNA, 22 nt, Human
uuugaaaauuagacacaggcua

SEQ ID NO: 532658 - RNA, 22 nt, Human
uaacaauaguguuugcuaguca

SEQ ID NO: 532659 - RNA, 22 nt, Human
gggugggccugucuggccaugu

SEQ ID NO: 532660 - RNA, 22 nt, Human
ccugcuguuuucuucacuucag

SEQ ID NO: 532661 - RNA, 22 nt, Human
aaggaaccugggaaccuaucau

SEQ ID NO: 532662 - RNA, 22 nt, Human
gggguggcccuacccucuggaa

SEQ ID NO: 532663 - RNA, 22 nt, Human
accugccuauggagccacaugg

SEQ ID NO: 532664 - RNA, 22 nt, Human
uaaguucauuagacuacagaua

SEQ ID NO: 532665 - RNA, 22 nt, Human
aggcagagagcaguggccgucu

SEQ ID NO: 532666 - RNA, 22 nt, Human
augugaaagagguguucagugg

SEQ ID NO: 532667 - RNA, 23 nt, Human
aauuacaaccaagaacuggaagg

SEQ ID NO: 532668 - RNA, 22 nt, Human
gaaaucaucugaguaauaaucu

SEQ ID NO: 532669 - RNA, 22 nt, Human
ugagcccaggaguaugaggcug

SEQ ID NO: 532670 - RNA, 22 nt, Human
cagccugcccuggaagcccagc

SEQ ID NO: 532671 - RNA, 22 nt, Human
gucacacagagcccugugcuca

SEQ ID NO: 532672 - RNA, 22 nt, Human
ccacagcuccucagccucuuuc

SEQ ID NO: 532673 - RNA, 22 nt, Human
agaaugauuuuggacaauaugg

SEQ ID NO: 532674 - RNA, 22 nt, Human
ugaaaucagugguauaaucggg

SEQ ID NO: 532675 - RNA, 21 nt, Human
augauaugcuuguauuuccaa

SEQ ID NO: 532676 - RNA, 22 nt, Human
uaagucauggagcugggauuga

SEQ ID NO: 532677 - RNA, 22 nt, Human
cagcgucucguugugggccucg

SEQ ID NO: 532678 - RNA, 22 nt, Human
ugccugaugcaggaguaucaga

SEQ ID NO: 532679 - RNA, 22 nt, Human
uuauuuguuuucugagaaguau

SEQ ID NO: 532680 - RNA, 22 nt, Human
uacaaagugagcaaccucuuuu

SEQ ID NO: 532681 - RNA, 22 nt, Human
gagagcuguguucauucuacca

SEQ ID NO: 532682 - RNA, 22 nt, Human
gaugucaucaggcuaagacacu

SEQ ID NO: 532683 - RNA, 22 nt, Human
gcagagcuccccaagacaccaa

SEQ ID NO: 532684 - RNA, 22 nt, Human
gccacccccaaguagguggucu

SEQ ID NO: 532685 - RNA, 22 nt, Human
acuuacaagcuagggaagcuug

SEQ ID NO: 532686 - RNA, 22 nt, Human
gucucuaucauagcugaacccu

SEQ ID NO: 532687 - RNA, 22 nt, Human
cuggaaggguacauaggaaacu

SEQ ID NO: 532688 - RNA, 22 nt, Human
gccggggcuggggagagacaug

SEQ ID NO: 532689 - RNA, 22 nt, Human
auuccaaagcacaucagaacua

SEQ ID NO: 532690 - RNA, 21 nt, Human
ggagaaggacaauguugagua

SEQ ID NO: 532691 - RNA, 22 nt, Human
aucagagaaauggagggcgcuu

SEQ ID NO: 532692 - RNA, 22 nt, Human
uccugagauaggaguugaaggc

SEQ ID NO: 532693 - RNA, 22 nt, Human
aggcucccaagcacugacccca

SEQ ID NO: 532694 - RNA, 22 nt, Human
ugugcucuaccucagugucauu

SEQ ID NO: 532695 - RNA, 22 nt, Human
ggcagguggccaagugucuaag

SEQ ID NO: 532696 - RNA, 22 nt, Human
cuccuccagcucucccuggggg

SEQ ID NO: 532697 - RNA, 22 nt, Human
uguaggaguccaaucaggagac

SEQ ID NO: 532698 - RNA, 22 nt, Human
guguccaucagcagccacugug

SEQ ID NO: 532699 - RNA, 22 nt, Human
guccuugcuugagacaggcagu

SEQ ID NO: 532700 - RNA, 22 nt, Human
uacaaagucagaauaacaggug

SEQ ID NO: 532701 - RNA, 20 nt, Human
cucuggcuccgcgugaccgc

SEQ ID NO: 532702 - RNA, 22 nt, Human
ggggcagaaagcccacagagug

SEQ ID NO: 532703 - RNA, 22 nt, Human
aacauugcagcuuaauugcagg

SEQ ID NO: 532704 - RNA, 22 nt, Human
cagaaaauaaaguuucuacgca

SEQ ID NO: 532705 - RNA, 22 nt, Human
aagccagguuccauggaggagc

SEQ ID NO: 532706 - RNA, 23 nt, Human
cccagcuuucccacugccgagag

SEQ ID NO: 532707 - RNA, 22 nt, Human
agugggccuuagaagguucccu

SEQ ID NO: 532708 - RNA, 22 nt, Human
gcugaagagagaugcguccagc

SEQ ID NO: 532709 - RNA, 22 nt, Human
gcucugcuugcaucaugacugc

SEQ ID NO: 532710 - RNA, 19 nt, Human
accucugcagagauguuua

SEQ ID NO: 532711 - RNA, 22 nt, Human
uucaaauacauucuuugccacu

SEQ ID NO: 532712 - RNA, 22 nt, Human
cugggcucagaugagaggaagg

SEQ ID NO: 532713 - RNA, 22 nt, Human
ccuguucacgguguguuguuag

SEQ ID NO: 532714 - RNA, 22 nt, Human
aucugacaaccuauugacuuga

SEQ ID NO: 532715 - RNA, 20 nt, Human
uguaaacaauaguguucuug

SEQ ID NO: 532716 - RNA, 22 nt, Human
caggucagagucccccuguccu

SEQ ID NO: 532717 - RNA, 21 nt, Human
aucccagcacccaggagugca

SEQ ID NO: 532718 - RNA, 22 nt, Human
cagagcggccacuagagggcgc

SEQ ID NO: 532719 - RNA, 18 nt, Human
uugaauucuucuacaugu

SEQ ID NO: 532720 - RNA, 22 nt, Human
cggggccucaguuuccccaccu

SEQ ID NO: 532721 - RNA, 22 nt, Human
cagcaauaaugucuacaaaucu

SEQ ID NO: 532722 - RNA, 22 nt, Human
uuucagaaauggcacugaaauc

SEQ ID NO: 532723 - RNA, 20 nt, Human
agccagaagaaggcuggaga

SEQ ID NO: 532724 - RNA, 22 nt, Human
cuggcagcucugagucccuucu

SEQ ID NO: 532725 - RNA, 22 nt, Human
uuccugaugcacacagucauuu

SEQ ID NO: 532726 - RNA, 19 nt, Human
ugcucagcuccugugaguc

SEQ ID NO: 532727 - RNA, 22 nt, Human
gucaggauguuuauucuccagu

SEQ ID NO: 532728 - RNA, 22 nt, Human
uuuaccaagcuuuaauuacaua

SEQ ID NO: 532729 - RNA, 22 nt, Human
aagagcaucuauuucacagugg

SEQ ID NO: 532730 - RNA, 23 nt, Human
uggacaguaggguagacagugcc

SEQ ID NO: 532731 - RNA, 22 nt, Human
aggaggccgauuucagaggucg

SEQ ID NO: 532732 - RNA, 21 nt, Human
cagaggcaggcucugugugug

SEQ ID NO: 532733 - RNA, 22 nt, Human
ggcaggcuagcacugauguccu

SEQ ID NO: 532734 - RNA, 22 nt, Human
gagcugggauucaucuaugucu

SEQ ID NO: 532735 - RNA, 22 nt, Human
gucucagagagcuacucucuua

SEQ ID NO: 532736 - RNA, 22 nt, Human
auaacagagagcuacugaacug

SEQ ID NO: 532737 - RNA, 22 nt, Human
ccaagggcucugacuugccugc

SEQ ID NO: 532738 - RNA, 22 nt, Human
uaauucagggccagaaucccca

SEQ ID NO: 532739 - RNA, 22 nt, Human
gggacccagguaauccugugcu

SEQ ID NO: 532740 - RNA, 22 nt, Human
gcagacagcauguugggcuauu

SEQ ID NO: 532741 - RNA, 22 nt, Human
acauuuaaugauccuacuguga

SEQ ID NO: 532742 - RNA, 22 nt, Human
ggcugcucuccaucccaggccu

SEQ ID NO: 532743 - RNA, 22 nt, Human
aggaagaggguggcagauaauc

SEQ ID NO: 532744 - RNA, 22 nt, Human
acaggcagguccugucccagcu

SEQ ID NO: 532745 - RNA, 23 nt, Human
cugcccugaucuugaucuauugu

SEQ ID NO: 532746 - RNA, 22 nt, Human
ucaaaucucacucugcauuucu

SEQ ID NO: 532747 - RNA, 22 nt, Human
cucucccuugggugggcuuugg

SEQ ID NO: 532748 - RNA, 22 nt, Human
uccauuuuucaugacuccucaa

SEQ ID NO: 532749 - RNA, 22 nt, Human
ucuggcucaggagcuguguuca

SEQ ID NO: 532750 - RNA, 22 nt, Human
cucagaaucugccaaguucagg

SEQ ID NO: 532751 - RNA, 22 nt, Human
agugcaggagccuggccagagc

SEQ ID NO: 532752 - RNA, 22 nt, Human
auguuuaauuaucuggguuuug

SEQ ID NO: 532753 - RNA, 22 nt, Human
uggcagcaauagaaauauaauc

SEQ ID NO: 532754 - RNA, 22 nt, Human
aagauuuucucaacuguauuug

SEQ ID NO: 532755 - RNA, 17 nt, Human
auuuguaacuagcucuu

SEQ ID NO: 532756 - RNA, 22 nt, Human
uagcagaaacuguuacagaagg

SEQ ID NO: 532757 - RNA, 22 nt, Human
cuugaaaauaagaaagacuuuc

SEQ ID NO: 532758 - RNA, 22 nt, Human
gaggaaugucagcacaggccuc

SEQ ID NO: 532759 - RNA, 22 nt, Human
cugggagagguggugggaagua

SEQ ID NO: 532760 - RNA, 20 nt, Human
aucaaaauccuauugagguu

SEQ ID NO: 532761 - RNA, 22 nt, Human
agggugcagggacaggugugca

SEQ ID NO: 532762 - RNA, 22 nt, Human
uccagggaagagcagaggcuac

SEQ ID NO: 532763 - RNA, 22 nt, Human
gcugugugacugagagccuggc

SEQ ID NO: 532764 - RNA, 22 nt, Human
agaguccaugaagacagcugag

SEQ ID NO: 532765 - RNA, 20 nt, Human
aaguuacauuguauuguacc

SEQ ID NO: 532766 - RNA, 22 nt, Human
aaaguuagaaugauaucaacga

SEQ ID NO: 532767 - RNA, 22 nt, Human
auuugcuuguaaauguaugccu

SEQ ID NO: 532768 - RNA, 20 nt, Human
ggcaccaggcuaggauugga

SEQ ID NO: 532769 - RNA, 22 nt, Human
cagcaacugugccugacacaca

SEQ ID NO: 532770 - RNA, 22 nt, Human
caggcuggacauuagauacaua

SEQ ID NO: 532771 - RNA, 22 nt, Human
cucauggauauaagaacuguuu

SEQ ID NO: 532772 - RNA, 22 nt, Human
aucaacauacugcucaggcauu

SEQ ID NO: 532773 - RNA, 22 nt, Human
auugaaaguccuaucuaaggga

SEQ ID NO: 532774 - RNA, 22 nt, Human
cagcuggcagcccuggcccugc

SEQ ID NO: 532775 - RNA, 22 nt, Human
acauuucuuagccuaguuccag

SEQ ID NO: 532776 - RNA, 22 nt, Human
agaaacaacuuguuucucuugc

SEQ ID NO: 532777 - RNA, 22 nt, Human
auauuuuuccaugugggacucu

SEQ ID NO: 532778 - RNA, 22 nt, Human
aagcuggccuguaccugcugag

SEQ ID NO: 532779 - RNA, 22 nt, Human
aaaaguuugugcaaacacucag

SEQ ID NO: 532780 - RNA, 22 nt, Human
acagagcaauaacagggagagg

SEQ ID NO: 532781 - RNA, 22 nt, Human
uucaaaaagguauguucaaguc

SEQ ID NO: 532782 - RNA, 22 nt, Human
uccugggcugugugccacucug

SEQ ID NO: 532783 - RNA, 22 nt, Human
auggaacaggcucagagaugcu

SEQ ID NO: 532784 - RNA, 22 nt, Human
cagaggcucagauggcccuggc

SEQ ID NO: 532785 - RNA, 22 nt, Human
caggaugaagggcaaaggcaag

SEQ ID NO: 532786 - RNA, 22 nt, Human
ucagggcaagucucagaagguu

SEQ ID NO: 532787 - RNA, 22 nt, Human
ggcacagcacagagcacaugua

SEQ ID NO: 532788 - RNA, 22 nt, Human
aaugguacccuggugacuuaga

SEQ ID NO: 532789 - RNA, 22 nt, Human
uaaacaucaggaaugaaaaccu

SEQ ID NO: 532790 - RNA, 22 nt, Human
ugacuggauugucauuacgacg

SEQ ID NO: 532791 - RNA, 22 nt, Human
gggucucucucggcuccacgcg

SEQ ID NO: 532792 - RNA, 22 nt, Human
ugagccuggagucguggagggg

SEQ ID NO: 532793 - RNA, 22 nt, Human
gaaggucaccuccccucucugg

SEQ ID NO: 532794 - RNA, 22 nt, Human
ggacugaggacaugugaggcau

SEQ ID NO: 532795 - RNA, 22 nt, Human
agugucugcuuaucaguucuug

SEQ ID NO: 532796 - RNA, 22 nt, Human
ugauuaaguucaaaauauagaa

SEQ ID NO: 532797 - RNA, 21 nt, Human
ugggcucuuuaacccaggcac

SEQ ID NO: 532798 - RNA, 22 nt, Human
agcacaggaccaaggaagcugu

SEQ ID NO: 532799 - RNA, 22 nt, Human
gccuggucucuuucaugucagu

SEQ ID NO: 532800 - RNA, 21 nt, Human
aaggagccuaggaggcucagg

SEQ ID NO: 532801 - RNA, 22 nt, Human
ugaaaucuuagccauucugccu

SEQ ID NO: 532802 - RNA, 22 nt, Human
ccugugagucaaccccuccuug

SEQ ID NO: 532803 - RNA, 22 nt, Human
aaauguuagguuguacugaguc

SEQ ID NO: 532804 - RNA, 19 nt, Human
caaggguugggucugucau

SEQ ID NO: 532805 - RNA, 19 nt, Human
gagguggguccccgcagcc

SEQ ID NO: 532806 - RNA, 22 nt, Human
uaaaaucagccgaccauggugg

SEQ ID NO: 532807 - RNA, 19 nt, Human
uucacaauuaugaaauuag

SEQ ID NO: 532808 - RNA, 22 nt, Human
uugcuaaauguguuauaucugu

SEQ ID NO: 532809 - RNA, 21 nt, Human
agcuggcaauguuguccucuu

SEQ ID NO: 532810 - RNA, 22 nt, Human
caguuuauagcucuagcagcuu

SEQ ID NO: 532811 - RNA, 22 nt, Human
uagauuucucauucauagauug

SEQ ID NO: 532812 - RNA, 22 nt, Human
uaaagcauuuuugaaauuauga

SEQ ID NO: 532813 - RNA, 22 nt, Human
aaacaauguacacaugaauguu

SEQ ID NO: 532814 - RNA, 19 nt, Human
uccaaaggacccaccucca

SEQ ID NO: 532815 - RNA, 22 nt, Human
ccuggauucaagucuuucuuuc

SEQ ID NO: 532816 - RNA, 22 nt, Human
cagcagcugggaaggaggcuga

SEQ ID NO: 532817 - RNA, 22 nt, Human
cgcaggugaaagaggcugggca

SEQ ID NO: 532818 - RNA, 22 nt, Human
cagggcucaggaaaucagacgu

SEQ ID NO: 532819 - RNA, 20 nt, Human
uggagccacagucagguucc

SEQ ID NO: 532820 - RNA, 22 nt, Human
caaauuuagguaacagucugua

SEQ ID NO: 532821 - RNA, 22 nt, Human
gggugcagugguucacgccugu

SEQ ID NO: 532822 - RNA, 22 nt, Human
gccucugcaugcucagcaccca

SEQ ID NO: 532823 - RNA, 22 nt, Human
uccuccugucuaccaguuccug

SEQ ID NO: 532824 - RNA, 22 nt, Human
ccuggagcaggagcugcagagg

SEQ ID NO: 532825 - RNA, 22 nt, Human
aagagaaggugaggaagccggu

SEQ ID NO: 532826 - RNA, 22 nt, Human
aagcagcaaguuuauuucuauc

SEQ ID NO: 532827 - RNA, 22 nt, Human
cccugcacagccuggcucucuu

SEQ ID NO: 532828 - RNA, 22 nt, Human
aggcagcauccagaggagaaug

SEQ ID NO: 532829 - RNA, 22 nt, Human
ccagggcagaaaaagagggaau

SEQ ID NO: 532830 - RNA, 21 nt, Human
auacagugguaugaauguagg

SEQ ID NO: 532831 - RNA, 22 nt, Human
cuucaagauccauagauauugc

SEQ ID NO: 532832 - RNA, 20 nt, Human
agcuaggagaaagcauggag

SEQ ID NO: 532833 - RNA, 22 nt, Human
gagggcagagacagugauucac

SEQ ID NO: 532834 - RNA, 22 nt, Human
ugucuccucauacugucauauu

SEQ ID NO: 532835 - RNA, 22 nt, Human
uggagaggaaagugcaguuuug

SEQ ID NO: 532836 - RNA, 22 nt, Human
acacaguauuacaauaggugcu

SEQ ID NO: 532837 - RNA, 22 nt, Human
cauuauuaauucagcacaugcu

SEQ ID NO: 532838 - RNA, 22 nt, Human
ucaaauauuggcuauuucacau

SEQ ID NO: 532839 - RNA, 22 nt, Human
ugggcugcugcggugcucuugg

SEQ ID NO: 532840 - RNA, 22 nt, Human
uacaaaaguaauuacgguuuuu

SEQ ID NO: 532841 - RNA, 23 nt, Human
ugcauaucagaaauuucauaugg

SEQ ID NO: 532842 - RNA, 22 nt, Human
gguggggcccaggcaucugaug

SEQ ID NO: 532843 - RNA, 22 nt, Human
aggaagaaacugagcucugaca

SEQ ID NO: 532844 - RNA, 22 nt, Human
acucccacuccagaguagaagc

SEQ ID NO: 532845 - RNA, 22 nt, Human
ccacagggugucaucagcuuga

SEQ ID NO: 532846 - RNA, 17 nt, Human
uauguaguacuuauaaa

SEQ ID NO: 532847 - RNA, 22 nt, Human
ucuccugguuuguuaaauaauu

SEQ ID NO: 532848 - RNA, 22 nt, Human
aggggaugccuaguggagucuc

SEQ ID NO: 532849 - RNA, 22 nt, Human
agcaggcuuaugguugaaggga

SEQ ID NO: 532850 - RNA, 22 nt, Human
uuugaaaguccuaggagagucc

SEQ ID NO: 532851 - RNA, 22 nt, Human
uucugcaggagcccuaguguau

SEQ ID NO: 532852 - RNA, 22 nt, Human
acugagaggaaauugagacuau

SEQ ID NO: 532853 - RNA, 22 nt, Human
aaugcuguaaagaugcuaucug

SEQ ID NO: 532854 - RNA, 22 nt, Human
ccaggagcuggagggugcagug

SEQ ID NO: 532855 - RNA, 22 nt, Human
ugcagccaucgcagagucugua

SEQ ID NO: 532856 - RNA, 22 nt, Human
acagugaaugcccaagaaaagu

SEQ ID NO: 532857 - RNA, 22 nt, Human
accauugccuagaaaaauuccu

SEQ ID NO: 532858 - RNA, 22 nt, Human
cagauguauaugcauaaaaagu

SEQ ID NO: 532859 - RNA, 22 nt, Human
caauuaaagaagaccugccuca

SEQ ID NO: 532860 - RNA, 22 nt, Human
ucccaaagcuacucuucugacu

SEQ ID NO: 532861 - RNA, 22 nt, Human
uggcccugcccucuucaucuuu

SEQ ID NO: 532862 - RNA, 22 nt, Human
cuggaagaguccuaaacagaua

SEQ ID NO: 532863 - RNA, 22 nt, Human
acaugaaaagacuaucugauua

SEQ ID NO: 532864 - RNA, 21 nt, Human
agacagagugcagucuacaua

SEQ ID NO: 532865 - RNA, 22 nt, Human
agaaaugcucaggucaacuuaa

SEQ ID NO: 532866 - RNA, 22 nt, Human
caucacauuuaaggggaaggac

SEQ ID NO: 532867 - RNA, 22 nt, Human
ucaagaaagggcuucaccagga

SEQ ID NO: 532868 - RNA, 22 nt, Human
uucaagauggccccagugagcc

SEQ ID NO: 532869 - RNA, 22 nt, Human
acuguguguuugucuagcacag

SEQ ID NO: 532870 - RNA, 22 nt, Human
auaggcaagcacaaagucagga

SEQ ID NO: 532871 - RNA, 22 nt, Human
auguuuaugcaaacaugugagu

SEQ ID NO: 532872 - RNA, 22 nt, Human
ccagagucauuuugagucauaa

SEQ ID NO: 532873 - RNA, 22 nt, Human
cagaaugggaaggacugcaguu

SEQ ID NO: 532874 - RNA, 22 nt, Human
cagggccucauggccggggugc

SEQ ID NO: 532875 - RNA, 22 nt, Human
gaggccugcuuuggcacucugg

SEQ ID NO: 532876 - RNA, 22 nt, Human
uaugcacauugguuuccucauu

SEQ ID NO: 532877 - RNA, 22 nt, Human
uacauauagacaguuacucuag

SEQ ID NO: 532878 - RNA, 22 nt, Human
cugggagcccugacuagccugg

SEQ ID NO: 532879 - RNA, 22 nt, Human
ggcuucugaaaucucugugcgu

SEQ ID NO: 532880 - RNA, 22 nt, Human
cagaguguauucugcaguugca

SEQ ID NO: 532881 - RNA, 22 nt, Human
caaagcagugauccuuaaagga

SEQ ID NO: 532882 - RNA, 22 nt, Human
agcagcugucccuuaacaucag

SEQ ID NO: 532883 - RNA, 22 nt, Human
ugaaugauuugggugcauucag

SEQ ID NO: 532884 - RNA, 22 nt, Human
accucugcuucccggguucaag

SEQ ID NO: 532885 - RNA, 22 nt, Human
gcagggcagaaggugcugagga

SEQ ID NO: 532886 - RNA, 19 nt, Human
cugggagguguucagagaa

SEQ ID NO: 532887 - RNA, 22 nt, Human
guggccaggccgacugccaggc

SEQ ID NO: 532888 - RNA, 22 nt, Human
acaugauauuaaugucuuauuu

SEQ ID NO: 532889 - RNA, 22 nt, Human
ucaggcuggagugcaguggcgc

SEQ ID NO: 532890 - RNA, 22 nt, Human
cugggcacuuuggggagccuac

SEQ ID NO: 532891 - RNA, 22 nt, Human
uggcaguccccugugccuggaa

SEQ ID NO: 532892 - RNA, 22 nt, Human
ugggcuccaauuuguccuuuca

SEQ ID NO: 532893 - RNA, 22 nt, Human
gggcacaggaauuugggaugug

SEQ ID NO: 532894 - RNA, 21 nt, Human
cuucagcaaauacuuggcagg

SEQ ID NO: 532895 - RNA, 22 nt, Human
ucacaauuguuuuuaggaucaa

SEQ ID NO: 532896 - RNA, 22 nt, Human
caugaagcucuugcaccucuag

SEQ ID NO: 532897 - RNA, 22 nt, Human
ucccagagcugauaagccuuua

SEQ ID NO: 532898 - RNA, 22 nt, Human
caggaagagguaucaccgagca

SEQ ID NO: 532899 - RNA, 22 nt, Human
aggacaguguggaagagggugc

SEQ ID NO: 532900 - RNA, 18 nt, Human
agcaggugugcagaaugu

SEQ ID NO: 532901 - RNA, 22 nt, Human
ugggcagagaguagaggcaacg

SEQ ID NO: 532902 - RNA, 19 nt, Human
auaaauaaaaagugggaga

SEQ ID NO: 532903 - RNA, 22 nt, Human
aaggggaauagaguggguugug

SEQ ID NO: 532904 - RNA, 23 nt, Human
cccauuuucauguuaacuccugg

SEQ ID NO: 532905 - RNA, 22 nt, Human
uucugagacaauugagagucua

SEQ ID NO: 532906 - RNA, 22 nt, Human
ugaugcuucacgcugaauaugc

SEQ ID NO: 532907 - RNA, 22 nt, Human
uuaugauuugccacagauuggu

SEQ ID NO: 532908 - RNA, 22 nt, Human
agaaauuauuagugaauagucu

SEQ ID NO: 532909 - RNA, 22 nt, Human
uuugcauuguaauauuuaguuc

SEQ ID NO: 532910 - RNA, 21 nt, Human
uccaagcucaacucccuuccu

SEQ ID NO: 532911 - RNA, 22 nt, Human
ucuuuccagaggaauuuuuaga

SEQ ID NO: 532912 - RNA, 21 nt, Human
gccugcaguuuugaagcccuu

SEQ ID NO: 532913 - RNA, 22 nt, Human
ggcugagccuggagcaucuggu

SEQ ID NO: 532914 - RNA, 22 nt, Human
accuggcacuacaggcaccugu

SEQ ID NO: 532915 - RNA, 22 nt, Human
uucaacaucauuguaagccucu

SEQ ID NO: 532916 - RNA, 22 nt, Human
gucagagauggcaugaaagauu

SEQ ID NO: 532917 - RNA, 22 nt, Human
gaacagaauuaccgaagaucug

SEQ ID NO: 532918 - RNA, 22 nt, Human
guuagaaacacauucuuauuga

SEQ ID NO: 532919 - RNA, 22 nt, Human
ugaaacacugcgauaaaauccu

SEQ ID NO: 532920 - RNA, 21 nt, Human
agauguuucccccuuggcuuc

SEQ ID NO: 532921 - RNA, 22 nt, Human
aagggagacaguugugugagga

SEQ ID NO: 532922 - RNA, 22 nt, Human
cccagagucucugcucuugccu

SEQ ID NO: 532923 - RNA, 21 nt, Human
uuuguucauagcucacucuuu

SEQ ID NO: 532924 - RNA, 22 nt, Human
cuguggaguggggaguacuggu

SEQ ID NO: 532925 - RNA, 22 nt, Human
cccacucuggcucccuucuagu

SEQ ID NO: 532926 - RNA, 22 nt, Human
cucagacuggggcucccugagu

SEQ ID NO: 532927 - RNA, 22 nt, Human
ggccucuggcaggcaggcccuc

SEQ ID NO: 532928 - RNA, 19 nt, Human
cugcugggugcugagggag

SEQ ID NO: 532929 - RNA, 22 nt, Human
ugcucuguugugcaugugggau

SEQ ID NO: 532930 - RNA, 22 nt, Human
cuauuugucacaacugguguuu

SEQ ID NO: 532931 - RNA, 22 nt, Human
ucagaugguacuaauuuaagga

SEQ ID NO: 532932 - RNA, 22 nt, Human
guggccugggguuuguucugag

SEQ ID NO: 532933 - RNA, 22 nt, Human
aaguaugacauuuaagacaauu

SEQ ID NO: 532934 - RNA, 22 nt, Human
gaggcagugaacaauuccugug

SEQ ID NO: 532935 - RNA, 22 nt, Human
ucccauggauagugaccuuguu

SEQ ID NO: 532936 - RNA, 22 nt, Human
aauaucagcucugucacuuacu

SEQ ID NO: 532937 - RNA, 21 nt, Human
uucucaugggauaaguacaug

SEQ ID NO: 532938 - RNA, 22 nt, Human
uucaaacacugcuuugagaggg

SEQ ID NO: 532939 - RNA, 22 nt, Human
agaauaucguagcauauuaucu

SEQ ID NO: 532940 - RNA, 22 nt, Human
ucucuucugaaaccugucuuua

SEQ ID NO: 532941 - RNA, 22 nt, Human
agugucaaaucagcaucugggu

SEQ ID NO: 532942 - RNA, 22 nt, Human
augauucagggaguuuucagga

SEQ ID NO: 532943 - RNA, 22 nt, Human
ggcccaucucuugcucuggguu

SEQ ID NO: 532944 - RNA, 22 nt, Human
caacaguguugcaaucugaaaa

SEQ ID NO: 532945 - RNA, 22 nt, Human
uccuuugguucucuaagaugcu

SEQ ID NO: 532946 - RNA, 22 nt, Human
ccugcugggacgugugguugcc

SEQ ID NO: 532947 - RNA, 22 nt, Human
ucuguucauaguaguguauaug

SEQ ID NO: 532948 - RNA, 22 nt, Human
auuccacagcuacaucaaucua

SEQ ID NO: 532949 - RNA, 22 nt, Human
ucaggaagaaagaagggagugu

SEQ ID NO: 532950 - RNA, 22 nt, Human
cuguccucuguccucagcagga

SEQ ID NO: 532951 - RNA, 22 nt, Human
agcuguggggcaggcagcgagg

SEQ ID NO: 532952 - RNA, 19 nt, Human
augucuguugaauuucaua

SEQ ID NO: 532953 - RNA, 22 nt, Human
uuugcauuuguucaaguauuga

SEQ ID NO: 532954 - RNA, 22 nt, Human
aagugagugguaaggagcaugg

SEQ ID NO: 532955 - RNA, 22 nt, Human
cauuucaguguuauucuaauuu

SEQ ID NO: 532956 - RNA, 22 nt, Human
uacaguucacaguaucauaaau

SEQ ID NO: 532957 - RNA, 19 nt, Human
ccucuccgcccaccagccc

SEQ ID NO: 532958 - RNA, 22 nt, Human
ggaaaaaugacacauaucucaa

SEQ ID NO: 532959 - RNA, 22 nt, Human
aauacagucuuacuagaaaauc

SEQ ID NO: 532960 - RNA, 22 nt, Human
aucccuggacggcgccucccca

SEQ ID NO: 532961 - RNA, 22 nt, Human
caagcuccuuacauccacaggg

SEQ ID NO: 532962 - RNA, 23 nt, Human
uuugcaaauuggacacaaccaca

SEQ ID NO: 532963 - RNA, 22 nt, Human
ccaggagcaacuugaaggcaag

SEQ ID NO: 532964 - RNA, 22 nt, Human
aguggacucuucccagugcuug

SEQ ID NO: 532965 - RNA, 22 nt, Human
uucuuucuuagcaaucuauggu

SEQ ID NO: 532966 - RNA, 22 nt, Human
gaaggagggugcggaucugagc

SEQ ID NO: 532967 - RNA, 22 nt, Human
auucucaauggcuacuuucaua

SEQ ID NO: 532968 - RNA, 22 nt, Human
uacugcuugguguuguuguauc

SEQ ID NO: 532969 - RNA, 22 nt, Human
uuggcucaggaccccugugacu

SEQ ID NO: 532970 - RNA, 22 nt, Human
ugaggcucaagaaagauuuguu

SEQ ID NO: 532971 - RNA, 22 nt, Human
ccagccugguucagaauuggcu

SEQ ID NO: 532972 - RNA, 16 nt, Human
ggaggaaggcauagug

SEQ ID NO: 532973 - RNA, 22 nt, Human
gauauuuucagucuccuuucaa

SEQ ID NO: 532974 - RNA, 22 nt, Human
ucaaggcuaaacuuucagagua

SEQ ID NO: 532975 - RNA, 22 nt, Human
auuaaauuuucacuaggcuccc

SEQ ID NO: 532976 - RNA, 22 nt, Human
caugucuuuguuaugcucacca

SEQ ID NO: 532977 - RNA, 22 nt, Human
uauccaaaguuucucagaaacu

SEQ ID NO: 532978 - RNA, 22 nt, Human
ugcagggcacggugcgcguggg

SEQ ID NO: 532979 - RNA, 22 nt, Human
ugacuccaaacagaaaacgaau

SEQ ID NO: 532980 - RNA, 21 nt, Human
uucagcuuaugugucacuugc

SEQ ID NO: 532981 - RNA, 22 nt, Human
aaauaugagggugaugcccaga

SEQ ID NO: 532982 - RNA, 22 nt, Human
cacugcuuauaaauucuaggca

SEQ ID NO: 532983 - RNA, 22 nt, Human
agcaaugacuuugaaaucauga

SEQ ID NO: 532984 - RNA, 22 nt, Human
auugaaagcauggauuuggauu

SEQ ID NO: 532985 - RNA, 20 nt, Human
uauucaacuuuaaaaacuua

SEQ ID NO: 532986 - RNA, 22 nt, Human
ggaaucagaugaggggcagagc

SEQ ID NO: 532987 - RNA, 22 nt, Human
aguggcaggcagaagcuucuca

SEQ ID NO: 532988 - RNA, 22 nt, Human
auguacaguggaaacuaacaaa

SEQ ID NO: 532989 - RNA, 22 nt, Human
cuucuuuucauggcuugggaag

SEQ ID NO: 532990 - RNA, 22 nt, Human
gcugaggcuccucgggaggaca

SEQ ID NO: 532991 - RNA, 20 nt, Human
ucagugauuaucucugagug

SEQ ID NO: 532992 - RNA, 22 nt, Human
cagagcagaaaccugggugauu

SEQ ID NO: 532993 - RNA, 22 nt, Human
gggaccaggugggugcauuccg

SEQ ID NO: 532994 - RNA, 22 nt, Human
ucugccuggcggacucccggaa

SEQ ID NO: 532995 - RNA, 22 nt, Human
gcuguauuuaacaacuggcuca

SEQ ID NO: 532996 - RNA, 22 nt, Human
ucuuccucuagaucugaggccc

SEQ ID NO: 532997 - RNA, 22 nt, Human
ucuguguaagaccagugcuggg

SEQ ID NO: 532998 - RNA, 22 nt, Human
ccuggaguuuuuugguugacuc

SEQ ID NO: 532999 - RNA, 22 nt, Human
uuaauacagucuccagaaguaa

SEQ ID NO: 533000 - RNA, 22 nt, Human
ucucccaagggcacauucaagg

SEQ ID NO: 533001 - RNA, 22 nt, Human
gugcucagggccuggcugggga

SEQ ID NO: 533002 - RNA, 22 nt, Human
uauacagauaucuaagauguaa

SEQ ID NO: 533003 - RNA, 21 nt, Human
uucaaagacuugaugcugacc

SEQ ID NO: 533004 - RNA, 22 nt, Human
gaaccucagugaaacuggaggu

SEQ ID NO: 533005 - RNA, 22 nt, Human
ucuccugguauguaugcaccug

SEQ ID NO: 533006 - RNA, 19 nt, Human
gaaggcugaaaugaagcac

SEQ ID NO: 533007 - RNA, 22 nt, Human
agggaccucuucuugcagcuga

SEQ ID NO: 533008 - RNA, 22 nt, Human
ucccuggagguguuugcucagg

SEQ ID NO: 533009 - RNA, 22 nt, Human
uuugcauuucuaaugagcuccg

SEQ ID NO: 533010 - RNA, 22 nt, Human
uauaucauggagauuaacauuc

SEQ ID NO: 533011 - RNA, 22 nt, Human
aaaacaguuuuugcuaacugcu

SEQ ID NO: 533012 - RNA, 19 nt, Human
uccuuccccccagcacaga

SEQ ID NO: 533013 - RNA, 22 nt, Human
gucagcuaugucuguuguugag

SEQ ID NO: 533014 - RNA, 22 nt, Human
uggcucaggggucuggcucugu

SEQ ID NO: 533015 - RNA, 22 nt, Human
ucuauuuuguuuccagcucuac

SEQ ID NO: 533016 - RNA, 22 nt, Human
cugggccucaugcacagagaug

SEQ ID NO: 533017 - RNA, 22 nt, Human
ucauacaaggaggguguucaaa

SEQ ID NO: 533018 - RNA, 22 nt, Human
cucugcagaauuugagcugcuc

SEQ ID NO: 533019 - RNA, 22 nt, Human
ccugucuggugaggggguugca

SEQ ID NO: 533020 - RNA, 22 nt, Human
gaguccaguaguuaggacagag

SEQ ID NO: 533021 - RNA, 23 nt, Human
cagggcugggcuugguguuaggc

SEQ ID NO: 533022 - RNA, 22 nt, Human
ggucccugguucccucugagcu

SEQ ID NO: 533023 - RNA, 21 nt, Human
uuacaaagcaagugcuguguc

SEQ ID NO: 533024 - RNA, 22 nt, Human
aacaaaagccgaaguagguguc

SEQ ID NO: 533025 - RNA, 22 nt, Human
auggacagugugaagcagauag

SEQ ID NO: 533026 - RNA, 22 nt, Human
gcuuggaaguaggauugggaga

SEQ ID NO: 533027 - RNA, 22 nt, Human
cccuggcucugccucagagccc

SEQ ID NO: 533028 - RNA, 22 nt, Human
gcugucuucacuuccugguuuc

SEQ ID NO: 533029 - RNA, 22 nt, Human
acuggggauuagggacucagug

SEQ ID NO: 533030 - RNA, 22 nt, Human
caucauuucacuuagaugaagu

SEQ ID NO: 533031 - RNA, 22 nt, Human
cccugcuuucaaccuucuagcu

SEQ ID NO: 533032 - RNA, 22 nt, Human
ccuuggagcggucagcacuggu

SEQ ID NO: 533033 - RNA, 21 nt, Human
agcagaggcagaauguaugca

SEQ ID NO: 533034 - RNA, 22 nt, Human
uaauacaaggcaggaagcagua

SEQ ID NO: 533035 - RNA, 21 nt, Human
ggaaggcuaugguguauuuuu

SEQ ID NO: 533036 - RNA, 22 nt, Human
agcccaagcuaugaggugaccu

SEQ ID NO: 533037 - RNA, 20 nt, Human
agagugagacuccaucucag

SEQ ID NO: 533038 - RNA, 22 nt, Human
ggcuuccuuucacuacccucag

SEQ ID NO: 533039 - RNA, 19 nt, Human
cauuuuaagcauccccagu

SEQ ID NO: 533040 - RNA, 22 nt, Human
cuuugaaaacuuaaauaacagc

SEQ ID NO: 533041 - RNA, 22 nt, Human
uaaaagaagcuucaaggccggc

SEQ ID NO: 533042 - RNA, 18 nt, Human
uggcagccagcugcuccu

SEQ ID NO: 533043 - RNA, 22 nt, Human
ucacaguacuccccaaaguuuc

SEQ ID NO: 533044 - RNA, 22 nt, Human
uuaagcucucauuauuauuauu

SEQ ID NO: 533045 - RNA, 22 nt, Human
cucagcagcagggaagagguca

SEQ ID NO: 533046 - RNA, 22 nt, Human
agcagaagugccuuagcaauca

SEQ ID NO: 533047 - RNA, 22 nt, Human
uggaagagguggaaguggcuuc

SEQ ID NO: 533048 - RNA, 22 nt, Human
agguggcagagcuggcccagcg

SEQ ID NO: 533049 - RNA, 23 nt, Human
uucuuuguggauaaucuccagug

SEQ ID NO: 533050 - RNA, 22 nt, Human
agacaaaggauuaaugaugaug

SEQ ID NO: 533051 - RNA, 22 nt, Human
gccuccugaaaggaagagcucc

SEQ ID NO: 533052 - RNA, 22 nt, Human
aaaugcacaggagaaccaauuc

SEQ ID NO: 533053 - RNA, 22 nt, Human
gccagagcacaggcugguagua

SEQ ID NO: 533054 - RNA, 22 nt, Human
caucauuuuuguaagcugguag

SEQ ID NO: 533055 - RNA, 22 nt, Human
ggcagagcuuguuccuucuguu

SEQ ID NO: 533056 - RNA, 22 nt, Human
acaccacaaguaacucuuuucc

SEQ ID NO: 533057 - RNA, 22 nt, Human
gggcugcugcugccagcgacac

SEQ ID NO: 533058 - RNA, 22 nt, Human
ccucuggcaacuucacagccca

SEQ ID NO: 533059 - RNA, 22 nt, Human
auguagagcaguguuguccaau

SEQ ID NO: 533060 - RNA, 20 nt, Human
caggcacacucauuccugcu

SEQ ID NO: 533061 - RNA, 22 nt, Human
ugggcaggggcccugcuuccgu

SEQ ID NO: 533062 - RNA, 22 nt, Human
agguaaagacagugaaagaggg

SEQ ID NO: 533063 - RNA, 22 nt, Human
uggcaagggauuguggagaacu

SEQ ID NO: 533064 - RNA, 22 nt, Human
ccugcagaagaguccagcucau

SEQ ID NO: 533065 - RNA, 22 nt, Human
gcagcugagagaagaacagggc

SEQ ID NO: 533066 - RNA, 22 nt, Human
uaaaguuuggcagacaauaaca

SEQ ID NO: 533067 - RNA, 22 nt, Human
ucagagcugcccaugcaagggg

SEQ ID NO: 533068 - RNA, 22 nt, Human
cagaacagaaguaaaauuuacc

SEQ ID NO: 533069 - RNA, 22 nt, Human
ccuggcuuccuggagcucacaa

SEQ ID NO: 533070 - RNA, 22 nt, Human
cugcucugugguccaugagaca

SEQ ID NO: 533071 - RNA, 22 nt, Human
ucucaggacuuugggaagcuca

SEQ ID NO: 533072 - RNA, 20 nt, Human
ucuuuagauuuaucuuaugu

SEQ ID NO: 533073 - RNA, 22 nt, Human
aguguuaagagaaaauucugcu

SEQ ID NO: 533074 - RNA, 22 nt, Human
aggccagacagcuagaaacagg

SEQ ID NO: 533075 - RNA, 22 nt, Human
aaggugggguccugucaucuga

SEQ ID NO: 533076 - RNA, 22 nt, Human
gaggcagagaccuucaggaccu

SEQ ID NO: 533077 - RNA, 22 nt, Human
cagugggcugugauggauucac

SEQ ID NO: 533078 - RNA, 22 nt, Human
uuugcauuuguuuagaaccuga

SEQ ID NO: 533079 - RNA, 22 nt, Human
cugcugugcagacagacucucu

SEQ ID NO: 533080 - RNA, 22 nt, Human
agagucugauauuuguaccaga

SEQ ID NO: 533081 - RNA, 22 nt, Human
acauuugacucuguucauauua

SEQ ID NO: 533082 - RNA, 22 nt, Human
gugucauuaaccaccaugcaaa

SEQ ID NO: 533083 - RNA, 22 nt, Human
uccaggagguagugcuuaauuu

SEQ ID NO: 533084 - RNA, 23 nt, Human
ucugggcugagacuuggaagguc

SEQ ID NO: 533085 - RNA, 22 nt, Human
aaaaaccuuucccauacuaaga

SEQ ID NO: 533086 - RNA, 22 nt, Human
acugggccuugccauggcagcc

SEQ ID NO: 533087 - RNA, 15 nt, Human
gcagaugggggugau

SEQ ID NO: 533088 - RNA, 22 nt, Human
auccaaaccuggacaugagugg

SEQ ID NO: 533089 - RNA, 20 nt, Human
cugggaggucuuccaaauca

SEQ ID NO: 533090 - RNA, 22 nt, Human
ucuguuuuugaggcuaucuucu

SEQ ID NO: 533091 - RNA, 22 nt, Human
ggagggguggucaccuggcagg

SEQ ID NO: 533092 - RNA, 22 nt, Human
agaaggcacucacacuggcacg

SEQ ID NO: 533093 - RNA, 22 nt, Human
ggugaggcagguggcugcugag

SEQ ID NO: 533094 - RNA, 16 nt, Human
uggaaggggucuccgg

SEQ ID NO: 533095 - RNA, 22 nt, Human
agacccugucaguguuaggaaa

SEQ ID NO: 533096 - RNA, 22 nt, Human
aacugcaaaauaaucaaguugu

SEQ ID NO: 533097 - RNA, 22 nt, Human
gcagcuuuaaacauuggaaaua

SEQ ID NO: 533098 - RNA, 22 nt, Human
aaacuucagugaaugacuuaug

SEQ ID NO: 533099 - RNA, 22 nt, Human
augcaagauguauagaagacuu

SEQ ID NO: 533100 - RNA, 22 nt, Human
cagagcugcgcuuuuuccuggu

SEQ ID NO: 533101 - RNA, 21 nt, Human
guggcccugguguggcugcac

SEQ ID NO: 533102 - RNA, 22 nt, Human
ugggcagaaaucaguaucagau

SEQ ID NO: 533103 - RNA, 22 nt, Human
acaagagauuaucuacagauga

SEQ ID NO: 533104 - RNA, 22 nt, Human
gaucuuuucagaauuuaucagu

SEQ ID NO: 533105 - RNA, 22 nt, Human
uauuuugucuucugcucaucac

SEQ ID NO: 533106 - RNA, 22 nt, Human
ggcugcuggaagacugaacaag

SEQ ID NO: 533107 - RNA, 22 nt, Human
gcacagccagcaucugagggau

SEQ ID NO: 533108 - RNA, 22 nt, Human
ugugugccagccuacgaggagc

SEQ ID NO: 533109 - RNA, 22 nt, Human
gaagcagcaaguauaggacagg

SEQ ID NO: 533110 - RNA, 22 nt, Human
ugccugggugcuggcuggucac

SEQ ID NO: 533111 - RNA, 22 nt, Human
cugcucuggucucuucauguuu

SEQ ID NO: 533112 - RNA, 22 nt, Human
uggugagaccuuguuccuuaug

SEQ ID NO: 533113 - RNA, 22 nt, Human
gcugugcucaacgugccuuccu

SEQ ID NO: 533114 - RNA, 22 nt, Human
cugaaauguuaaauacuuggcu

SEQ ID NO: 533115 - RNA, 22 nt, Human
cagauaaauagauagauaaacu

SEQ ID NO: 533116 - RNA, 20 nt, Human
ggcagggcaucaacagcucu

SEQ ID NO: 533117 - RNA, 22 nt, Human
guguuuccuaguuuaaugaaug

SEQ ID NO: 533118 - RNA, 22 nt, Human
uaggccaguggcagguugugug

SEQ ID NO: 533119 - RNA, 22 nt, Human
cuggagccgcauggagcaggga

SEQ ID NO: 533120 - RNA, 22 nt, Human
caggccucuauggucagcugag

SEQ ID NO: 533121 - RNA, 22 nt, Human
gggcugagaauucagcuuuccu

SEQ ID NO: 533122 - RNA, 18 nt, Human
cacagugacuucugauac

SEQ ID NO: 533123 - RNA, 22 nt, Human
agggcagcagcccauggcucug

SEQ ID NO: 533124 - RNA, 22 nt, Human
cgccggcuugaggcaggcggca

SEQ ID NO: 533125 - RNA, 22 nt, Human
uugcccagagucacccagcuca

SEQ ID NO: 533126 - RNA, 22 nt, Human
gaaggaaaaauacucuguaagg

SEQ ID NO: 533127 - RNA, 22 nt, Human
aauaauuuugagagccuggaaa

SEQ ID NO: 533128 - RNA, 22 nt, Human
uuuauacuccacucugcaagcg

SEQ ID NO: 533129 - RNA, 22 nt, Human
uccuugaauauaauaacaguag

SEQ ID NO: 533130 - RNA, 22 nt, Human
gcugugcagguccccacugccu

SEQ ID NO: 533131 - RNA, 22 nt, Human
ucagcaguggcucucaugcagu

SEQ ID NO: 533132 - RNA, 22 nt, Human
gugcccuguugcacacuugagg

SEQ ID NO: 533133 - RNA, 22 nt, Human
uggccugccugggagcagcagg

SEQ ID NO: 533134 - RNA, 19 nt, Human
uccccagcaccucugaguc

SEQ ID NO: 533135 - RNA, 22 nt, Human
uguuuauucauggcuaaugaaa

SEQ ID NO: 533136 - RNA, 22 nt, Human
agugucauuuuguccaucuucu

SEQ ID NO: 533137 - RNA, 22 nt, Human
aucuggcuccuacacuugaaga

SEQ ID NO: 533138 - RNA, 22 nt, Human
caauaugcaagcuauuaaguau

SEQ ID NO: 533139 - RNA, 18 nt, Human
uucagcagcagacacacu

SEQ ID NO: 533140 - RNA, 22 nt, Human
ucaaguguaguggugucagguc

SEQ ID NO: 533141 - RNA, 22 nt, Human
guuucuggcgccggggcaggcc

SEQ ID NO: 533142 - RNA, 22 nt, Human
caucuccuuuggucuacuucca

SEQ ID NO: 533143 - RNA, 22 nt, Human
agcugucuuucugccuccugau

SEQ ID NO: 533144 - RNA, 20 nt, Human
cacguuuuuccacuagcaaa

SEQ ID NO: 533145 - RNA, 22 nt, Human
auuuaguguguauugcuauuau

SEQ ID NO: 533146 - RNA, 22 nt, Human
uuugaaacucaugaucaucacu

SEQ ID NO: 533147 - RNA, 20 nt, Human
ugaaggccagcagcauaggg

SEQ ID NO: 533148 - RNA, 22 nt, Human
agguauuauuagcaucucuauu

SEQ ID NO: 533149 - RNA, 20 nt, Human
ucugaggcugagcucuacuu

SEQ ID NO: 533150 - RNA, 21 nt, Human
uuccagaaaucucuuucuuca

SEQ ID NO: 533151 - RNA, 22 nt, Human
gcuccaggagagggaagcagau

SEQ ID NO: 533152 - RNA, 22 nt, Human
uagcacaggucuuguugccauu

SEQ ID NO: 533153 - RNA, 22 nt, Human
aacagcagcaaguaagcagguc

SEQ ID NO: 533154 - RNA, 22 nt, Human
ccagcuggaagagugcagaacu

SEQ ID NO: 533155 - RNA, 22 nt, Human
gggauggacuuggggacuccag

SEQ ID NO: 533156 - RNA, 22 nt, Human
uucaacauuugaaaugaaugaa

SEQ ID NO: 533157 - RNA, 22 nt, Human
cagcaauauacacagucuaugg

SEQ ID NO: 533158 - RNA, 22 nt, Human
ucagagaaaugaaguagggauu

SEQ ID NO: 533159 - RNA, 22 nt, Human
aaggcacauuccugaaaacaau

SEQ ID NO: 533160 - RNA, 23 nt, Human
uuggggacaaacaugcuacuuuc

SEQ ID NO: 533161 - RNA, 22 nt, Human
cagccacguagcccuuggccgu

SEQ ID NO: 533162 - RNA, 22 nt, Human
gcagacaggggcuuaggaaagg

SEQ ID NO: 533163 - RNA, 22 nt, Human
uucaaagauaauuaccaaacau

SEQ ID NO: 533164 - RNA, 22 nt, Human
ccaaggagaaugacaccaugga

SEQ ID NO: 533165 - RNA, 22 nt, Human
auauauuacaaaagaggaagga

SEQ ID NO: 533166 - RNA, 22 nt, Human
uucuguaugccaauggguuuuu

SEQ ID NO: 533167 - RNA, 22 nt, Human
ggcuucucgugccgaagcaaga

SEQ ID NO: 533168 - RNA, 22 nt, Human
auuauuaaagcuacaucaagga

SEQ ID NO: 533169 - RNA, 19 nt, Human
uacuuuuucaggacagagu

SEQ ID NO: 533170 - RNA, 22 nt, Human
cuuuaugguaaguauagaugac

SEQ ID NO: 533171 - RNA, 22 nt, Human
uucauagaaagugcuuagauug

SEQ ID NO: 533172 - RNA, 22 nt, Human
acagagccacuuuggugccuac

SEQ ID NO: 533173 - RNA, 22 nt, Human
cccaggcacaccccgaacggaa

SEQ ID NO: 533174 - RNA, 18 nt, Human
uauaaacacacuuagguu

SEQ ID NO: 533175 - RNA, 22 nt, Human
uggcaucucaaacaggcagauu

SEQ ID NO: 533176 - RNA, 22 nt, Human
ucuguaaaacaauauuguauuc

SEQ ID NO: 533177 - RNA, 22 nt, Human
ccaacucugaaaauccagauau

SEQ ID NO: 533178 - RNA, 21 nt, Human
accucaagcaacaaccaaggu

SEQ ID NO: 533179 - RNA, 22 nt, Human
agaaagcacucugucuuuuacc

SEQ ID NO: 533180 - RNA, 22 nt, Human
aauuucaaacuaauaggaacca

SEQ ID NO: 533181 - RNA, 22 nt, Human
acugugauguucucuaucuugg

SEQ ID NO: 533182 - RNA, 21 nt, Human
uaaggccaagucuauuucugu

SEQ ID NO: 533183 - RNA, 22 nt, Human
guggugcaggccagcaggggcg

SEQ ID NO: 533184 - RNA, 22 nt, Human
ugcagggccagacuggguugga

SEQ ID NO: 533185 - RNA, 22 nt, Human
gucugcugcagagcauggcuuu

SEQ ID NO: 533186 - RNA, 22 nt, Human
caggagcucuuaaggaugugau

SEQ ID NO: 533187 - RNA, 19 nt, Human
augauggucccauucaccu

SEQ ID NO: 533188 - RNA, 22 nt, Human
cacauuucucuaccucacacaa

SEQ ID NO: 533189 - RNA, 22 nt, Human
ccugagggaaggaugcuaccca

SEQ ID NO: 533190 - RNA, 22 nt, Human
ugcccugcagugagugcgucug

SEQ ID NO: 533191 - RNA, 22 nt, Human
aggcacugagaggcuguguugc

SEQ ID NO: 533192 - RNA, 19 nt, Human
auggaaaaugccagacuga

SEQ ID NO: 533193 - RNA, 22 nt, Human
ccugcuguagggccccuggggc

SEQ ID NO: 533194 - RNA, 22 nt, Human
uucaaagugcuuuuaaccuuua

SEQ ID NO: 533195 - RNA, 22 nt, Human
ccugggcagggagaccaggcuc

SEQ ID NO: 533196 - RNA, 19 nt, Human
agugcagggagcacccuca

SEQ ID NO: 533197 - RNA, 22 nt, Human
acaggcagguugagaaacauuu

SEQ ID NO: 533198 - RNA, 22 nt, Human
cauugcacuccagcuugggcaa

SEQ ID NO: 533199 - RNA, 22 nt, Human
uaaagcagugcaaaagcguuuu

SEQ ID NO: 533200 - RNA, 22 nt, Human
agugcaaaauucagaagcaauu

SEQ ID NO: 533201 - RNA, 22 nt, Human
ugaggccugcuuggaauugaau

SEQ ID NO: 533202 - RNA, 22 nt, Human
uuccaagaguaaauucaaauug

SEQ ID NO: 533203 - RNA, 20 nt, Human
ccagguggugccuggagagg

SEQ ID NO: 533204 - RNA, 20 nt, Human
cacagcuugccuuuuaugac

SEQ ID NO: 533205 - RNA, 22 nt, Human
caggcugaggcaguaggguuug

SEQ ID NO: 533206 - RNA, 22 nt, Human
ucuuuccuagaggcugaugagu

SEQ ID NO: 533207 - RNA, 22 nt, Human
uagagcuggaaaacugcaggua

SEQ ID NO: 533208 - RNA, 22 nt, Human
gcagucaguaaggcagccagaa

SEQ ID NO: 533209 - RNA, 22 nt, Human
acaaagcuagagaagagaauug

SEQ ID NO: 533210 - RNA, 22 nt, Human
uaguggagaguuguuuugugca

SEQ ID NO: 533211 - RNA, 22 nt, Human
ugccugugcccuuugcugggag

SEQ ID NO: 533212 - RNA, 19 nt, Human
uuugaaagaguuuuauugg

SEQ ID NO: 533213 - RNA, 22 nt, Human
aagaaucauuguaaaguucugu

SEQ ID NO: 533214 - RNA, 22 nt, Human
gggccaguagcaccugugugga

SEQ ID NO: 533215 - RNA, 22 nt, Human
uggaggaaguggcuggccagaa

SEQ ID NO: 533216 - RNA, 22 nt, Human
ugcagccccugaaaauggcagc

SEQ ID NO: 533217 - RNA, 19 nt, Human
cagagcagugguuccugaa

SEQ ID NO: 533218 - RNA, 22 nt, Human
ugcaggcuccaggugcacauau

SEQ ID NO: 533219 - RNA, 22 nt, Human
gagauggccagugccaggacaa

SEQ ID NO: 533220 - RNA, 22 nt, Human
uguuuuucaaauauugcucugu

SEQ ID NO: 533221 - RNA, 22 nt, Human
gaggugucccgcaguccccaag

SEQ ID NO: 533222 - RNA, 22 nt, Human
gggccuucuaguuagccccaau

SEQ ID NO: 533223 - RNA, 22 nt, Human
accaaggaagaaucuauuugag

SEQ ID NO: 533224 - RNA, 22 nt, Human
auuugaaccacucagaacucau

SEQ ID NO: 533225 - RNA, 22 nt, Human
cuuggagugaaugggggcaggu

SEQ ID NO: 533226 - RNA, 19 nt, Human
cagguggcgcucuacaggg

SEQ ID NO: 533227 - RNA, 18 nt, Human
uccugccugcgggcuccc

SEQ ID NO: 533228 - RNA, 22 nt, Human
cugggcugcaguuccugguccu

SEQ ID NO: 533229 - RNA, 22 nt, Human
aauaugcauuauacagacugau

SEQ ID NO: 533230 - RNA, 22 nt, Human
ggcucaccauggccucccugcu

SEQ ID NO: 533231 - RNA, 22 nt, Human
guccagaauuacuacuguuuga

SEQ ID NO: 533232 - RNA, 22 nt, Human
ccugugcucccuauguaucugg

SEQ ID NO: 533233 - RNA, 22 nt, Human
uccucugcuguucugguucuuu

SEQ ID NO: 533234 - RNA, 22 nt, Human
acagaugaaucugugauugcug

SEQ ID NO: 533235 - RNA, 23 nt, Human
cccuggagcuagucugagcagag

SEQ ID NO: 533236 - RNA, 22 nt, Human
caggucccgccccgggcugacc

SEQ ID NO: 533237 - RNA, 22 nt, Human
uauuugaaaguguacaaaaacu

SEQ ID NO: 533238 - RNA, 22 nt, Human
acuugguuggucucacccuguu

SEQ ID NO: 533239 - RNA, 22 nt, Human
cuacauuaaauuggcuuacuua

SEQ ID NO: 533240 - RNA, 22 nt, Human
uagaaauguugguauuaacauu

SEQ ID NO: 533241 - RNA, 22 nt, Human
augcacaagcaagagauaaugg

SEQ ID NO: 533242 - RNA, 22 nt, Human
uuagauaacaguagaauaucaa

SEQ ID NO: 533243 - RNA, 22 nt, Human
guucaaguuucugagcuuuaau

SEQ ID NO: 533244 - RNA, 22 nt, Human
gucagagagggcacgugcacac

SEQ ID NO: 533245 - RNA, 22 nt, Human
gcaggcaggagcccaacugccu

SEQ ID NO: 533246 - RNA, 22 nt, Human
ugaggcucaaggucugguggag

SEQ ID NO: 533247 - RNA, 22 nt, Human
cacacacugacaccuuaucuug

SEQ ID NO: 533248 - RNA, 22 nt, Human
aggcugaggcuggcagcuccag

SEQ ID NO: 533249 - RNA, 22 nt, Human
ggccaguggcucugugcuuggg

SEQ ID NO: 533250 - RNA, 22 nt, Human
uaaacaucaccuucugcaguug

SEQ ID NO: 533251 - RNA, 22 nt, Human
ugaggaggcccagguuggggcu

SEQ ID NO: 533252 - RNA, 14 nt, Human
caggaagacucagc

SEQ ID NO: 533253 - RNA, 17 nt, Human
uuguguguaguucugau

SEQ ID NO: 533254 - RNA, 22 nt, Human
ggggacaguuaaagaccaagac

SEQ ID NO: 533255 - RNA, 22 nt, Human
caaaauguucuggcaccuuuaa

SEQ ID NO: 533256 - RNA, 22 nt, Human
cagcaucaccgccauuucugau

SEQ ID NO: 533257 - RNA, 22 nt, Human
gcugaggccccagggugauggg

SEQ ID NO: 533258 - RNA, 22 nt, Human
aaguucaaggcucuagaguucc

SEQ ID NO: 533259 - RNA, 22 nt, Human
uucacacacagcuuccuauugu

SEQ ID NO: 533260 - RNA, 22 nt, Human
gcugggcuccaggccaggguga

SEQ ID NO: 533261 - RNA, 21 nt, Human
cucaggauggcggccuggugg

SEQ ID NO: 533262 - RNA, 23 nt, Human
uggccagguagaggagguaguga

SEQ ID NO: 533263 - RNA, 17 nt, Human
acagggcagaaacagcu

SEQ ID NO: 533264 - RNA, 22 nt, Human
acaauuuuucaaagaagcuuau

SEQ ID NO: 533265 - RNA, 22 nt, Human
acuguguccuauuuccuugaca

SEQ ID NO: 533266 - RNA, 22 nt, Human
gaaaggugccccauaggcagga

SEQ ID NO: 533267 - RNA, 22 nt, Human
uccucuggcccagcugccucug

SEQ ID NO: 533268 - RNA, 22 nt, Human
cagagcuggagcuugaauggag

SEQ ID NO: 533269 - RNA, 22 nt, Human
cuacauuuggagaguauaggaa

SEQ ID NO: 533270 - RNA, 18 nt, Human
ugggagugggaguggaua

SEQ ID NO: 533271 - RNA, 22 nt, Human
cagaggugcauacaggucauua

SEQ ID NO: 533272 - RNA, 22 nt, Human
ugggagcagcuuugcgagggag

SEQ ID NO: 533273 - RNA, 22 nt, Human
caggccugggcuucggggcuga

SEQ ID NO: 533274 - RNA, 22 nt, Human
aaggccuugccgaaggaugcca

SEQ ID NO: 533275 - RNA, 22 nt, Human
cagaguguuucuuugggugggu

SEQ ID NO: 533276 - RNA, 23 nt, Human
agagcaucaugaugcuaagucug

SEQ ID NO: 533277 - RNA, 22 nt, Human
augcuggggccucagaccagaa

SEQ ID NO: 533278 - RNA, 22 nt, Human
cagaagcagugagagaugugca

SEQ ID NO: 533279 - RNA, 22 nt, Human
uauagcaauucagaauacaugu

SEQ ID NO: 533280 - RNA, 22 nt, Human
ggagccuuccagacugcccaca

SEQ ID NO: 533281 - RNA, 22 nt, Human
gugggcagacagugcuuugcag

SEQ ID NO: 533282 - RNA, 23 nt, Human
caugcaaacacuauugcauuugg

SEQ ID NO: 533283 - RNA, 22 nt, Human
agggaugcaguaaaaacuguag

SEQ ID NO: 533284 - RNA, 22 nt, Human
uucaggaaauuugugucacagg

SEQ ID NO: 533285 - RNA, 22 nt, Human
augcaccugaacuccaucagcu

SEQ ID NO: 533286 - RNA, 22 nt, Human
aaaacauugaauugcacacuau

SEQ ID NO: 533287 - RNA, 22 nt, Human
cuguggcuucugcuugggccuc

SEQ ID NO: 533288 - RNA, 22 nt, Human
accuccugaugagaguaaagga

SEQ ID NO: 533289 - RNA, 22 nt, Human
agggcccauagaucgucagcuu

SEQ ID NO: 533290 - RNA, 22 nt, Human
cagaggcaggauaagaacugcg

SEQ ID NO: 533291 - RNA, 22 nt, Human
ugcuaaauaaguggaauagaca

SEQ ID NO: 533292 - RNA, 22 nt, Human
aagcuggagaguuaggugaaua

SEQ ID NO: 533293 - RNA, 22 nt, Human
ucagaggaacacuguuucaugc

SEQ ID NO: 533294 - RNA, 22 nt, Human
agggcagagagaugaaugggau

SEQ ID NO: 533295 - RNA, 22 nt, Human
uucucuuagcuguaaagucaau

SEQ ID NO: 533296 - RNA, 22 nt, Human
uuauuuuuaaaaguucacacag

SEQ ID NO: 533297 - RNA, 22 nt, Human
acauacaaauagagcuguagua

SEQ ID NO: 533298 - RNA, 22 nt, Human
gauuuucaugauaaacuuguga

SEQ ID NO: 533299 - RNA, 22 nt, Human
gcugagaggcacuaucuccgga

SEQ ID NO: 533300 - RNA, 22 nt, Human
agcagggcagugcuucagcucu

SEQ ID NO: 533301 - RNA, 22 nt, Human
ucacugcaaggaggcuucucaa

SEQ ID NO: 533302 - RNA, 22 nt, Human
uaaagcauguuucaguaagguu

SEQ ID NO: 533303 - RNA, 22 nt, Human
cucucugaggaaggagcaucug

SEQ ID NO: 533304 - RNA, 22 nt, Human
acucagaguuuuacccagagac

SEQ ID NO: 533305 - RNA, 22 nt, Human
ucacagaaauaagauaguuauu

SEQ ID NO: 533306 - RNA, 22 nt, Human
augggccuugacacauggagug

SEQ ID NO: 533307 - RNA, 22 nt, Human
aauaaaucaauccuauugguag

SEQ ID NO: 533308 - RNA, 22 nt, Human
gggccugcuggugcuuccauug

SEQ ID NO: 533309 - RNA, 22 nt, Human
ugcauacacaagcauacaugua

SEQ ID NO: 533310 - RNA, 22 nt, Human
gcauuucagaagcaugcccucu

SEQ ID NO: 533311 - RNA, 22 nt, Human
cucagagaaaaggagcaagggu

SEQ ID NO: 533312 - RNA, 22 nt, Human
cugccucucagccugaccgcca

SEQ ID NO: 533313 - RNA, 22 nt, Human
acagcagccugcagcccugugu

SEQ ID NO: 533314 - RNA, 19 nt, Human
ugcagcucagggcaggggc

SEQ ID NO: 533315 - RNA, 22 nt, Human
gcacugcagguggguggagagg

SEQ ID NO: 533316 - RNA, 19 nt, Human
ggaagagaggaaaggugga

SEQ ID NO: 533317 - RNA, 22 nt, Human
uuugugugguggauacugggua

SEQ ID NO: 533318 - RNA, 22 nt, Human
uggaguuccuuugaaaggcucu

SEQ ID NO: 533319 - RNA, 22 nt, Human
gcagggcaugggcccugucugc

SEQ ID NO: 533320 - RNA, 22 nt, Human
uuuaaucaggcaaagcauaaua

SEQ ID NO: 533321 - RNA, 22 nt, Human
guucaauuuagaaagcacaguu

SEQ ID NO: 533322 - RNA, 22 nt, Human
aaggccugggaguacugggaca

SEQ ID NO: 533323 - RNA, 22 nt, Human
uuuucaagagaguguucuaugu

SEQ ID NO: 533324 - RNA, 22 nt, Human
ccagggagccuggugugucagc

SEQ ID NO: 533325 - RNA, 22 nt, Human
acagcugggaacucacacagca

SEQ ID NO: 533326 - RNA, 22 nt, Human
aauggcugccagggcaggaggu

SEQ ID NO: 533327 - RNA, 22 nt, Human
aauucagcaaaaagauacagga

SEQ ID NO: 533328 - RNA, 22 nt, Human
agcucugggccaggaacccuaa

SEQ ID NO: 533329 - RNA, 22 nt, Human
uaauguuugggaaggugcuuug

SEQ ID NO: 533330 - RNA, 23 nt, Human
gggaagugaggagccccucugcc

SEQ ID NO: 533331 - RNA, 22 nt, Human
agcccagguugaggcugcagug

SEQ ID NO: 533332 - RNA, 22 nt, Human
ugcagcaggagccaggccuggu

SEQ ID NO: 533333 - RNA, 22 nt, Human
auucauaaguaaaugauuaccu

SEQ ID NO: 533334 - RNA, 19 nt, Human
ccuguucaugacucugucc

SEQ ID NO: 533335 - RNA, 22 nt, Human
ccaucaguuuuaucugacaaaa

SEQ ID NO: 533336 - RNA, 19 nt, Human
aauaagcuuggguaaaacu

SEQ ID NO: 533337 - RNA, 22 nt, Human
uuugguuuuuaccugcugagag

SEQ ID NO: 533338 - RNA, 22 nt, Human
ggugggaaauaauuaggauuau

SEQ ID NO: 533339 - RNA, 22 nt, Human
gggcucagcugggcgugcuggu

SEQ ID NO: 533340 - RNA, 22 nt, Human
uuuuauguuccugaagcuaucu

SEQ ID NO: 533341 - RNA, 22 nt, Human
gcugguuaggugagggugcgcc

SEQ ID NO: 533342 - RNA, 22 nt, Human
aaaauugaggcucauguuaaau

SEQ ID NO: 533343 - RNA, 22 nt, Human
cauugcacuucugcuuuuccuc

SEQ ID NO: 533344 - RNA, 22 nt, Human
auuuucaaaacaucugcugugu

SEQ ID NO: 533345 - RNA, 22 nt, Human
ucaaaugcacguagagaaaaua

SEQ ID NO: 533346 - RNA, 22 nt, Human
gauaaaauaacuauggaauacu

SEQ ID NO: 533347 - RNA, 22 nt, Human
ucauucuccucuggaaaaggca

SEQ ID NO: 533348 - RNA, 22 nt, Human
guugaaagaucauguggcugcc

SEQ ID NO: 533349 - RNA, 22 nt, Human
ccugugcccucagccuggcucu

SEQ ID NO: 533350 - RNA, 22 nt, Human
ccugggcagugcuggaguugaa

SEQ ID NO: 533351 - RNA, 22 nt, Human
gaggguggccuuuagagcccau

SEQ ID NO: 533352 - RNA, 22 nt, Human
guggggugggcugaguuaggcc

SEQ ID NO: 533353 - RNA, 22 nt, Human
gaaaguauuuaaguccauauuu

SEQ ID NO: 533354 - RNA, 22 nt, Human
auucacagggcuuuccgcaugg

SEQ ID NO: 533355 - RNA, 21 nt, Human
ccuggccaaucugauaggguu

SEQ ID NO: 533356 - RNA, 22 nt, Human
ucuuugaacucuguguauuaac

SEQ ID NO: 533357 - RNA, 22 nt, Human
accaggcagucaccguccagga

SEQ ID NO: 533358 - RNA, 22 nt, Human
ggaggcagaauagagugugggu

SEQ ID NO: 533359 - RNA, 22 nt, Human
aauauguugagucuaucuuuau

SEQ ID NO: 533360 - RNA, 22 nt, Human
ccugacgaaaggcgugcuggag

SEQ ID NO: 533361 - RNA, 22 nt, Human
ggcagggaguggagacucccua

SEQ ID NO: 533362 - RNA, 22 nt, Human
gucacacagggccuccaaauca

SEQ ID NO: 533363 - RNA, 20 nt, Human
uguaaauaggcauuguaguu

SEQ ID NO: 533364 - RNA, 22 nt, Human
ucccacaggaaaguagacauug

SEQ ID NO: 533365 - RNA, 22 nt, Human
uauugaaauccauuacguucuu

SEQ ID NO: 533366 - RNA, 22 nt, Human
ccagguggacuugauuugaaua

SEQ ID NO: 533367 - RNA, 22 nt, Human
ucugcagcgugcaggcuggugc

SEQ ID NO: 533368 - RNA, 22 nt, Human
uagcugucagcaaucaaguggu

SEQ ID NO: 533369 - RNA, 20 nt, Human
uucuuaaagaccucacuuug

SEQ ID NO: 533370 - RNA, 22 nt, Human
cagcugaauucuucagacucca

SEQ ID NO: 533371 - RNA, 22 nt, Human
uggagcaggaaacaucuagagg

SEQ ID NO: 533372 - RNA, 22 nt, Human
cagaggcacaagaaagcaaggc

SEQ ID NO: 533373 - RNA, 22 nt, Human
gagggcuccauuccccgugccc

SEQ ID NO: 533374 - RNA, 21 nt, Human
aggcagcucaggcccagagag

SEQ ID NO: 533375 - RNA, 22 nt, Human
augcuugaaaguuauuucauuu

SEQ ID NO: 533376 - RNA, 22 nt, Human
uccacagaauguaagauccaca

SEQ ID NO: 533377 - RNA, 22 nt, Human
acauucuuucaccuugugucca

SEQ ID NO: 533378 - RNA, 22 nt, Human
aucucacacuggguuugagggu

SEQ ID NO: 533379 - RNA, 22 nt, Human
uucuucaaagaugucuguugga

SEQ ID NO: 533380 - RNA, 22 nt, Human
agugcaaauaucuacgcgguga

SEQ ID NO: 533381 - RNA, 17 nt, Human
gggaaguggagaaagcu

SEQ ID NO: 533382 - RNA, 22 nt, Human
cucagcucugacaggaggcauc

SEQ ID NO: 533383 - RNA, 19 nt, Human
uagcagagaugacuccagc

SEQ ID NO: 533384 - RNA, 22 nt, Human
ucuuccaaaauuagucucaguu

SEQ ID NO: 533385 - RNA, 22 nt, Human
gugagacaauuccucaguagac

SEQ ID NO: 533386 - RNA, 22 nt, Human
ucaggcugaaucauccuagcuu

SEQ ID NO: 533387 - RNA, 20 nt, Human
gggugagauguaggagaggg

SEQ ID NO: 533388 - RNA, 22 nt, Human
ggcaggagggcggacaaugacc

SEQ ID NO: 533389 - RNA, 22 nt, Human
auggagggugguaagacagaga

SEQ ID NO: 533390 - RNA, 21 nt, Human
agcaugcacuacuucaucuua

SEQ ID NO: 533391 - RNA, 22 nt, Human
gucaggauuuuaaaaucccagu

SEQ ID NO: 533392 - RNA, 22 nt, Human
ucauaaacacacuaguaugauu

SEQ ID NO: 533393 - RNA, 22 nt, Human
aagaguuuuagacaaacugauu

SEQ ID NO: 533394 - RNA, 22 nt, Human
uggaaagagguagaggaucugg

SEQ ID NO: 533395 - RNA, 22 nt, Human
uggagggaacccaggcugcucu

SEQ ID NO: 533396 - RNA, 22 nt, Human
ccacucugauuuuggcuccacu

SEQ ID NO: 533397 - RNA, 22 nt, Human
uaaccauauuuuccauuaaguu

SEQ ID NO: 533398 - RNA, 22 nt, Human
ucagcuuggacagcuugguuga

SEQ ID NO: 533399 - RNA, 22 nt, Human
auuuuuucccaguuagccagga

SEQ ID NO: 533400 - RNA, 22 nt, Human
auccuuaauuuacuugcaucuu

SEQ ID NO: 533401 - RNA, 22 nt, Human
ucucagggaccaugaugaugac

SEQ ID NO: 533402 - RNA, 22 nt, Human
gagccaggcccguacuugcugu

SEQ ID NO: 533403 - RNA, 22 nt, Human
auauuuaaacaggguaccaaua

SEQ ID NO: 533404 - RNA, 22 nt, Human
uacuuugaauuaaauauuucag

SEQ ID NO: 533405 - RNA, 22 nt, Human
ucuuaagcagagaagaaguuga

SEQ ID NO: 533406 - RNA, 22 nt, Human
ggcuucaccgcgggguugcagg

SEQ ID NO: 533407 - RNA, 22 nt, Human
cacugagaggucucauuuccaa

SEQ ID NO: 533408 - RNA, 22 nt, Human
cacaauguauauguauaucaaa

SEQ ID NO: 533409 - RNA, 21 nt, Human
aacacauccagaguauuugac

SEQ ID NO: 533410 - RNA, 22 nt, Human
cugggagcuggaugcccugccc

SEQ ID NO: 533411 - RNA, 22 nt, Human
gccaaucuuugacuauaugugu

SEQ ID NO: 533412 - RNA, 22 nt, Human
gaggccaggguaccaucaacau

SEQ ID NO: 533413 - RNA, 18 nt, Human
agaggggagguaagucug

SEQ ID NO: 533414 - RNA, 22 nt, Human
uacaguuuguuacauuguuagu

SEQ ID NO: 533415 - RNA, 22 nt, Human
ucuuggaaucuccauagaguga

SEQ ID NO: 533416 - RNA, 22 nt, Human
caguacuugggaaugcugggga

SEQ ID NO: 533417 - RNA, 22 nt, Human
aaagauacuuaauaguugucug

SEQ ID NO: 533418 - RNA, 22 nt, Human
augaagauuucccagagacaug

SEQ ID NO: 533419 - RNA, 22 nt, Human
uggccagugauuaaugacgcuu

SEQ ID NO: 533420 - RNA, 22 nt, Human
cagcugggccuccugagcccug

SEQ ID NO: 533421 - RNA, 22 nt, Human
uaaagguacgaagugagggauu

SEQ ID NO: 533422 - RNA, 22 nt, Human
uuuagcauauccuauaaaacua

SEQ ID NO: 533423 - RNA, 22 nt, Human
caaaaguagugaaguuguacau

SEQ ID NO: 533424 - RNA, 22 nt, Human
caggugggagcgaggagcuacu

SEQ ID NO: 533425 - RNA, 22 nt, Human
uuacagagcucauuucuaaggg

SEQ ID NO: 533426 - RNA, 22 nt, Human
cuuuuaaugggagcaguauuug

SEQ ID NO: 533427 - RNA, 22 nt, Human
aggcuggguaccugucauaugc

SEQ ID NO: 533428 - RNA, 22 nt, Human
cuuugcaauagaggcacacaug

SEQ ID NO: 533429 - RNA, 22 nt, Human
ggauggcagucugcaugagaaa

SEQ ID NO: 533430 - RNA, 22 nt, Human
uugaaagggauauaucuuucug

SEQ ID NO: 533431 - RNA, 19 nt, Human
uccaggaggcugccauuga

SEQ ID NO: 533432 - RNA, 22 nt, Human
uggcagagacaaggccgggccu

SEQ ID NO: 533433 - RNA, 22 nt, Human
aagacuuucccucaucagaacg

SEQ ID NO: 533434 - RNA, 22 nt, Human
gagaggagguggcuaugacagc

SEQ ID NO: 533435 - RNA, 22 nt, Human
uuugagaaggugacaaauucua

SEQ ID NO: 533436 - RNA, 22 nt, Human
uacagagauuuauugcuaaggc

SEQ ID NO: 533437 - RNA, 22 nt, Human
uccuugaaaggggcugcagggc

SEQ ID NO: 533438 - RNA, 22 nt, Human
aaaugucaaagacguguuuuug

SEQ ID NO: 533439 - RNA, 22 nt, Human
ugccaggggaccuagggauguc

SEQ ID NO: 533440 - RNA, 22 nt, Human
uuuccucuuugugacacagcug

SEQ ID NO: 533441 - RNA, 22 nt, Human
auacaagugagaaaacugaaga

SEQ ID NO: 533442 - RNA, 17 nt, Human
ggagaucuggcagaggg

SEQ ID NO: 533443 - RNA, 22 nt, Human
caguggaggccuugggaccuuu

SEQ ID NO: 533444 - RNA, 22 nt, Human
uggcugagcugcagcguggcuu

SEQ ID NO: 533445 - RNA, 22 nt, Human
guccucugggcagcugccccac

SEQ ID NO: 533446 - RNA, 22 nt, Human
ugucuacagaauguuaauauuu

SEQ ID NO: 533447 - RNA, 23 nt, Human
caauuucauaugauucuaccuaa

SEQ ID NO: 533448 - RNA, 22 nt, Human
agcagggcagguaaggaucaga

SEQ ID NO: 533449 - RNA, 17 nt, Human
cgagggcuugcuggcuc

SEQ ID NO: 533450 - RNA, 22 nt, Human
aucuggcuuggguguggguagc

SEQ ID NO: 533451 - RNA, 22 nt, Human
ugggcagcauccuccacaguca

SEQ ID NO: 533452 - RNA, 22 nt, Human
aucuacaaaaacugucucagga

SEQ ID NO: 533453 - RNA, 22 nt, Human
gcugcagggcucucacaggggg

SEQ ID NO: 533454 - RNA, 22 nt, Human
aagcagaacugggaaguagugg

SEQ ID NO: 533455 - RNA, 22 nt, Human
agcuaguucacugaagccuaug

SEQ ID NO: 533456 - RNA, 22 nt, Human
cacagggcagagaccugggugc

SEQ ID NO: 533457 - RNA, 22 nt, Human
aggcucaguucacgucaacuuu

SEQ ID NO: 533458 - RNA, 22 nt, Human
uguggaaaagaauaagggagau

SEQ ID NO: 533459 - RNA, 22 nt, Human
cagucuuaggagaaacuacaga

SEQ ID NO: 533460 - RNA, 22 nt, Human
agugcaaagccgagguuucuug

SEQ ID NO: 533461 - RNA, 23 nt, Human
uggauaaagcugugcugcauagg

SEQ ID NO: 533462 - RNA, 22 nt, Human
gagaggaguagacacuuugguu

SEQ ID NO: 533463 - RNA, 22 nt, Human
gggguugguuuaaaugcuugag

SEQ ID NO: 533464 - RNA, 22 nt, Human
aagggaaauggccaggcagaga

SEQ ID NO: 533465 - RNA, 22 nt, Human
gcaaaggccacuggggcgaugg

SEQ ID NO: 533466 - RNA, 22 nt, Human
ugcaaagaagccacagucccag

SEQ ID NO: 533467 - RNA, 22 nt, Human
gcgcaggugaugcgucugccuu

SEQ ID NO: 533468 - RNA, 22 nt, Human
ucuuugcaucccuuccauaguu

SEQ ID NO: 533469 - RNA, 17 nt, Human
aggggagagugggaaga

SEQ ID NO: 533470 - RNA, 22 nt, Human
ucugcaucauuuuucagagccg

SEQ ID NO: 533471 - RNA, 22 nt, Human
cagcugcccaggccaccuggag

SEQ ID NO: 533472 - RNA, 22 nt, Human
auguaugaugcuaggcucucag

SEQ ID NO: 533473 - RNA, 22 nt, Human
ccagcuccaaguuugggcauca

SEQ ID NO: 533474 - RNA, 22 nt, Human
agcagggcacuggaaggcacug

SEQ ID NO: 533475 - RNA, 20 nt, Human
ccccacacuauugagcacuu

SEQ ID NO: 533476 - RNA, 22 nt, Human
cauggggagacaccuagggaaa

SEQ ID NO: 533477 - RNA, 20 nt, Human
ggaccagguggggcgguggc

SEQ ID NO: 533478 - RNA, 22 nt, Human
ccucugcucugguccaugugcu

SEQ ID NO: 533479 - RNA, 22 nt, Human
caaagcaggaagcuccugacag

SEQ ID NO: 533480 - RNA, 22 nt, Human
ugaagcccugugucagcuucca

SEQ ID NO: 533481 - RNA, 22 nt, Human
cuguguccugcgucaagccaau

SEQ ID NO: 533482 - RNA, 20 nt, Human
ccugucuccucuuaccuggc

SEQ ID NO: 533483 - RNA, 22 nt, Human
cugugcuuguguucauuguuaa

SEQ ID NO: 533484 - RNA, 23 nt, Human
uccugcagauaagcugguugaca

SEQ ID NO: 533485 - RNA, 22 nt, Human
uuguguguguaacuuuaugaga

SEQ ID NO: 533486 - RNA, 22 nt, Human
auugaagaguugauuauuaucu

SEQ ID NO: 533487 - RNA, 22 nt, Human
gucacuuuauuaauuuugguga

SEQ ID NO: 533488 - RNA, 22 nt, Human
aggcucaguucuguggugagcc

SEQ ID NO: 533489 - RNA, 22 nt, Human
aaggcucuccaaaugauauaau

SEQ ID NO: 533490 - RNA, 22 nt, Human
uuuaaauguguucuuaguagcu

SEQ ID NO: 533491 - RNA, 22 nt, Human
uuuuuccaggguuagauguuua

SEQ ID NO: 533492 - RNA, 22 nt, Human
caggcagaugcugacaagaguu

SEQ ID NO: 533493 - RNA, 22 nt, Human
gugccugcugcagagucgcugu

SEQ ID NO: 533494 - RNA, 22 nt, Human
ucagagaggauuuuaauaagug

SEQ ID NO: 533495 - RNA, 18 nt, Human
uaagucauuugaaaugcc

SEQ ID NO: 533496 - RNA, 22 nt, Human
ugcccaggcuccucgcagccuu

SEQ ID NO: 533497 - RNA, 22 nt, Human
uucuuacaucaguuuauuuugu

SEQ ID NO: 533498 - RNA, 22 nt, Human
ucauuucaaugauacuacuaag

SEQ ID NO: 533499 - RNA, 22 nt, Human
ggcagaggugacagugucuuuu

SEQ ID NO: 533500 - RNA, 22 nt, Human
acauuaaauuucauagugauua

SEQ ID NO: 533501 - RNA, 22 nt, Human
uucuguauuuaguuugaggaca

SEQ ID NO: 533502 - RNA, 22 nt, Human
aaggcagcuucaccacagcauu

SEQ ID NO: 533503 - RNA, 22 nt, Human
agcuccagccucuucuggaggu

SEQ ID NO: 533504 - RNA, 22 nt, Human
ugggacugagaauaugaugggg

SEQ ID NO: 533505 - RNA, 23 nt, Human
aggcagugggggccacuuugcuu

SEQ ID NO: 533506 - RNA, 22 nt, Human
aagucacacuagacaacugagg

SEQ ID NO: 533507 - RNA, 22 nt, Human
uaagacuugauccaaagaacua

SEQ ID NO: 533508 - RNA, 23 nt, Human
ucacauaauccuucauccacagg

SEQ ID NO: 533509 - RNA, 22 nt, Human
gcagaggacacaggagggcaag

SEQ ID NO: 533510 - RNA, 22 nt, Human
uggggccuuggccucauuagau

SEQ ID NO: 533511 - RNA, 22 nt, Human
uuacucagucucccauacauug

SEQ ID NO: 533512 - RNA, 19 nt, Human
cuucagggaggggccaggc

SEQ ID NO: 533513 - RNA, 22 nt, Human
gcaggaguguggugggacaucc

SEQ ID NO: 533514 - RNA, 22 nt, Human
ugugcaaucauauuuuaaaaug

SEQ ID NO: 533515 - RNA, 22 nt, Human
gccaguggcaugcggcagggac

SEQ ID NO: 533516 - RNA, 22 nt, Human
gagggccagcagccucagcaug

SEQ ID NO: 533517 - RNA, 22 nt, Human
uauuacugagguuuuauggagu

SEQ ID NO: 533518 - RNA, 19 nt, Human
ucucuggggacacuuucac

SEQ ID NO: 533519 - RNA, 20 nt, Human
agcccuguuuccuggagaga

SEQ ID NO: 533520 - RNA, 22 nt, Human
cagugccucuuaagugucaccc

SEQ ID NO: 533521 - RNA, 22 nt, Human
uuggcaggaggcuucaguuccu

SEQ ID NO: 533522 - RNA, 22 nt, Human
aucugaagggaaguggaaggca

SEQ ID NO: 533523 - RNA, 22 nt, Human
uaccauuuacuugaaaauaaaa

SEQ ID NO: 533524 - RNA, 22 nt, Human
cugguccuugacgcgugggagg

SEQ ID NO: 533525 - RNA, 21 nt, Human
acacacucugagucuucuauu

SEQ ID NO: 533526 - RNA, 22 nt, Human
cauugcucaggcccagcaggaa

SEQ ID NO: 533527 - RNA, 22 nt, Human
ucuaggagaaccaucagggagg

SEQ ID NO: 533528 - RNA, 22 nt, Human
agugcugggauugcaggcauga

SEQ ID NO: 533529 - RNA, 22 nt, Human
agugcugggauuacaggcauaa

SEQ ID NO: 533530 - RNA, 22 nt, Human
aucuggcuuuuacugaauugcu

SEQ ID NO: 533531 - RNA, 21 nt, Human
aaauuucugcaagccucaacu

SEQ ID NO: 533532 - RNA, 19 nt, Human
cagcucaguuugauucucu

SEQ ID NO: 533533 - RNA, 22 nt, Human
uaaugcuuuguuuugaucuaac

SEQ ID NO: 533534 - RNA, 22 nt, Human
uuccaaguccagccaggccaaa

SEQ ID NO: 533535 - RNA, 22 nt, Human
cccuggguucuggcugggcugc

SEQ ID NO: 533536 - RNA, 22 nt, Human
gcuggugagcaaaggagaagga

SEQ ID NO: 533537 - RNA, 22 nt, Human
auaaacagcuccauuuagugcc

SEQ ID NO: 533538 - RNA, 22 nt, Human
ugaagcagagugaaggugaauu

SEQ ID NO: 533539 - RNA, 22 nt, Human
uucuuuuccuacacagcgauuu

SEQ ID NO: 533540 - RNA, 22 nt, Human
uauugaaaugaaugacagugau

SEQ ID NO: 533541 - RNA, 22 nt, Human
uggagaggagcaccauggccau

SEQ ID NO: 533542 - RNA, 22 nt, Human
cagccagugugaccgaggagga

SEQ ID NO: 533543 - RNA, 23 nt, Human
uccuuccuuugagaggcuccauc

SEQ ID NO: 533544 - RNA, 22 nt, Human
agguaguguagcugagugggau

SEQ ID NO: 533545 - RNA, 22 nt, Human
acagugauuuuaggauagaugg

SEQ ID NO: 533546 - RNA, 22 nt, Human
uggagguguggagucaaaggga

SEQ ID NO: 533547 - RNA, 22 nt, Human
gcugggcuucucaaugcugccu

SEQ ID NO: 533548 - RNA, 22 nt, Human
aauaucugucucuaaugcauau

SEQ ID NO: 533549 - RNA, 22 nt, Human
uggccuuggagaggcacggccc

SEQ ID NO: 533550 - RNA, 22 nt, Human
caguguuccaggcggcagugaa

SEQ ID NO: 533551 - RNA, 22 nt, Human
gccagugggacccgcugugggc

SEQ ID NO: 533552 - RNA, 22 nt, Human
cuguuuucccuggaguucagca

SEQ ID NO: 533553 - RNA, 22 nt, Human
aagcagaggaccgacggaggga

SEQ ID NO: 533554 - RNA, 22 nt, Human
ccucacuggccagccaggggug

SEQ ID NO: 533555 - RNA, 22 nt, Human
uucaacaucaagaaugcaugga

SEQ ID NO: 533556 - RNA, 22 nt, Human
agcagcagaucaaacaggcuug

SEQ ID NO: 533557 - RNA, 22 nt, Human
uccauccauguaggaagauggu

SEQ ID NO: 533558 - RNA, 18 nt, Human
acaaauguagugucuuaa

SEQ ID NO: 533559 - RNA, 22 nt, Human
agaagaaacugucggggauauu

SEQ ID NO: 533560 - RNA, 22 nt, Human
uuuaaggcuucacuggaguggg

SEQ ID NO: 533561 - RNA, 23 nt, Human
agaugaaagcuucccaucacagu

SEQ ID NO: 533562 - RNA, 22 nt, Human
uuucucaaccucaacacuauuu

SEQ ID NO: 533563 - RNA, 22 nt, Human
augugcauaaacauauuguugg

SEQ ID NO: 533564 - RNA, 22 nt, Human
aagauuuacuagcauaauagcu

SEQ ID NO: 533565 - RNA, 22 nt, Human
gaggcugugugucccucuggac

SEQ ID NO: 533566 - RNA, 22 nt, Human
cugguucaugguggaaugacau

SEQ ID NO: 533567 - RNA, 22 nt, Human
uuccuaauggcaaaacauguuu

SEQ ID NO: 533568 - RNA, 22 nt, Human
cagcaucucuuuuugcauuccu

SEQ ID NO: 533569 - RNA, 22 nt, Human
uagauuccucuacaauaaauga

SEQ ID NO: 533570 - RNA, 23 nt, Human
agccuucaggcaaugucaguaga

SEQ ID NO: 533571 - RNA, 22 nt, Human
ggcuccaggugcaugccaggcu

SEQ ID NO: 533572 - RNA, 18 nt, Human
uaaaugcauguuaauaac

SEQ ID NO: 533573 - RNA, 22 nt, Human
uuccucucgcucuccggggccc

SEQ ID NO: 533574 - RNA, 22 nt, Human
ccaggaaggaagcagggguuuc

SEQ ID NO: 533575 - RNA, 22 nt, Human
gccaggugcaccugcccuggcc

SEQ ID NO: 533576 - RNA, 22 nt, Human
aaggacuccaauucuuucaucu

SEQ ID NO: 533577 - RNA, 23 nt, Human
uccuccugagugagagugccagc

SEQ ID NO: 533578 - RNA, 22 nt, Human
auuuagaaguuggagggcaaga

SEQ ID NO: 533579 - RNA, 22 nt, Human
uggcucuggauuaaucuaggaa

SEQ ID NO: 533580 - RNA, 22 nt, Human
ccugccugucaucgccugcgcc

SEQ ID NO: 533581 - RNA, 22 nt, Human
gcugguggcagagacaucaggu

SEQ ID NO: 533582 - RNA, 22 nt, Human
ggcagguggaaggucuccauuc

SEQ ID NO: 533583 - RNA, 22 nt, Human
ugcuggaguaacaagacacuca

SEQ ID NO: 533584 - RNA, 22 nt, Human
gugcaauggggcaauaucagcu

SEQ ID NO: 533585 - RNA, 22 nt, Human
gauuuauuggucuuucauuggu

SEQ ID NO: 533586 - RNA, 22 nt, Human
aggcucagcccaagguggagag

SEQ ID NO: 533587 - RNA, 22 nt, Human
ccuguucacuuugacuucucca

SEQ ID NO: 533588 - RNA, 22 nt, Human
gcugaugagagagacaaaugcu

SEQ ID NO: 533589 - RNA, 21 nt, Human
caguagugcgucgcagaggac

SEQ ID NO: 533590 - RNA, 22 nt, Human
uggaaggaaagguagcagagaa

SEQ ID NO: 533591 - RNA, 22 nt, Human
aggcugugcgaggucucagagu

SEQ ID NO: 533592 - RNA, 22 nt, Human
caacuauagaucaaaugaguuu

SEQ ID NO: 533593 - RNA, 22 nt, Human
gcagaugguggggcaggaaaau

SEQ ID NO: 533594 - RNA, 22 nt, Human
gggcugcugccaaucacagccu

SEQ ID NO: 533595 - RNA, 22 nt, Human
gcugccugccuaguuccacagu

SEQ ID NO: 533596 - RNA, 22 nt, Human
acaugauuuuaguaucauaaua

SEQ ID NO: 533597 - RNA, 21 nt, Human
ccacaggggcuccccugucag

SEQ ID NO: 533598 - RNA, 22 nt, Human
cuuacagugacccugcagauuu

SEQ ID NO: 533599 - RNA, 22 nt, Human
uaaguuagaucuuaauuaaagu

SEQ ID NO: 533600 - RNA, 22 nt, Human
ugugcaaaguguacaaauuaau

SEQ ID NO: 533601 - RNA, 22 nt, Human
aagaugcuuauugcuccugcag

SEQ ID NO: 533602 - RNA, 22 nt, Human
gggcagcagcaggaggucucug

SEQ ID NO: 533603 - RNA, 22 nt, Human
uagcagcucugauucugggccc

SEQ ID NO: 533604 - RNA, 22 nt, Human
caaggccacugcucagguuucc

SEQ ID NO: 533605 - RNA, 22 nt, Human
ccgggcgggggcucucgucacc

SEQ ID NO: 533606 - RNA, 22 nt, Human
aaaagcaguuuauagucaguug

SEQ ID NO: 533607 - RNA, 17 nt, Human
cauaaaacaguucuauu

SEQ ID NO: 533608 - RNA, 22 nt, Human
ggagccuguggccgucacgacu

SEQ ID NO: 533609 - RNA, 22 nt, Human
aaaaaagauugaugguggaugc

SEQ ID NO: 533610 - RNA, 22 nt, Human
aguuacuugagacguuuaugaa

SEQ ID NO: 533611 - RNA, 22 nt, Human
aggcugaaaacgagauggcaau

SEQ ID NO: 533612 - RNA, 22 nt, Human
cugccucuugacagaucguggc

SEQ ID NO: 533613 - RNA, 22 nt, Human
acagauguacacucauauauaa

SEQ ID NO: 533614 - RNA, 22 nt, Human
acuugcaugucaggaaauuaac

SEQ ID NO: 533615 - RNA, 22 nt, Human
aaaugcuuauuagugucacaaa

SEQ ID NO: 533616 - RNA, 22 nt, Human
ucucaagagggaggcaaucaug

SEQ ID NO: 533617 - RNA, 22 nt, Human
acaaaguaggaagauuagcuga

SEQ ID NO: 533618 - RNA, 22 nt, Human
cagcaggguauacagggaauuu

SEQ ID NO: 533619 - RNA, 20 nt, Human
aggcugggguguuuugccca

SEQ ID NO: 533620 - RNA, 22 nt, Human
uuuguguuuuagcuggugaggc

SEQ ID NO: 533621 - RNA, 22 nt, Human
uccugugccuccaccugcuccg

SEQ ID NO: 533622 - RNA, 22 nt, Human
caggccuuucuuggggcuuaga

SEQ ID NO: 533623 - RNA, 22 nt, Human
gcugagagcaguguggccuuaa

SEQ ID NO: 533624 - RNA, 22 nt, Human
accaggcaguauggugcugcaa

SEQ ID NO: 533625 - RNA, 22 nt, Human
cauacaaucaaguucuuuauua

SEQ ID NO: 533626 - RNA, 22 nt, Human
gagauggagucuuuuucuguca

SEQ ID NO: 533627 - RNA, 22 nt, Human
acauuccugaggaaauacauuc

SEQ ID NO: 533628 - RNA, 22 nt, Human
ggaagggccucgggcgugggac

SEQ ID NO: 533629 - RNA, 22 nt, Human
acucuugauugauuuagucuuu

SEQ ID NO: 533630 - RNA, 22 nt, Human
aggauccugcgcuuugggggag

SEQ ID NO: 533631 - RNA, 22 nt, Human
aaggugugaagagaugggaaga

SEQ ID NO: 533632 - RNA, 22 nt, Human
acugggcuccaaggaccuggag

SEQ ID NO: 533633 - RNA, 22 nt, Human
aagacuuucucccaaauccuca

SEQ ID NO: 533634 - RNA, 21 nt, Human
uguuuaauacauauuugugga

SEQ ID NO: 533635 - RNA, 22 nt, Human
gaagaccaauuugggccauggc

SEQ ID NO: 533636 - RNA, 22 nt, Human
uaguuucagcuccuucauccug

SEQ ID NO: 533637 - RNA, 22 nt, Human
caggcccaaaugcaaccuucuu

SEQ ID NO: 533638 - RNA, 22 nt, Human
gcggcaggaagagcgcagcccc

SEQ ID NO: 533639 - RNA, 22 nt, Human
cuuaacagcaagaucuguguca

SEQ ID NO: 533640 - RNA, 22 nt, Human
ugcaaaugcccauuuauuuucu

SEQ ID NO: 533641 - RNA, 22 nt, Human
ggucccaggaaucuguguucua

SEQ ID NO: 533642 - RNA, 22 nt, Human
uuucccuugaauaaagauaucu

SEQ ID NO: 533643 - RNA, 22 nt, Human
gcucuggacccuggaguggcug

SEQ ID NO: 533644 - RNA, 22 nt, Human
uaggcaggugugcacugcccac

SEQ ID NO: 533645 - RNA, 22 nt, Human
uuguaacaggcacucugugcca

SEQ ID NO: 533646 - RNA, 22 nt, Human
auuucucaguuccuacuguuua

SEQ ID NO: 533647 - RNA, 22 nt, Human
uucauacaaugggauauuauga

SEQ ID NO: 533648 - RNA, 22 nt, Human
ugggccacgugacccuuacccu

SEQ ID NO: 533649 - RNA, 22 nt, Human
gugggagaagcccuguucguag

SEQ ID NO: 533650 - RNA, 22 nt, Human
agggcugaagggaggugcucau

SEQ ID NO: 533651 - RNA, 22 nt, Human
ggcugcagcggauuggggauug

SEQ ID NO: 533652 - RNA, 19 nt, Human
ucaguuuuagucaucaguu

SEQ ID NO: 533653 - RNA, 22 nt, Human
auguuacauaguccuuauuugu

SEQ ID NO: 533654 - RNA, 22 nt, Human
uugggcugaaguagagggcaga

SEQ ID NO: 533655 - RNA, 22 nt, Human
aaguuauugcagcaauccaagu

SEQ ID NO: 533656 - RNA, 19 nt, Human
ugggaguggggaagguccu

SEQ ID NO: 533657 - RNA, 22 nt, Human
cagguaggauggaagggcucaa

SEQ ID NO: 533658 - RNA, 22 nt, Human
uguauuaucaaguaaauacaug

SEQ ID NO: 533659 - RNA, 22 nt, Human
ucuucucccaucuccaggcagg

SEQ ID NO: 533660 - RNA, 22 nt, Human
ugccugagugauguggcagcca

SEQ ID NO: 533661 - RNA, 21 nt, Human
gugguucuagagaaacagaau

SEQ ID NO: 533662 - RNA, 23 nt, Human
ugcagagggacugaagccagcuu

SEQ ID NO: 533663 - RNA, 22 nt, Human
uuucuuccuuaccuuacuagag

SEQ ID NO: 533664 - RNA, 22 nt, Human
ugaagcuugagugucaguuccu

SEQ ID NO: 533665 - RNA, 22 nt, Human
uuucuauaugaggagcuaaagu

SEQ ID NO: 533666 - RNA, 22 nt, Human
agcagguguagggcucuuugua

SEQ ID NO: 533667 - RNA, 22 nt, Human
aagagcugauuaagucaugagg

SEQ ID NO: 533668 - RNA, 22 nt, Human
uccaggcuacuuggauuccugg

SEQ ID NO: 533669 - RNA, 22 nt, Human
cccaggucugugccagcucuga

SEQ ID NO: 533670 - RNA, 22 nt, Human
gccuggcaggccuguuggggcu

SEQ ID NO: 533671 - RNA, 22 nt, Human
uucucacuauguauguagauug

SEQ ID NO: 533672 - RNA, 22 nt, Human
gccaggaguucagaugcauguu

SEQ ID NO: 533673 - RNA, 22 nt, Human
cuuuucuucucacggcugucag

SEQ ID NO: 533674 - RNA, 19 nt, Human
ccucugccagcccgccucu

SEQ ID NO: 533675 - RNA, 17 nt, Human
uuagcaaaauagcacuu

SEQ ID NO: 533676 - RNA, 22 nt, Human
auuaagacugcccauguuuuua

SEQ ID NO: 533677 - RNA, 21 nt, Human
agccugccugaacucuguggc

SEQ ID NO: 533678 - RNA, 22 nt, Human
aagcagagguagggugugcagu

SEQ ID NO: 533679 - RNA, 22 nt, Human
uggccaaauuugguguaacuug

SEQ ID NO: 533680 - RNA, 22 nt, Human
ucuggagaacuugcaagaggau

SEQ ID NO: 533681 - RNA, 22 nt, Human
agcuguguccugaagacacugc

SEQ ID NO: 533682 - RNA, 22 nt, Human
aaucuucacucauucagaguug

SEQ ID NO: 533683 - RNA, 22 nt, Human
aacuguaaggcuuagaacagca

SEQ ID NO: 533684 - RNA, 22 nt, Human
uucucacaggaaguaggacuuu

SEQ ID NO: 533685 - RNA, 22 nt, Human
uugguucaguaggcaugccugg

SEQ ID NO: 533686 - RNA, 22 nt, Human
cacaggagcuguggggcagugu

SEQ ID NO: 533687 - RNA, 22 nt, Human
ugcugagucguauuauuuuuua

SEQ ID NO: 533688 - RNA, 22 nt, Human
gcucccagggcagcgcagaaga

SEQ ID NO: 533689 - RNA, 22 nt, Human
auuuuuuguuaacucaggauag

SEQ ID NO: 533690 - RNA, 22 nt, Human
ucccacuggacgucugugcugg

SEQ ID NO: 533691 - RNA, 22 nt, Human
aggaaauugagaaucagaauaa

SEQ ID NO: 533692 - RNA, 22 nt, Human
ggagagcaggguccugagauac

SEQ ID NO: 533693 - RNA, 22 nt, Human
acacuucagcuccacaaacauu

SEQ ID NO: 533694 - RNA, 22 nt, Human
aacauacuuauacuaaauaaug

SEQ ID NO: 533695 - RNA, 22 nt, Human
cagaagcagauucuaaagcaag

SEQ ID NO: 533696 - RNA, 22 nt, Human
aacuuucaggcaaugaauauuu

SEQ ID NO: 533697 - RNA, 22 nt, Human
caggcuggucccagagcauugc

SEQ ID NO: 533698 - RNA, 22 nt, Human
ggcuugggagcaggcaugugac

SEQ ID NO: 533699 - RNA, 22 nt, Human
gcugggcaaggcugaagcuacc

SEQ ID NO: 533700 - RNA, 22 nt, Human
acugcagggcauccuggccaag

SEQ ID NO: 533701 - RNA, 22 nt, Human
cagauauuaggagcucaauaau

SEQ ID NO: 533702 - RNA, 22 nt, Human
aucagcuauuaugugaagaaag

SEQ ID NO: 533703 - RNA, 22 nt, Human
guuugaaaugucugcaagggaa

SEQ ID NO: 533704 - RNA, 22 nt, Human
gcugggccagacuuucaauguc

SEQ ID NO: 533705 - RNA, 22 nt, Human
gcuccucucccagagcugcagg

SEQ ID NO: 533706 - RNA, 22 nt, Human
aaugcuuugucugcuccagacu

SEQ ID NO: 533707 - RNA, 21 nt, Human
aggccucuucauggccaugau

SEQ ID NO: 533708 - RNA, 22 nt, Human
gggcacagcccagugggguccc

SEQ ID NO: 533709 - RNA, 22 nt, Human
gcacugggaagaaugagccugu

SEQ ID NO: 533710 - RNA, 22 nt, Human
ugccaggaggaggugggacaga

SEQ ID NO: 533711 - RNA, 22 nt, Human
uuuccucuucgauuaaguuugg

SEQ ID NO: 533712 - RNA, 22 nt, Human
gagaaacacuguuaguuuauua

SEQ ID NO: 533713 - RNA, 22 nt, Human
agcacugauuuuguugcacuua

SEQ ID NO: 533714 - RNA, 22 nt, Human
gagugcaucguggccauuuuaa

SEQ ID NO: 533715 - RNA, 22 nt, Human
acaucugaggagaccagccucu

SEQ ID NO: 533716 - RNA, 22 nt, Human
gggcuccuccucugacuguggc

SEQ ID NO: 533717 - RNA, 22 nt, Human
guaugaaguuggacuguauaaa

SEQ ID NO: 533718 - RNA, 22 nt, Human
uuagaaagaacuuuagauauca

SEQ ID NO: 533719 - RNA, 22 nt, Human
uauuaacauuuuaugaaaauaa

SEQ ID NO: 533720 - RNA, 22 nt, Human
uccuugaagcaacgugcagaca

SEQ ID NO: 533721 - RNA, 22 nt, Human
aguuuccaaauauuguuuuagc

SEQ ID NO: 533722 - RNA, 22 nt, Human
gauuuaaaguagaccuuuguuu

SEQ ID NO: 533723 - RNA, 22 nt, Human
gccugcagggcccuuguggguc

SEQ ID NO: 533724 - RNA, 22 nt, Human
caggcugcagcagcaguggccc

SEQ ID NO: 533725 - RNA, 22 nt, Human
uucugagauuguuaggcacuaa

SEQ ID NO: 533726 - RNA, 22 nt, Human
cuguucacacacuuguacucuc

SEQ ID NO: 533727 - RNA, 22 nt, Human
cauuauggcagccaggauauug

SEQ ID NO: 533728 - RNA, 22 nt, Human
aagccaugguagaaaacucagu

SEQ ID NO: 533729 - RNA, 22 nt, Human
uucacagauguauuggaacucc

SEQ ID NO: 533730 - RNA, 22 nt, Human
ccaggccccagggcuggcuuuc

SEQ ID NO: 533731 - RNA, 22 nt, Human
caggaacaauguaagucucauu

SEQ ID NO: 533732 - RNA, 19 nt, Human
aaauaucagagagaugaua

SEQ ID NO: 533733 - RNA, 22 nt, Human
aucaggauucaccccagagcug

SEQ ID NO: 533734 - RNA, 22 nt, Human
cucucugucuuggcauuugguc

SEQ ID NO: 533735 - RNA, 22 nt, Human
cugggguggauggguccaaguu

SEQ ID NO: 533736 - RNA, 22 nt, Human
agggccagaggcaccuugcagc

SEQ ID NO: 533737 - RNA, 22 nt, Human
ccugcuggacagggguguucau

SEQ ID NO: 533738 - RNA, 22 nt, Human
cuggccuggcaggggaccucua

SEQ ID NO: 533739 - RNA, 22 nt, Human
cauuuauucucagauccuuguc

SEQ ID NO: 533740 - RNA, 22 nt, Human
caggugccgggaaugcagcaau

SEQ ID NO: 533741 - RNA, 22 nt, Human
uguuacagucauuguuuucuga

SEQ ID NO: 533742 - RNA, 22 nt, Human
gagcccuccauggagccaggca

SEQ ID NO: 533743 - RNA, 22 nt, Human
ccucaggcuuacgggcaaugga

SEQ ID NO: 533744 - RNA, 22 nt, Human
cuggcucaggguggucuggguc

SEQ ID NO: 533745 - RNA, 22 nt, Human
aacacaguuaguaagggaaaua

SEQ ID NO: 533746 - RNA, 22 nt, Human
cccaagaucuaggacagaaaga

SEQ ID NO: 533747 - RNA, 22 nt, Human
uuguuucaggaugguuuguuac

SEQ ID NO: 533748 - RNA, 22 nt, Human
ugacauuuaaucccuaaauauu

SEQ ID NO: 533749 - RNA, 22 nt, Human
aggcugucugaccccagagccc

SEQ ID NO: 533750 - RNA, 22 nt, Human
guucacagcuucuuaggucaua

SEQ ID NO: 533751 - RNA, 22 nt, Human
uucacauugaaggugcuuucuu

SEQ ID NO: 533752 - RNA, 22 nt, Human
ggagcugcucagagccaguccc

SEQ ID NO: 533753 - RNA, 22 nt, Human
aagaggucauaccagauaaggg

SEQ ID NO: 533754 - RNA, 22 nt, Human
uuagucuucuuccuuauauguu

SEQ ID NO: 533755 - RNA, 22 nt, Human
ggagcagagcauuucacagccu

SEQ ID NO: 533756 - RNA, 22 nt, Human
gcugccuggcuuuaguccacuu

SEQ ID NO: 533757 - RNA, 22 nt, Human
acaagauagguugagucuagcc

SEQ ID NO: 533758 - RNA, 22 nt, Human
aggagccaaauuuuagacucug

SEQ ID NO: 533759 - RNA, 22 nt, Human
agugugagcccuggaguggugc

SEQ ID NO: 533760 - RNA, 22 nt, Human
ggcuagggacuccuccucaggg

SEQ ID NO: 533761 - RNA, 22 nt, Human
acacaaugugcaggacaccugu

SEQ ID NO: 533762 - RNA, 22 nt, Human
auucacauugagcuucacugug

SEQ ID NO: 533763 - RNA, 22 nt, Human
aaagaggauggaguagucagcu

SEQ ID NO: 533764 - RNA, 22 nt, Human
acacagaguuugacacauggga

SEQ ID NO: 533765 - RNA, 22 nt, Human
gugaggacugguaaggacugca

SEQ ID NO: 533766 - RNA, 22 nt, Human
aacuaacagucauuaaaagaac

SEQ ID NO: 533767 - RNA, 22 nt, Human
caaaacuaucaggcucaaagcu

SEQ ID NO: 533768 - RNA, 22 nt, Human
uagaggugagacuucagugaca

SEQ ID NO: 533769 - RNA, 22 nt, Human
aacuucagggggcacauucaag

SEQ ID NO: 533770 - RNA, 18 nt, Human
ccugugcuccagcaucug

SEQ ID NO: 533771 - RNA, 22 nt, Human
agcacuuuccuggcaaaugugg

SEQ ID NO: 533772 - RNA, 22 nt, Human
uccugaagaacgaagucaugua

SEQ ID NO: 533773 - RNA, 22 nt, Human
aacaugugucuugcauuucuug

SEQ ID NO: 533774 - RNA, 22 nt, Human
uccccagccgugaaggagagga

SEQ ID NO: 533775 - RNA, 22 nt, Human
ucuccuggucaccucagaaguc

SEQ ID NO: 533776 - RNA, 21 nt, Human
guggcccugccgcagugucca

SEQ ID NO: 533777 - RNA, 22 nt, Human
uuccuauccuuuuauguuuaug

SEQ ID NO: 533778 - RNA, 22 nt, Human
uaugcaauucucuuaauauucu

SEQ ID NO: 533779 - RNA, 22 nt, Human
uaucaccagagggauagucucu

SEQ ID NO: 533780 - RNA, 22 nt, Human
ucacauuuaaacaggaggauua

SEQ ID NO: 533781 - RNA, 23 nt, Human
gcucaucaggcuuagagucaagg

SEQ ID NO: 533782 - RNA, 19 nt, Human
gcauuucauuuaaccauca

SEQ ID NO: 533783 - RNA, 22 nt, Human
cccagccuuugcuuccugguuc

SEQ ID NO: 533784 - RNA, 22 nt, Human
auacuuugcuacauuguacauu

SEQ ID NO: 533785 - RNA, 22 nt, Human
gugcuuaauacaugucaauaac

SEQ ID NO: 533786 - RNA, 22 nt, Human
guccucuccaggaggcucugau

SEQ ID NO: 533787 - RNA, 22 nt, Human
gcauggcauuaacaagauggaa

SEQ ID NO: 533788 - RNA, 22 nt, Human
gaggagagaagcuaacggugcu

SEQ ID NO: 533789 - RNA, 22 nt, Human
uacagagaguacagcauccaca

SEQ ID NO: 533790 - RNA, 22 nt, Human
uucaggauccccaccgcguuua

SEQ ID NO: 533791 - RNA, 22 nt, Human
aaaauuuccaccaucuuugugu

SEQ ID NO: 533792 - RNA, 18 nt, Human
gggcacuggggacuggag

SEQ ID NO: 533793 - RNA, 20 nt, Human
ucccaagggcugagaggauc

SEQ ID NO: 533794 - RNA, 22 nt, Human
gaggaaaaugcaacaggaaugc

SEQ ID NO: 533795 - RNA, 22 nt, Human
gaaagcagaugaaauugcaaca

SEQ ID NO: 533796 - RNA, 22 nt, Human
ugugucaauuuucauuccuacu

SEQ ID NO: 533797 - RNA, 22 nt, Human
ccagagcccagcacacggugcu

SEQ ID NO: 533798 - RNA, 22 nt, Human
gaugcuuuggccccaucaugag

SEQ ID NO: 533799 - RNA, 22 nt, Human
ucauuucaguccucugugugag

SEQ ID NO: 533800 - RNA, 22 nt, Human
aggugggguucagucucagccg

SEQ ID NO: 533801 - RNA, 22 nt, Human
caaggcugugcaggguccauau

SEQ ID NO: 533802 - RNA, 22 nt, Human
gaguuuaaucauuguucuaucc

SEQ ID NO: 533803 - RNA, 22 nt, Human
uagggcagccacccaggcugcu

SEQ ID NO: 533804 - RNA, 22 nt, Human
augagcugggccauccagugau

SEQ ID NO: 533805 - RNA, 22 nt, Human
gaauauuaguaucaguuauacc

SEQ ID NO: 533806 - RNA, 22 nt, Human
ggcuccaagucucagagugaag

SEQ ID NO: 533807 - RNA, 22 nt, Human
uugaaaaaauugguagaggaug

SEQ ID NO: 533808 - RNA, 22 nt, Human
uggccugauuuugcuaagagaa

SEQ ID NO: 533809 - RNA, 22 nt, Human
auuugacauugacacaccuaug

SEQ ID NO: 533810 - RNA, 22 nt, Human
cuggcuuguuuuaagaauacaa

SEQ ID NO: 533811 - RNA, 22 nt, Human
agccuucagcaguucaggugcc

SEQ ID NO: 533812 - RNA, 18 nt, Human
uggagcaggaagccuggc

SEQ ID NO: 533813 - RNA, 22 nt, Human
ucuaaacuaggguuaaaggaaa

SEQ ID NO: 533814 - RNA, 22 nt, Human
cugaccaucauggugaaacccc

SEQ ID NO: 533815 - RNA, 22 nt, Human
caagcuacucaggcaagaugug

SEQ ID NO: 533816 - RNA, 22 nt, Human
gaggagaaagcagugauuugug

SEQ ID NO: 533817 - RNA, 22 nt, Human
uaauaccuagagaugauacaaa

SEQ ID NO: 533818 - RNA, 22 nt, Human
aaaaagcuuaaaugagcaguuc

SEQ ID NO: 533819 - RNA, 22 nt, Human
gcaugguggccuuaggguagcc

SEQ ID NO: 533820 - RNA, 22 nt, Human
auugacaaucuacuauguucug

SEQ ID NO: 533821 - RNA, 22 nt, Human
agauggggcagaauggagccau

SEQ ID NO: 533822 - RNA, 22 nt, Human
acagaauugaaaguauaaucug

SEQ ID NO: 533823 - RNA, 22 nt, Human
ucacauuuuguucaaggcuagu

SEQ ID NO: 533824 - RNA, 22 nt, Human
ugccuggguccaggccaagccu

SEQ ID NO: 533825 - RNA, 22 nt, Human
uauuuccagaggaguauagaag

SEQ ID NO: 533826 - RNA, 22 nt, Human
uuugcaacagacucaucauuga

SEQ ID NO: 533827 - RNA, 22 nt, Human
ccagccagucccgcaugaccgc

SEQ ID NO: 533828 - RNA, 21 nt, Human
ccccauggaguacaguugggc

SEQ ID NO: 533829 - RNA, 22 nt, Human
acacauguauggcacuuacauu

SEQ ID NO: 533830 - RNA, 22 nt, Human
uugaaaggccuguuuauccagc

SEQ ID NO: 533831 - RNA, 22 nt, Human
uaacaguugguguaauuucuug

SEQ ID NO: 533832 - RNA, 22 nt, Human
cucacagcagcucugcgagaua

SEQ ID NO: 533833 - RNA, 22 nt, Human
cuguauuuguccucuauuuauu

SEQ ID NO: 533834 - RNA, 22 nt, Human
agagcaauggcauccagcugau

SEQ ID NO: 533835 - RNA, 22 nt, Human
ccaucaguggcaaauaaacacc

SEQ ID NO: 533836 - RNA, 22 nt, Human
aaugucaaguagccaaugcuuc

SEQ ID NO: 533837 - RNA, 22 nt, Human
ccagaauagaaggcagcuguca

SEQ ID NO: 533838 - RNA, 22 nt, Human
uaagcauaacuaaaaaugauuu

SEQ ID NO: 533839 - RNA, 22 nt, Human
agagcagauggagcuggaagag

SEQ ID NO: 533840 - RNA, 22 nt, Human
gucauuccuauccauuugauac

SEQ ID NO: 533841 - RNA, 21 nt, Human
aguuuuuacucuuaacugugg

SEQ ID NO: 533842 - RNA, 22 nt, Human
cacacaggaugaagcagcagaa

SEQ ID NO: 533843 - RNA, 22 nt, Human
auaaagaggauguauuuacagc

SEQ ID NO: 533844 - RNA, 22 nt, Human
aaauuaagggugagaagaguug

SEQ ID NO: 533845 - RNA, 22 nt, Human
gccuaauaugcaaaauugauac

SEQ ID NO: 533846 - RNA, 22 nt, Human
ugaagauuuccaccaaaucaca

SEQ ID NO: 533847 - RNA, 22 nt, Human
agaauucuccuucagggcagga

SEQ ID NO: 533848 - RNA, 22 nt, Human
gaguuauuuguagggauuauau

SEQ ID NO: 533849 - RNA, 22 nt, Human
cagcuguguaugagagcaugcu

SEQ ID NO: 533850 - RNA, 20 nt, Human
ccugggcucaaagcauccuc

SEQ ID NO: 533851 - RNA, 22 nt, Human
cacugggcaauucugagccuaa

SEQ ID NO: 533852 - RNA, 22 nt, Human
ucuugauuuacucuaauagcuu

SEQ ID NO: 533853 - RNA, 22 nt, Human
gccugugcuuucuucccuccug

SEQ ID NO: 533854 - RNA, 22 nt, Human
caguuaaaaugugcuauaagaa

SEQ ID NO: 533855 - RNA, 22 nt, Human
uggaaggggagcuggaaagggg

SEQ ID NO: 533856 - RNA, 21 nt, Human
cagcccagcccauugacagug

SEQ ID NO: 533857 - RNA, 23 nt, Human
aggagaagagauuuccacaugca

SEQ ID NO: 533858 - RNA, 22 nt, Human
uaagcaaauaaugcaucaaggg

SEQ ID NO: 533859 - RNA, 20 nt, Human
gggagucuggaugaaagaug

SEQ ID NO: 533860 - RNA, 22 nt, Human
agagaaaagaguucaggcuuug

SEQ ID NO: 533861 - RNA, 22 nt, Human
gggagagaauuauugccagacc

SEQ ID NO: 533862 - RNA, 22 nt, Human
acauuucuaucauccuguaaug

SEQ ID NO: 533863 - RNA, 22 nt, Human
uuucuucuaagauuucaaacua

SEQ ID NO: 533864 - RNA, 22 nt, Human
gcugugcagauguagggagugg

SEQ ID NO: 533865 - RNA, 22 nt, Human
uucuacaauaugaauaaugaag

SEQ ID NO: 533866 - RNA, 19 nt, Human
ccauauaaccagcaagugu

SEQ ID NO: 533867 - RNA, 22 nt, Human
uaagaauuguguugaauagagu

SEQ ID NO: 533868 - RNA, 22 nt, Human
agggagugguuaagaaggugca

SEQ ID NO: 533869 - RNA, 22 nt, Human
gaggccuggcugggaggaggug

SEQ ID NO: 533870 - RNA, 22 nt, Human
caaagcagacgcaguaagggua

SEQ ID NO: 533871 - RNA, 22 nt, Human
aauuuuaagcauaugacugguu

SEQ ID NO: 533872 - RNA, 22 nt, Human
uggcagaguuggagguggaaga

SEQ ID NO: 533873 - RNA, 17 nt, Human
ucuuuccugccaugcuc

SEQ ID NO: 533874 - RNA, 22 nt, Human
gagcuuuaagggcacuggucuu

SEQ ID NO: 533875 - RNA, 22 nt, Human
cagguugguauucaucuccaca

SEQ ID NO: 533876 - RNA, 22 nt, Human
ucuugauuaauaccuuagcccu

SEQ ID NO: 533877 - RNA, 22 nt, Human
accagaguaauguguggaaauu

SEQ ID NO: 533878 - RNA, 22 nt, Human
gggcacuguacacugugcaugg

SEQ ID NO: 533879 - RNA, 22 nt, Human
uacccagcaaucccuagagguu

SEQ ID NO: 533880 - RNA, 22 nt, Human
cccaagggagugccuggucaac

SEQ ID NO: 533881 - RNA, 19 nt, Human
gggaugggcccucacccuc

SEQ ID NO: 533882 - RNA, 22 nt, Human
acagugauuggcacugauucag

SEQ ID NO: 533883 - RNA, 23 nt, Human
uggcuggcagaaacugaagcaug

SEQ ID NO: 533884 - RNA, 22 nt, Human
caggggccuggcugucuaggaa

SEQ ID NO: 533885 - RNA, 22 nt, Human
cacacaugucucuccaugcucu

SEQ ID NO: 533886 - RNA, 22 nt, Human
aauuuuaaucaguggugcugag

SEQ ID NO: 533887 - RNA, 22 nt, Human
ggucucugacuuagagauggau

SEQ ID NO: 533888 - RNA, 22 nt, Human
cccaggcuggagugcaauggug

SEQ ID NO: 533889 - RNA, 22 nt, Human
uuggaauugcuauugauaacaa

SEQ ID NO: 533890 - RNA, 22 nt, Human
ucauuuccucaaauucaagguu

SEQ ID NO: 533891 - RNA, 22 nt, Human
ucugucaaaugggcauaaggau

SEQ ID NO: 533892 - RNA, 22 nt, Human
gcuggccauggccugcgccauc

SEQ ID NO: 533893 - RNA, 22 nt, Human
agugauggugagugagaagcuc

SEQ ID NO: 533894 - RNA, 22 nt, Human
cagaaucagugacacauguaua

SEQ ID NO: 533895 - RNA, 22 nt, Human
ucuggcucaucucuccagguaa

SEQ ID NO: 533896 - RNA, 22 nt, Human
caucaucaccugcuauacgauc

SEQ ID NO: 533897 - RNA, 19 nt, Human
ucucuggaugacagacacu

SEQ ID NO: 533898 - RNA, 22 nt, Human
gcugcuuuagguugagcucagc

SEQ ID NO: 533899 - RNA, 22 nt, Human
acucuucacuuccccugccagc

SEQ ID NO: 533900 - RNA, 22 nt, Human
ugucauuaugaggauuacaaua

SEQ ID NO: 533901 - RNA, 22 nt, Human
cucagagucccuucccucgugg

SEQ ID NO: 533902 - RNA, 22 nt, Human
ucccugcugggagaugaccuua

SEQ ID NO: 533903 - RNA, 22 nt, Human
aauuaaauugguuuagagagga

SEQ ID NO: 533904 - RNA, 21 nt, Human
cagcaaaucauugggcagacu

SEQ ID NO: 533905 - RNA, 22 nt, Human
ugaugaauaaacuugagaguca

SEQ ID NO: 533906 - RNA, 23 nt, Human
aagaaucaguaaguaaggagacc

SEQ ID NO: 533907 - RNA, 22 nt, Human
ucuuugcaggagcccuuugaac

SEQ ID NO: 533908 - RNA, 22 nt, Human
gggcugccaagccugccugccu

SEQ ID NO: 533909 - RNA, 23 nt, Human
uuccaagugcuuuacuuaauccu

SEQ ID NO: 533910 - RNA, 22 nt, Human
ucuucaugccaaaugaguuuug

SEQ ID NO: 533911 - RNA, 22 nt, Human
agagacaagaaauaccugggac

SEQ ID NO: 533912 - RNA, 22 nt, Human
gcuggcuuugcacugggugcau

SEQ ID NO: 533913 - RNA, 22 nt, Human
ugaaauuagugaaguuacaguu

SEQ ID NO: 533914 - RNA, 22 nt, Human
ugcaggcuggaggagggacuaa

SEQ ID NO: 533915 - RNA, 22 nt, Human
cagagggguguagagaucacug

SEQ ID NO: 533916 - RNA, 22 nt, Human
uuccagaaaacucugccuggua

SEQ ID NO: 533917 - RNA, 22 nt, Human
aauucuuguuguuaguauauuu

SEQ ID NO: 533918 - RNA, 22 nt, Human
aagacagaagugauuugaugug

SEQ ID NO: 533919 - RNA, 22 nt, Human
uuaacaguggcuaagacugagg

SEQ ID NO: 533920 - RNA, 22 nt, Human
acagauuuauugaagcugcugc

SEQ ID NO: 533921 - RNA, 22 nt, Human
aggcacugugcuucuuauaugu

SEQ ID NO: 533922 - RNA, 22 nt, Human
aguucuuugugauggaaauuua

SEQ ID NO: 533923 - RNA, 22 nt, Human
aacaggaaaacagcacaauagc

SEQ ID NO: 533924 - RNA, 22 nt, Human
uguacaaugccagggaacacca

SEQ ID NO: 533925 - RNA, 22 nt, Human
caagucugaccucugggugaag

SEQ ID NO: 533926 - RNA, 22 nt, Human
gagggugguggcuuaaggugcu

SEQ ID NO: 533927 - RNA, 22 nt, Human
auagggccuaaaaaguauugcu

SEQ ID NO: 533928 - RNA, 22 nt, Human
aaggguugaagauaaauaaggu

SEQ ID NO: 533929 - RNA, 22 nt, Human
aacacagaucaaaauauuuccu

SEQ ID NO: 533930 - RNA, 22 nt, Human
cccuggagcaucucugcugucu

SEQ ID NO: 533931 - RNA, 21 nt, Human
guucaaauccugacacuacac

SEQ ID NO: 533932 - RNA, 22 nt, Human
ggagacucaccccgcauucuag

SEQ ID NO: 533933 - RNA, 22 nt, Human
ucagaggacgcacuaggguugu

SEQ ID NO: 533934 - RNA, 22 nt, Human
ggccucucagggcagagacccu

SEQ ID NO: 533935 - RNA, 22 nt, Human
ugaaaucaucaaaagagccauu

SEQ ID NO: 533936 - RNA, 22 nt, Human
uaaaaaguagugagaauggcgc

SEQ ID NO: 533937 - RNA, 22 nt, Human
gcagcaguacucaauauccugg

SEQ ID NO: 533938 - RNA, 22 nt, Human
gcacauaaagggcaugggaggu

SEQ ID NO: 533939 - RNA, 22 nt, Human
ucaggacagccagggugcagac

SEQ ID NO: 533940 - RNA, 22 nt, Human
uuaauugagccagaaaguaucu

SEQ ID NO: 533941 - RNA, 22 nt, Human
uuaauuuuaaccuguuuguguc

SEQ ID NO: 533942 - RNA, 22 nt, Human
uugccauuuaguaugcuuguau

SEQ ID NO: 533943 - RNA, 22 nt, Human
ucuggaguguuucuaauuacug

SEQ ID NO: 533944 - RNA, 22 nt, Human
uuuguaaaagcccaagcuguag

SEQ ID NO: 533945 - RNA, 22 nt, Human
agugaaaugacugaaucagaua

SEQ ID NO: 533946 - RNA, 22 nt, Human
cccugcugugucccaccuggaa

SEQ ID NO: 533947 - RNA, 22 nt, Human
acaaaauuguguuaaacuuuau

SEQ ID NO: 533948 - RNA, 22 nt, Human
guaucuagucaaugcuguucaa

SEQ ID NO: 533949 - RNA, 22 nt, Human
gcacccagaauaaggacaggac

SEQ ID NO: 533950 - RNA, 22 nt, Human
acagcuuugggcaaugcuauga

SEQ ID NO: 533951 - RNA, 17 nt, Human
aggagucucagaugagc

SEQ ID NO: 533952 - RNA, 22 nt, Human
cagcuauugguccacagguaug

SEQ ID NO: 533953 - RNA, 22 nt, Human
ggagaggugcaggucaguggca

SEQ ID NO: 533954 - RNA, 22 nt, Human
gggcucagccccauugaaccag

SEQ ID NO: 533955 - RNA, 23 nt, Human
gauguguagggaaagucagacuc

SEQ ID NO: 533956 - RNA, 22 nt, Human
gcagggaccagggccagaucca

SEQ ID NO: 533957 - RNA, 22 nt, Human
gaaggagagaaaggcaauucug

SEQ ID NO: 533958 - RNA, 22 nt, Human
ugggcagccaucccagccucuc

SEQ ID NO: 533959 - RNA, 22 nt, Human
uauuuauucauucagcaagcau

SEQ ID NO: 533960 - RNA, 22 nt, Human
gcagcugauggaaguccuauug

SEQ ID NO: 533961 - RNA, 22 nt, Human
cuuuacaaacuauaaagugcgg

SEQ ID NO: 533962 - RNA, 22 nt, Human
ucugaaaacuccaugagcucgu

SEQ ID NO: 533963 - RNA, 22 nt, Human
uccugcagguggaugauucucu

SEQ ID NO: 533964 - RNA, 22 nt, Human
uacacagauuucaguaucauca

SEQ ID NO: 533965 - RNA, 22 nt, Human
aggagggagcuuaagccaggca

SEQ ID NO: 533966 - RNA, 22 nt, Human
caccagggcagcagccuagucu

SEQ ID NO: 533967 - RNA, 22 nt, Human
ugguggggucaucgucagaugc

SEQ ID NO: 533968 - RNA, 22 nt, Human
auuuaauuuggagagagaaacc

SEQ ID NO: 533969 - RNA, 22 nt, Human
uuuaauguagcgugaaaugauu

SEQ ID NO: 533970 - RNA, 22 nt, Human
ugggcuguccagcaccugggcu

SEQ ID NO: 533971 - RNA, 22 nt, Human
gucccucugugucccugcaguc

SEQ ID NO: 533972 - RNA, 22 nt, Human
ccugggagccaagccucugugu

SEQ ID NO: 533973 - RNA, 22 nt, Human
auacaaguugcccaaaugauua

SEQ ID NO: 533974 - RNA, 22 nt, Human
aggcaguuuauccccagagccu

SEQ ID NO: 533975 - RNA, 22 nt, Human
agaggcaguauacaauccgagc

SEQ ID NO: 533976 - RNA, 22 nt, Human
aaaugucauauuuaaguaggaa

SEQ ID NO: 533977 - RNA, 22 nt, Human
augcccugugguucaugugaga

SEQ ID NO: 533978 - RNA, 22 nt, Human
gagggcaguagccucguacccu

SEQ ID NO: 533979 - RNA, 22 nt, Human
uuucacauucagauauagacuu

SEQ ID NO: 533980 - RNA, 22 nt, Human
uagcaggguaaauguagaugga

SEQ ID NO: 533981 - RNA, 17 nt, Human
cugggccuccccugucc

SEQ ID NO: 533982 - RNA, 22 nt, Human
ggcuucucucccccagcuccac

SEQ ID NO: 533983 - RNA, 22 nt, Human
cuggcucccucgcugaggugcu

SEQ ID NO: 533984 - RNA, 18 nt, Human
ugggcugccuggccucug

SEQ ID NO: 533985 - RNA, 20 nt, Human
cucaggauacugcaaaguug

SEQ ID NO: 533986 - RNA, 22 nt, Human
ggaggacaggggcugcagcaca

SEQ ID NO: 533987 - RNA, 22 nt, Human
acuuuguauaagacaauaaaga

SEQ ID NO: 533988 - RNA, 22 nt, Human
uggcaggguggcaacuuuuggu

SEQ ID NO: 533989 - RNA, 22 nt, Human
gggcacugaaugccaagcuagg

SEQ ID NO: 533990 - RNA, 22 nt, Human
ggccugagcuugggcagcguau

SEQ ID NO: 533991 - RNA, 22 nt, Human
uagaccaggggagucaacaggu

SEQ ID NO: 533992 - RNA, 22 nt, Human
aaaagagucuuaggcagucaua

SEQ ID NO: 533993 - RNA, 22 nt, Human
uccaggcucucaggugucagca

SEQ ID NO: 533994 - RNA, 22 nt, Human
gagcaggcauucuaguggcuga

SEQ ID NO: 533995 - RNA, 22 nt, Human
uggagaugaauauguguaccug

SEQ ID NO: 533996 - RNA, 22 nt, Human
uccaggcaaggauaauaaacau

SEQ ID NO: 533997 - RNA, 22 nt, Human
ccugcacuaccuggggcugcug

SEQ ID NO: 533998 - RNA, 22 nt, Human
ggagggugcagacccuuugcaa

SEQ ID NO: 533999 - RNA, 22 nt, Human
uuuguguguauauguauauaga

SEQ ID NO: 534000 - RNA, 22 nt, Human
cagcucuggcagagcccaaccc

SEQ ID NO: 534001 - RNA, 22 nt, Human
acaggcucacagucauuucauu

SEQ ID NO: 534002 - RNA, 22 nt, Human
gugguucagugucauauuaacg

SEQ ID NO: 534003 - RNA, 22 nt, Human
ugugccuggucccugagucgag

SEQ ID NO: 534004 - RNA, 22 nt, Human
uuuccucugucaugacagcuga

SEQ ID NO: 534005 - RNA, 22 nt, Human
acugcuggcaugcauauacaaa

SEQ ID NO: 534006 - RNA, 21 nt, Human
auauuuuuguuuggacuguca

SEQ ID NO: 534007 - RNA, 22 nt, Human
guggcagugugaggauccugcu

SEQ ID NO: 534008 - RNA, 22 nt, Human
cugugacaguuucucagacuuu

SEQ ID NO: 534009 - RNA, 22 nt, Human
cgcaggugaacuguucugcagu

SEQ ID NO: 534010 - RNA, 22 nt, Human
uccucaggauguggaguagaau

SEQ ID NO: 534011 - RNA, 19 nt, Human
cuucuagaccuuauaccac

SEQ ID NO: 534012 - RNA, 22 nt, Human
aggguggggugcuacaucuuua

SEQ ID NO: 534013 - RNA, 22 nt, Human
uuguaaacaucuguugcuuaga

SEQ ID NO: 534014 - RNA, 22 nt, Human
auacaugugugugcauacaugu

SEQ ID NO: 534015 - RNA, 22 nt, Human
guaugcaucgacucaagucuga

SEQ ID NO: 534016 - RNA, 22 nt, Human
accaaggagaaggugcaagcuu

SEQ ID NO: 534017 - RNA, 22 nt, Human
uggcucaguuugggggauugaa

SEQ ID NO: 534018 - RNA, 22 nt, Human
cucccugggccucaguuucucu

SEQ ID NO: 534019 - RNA, 22 nt, Human
ugugccauuucuauucugcagc

SEQ ID NO: 534020 - RNA, 22 nt, Human
augaggcaaggaucagguaagg

SEQ ID NO: 534021 - RNA, 22 nt, Human
aucuacaaccccucaaacugug

SEQ ID NO: 534022 - RNA, 22 nt, Human
cuggcagcguguuuaugaacau

SEQ ID NO: 534023 - RNA, 22 nt, Human
ggcaucuguccaucucuccagc

SEQ ID NO: 534024 - RNA, 22 nt, Human
ggcagccaugcacgcugccugg

SEQ ID NO: 534025 - RNA, 22 nt, Human
ggcagcuguaagaugagugaau

SEQ ID NO: 534026 - RNA, 22 nt, Human
ucuguucauguugggcuuuucc

SEQ ID NO: 534027 - RNA, 22 nt, Human
uaugucaugggucaaaaugaag

SEQ ID NO: 534028 - RNA, 22 nt, Human
aaggcugaggcuggagaauuac

SEQ ID NO: 534029 - RNA, 22 nt, Human
caggccugacccugagcuucac

SEQ ID NO: 534030 - RNA, 22 nt, Human
uugugaaacauucauggauuug

SEQ ID NO: 534031 - RNA, 22 nt, Human
gcagcuuucuaagcuuuauugc

SEQ ID NO: 534032 - RNA, 22 nt, Human
caaagagguuuugagggcagcu

SEQ ID NO: 534033 - RNA, 22 nt, Human
uuacacagaaacacuguucaga

SEQ ID NO: 534034 - RNA, 22 nt, Human
ugugagacguaggccaucgagg

SEQ ID NO: 534035 - RNA, 22 nt, Human
acagccagguaaaggcauggca

SEQ ID NO: 534036 - RNA, 22 nt, Human
agcucaggcaacucugggcccc

SEQ ID NO: 534037 - RNA, 22 nt, Human
ucucagaguuuacggggcugaa

SEQ ID NO: 534038 - RNA, 22 nt, Human
uuguuaaaaauagauuuccagg

SEQ ID NO: 534039 - RNA, 22 nt, Human
cuuuauggaaucaaagacugga

SEQ ID NO: 534040 - RNA, 22 nt, Human
aggagccaguuccaccccagga

SEQ ID NO: 534041 - RNA, 22 nt, Human
auucucugugcagauuuaagac

SEQ ID NO: 534042 - RNA, 22 nt, Human
gacagggcgcccagccuguuuc

SEQ ID NO: 534043 - RNA, 22 nt, Human
aggcucauucuugccucugagc

SEQ ID NO: 534044 - RNA, 22 nt, Human
gaugaagcuauuugguuggcac

SEQ ID NO: 534045 - RNA, 22 nt, Human
gaauacaugauuaaaguuugau

SEQ ID NO: 534046 - RNA, 22 nt, Human
ugggccugaaggagcugcgccc

SEQ ID NO: 534047 - RNA, 22 nt, Human
agaagccaaucagcucucugcu

SEQ ID NO: 534048 - RNA, 22 nt, Human
ggguccagaguugaagagguua

SEQ ID NO: 534049 - RNA, 22 nt, Human
aaaagcagaccacgcuuugugg

SEQ ID NO: 534050 - RNA, 22 nt, Human
aagacagagggaagcaaugaug

SEQ ID NO: 534051 - RNA, 22 nt, Human
ugcucauuggcgaucugaggga

SEQ ID NO: 534052 - RNA, 22 nt, Human
aguguuguaugggaugacugcu

SEQ ID NO: 534053 - RNA, 21 nt, Human
auuguuaguaauaguccacac

SEQ ID NO: 534054 - RNA, 22 nt, Human
cuguggcucucugcaggguccc

SEQ ID NO: 534055 - RNA, 22 nt, Human
gaacaguaucaguagugccagu

SEQ ID NO: 534056 - RNA, 22 nt, Human
cucaggaggaggaaguucauug

SEQ ID NO: 534057 - RNA, 22 nt, Human
ggcuccuggcaucuggugggua

SEQ ID NO: 534058 - RNA, 22 nt, Human
ggccaggcugguuccuugaccu

SEQ ID NO: 534059 - RNA, 22 nt, Human
uugcauucuguuaaaauguauu

SEQ ID NO: 534060 - RNA, 22 nt, Human
aaggggaaguagcaccagaggu

SEQ ID NO: 534061 - RNA, 22 nt, Human
uggcagcugaggggaggcuuug

SEQ ID NO: 534062 - RNA, 17 nt, Human
cacaggugugguuugag

SEQ ID NO: 534063 - RNA, 22 nt, Human
gcugagagugagcacuggauau

SEQ ID NO: 534064 - RNA, 22 nt, Human
ucagcuuucucucgccaucagg

SEQ ID NO: 534065 - RNA, 22 nt, Human
cuuccuccgaagaaguugcugg

SEQ ID NO: 534066 - RNA, 22 nt, Human
ugaaauauccagcccagcagga

SEQ ID NO: 534067 - RNA, 22 nt, Human
aguucaaacucuauaagaacuu

SEQ ID NO: 534068 - RNA, 22 nt, Human
accagagaugucuaauaggggc

SEQ ID NO: 534069 - RNA, 22 nt, Human
agagaauacaggguaacaggaa

SEQ ID NO: 534070 - RNA, 23 nt, Human
aaggccagaauuucaauggugcc

SEQ ID NO: 534071 - RNA, 22 nt, Human
ggcugagggccagggcuagucu

SEQ ID NO: 534072 - RNA, 22 nt, Human
acagauaauaggauguacccug

SEQ ID NO: 534073 - RNA, 22 nt, Human
ggcacagcuacuugcucacucu

SEQ ID NO: 534074 - RNA, 22 nt, Human
agaauauaugacugcaagacua

SEQ ID NO: 534075 - RNA, 22 nt, Human
aacauuuaugguagucauugca

SEQ ID NO: 534076 - RNA, 22 nt, Human
gcaggaagggaaagguugacuc

SEQ ID NO: 534077 - RNA, 19 nt, Human
cccagagcauccugaacuu

SEQ ID NO: 534078 - RNA, 22 nt, Human
ccaggagcaaagaucacuggga

SEQ ID NO: 534079 - RNA, 22 nt, Human
agaaggaaggcugagugcugau

SEQ ID NO: 534080 - RNA, 22 nt, Human
aagucagcacuccaggaagcca

SEQ ID NO: 534081 - RNA, 22 nt, Human
caugaauauuuaguauuuacuu

SEQ ID NO: 534082 - RNA, 22 nt, Human
aucccugcccucauggagcuua

SEQ ID NO: 534083 - RNA, 22 nt, Human
ccucuccaguuuuaacgugacc

SEQ ID NO: 534084 - RNA, 20 nt, Human
uuggucagugguucaguuug

SEQ ID NO: 534085 - RNA, 22 nt, Human
caaaagauacuugcaucuaacu

SEQ ID NO: 534086 - RNA, 22 nt, Human
aaggcgacacaggcagcaggcc

SEQ ID NO: 534087 - RNA, 22 nt, Human
gcaugcugcaccagagccucuc

SEQ ID NO: 534088 - RNA, 22 nt, Human
uuacauuuggcuauguccucua

SEQ ID NO: 534089 - RNA, 22 nt, Human
uccuuuguuaaggagguuuguu

SEQ ID NO: 534090 - RNA, 22 nt, Human
uacaagagguauauagaaacag

SEQ ID NO: 534091 - RNA, 22 nt, Human
agcauugccugccuauugcuaa

SEQ ID NO: 534092 - RNA, 22 nt, Human
auguuugucaggauuguaauua

SEQ ID NO: 534093 - RNA, 22 nt, Human
agagggaaugugauugcaccau

SEQ ID NO: 534094 - RNA, 22 nt, Human
gaaauacaauuuugucccagcu

SEQ ID NO: 534095 - RNA, 23 nt, Human
gccaggcacaugguggacacgca

SEQ ID NO: 534096 - RNA, 22 nt, Human
ucccagggcagcuguccagaag

SEQ ID NO: 534097 - RNA, 22 nt, Human
uggguaggccaggaagcagugu

SEQ ID NO: 534098 - RNA, 22 nt, Human
caggccugcuucuuacccuuca

SEQ ID NO: 534099 - RNA, 22 nt, Human
aaaaugugaucuacaaaugcaa

SEQ ID NO: 534100 - RNA, 22 nt, Human
caauauauaggaacaacuuagg

SEQ ID NO: 534101 - RNA, 22 nt, Human
ccaggccuucugaggacacucu

SEQ ID NO: 534102 - RNA, 22 nt, Human
gcuagcuuuauaaugcugggcg

SEQ ID NO: 534103 - RNA, 22 nt, Human
accugaggcuguuagucuaggu

SEQ ID NO: 534104 - RNA, 22 nt, Human
gcugguccacucccuggaggcu

SEQ ID NO: 534105 - RNA, 22 nt, Human
agggcagccucucagccuaggu

SEQ ID NO: 534106 - RNA, 22 nt, Human
aagaucaagugcuggcaguguu

SEQ ID NO: 534107 - RNA, 19 nt, Human
ucccaggcaaaggcuucuc

SEQ ID NO: 534108 - RNA, 22 nt, Human
accugagaccuaaucugacugu

SEQ ID NO: 534109 - RNA, 22 nt, Human
auggccagucaagccucuggcu

SEQ ID NO: 534110 - RNA, 22 nt, Human
uauguacaugauuucauuugcu

SEQ ID NO: 534111 - RNA, 22 nt, Human
gaaauauacaugaagucggcug

SEQ ID NO: 534112 - RNA, 21 nt, Human
ggauggauagggaagagauuu

SEQ ID NO: 534113 - RNA, 22 nt, Human
gaggaaccaccuuggguaggcu

SEQ ID NO: 534114 - RNA, 18 nt, Human
gagcucugccucccaguc

SEQ ID NO: 534115 - RNA, 22 nt, Human
uuucacauaucaacucuauccu

SEQ ID NO: 534116 - RNA, 22 nt, Human
aucuuuaguagaggaauauauu

SEQ ID NO: 534117 - RNA, 22 nt, Human
ccucugaguccuuugggcucuc

SEQ ID NO: 534118 - RNA, 22 nt, Human
uccaguucuaggucacucucug

SEQ ID NO: 534119 - RNA, 19 nt, Human
uggagcagggcccuuguuu

SEQ ID NO: 534120 - RNA, 22 nt, Human
acuuugaaauguguaagagaga

SEQ ID NO: 534121 - RNA, 22 nt, Human
uuucuggaggcccaagggcaga

SEQ ID NO: 534122 - RNA, 22 nt, Human
auaaaguagccacuggaaagcu

SEQ ID NO: 534123 - RNA, 22 nt, Human
uaguuuuagucccauuuuacag

SEQ ID NO: 534124 - RNA, 22 nt, Human
uaagaacagugacagccaacau

SEQ ID NO: 534125 - RNA, 22 nt, Human
ugcagauucaaaugaaaugcaa

SEQ ID NO: 534126 - RNA, 22 nt, Human
gccaggcaugggcuucugggcg

SEQ ID NO: 534127 - RNA, 22 nt, Human
gcaggaagaugagcucagguaa

SEQ ID NO: 534128 - RNA, 22 nt, Human
gucacuuuggccucuacagcca

SEQ ID NO: 534129 - RNA, 22 nt, Human
cucaacagcucugccauacucc

SEQ ID NO: 534130 - RNA, 22 nt, Human
gauauacauagguuucuaugca

SEQ ID NO: 534131 - RNA, 22 nt, Human
ugugccaggcacuugcccaggc

SEQ ID NO: 534132 - RNA, 22 nt, Human
gcuggcagucccaucagcuggg

SEQ ID NO: 534133 - RNA, 22 nt, Human
uagggcucagaguccaguuucu

SEQ ID NO: 534134 - RNA, 22 nt, Human
uccugggaggcugugccuggcu

SEQ ID NO: 534135 - RNA, 22 nt, Human
cuggagaggccccaagauauuu

SEQ ID NO: 534136 - RNA, 21 nt, Human
acaugagacacacauauaugu

SEQ ID NO: 534137 - RNA, 22 nt, Human
ugauuuuacuuagcaugauguu

SEQ ID NO: 534138 - RNA, 19 nt, Human
agcaggcuaggcugccucu

SEQ ID NO: 534139 - RNA, 22 nt, Human
cugaagaugucugagaugcuca

SEQ ID NO: 534140 - RNA, 22 nt, Human
gcaagcaguuguggcuucugag

SEQ ID NO: 534141 - RNA, 22 nt, Human
aaaaugaacagaacaaugggga

SEQ ID NO: 534142 - RNA, 22 nt, Human
uccaagaagucaucuaaacugu

SEQ ID NO: 534143 - RNA, 22 nt, Human
ggccagguggcuguccuggcgu

SEQ ID NO: 534144 - RNA, 22 nt, Human
acauucaccacacuuauagggc

SEQ ID NO: 534145 - RNA, 22 nt, Human
ucacugggcccugaggugggac

SEQ ID NO: 534146 - RNA, 22 nt, Human
uuacacaacagugcaucagcag

SEQ ID NO: 534147 - RNA, 20 nt, Human
aacuuguucuaccuguuuca

SEQ ID NO: 534148 - RNA, 22 nt, Human
gccagagcagaauagaguggcc

SEQ ID NO: 534149 - RNA, 22 nt, Human
auuuguagugaagugaaaauaa

SEQ ID NO: 534150 - RNA, 22 nt, Human
agagcccucucauuggcuuauu

SEQ ID NO: 534151 - RNA, 22 nt, Human
aaauaauugaguuggucaauau

SEQ ID NO: 534152 - RNA, 22 nt, Human
acacuuuaucucaucucagaca

SEQ ID NO: 534153 - RNA, 22 nt, Human
ugaaugagaacacugaaagagg

SEQ ID NO: 534154 - RNA, 22 nt, Human
auaaacuauguaauuugcucua

SEQ ID NO: 534155 - RNA, 22 nt, Human
uaaaugaagaaauggagauugu

SEQ ID NO: 534156 - RNA, 22 nt, Human
gucugaggaagaugcaggggga

SEQ ID NO: 534157 - RNA, 22 nt, Human
caaaggcaugugaguauaugug

SEQ ID NO: 534158 - RNA, 22 nt, Human
gauggcagcagcagccagggau

SEQ ID NO: 534159 - RNA, 22 nt, Human
agcuuugugacuuugagcuagu

SEQ ID NO: 534160 - RNA, 22 nt, Human
acauaaugaaaugcagaaauca

SEQ ID NO: 534161 - RNA, 22 nt, Human
uucacauaaauagaucacauca

SEQ ID NO: 534162 - RNA, 22 nt, Human
ugcccugccaagaccaaguggu

SEQ ID NO: 534163 - RNA, 22 nt, Human
agcaggcacaagaaagggaggu

SEQ ID NO: 534164 - RNA, 22 nt, Human
cuagggaccucagcuccuggag

SEQ ID NO: 534165 - RNA, 22 nt, Human
aacauuagauuuguuuuucuag

SEQ ID NO: 534166 - RNA, 22 nt, Human
aaauuauuuucagaauggagaa

SEQ ID NO: 534167 - RNA, 19 nt, Human
agcuggggcgguguguguu

SEQ ID NO: 534168 - RNA, 22 nt, Human
gagggcucuaccaaguaacucu

SEQ ID NO: 534169 - RNA, 22 nt, Human
ucuggggagcagcccuggugag

SEQ ID NO: 534170 - RNA, 22 nt, Human
aaaugcuacauacacaucaggg

SEQ ID NO: 534171 - RNA, 22 nt, Human
gagagugaggcaucaggggcag

SEQ ID NO: 534172 - RNA, 22 nt, Human
uaauuucuaauucauuuucagu

SEQ ID NO: 534173 - RNA, 22 nt, Human
uccugaggcacaauccuagaau

SEQ ID NO: 534174 - RNA, 18 nt, Human
agcagaauucuaggguuc

SEQ ID NO: 534175 - RNA, 22 nt, Human
ugccugugaaaacccugggguu

SEQ ID NO: 534176 - RNA, 22 nt, Human
ucucuuuuauguacacccugac

SEQ ID NO: 534177 - RNA, 22 nt, Human
ggcaaagccuuccagcuguuac

SEQ ID NO: 534178 - RNA, 22 nt, Human
gaaaucuacgauuagugaaaau

SEQ ID NO: 534179 - RNA, 22 nt, Human
gugucacaugguuuacugcagc

SEQ ID NO: 534180 - RNA, 22 nt, Human
caggaaauuuauguucuacuua

SEQ ID NO: 534181 - RNA, 22 nt, Human
ccuccuggccugugcagagccc

SEQ ID NO: 534182 - RNA, 22 nt, Human
auuccacacaguaauacucaau

SEQ ID NO: 534183 - RNA, 22 nt, Human
ggaagugguagagccaugagug

SEQ ID NO: 534184 - RNA, 22 nt, Human
ggcuucugaaccaggcccugga

SEQ ID NO: 534185 - RNA, 22 nt, Human
aaugccuuauaggcugaaaauu

SEQ ID NO: 534186 - RNA, 22 nt, Human
caaggcaggcaguucacuugag

SEQ ID NO: 534187 - RNA, 22 nt, Human
uuauuauaaugagggauaaaaa

SEQ ID NO: 534188 - RNA, 22 nt, Human
acaguuuacagggauuugagcu

SEQ ID NO: 534189 - RNA, 22 nt, Human
aggcuucagaugaccuuagcau

SEQ ID NO: 534190 - RNA, 22 nt, Human
auaugauuguccuuagcaaauu

SEQ ID NO: 534191 - RNA, 22 nt, Human
ggcugcucugccuuccagcugg

SEQ ID NO: 534192 - RNA, 22 nt, Human
uaaagcagugugguuguguccc

SEQ ID NO: 534193 - RNA, 22 nt, Human
cagaaauguacugacaugcagu

SEQ ID NO: 534194 - RNA, 22 nt, Human
uuccaggggcagcagugauggu

SEQ ID NO: 534195 - RNA, 22 nt, Human
ggccucacccaucggugccuuu

SEQ ID NO: 534196 - RNA, 20 nt, Human
cauuuguuagcuuucuacug

SEQ ID NO: 534197 - RNA, 22 nt, Human
ugccuggcaagaggggcuggcu

SEQ ID NO: 534198 - RNA, 22 nt, Human
acagaacuuccagggaacauac

SEQ ID NO: 534199 - RNA, 22 nt, Human
acaaaugugucuaauugugccu

SEQ ID NO: 534200 - RNA, 22 nt, Human
ugcuuaaaauaguucauuuuug

SEQ ID NO: 534201 - RNA, 22 nt, Human
gagagugagauaauuucacaua

SEQ ID NO: 534202 - RNA, 22 nt, Human
gaacaugauggcuguuauuuug

SEQ ID NO: 534203 - RNA, 22 nt, Human
uggcaaagaugaagcauuucgu

SEQ ID NO: 534204 - RNA, 22 nt, Human
ugacacagauuagagacauacc

SEQ ID NO: 534205 - RNA, 22 nt, Human
ugaggccuuuucugucuggcua

SEQ ID NO: 534206 - RNA, 22 nt, Human
cuggggacuugcagacacaauu

SEQ ID NO: 534207 - RNA, 22 nt, Human
ugcuuuauucaggguuuacccc

SEQ ID NO: 534208 - RNA, 22 nt, Human
gaggaagaagggauuagaacuc

SEQ ID NO: 534209 - RNA, 22 nt, Human
auucuugcaguauacaacuacu

SEQ ID NO: 534210 - RNA, 22 nt, Human
guuuauaaauucugcuuuuguu

SEQ ID NO: 534211 - RNA, 22 nt, Human
cugugcugauucagcacaggcc

SEQ ID NO: 534212 - RNA, 22 nt, Human
agguuccuuauggggauggcua

SEQ ID NO: 534213 - RNA, 22 nt, Human
cugccugacugauaaucucuga

SEQ ID NO: 534214 - RNA, 22 nt, Human
aaagcagacugauuugcaucac

SEQ ID NO: 534215 - RNA, 22 nt, Human
uuaccagaugggggacuaugag

SEQ ID NO: 534216 - RNA, 22 nt, Human
acuucuguaaagggaagacagu

SEQ ID NO: 534217 - RNA, 22 nt, Human
agccagccgggggaccacagug

SEQ ID NO: 534218 - RNA, 22 nt, Human
ucaucacauguguagucauccc

SEQ ID NO: 534219 - RNA, 22 nt, Human
aucagaaaggugggcaagcaga

SEQ ID NO: 534220 - RNA, 18 nt, Human
agccuggaggguugaagu

SEQ ID NO: 534221 - RNA, 22 nt, Human
cuuauacagaucaagggaaaag

SEQ ID NO: 534222 - RNA, 22 nt, Human
gcacugaaugcuuuuacuguaa

SEQ ID NO: 534223 - RNA, 22 nt, Human
ccugccucaucaacuugucgug

SEQ ID NO: 534224 - RNA, 22 nt, Human
augggaggaagagaagaugucu

SEQ ID NO: 534225 - RNA, 22 nt, Human
ucagaguccuuuggccugacag

SEQ ID NO: 534226 - RNA, 22 nt, Human
gauggcacacagacauccccgc

SEQ ID NO: 534227 - RNA, 22 nt, Human
cauaucauaggucuuggauaau

SEQ ID NO: 534228 - RNA, 22 nt, Human
uugcccugccucccugagguga

SEQ ID NO: 534229 - RNA, 22 nt, Human
uggcaccugaacuuagaggugu

SEQ ID NO: 534230 - RNA, 22 nt, Human
ggcacacaggcagauggagugu

SEQ ID NO: 534231 - RNA, 22 nt, Human
ugaaggaaugaguauacuguuu

SEQ ID NO: 534232 - RNA, 21 nt, Human
auucaacuagaugauuauuuc

SEQ ID NO: 534233 - RNA, 22 nt, Human
cuccaguaucuguaggaaaagg

SEQ ID NO: 534234 - RNA, 23 nt, Human
cuucacaaucaaaaucaguucug

SEQ ID NO: 534235 - RNA, 22 nt, Human
ggauauaugcauguuaucauuu

SEQ ID NO: 534236 - RNA, 22 nt, Human
auuauuaggugcucucugacaa

SEQ ID NO: 534237 - RNA, 22 nt, Human
ggacagaggguugacagaguau

SEQ ID NO: 534238 - RNA, 22 nt, Human
gcaggcuccaggccggccccuu

SEQ ID NO: 534239 - RNA, 23 nt, Human
gccugggacucaggaggagcuca

SEQ ID NO: 534240 - RNA, 22 nt, Human
cucuucaauagauuguugaggg

SEQ ID NO: 534241 - RNA, 22 nt, Human
gauagcaacauagaacagaauu

SEQ ID NO: 534242 - RNA, 22 nt, Human
aguguauugauuggaacagccu

SEQ ID NO: 534243 - RNA, 18 nt, Human
cgcccugcuauaaaugac

SEQ ID NO: 534244 - RNA, 22 nt, Human
ggaggaguguggggcacucugc

SEQ ID NO: 534245 - RNA, 22 nt, Human
uuguaacacuuuucuauuaaua

SEQ ID NO: 534246 - RNA, 23 nt, Human
agagcuuucuaaaauguaaaucu

SEQ ID NO: 534247 - RNA, 22 nt, Human
gcauggcaaauaucgagggcag

SEQ ID NO: 534248 - RNA, 22 nt, Human
augaaggcuguguagauggaug

SEQ ID NO: 534249 - RNA, 22 nt, Human
uggcagucgaucauauucagca

SEQ ID NO: 534250 - RNA, 22 nt, Human
uggucucuucuuccaagauggc

SEQ ID NO: 534251 - RNA, 22 nt, Human
acagagucauucauuguccagu

SEQ ID NO: 534252 - RNA, 22 nt, Human
cuccagugggggugagccuaga

SEQ ID NO: 534253 - RNA, 22 nt, Human
aaagcagagguugcagugagcu

SEQ ID NO: 534254 - RNA, 22 nt, Human
cagccaggcccccgagucguug

SEQ ID NO: 534255 - RNA, 22 nt, Human
agcacuagagccaaaauuuggg

SEQ ID NO: 534256 - RNA, 22 nt, Human
agggcuggagccacagcuggga

SEQ ID NO: 534257 - RNA, 22 nt, Human
uggggcugucccgguuuggcga

SEQ ID NO: 534258 - RNA, 22 nt, Human
aaugagcuagaccugcuuccuc

SEQ ID NO: 534259 - RNA, 22 nt, Human
aagugcaaaucuguggcugaaa

SEQ ID NO: 534260 - RNA, 22 nt, Human
auuugcagagcucugaauuuug

SEQ ID NO: 534261 - RNA, 22 nt, Human
agagagaacacccucggcaugg

SEQ ID NO: 534262 - RNA, 22 nt, Human
gggcucugcgcucagcuccagc

SEQ ID NO: 534263 - RNA, 22 nt, Human
cagagaaacucagauagcugau

SEQ ID NO: 534264 - RNA, 22 nt, Human
agagccaguuacaacuguggag

SEQ ID NO: 534265 - RNA, 22 nt, Human
agaggguggugaggccugguuc

SEQ ID NO: 534266 - RNA, 22 nt, Human
uaacagaaaggggacagaaaua

SEQ ID NO: 534267 - RNA, 22 nt, Human
gaacagcagcuuccugggaauu

SEQ ID NO: 534268 - RNA, 22 nt, Human
uucucuucuguucagugcccaa

SEQ ID NO: 534269 - RNA, 22 nt, Human
ugggggagaguuuagaugauuu

SEQ ID NO: 534270 - RNA, 22 nt, Human
ccuuaccugauugcuggcaucc

SEQ ID NO: 534271 - RNA, 23 nt, Human
cgcccagccucagugaccugggc

SEQ ID NO: 534272 - RNA, 23 nt, Human
uuacaguaggaguuggaaaacca

SEQ ID NO: 534273 - RNA, 22 nt, Human
cugggcucccucaugugucugc

SEQ ID NO: 534274 - RNA, 22 nt, Human
guguaugaacgaaagaauggau

SEQ ID NO: 534275 - RNA, 22 nt, Human
aacuuuaaggcuauaaauuaug

SEQ ID NO: 534276 - RNA, 22 nt, Human
cagguugggcugcgaggaggag

SEQ ID NO: 534277 - RNA, 22 nt, Human
augaaacagaguacuuaauaua

SEQ ID NO: 534278 - RNA, 22 nt, Human
agcugcugagccaggcugaugu

SEQ ID NO: 534279 - RNA, 22 nt, Human
ugggcuguggagcaccuuugca

SEQ ID NO: 534280 - RNA, 22 nt, Human
cacauucaauuacacagauagg

SEQ ID NO: 534281 - RNA, 22 nt, Human
ucagaguguuuuacuaaacaag

SEQ ID NO: 534282 - RNA, 22 nt, Human
uucaugaacgaacauauguaua

SEQ ID NO: 534283 - RNA, 22 nt, Human
gccaggcugacucccccggccu

SEQ ID NO: 534284 - RNA, 22 nt, Human
uuagggcaggcaugagagaacu

SEQ ID NO: 534285 - RNA, 22 nt, Human
agcaaggcagucagcuggcugg

SEQ ID NO: 534286 - RNA, 22 nt, Human
ugcagcucauugcuggggucug

SEQ ID NO: 534287 - RNA, 21 nt, Human
acuguucauuugaugaacugg

SEQ ID NO: 534288 - RNA, 22 nt, Human
acugggcugguuaguuuuacua

SEQ ID NO: 534289 - RNA, 22 nt, Human
gcugcugggagggaucguaaau

SEQ ID NO: 534290 - RNA, 22 nt, Human
aacagaauugcugcugccaaug

SEQ ID NO: 534291 - RNA, 22 nt, Human
acaucuguuugagaaaaagaag

SEQ ID NO: 534292 - RNA, 21 nt, Human
agauuguauggaggugagagg

SEQ ID NO: 534293 - RNA, 19 nt, Human
aggcucugagcuccuggag

SEQ ID NO: 534294 - RNA, 22 nt, Human
gcugccucaggcaccuccuggc

SEQ ID NO: 534295 - RNA, 22 nt, Human
ugggaagggucaguuucuucau

SEQ ID NO: 534296 - RNA, 22 nt, Human
ucagcaguuuuauaugcagcuu

SEQ ID NO: 534297 - RNA, 20 nt, Human
cuucaaguuaugguuggcaa

SEQ ID NO: 534298 - RNA, 22 nt, Human
aaacaucauaggcaugcaugau

SEQ ID NO: 534299 - RNA, 22 nt, Human
caguaaugggcaagacaauaug

SEQ ID NO: 534300 - RNA, 22 nt, Human
uuuuccaaaguaccaugucccu

SEQ ID NO: 534301 - RNA, 22 nt, Human
uaucuugagagacaacacagca

SEQ ID NO: 534302 - RNA, 22 nt, Human
cugcagcuguagaggacagugg

SEQ ID NO: 534303 - RNA, 22 nt, Human
auugcaaaugagucuuaauaua

SEQ ID NO: 534304 - RNA, 22 nt, Human
aucuaggauuugaaugcacagu

SEQ ID NO: 534305 - RNA, 22 nt, Human
gccuucaguagugucagcugua

SEQ ID NO: 534306 - RNA, 22 nt, Human
gcagagaguugggcugcgccag

SEQ ID NO: 534307 - RNA, 22 nt, Human
ggaggccaguccuggccgggcu

SEQ ID NO: 534308 - RNA, 22 nt, Human
cccuguccuggaugggagcacu

SEQ ID NO: 534309 - RNA, 22 nt, Human
auuauguaacugugguucagca

SEQ ID NO: 534310 - RNA, 22 nt, Human
ucccaggcuggcaggcagcagu

SEQ ID NO: 534311 - RNA, 22 nt, Human
cagcaucuguauccuaggcuga

SEQ ID NO: 534312 - RNA, 22 nt, Human
aagcauuugugaaauucagaug

SEQ ID NO: 534313 - RNA, 22 nt, Human
uacacauacaccaaugugguca

SEQ ID NO: 534314 - RNA, 20 nt, Human
ugcuuuuauaccuauaauga

SEQ ID NO: 534315 - RNA, 22 nt, Human
guggccugccgugugguauggg

SEQ ID NO: 534316 - RNA, 22 nt, Human
auguaaauuguacugacacacg

SEQ ID NO: 534317 - RNA, 22 nt, Human
uugaauaggacucagcagugau

SEQ ID NO: 534318 - RNA, 22 nt, Human
accaucagucacauguagagaa

SEQ ID NO: 534319 - RNA, 22 nt, Human
gcugccaauccagcugugggag

SEQ ID NO: 534320 - RNA, 18 nt, Human
gucacuguguuucugagc

SEQ ID NO: 534321 - RNA, 22 nt, Human
agcugcucucacuggacgccug

SEQ ID NO: 534322 - RNA, 22 nt, Human
ugcuuuuaggagauuaaaauua

SEQ ID NO: 534323 - RNA, 22 nt, Human
caguuugucuugauucagaaca

SEQ ID NO: 534324 - RNA, 22 nt, Human
ucagggacugcagagggaagcu

SEQ ID NO: 534325 - RNA, 22 nt, Human
uaagaaacaugauacuuuuccu

SEQ ID NO: 534326 - RNA, 22 nt, Human
cagacacagcaauucuguguug

SEQ ID NO: 534327 - RNA, 22 nt, Human
cugaagccacgauagcuuccua

SEQ ID NO: 534328 - RNA, 22 nt, Human
gcucaagggaugggagugggug

SEQ ID NO: 534329 - RNA, 22 nt, Human
ugccaggcccagcuccagagcu

SEQ ID NO: 534330 - RNA, 22 nt, Human
auaaggcacacauagauagggu

SEQ ID NO: 534331 - RNA, 22 nt, Human
ucagcauaucuugagcuucaug

SEQ ID NO: 534332 - RNA, 22 nt, Human
aguaauuuguuauaaagcaaua

SEQ ID NO: 534333 - RNA, 21 nt, Human
uauuucuuugacucucucccu

SEQ ID NO: 534334 - RNA, 22 nt, Human
guggucaggcagugggagagaa

SEQ ID NO: 534335 - RNA, 22 nt, Human
agcagggcuuugcagacuuggg

SEQ ID NO: 534336 - RNA, 22 nt, Human
aaugggaggauuuucucucuug

SEQ ID NO: 534337 - RNA, 22 nt, Human
uuuccacaauguuuuugcagga

SEQ ID NO: 534338 - RNA, 22 nt, Human
uugguccugggcacugauuaac

SEQ ID NO: 534339 - RNA, 22 nt, Human
uccaggcagcccuuccugacuc

SEQ ID NO: 534340 - RNA, 22 nt, Human
uuucacauguggaaugccaggu

SEQ ID NO: 534341 - RNA, 22 nt, Human
agaugguuaucuuuucuuugua

SEQ ID NO: 534342 - RNA, 22 nt, Human
acuuucaauuugcacuaaccua

SEQ ID NO: 534343 - RNA, 22 nt, Human
uggcccugcugggucagagcug

SEQ ID NO: 534344 - RNA, 22 nt, Human
gggcaguagcuucguaggcauc

SEQ ID NO: 534345 - RNA, 22 nt, Human
gcguaaggccucuggucucgga

SEQ ID NO: 534346 - RNA, 22 nt, Human
uggagcagccuuuucuaagcaa

SEQ ID NO: 534347 - RNA, 22 nt, Human
ugaaacuucuaauaugaauagu

SEQ ID NO: 534348 - RNA, 22 nt, Human
cccugcaggggaccugcagccu

SEQ ID NO: 534349 - RNA, 22 nt, Human
ggcaggagauaaaauauuaguu

SEQ ID NO: 534350 - RNA, 22 nt, Human
ccaggcucugagccucacucuu

SEQ ID NO: 534351 - RNA, 22 nt, Human
gcugggcucuuaucaccuguac

SEQ ID NO: 534352 - RNA, 22 nt, Human
uugcacuauaggaaaauguguc

SEQ ID NO: 534353 - RNA, 22 nt, Human
cuggccagcugacagcagggcu

SEQ ID NO: 534354 - RNA, 22 nt, Human
gccagcagggcccaaaugcugg

SEQ ID NO: 534355 - RNA, 22 nt, Human
ccuggcugggccugauuucuca

SEQ ID NO: 534356 - RNA, 22 nt, Human
ccugccagauccccugagcuga

SEQ ID NO: 534357 - RNA, 22 nt, Human
ucugccuuccccauaaucugau

SEQ ID NO: 534358 - RNA, 22 nt, Human
agucccagaugacccagcuacu

SEQ ID NO: 534359 - RNA, 22 nt, Human
ugcuucucccaaccagggccug

SEQ ID NO: 534360 - RNA, 22 nt, Human
ugaggcagguggauuacaaggu

SEQ ID NO: 534361 - RNA, 22 nt, Human
ccaggcugccgaggaaagaaag

SEQ ID NO: 534362 - RNA, 22 nt, Human
aggaagugaaagggaaggaguu

SEQ ID NO: 534363 - RNA, 20 nt, Human
aggcagacaaggagucuguu

SEQ ID NO: 534364 - RNA, 22 nt, Human
ucagaguguggugagaugugca

SEQ ID NO: 534365 - RNA, 22 nt, Human
ggagaaggaagaaagcuacuau

SEQ ID NO: 534366 - RNA, 22 nt, Human
agaggagcugggaggcccucgu

SEQ ID NO: 534367 - RNA, 22 nt, Human
cucgcaggacagugcuaggacu

SEQ ID NO: 534368 - RNA, 22 nt, Human
gugacucacacaggccugggcu

SEQ ID NO: 534369 - RNA, 22 nt, Human
cugccuuccaaccccagacucc

SEQ ID NO: 534370 - RNA, 22 nt, Human
gccucugcacuguggcacacca

SEQ ID NO: 534371 - RNA, 22 nt, Human
uauccuuguacuauaguauuua

SEQ ID NO: 534372 - RNA, 22 nt, Human
uguuccaucaguuuuugguuga

SEQ ID NO: 534373 - RNA, 20 nt, Human
uuauuucucauucuccuacu

SEQ ID NO: 534374 - RNA, 22 nt, Human
gaaauauuacaguggaggggau

SEQ ID NO: 534375 - RNA, 22 nt, Human
aguuacauauaagaagacagac

SEQ ID NO: 534376 - RNA, 22 nt, Human
gggggcuggaauauccaucaac

SEQ ID NO: 534377 - RNA, 22 nt, Human
ugcaggugcuccgggggugccc

SEQ ID NO: 534378 - RNA, 22 nt, Human
auuauucuuaugucaucauggc

SEQ ID NO: 534379 - RNA, 22 nt, Human
cuuucuuugcagugagccagag

SEQ ID NO: 534380 - RNA, 22 nt, Human
ucacuuaaaaauucuaguuaug

SEQ ID NO: 534381 - RNA, 22 nt, Human
agcuuguaacagacauaaaaau

SEQ ID NO: 534382 - RNA, 22 nt, Human
ucagguggagaccuccuuggcc

SEQ ID NO: 534383 - RNA, 22 nt, Human
auuguacaaugccuggaacauu

SEQ ID NO: 534384 - RNA, 22 nt, Human
uauauuuuagacacccucacgc

SEQ ID NO: 534385 - RNA, 22 nt, Human
auucagcaguuccugcuucagu

SEQ ID NO: 534386 - RNA, 22 nt, Human
ugccagucagugguuuaaaagu

SEQ ID NO: 534387 - RNA, 22 nt, Human
agggcugcaccggggcuucgcg

SEQ ID NO: 534388 - RNA, 22 nt, Human
ucaaagucauggcaggcucaga

SEQ ID NO: 534389 - RNA, 21 nt, Human
uucauaaaccauucucaugca

SEQ ID NO: 534390 - RNA, 22 nt, Human
aaugaguucugguucauuuuau

SEQ ID NO: 534391 - RNA, 22 nt, Human
acuguguggaccacucugaggc

SEQ ID NO: 534392 - RNA, 22 nt, Human
ucucuuaauuguaaugguuccu

SEQ ID NO: 534393 - RNA, 22 nt, Human
acagaauuaacauuugaugaau

SEQ ID NO: 534394 - RNA, 22 nt, Human
aagauucuguauuucuaacaau

SEQ ID NO: 534395 - RNA, 22 nt, Human
gaaaucugcccagugcacuggu

SEQ ID NO: 534396 - RNA, 21 nt, Human
uacauugacuacaaauaaagc

SEQ ID NO: 534397 - RNA, 22 nt, Human
cagcaggaccauugaggcauca

SEQ ID NO: 534398 - RNA, 22 nt, Human
gauauugcauauuggaugaguu

SEQ ID NO: 534399 - RNA, 22 nt, Human
cugggcugucccaaccccaucc

SEQ ID NO: 534400 - RNA, 22 nt, Human
cuguggggaagauagaaccgac

SEQ ID NO: 534401 - RNA, 22 nt, Human
aggcccagagagccaguuagug

SEQ ID NO: 534402 - RNA, 22 nt, Human
gacacagagggcaccagauaug

SEQ ID NO: 534403 - RNA, 22 nt, Human
gagccuggauagccuuguucca

SEQ ID NO: 534404 - RNA, 22 nt, Human
ugaaaucauugccaaguauuga

SEQ ID NO: 534405 - RNA, 22 nt, Human
uuugauuuucagcaauaguggc

SEQ ID NO: 534406 - RNA, 20 nt, Human
cucuccuugccgacuuggca

SEQ ID NO: 534407 - RNA, 22 nt, Human
gccugcugccacccuggcuccg

SEQ ID NO: 534408 - RNA, 22 nt, Human
gcuggucccaauguguuuccuu

SEQ ID NO: 534409 - RNA, 22 nt, Human
cucaggcuugggaggaggccca

SEQ ID NO: 534410 - RNA, 22 nt, Human
uguuacacagcagaauagcaag

SEQ ID NO: 534411 - RNA, 22 nt, Human
cgcagggccgcgagcgggacca

SEQ ID NO: 534412 - RNA, 22 nt, Human
aggcagccagauggcagccugc

SEQ ID NO: 534413 - RNA, 22 nt, Human
uggggucugaguaucugcauuu

SEQ ID NO: 534414 - RNA, 22 nt, Human
cuauuagguuggugcaaaagua

SEQ ID NO: 534415 - RNA, 22 nt, Human
guggagacuucuacuagagacc

SEQ ID NO: 534416 - RNA, 20 nt, Human
acugggccuaggggaggcau

SEQ ID NO: 534417 - RNA, 22 nt, Human
gcccauggcagaacugugagca

SEQ ID NO: 534418 - RNA, 22 nt, Human
cagcuguugaucucuuaagccu

SEQ ID NO: 534419 - RNA, 22 nt, Human
guggcaguucugugucucuugu

SEQ ID NO: 534420 - RNA, 22 nt, Human
auaaggcaagcugucaguuugu

SEQ ID NO: 534421 - RNA, 20 nt, Human
uucagcuaccagguaucuuc

SEQ ID NO: 534422 - RNA, 22 nt, Human
aaacaccaagagcuagcuauua

SEQ ID NO: 534423 - RNA, 22 nt, Human
aagcccagaugggagcauuuca

SEQ ID NO: 534424 - RNA, 22 nt, Human
ugggcuggcugaacuucaaccu

SEQ ID NO: 534425 - RNA, 22 nt, Human
uucuuaaaacuuauggacaggu

SEQ ID NO: 534426 - RNA, 22 nt, Human
aaaauuauggaguaucccaaag

SEQ ID NO: 534427 - RNA, 22 nt, Human
uuuucauuuuuguagaugcaag

SEQ ID NO: 534428 - RNA, 22 nt, Human
gccaggcagauaugugagcuua

SEQ ID NO: 534429 - RNA, 22 nt, Human
cagugaggaagcugucuggacc

SEQ ID NO: 534430 - RNA, 22 nt, Human
agugguucaguuuuggucuggc

SEQ ID NO: 534431 - RNA, 22 nt, Human
gugcucaggggcaauccuggga

SEQ ID NO: 534432 - RNA, 22 nt, Human
caggcuugauuauucagacaau

SEQ ID NO: 534433 - RNA, 22 nt, Human
cagcugggcuaagaguagaggc

SEQ ID NO: 534434 - RNA, 22 nt, Human
aauaggaagcaccaaauucucc

SEQ ID NO: 534435 - RNA, 22 nt, Human
uugcaagguuucucucugccua

SEQ ID NO: 534436 - RNA, 22 nt, Human
ugcagccaccaccucugcugaa

SEQ ID NO: 534437 - RNA, 22 nt, Human
gccucugcggagcuguacauca

SEQ ID NO: 534438 - RNA, 22 nt, Human
agggcuccaggggaccaucagu

SEQ ID NO: 534439 - RNA, 22 nt, Human
ggcugugggaugcauaggagcu

SEQ ID NO: 534440 - RNA, 22 nt, Human
agggucaagaggcagaguucuu

SEQ ID NO: 534441 - RNA, 22 nt, Human
ccacccagaccagggaucuggg

SEQ ID NO: 534442 - RNA, 21 nt, Human
ugggaugggucugggaccagc

SEQ ID NO: 534443 - RNA, 22 nt, Human
acaaggcugugggagaaccucu

SEQ ID NO: 534444 - RNA, 23 nt, Human
auacauacagucuuacugacuuu

SEQ ID NO: 534445 - RNA, 22 nt, Human
ugucauuuggugccaggaaaga

SEQ ID NO: 534446 - RNA, 22 nt, Human
guuucaaaaugaugcuguaacu

SEQ ID NO: 534447 - RNA, 22 nt, Human
cauggacucugguuuggggagc

SEQ ID NO: 534448 - RNA, 22 nt, Human
agacaaguucugugggucaccu

SEQ ID NO: 534449 - RNA, 22 nt, Human
ugggcacuggaagccugcugug

SEQ ID NO: 534450 - RNA, 22 nt, Human
ccagcuaguaagcaccugcauc

SEQ ID NO: 534451 - RNA, 20 nt, Human
aggcacuggauuucuuauau

SEQ ID NO: 534452 - RNA, 22 nt, Human
acauacauauguuuaaaugcau

SEQ ID NO: 534453 - RNA, 22 nt, Human
aacccgggaggcagagguugug

SEQ ID NO: 534454 - RNA, 22 nt, Human
cacaggguuguucugaggauuc

SEQ ID NO: 534455 - RNA, 20 nt, Human
uggagcuguaaucuugucug

SEQ ID NO: 534456 - RNA, 22 nt, Human
uuaaauuagucaagcuucucug

SEQ ID NO: 534457 - RNA, 22 nt, Human
ccuguucacugcacaguuuccg

SEQ ID NO: 534458 - RNA, 22 nt, Human
cuggaaagauuuacacggggaa

SEQ ID NO: 534459 - RNA, 19 nt, Human
ucugucacuggggguauuc

SEQ ID NO: 534460 - RNA, 22 nt, Human
ugaggugaagaguggagcucag

SEQ ID NO: 534461 - RNA, 22 nt, Human
ucuguaaagacuccaaaagcca

SEQ ID NO: 534462 - RNA, 22 nt, Human
uguggggcuuacaaaggcagau

SEQ ID NO: 534463 - RNA, 22 nt, Human
ugcaugcaacaauucuucuaua

SEQ ID NO: 534464 - RNA, 22 nt, Human
agcaggcugggcaauaugggca

SEQ ID NO: 534465 - RNA, 22 nt, Human
acagcuggaggucugugagcac

SEQ ID NO: 534466 - RNA, 23 nt, Human
aggaggccugaaacugaggcuga

SEQ ID NO: 534467 - RNA, 22 nt, Human
aauaaacugcucaauugcauca

SEQ ID NO: 534468 - RNA, 22 nt, Human
ucugucacccagagugcagugg

SEQ ID NO: 534469 - RNA, 21 nt, Human
uccugggaagcacuggggugg

SEQ ID NO: 534470 - RNA, 22 nt, Human
uuguaugagcuccaggaacuca

SEQ ID NO: 534471 - RNA, 22 nt, Human
ccaaggcaggggaucaaaguuu

SEQ ID NO: 534472 - RNA, 22 nt, Human
cugaaggauucaaaauggcagg

SEQ ID NO: 534473 - RNA, 22 nt, Human
cuggcagcuuccuuugcaucug

SEQ ID NO: 534474 - RNA, 22 nt, Human
uaaacuacccaugacaguuuca

SEQ ID NO: 534475 - RNA, 22 nt, Human
ucaagaauuuuuaaugugacug

SEQ ID NO: 534476 - RNA, 22 nt, Human
agguaccaaaagccuuuuucug

SEQ ID NO: 534477 - RNA, 22 nt, Human
ucagagaaguaagguggggugc

SEQ ID NO: 534478 - RNA, 22 nt, Human
ucagaaagcuauaugguguguc

SEQ ID NO: 534479 - RNA, 22 nt, Human
uaaaguuuauuugaacaucucu

SEQ ID NO: 534480 - RNA, 22 nt, Human
aacuaaaagugugucucuugua

SEQ ID NO: 534481 - RNA, 22 nt, Human
gcccagcagaucucagugucuc

SEQ ID NO: 534482 - RNA, 22 nt, Human
cuauuuguaaagugccuggugu

SEQ ID NO: 534483 - RNA, 22 nt, Human
gcugagagaaaagugagguucu

SEQ ID NO: 534484 - RNA, 20 nt, Human
agugcaagaaagcacagcug

SEQ ID NO: 534485 - RNA, 22 nt, Human
guuugaaaguucaacaggaaaa

SEQ ID NO: 534486 - RNA, 22 nt, Human
aaguauaagcuauucuucauga

SEQ ID NO: 534487 - RNA, 21 nt, Human
agaggcaggcauuaaguacac

SEQ ID NO: 534488 - RNA, 22 nt, Human
agcuuccuacaaccaucucaga

SEQ ID NO: 534489 - RNA, 22 nt, Human
agacacagaaguugcuguuggg

SEQ ID NO: 534490 - RNA, 22 nt, Human
ugggaagaugauaauucacagu

SEQ ID NO: 534491 - RNA, 22 nt, Human
ucugccugagggagcugaggaa

SEQ ID NO: 534492 - RNA, 22 nt, Human
guacauuucauuuaaaugaugu

SEQ ID NO: 534493 - RNA, 22 nt, Human
cuggugugauugagcccaggug

SEQ ID NO: 534494 - RNA, 22 nt, Human
acacauaucuaagauagaugac

SEQ ID NO: 534495 - RNA, 20 nt, Human
auucugcuuugaaaauaagg

SEQ ID NO: 534496 - RNA, 22 nt, Human
uagcagaggguagugccggggc

SEQ ID NO: 534497 - RNA, 22 nt, Human
uagauggcugguguucugagcu

SEQ ID NO: 534498 - RNA, 22 nt, Human
ggugcagugguguggcaaaggg

SEQ ID NO: 534499 - RNA, 22 nt, Human
cuggagcugcuguccuugggug

SEQ ID NO: 534500 - RNA, 22 nt, Human
agccuggauucgugcauccaca

SEQ ID NO: 534501 - RNA, 22 nt, Human
uuuccucugaugcugacuugga

SEQ ID NO: 534502 - RNA, 22 nt, Human
gauuucaaggaguuuucacagu

SEQ ID NO: 534503 - RNA, 22 nt, Human
cccugagcccauaguugacauu

SEQ ID NO: 534504 - RNA, 22 nt, Human
gaggccacccuaugggucccag

SEQ ID NO: 534505 - RNA, 22 nt, Human
aucagagauggcuccagugcuc

SEQ ID NO: 534506 - RNA, 22 nt, Human
ggaggccagggacccagucagc

SEQ ID NO: 534507 - RNA, 22 nt, Human
cccaggagauggagguugcagu

SEQ ID NO: 534508 - RNA, 22 nt, Human
ugggagaagcagcagccaagug

SEQ ID NO: 534509 - RNA, 22 nt, Human
caaggccaguccauuuuggaag

SEQ ID NO: 534510 - RNA, 22 nt, Human
cuggagccuucaccaggggaaa

SEQ ID NO: 534511 - RNA, 19 nt, Human
acauguuuugcagaacagc

SEQ ID NO: 534512 - RNA, 22 nt, Human
ugcaucuguucagagcugucga

SEQ ID NO: 534513 - RNA, 17 nt, Human
cuggagccaagagggcc

SEQ ID NO: 534514 - RNA, 22 nt, Human
uaacuaacuaguguucaaaaua

SEQ ID NO: 534515 - RNA, 22 nt, Human
gacauuuaugaaggagauaugc

SEQ ID NO: 534516 - RNA, 20 nt, Human
auauguguacguguauacau

SEQ ID NO: 534517 - RNA, 18 nt, Human
uggcucagauggcuuuaa

SEQ ID NO: 534518 - RNA, 22 nt, Human
acccaaaagucacucaggagca

SEQ ID NO: 534519 - RNA, 22 nt, Human
auuuuguuauaggagcugaaau

SEQ ID NO: 534520 - RNA, 22 nt, Human
caguagacacauuaauauggaa

SEQ ID NO: 534521 - RNA, 22 nt, Human
uugaaaguuaucuagauucuga

SEQ ID NO: 534522 - RNA, 22 nt, Human
uauuuauuggacaguguugcug

SEQ ID NO: 534523 - RNA, 22 nt, Human
aaaaaucacuuuuauaggcagc

SEQ ID NO: 534524 - RNA, 22 nt, Human
ccugggugaugugcugcccucg

SEQ ID NO: 534525 - RNA, 22 nt, Human
uuugacaaaggaaaaaugcaca

SEQ ID NO: 534526 - RNA, 22 nt, Human
ugucccaguuuaucugggacug

SEQ ID NO: 534527 - RNA, 22 nt, Human
cagaagccugccucagaugcac

SEQ ID NO: 534528 - RNA, 22 nt, Human
uucagcagguggugaguucugc

SEQ ID NO: 534529 - RNA, 22 nt, Human
acaaauuuggugagaguaaaua

SEQ ID NO: 534530 - RNA, 22 nt, Human
uccauuaacaccuguacguggc

SEQ ID NO: 534531 - RNA, 22 nt, Human
aaacaccagucccaguauacac

SEQ ID NO: 534532 - RNA, 22 nt, Human
ugcaccauacccauuccccucu

SEQ ID NO: 534533 - RNA, 22 nt, Human
aaagcaauugugguuuuuguca

SEQ ID NO: 534534 - RNA, 22 nt, Human
ugggcucugcugcguaccaguu

SEQ ID NO: 534535 - RNA, 22 nt, Human
aggggcugggacagagccaagc

SEQ ID NO: 534536 - RNA, 22 nt, Human
uaaggcacacaguugcugcaug

SEQ ID NO: 534537 - RNA, 22 nt, Human
cugggcacaaguggcccuggau

SEQ ID NO: 534538 - RNA, 22 nt, Human
gcagggaaguuugaucuuuuuc

SEQ ID NO: 534539 - RNA, 22 nt, Human
gcaaaaaaugcuuguugcuuag

SEQ ID NO: 534540 - RNA, 20 nt, Human
caggaggcaaggucaagguc

SEQ ID NO: 534541 - RNA, 17 nt, Human
ucauuucaguaaaucca

SEQ ID NO: 534542 - RNA, 22 nt, Human
uaucuuugcaaauaucucuaag

SEQ ID NO: 534543 - RNA, 21 nt, Human
agcugcagcccaaaggccugu

SEQ ID NO: 534544 - RNA, 22 nt, Human
augucuuuggcuuugacauggc

SEQ ID NO: 534545 - RNA, 22 nt, Human
agcccaagcauaggagggaggc

SEQ ID NO: 534546 - RNA, 22 nt, Human
uucuggagguuauuaggagucu

SEQ ID NO: 534547 - RNA, 22 nt, Human
ugaaauguuugaagaccacuga

SEQ ID NO: 534548 - RNA, 22 nt, Human
gggaaagaccuuccuggggugu

SEQ ID NO: 534549 - RNA, 22 nt, Human
aaguucuuggaggaugaagagu

SEQ ID NO: 534550 - RNA, 22 nt, Human
uuacacagacauggcaucauga

SEQ ID NO: 534551 - RNA, 22 nt, Human
auggccaguguuucccucaguu

SEQ ID NO: 534552 - RNA, 22 nt, Human
gugaauggggcaggaaggaugg

SEQ ID NO: 534553 - RNA, 22 nt, Human
ugccuuuuguaugcaggccaug

SEQ ID NO: 534554 - RNA, 22 nt, Human
uacacagaaauuguguagggau

SEQ ID NO: 534555 - RNA, 22 nt, Human
cagaggaggcgguauacacugc

SEQ ID NO: 534556 - RNA, 22 nt, Human
aacaguaaugugguguuggguu

SEQ ID NO: 534557 - RNA, 22 nt, Human
caguuuuagcuagagcaaacca

SEQ ID NO: 534558 - RNA, 19 nt, Human
cagucccaaauucuuguca

SEQ ID NO: 534559 - RNA, 22 nt, Human
uacacaauucuggaugcauguc

SEQ ID NO: 534560 - RNA, 22 nt, Human
uagcuugucagugaauagcugu

SEQ ID NO: 534561 - RNA, 22 nt, Human
gaggcauaaaucacaguguuca

SEQ ID NO: 534562 - RNA, 22 nt, Human
uguuuccaaagucuuuucuuaa

SEQ ID NO: 534563 - RNA, 22 nt, Human
aauaggaaaauauuuaacaaga

SEQ ID NO: 534564 - RNA, 19 nt, Human
aaaucagaaucugcauuuu

SEQ ID NO: 534565 - RNA, 19 nt, Human
cagagcugcuggccucguc

SEQ ID NO: 534566 - RNA, 22 nt, Human
caucagugaaagugaauguucu

SEQ ID NO: 534567 - RNA, 22 nt, Human
uuccaacucugaaaugugaaau

SEQ ID NO: 534568 - RNA, 22 nt, Human
gaggcuccccaugaggccccag

SEQ ID NO: 534569 - RNA, 22 nt, Human
cugcugagccuggugcgggaug

SEQ ID NO: 534570 - RNA, 22 nt, Human
aggacccugagcgggcaugccg

SEQ ID NO: 534571 - RNA, 19 nt, Human
gaggaggcuucagcuuucu

SEQ ID NO: 534572 - RNA, 20 nt, Human
agacaggagcccccauucag

SEQ ID NO: 534573 - RNA, 22 nt, Human
uuugacaguaauaaagcacaag

SEQ ID NO: 534574 - RNA, 23 nt, Human
cagguggcuccacgagggguggg

SEQ ID NO: 534575 - RNA, 22 nt, Human
cauuucuguacauguuuuggug

SEQ ID NO: 534576 - RNA, 22 nt, Human
uggggugugcucagagcagggg

SEQ ID NO: 534577 - RNA, 22 nt, Human
aaucuuaagcugaauucucucc

SEQ ID NO: 534578 - RNA, 22 nt, Human
augaaacugggauaacuauagc

SEQ ID NO: 534579 - RNA, 22 nt, Human
agucucuuccuucaaggcuggu

SEQ ID NO: 534580 - RNA, 22 nt, Human
aaaaugcaugagaaugugcucg

SEQ ID NO: 534581 - RNA, 22 nt, Human
agguaagggucacaguucauau

SEQ ID NO: 534582 - RNA, 22 nt, Human
cagcucagucuggagagaugca

SEQ ID NO: 534583 - RNA, 22 nt, Human
agccuauucaucugaucuugaa

SEQ ID NO: 534584 - RNA, 22 nt, Human
uggccuggcagagcaaggccug

SEQ ID NO: 534585 - RNA, 22 nt, Human
agggccagcacuccuggcagga

SEQ ID NO: 534586 - RNA, 22 nt, Human
uucaacauuuuugaguuuaggu

SEQ ID NO: 534587 - RNA, 22 nt, Human
ucuggcucuuugggugauugua

SEQ ID NO: 534588 - RNA, 22 nt, Human
ggcaggugugagaucgaggcca

SEQ ID NO: 534589 - RNA, 22 nt, Human
uggacagcgaaagugccuggga

SEQ ID NO: 534590 - RNA, 22 nt, Human
cucaggauguacuacagaaggc

SEQ ID NO: 534591 - RNA, 22 nt, Human
ugaggcagcaauugauuauuca

SEQ ID NO: 534592 - RNA, 22 nt, Human
agaagccacaggccucgucugg

SEQ ID NO: 534593 - RNA, 22 nt, Human
agccuauuccaggaugagcuca

SEQ ID NO: 534594 - RNA, 22 nt, Human
uacauuccauguguguguauuc

SEQ ID NO: 534595 - RNA, 22 nt, Human
augccacugacauggacaauuu

SEQ ID NO: 534596 - RNA, 22 nt, Human
uguuuuguuuaugagagcacag

SEQ ID NO: 534597 - RNA, 22 nt, Human
uuucugaauuuacucaagguca

SEQ ID NO: 534598 - RNA, 22 nt, Human
gcugccucuguagcuuuggacc

SEQ ID NO: 534599 - RNA, 22 nt, Human
gucugucucucuccagagugca

SEQ ID NO: 534600 - RNA, 21 nt, Human
acagacagggccagugucccc

SEQ ID NO: 534601 - RNA, 22 nt, Human
uuaaaaugcagauuaugacuca

SEQ ID NO: 534602 - RNA, 22 nt, Human
uaucaauacauguuaucagugu

SEQ ID NO: 534603 - RNA, 22 nt, Human
ugggagagcagagaacccucuu

SEQ ID NO: 534604 - RNA, 22 nt, Human
auauguccaccuguaugcuaaa

SEQ ID NO: 534605 - RNA, 22 nt, Human
uccuucaguucaauuaguccgu

SEQ ID NO: 534606 - RNA, 22 nt, Human
cuggcucacaggugagaugcau

SEQ ID NO: 534607 - RNA, 22 nt, Human
gcucccagacugaccagaggug

SEQ ID NO: 534608 - RNA, 21 nt, Human
aauuucagacccauuuugccu

SEQ ID NO: 534609 - RNA, 22 nt, Human
gcucaggcaggagugcaguggc

SEQ ID NO: 534610 - RNA, 22 nt, Human
auauucuuauccuuuucucugu

SEQ ID NO: 534611 - RNA, 22 nt, Human
aggcacacagaccccagcaagu

SEQ ID NO: 534612 - RNA, 22 nt, Human
aucuggguucaccaugcuccug

SEQ ID NO: 534613 - RNA, 22 nt, Human
gcugcuggagcuuugcagaagg

SEQ ID NO: 534614 - RNA, 22 nt, Human
agagccaggcaggcaauguuga

SEQ ID NO: 534615 - RNA, 22 nt, Human
uggcugcuuguuuuagugaggc

SEQ ID NO: 534616 - RNA, 22 nt, Human
ccugggcuggaguacagcagug

SEQ ID NO: 534617 - RNA, 22 nt, Human
ggcugccauaacagaguaccac

SEQ ID NO: 534618 - RNA, 21 nt, Human
gcuggcugucccagggaagca

SEQ ID NO: 534619 - RNA, 18 nt, Human
gugacagcugcuagcuca

SEQ ID NO: 534620 - RNA, 22 nt, Human
guauuuuacugcucaaagcucu

SEQ ID NO: 534621 - RNA, 22 nt, Human
agguggggaguauauguaauug

SEQ ID NO: 534622 - RNA, 22 nt, Human
ucuucaaugcauucucuuguuu

SEQ ID NO: 534623 - RNA, 20 nt, Human
cugccuggaggccucuaccu

SEQ ID NO: 534624 - RNA, 22 nt, Human
gcaaggagacuguagggccaag

SEQ ID NO: 534625 - RNA, 22 nt, Human
gaaaucacuuuuuucauaguug

SEQ ID NO: 534626 - RNA, 18 nt, Human
gcuucauggaaggguugu

SEQ ID NO: 534627 - RNA, 22 nt, Human
aagugaagaaauacaugagaau

SEQ ID NO: 534628 - RNA, 22 nt, Human
cuuauggccugcccacaguagu

SEQ ID NO: 534629 - RNA, 22 nt, Human
uggaggcauuuuagguugucac

SEQ ID NO: 534630 - RNA, 22 nt, Human
uugaagcaugguacuuguucaa

SEQ ID NO: 534631 - RNA, 22 nt, Human
uaacaguuuugaguuuugcuuc

SEQ ID NO: 534632 - RNA, 23 nt, Human
ccagugauugccuggaaggaggu

SEQ ID NO: 534633 - RNA, 18 nt, Human
cccugagaugaugcugug

SEQ ID NO: 534634 - RNA, 22 nt, Human
agucucuggacugggagauggc

SEQ ID NO: 534635 - RNA, 22 nt, Human
cagggccugcuuccuucuuguu

SEQ ID NO: 534636 - RNA, 22 nt, Human
auaugcauguacgugugcacaa

SEQ ID NO: 534637 - RNA, 22 nt, Human
aaaucagagugguuggucaucc

SEQ ID NO: 534638 - RNA, 22 nt, Human
agggcugacaguggcguggcgu

SEQ ID NO: 534639 - RNA, 22 nt, Human
acacucuuuuugugguugucua

SEQ ID NO: 534640 - RNA, 22 nt, Human
ugcagggcuaagucagagccug

SEQ ID NO: 534641 - RNA, 22 nt, Human
aggaggaggcuggaguacaccc

SEQ ID NO: 534642 - RNA, 22 nt, Human
ugccuucaaucaggauggucuc

SEQ ID NO: 534643 - RNA, 22 nt, Human
uuugaaaaaggccuuugguaug

SEQ ID NO: 534644 - RNA, 22 nt, Human
ucagggacagggugcugcugcg

SEQ ID NO: 534645 - RNA, 22 nt, Human
aguaucaaggaucuccagcacc

SEQ ID NO: 534646 - RNA, 22 nt, Human
gccagcagguugucaaggagcu

SEQ ID NO: 534647 - RNA, 22 nt, Human
agggauguaaauucuucuucuu

SEQ ID NO: 534648 - RNA, 19 nt, Human
uggcuccugccugccuucu

SEQ ID NO: 534649 - RNA, 22 nt, Human
cuguccucaacccauccuucuc

SEQ ID NO: 534650 - RNA, 17 nt, Human
ggcaggugacagacacc

SEQ ID NO: 534651 - RNA, 22 nt, Human
ugcugucuguuuacuggcuaua

SEQ ID NO: 534652 - RNA, 22 nt, Human
gagauuuuucaacaagaauagg

SEQ ID NO: 534653 - RNA, 22 nt, Human
aaguacauauauuuaugauucu

SEQ ID NO: 534654 - RNA, 22 nt, Human
uugcaccaaaugaguuaaaauu

SEQ ID NO: 534655 - RNA, 22 nt, Human
uuguguaacuugagcaaacaca

SEQ ID NO: 534656 - RNA, 22 nt, Human
auuauugccagcuauuacaaca

SEQ ID NO: 534657 - RNA, 22 nt, Human
cucaggccaauaagcuccagcc

SEQ ID NO: 534658 - RNA, 22 nt, Human
cugagccaaccacagcaggagc

SEQ ID NO: 534659 - RNA, 22 nt, Human
ggcagcaggcgacuucccuauu

SEQ ID NO: 534660 - RNA, 22 nt, Human
cugccuggccugaucuccacgc

SEQ ID NO: 534661 - RNA, 22 nt, Human
acauguuuacauuaggugauau

SEQ ID NO: 534662 - RNA, 22 nt, Human
uagggaccuuagaauuguaugu

SEQ ID NO: 534663 - RNA, 18 nt, Human
ucacuggguguauguggc

SEQ ID NO: 534664 - RNA, 22 nt, Human
gggcuucucuuaugcuaacugg

SEQ ID NO: 534665 - RNA, 22 nt, Human
cccuccagcucaaagcaaccgg

SEQ ID NO: 534666 - RNA, 22 nt, Human
uuauuuacaacucuucucuucc

SEQ ID NO: 534667 - RNA, 22 nt, Human
uaaagucauaagaguggauccg

SEQ ID NO: 534668 - RNA, 22 nt, Human
agagucauaguuuaacuuuugu

SEQ ID NO: 534669 - RNA, 21 nt, Human
ugggaccuagcuuugcacagg

SEQ ID NO: 534670 - RNA, 18 nt, Human
aggcagcagcaucuucuc

SEQ ID NO: 534671 - RNA, 22 nt, Human
ugguucauugagaagacugaag

SEQ ID NO: 534672 - RNA, 23 nt, Human
agcccagcagagaaccuaggucc

SEQ ID NO: 534673 - RNA, 22 nt, Human
ugauuucucuccguuauuucag

SEQ ID NO: 534674 - RNA, 22 nt, Human
auaauaaaccaggaugggucug

SEQ ID NO: 534675 - RNA, 22 nt, Human
gucccugggucuaaggcaguaa

SEQ ID NO: 534676 - RNA, 22 nt, Human
cuguuuuugugcugugucuccc

SEQ ID NO: 534677 - RNA, 22 nt, Human
gucuggagagcugagcagaguu

SEQ ID NO: 534678 - RNA, 22 nt, Human
cagagcuggagaaguggauuua

SEQ ID NO: 534679 - RNA, 22 nt, Human
uccugcagagucccacugauuu

SEQ ID NO: 534680 - RNA, 22 nt, Human
cuggcuggcagaugcucuugcu

SEQ ID NO: 534681 - RNA, 22 nt, Human
ggcagcaguggcugcuauuguc

SEQ ID NO: 534682 - RNA, 22 nt, Human
aaauauacggucccuaacaguc

SEQ ID NO: 534683 - RNA, 22 nt, Human
guuuacaacaucuuguccuuca

SEQ ID NO: 534684 - RNA, 22 nt, Human
uuguucuugccaagacaugaag

SEQ ID NO: 534685 - RNA, 22 nt, Human
ccugggcuuugcuggcaaggcc

SEQ ID NO: 534686 - RNA, 22 nt, Human
aggaugugaguggacacagucc

SEQ ID NO: 534687 - RNA, 22 nt, Human
ccagcuggagcucgcagauagg

SEQ ID NO: 534688 - RNA, 22 nt, Human
uuuucauugagcaccugaguaa

SEQ ID NO: 534689 - RNA, 22 nt, Human
caagauggaguccgggaaugug

SEQ ID NO: 534690 - RNA, 22 nt, Human
ggacuggccggcgcugaggccc

SEQ ID NO: 534691 - RNA, 22 nt, Human
ucccagccuuucuuuucugcug

SEQ ID NO: 534692 - RNA, 22 nt, Human
cucuggaguuagugaucugggc

SEQ ID NO: 534693 - RNA, 22 nt, Human
uaguaucuuucuauauuuccca

SEQ ID NO: 534694 - RNA, 22 nt, Human
augcaucuauucccaagggcag

SEQ ID NO: 534695 - RNA, 22 nt, Human
ccagcagaggggcggagugcag

SEQ ID NO: 534696 - RNA, 22 nt, Human
ucuggagucugagaucugagga

SEQ ID NO: 534697 - RNA, 22 nt, Human
aagugauucauugaugaugagg

SEQ ID NO: 534698 - RNA, 22 nt, Human
uugaccauaccuccaggcaguu

SEQ ID NO: 534699 - RNA, 22 nt, Human
gucaggaugacaagugcuuuca

SEQ ID NO: 534700 - RNA, 18 nt, Human
gccugccuagagcuugcc

SEQ ID NO: 534701 - RNA, 20 nt, Human
ggaagcuguggguccccagg

SEQ ID NO: 534702 - RNA, 22 nt, Human
cagaugagaguggccaggguuc

SEQ ID NO: 534703 - RNA, 21 nt, Human
ccuggcagaagccugauaugc

SEQ ID NO: 534704 - RNA, 22 nt, Human
gugggcaguggggucuucugcc

SEQ ID NO: 534705 - RNA, 22 nt, Human
ucauauuuaggccuuuaauuca

SEQ ID NO: 534706 - RNA, 22 nt, Human
uugcuuuguuuaaaagugguau

SEQ ID NO: 534707 - RNA, 21 nt, Human
agggucaggaaccaggguacc

SEQ ID NO: 534708 - RNA, 22 nt, Human
guuugcauguauuaagucaaua

SEQ ID NO: 534709 - RNA, 22 nt, Human
uaaacagaaagcagauguacuu

SEQ ID NO: 534710 - RNA, 22 nt, Human
gccaggccugcaagugcuggug

SEQ ID NO: 534711 - RNA, 20 nt, Human
cugugcuuuggaaccuggaa

SEQ ID NO: 534712 - RNA, 23 nt, Human
ccagcccuccaccagcucuaggc

SEQ ID NO: 534713 - RNA, 22 nt, Human
ccugggcuugguuguugagaac

SEQ ID NO: 534714 - RNA, 22 nt, Human
ggcauggcucggagucagaaca

SEQ ID NO: 534715 - RNA, 22 nt, Human
gauuuccuagacauggggcaga

SEQ ID NO: 534716 - RNA, 22 nt, Human
ccugagagcgaguggccucaug

SEQ ID NO: 534717 - RNA, 22 nt, Human
gcacagcccugagcgcaugucu

SEQ ID NO: 534718 - RNA, 21 nt, Human
agcugccuccacuucugaggc

SEQ ID NO: 534719 - RNA, 21 nt, Human
auuuucauuaauucagugugg

SEQ ID NO: 534720 - RNA, 22 nt, Human
aacagcaguggcaggagaaggc

SEQ ID NO: 534721 - RNA, 22 nt, Human
gcugggcucuuuaccccuguac

SEQ ID NO: 534722 - RNA, 22 nt, Human
cuggucagggcucuuugggagc

SEQ ID NO: 534723 - RNA, 22 nt, Human
uucuccccugacccugaugagg

SEQ ID NO: 534724 - RNA, 22 nt, Human
cucugagcuccuggaagcgugc

SEQ ID NO: 534725 - RNA, 22 nt, Human
auacuacacauugacuauauuu

SEQ ID NO: 534726 - RNA, 22 nt, Human
cuggcaggucucgcugacgugu

SEQ ID NO: 534727 - RNA, 22 nt, Human
agcugcucuuugaaggacacuu

SEQ ID NO: 534728 - RNA, 22 nt, Human
aggcagcagacuguuaaucaga

SEQ ID NO: 534729 - RNA, 22 nt, Human
ggaagagagggcugggccucaa

SEQ ID NO: 534730 - RNA, 22 nt, Human
ugcaggugugggcaggggagca

SEQ ID NO: 534731 - RNA, 22 nt, Human
uucaggauucugugucugacaa

SEQ ID NO: 534732 - RNA, 19 nt, Human
uaugucccuuucccccauu

SEQ ID NO: 534733 - RNA, 22 nt, Human
ggggaaagugaauuguguagug

SEQ ID NO: 534734 - RNA, 17 nt, Human
gcugcagcgguaggcag

SEQ ID NO: 534735 - RNA, 22 nt, Human
aagcauuugguucugaagacuc

SEQ ID NO: 534736 - RNA, 22 nt, Human
aagcauuuuguuuuaagaauga

SEQ ID NO: 534737 - RNA, 22 nt, Human
ccaggccuggaccaugccaggg

SEQ ID NO: 534738 - RNA, 22 nt, Human
aagagcugugggugguaguccu

SEQ ID NO: 534739 - RNA, 23 nt, Human
agaugagccaacaccuccaugcc

SEQ ID NO: 534740 - RNA, 20 nt, Human
auauagagucaaaauggcuu

SEQ ID NO: 534741 - RNA, 22 nt, Human
agcagagcuauucuugugcaau

SEQ ID NO: 534742 - RNA, 22 nt, Human
acagaauacuacagacugguua

SEQ ID NO: 534743 - RNA, 22 nt, Human
cuggggcagagcccagcaauuu

SEQ ID NO: 534744 - RNA, 22 nt, Human
aaacucuuccuuucuuuaaagu

SEQ ID NO: 534745 - RNA, 22 nt, Human
uuuggaaagacacacaguuuua

SEQ ID NO: 534746 - RNA, 22 nt, Human
auuuucagaacauucauucacu

SEQ ID NO: 534747 - RNA, 22 nt, Human
ggcacugagcgggcucugagcg

SEQ ID NO: 534748 - RNA, 22 nt, Human
gcauuuagcuuuaaaauauuuc

SEQ ID NO: 534749 - RNA, 22 nt, Human
uguccugugaccuggcaccaca

SEQ ID NO: 534750 - RNA, 22 nt, Human
auuccaguccaaauguuuuccu

SEQ ID NO: 534751 - RNA, 22 nt, Human
auucuagaaggcaaagcaaggg

SEQ ID NO: 534752 - RNA, 22 nt, Human
caggaggcccaaagggcgcaga

SEQ ID NO: 534753 - RNA, 18 nt, Human
cuuucagauggauaugcu

SEQ ID NO: 534754 - RNA, 22 nt, Human
ccuguaacuccuuggcucaagu

SEQ ID NO: 534755 - RNA, 22 nt, Human
guuacauuaaaaacauucacug

SEQ ID NO: 534756 - RNA, 22 nt, Human
auuucucaaguaaaugagucau

SEQ ID NO: 534757 - RNA, 17 nt, Human
cccugcacccuacucuc

SEQ ID NO: 534758 - RNA, 22 nt, Human
uaaacuacugggcaaggacagg

SEQ ID NO: 534759 - RNA, 22 nt, Human
gccugguguccagaggcgagug

SEQ ID NO: 534760 - RNA, 22 nt, Human
ucagcugaaguggagaagcaga

SEQ ID NO: 534761 - RNA, 22 nt, Human
aaucacaucacugagaaugagg

SEQ ID NO: 534762 - RNA, 22 nt, Human
uaaauguguguagccaucugug

SEQ ID NO: 534763 - RNA, 22 nt, Human
cagugaaguguggacgucacca

SEQ ID NO: 534764 - RNA, 22 nt, Human
uguuucuuacguuuuuagaggc

SEQ ID NO: 534765 - RNA, 22 nt, Human
uguggggcugugguguucuucu

SEQ ID NO: 534766 - RNA, 22 nt, Human
gagcugucuggggacucugggu

SEQ ID NO: 534767 - RNA, 22 nt, Human
guuaaugugauauaaaguauuu

SEQ ID NO: 534768 - RNA, 22 nt, Human
caguagccacuagacacaugua

SEQ ID NO: 534769 - RNA, 22 nt, Human
ccaucuccaaauaccaucacau

SEQ ID NO: 534770 - RNA, 22 nt, Human
uccaguccuagaaacuggagag

SEQ ID NO: 534771 - RNA, 22 nt, Human
gcccucucggcauagcaggggc

SEQ ID NO: 534772 - RNA, 22 nt, Human
cagagagcuuagugugcugcau

SEQ ID NO: 534773 - RNA, 22 nt, Human
gagcuggaagucuguggucaga

SEQ ID NO: 534774 - RNA, 22 nt, Human
gcuggccucgcaggcaggaugu

SEQ ID NO: 534775 - RNA, 22 nt, Human
auagcauauaaguuauaaaacu

SEQ ID NO: 534776 - RNA, 22 nt, Human
ggccuugggcagacacgucaca

SEQ ID NO: 534777 - RNA, 22 nt, Human
agauguuucaguaauuuaucuu

SEQ ID NO: 534778 - RNA, 22 nt, Human
aauguuuuauagcucaagcaau

SEQ ID NO: 534779 - RNA, 18 nt, Human
ucaugagguagaggcugg

SEQ ID NO: 534780 - RNA, 22 nt, Human
aaaugcacucugcuucugugac

SEQ ID NO: 534781 - RNA, 22 nt, Human
uuuauuagugcuuguaucacug

SEQ ID NO: 534782 - RNA, 22 nt, Human
uuaauuuucucaucugugaaau

SEQ ID NO: 534783 - RNA, 22 nt, Human
uaaaugcaguacaaauuguucu

SEQ ID NO: 534784 - RNA, 22 nt, Human
agagugguggccguggugucac

SEQ ID NO: 534785 - RNA, 22 nt, Human
ucagcuuugccaccagcuguaa

SEQ ID NO: 534786 - RNA, 20 nt, Human
ugcuuugauggaaauacagc

SEQ ID NO: 534787 - RNA, 23 nt, Human
gaagccacacaaaggucgccaag

SEQ ID NO: 534788 - RNA, 22 nt, Human
cccacacucugagaaaugcuga

SEQ ID NO: 534789 - RNA, 22 nt, Human
ggucaucuugaauuuccauucu

SEQ ID NO: 534790 - RNA, 22 nt, Human
auggcuaauacgccacuggaca

SEQ ID NO: 534791 - RNA, 22 nt, Human
uaaggcacgcauaagagggggc

SEQ ID NO: 534792 - RNA, 22 nt, Human
uccucugccccagaugaaauuu

SEQ ID NO: 534793 - RNA, 22 nt, Human
uggcacagagggacccagcagc

SEQ ID NO: 534794 - RNA, 22 nt, Human
aacuaaaacugguuuguucucu

SEQ ID NO: 534795 - RNA, 23 nt, Human
ggcugagacuacaggcgcuugcc

SEQ ID NO: 534796 - RNA, 19 nt, Human
aacuagaaagguuuugaga

SEQ ID NO: 534797 - RNA, 22 nt, Human
uucaguuucagucuugcaaaaa

SEQ ID NO: 534798 - RNA, 22 nt, Human
aggucuggaggcggagucagga

SEQ ID NO: 534799 - RNA, 22 nt, Human
cagcccugagaaggaggaucuc

SEQ ID NO: 534800 - RNA, 22 nt, Human
gaaauuuauuaucuacaucauu

SEQ ID NO: 534801 - RNA, 22 nt, Human
gcuaaugugauagagcagaaag

SEQ ID NO: 534802 - RNA, 22 nt, Human
agccaauacacugaagaucuaa

SEQ ID NO: 534803 - RNA, 18 nt, Human
uggcagcaggaagccauu

SEQ ID NO: 534804 - RNA, 19 nt, Human
ucacaagagagauaaagug

SEQ ID NO: 534805 - RNA, 22 nt, Human
aaggcacacaguuagauagagc

SEQ ID NO: 534806 - RNA, 21 nt, Human
uugcacagaaaaccauagaga

SEQ ID NO: 534807 - RNA, 21 nt, Human
cucugcugucuaccagcuguu

SEQ ID NO: 534808 - RNA, 22 nt, Human
uagacacaucuucauccacaau

SEQ ID NO: 534809 - RNA, 19 nt, Human
ucccuggcgccucucgggc

SEQ ID NO: 534810 - RNA, 22 nt, Human
cagucccaucucccagguggcu

SEQ ID NO: 534811 - RNA, 22 nt, Human
ucacauuuggagaaagccugcc

SEQ ID NO: 534812 - RNA, 22 nt, Human
uauuuacuuuuaaauugagaac

SEQ ID NO: 534813 - RNA, 22 nt, Human
acucuucagggcagugagcggg

SEQ ID NO: 534814 - RNA, 22 nt, Human
uugaagcaggaaaauuucuauu

SEQ ID NO: 534815 - RNA, 22 nt, Human
uaacaaaguauuguuuguguau

SEQ ID NO: 534816 - RNA, 22 nt, Human
acuucaguuucccucaacaaga

SEQ ID NO: 534817 - RNA, 22 nt, Human
uauaaaacagaaagcacuaccu

SEQ ID NO: 534818 - RNA, 23 nt, Human
uugcuucugugcaauucaguacu

SEQ ID NO: 534819 - RNA, 22 nt, Human
uuucacagauccuacagcuugu

SEQ ID NO: 534820 - RNA, 22 nt, Human
uuuccauauuuggucuuuggga

SEQ ID NO: 534821 - RNA, 22 nt, Human
cugccuguuccugaucauucua

SEQ ID NO: 534822 - RNA, 22 nt, Human
uacaggaggauuaucaaaggau

SEQ ID NO: 534823 - RNA, 22 nt, Human
auucacagggacaaugggagag

SEQ ID NO: 534824 - RNA, 22 nt, Human
augcaguacagauaauucuaca

SEQ ID NO: 534825 - RNA, 22 nt, Human
ccuggagcaaaaaucuaaggag

SEQ ID NO: 534826 - RNA, 22 nt, Human
ccaucccuucucuggccagcag

SEQ ID NO: 534827 - RNA, 22 nt, Human
ucccaggaucugagggcagaga

SEQ ID NO: 534828 - RNA, 22 nt, Human
uuucuggaacaguaauugaaga

SEQ ID NO: 534829 - RNA, 22 nt, Human
cccagcuucugagggggccuug

SEQ ID NO: 534830 - RNA, 22 nt, Human
cccagcagaccgcugugauggc

SEQ ID NO: 534831 - RNA, 22 nt, Human
uagaaagacaugggccagcagc

SEQ ID NO: 534832 - RNA, 22 nt, Human
uuguaugaggauagcaagaagc

SEQ ID NO: 534833 - RNA, 22 nt, Human
aguguuuuuacaagcacucugg

SEQ ID NO: 534834 - RNA, 22 nt, Human
ggaaaguggugguggaaagagg

SEQ ID NO: 534835 - RNA, 22 nt, Human
gcagcuggugcaaaugucacuc

SEQ ID NO: 534836 - RNA, 22 nt, Human
caaguuuggauuaugaaaaagu

SEQ ID NO: 534837 - RNA, 18 nt, Human
ugggauggagaguaacug

SEQ ID NO: 534838 - RNA, 22 nt, Human
ggcugugcgggcagccguggga

SEQ ID NO: 534839 - RNA, 22 nt, Human
ucaggaagcucuugcugauucu

SEQ ID NO: 534840 - RNA, 22 nt, Human
gguuuccugcauugggaaauuu

SEQ ID NO: 534841 - RNA, 22 nt, Human
caggugcucccagagaagugcu

SEQ ID NO: 534842 - RNA, 17 nt, Human
aagacagaagccaugag

SEQ ID NO: 534843 - RNA, 22 nt, Human
cccaggaaguggagguugcagu

SEQ ID NO: 534844 - RNA, 22 nt, Human
ucugcagcuugcacaggcaggc

SEQ ID NO: 534845 - RNA, 22 nt, Human
gcagauggcagcccaggcuggg

SEQ ID NO: 534846 - RNA, 22 nt, Human
ugaggcaggaguucaggcugcg

SEQ ID NO: 534847 - RNA, 22 nt, Human
uccuggcuucugucuccuuauu

SEQ ID NO: 534848 - RNA, 22 nt, Human
agaguccauaugugggaggagu

SEQ ID NO: 534849 - RNA, 22 nt, Human
ccccagcugcauacuugccaag

SEQ ID NO: 534850 - RNA, 22 nt, Human
ccugugaugguguuacacuguu

SEQ ID NO: 534851 - RNA, 22 nt, Human
uuccucaucugugcaccucacu

SEQ ID NO: 534852 - RNA, 22 nt, Human
uaaaguguuguacaaauguaug

SEQ ID NO: 534853 - RNA, 22 nt, Human
uaguauuuauaaucaugcuuaa

SEQ ID NO: 534854 - RNA, 22 nt, Human
ugaaggugaaugucuaugggga

SEQ ID NO: 534855 - RNA, 22 nt, Human
cagcugauuugagaaagaauga

SEQ ID NO: 534856 - RNA, 22 nt, Human
ccuccagcugccucagucucuu

SEQ ID NO: 534857 - RNA, 22 nt, Human
cuguauuuaguuaaaaugcuaa

SEQ ID NO: 534858 - RNA, 22 nt, Human
ucuaaacaguuucacucuuaau

SEQ ID NO: 534859 - RNA, 22 nt, Human
ggggcacuuccaggcugaggcu

SEQ ID NO: 534860 - RNA, 20 nt, Human
cuguuaaaagguaugaauuc

SEQ ID NO: 534861 - RNA, 23 nt, Human
gcugggcuuacucuuucagugag

SEQ ID NO: 534862 - RNA, 22 nt, Human
aaggagaauuuggcuugugaug

SEQ ID NO: 534863 - RNA, 22 nt, Human
ucaagugagcguagcugaaugg

SEQ ID NO: 534864 - RNA, 22 nt, Human
gggacaggcugagacuugagcu

SEQ ID NO: 534865 - RNA, 22 nt, Human
uucaaaguaccguacuuaaugg

SEQ ID NO: 534866 - RNA, 22 nt, Human
uacagcaugaucacaauggaaa

SEQ ID NO: 534867 - RNA, 22 nt, Human
ggagauaguccaggugaaggga

SEQ ID NO: 534868 - RNA, 22 nt, Human
acaacaaaaucacuagucuucc

SEQ ID NO: 534869 - RNA, 22 nt, Human
cucagcuacuugggaagcuuag

SEQ ID NO: 534870 - RNA, 22 nt, Human
gacaaaacugagaucacacugu

SEQ ID NO: 534871 - RNA, 22 nt, Human
gucagaggggcagcugccaggc

SEQ ID NO: 534872 - RNA, 22 nt, Human
agacacauaggaccacacugug

SEQ ID NO: 534873 - RNA, 22 nt, Human
ugugcagcuaguccuggacuug

SEQ ID NO: 534874 - RNA, 22 nt, Human
uccugagagcagaguccaggug

SEQ ID NO: 534875 - RNA, 22 nt, Human
ucaugucaguuucuucuauaaa

SEQ ID NO: 534876 - RNA, 22 nt, Human
guaggcagucucucaggugauc

SEQ ID NO: 534877 - RNA, 22 nt, Human
gggaagugaaguguagcugucu

SEQ ID NO: 534878 - RNA, 22 nt, Human
uuugucuuaaaucuuguuacug

SEQ ID NO: 534879 - RNA, 22 nt, Human
aagagagagugcgcucacagaa

SEQ ID NO: 534880 - RNA, 22 nt, Human
ugaaggcccuaucuccauauac

SEQ ID NO: 534881 - RNA, 22 nt, Human
ucccagauucuucugugugggc

SEQ ID NO: 534882 - RNA, 22 nt, Human
cuggggcuggugaggcaggcuc

SEQ ID NO: 534883 - RNA, 22 nt, Human
cucccagagagcaggugggccg

SEQ ID NO: 534884 - RNA, 22 nt, Human
caggaguccagagugucauuuu

SEQ ID NO: 534885 - RNA, 18 nt, Human
uaaauauauuucccccuu

SEQ ID NO: 534886 - RNA, 22 nt, Human
cuggccugagaaugcuacccuu

SEQ ID NO: 534887 - RNA, 22 nt, Human
accucugcaguagggcugugcc

SEQ ID NO: 534888 - RNA, 22 nt, Human
ucagagugaggcgucaacauga

SEQ ID NO: 534889 - RNA, 22 nt, Human
ugucugagugugccugggcauu

SEQ ID NO: 534890 - RNA, 22 nt, Human
cccaggaaaagcagugccagca

SEQ ID NO: 534891 - RNA, 21 nt, Human
agaguaauuccugcuggaaag

SEQ ID NO: 534892 - RNA, 22 nt, Human
cuucuguguagaaagguagccc

SEQ ID NO: 534893 - RNA, 22 nt, Human
aguggaugguauugggaccagg

SEQ ID NO: 534894 - RNA, 22 nt, Human
aguccccucuaacccaacuuua

SEQ ID NO: 534895 - RNA, 22 nt, Human
gcugugaguggaguucugugcu

SEQ ID NO: 534896 - RNA, 22 nt, Human
ugggcuccagcaccugugcucu

SEQ ID NO: 534897 - RNA, 22 nt, Human
aaggaagaagacucuuuacucc

SEQ ID NO: 534898 - RNA, 22 nt, Human
aaguacuaaggcuauuaugaug

SEQ ID NO: 534899 - RNA, 22 nt, Human
acauacaugggauuaaaaaauu

SEQ ID NO: 534900 - RNA, 22 nt, Human
aggcucagcugguggugaucgc

SEQ ID NO: 534901 - RNA, 22 nt, Human
aggacuucuccgauaagucaga

SEQ ID NO: 534902 - RNA, 22 nt, Human
gcugugcaguaguagguacagu

SEQ ID NO: 534903 - RNA, 22 nt, Human
uagaaagcuugggguguuuaaa

SEQ ID NO: 534904 - RNA, 22 nt, Human
aaauguaccuugauaguuuggu

SEQ ID NO: 534905 - RNA, 22 nt, Human
cagugccacaggaauggccaau

SEQ ID NO: 534906 - RNA, 22 nt, Human
agaggcacuaagggaagagcag

SEQ ID NO: 534907 - RNA, 22 nt, Human
uggcucugugcuucuaguaucu

SEQ ID NO: 534908 - RNA, 22 nt, Human
ccugccaggccagugagcuucc

SEQ ID NO: 534909 - RNA, 22 nt, Human
aauuucagaugucauaaauaua

SEQ ID NO: 534910 - RNA, 22 nt, Human
ucucaggaagugauauugagac

SEQ ID NO: 534911 - RNA, 22 nt, Human
acagauggaauguguuauggga

SEQ ID NO: 534912 - RNA, 22 nt, Human
aauacuugucagaugaauaaga

SEQ ID NO: 534913 - RNA, 22 nt, Human
gugauuuucuccuccuagaagu

SEQ ID NO: 534914 - RNA, 22 nt, Human
ugugagacacacugcugcuuca

SEQ ID NO: 534915 - RNA, 20 nt, Human
ucuguucaaaucuuaguucc

SEQ ID NO: 534916 - RNA, 22 nt, Human
auggacaggaacucccuuggca

SEQ ID NO: 534917 - RNA, 22 nt, Human
ucuuugcuccacacucuagaga

SEQ ID NO: 534918 - RNA, 22 nt, Human
ugagcagagucgcuccagagug

SEQ ID NO: 534919 - RNA, 22 nt, Human
uucuacaucacuuaacaugcua

SEQ ID NO: 534920 - RNA, 22 nt, Human
acugcccuggagacagcagagu

SEQ ID NO: 534921 - RNA, 22 nt, Human
aucaguuucuaccauguggaau

SEQ ID NO: 534922 - RNA, 22 nt, Human
acuuuuaucaaggaagugaucu

SEQ ID NO: 534923 - RNA, 22 nt, Human
ucucaggaauagaguggcagca

SEQ ID NO: 534924 - RNA, 22 nt, Human
cuucacagcaugagcuuuggag

SEQ ID NO: 534925 - RNA, 22 nt, Human
ggccagaaaguuaagcuguggc

SEQ ID NO: 534926 - RNA, 23 nt, Human
agagcuuagggaauucacaugag

SEQ ID NO: 534927 - RNA, 22 nt, Human
gagcuuccacucuagaaggagu

SEQ ID NO: 534928 - RNA, 22 nt, Human
acaauuucaccuuuugguucaa

SEQ ID NO: 534929 - RNA, 22 nt, Human
ggcugagcuuuucaugaugguu

SEQ ID NO: 534930 - RNA, 22 nt, Human
agauacauauagaaaacaucaa

SEQ ID NO: 534931 - RNA, 22 nt, Human
cauuucaaacaguuacagcugc

SEQ ID NO: 534932 - RNA, 22 nt, Human
auuucuacaguacacaugcauu

SEQ ID NO: 534933 - RNA, 22 nt, Human
ucugagugagggugugagauau

SEQ ID NO: 534934 - RNA, 22 nt, Human
uggccagcagaguucacucucu

SEQ ID NO: 534935 - RNA, 22 nt, Human
uuccuuguuuguagcucuggga

SEQ ID NO: 534936 - RNA, 22 nt, Human
agguggggaaaccagcgauccc

SEQ ID NO: 534937 - RNA, 22 nt, Human
ugucuucaguaaaauacacuau

SEQ ID NO: 534938 - RNA, 22 nt, Human
aagagcuggcccaaucugagca

SEQ ID NO: 534939 - RNA, 22 nt, Human
uccagccuaggggaacagcugc

SEQ ID NO: 534940 - RNA, 22 nt, Human
agcauauacaaacucauauaca

SEQ ID NO: 534941 - RNA, 22 nt, Human
cagcaggcguugggagaaagac

SEQ ID NO: 534942 - RNA, 22 nt, Human
aggcugugaguuuugucucaga

SEQ ID NO: 534943 - RNA, 22 nt, Human
uugcagagagguuaggaacuca

SEQ ID NO: 534944 - RNA, 22 nt, Human
gccuggaagugugucgugggaa

SEQ ID NO: 534945 - RNA, 22 nt, Human
auguaauaggguaacauaacau

SEQ ID NO: 534946 - RNA, 22 nt, Human
aucuuuagacaggaagcaauca

SEQ ID NO: 534947 - RNA, 22 nt, Human
guguuuggucagacguccgggg

SEQ ID NO: 534948 - RNA, 22 nt, Human
uccugggguccugacugcuucc

SEQ ID NO: 534949 - RNA, 22 nt, Human
uggcccuguggaggucagugag

SEQ ID NO: 534950 - RNA, 22 nt, Human
gccugucaauuuuguguacaau

SEQ ID NO: 534951 - RNA, 22 nt, Human
aauuaguaaccuaauuccaucu

SEQ ID NO: 534952 - RNA, 22 nt, Human
augcugaagaguucaugauuau

SEQ ID NO: 534953 - RNA, 19 nt, Human
uggcuucuguuuucauguu

SEQ ID NO: 534954 - RNA, 19 nt, Human
aagaacuaugugauuacag

SEQ ID NO: 534955 - RNA, 22 nt, Human
aagcagcacaguaauauuggug

SEQ ID NO: 534956 - RNA, 22 nt, Human
aagauuuagggccaguuuacau

SEQ ID NO: 534957 - RNA, 19 nt, Human
agcuguggggccuagcacc

SEQ ID NO: 534958 - RNA, 22 nt, Human
ggagcacuauaauagagauuuu

SEQ ID NO: 534959 - RNA, 20 nt, Human
ccucugccccggggcugcua

SEQ ID NO: 534960 - RNA, 22 nt, Human
aggcugagugcuccccuagaug

SEQ ID NO: 534961 - RNA, 15 nt, Human
uccaggcauucauuc

SEQ ID NO: 534962 - RNA, 21 nt, Human
gagcugcaccuugaccuguuu

SEQ ID NO: 534963 - RNA, 18 nt, Human
ugaauuaguuugugguuu

SEQ ID NO: 534964 - RNA, 18 nt, Human
ugucauugccagggaagc

SEQ ID NO: 534965 - RNA, 22 nt, Human
cuauuuguaagagccccacacc

SEQ ID NO: 534966 - RNA, 22 nt, Human
ccuccugguccagcaucucuuu

SEQ ID NO: 534967 - RNA, 23 nt, Human
cccagaccuugugcugcccuugg

SEQ ID NO: 534968 - RNA, 22 nt, Human
cugcaggcaucuaacugugggc

SEQ ID NO: 534969 - RNA, 22 nt, Human
cauaacauguacauauaaaugc

SEQ ID NO: 534970 - RNA, 22 nt, Human
ucuuugauggagagauagauau

SEQ ID NO: 534971 - RNA, 22 nt, Human
uccauucuaugcuuacauuuau

SEQ ID NO: 534972 - RNA, 22 nt, Human
uuauucuucuucucuugccagg

SEQ ID NO: 534973 - RNA, 22 nt, Human
cacauaauugaacgugaugagu

SEQ ID NO: 534974 - RNA, 22 nt, Human
aggcacaguggcucacaccugu

SEQ ID NO: 534975 - RNA, 22 nt, Human
cugucccaggagcuguaagaca

SEQ ID NO: 534976 - RNA, 22 nt, Human
guuagaaagugucugcuugggu

SEQ ID NO: 534977 - RNA, 22 nt, Human
cuggaaagugucuccauccugg

SEQ ID NO: 534978 - RNA, 22 nt, Human
cuguccucaccuuggcaggggg

SEQ ID NO: 534979 - RNA, 22 nt, Human
ucugccugugcuguguuuucau

SEQ ID NO: 534980 - RNA, 22 nt, Human
cuggccacaugugugcugagca

SEQ ID NO: 534981 - RNA, 22 nt, Human
ccuggcugucguuuugugaaau

SEQ ID NO: 534982 - RNA, 16 nt, Human
ugggaccuguggccaa

SEQ ID NO: 534983 - RNA, 22 nt, Human
cuuccagguccuucuugagaag

SEQ ID NO: 534984 - RNA, 23 nt, Human
ggcucugugcugggccugcagga

SEQ ID NO: 534985 - RNA, 22 nt, Human
ugggcucuccuggaggacaaca

SEQ ID NO: 534986 - RNA, 22 nt, Human
cagccagcuggugcggcagagc

SEQ ID NO: 534987 - RNA, 22 nt, Human
ucuuguccuaagagcuggauuc

SEQ ID NO: 534988 - RNA, 22 nt, Human
ucauugcagcuucagguguuca

SEQ ID NO: 534989 - RNA, 22 nt, Human
guguaaggugaaaucaacaaau

SEQ ID NO: 534990 - RNA, 18 nt, Human
ugcuuacaggaguuccug

SEQ ID NO: 534991 - RNA, 22 nt, Human
cuggcuccacucccugccugac

SEQ ID NO: 534992 - RNA, 22 nt, Human
uaguucuguguagcucaagagu

SEQ ID NO: 534993 - RNA, 22 nt, Human
uuccagaaggaagccggggagc

SEQ ID NO: 534994 - RNA, 22 nt, Human
ucaggugggcguuccggugcgg

SEQ ID NO: 534995 - RNA, 22 nt, Human
aacaaccaaaaagaugaaugua

SEQ ID NO: 534996 - RNA, 20 nt, Human
agugacagagacuguguggc

SEQ ID NO: 534997 - RNA, 22 nt, Human
gucacuguauccagguuccagc

SEQ ID NO: 534998 - RNA, 22 nt, Human
agccuggauccauguggcuacc

SEQ ID NO: 534999 - RNA, 22 nt, Human
aauaugcagcaugaugaaguaa

SEQ ID NO: 535000 - RNA, 22 nt, Human
uguacagagacuaccauuaaua

SEQ ID NO: 535001 - RNA, 22 nt, Human
uucagucagugacuaagcaguu

SEQ ID NO: 535002 - RNA, 22 nt, Human
aggggcaguuccaaguuuugug

SEQ ID NO: 535003 - RNA, 22 nt, Human
ugcagaguaaaagcagaugcua

SEQ ID NO: 535004 - RNA, 22 nt, Human
uccaggcauguugggaagauga

SEQ ID NO: 535005 - RNA, 22 nt, Human
cugcuuuaauguaagauauacc

SEQ ID NO: 535006 - RNA, 22 nt, Human
cugaaggaagcagguggccugu

SEQ ID NO: 535007 - RNA, 22 nt, Human
cuccaggcucguccaagaucga

SEQ ID NO: 535008 - RNA, 22 nt, Human
uacccaggggcugagcagaggu

SEQ ID NO: 535009 - RNA, 22 nt, Human
ccagcucugcauguuucccuug

SEQ ID NO: 535010 - RNA, 22 nt, Human
aaaugacaauaaaaguccaugc

SEQ ID NO: 535011 - RNA, 22 nt, Human
acugcuauuuuauaacagaaga

SEQ ID NO: 535012 - RNA, 20 nt, Human
uccaggcagacagcuauggg

SEQ ID NO: 535013 - RNA, 22 nt, Human
ugcagaugagagggaguuuuua

SEQ ID NO: 535014 - RNA, 22 nt, Human
uccuuccugcaggccaaguccu

SEQ ID NO: 535015 - RNA, 22 nt, Human
ugcaauaaggaguaauaguaaa

SEQ ID NO: 535016 - RNA, 22 nt, Human
cauuuguagcuauuuacuguau

SEQ ID NO: 535017 - RNA, 22 nt, Human
agcuggccuguuagagcugagu

SEQ ID NO: 535018 - RNA, 22 nt, Human
ugaggcagguaagcaaguuuug

SEQ ID NO: 535019 - RNA, 22 nt, Human
gaggaaccuaugauuuagagca

SEQ ID NO: 535020 - RNA, 22 nt, Human
ccucuggguaucuguggaagua

SEQ ID NO: 535021 - RNA, 22 nt, Human
uccugccuucauacugcuguau

SEQ ID NO: 535022 - RNA, 22 nt, Human
guccucagagugggcagguccu

SEQ ID NO: 535023 - RNA, 22 nt, Human
aaggcacucagccuugggacag

SEQ ID NO: 535024 - RNA, 22 nt, Human
aaaguggucaccuucucauuuc

SEQ ID NO: 535025 - RNA, 22 nt, Human
cagagccugcucacgucucugu

SEQ ID NO: 535026 - RNA, 22 nt, Human
caggggcuguuugccucaggcc

SEQ ID NO: 535027 - RNA, 22 nt, Human
acccaggagccgugagagguua

SEQ ID NO: 535028 - RNA, 22 nt, Human
caguacuuugaagauauuuuag

SEQ ID NO: 535029 - RNA, 22 nt, Human
agcaggugaauuccuggaugug

SEQ ID NO: 535030 - RNA, 22 nt, Human
acagcuuuugaaaaauuacugg

SEQ ID NO: 535031 - RNA, 22 nt, Human
ugagagucucagaccuccuggu

SEQ ID NO: 535032 - RNA, 22 nt, Human
cccaggcagaauuaguguuuca

SEQ ID NO: 535033 - RNA, 22 nt, Human
aaaaccugauugaauucuauuu

SEQ ID NO: 535034 - RNA, 22 nt, Human
ggugaggaaagauggugacagu

SEQ ID NO: 535035 - RNA, 22 nt, Human
cagaaagaccugggcucaagag

SEQ ID NO: 535036 - RNA, 22 nt, Human
acagcagcacuauugacauuuu

SEQ ID NO: 535037 - RNA, 22 nt, Human
uggaggugagugugguacagca

SEQ ID NO: 535038 - RNA, 22 nt, Human
acagaaagauaggcacaagguc

SEQ ID NO: 535039 - RNA, 22 nt, Human
cucuuaaaaacuugauauauuu

SEQ ID NO: 535040 - RNA, 22 nt, Human
ucuguaaacaccauguuagagu

SEQ ID NO: 535041 - RNA, 22 nt, Human
uuacuguuugaaaaaugaaugu

SEQ ID NO: 535042 - RNA, 22 nt, Human
cuggccagccugucgaugcccu

SEQ ID NO: 535043 - RNA, 22 nt, Human
ccucagagguguggcaucucug

SEQ ID NO: 535044 - RNA, 22 nt, Human
guucacaguuucuaaucccagc

SEQ ID NO: 535045 - RNA, 22 nt, Human
uucucagauccaucagaagucc

SEQ ID NO: 535046 - RNA, 22 nt, Human
acaggggcuccgaaggugaggg

SEQ ID NO: 535047 - RNA, 21 nt, Human
aaauacugggcagugacuuga

SEQ ID NO: 535048 - RNA, 20 nt, Human
gccuggaggcaaugggaaga

SEQ ID NO: 535049 - RNA, 22 nt, Human
uuacauacuuacuagaucuaug

SEQ ID NO: 535050 - RNA, 20 nt, Human
aggguggggacguucugacu

SEQ ID NO: 535051 - RNA, 22 nt, Human
auucauuugcuauuguguaugg

SEQ ID NO: 535052 - RNA, 22 nt, Human
aguggcaguggcugggcagagc

SEQ ID NO: 535053 - RNA, 22 nt, Human
acauuucugcaucucagagcua

SEQ ID NO: 535054 - RNA, 22 nt, Human
gcugcuggcacuggagugagcc

SEQ ID NO: 535055 - RNA, 22 nt, Human
uugaagcagagaaauacuugaa

SEQ ID NO: 535056 - RNA, 21 nt, Human
gcacagcaugaguguuggcau

SEQ ID NO: 535057 - RNA, 22 nt, Human
aauguuugugcauaaauauguu

SEQ ID NO: 535058 - RNA, 22 nt, Human
acugagagggaggcuguccggu

SEQ ID NO: 535059 - RNA, 17 nt, Human
agaaagaggauccacag

SEQ ID NO: 535060 - RNA, 22 nt, Human
ucugaggcccugcaggcagugu

SEQ ID NO: 535061 - RNA, 22 nt, Human
guuaauguuaucugaagacagu

SEQ ID NO: 535062 - RNA, 22 nt, Human
guccugucccccaaggcugugg

SEQ ID NO: 535063 - RNA, 22 nt, Human
uggcucugucacugugagcuau

SEQ ID NO: 535064 - RNA, 22 nt, Human
aacauugccaugguuaauuuua

SEQ ID NO: 535065 - RNA, 22 nt, Human
ucccaggccauaaaacucagag

SEQ ID NO: 535066 - RNA, 22 nt, Human
ucugaaauauugguaauacuuu

SEQ ID NO: 535067 - RNA, 22 nt, Human
cagucuuuguucccauuacuga

SEQ ID NO: 535068 - RNA, 22 nt, Human
acauguuuaaguuuguuauaug

SEQ ID NO: 535069 - RNA, 22 nt, Human
gaaggaaaucugugauuuaugc

SEQ ID NO: 535070 - RNA, 22 nt, Human
gggcaagcacagcgagcgugcg

SEQ ID NO: 535071 - RNA, 22 nt, Human
gggcugugcugaguaggaggug

SEQ ID NO: 535072 - RNA, 22 nt, Human
gugccucagcaccgccugcagc

SEQ ID NO: 535073 - RNA, 22 nt, Human
gcugagagaucaaggcaggauu

SEQ ID NO: 535074 - RNA, 22 nt, Human
uauuuguauuucaugcaguaaa

SEQ ID NO: 535075 - RNA, 17 nt, Human
gaaagguccuagaaauc

SEQ ID NO: 535076 - RNA, 22 nt, Human
gucacacuagggccaaguggag

SEQ ID NO: 535077 - RNA, 22 nt, Human
ucauuuguggaagugauugugg

SEQ ID NO: 535078 - RNA, 22 nt, Human
ucaggcuaacccuaggcagaag

SEQ ID NO: 535079 - RNA, 22 nt, Human
ugugaccucaucuuaacuggaa

SEQ ID NO: 535080 - RNA, 22 nt, Human
ggcagcuuuuaucccugacaga

SEQ ID NO: 535081 - RNA, 22 nt, Human
gcuuucuucauacucaagcauc

SEQ ID NO: 535082 - RNA, 22 nt, Human
caucccugcccucaugccuaua

SEQ ID NO: 535083 - RNA, 21 nt, Human
gggagcuggaaacugggugac

SEQ ID NO: 535084 - RNA, 22 nt, Human
agugggggcagagccucucucg

SEQ ID NO: 535085 - RNA, 22 nt, Human
auuauauugaguauaaccagag

SEQ ID NO: 535086 - RNA, 22 nt, Human
acuuuuuacaggguguauacca

SEQ ID NO: 535087 - RNA, 22 nt, Human
gcuuugcauuguuuaaucagga

SEQ ID NO: 535088 - RNA, 22 nt, Human
cacagcuuaugccacugauugg

SEQ ID NO: 535089 - RNA, 22 nt, Human
uggcagaguucgcuccuauuca

SEQ ID NO: 535090 - RNA, 22 nt, Human
cagcauuuucuuaauguaggug

SEQ ID NO: 535091 - RNA, 22 nt, Human
uuuacaauugguuuucucuaau

SEQ ID NO: 535092 - RNA, 22 nt, Human
uuauaacaacaguuuacuuuaa

SEQ ID NO: 535093 - RNA, 22 nt, Human
ggugaguugggguucacagguc

SEQ ID NO: 535094 - RNA, 22 nt, Human
acagagcucccagccaucuccu

SEQ ID NO: 535095 - RNA, 22 nt, Human
uggugggggaggcugucuagca

SEQ ID NO: 535096 - RNA, 22 nt, Human
uuugcauuccugccugcauuca

SEQ ID NO: 535097 - RNA, 21 nt, Human
guucaaauggguagauucaca

SEQ ID NO: 535098 - RNA, 21 nt, Human
uuucuuucuggcucucacagu

SEQ ID NO: 535099 - RNA, 22 nt, Human
caguguuugcuuaaguuauaug

SEQ ID NO: 535100 - RNA, 22 nt, Human
uauauuaacuugugauccugga

SEQ ID NO: 535101 - RNA, 22 nt, Human
ucuguucauacagaguauagua

SEQ ID NO: 535102 - RNA, 22 nt, Human
caguaaaagauggaaauagaau

SEQ ID NO: 535103 - RNA, 19 nt, Human
agagacugccaccagcugu

SEQ ID NO: 535104 - RNA, 22 nt, Human
aaccucaggcucucuggacaau

SEQ ID NO: 535105 - RNA, 22 nt, Human
uguuaacagccagauuugguga

SEQ ID NO: 535106 - RNA, 22 nt, Human
augcagaaucuugagaaaaauu

SEQ ID NO: 535107 - RNA, 22 nt, Human
cccagcugcaccucuauggccu

SEQ ID NO: 535108 - RNA, 22 nt, Human
ugugauuuauugaaaagagcuu

SEQ ID NO: 535109 - RNA, 22 nt, Human
aggcaggccccugagaauagac

SEQ ID NO: 535110 - RNA, 22 nt, Human
agagcagcuggggcagagacca

SEQ ID NO: 535111 - RNA, 20 nt, Human
gacaucauguacacauugcc

SEQ ID NO: 535112 - RNA, 22 nt, Human
aauaaaauggucaguuuucuca

SEQ ID NO: 535113 - RNA, 22 nt, Human
uuccauauguauauagcuguua

SEQ ID NO: 535114 - RNA, 22 nt, Human
cuguuuaucuaggaguugcagg

SEQ ID NO: 535115 - RNA, 20 nt, Human
auacaagaugaguaauuucu

SEQ ID NO: 535116 - RNA, 23 nt, Human
aagcuuccuucacgucuccuggg

SEQ ID NO: 535117 - RNA, 22 nt, Human
cagcuguuccuggaaggagacc

SEQ ID NO: 535118 - RNA, 22 nt, Human
gacauucacaguuuccgauggu

SEQ ID NO: 535119 - RNA, 22 nt, Human
uacauacacaaaugcugaaugg

SEQ ID NO: 535120 - RNA, 22 nt, Human
ucuggaaguuagaggaggaaag

SEQ ID NO: 535121 - RNA, 22 nt, Human
ugugggcuuuggagucaggaag

SEQ ID NO: 535122 - RNA, 22 nt, Human
cauggccucucuccuggaaugg

SEQ ID NO: 535123 - RNA, 22 nt, Human
agaggccagggacacugcucaa

SEQ ID NO: 535124 - RNA, 18 nt, Human
ucugccugcagggcaucu

SEQ ID NO: 535125 - RNA, 22 nt, Human
uguauuuccugguuuagaucaa

SEQ ID NO: 535126 - RNA, 22 nt, Human
gccugcuggacauuggccggcc

SEQ ID NO: 535127 - RNA, 22 nt, Human
aaaauagccucacauaauugcu

SEQ ID NO: 535128 - RNA, 22 nt, Human
aaagucauguaaugauaugauu

SEQ ID NO: 535129 - RNA, 22 nt, Human
agaaaaggcuugaagagguuuu

SEQ ID NO: 535130 - RNA, 21 nt, Human
ugcaggaaagugcugcgaccc

SEQ ID NO: 535131 - RNA, 22 nt, Human
ugacagauuuugauggcuaaua

SEQ ID NO: 535132 - RNA, 22 nt, Human
guguaugauuucaaauggcuag

SEQ ID NO: 535133 - RNA, 22 nt, Human
cuccaagucggcugcagcugga

SEQ ID NO: 535134 - RNA, 22 nt, Human
ggagagaauucagcuuaagauu

SEQ ID NO: 535135 - RNA, 22 nt, Human
ccuguucaaguugcagggcugg

SEQ ID NO: 535136 - RNA, 22 nt, Human
ccuggccaggcauggagucaca

SEQ ID NO: 535137 - RNA, 22 nt, Human
cugcuggguuugccuuucacca

SEQ ID NO: 535138 - RNA, 22 nt, Human
caacauuucaaggucuuuagga

SEQ ID NO: 535139 - RNA, 22 nt, Human
uggagaagcuguagguggacuc

SEQ ID NO: 535140 - RNA, 22 nt, Human
aaugcugcaagaggugaaaaga

SEQ ID NO: 535141 - RNA, 22 nt, Human
ggagcaguggucauucagcugg

SEQ ID NO: 535142 - RNA, 22 nt, Human
uguacagaaauuccuacuacau

SEQ ID NO: 535143 - RNA, 22 nt, Human
ugagggugugcggcccagacag

SEQ ID NO: 535144 - RNA, 22 nt, Human
ccagcaccuugaucuuggaguu

SEQ ID NO: 535145 - RNA, 20 nt, Human
cuuuuucuccagcucugagc

SEQ ID NO: 535146 - RNA, 22 nt, Human
cagucauuccuaaccaagaaca

SEQ ID NO: 535147 - RNA, 22 nt, Human
ucucccuagggccgcuggcuaa

SEQ ID NO: 535148 - RNA, 22 nt, Human
acugggaauggagccugggccu

SEQ ID NO: 535149 - RNA, 19 nt, Human
gcagcugugggaagagcca

SEQ ID NO: 535150 - RNA, 22 nt, Human
ugcacacauacaugggaagugc

SEQ ID NO: 535151 - RNA, 22 nt, Human
auuaaagcuauccagucaugaa

SEQ ID NO: 535152 - RNA, 22 nt, Human
uuugcaauuugugcugcaaaug

SEQ ID NO: 535153 - RNA, 22 nt, Human
ucccagauuguugauggcuuaa

SEQ ID NO: 535154 - RNA, 22 nt, Human
ucuguucacugagcaauggcaa

SEQ ID NO: 535155 - RNA, 22 nt, Human
ugaaaucuuuaguuucuguccc

SEQ ID NO: 535156 - RNA, 22 nt, Human
cucugugggggagaggcagcug

SEQ ID NO: 535157 - RNA, 22 nt, Human
ugaccaaagaguugcuuguauu

SEQ ID NO: 535158 - RNA, 22 nt, Human
uugugcaauccccucauuuuau

SEQ ID NO: 535159 - RNA, 22 nt, Human
cugcugugcacccaggaaggcu

SEQ ID NO: 535160 - RNA, 22 nt, Human
acacagggcggaaagcaugaga

SEQ ID NO: 535161 - RNA, 22 nt, Human
aucaguuucugugaagaacaca

SEQ ID NO: 535162 - RNA, 22 nt, Human
cucagggcuugaguguccagga

SEQ ID NO: 535163 - RNA, 22 nt, Human
cauaagaaauaaugaugaugac

SEQ ID NO: 535164 - RNA, 22 nt, Human
caaauacuguacugaacacugu

SEQ ID NO: 535165 - RNA, 22 nt, Human
guuaaagaagaauaguuccuuu

SEQ ID NO: 535166 - RNA, 22 nt, Human
ccagcagcgauagggugagugc

SEQ ID NO: 535167 - RNA, 22 nt, Human
guguucauggaugucaauuuga

SEQ ID NO: 535168 - RNA, 21 nt, Human
uuugaaagcuacaucuauagc

SEQ ID NO: 535169 - RNA, 22 nt, Human
uccagcagaccaucaaggcuca

SEQ ID NO: 535170 - RNA, 22 nt, Human
cucagcagugacaagagaguau

SEQ ID NO: 535171 - RNA, 18 nt, Human
guuaauuuugaaguucau

SEQ ID NO: 535172 - RNA, 22 nt, Human
cacuauuucagugauucugcag

SEQ ID NO: 535173 - RNA, 22 nt, Human
gugcugcagagucucgugccgc

SEQ ID NO: 535174 - RNA, 22 nt, Human
cucugcuuggaacuggacagaa

SEQ ID NO: 535175 - RNA, 22 nt, Human
uggcucuggcgugaagcccaga

SEQ ID NO: 535176 - RNA, 22 nt, Human
agcaaacagugugcuaagaaau

SEQ ID NO: 535177 - RNA, 22 nt, Human
aggccuagaggaauggccaggg

SEQ ID NO: 535178 - RNA, 22 nt, Human
gccugcuggcuguccauugcag

SEQ ID NO: 535179 - RNA, 20 nt, Human
cuguccccgaggucaccagg

SEQ ID NO: 535180 - RNA, 22 nt, Human
guuugcuaauuuaaagcuauuu

SEQ ID NO: 535181 - RNA, 22 nt, Human
cagcauggggcuuggagucagc

SEQ ID NO: 535182 - RNA, 22 nt, Human
guccucuggccuuucccaggac

SEQ ID NO: 535183 - RNA, 22 nt, Human
aaaaguacuauuuuaacaaagu

SEQ ID NO: 535184 - RNA, 23 nt, Human
gguccaggaaaggcagcagcacc

SEQ ID NO: 535185 - RNA, 22 nt, Human
cagggugggcacccagccucca

SEQ ID NO: 535186 - RNA, 22 nt, Human
augaugugugcugaucaagcuu

SEQ ID NO: 535187 - RNA, 22 nt, Human
augaagcugguuuuggcuuggg

SEQ ID NO: 535188 - RNA, 22 nt, Human
uccaggcccugggaugggagca

SEQ ID NO: 535189 - RNA, 22 nt, Human
cucacugcccugaaguuggguu

SEQ ID NO: 535190 - RNA, 19 nt, Human
cacaucagcagggcugugg

SEQ ID NO: 535191 - RNA, 22 nt, Human
gccucuccucuuaauaccauua

SEQ ID NO: 535192 - RNA, 22 nt, Human
acaggaaagagcuaggcauagg

SEQ ID NO: 535193 - RNA, 22 nt, Human
aggcuuuaaguggccuacagcu

SEQ ID NO: 535194 - RNA, 22 nt, Human
augguuuguguggcccagauga

SEQ ID NO: 535195 - RNA, 22 nt, Human
uacuugugugucaugugcagag

SEQ ID NO: 535196 - RNA, 19 nt, Human
uccugggcugggccagguc

SEQ ID NO: 535197 - RNA, 22 nt, Human
accagaaaggaugccuccuucc

SEQ ID NO: 535198 - RNA, 22 nt, Human
aggagucagauaugggaaaguu

SEQ ID NO: 535199 - RNA, 19 nt, Human
agaguugggcacuguuuca

SEQ ID NO: 535200 - RNA, 22 nt, Human
ggagccaggggaccuucacaga

SEQ ID NO: 535201 - RNA, 22 nt, Human
cuuucccuuagccccauucuau

SEQ ID NO: 535202 - RNA, 22 nt, Human
uagaaacugauagucuugugcu

SEQ ID NO: 535203 - RNA, 22 nt, Human
ccuggccuuaagggcagggagc

SEQ ID NO: 535204 - RNA, 22 nt, Human
ugcuugucuucaggaaugcuga

SEQ ID NO: 535205 - RNA, 22 nt, Human
agaguggggacagggccugucc

SEQ ID NO: 535206 - RNA, 23 nt, Human
cuccucguaacucuguggugggu

SEQ ID NO: 535207 - RNA, 22 nt, Human
agcaaucaccaccucuauauuu

SEQ ID NO: 535208 - RNA, 22 nt, Human
ucugaagugaucaucauuucuc

SEQ ID NO: 535209 - RNA, 22 nt, Human
ccaggcagagggaauagcaagu

SEQ ID NO: 535210 - RNA, 22 nt, Human
uggcagagaacacacaugauuc

SEQ ID NO: 535211 - RNA, 22 nt, Human
ccugucugcggaggaguggaag

SEQ ID NO: 535212 - RNA, 22 nt, Human
uuugaaguaccugguucugacu

SEQ ID NO: 535213 - RNA, 22 nt, Human
cagggcagaaggcacucuacuc

SEQ ID NO: 535214 - RNA, 22 nt, Human
caauuucuggaacuaauucuga

SEQ ID NO: 535215 - RNA, 22 nt, Human
cauagauuuuagguuagaucga

SEQ ID NO: 535216 - RNA, 22 nt, Human
uuauuuguaaggcagggccagu

SEQ ID NO: 535217 - RNA, 22 nt, Human
gugugccaggaacuggcugcug

SEQ ID NO: 535218 - RNA, 22 nt, Human
cagcagaguaggugcuacuucu

SEQ ID NO: 535219 - RNA, 22 nt, Human
cagcuguugugcugggcaguua

SEQ ID NO: 535220 - RNA, 22 nt, Human
agcagggcuggggcacgagcca

SEQ ID NO: 535221 - RNA, 22 nt, Human
uguguacacaaugauugcagag

SEQ ID NO: 535222 - RNA, 22 nt, Human
caagcagagaagucucuaggcu

SEQ ID NO: 535223 - RNA, 22 nt, Human
uguucauuuggcccuuuuguau

SEQ ID NO: 535224 - RNA, 22 nt, Human
aaggccagccugagagcuaaca

SEQ ID NO: 535225 - RNA, 22 nt, Human
gaaaagagaacaucugaggauc

SEQ ID NO: 535226 - RNA, 22 nt, Human
auuugucuuugagugcccugcu

SEQ ID NO: 535227 - RNA, 22 nt, Human
ucagggcauacucuucaagguc

SEQ ID NO: 535228 - RNA, 22 nt, Human
uggcaggaggaugaggcggcua

SEQ ID NO: 535229 - RNA, 22 nt, Human
aaugaagccagguagaagagaa

SEQ ID NO: 535230 - RNA, 22 nt, Human
caaauaguaugagcaaugauuc

SEQ ID NO: 535231 - RNA, 22 nt, Human
uguuugacaacaggcucacaga

SEQ ID NO: 535232 - RNA, 22 nt, Human
auucuccacacauccagaccuu

SEQ ID NO: 535233 - RNA, 22 nt, Human
gaugguuuggaaugaaguagcu

SEQ ID NO: 535234 - RNA, 22 nt, Human
auggcaagcaagcugaagagau

SEQ ID NO: 535235 - RNA, 22 nt, Human
agauaacuaaagaaagggauua

SEQ ID NO: 535236 - RNA, 22 nt, Human
auucauuuagagggauuaagca

SEQ ID NO: 535237 - RNA, 22 nt, Human
uguaugaaaaggaauagauuga

SEQ ID NO: 535238 - RNA, 22 nt, Human
ccagguguggggaggacucaca

SEQ ID NO: 535239 - RNA, 22 nt, Human
agucauaauuauaaacaucagu

SEQ ID NO: 535240 - RNA, 22 nt, Human
uuuguaacaucccaacaaauuu

SEQ ID NO: 535241 - RNA, 20 nt, Human
uuaagaaaagcacauccugc

SEQ ID NO: 535242 - RNA, 22 nt, Human
cugggccucauccucagaguuu

SEQ ID NO: 535243 - RNA, 22 nt, Human
caggccuugaaggccugcggga

SEQ ID NO: 535244 - RNA, 22 nt, Human
ucauaaguaauuuaaacauucc

SEQ ID NO: 535245 - RNA, 22 nt, Human
gcagaugccugaaggagcuggg

SEQ ID NO: 535246 - RNA, 22 nt, Human
aaaggcauguggucaaggcuca

SEQ ID NO: 535247 - RNA, 22 nt, Human
ugggguggauagaaagugaugu

SEQ ID NO: 535248 - RNA, 22 nt, Human
aaggggauagagcagacacucc

SEQ ID NO: 535249 - RNA, 22 nt, Human
cauugacaucaggcuuggccaa

SEQ ID NO: 535250 - RNA, 22 nt, Human
cuuucacacacauacauuugga

SEQ ID NO: 535251 - RNA, 22 nt, Human
cacauuuaagcagauguggacc

SEQ ID NO: 535252 - RNA, 22 nt, Human
ugccugucuuggaguccuggcc

SEQ ID NO: 535253 - RNA, 22 nt, Human
agaagaaagauugaagguuccu

SEQ ID NO: 535254 - RNA, 22 nt, Human
ugggaggcuuccagaccuugcu

SEQ ID NO: 535255 - RNA, 22 nt, Human
aagcugccacacggugaguacu

SEQ ID NO: 535256 - RNA, 22 nt, Human
aaagccacguggccuggggagc

SEQ ID NO: 535257 - RNA, 22 nt, Human
ugugaaagauacuaggcagagg

SEQ ID NO: 535258 - RNA, 22 nt, Human
gcugccugcacagagcugcuuu

SEQ ID NO: 535259 - RNA, 22 nt, Human
ucaaaguuuuugagaauuacau

SEQ ID NO: 535260 - RNA, 22 nt, Human
cucugcaggggaggcaugcacu

SEQ ID NO: 535261 - RNA, 21 nt, Human
accuccuggcauccuguuccc

SEQ ID NO: 535262 - RNA, 22 nt, Human
aaaguguuuucugauguguucu

SEQ ID NO: 535263 - RNA, 22 nt, Human
uggaauuaucugaagugauuug

SEQ ID NO: 535264 - RNA, 22 nt, Human
ugcccagcagggagcuaccugg

SEQ ID NO: 535265 - RNA, 22 nt, Human
agcaaagcuaucucuauggaga

SEQ ID NO: 535266 - RNA, 22 nt, Human
acacacucaauugcauaagcac

SEQ ID NO: 535267 - RNA, 22 nt, Human
guucaaauucuaugaaauaugu

SEQ ID NO: 535268 - RNA, 22 nt, Human
ccugaggggcugcaggccagcu

SEQ ID NO: 535269 - RNA, 20 nt, Human
cagcagaaauggggugggaa

SEQ ID NO: 535270 - RNA, 22 nt, Human
aguauuuccuggcuuaucugcu

SEQ ID NO: 535271 - RNA, 22 nt, Human
aggaggugcguggugauccccu

SEQ ID NO: 535272 - RNA, 22 nt, Human
gcaggaugaaggcagaggcuga

SEQ ID NO: 535273 - RNA, 22 nt, Human
aucuguaaaugcaaauguagcu

SEQ ID NO: 535274 - RNA, 22 nt, Human
uggcucuggccaccgggagggc

SEQ ID NO: 535275 - RNA, 22 nt, Human
ugaaacagucuccagacuugga

SEQ ID NO: 535276 - RNA, 22 nt, Human
ggcuggcuuucucuccgcaccu

SEQ ID NO: 535277 - RNA, 22 nt, Human
uacaaagcuguauagccugguc

SEQ ID NO: 535278 - RNA, 22 nt, Human
ccagggugagugucauggguua

SEQ ID NO: 535279 - RNA, 22 nt, Human
ugcccagggauaagccuagaga

SEQ ID NO: 535280 - RNA, 22 nt, Human
aucaggaagccagucuaaugga

SEQ ID NO: 535281 - RNA, 22 nt, Human
ggcccuguuagagcucccacaa

SEQ ID NO: 535282 - RNA, 23 nt, Human
ugaugggaaggaacgacuaccac

SEQ ID NO: 535283 - RNA, 22 nt, Human
ucucagagauucagggagaagu

SEQ ID NO: 535284 - RNA, 22 nt, Human
cagcuggguggcucuucugcuc

SEQ ID NO: 535285 - RNA, 22 nt, Human
aucaaaauggaagaauuuggcu

SEQ ID NO: 535286 - RNA, 22 nt, Human
auauuuguuagagucuaugugu

SEQ ID NO: 535287 - RNA, 22 nt, Human
ccuccuuuccuguuuuccugag

SEQ ID NO: 535288 - RNA, 22 nt, Human
cugugcuugcggguguggagcc

SEQ ID NO: 535289 - RNA, 18 nt, Human
ucagagguacagaaaagu

SEQ ID NO: 535290 - RNA, 22 nt, Human
ggagaagccacacauugggugu

SEQ ID NO: 535291 - RNA, 22 nt, Human
ccuuuguucacuggagagugga

SEQ ID NO: 535292 - RNA, 22 nt, Human
agcucugacugaagagaugcaa

SEQ ID NO: 535293 - RNA, 18 nt, Human
uaagaagguggcuccagc

SEQ ID NO: 535294 - RNA, 22 nt, Human
gcagugaagccagaucugaaau

SEQ ID NO: 535295 - RNA, 22 nt, Human
ugagccagucugucugggugaa

SEQ ID NO: 535296 - RNA, 22 nt, Human
gagguagccacagauagagacu

SEQ ID NO: 535297 - RNA, 22 nt, Human
caaagcucaugcucuuagccau

SEQ ID NO: 535298 - RNA, 22 nt, Human
gguguugggagagcugguuuug

SEQ ID NO: 535299 - RNA, 22 nt, Human
augagcagaugcuccugccucu

SEQ ID NO: 535300 - RNA, 22 nt, Human
ccggggacuuaaagugaaggaa

SEQ ID NO: 535301 - RNA, 22 nt, Human
caggcccucaggcaagggcucu

SEQ ID NO: 535302 - RNA, 22 nt, Human
agaagagaguccuaccccauac

SEQ ID NO: 535303 - RNA, 20 nt, Human
ccugccuguguuugugauga

SEQ ID NO: 535304 - RNA, 22 nt, Human
ugccaggcuguccugggccugg

SEQ ID NO: 535305 - RNA, 22 nt, Human
uuucaauguaugucuuucugag

SEQ ID NO: 535306 - RNA, 22 nt, Human
guuauacauauguguuaacaaa

SEQ ID NO: 535307 - RNA, 22 nt, Human
aaggcugaccaguuuacacuuu

SEQ ID NO: 535308 - RNA, 22 nt, Human
uugcagagcaguaggaauauag

SEQ ID NO: 535309 - RNA, 22 nt, Human
uuauuagaucuguuagggaucc

SEQ ID NO: 535310 - RNA, 20 nt, Human
gccuggaggcagagauaaag

SEQ ID NO: 535311 - RNA, 22 nt, Human
guauuaggaggaacacaggccu

SEQ ID NO: 535312 - RNA, 22 nt, Human
ugcuccagcuggagaugggggc

SEQ ID NO: 535313 - RNA, 22 nt, Human
uuacacaaaaauaagauauggc

SEQ ID NO: 535314 - RNA, 22 nt, Human
acuguagaauggaaccaauugu

SEQ ID NO: 535315 - RNA, 22 nt, Human
uuggaugaagucuagcuuuagu

SEQ ID NO: 535316 - RNA, 22 nt, Human
cagacagaccugcaagggcaca

SEQ ID NO: 535317 - RNA, 22 nt, Human
uuuuuaagagauucuccagucu

SEQ ID NO: 535318 - RNA, 22 nt, Human
ucagggaaucagacucugcagc

SEQ ID NO: 535319 - RNA, 22 nt, Human
ggccugagcagacagcaugaug

SEQ ID NO: 535320 - RNA, 20 nt, Human
agcaggcugcagggugaaau

SEQ ID NO: 535321 - RNA, 22 nt, Human
ccagagagaaauggauuugagu

SEQ ID NO: 535322 - RNA, 22 nt, Human
gagaggggcccaagccacauag

SEQ ID NO: 535323 - RNA, 22 nt, Human
ugcuggcucuaggcugagacag

SEQ ID NO: 535324 - RNA, 22 nt, Human
cugagcagccccaccagccauu

SEQ ID NO: 535325 - RNA, 22 nt, Human
acacugaaagaagccagcuugu

SEQ ID NO: 535326 - RNA, 22 nt, Human
gcauagucaguaggauucucaa

SEQ ID NO: 535327 - RNA, 22 nt, Human
guauuuucaagagcaguaguau

SEQ ID NO: 535328 - RNA, 22 nt, Human
ugauuuaugaccaaguuagaau

SEQ ID NO: 535329 - RNA, 22 nt, Human
uacauguuugguaaaugauggc

SEQ ID NO: 535330 - RNA, 22 nt, Human
ggccuuccaucugccucuguuu

SEQ ID NO: 535331 - RNA, 19 nt, Human
cuucuggauccgcagggcc

SEQ ID NO: 535332 - RNA, 22 nt, Human
ucugggagguaaccaugcugau

SEQ ID NO: 535333 - RNA, 22 nt, Human
aucaacauuugcauccuuccac

SEQ ID NO: 535334 - RNA, 22 nt, Human
gcagagcagcaaauggaaagga

SEQ ID NO: 535335 - RNA, 22 nt, Human
caggcccagugaucagggcucu

SEQ ID NO: 535336 - RNA, 22 nt, Human
accugagagcuauaagguuuua

SEQ ID NO: 535337 - RNA, 22 nt, Human
cccagacugcagagcgggcaga

SEQ ID NO: 535338 - RNA, 22 nt, Human
uuuaacuugaucaguagagcau

SEQ ID NO: 535339 - RNA, 22 nt, Human
guuugucauuuguacuucuagc

SEQ ID NO: 535340 - RNA, 22 nt, Human
uacauacaagauguguuuaaaa

SEQ ID NO: 535341 - RNA, 22 nt, Human
uggcacagacagaucaggaguc

SEQ ID NO: 535342 - RNA, 21 nt, Human
agccaggcaagcacccccacu

SEQ ID NO: 535343 - RNA, 19 nt, Human
gguagaagggaaguguuuu

SEQ ID NO: 535344 - RNA, 22 nt, Human
auacagaugggucagauuucau

SEQ ID NO: 535345 - RNA, 22 nt, Human
guuacaaaugccaaagcugaga

SEQ ID NO: 535346 - RNA, 22 nt, Human
cuauuuucauucuuacauuguc

SEQ ID NO: 535347 - RNA, 22 nt, Human
uccugcaggccuguucccagua

SEQ ID NO: 535348 - RNA, 22 nt, Human
aggacccagaggcagaggacgu

SEQ ID NO: 535349 - RNA, 22 nt, Human
ccucuccuugcacccgucccgc

SEQ ID NO: 535350 - RNA, 22 nt, Human
aagcauuucagguagagauauu

SEQ ID NO: 535351 - RNA, 22 nt, Human
uggcagaguucgcugugccuuu

SEQ ID NO: 535352 - RNA, 22 nt, Human
uggccaccccuuucucugcacu

SEQ ID NO: 535353 - RNA, 22 nt, Human
aaggaaccuggaguagagggag

SEQ ID NO: 535354 - RNA, 18 nt, Human
uuuccaagaagagagcuc

SEQ ID NO: 535355 - RNA, 22 nt, Human
ggcaguggguuccccaaggcac

SEQ ID NO: 535356 - RNA, 22 nt, Human
ugcccugcagacccugcagugu

SEQ ID NO: 535357 - RNA, 22 nt, Human
acaacuguuggaggaacacagg

SEQ ID NO: 535358 - RNA, 22 nt, Human
uacacuaauguuuuugcaaagc

SEQ ID NO: 535359 - RNA, 22 nt, Human
uucuuucucaacaugaauguuu

SEQ ID NO: 535360 - RNA, 22 nt, Human
agcaugcacaugacuggcuuaa

SEQ ID NO: 535361 - RNA, 22 nt, Human
acuuaaaaagaaucuuuucacg

SEQ ID NO: 535362 - RNA, 22 nt, Human
ugcccugucgcucacucccacc

SEQ ID NO: 535363 - RNA, 22 nt, Human
ggcucaccauuuucacucucug

SEQ ID NO: 535364 - RNA, 22 nt, Human
ugggauggcauccugggccuug

SEQ ID NO: 535365 - RNA, 22 nt, Human
ugcauucugaacguaaauguga

SEQ ID NO: 535366 - RNA, 22 nt, Human
ggugaggcuggcuugccuucuu

SEQ ID NO: 535367 - RNA, 22 nt, Human
ccaggcagagggauccccaucc

SEQ ID NO: 535368 - RNA, 21 nt, Human
gccacugcacuccagccuggg

SEQ ID NO: 535369 - RNA, 22 nt, Human
ccagaagucaggaaugagucuu

SEQ ID NO: 535370 - RNA, 22 nt, Human
cauuuguacuguucaaugucau

SEQ ID NO: 535371 - RNA, 22 nt, Human
aggcacacagcuugcauaaauc

SEQ ID NO: 535372 - RNA, 22 nt, Human
augguuuguaacccaauacucc

SEQ ID NO: 535373 - RNA, 22 nt, Human
aagggcucuguugccauuucag

SEQ ID NO: 535374 - RNA, 22 nt, Human
uagcuuguuacacagcaauguu

SEQ ID NO: 535375 - RNA, 22 nt, Human
ucaggcugcccguucagggcuc

SEQ ID NO: 535376 - RNA, 22 nt, Human
gccauuuagggaggcaagguga

SEQ ID NO: 535377 - RNA, 22 nt, Human
cuggacuuuggcccaucugcca

SEQ ID NO: 535378 - RNA, 22 nt, Human
ccuguggacauucuguguggaa

SEQ ID NO: 535379 - RNA, 22 nt, Human
gcaaggcagcgcggaguagcua

SEQ ID NO: 535380 - RNA, 22 nt, Human
uuaaagcaugcugcuuuuccau

SEQ ID NO: 535381 - RNA, 22 nt, Human
guucacaagaguuacagacaga

SEQ ID NO: 535382 - RNA, 22 nt, Human
uccucaaauuagcagaucauag

SEQ ID NO: 535383 - RNA, 22 nt, Human
ugggccaggcaugugaucagca

SEQ ID NO: 535384 - RNA, 22 nt, Human
cuccucccucuuugccacacau

SEQ ID NO: 535385 - RNA, 22 nt, Human
ccagggcuccauugcucauccu

SEQ ID NO: 535386 - RNA, 22 nt, Human
cugcuucuccaaaguaggacuu

SEQ ID NO: 535387 - RNA, 22 nt, Human
ugaaagguagcuggccucauag

SEQ ID NO: 535388 - RNA, 18 nt, Human
uccugggaaaggcauaca

SEQ ID NO: 535389 - RNA, 22 nt, Human
ugaauaagugaugucauauaua

SEQ ID NO: 535390 - RNA, 22 nt, Human
aggcugaggcagguggaucauu

SEQ ID NO: 535391 - RNA, 22 nt, Human
aucagcaaucaaauugcagagu

SEQ ID NO: 535392 - RNA, 22 nt, Human
ucuggaugaagacccagaggcu

SEQ ID NO: 535393 - RNA, 22 nt, Human
ggcagcaacucggagagaagag

SEQ ID NO: 535394 - RNA, 22 nt, Human
ucauucauaucucucaagcuua

SEQ ID NO: 535395 - RNA, 22 nt, Human
uacauuccacuagugacuggcg

SEQ ID NO: 535396 - RNA, 18 nt, Human
auacaagcucuguuacuu

SEQ ID NO: 535397 - RNA, 22 nt, Human
gaggguggaagagcugcugaga

SEQ ID NO: 535398 - RNA, 22 nt, Human
uauuucaccucacccaggagaa

SEQ ID NO: 535399 - RNA, 22 nt, Human
caagaaggcauccccagucccu

SEQ ID NO: 535400 - RNA, 22 nt, Human
uuuccuucaucaucugagagcu

SEQ ID NO: 535401 - RNA, 22 nt, Human
auugaaaaugacauuugugccc

SEQ ID NO: 535402 - RNA, 22 nt, Human
aaggagucugggccauucagag

SEQ ID NO: 535403 - RNA, 22 nt, Human
cugcccugggugcuggggaucc

SEQ ID NO: 535404 - RNA, 22 nt, Human
ucuugcccucaacaagagcaug

SEQ ID NO: 535405 - RNA, 22 nt, Human
uccaaauucuauguucuuucca

SEQ ID NO: 535406 - RNA, 18 nt, Human
ccuggagcuccacagcaa

SEQ ID NO: 535407 - RNA, 22 nt, Human
auccuugaaugacucugcccuc

SEQ ID NO: 535408 - RNA, 21 nt, Human
cacuuuaaaaauaucuuuaua

SEQ ID NO: 535409 - RNA, 22 nt, Human
uagaauaugauuaauuuucuua

SEQ ID NO: 535410 - RNA, 22 nt, Human
aauucacaggagguauuugucc

SEQ ID NO: 535411 - RNA, 22 nt, Human
gcaugcaaauagucaugcuucc

SEQ ID NO: 535412 - RNA, 22 nt, Human
cgaggcaggcaggcggaggaua

SEQ ID NO: 535413 - RNA, 22 nt, Human
ugccucagucuaaagucucuca

SEQ ID NO: 535414 - RNA, 23 nt, Human
cuuuuaacuugaucugagaccag

SEQ ID NO: 535415 - RNA, 22 nt, Human
agaagccauugaagcagaccuc

SEQ ID NO: 535416 - RNA, 22 nt, Human
cagcuuugcaggcuggucagug

SEQ ID NO: 535417 - RNA, 22 nt, Human
gagaggcauggaacagauucuu

SEQ ID NO: 535418 - RNA, 22 nt, Human
cagaaauguuuauauguggugu

SEQ ID NO: 535419 - RNA, 21 nt, Human
cugaggcagcacagcuaguca

SEQ ID NO: 535420 - RNA, 22 nt, Human
auacaacugccuuagaaggaaa

SEQ ID NO: 535421 - RNA, 22 nt, Human
auaaggcagugacuucaucuau

SEQ ID NO: 535422 - RNA, 22 nt, Human
gcugcucuccauggccgugagu

SEQ ID NO: 535423 - RNA, 22 nt, Human
cuggaaguggagaguggcccuc

SEQ ID NO: 535424 - RNA, 22 nt, Human
ucccagccggugccuggguccc

SEQ ID NO: 535425 - RNA, 22 nt, Human
agcugccugugcugggagccca

SEQ ID NO: 535426 - RNA, 22 nt, Human
ccagcccuguaaggaugaggca

SEQ ID NO: 535427 - RNA, 22 nt, Human
ccagcugcugugaggaccacag

SEQ ID NO: 535428 - RNA, 22 nt, Human
cuucccugauaagagccucaga

SEQ ID NO: 535429 - RNA, 22 nt, Human
uguugacucaacacugugggca

SEQ ID NO: 535430 - RNA, 22 nt, Human
acagaacaggcugagaaaaaca

SEQ ID NO: 535431 - RNA, 22 nt, Human
auauuucuccaaauguuuucaa

SEQ ID NO: 535432 - RNA, 22 nt, Human
gcagagcuucuguccuucagga

SEQ ID NO: 535433 - RNA, 22 nt, Human
ugcuauuuuagacauacuuugu

SEQ ID NO: 535434 - RNA, 22 nt, Human
aagauacauuuucuucagagaa

SEQ ID NO: 535435 - RNA, 17 nt, Human
cugcuuugugcaacgcu

SEQ ID NO: 535436 - RNA, 22 nt, Human
ggaccugaacauaaaacgaggc

SEQ ID NO: 535437 - RNA, 22 nt, Human
guucauucagcuggguaggagg

SEQ ID NO: 535438 - RNA, 22 nt, Human
gcacccagggacuuggcuggcc

SEQ ID NO: 535439 - RNA, 22 nt, Human
cagggccauuggcguggcuguc

SEQ ID NO: 535440 - RNA, 23 nt, Human
ucuccuggcugcacuguggccac

SEQ ID NO: 535441 - RNA, 23 nt, Human
agggaagaaacaugaagggcugu

SEQ ID NO: 535442 - RNA, 22 nt, Human
gcaaggaccuuugagcgugcca

SEQ ID NO: 535443 - RNA, 22 nt, Human
uggcucagcauucacuggucuu

SEQ ID NO: 535444 - RNA, 18 nt, Human
ugcucuguuuaaugauuu

SEQ ID NO: 535445 - RNA, 22 nt, Human
caggcagcucuaauggaaagug

SEQ ID NO: 535446 - RNA, 22 nt, Human
cuucuuuugaagggcguugugu

SEQ ID NO: 535447 - RNA, 22 nt, Human
aagcaggagaugcaggaaugua

SEQ ID NO: 535448 - RNA, 22 nt, Human
aaauggcaggcucuuugcuagu

SEQ ID NO: 535449 - RNA, 22 nt, Human
auugugaauagugcugcaauaa

SEQ ID NO: 535450 - RNA, 22 nt, Human
gcucagagcacucagacucagc

SEQ ID NO: 535451 - RNA, 22 nt, Human
ucaaaguagaguucagugcagc

SEQ ID NO: 535452 - RNA, 22 nt, Human
guaauuuuuaguucauucuauc

SEQ ID NO: 535453 - RNA, 22 nt, Human
uggaggaugagugugggcucug

SEQ ID NO: 535454 - RNA, 22 nt, Human
cugggugguuuugaugugaauu

SEQ ID NO: 535455 - RNA, 22 nt, Human
agccaggggauucaucagggac

SEQ ID NO: 535456 - RNA, 22 nt, Human
ccugcuggcauucuugcucccu

SEQ ID NO: 535457 - RNA, 22 nt, Human
gcagagucauuauuuaugcaau

SEQ ID NO: 535458 - RNA, 22 nt, Human
aucuuuuugacauggugauggu

SEQ ID NO: 535459 - RNA, 22 nt, Human
acugggccggugcagaguaguu

SEQ ID NO: 535460 - RNA, 22 nt, Human
uagggcagcugcaucaggcacu

SEQ ID NO: 535461 - RNA, 23 nt, Human
ugaagguauuaccugagaugcuc

SEQ ID NO: 535462 - RNA, 20 nt, Human
ccaccuggccaaggcugugc

SEQ ID NO: 535463 - RNA, 22 nt, Human
ggcagucuaguguccuugggcc

SEQ ID NO: 535464 - RNA, 22 nt, Human
caugaaaaugucaaguucugcu

SEQ ID NO: 535465 - RNA, 22 nt, Human
ggggccugcgagguucaacuuc

SEQ ID NO: 535466 - RNA, 22 nt, Human
cuccucuguauugauugggacu

SEQ ID NO: 535467 - RNA, 22 nt, Human
uccuguguuacugccuggagcg

SEQ ID NO: 535468 - RNA, 22 nt, Human
ccagcugaggcagccacacagg

SEQ ID NO: 535469 - RNA, 22 nt, Human
augaaauuugcugcuaaguucc

SEQ ID NO: 535470 - RNA, 22 nt, Human
uccaaguugauguuucuuaaau

SEQ ID NO: 535471 - RNA, 22 nt, Human
cuccucugucuggcccugagcc

SEQ ID NO: 535472 - RNA, 22 nt, Human
cagaggcugcucuggguggcau

SEQ ID NO: 535473 - RNA, 22 nt, Human
ucacacacauggauaguauuuu

SEQ ID NO: 535474 - RNA, 23 nt, Human
ggguccagagacaggcaugggug

SEQ ID NO: 535475 - RNA, 22 nt, Human
cacccagcauuggcuaagagag

SEQ ID NO: 535476 - RNA, 22 nt, Human
cugaggccuggugaggugguga

SEQ ID NO: 535477 - RNA, 22 nt, Human
acuuuuaaaugaguuucaguug

SEQ ID NO: 535478 - RNA, 22 nt, Human
aagggaggccagagguuuugca

SEQ ID NO: 535479 - RNA, 22 nt, Human
auagaaacagaugcacuucucu

SEQ ID NO: 535480 - RNA, 22 nt, Human
ugucaacacaccuaucucaauu

SEQ ID NO: 535481 - RNA, 22 nt, Human
caagcagaaaucuagaacucca

SEQ ID NO: 535482 - RNA, 17 nt, Human
uaucagaauguguuuac

SEQ ID NO: 535483 - RNA, 18 nt, Human
agcaaauauuaagugcau

SEQ ID NO: 535484 - RNA, 22 nt, Human
gggcacugcuuugcucugucac

SEQ ID NO: 535485 - RNA, 22 nt, Human
aaagauucgagcgauguauaaa

SEQ ID NO: 535486 - RNA, 22 nt, Human
aaacaaguuuagaauaaugaau

SEQ ID NO: 535487 - RNA, 22 nt, Human
uuucacaaguuucaggauucug

SEQ ID NO: 535488 - RNA, 22 nt, Human
ugcugccuuagcagccaggcaa

SEQ ID NO: 535489 - RNA, 22 nt, Human
agccaggacguugcucagcucc

SEQ ID NO: 535490 - RNA, 22 nt, Human
ucaccagucuuucuuaccauug

SEQ ID NO: 535491 - RNA, 22 nt, Human
gcagagcagaggugcagguugg

SEQ ID NO: 535492 - RNA, 22 nt, Human
agcucugugaagccagcaguuc

SEQ ID NO: 535493 - RNA, 22 nt, Human
caucagucagucucuucaguau

SEQ ID NO: 535494 - RNA, 22 nt, Human
uacuuacagagcuuauaaguua

SEQ ID NO: 535495 - RNA, 22 nt, Human
guggccagccagggugcugaug

SEQ ID NO: 535496 - RNA, 22 nt, Human
augcuauguaacuggcagauag

SEQ ID NO: 535497 - RNA, 22 nt, Human
uauacagaaccgccugaagucu

SEQ ID NO: 535498 - RNA, 18 nt, Human
gcuccuggaccaggucac

SEQ ID NO: 535499 - RNA, 22 nt, Human
uguauuuaagcuuuaccuaaaa

SEQ ID NO: 535500 - RNA, 22 nt, Human
uuuccaauaaggucaccuuccu

SEQ ID NO: 535501 - RNA, 22 nt, Human
gcaggugguggggcuaugaucu

SEQ ID NO: 535502 - RNA, 22 nt, Human
cauucccacguguucuuugcuu

SEQ ID NO: 535503 - RNA, 22 nt, Human
cauucaaauuaagauuuuguua

SEQ ID NO: 535504 - RNA, 22 nt, Human
ugaggcuggcaaggcugguauu

SEQ ID NO: 535505 - RNA, 22 nt, Human
auaagaaacauuauucuuucca

SEQ ID NO: 535506 - RNA, 21 nt, Human
aaagaacaggcagauguucuu

SEQ ID NO: 535507 - RNA, 22 nt, Human
cuuauaguaugauguugagaau

SEQ ID NO: 535508 - RNA, 22 nt, Human
cugugcaaugccuaaucacaaa

SEQ ID NO: 535509 - RNA, 21 nt, Human
ugcaggcaggcagagaugcug

SEQ ID NO: 535510 - RNA, 22 nt, Human
gugugcagugagcaaaagaucu

SEQ ID NO: 535511 - RNA, 22 nt, Human
acuuugcacuaaguuacucauu

SEQ ID NO: 535512 - RNA, 22 nt, Human
ugagagcagaggugggcagccu

SEQ ID NO: 535513 - RNA, 22 nt, Human
caguucagcuagaagaaacaaa

SEQ ID NO: 535514 - RNA, 22 nt, Human
ugggccacggggguggagagcu

SEQ ID NO: 535515 - RNA, 22 nt, Human
acaggcacugucaagucaugaa

SEQ ID NO: 535516 - RNA, 22 nt, Human
accaucagagcacaguccgugc

SEQ ID NO: 535517 - RNA, 22 nt, Human
gggcugagugaccucaggccaa

SEQ ID NO: 535518 - RNA, 22 nt, Human
ugcaagagcccagggccaggaa

SEQ ID NO: 535519 - RNA, 22 nt, Human
aaaagucagucucuccuagcuc

SEQ ID NO: 535520 - RNA, 22 nt, Human
augcacuguaggugccaucugc

SEQ ID NO: 535521 - RNA, 23 nt, Human
acacaaggguaacugccagccau

SEQ ID NO: 535522 - RNA, 22 nt, Human
aaguaaaagcuuuaccaugcgc

SEQ ID NO: 535523 - RNA, 22 nt, Human
uggccugcagcucucagggaag

SEQ ID NO: 535524 - RNA, 22 nt, Human
ccuggcugaacaaagucccucc

SEQ ID NO: 535525 - RNA, 22 nt, Human
guauuacauuuaguaauuaggc

SEQ ID NO: 535526 - RNA, 22 nt, Human
ucccacuauuauccuauguggg

SEQ ID NO: 535527 - RNA, 20 nt, Human
gcugucuggauuagaagccu

SEQ ID NO: 535528 - RNA, 22 nt, Human
cugcaggcccccuuccuggagu

SEQ ID NO: 535529 - RNA, 22 nt, Human
ccaaaugugccuguuucaacaa

SEQ ID NO: 535530 - RNA, 22 nt, Human
cucaacauuuaacagugaaaaa

SEQ ID NO: 535531 - RNA, 16 nt, Human
ggcaccagugaacaca

SEQ ID NO: 535532 - RNA, 22 nt, Human
gcagagucagccuccgagacag

SEQ ID NO: 535533 - RNA, 22 nt, Human
gacaauaaaaugaucuuacagu

SEQ ID NO: 535534 - RNA, 22 nt, Human
ugucagugauuuguagggaauu

SEQ ID NO: 535535 - RNA, 22 nt, Human
agggugcagguguggagucuag

SEQ ID NO: 535536 - RNA, 22 nt, Human
gaacacuuuaacauuccuuuuc

SEQ ID NO: 535537 - RNA, 22 nt, Human
cauacuuuugcccugacauucu

SEQ ID NO: 535538 - RNA, 22 nt, Human
augggcugggaucugaguguca

SEQ ID NO: 535539 - RNA, 22 nt, Human
gagugagggcagcaggggcugc

SEQ ID NO: 535540 - RNA, 22 nt, Human
agugugaguaauucagggaggg

SEQ ID NO: 535541 - RNA, 22 nt, Human
ggcucaggaugagccuucucau

SEQ ID NO: 535542 - RNA, 22 nt, Human
gggauggggagcuggaaagggg

SEQ ID NO: 535543 - RNA, 22 nt, Human
cagcaggacauggaggaguaaa

SEQ ID NO: 535544 - RNA, 22 nt, Human
acagaugagauucauugaccac

SEQ ID NO: 535545 - RNA, 22 nt, Human
ugggcaggagagaagcuaaaga

SEQ ID NO: 535546 - RNA, 21 nt, Human
ucuggcaggaagacggauggg

SEQ ID NO: 535547 - RNA, 22 nt, Human
ccugccugggcucacuugccag

SEQ ID NO: 535548 - RNA, 22 nt, Human
ggaaggcugugccagaagaacu

SEQ ID NO: 535549 - RNA, 22 nt, Human
ugggagcaccuugagggcagaa

SEQ ID NO: 535550 - RNA, 19 nt, Human
ucucaauguucagaaagcu

SEQ ID NO: 535551 - RNA, 22 nt, Human
uuucuuuccauacauauugcua

SEQ ID NO: 535552 - RNA, 22 nt, Human
gccaggagccagcuucuuagca

SEQ ID NO: 535553 - RNA, 22 nt, Human
cccagaguucaaacccugcguc

SEQ ID NO: 535554 - RNA, 22 nt, Human
caaaugcuacuaauaggcaagu

SEQ ID NO: 535555 - RNA, 22 nt, Human
aguggaaggcugggaaaugcgg

SEQ ID NO: 535556 - RNA, 17 nt, Human
auacaaagccauaaacc

SEQ ID NO: 535557 - RNA, 22 nt, Human
guagccauuggcaaugaagccu

SEQ ID NO: 535558 - RNA, 22 nt, Human
ggcugucugugguggagcguug

SEQ ID NO: 535559 - RNA, 22 nt, Human
aucauaaaauugcaccauuucu

SEQ ID NO: 535560 - RNA, 23 nt, Human
acagggcauugcuggccucgagg

SEQ ID NO: 535561 - RNA, 22 nt, Human
augcagcugucagggagaacau

SEQ ID NO: 535562 - RNA, 22 nt, Human
uguuacaauauuaucaacugag

SEQ ID NO: 535563 - RNA, 22 nt, Human
acacauaagccuaaucaucucc

SEQ ID NO: 535564 - RNA, 22 nt, Human
aaggcacugaaaaauugugugu

SEQ ID NO: 535565 - RNA, 22 nt, Human
uuaauuaugagaaagggaaaag

SEQ ID NO: 535566 - RNA, 22 nt, Human
gcagugcugaucccauggcaga

SEQ ID NO: 535567 - RNA, 22 nt, Human
cccugcagccuugcaugccuuc

SEQ ID NO: 535568 - RNA, 19 nt, Human
ggccccucucacaggaguu

SEQ ID NO: 535569 - RNA, 22 nt, Human
cugugcccagcucccugacugc

SEQ ID NO: 535570 - RNA, 23 nt, Human
agaauuguaaauagaauauaccu

SEQ ID NO: 535571 - RNA, 22 nt, Human
aggaaacuguccccucauccua

SEQ ID NO: 535572 - RNA, 22 nt, Human
ugcagaugaaugcugagacacu

SEQ ID NO: 535573 - RNA, 22 nt, Human
aggagccaccuaggagcuguuu

SEQ ID NO: 535574 - RNA, 23 nt, Human
uuccagaguccacaucugccacc

SEQ ID NO: 535575 - RNA, 23 nt, Human
agguucaggagauggaggaacaa

SEQ ID NO: 535576 - RNA, 22 nt, Human
aucuuuccuguuuucagacagc

SEQ ID NO: 535577 - RNA, 22 nt, Human
aaauuguccuuuuaagaaacag

SEQ ID NO: 535578 - RNA, 22 nt, Human
ccagccuccauguagauagcug

SEQ ID NO: 535579 - RNA, 22 nt, Human
aauuuagauugauaaacaugga

SEQ ID NO: 535580 - RNA, 22 nt, Human
cucugauuuauauuauaaagug

SEQ ID NO: 535581 - RNA, 22 nt, Human
uccauuuucuaaguaucacuua

SEQ ID NO: 535582 - RNA, 22 nt, Human
uuggaagaucuaacagaggcau

SEQ ID NO: 535583 - RNA, 22 nt, Human
gcugccugaagugucuacacug

SEQ ID NO: 535584 - RNA, 22 nt, Human
ggcaggcuggcuuuguuccagg

SEQ ID NO: 535585 - RNA, 22 nt, Human
acaaagugcugacauuacaggc

SEQ ID NO: 535586 - RNA, 22 nt, Human
acagggccucagcugauucugg

SEQ ID NO: 535587 - RNA, 22 nt, Human
acccaugggccaguuggggugg

SEQ ID NO: 535588 - RNA, 22 nt, Human
aaaaaccucaauuacuuuugca

SEQ ID NO: 535589 - RNA, 22 nt, Human
uugaacaguuuugucagguuca

SEQ ID NO: 535590 - RNA, 22 nt, Human
cagcaucuucaugugcaucucc

SEQ ID NO: 535591 - RNA, 22 nt, Human
gcagaugguggaggcaagaggc

SEQ ID NO: 535592 - RNA, 22 nt, Human
agcuccugggagcaggugguac

SEQ ID NO: 535593 - RNA, 22 nt, Human
ucaggcaggcucagaggaaaac

SEQ ID NO: 535594 - RNA, 22 nt, Human
caggagugagaugcgaucacuu

SEQ ID NO: 535595 - RNA, 22 nt, Human
uuuucacaugcuuggggacuua

SEQ ID NO: 535596 - RNA, 22 nt, Human
cuucccagacgggguggcagcc

SEQ ID NO: 535597 - RNA, 22 nt, Human
guggagacgggacagaagcuaa

SEQ ID NO: 535598 - RNA, 22 nt, Human
uuuguucaugccuauauucuca

SEQ ID NO: 535599 - RNA, 22 nt, Human
gagggcuccucacauucucuau

SEQ ID NO: 535600 - RNA, 21 nt, Human
ugucagaaauaagcaugugau

SEQ ID NO: 535601 - RNA, 22 nt, Human
cuccagcuucccucagcugugg

SEQ ID NO: 535602 - RNA, 17 nt, Human
uauacacagacagacug

SEQ ID NO: 535603 - RNA, 22 nt, Human
cuuacauuaaguaagagauuga

SEQ ID NO: 535604 - RNA, 22 nt, Human
gguggcucaaagagagcacaga

SEQ ID NO: 535605 - RNA, 22 nt, Human
aagauucagccaaauuguucau

SEQ ID NO: 535606 - RNA, 22 nt, Human
auuaauaaaauaccacuuuguu

SEQ ID NO: 535607 - RNA, 22 nt, Human
uacagaguuuuccugccaagaa

SEQ ID NO: 535608 - RNA, 22 nt, Human
agggccuggaacugugggcagg

SEQ ID NO: 535609 - RNA, 22 nt, Human
gcaggaagccuuaccaagccca

SEQ ID NO: 535610 - RNA, 22 nt, Human
ccuucaaauuuagaacaaguga

SEQ ID NO: 535611 - RNA, 20 nt, Human
cucugcccccagacugacag

SEQ ID NO: 535612 - RNA, 22 nt, Human
uugaauaguuuuggauagcaua

SEQ ID NO: 535613 - RNA, 21 nt, Human
agcugccacccuagcuucuga

SEQ ID NO: 535614 - RNA, 22 nt, Human
gggcagcucuggcugugggaag

SEQ ID NO: 535615 - RNA, 22 nt, Human
ucagaagcaggagugugcacaa

SEQ ID NO: 535616 - RNA, 22 nt, Human
aacaaaguagcugcuguucuua

SEQ ID NO: 535617 - RNA, 22 nt, Human
ccugcaccaggcccagcauggu

SEQ ID NO: 535618 - RNA, 22 nt, Human
ccaggcuguuuucaaacuuggg

SEQ ID NO: 535619 - RNA, 22 nt, Human
ugugaaaugaagauaauucuug

SEQ ID NO: 535620 - RNA, 22 nt, Human
agagcccuuucuccaggcaccu

SEQ ID NO: 535621 - RNA, 22 nt, Human
aaguucuugaagacuuuaaaua

SEQ ID NO: 535622 - RNA, 22 nt, Human
ugcuucaggagaugucaccaug

SEQ ID NO: 535623 - RNA, 22 nt, Human
aggcacugaagaacucuuuuug

SEQ ID NO: 535624 - RNA, 22 nt, Human
ggcugggucccagcugggagga

SEQ ID NO: 535625 - RNA, 22 nt, Human
caugugucaaaugauguagcug

SEQ ID NO: 535626 - RNA, 21 nt, Human
ucagaguguguuacagcaagc

SEQ ID NO: 535627 - RNA, 22 nt, Human
uuacagagaggugauugugaag

SEQ ID NO: 535628 - RNA, 22 nt, Human
ugugcccaucccucuggagugu

SEQ ID NO: 535629 - RNA, 22 nt, Human
ucaggaaggcacuugguguguu

SEQ ID NO: 535630 - RNA, 21 nt, Human
cuccugggcuaagauauagug

SEQ ID NO: 535631 - RNA, 22 nt, Human
uaucaaggcauggaaaaugcua

SEQ ID NO: 535632 - RNA, 22 nt, Human
auacaugacucacacauucugc

SEQ ID NO: 535633 - RNA, 19 nt, Human
uaaaucuguauucuucaaa

SEQ ID NO: 535634 - RNA, 22 nt, Human
uggcugucagcugccuggugcg

SEQ ID NO: 535635 - RNA, 22 nt, Human
auaaggcagaaaugauucuagu

SEQ ID NO: 535636 - RNA, 21 nt, Human
ugggccucaggcagcugugac

SEQ ID NO: 535637 - RNA, 16 nt, Human
agcagguguauagugu

SEQ ID NO: 535638 - RNA, 22 nt, Human
agcacaggacguagagcuugga

SEQ ID NO: 535639 - RNA, 22 nt, Human
aaaggccaauaaagacaagcug

SEQ ID NO: 535640 - RNA, 22 nt, Human
gagacugaggucaccaggcugu

SEQ ID NO: 535641 - RNA, 22 nt, Human
ggcucugcaugugagugggugg

SEQ ID NO: 535642 - RNA, 22 nt, Human
cucagggcuggaaagccaggaa

SEQ ID NO: 535643 - RNA, 22 nt, Human
ccugggagggcaagugcugaug

SEQ ID NO: 535644 - RNA, 22 nt, Human
caaguauucuguaaaaagucaa

SEQ ID NO: 535645 - RNA, 22 nt, Human
ccucccucuguuagagcugucu

SEQ ID NO: 535646 - RNA, 22 nt, Human
acauucaaggccuucugacaca

SEQ ID NO: 535647 - RNA, 22 nt, Human
uaauuuaauccaaguguuacau

SEQ ID NO: 535648 - RNA, 22 nt, Human
agcaaacagaugucuccuuuag

SEQ ID NO: 535649 - RNA, 22 nt, Human
aacauuuauucuaauucuggga

SEQ ID NO: 535650 - RNA, 23 nt, Human
cugaggccugcugcguucagguu

SEQ ID NO: 535651 - RNA, 22 nt, Human
ucucugucccuaggagccuugc

SEQ ID NO: 535652 - RNA, 21 nt, Human
ggcuaggaugcugggguuucc

SEQ ID NO: 535653 - RNA, 17 nt, Human
agcugccagggagugug

SEQ ID NO: 535654 - RNA, 22 nt, Human
uaugauuuguagacauuugauu

SEQ ID NO: 535655 - RNA, 23 nt, Human
agcauaaaccucuguggcuuuag

SEQ ID NO: 535656 - RNA, 21 nt, Human
auacuuugaauuacagccuug

SEQ ID NO: 535657 - RNA, 22 nt, Human
caauauauaaugaguacuuucc

SEQ ID NO: 535658 - RNA, 22 nt, Human
ggaguuggugagcaccaggcuu

SEQ ID NO: 535659 - RNA, 22 nt, Human
ucugcccugccauucacuggaa

SEQ ID NO: 535660 - RNA, 22 nt, Human
auuugaauggcuuaacacaacg

SEQ ID NO: 535661 - RNA, 22 nt, Human
ccaguggaaauguggucaggau

SEQ ID NO: 535662 - RNA, 22 nt, Human
ucagaagaagagacuccacagc

SEQ ID NO: 535663 - RNA, 22 nt, Human
gcccagcacagcuggaagaguc

SEQ ID NO: 535664 - RNA, 20 nt, Human
cucugcugcccgccggcugc

SEQ ID NO: 535665 - RNA, 22 nt, Human
acaauuucuuauaguucaauuc

SEQ ID NO: 535666 - RNA, 22 nt, Human
ccuggccugcucggcucuuaag

SEQ ID NO: 535667 - RNA, 22 nt, Human
caagauauauguaugauuccau

SEQ ID NO: 535668 - RNA, 22 nt, Human
ccuggcagcgugccgagcugcg

SEQ ID NO: 535669 - RNA, 22 nt, Human
uguggggaggcugcagugcugc

SEQ ID NO: 535670 - RNA, 22 nt, Human
acguuuucagccuuaauguaga

SEQ ID NO: 535671 - RNA, 22 nt, Human
cugggcuuugaagccaggcugc

SEQ ID NO: 535672 - RNA, 20 nt, Human
gcugcugagcuucccugggg

SEQ ID NO: 535673 - RNA, 22 nt, Human
acuuccuguuaugugugccucu

SEQ ID NO: 535674 - RNA, 22 nt, Human
aauggacaggagagcauaguca

SEQ ID NO: 535675 - RNA, 18 nt, Human
gggcagcacagcagccuc

SEQ ID NO: 535676 - RNA, 22 nt, Human
cagcuguugugauccauuuacg

SEQ ID NO: 535677 - RNA, 22 nt, Human
cuucugggcauggcagagccug

SEQ ID NO: 535678 - RNA, 22 nt, Human
ugaagugaccuggggcagugua

SEQ ID NO: 535679 - RNA, 22 nt, Human
cccacaggcuagggguagggca

SEQ ID NO: 535680 - RNA, 22 nt, Human
uuuuuauaacucuuuugugaca

SEQ ID NO: 535681 - RNA, 22 nt, Human
cugacccauauaagaguggagg

SEQ ID NO: 535682 - RNA, 22 nt, Human
caauuucauuaauagauauaga

SEQ ID NO: 535683 - RNA, 22 nt, Human
ugccaaggguaugggcaagaua

SEQ ID NO: 535684 - RNA, 19 nt, Human
cccaaggcccugggcaggc

SEQ ID NO: 535685 - RNA, 23 nt, Human
uuauugcauccaaaugcauuccu

SEQ ID NO: 535686 - RNA, 22 nt, Human
cccuucuguaaaugcugacugg

SEQ ID NO: 535687 - RNA, 22 nt, Human
cagugcagguggcagaggacag

SEQ ID NO: 535688 - RNA, 22 nt, Human
cuguggagguaggagcaggaca

SEQ ID NO: 535689 - RNA, 16 nt, Human
gcaggcagaucacaug

SEQ ID NO: 535690 - RNA, 21 nt, Human
uagggcucuauuuuuauuuca

SEQ ID NO: 535691 - RNA, 22 nt, Human
gcugcagcagaaguucucagag

SEQ ID NO: 535692 - RNA, 22 nt, Human
guggcugcuguccucucugguu

SEQ ID NO: 535693 - RNA, 22 nt, Human
guccucuguagggcugggccac

SEQ ID NO: 535694 - RNA, 22 nt, Human
cccugcagcauucucuaacugg

SEQ ID NO: 535695 - RNA, 22 nt, Human
cccugagagugagugccaccuu

SEQ ID NO: 535696 - RNA, 22 nt, Human
cucuucagguuucugcucugga

SEQ ID NO: 535697 - RNA, 20 nt, Human
aaacuugauggcauagaaua

SEQ ID NO: 535698 - RNA, 22 nt, Human
aauauuaauagaagggguucua

SEQ ID NO: 535699 - RNA, 22 nt, Human
ugaagcaguuacuggguguuaa

SEQ ID NO: 535700 - RNA, 22 nt, Human
ucugggagcacacgcagugauc

SEQ ID NO: 535701 - RNA, 22 nt, Human
agcuugccucuuaaucaccuca

SEQ ID NO: 535702 - RNA, 22 nt, Human
agguacagcaauauaagagguc

SEQ ID NO: 535703 - RNA, 22 nt, Human
gagggcugauaaaugcgcaugg

SEQ ID NO: 535704 - RNA, 18 nt, Human
aaggcuucaaagaguaga

SEQ ID NO: 535705 - RNA, 22 nt, Human
guuucauauaccaagcacuuga

SEQ ID NO: 535706 - RNA, 22 nt, Human
gggcauguaggaauccauggag

SEQ ID NO: 535707 - RNA, 22 nt, Human
gccuccuguuaugccaugugcc

SEQ ID NO: 535708 - RNA, 22 nt, Human
ucucccaggcugcccuguggac

SEQ ID NO: 535709 - RNA, 22 nt, Human
uccagagaacgaugaaagcugg

SEQ ID NO: 535710 - RNA, 22 nt, Human
acacagaaccucauagccucuc

SEQ ID NO: 535711 - RNA, 22 nt, Human
uuuaaugauagucuuacgaaaa

SEQ ID NO: 535712 - RNA, 22 nt, Human
acaaauuauagaaaauugagcu

SEQ ID NO: 535713 - RNA, 22 nt, Human
auguaugauauuuccaguauca

SEQ ID NO: 535714 - RNA, 22 nt, Human
uacuguuuucuauaauggcugu

SEQ ID NO: 535715 - RNA, 22 nt, Human
guggccugagcuucagaguugg

SEQ ID NO: 535716 - RNA, 22 nt, Human
ucccaagacgaugugcuuggcc

SEQ ID NO: 535717 - RNA, 22 nt, Human
uucuuacagcccuauuacuaaa

SEQ ID NO: 535718 - RNA, 20 nt, Human
uauuuagauucaaguaugga

SEQ ID NO: 535719 - RNA, 22 nt, Human
caugcaaaauguauuuuauuag

SEQ ID NO: 535720 - RNA, 22 nt, Human
gugaagcauaacugaaggauuu

SEQ ID NO: 535721 - RNA, 22 nt, Human
ggaagagagguucagcccuaag

SEQ ID NO: 535722 - RNA, 22 nt, Human
ucugcccacaguccaauaguug

SEQ ID NO: 535723 - RNA, 22 nt, Human
cucaggauuaaggaaucuaaau

SEQ ID NO: 535724 - RNA, 22 nt, Human
aaaguucuuugcaucuuugcuc

SEQ ID NO: 535725 - RNA, 22 nt, Human
ccauaagguuuggggccaugca

SEQ ID NO: 535726 - RNA, 22 nt, Human
cagaggaagagauacaagcccu

SEQ ID NO: 535727 - RNA, 22 nt, Human
ugcacacauaugagcaugugug

SEQ ID NO: 535728 - RNA, 22 nt, Human
gccuccucuugagggucaggga

SEQ ID NO: 535729 - RNA, 22 nt, Human
aauauugagaaccagcauguuu

SEQ ID NO: 535730 - RNA, 22 nt, Human
ucuaaagccuuccauauaacgc

SEQ ID NO: 535731 - RNA, 22 nt, Human
uggcugagggcacuaugaagcc

SEQ ID NO: 535732 - RNA, 22 nt, Human
gcugaggccucagaaggcugag

SEQ ID NO: 535733 - RNA, 22 nt, Human
ggccaagauggaaggagagaug

SEQ ID NO: 535734 - RNA, 20 nt, Human
auguuuaauguuguccaccc

SEQ ID NO: 535735 - RNA, 22 nt, Human
uagcccagagucccaauuccag

SEQ ID NO: 535736 - RNA, 22 nt, Human
ugcuguggcaguuuauguauag

SEQ ID NO: 535737 - RNA, 22 nt, Human
gucccagaggcuuuggccacag

SEQ ID NO: 535738 - RNA, 22 nt, Human
gaguguuuuacucaaagaaaga

SEQ ID NO: 535739 - RNA, 22 nt, Human
ccaucagcaugggagcaugggc

SEQ ID NO: 535740 - RNA, 22 nt, Human
uggcacugagcagccgcggcag

SEQ ID NO: 535741 - RNA, 22 nt, Human
uacauuccuucguuuagagauu

SEQ ID NO: 535742 - RNA, 22 nt, Human
ggggaggaagcuggaacacggg

SEQ ID NO: 535743 - RNA, 20 nt, Human
augccucuaauuuugcaaac

SEQ ID NO: 535744 - RNA, 17 nt, Human
aggauguggagaaaauu

SEQ ID NO: 535745 - RNA, 22 nt, Human
uuuuucaugagacuagaaguca

SEQ ID NO: 535746 - RNA, 22 nt, Human
cugugaggcccugggugcugga

SEQ ID NO: 535747 - RNA, 22 nt, Human
uuggcugaagguuaagugcugg

SEQ ID NO: 535748 - RNA, 22 nt, Human
uaaugcacaugacugaacuauu

SEQ ID NO: 535749 - RNA, 22 nt, Human
uguguucauuagcauugccuug

SEQ ID NO: 535750 - RNA, 22 nt, Human
uccugggaaguugcaucaccgu

SEQ ID NO: 535751 - RNA, 22 nt, Human
gacaggcuuccuaagugccaga

SEQ ID NO: 535752 - RNA, 21 nt, Human
ggccucugccuugccccacuc

SEQ ID NO: 535753 - RNA, 22 nt, Human
uaaagcaaggaauagaguaguc

SEQ ID NO: 535754 - RNA, 22 nt, Human
ugcacacacacguagagaaaag

SEQ ID NO: 535755 - RNA, 22 nt, Human
uagaucugauacaauucaucug

SEQ ID NO: 535756 - RNA, 22 nt, Human
augcaguaaauguuaagaaaaa

SEQ ID NO: 535757 - RNA, 22 nt, Human
gcugcuccgucugagcucuggu

SEQ ID NO: 535758 - RNA, 22 nt, Human
caggcccaggccagugguuccc

SEQ ID NO: 535759 - RNA, 22 nt, Human
agcacugauuuaaacuggauuu

SEQ ID NO: 535760 - RNA, 22 nt, Human
caggaaccagaaccuucccccg

SEQ ID NO: 535761 - RNA, 22 nt, Human
gcaaagucucaagacccaagug

SEQ ID NO: 535762 - RNA, 22 nt, Human
uuuguggcaggagcggagaccg

SEQ ID NO: 535763 - RNA, 21 nt, Human
uuuagggaccaggucauaggc

SEQ ID NO: 535764 - RNA, 21 nt, Human
acagauuuuauaucucugcug

SEQ ID NO: 535765 - RNA, 22 nt, Human
cugcuguggguuaagacacugu

SEQ ID NO: 535766 - RNA, 22 nt, Human
gggacccugggaggcuggcgca

SEQ ID NO: 535767 - RNA, 22 nt, Human
aggcuuccucgugccuuagaua

SEQ ID NO: 535768 - RNA, 22 nt, Human
agcuccugaaaagcgcuugcuu

SEQ ID NO: 535769 - RNA, 22 nt, Human
aggcucagacaggaaaaguaac

SEQ ID NO: 535770 - RNA, 22 nt, Human
agcuccugucucaagggagccu

SEQ ID NO: 535771 - RNA, 18 nt, Human
cuguucuagaacuccugu

SEQ ID NO: 535772 - RNA, 22 nt, Human
uccuuaaauccuucagagauua

SEQ ID NO: 535773 - RNA, 22 nt, Human
ucuauuuuauacucaaaucuuc

SEQ ID NO: 535774 - RNA, 22 nt, Human
aagagcuggaugaagaaaucaa

SEQ ID NO: 535775 - RNA, 22 nt, Human
gggcugggaauggcuaaguaug

SEQ ID NO: 535776 - RNA, 22 nt, Human
cuggcaggaaggcauuuagaca

SEQ ID NO: 535777 - RNA, 22 nt, Human
ggcaaggggucaggcugagaca

SEQ ID NO: 535778 - RNA, 22 nt, Human
aaggcugaaagaccuugaaccu

SEQ ID NO: 535779 - RNA, 22 nt, Human
cuggcugguuacuauuucuggu

SEQ ID NO: 535780 - RNA, 22 nt, Human
caauguaucaagaagcaucagu

SEQ ID NO: 535781 - RNA, 22 nt, Human
ggccugaggcgucccagcugug

SEQ ID NO: 535782 - RNA, 19 nt, Human
ggcauccagaacuaccagu

SEQ ID NO: 535783 - RNA, 21 nt, Human
guuauuuuaagugagcuuugc

SEQ ID NO: 535784 - RNA, 22 nt, Human
cagggagcuuucccaggacccu

SEQ ID NO: 535785 - RNA, 22 nt, Human
ccuucaaaguacacaucuuuau

SEQ ID NO: 535786 - RNA, 22 nt, Human
ugcaaaauaaugaacgauuuuu

SEQ ID NO: 535787 - RNA, 17 nt, Human
ucaaaguauucugaugc

SEQ ID NO: 535788 - RNA, 22 nt, Human
cuucacauguuggaguccuuug

SEQ ID NO: 535789 - RNA, 22 nt, Human
guagggacaauauguuauuaga

SEQ ID NO: 535790 - RNA, 22 nt, Human
acucaggaaaugagaggcucuc

SEQ ID NO: 535791 - RNA, 22 nt, Human
ugccagucucacccuggguccu

SEQ ID NO: 535792 - RNA, 23 nt, Human
cugagcaaagggggaagcugcuu

SEQ ID NO: 535793 - RNA, 22 nt, Human
ucugugcucuucucaguaucac

SEQ ID NO: 535794 - RNA, 22 nt, Human
agaauaaauguuggacuuagga

SEQ ID NO: 535795 - RNA, 22 nt, Human
uuugauaauacacaagagaaag

SEQ ID NO: 535796 - RNA, 22 nt, Human
guggucagcagcagugggagug

SEQ ID NO: 535797 - RNA, 22 nt, Human
ggccucugggguccugagccca

SEQ ID NO: 535798 - RNA, 22 nt, Human
ucagugcuucggcgagcaccua

SEQ ID NO: 535799 - RNA, 22 nt, Human
aacagcugucugccuaucucug

SEQ ID NO: 535800 - RNA, 22 nt, Human
ugcacagagagaugagacacgu

SEQ ID NO: 535801 - RNA, 22 nt, Human
uuuguucacuauaucccucagu

SEQ ID NO: 535802 - RNA, 22 nt, Human
auuucaguagaaaaucuugauu

SEQ ID NO: 535803 - RNA, 22 nt, Human
uggccugccucccggcuucuuu

SEQ ID NO: 535804 - RNA, 22 nt, Human
ucccagaguuuccuguguccca

SEQ ID NO: 535805 - RNA, 22 nt, Human
gaccaaggaagaggggagccag

SEQ ID NO: 535806 - RNA, 22 nt, Human
cccaggcugauguucagcgggu

SEQ ID NO: 535807 - RNA, 22 nt, Human
cagggccagccauccugcuggg

SEQ ID NO: 535808 - RNA, 22 nt, Human
uucaaacaguguagaauauaug

SEQ ID NO: 535809 - RNA, 22 nt, Human
guguauaaugcuguuuguacau

SEQ ID NO: 535810 - RNA, 21 nt, Human
aagccagcccacagugguuug

SEQ ID NO: 535811 - RNA, 22 nt, Human
ucagaggacagcagcuaaauaa

SEQ ID NO: 535812 - RNA, 22 nt, Human
caaaguuuggcucucaugacau

SEQ ID NO: 535813 - RNA, 22 nt, Human
uguuccuguacugcuguggcuu

SEQ ID NO: 535814 - RNA, 22 nt, Human
auauaaguguguggcuguuagu

SEQ ID NO: 535815 - RNA, 22 nt, Human
agugcaaaaaaguguugugaca

SEQ ID NO: 535816 - RNA, 22 nt, Human
agccaggcugcaguuggcuggc

SEQ ID NO: 535817 - RNA, 22 nt, Human
agucaguugcaaacaucaggca

SEQ ID NO: 535818 - RNA, 22 nt, Human
ugugaaauugagaaacuuucac

SEQ ID NO: 535819 - RNA, 22 nt, Human
gccucacugcagccccaggaag

SEQ ID NO: 535820 - RNA, 22 nt, Human
agcuggugcucaggggcaugga

SEQ ID NO: 535821 - RNA, 19 nt, Human
gcugugccccugccgcuug

SEQ ID NO: 535822 - RNA, 22 nt, Human
uguuuuaagagcgcacuuuaua

SEQ ID NO: 535823 - RNA, 22 nt, Human
ugagaagcagcuuacagguguc

SEQ ID NO: 535824 - RNA, 22 nt, Human
aauguacaauaagacaaagagg

SEQ ID NO: 535825 - RNA, 22 nt, Human
ccuucaaaacacuaguuuuuga

SEQ ID NO: 535826 - RNA, 22 nt, Human
cagacaugagauacagcugcua

SEQ ID NO: 535827 - RNA, 22 nt, Human
cucuguccuugcacaguuccua

SEQ ID NO: 535828 - RNA, 22 nt, Human
uugauacagcagccugugaucc

SEQ ID NO: 535829 - RNA, 17 nt, Human
cacuuuguugcuguggg

SEQ ID NO: 535830 - RNA, 22 nt, Human
auuguggcuagacagucacaau

SEQ ID NO: 535831 - RNA, 22 nt, Human
cagcccugccauggagccuccu

SEQ ID NO: 535832 - RNA, 22 nt, Human
cauuuguauguuccuccuuagg

SEQ ID NO: 535833 - RNA, 22 nt, Human
cugggcuuucaggcccuaaggc

SEQ ID NO: 535834 - RNA, 22 nt, Human
uuucuucauugaugucaggugg

SEQ ID NO: 535835 - RNA, 17 nt, Human
ggaaaaggaugauacag

SEQ ID NO: 535836 - RNA, 22 nt, Human
ugugugacccccagugaagccu

SEQ ID NO: 535837 - RNA, 22 nt, Human
aucccaugagaccacguuggcu

SEQ ID NO: 535838 - RNA, 23 nt, Human
cauggcagcaagagcucauggcc

SEQ ID NO: 535839 - RNA, 22 nt, Human
uggagccaugccuggccuuucc

SEQ ID NO: 535840 - RNA, 22 nt, Human
ucugugaaaggaaagaacugac

SEQ ID NO: 535841 - RNA, 22 nt, Human
cuccucuggcuuccuggaggca

SEQ ID NO: 535842 - RNA, 22 nt, Human
ucagcaacuauuuaucaaauuc

SEQ ID NO: 535843 - RNA, 22 nt, Human
uguucuaaauuugcauggucca

SEQ ID NO: 535844 - RNA, 22 nt, Human
ccagagccucuuaugaagaucg

SEQ ID NO: 535845 - RNA, 22 nt, Human
cagcagagaaauuaaacuucug

SEQ ID NO: 535846 - RNA, 22 nt, Human
guccugggaaggaagccaggga

SEQ ID NO: 535847 - RNA, 20 nt, Human
ccaggccugggccugcucua

SEQ ID NO: 535848 - RNA, 22 nt, Human
acaucuuuuuggaaacggcuga

SEQ ID NO: 535849 - RNA, 22 nt, Human
cccagcaucccagugggcagca

SEQ ID NO: 535850 - RNA, 22 nt, Human
uuguacuugccauagaacaaca

SEQ ID NO: 535851 - RNA, 22 nt, Human
cagaauuugaaguaauauucca

SEQ ID NO: 535852 - RNA, 22 nt, Human
aaagaaggggucuacauccaau

SEQ ID NO: 535853 - RNA, 22 nt, Human
ccagcuggugggucuuucucug

SEQ ID NO: 535854 - RNA, 22 nt, Human
cacaugggugugccuggaggaa

SEQ ID NO: 535855 - RNA, 22 nt, Human
ucagauggauucauuacaugac

SEQ ID NO: 535856 - RNA, 22 nt, Human
aaaaaugaaacggcugguuggc

SEQ ID NO: 535857 - RNA, 22 nt, Human
acucacagucccuguaggagug

SEQ ID NO: 535858 - RNA, 22 nt, Human
uaaagcaggugcucagugacca

SEQ ID NO: 535859 - RNA, 22 nt, Human
ucagaggagccaaaguucugag

SEQ ID NO: 535860 - RNA, 20 nt, Human
cagaccugcacccacuucga

SEQ ID NO: 535861 - RNA, 17 nt, Human
ugagaaguaggcaucau

SEQ ID NO: 535862 - RNA, 22 nt, Human
acuaacauguuaaucaaaagaa

SEQ ID NO: 535863 - RNA, 22 nt, Human
aaacaugagcauuucuguuuaa

SEQ ID NO: 535864 - RNA, 22 nt, Human
gggaagugaggagccccucugc

SEQ ID NO: 535865 - RNA, 22 nt, Human
caucuucaggggcuacaucugu

SEQ ID NO: 535866 - RNA, 22 nt, Human
uccuccugcuguuagucuugaa

SEQ ID NO: 535867 - RNA, 22 nt, Human
aggcuguccucucuugcucagu

SEQ ID NO: 535868 - RNA, 22 nt, Human
ucucuggggauggaccugggag

SEQ ID NO: 535869 - RNA, 22 nt, Human
gagaaagggauaauuugaagag

SEQ ID NO: 535870 - RNA, 22 nt, Human
ccuggagugacagguguagccu

SEQ ID NO: 535871 - RNA, 22 nt, Human
cugagagccuccuguuggcuag

SEQ ID NO: 535872 - RNA, 22 nt, Human
ugugaaaagggcuuuguacaaa

SEQ ID NO: 535873 - RNA, 22 nt, Human
ucagcuggagaugagaaccgaa

SEQ ID NO: 535874 - RNA, 22 nt, Human
gagcacagcuggagguagcauu

SEQ ID NO: 535875 - RNA, 22 nt, Human
acauauguuguaaacauuccaa

SEQ ID NO: 535876 - RNA, 22 nt, Human
uggcacaguccugggugccugc

SEQ ID NO: 535877 - RNA, 22 nt, Human
gggaggaaggcuugggugagua

SEQ ID NO: 535878 - RNA, 22 nt, Human
cuuauguacacacauauauugu

SEQ ID NO: 535879 - RNA, 22 nt, Human
cagggcuggguuaaaagcaggg

SEQ ID NO: 535880 - RNA, 22 nt, Human
acucuguguuuugguggcagca

SEQ ID NO: 535881 - RNA, 22 nt, Human
ggcucugcugguaagaugccuc

SEQ ID NO: 535882 - RNA, 22 nt, Human
guguggggucuucucuuggccu

SEQ ID NO: 535883 - RNA, 22 nt, Human
acaaauuaccauggaauuuggg

SEQ ID NO: 535884 - RNA, 22 nt, Human
ugugacaucgcugugucuguuu

SEQ ID NO: 535885 - RNA, 22 nt, Human
uucuuuccccauggaguucgga

SEQ ID NO: 535886 - RNA, 22 nt, Human
ucucugggauaaacugggccag

SEQ ID NO: 535887 - RNA, 22 nt, Human
gugcucaggaagcuguuccugc

SEQ ID NO: 535888 - RNA, 21 nt, Human
caaauacuuagaaacuuaaga

SEQ ID NO: 535889 - RNA, 22 nt, Human
gcuguucacauuuugggccaaa

SEQ ID NO: 535890 - RNA, 22 nt, Human
auguuuuauuaccaacuuguac

SEQ ID NO: 535891 - RNA, 22 nt, Human
uaaggcaccuguccaggcuggg

SEQ ID NO: 535892 - RNA, 22 nt, Human
uagaaacaaagaccugggugcu

SEQ ID NO: 535893 - RNA, 22 nt, Human
gccagagcaugcacugccugca

SEQ ID NO: 535894 - RNA, 22 nt, Human
cugagcacugggcacauagcug

SEQ ID NO: 535895 - RNA, 22 nt, Human
acugugugggccgcucacuggg

SEQ ID NO: 535896 - RNA, 22 nt, Human
aaggcugugucagaagcucccu

SEQ ID NO: 535897 - RNA, 22 nt, Human
ucucagaguaauucuuuaaggu

SEQ ID NO: 535898 - RNA, 22 nt, Human
aaacauuguaauuuuagcaugg

SEQ ID NO: 535899 - RNA, 21 nt, Human
ugcagaggcacaaacaagccc

SEQ ID NO: 535900 - RNA, 22 nt, Human
cagaaucugagucgugauugua

SEQ ID NO: 535901 - RNA, 22 nt, Human
gacuucugagcuauccagcugu

SEQ ID NO: 535902 - RNA, 22 nt, Human
ccagaggugccacagaaagagc

SEQ ID NO: 535903 - RNA, 22 nt, Human
uguaugaaugggaaaaggaaac

SEQ ID NO: 535904 - RNA, 19 nt, Human
ggagccuggagcacgugcc

SEQ ID NO: 535905 - RNA, 22 nt, Human
uuucuuaggcucuaaaaugacu

SEQ ID NO: 535906 - RNA, 22 nt, Human
aggauuugcacugguguuugag

SEQ ID NO: 535907 - RNA, 22 nt, Human
gagggugggcuccuaucugggu

SEQ ID NO: 535908 - RNA, 22 nt, Human
uucuuucccaguagaugugaaa

SEQ ID NO: 535909 - RNA, 22 nt, Human
ucaggaagugguaaaggauguu

SEQ ID NO: 535910 - RNA, 20 nt, Human
caagcccucuuuagccugcc

SEQ ID NO: 535911 - RNA, 22 nt, Human
cucaggaugcaggucacaggac

SEQ ID NO: 535912 - RNA, 22 nt, Human
aaauaauuauagcgagucuauc

SEQ ID NO: 535913 - RNA, 21 nt, Human
ggcccugguuacgccuccucu

SEQ ID NO: 535914 - RNA, 22 nt, Human
uagacagauuuaaaggaaugga

SEQ ID NO: 535915 - RNA, 22 nt, Human
aauuagggaaguauuuaguagu

SEQ ID NO: 535916 - RNA, 19 nt, Human
ggcuggcaagugacagugu

SEQ ID NO: 535917 - RNA, 22 nt, Human
ggccugaggccaccagcagccc

SEQ ID NO: 535918 - RNA, 22 nt, Human
acaaagugcacaagaugagaac

SEQ ID NO: 535919 - RNA, 19 nt, Human
uggcuaauuuuauagaggc

SEQ ID NO: 535920 - RNA, 22 nt, Human
ugcuugucacauacaggagcau

SEQ ID NO: 535921 - RNA, 22 nt, Human
caaaguuuaaaguagauuucag

SEQ ID NO: 535922 - RNA, 21 nt, Human
auacacauacacauaaaugug

SEQ ID NO: 535923 - RNA, 22 nt, Human
uuuguugacaucccuguacuuu

SEQ ID NO: 535924 - RNA, 22 nt, Human
gaagacauuuuaugcauacucu

SEQ ID NO: 535925 - RNA, 22 nt, Human
aaguccaguuuuuccagguggu

SEQ ID NO: 535926 - RNA, 22 nt, Human
ugaacagaucaauagaacugac

SEQ ID NO: 535927 - RNA, 22 nt, Human
auuuauuaugggauuuggcaca

SEQ ID NO: 535928 - RNA, 22 nt, Human
gcugaaaugucuuuagcagugu

SEQ ID NO: 535929 - RNA, 22 nt, Human
agcagcuguggggacaagggua

SEQ ID NO: 535930 - RNA, 22 nt, Human
uucucauggugucuuuauacau

SEQ ID NO: 535931 - RNA, 22 nt, Human
ccugucucuguuaccacauuug

SEQ ID NO: 535932 - RNA, 22 nt, Human
ugaacccaggagguugcaguga

SEQ ID NO: 535933 - RNA, 20 nt, Human
cugggcagguguuugaucuc

SEQ ID NO: 535934 - RNA, 21 nt, Human
guuuucuuugauagagggaag

SEQ ID NO: 535935 - RNA, 22 nt, Human
auugaaagagaauguagcucuu

SEQ ID NO: 535936 - RNA, 22 nt, Human
caggagcaguuagaagcccacu

SEQ ID NO: 535937 - RNA, 22 nt, Human
ugagcuuacgugggaacagacu

SEQ ID NO: 535938 - RNA, 22 nt, Human
caucugcuguuccuuggacuca

SEQ ID NO: 535939 - RNA, 22 nt, Human
gccaagagaaugugagagaaau

SEQ ID NO: 535940 - RNA, 22 nt, Human
ggggaggcugaugugggcaaag

SEQ ID NO: 535941 - RNA, 22 nt, Human
acaggagugaaucuggcacuua

SEQ ID NO: 535942 - RNA, 22 nt, Human
cugagaaaauuucaggaagugu

SEQ ID NO: 535943 - RNA, 22 nt, Human
ucaucuuuccucaaaagaucca

SEQ ID NO: 535944 - RNA, 22 nt, Human
agaaacuaaccugguaggguuc

SEQ ID NO: 535945 - RNA, 22 nt, Human
gacaggaagucugaaggaggga

SEQ ID NO: 535946 - RNA, 22 nt, Human
aaggagucucagcugggccuga

SEQ ID NO: 535947 - RNA, 22 nt, Human
gcugagguggcugccuuaguaa

SEQ ID NO: 535948 - RNA, 22 nt, Human
uucuuuccacagaggggaugau

SEQ ID NO: 535949 - RNA, 22 nt, Human
caaagauaugacauggaaaaug

SEQ ID NO: 535950 - RNA, 22 nt, Human
uaacauuuagaaaguguccauu

SEQ ID NO: 535951 - RNA, 22 nt, Human
uucaaugagcccggggccauag

SEQ ID NO: 535952 - RNA, 22 nt, Human
uucaggccuaauuucuagcccc

SEQ ID NO: 535953 - RNA, 22 nt, Human
aggaaccuaagagccugcaguc

SEQ ID NO: 535954 - RNA, 21 nt, Human
gcccucaggggaggauggccu

SEQ ID NO: 535955 - RNA, 22 nt, Human
uuuaccagaauugccaccagaa

SEQ ID NO: 535956 - RNA, 22 nt, Human
acagagagaauuggguuuacag

SEQ ID NO: 535957 - RNA, 22 nt, Human
cacugguguauuagagcuagaa

SEQ ID NO: 535958 - RNA, 22 nt, Human
uggaaagaauuccuaugguuca

SEQ ID NO: 535959 - RNA, 22 nt, Human
uugcugaagugaagguauguuu

SEQ ID NO: 535960 - RNA, 22 nt, Human
accugucuauaaaagugaauac

SEQ ID NO: 535961 - RNA, 22 nt, Human
ucagagugggagaaugugccaa

SEQ ID NO: 535962 - RNA, 22 nt, Human
aguggcagagaccccagccagc

SEQ ID NO: 535963 - RNA, 19 nt, Human
agaggcagucuccaacagg

SEQ ID NO: 535964 - RNA, 22 nt, Human
ucaaaaauuuucugaggaugag

SEQ ID NO: 535965 - RNA, 22 nt, Human
cucuggagugcagccugguggc

SEQ ID NO: 535966 - RNA, 19 nt, Human
cccagcuugaccaccugcu

SEQ ID NO: 535967 - RNA, 22 nt, Human
uggccugacugucaggcuguau

SEQ ID NO: 535968 - RNA, 22 nt, Human
gaauaugaacuauuccuagccc

SEQ ID NO: 535969 - RNA, 22 nt, Human
cuugccuagguguauauuaaau

SEQ ID NO: 535970 - RNA, 22 nt, Human
auuauucagucuuguaaggagu

SEQ ID NO: 535971 - RNA, 22 nt, Human
aauuucuccaagaaugcuuaga

SEQ ID NO: 535972 - RNA, 22 nt, Human
ggcugcaagcaugcacagauac

SEQ ID NO: 535973 - RNA, 22 nt, Human
uccaauuuguuugaugauggaa

SEQ ID NO: 535974 - RNA, 22 nt, Human
gaggccugguagccgagcccca

SEQ ID NO: 535975 - RNA, 22 nt, Human
uuccuuaauaucccuuuuggaa

SEQ ID NO: 535976 - RNA, 22 nt, Human
uccugguggcuuucccugccuu

SEQ ID NO: 535977 - RNA, 22 nt, Human
caccuaggguuucgccuuucuu

SEQ ID NO: 535978 - RNA, 22 nt, Human
guuucaaaggugucaggcaguu

SEQ ID NO: 535979 - RNA, 23 nt, Human
auuuacagguuaaaugaaaucag

SEQ ID NO: 535980 - RNA, 22 nt, Human
ugcacacauguuuacaagcauc

SEQ ID NO: 535981 - RNA, 22 nt, Human
ucucacugggucacagcagagg

SEQ ID NO: 535982 - RNA, 22 nt, Human
gaauaacagcaaguuugcaggc

SEQ ID NO: 535983 - RNA, 22 nt, Human
uaugcacgucuauuuaugaaga

SEQ ID NO: 535984 - RNA, 22 nt, Human
caagaucaaggugucagcaggu

SEQ ID NO: 535985 - RNA, 22 nt, Human
caagaucaagguaucagcagau

SEQ ID NO: 535986 - RNA, 22 nt, Human
aauagguagccagauauauaaa

SEQ ID NO: 535987 - RNA, 22 nt, Human
cuccaggccauggcugcggagg

SEQ ID NO: 535988 - RNA, 19 nt, Human
aguggcagaucuggaagua

SEQ ID NO: 535989 - RNA, 22 nt, Human
ucuuuuccuucccuacagaucu

SEQ ID NO: 535990 - RNA, 22 nt, Human
agccugguguggggcugcagag

SEQ ID NO: 535991 - RNA, 18 nt, Human
aggaaagaaaggcaggug

SEQ ID NO: 535992 - RNA, 22 nt, Human
auauaucaugaguaaaacuuga

SEQ ID NO: 535993 - RNA, 22 nt, Human
cuggcucucugagauauugagu

SEQ ID NO: 535994 - RNA, 22 nt, Human
ggcugagugcugcuguucacga

SEQ ID NO: 535995 - RNA, 22 nt, Human
uggcuggcccugggagugcaga

SEQ ID NO: 535996 - RNA, 22 nt, Human
acagcuuuguuuucccugcuga

SEQ ID NO: 535997 - RNA, 22 nt, Human
aagauuucuuacuuauugaugc

SEQ ID NO: 535998 - RNA, 22 nt, Human
gagcagaacuacucacauaucg

SEQ ID NO: 535999 - RNA, 22 nt, Human
ucagaagagcuggugcugccug

SEQ ID NO: 536000 - RNA, 21 nt, Human
ucccaagaauaugcauaaguu

SEQ ID NO: 536001 - RNA, 22 nt, Human
uuacaaacaagaucuuauucuu

SEQ ID NO: 536002 - RNA, 22 nt, Human
uuguaagacuguagaaugcaaa

SEQ ID NO: 536003 - RNA, 23 nt, Human
ucucccugagguuguuagcauua

SEQ ID NO: 536004 - RNA, 22 nt, Human
auuucuuuucaagagggugcuu

SEQ ID NO: 536005 - RNA, 19 nt, Human
uggggcuguguuuugaccc

SEQ ID NO: 536006 - RNA, 22 nt, Human
uugggggaagaggauagacagu

SEQ ID NO: 536007 - RNA, 22 nt, Human
ugggcacuauggcucugugcac

SEQ ID NO: 536008 - RNA, 22 nt, Human
ugucccagcacuuugggagucu

SEQ ID NO: 536009 - RNA, 22 nt, Human
cucagaauuaauaaccacaagg

SEQ ID NO: 536010 - RNA, 22 nt, Human
uagcaaaaacugcaguuacuuu

SEQ ID NO: 536011 - RNA, 22 nt, Human
gauuucuucauuuguggugaau

SEQ ID NO: 536012 - RNA, 22 nt, Human
aguguucauuuauucauucacu

SEQ ID NO: 536013 - RNA, 22 nt, Human
uguuucuugauaaagcagaaaa

SEQ ID NO: 536014 - RNA, 22 nt, Human
uauaaagcugacucaugaaacu

SEQ ID NO: 536015 - RNA, 22 nt, Human
uaaauucccaacucugcucuuc

SEQ ID NO: 536016 - RNA, 22 nt, Human
agaaggccuaacuugggggcaa

SEQ ID NO: 536017 - RNA, 22 nt, Human
aaggccaggacaccaggggacu

SEQ ID NO: 536018 - RNA, 23 nt, Human
gccucugcucugcguuggggacu

SEQ ID NO: 536019 - RNA, 22 nt, Human
uucuucuuuccuauaauuaauu

SEQ ID NO: 536020 - RNA, 22 nt, Human
cucucuggcuuggcacggagau

SEQ ID NO: 536021 - RNA, 23 nt, Human
acacugucucauggauagacugc

SEQ ID NO: 536022 - RNA, 22 nt, Human
ucacaucauggagaauuauggg

SEQ ID NO: 536023 - RNA, 22 nt, Human
agcaggaacgaguucaugggga

SEQ ID NO: 536024 - RNA, 22 nt, Human
uguaggauuuucaccagaccuu

SEQ ID NO: 536025 - RNA, 22 nt, Human
caaaugcaggucauaaccugag

SEQ ID NO: 536026 - RNA, 20 nt, Human
guucacaggcuuccuuucag

SEQ ID NO: 536027 - RNA, 22 nt, Human
gagcugcagacauagauaagcg

SEQ ID NO: 536028 - RNA, 22 nt, Human
agggaguuagaaauccaggaua

SEQ ID NO: 536029 - RNA, 22 nt, Human
aaguggugguaugaaccgaggg

SEQ ID NO: 536030 - RNA, 22 nt, Human
cagugcauagauccugaggccu

SEQ ID NO: 536031 - RNA, 22 nt, Human
uuauuuauggcccucaccugau

SEQ ID NO: 536032 - RNA, 22 nt, Human
uccuggcuuuucuuggcucauc

SEQ ID NO: 536033 - RNA, 22 nt, Human
ccagcugguguuccuuaggacc

SEQ ID NO: 536034 - RNA, 22 nt, Human
uuacacagugaauuuacucaag

SEQ ID NO: 536035 - RNA, 19 nt, Human
gagcagcugcacccauuga

SEQ ID NO: 536036 - RNA, 22 nt, Human
gaagccaacauuccaaguagaa

SEQ ID NO: 536037 - RNA, 22 nt, Human
uagaaaggauauugagaugaau

SEQ ID NO: 536038 - RNA, 22 nt, Human
ucuguagcaagugagaggcauu

SEQ ID NO: 536039 - RNA, 22 nt, Human
gcagccagguuugaggaccacu

SEQ ID NO: 536040 - RNA, 22 nt, Human
ugcaggccucacaccuggcacc

SEQ ID NO: 536041 - RNA, 22 nt, Human
uacauuguuuuuucuugccauc

SEQ ID NO: 536042 - RNA, 22 nt, Human
aggagccagaauccagacucgg

SEQ ID NO: 536043 - RNA, 22 nt, Human
uccuucagggggccgccugcac

SEQ ID NO: 536044 - RNA, 22 nt, Human
uagggacaaagagcugaggccu

SEQ ID NO: 536045 - RNA, 22 nt, Human
cucucccuggccagcugugcag

SEQ ID NO: 536046 - RNA, 21 nt, Human
guuuguaaggcacuguguucu

SEQ ID NO: 536047 - RNA, 22 nt, Human
gccugcuguugagggaagagcu

SEQ ID NO: 536048 - RNA, 22 nt, Human
ugagccugggagauggaggcug

SEQ ID NO: 536049 - RNA, 22 nt, Human
cuggcagcugcccgagaugccc

SEQ ID NO: 536050 - RNA, 22 nt, Human
agugcacuggcaccaucucagc

SEQ ID NO: 536051 - RNA, 22 nt, Human
ggagacucggguucuagccuug

SEQ ID NO: 536052 - RNA, 22 nt, Human
ccagagcccgggaccuggacuu

SEQ ID NO: 536053 - RNA, 22 nt, Human
agucccuucucaaagugugcgg

SEQ ID NO: 536054 - RNA, 22 nt, Human
accagagauggggcuucucugu

SEQ ID NO: 536055 - RNA, 22 nt, Human
uguauacaagucguguaaacuu

SEQ ID NO: 536056 - RNA, 22 nt, Human
ugcuuuauaggggauugcaggc

SEQ ID NO: 536057 - RNA, 22 nt, Human
ucuguucaguugauguaguuuu

SEQ ID NO: 536058 - RNA, 22 nt, Human
ugaaaguuacaggaaaacagau

SEQ ID NO: 536059 - RNA, 22 nt, Human
uuccucaugggguuccuucaga

SEQ ID NO: 536060 - RNA, 22 nt, Human
agucccagugagaugagccacg

SEQ ID NO: 536061 - RNA, 22 nt, Human
cugagggcaugaacauuccaua

SEQ ID NO: 536062 - RNA, 22 nt, Human
cagcuuuuuagaaucuagggca

SEQ ID NO: 536063 - RNA, 22 nt, Human
gcccucuggcagccuuggcugg

SEQ ID NO: 536064 - RNA, 22 nt, Human
agcccugggaggccagcuugua

SEQ ID NO: 536065 - RNA, 22 nt, Human
gcagcccagguguagcucuuug

SEQ ID NO: 536066 - RNA, 19 nt, Human
ugaagcagcaaacucucag

SEQ ID NO: 536067 - RNA, 22 nt, Human
cuggcauguguuuggcuccugu

SEQ ID NO: 536068 - RNA, 18 nt, Human
uggaggaaucacaauggc

SEQ ID NO: 536069 - RNA, 22 nt, Human
gaggaacagcagccacaugucc

SEQ ID NO: 536070 - RNA, 20 nt, Human
ugaugguucuuuccggguug

SEQ ID NO: 536071 - RNA, 22 nt, Human
gugcaguggcagauccuagcuc

SEQ ID NO: 536072 - RNA, 22 nt, Human
guaaauaacugguaauuggggu

SEQ ID NO: 536073 - RNA, 22 nt, Human
caaauucucaagguuuauccca

SEQ ID NO: 536074 - RNA, 22 nt, Human
gcuguggccaacaaaccacuuu

SEQ ID NO: 536075 - RNA, 22 nt, Human
ucuuagaaauuccccaguggcu

SEQ ID NO: 536076 - RNA, 22 nt, Human
gggcaagcucuucagaagcucu

SEQ ID NO: 536077 - RNA, 21 nt, Human
uccucagggccccagagcacu

SEQ ID NO: 536078 - RNA, 21 nt, Human
agagacugucacugcaguacc

SEQ ID NO: 536079 - RNA, 22 nt, Human
cauuuauucaugaucuguagcu

SEQ ID NO: 536080 - RNA, 18 nt, Human
ugcuuuaugcuuauauaa

SEQ ID NO: 536081 - RNA, 22 nt, Human
uuuagggaugucagaacaggga

SEQ ID NO: 536082 - RNA, 22 nt, Human
aaauauguauggaguucaugaa

SEQ ID NO: 536083 - RNA, 22 nt, Human
ggcagauguuauaugaucugag

SEQ ID NO: 536084 - RNA, 22 nt, Human
aggacagaccuaggacuggagc

SEQ ID NO: 536085 - RNA, 22 nt, Human
gccuggcaguguaauuccuguc

SEQ ID NO: 536086 - RNA, 22 nt, Human
cugccugcaugcugccauagcu

SEQ ID NO: 536087 - RNA, 23 nt, Human
aaggucacagaacuuagcaagcc

SEQ ID NO: 536088 - RNA, 22 nt, Human
ccaggcucugcaaaaucaggcu

SEQ ID NO: 536089 - RNA, 22 nt, Human
caggcuuuuucugcuguccucu

SEQ ID NO: 536090 - RNA, 22 nt, Human
aauguacaaaccuucuuuguag

SEQ ID NO: 536091 - RNA, 22 nt, Human
auuuugugaacccucaagcaau

SEQ ID NO: 536092 - RNA, 22 nt, Human
agguaacacuacuuaguauacu

SEQ ID NO: 536093 - RNA, 22 nt, Human
cugcuuugcauagcugccagag

SEQ ID NO: 536094 - RNA, 22 nt, Human
ggaaggcuccacccaaggcgag

SEQ ID NO: 536095 - RNA, 22 nt, Human
aaaauaugaaguugucaguaug

SEQ ID NO: 536096 - RNA, 22 nt, Human
cagggcucccucuggcucccag

SEQ ID NO: 536097 - RNA, 17 nt, Human
uggcacagaggugcuau

SEQ ID NO: 536098 - RNA, 20 nt, Human
aggcacuguugucuguaucc

SEQ ID NO: 536099 - RNA, 22 nt, Human
cagaacauuccaugugcccugc

SEQ ID NO: 536100 - RNA, 22 nt, Human
gggaaggaaaguuauuagcaga

SEQ ID NO: 536101 - RNA, 22 nt, Human
gccagguguccucacagugagg

SEQ ID NO: 536102 - RNA, 22 nt, Human
cauucacagagggggaagcauc

SEQ ID NO: 536103 - RNA, 22 nt, Human
uccugagaggugugaggugcag

SEQ ID NO: 536104 - RNA, 22 nt, Human
agccacagcuccuugguggaga

SEQ ID NO: 536105 - RNA, 22 nt, Human
acaggggaauuuacugucauua

SEQ ID NO: 536106 - RNA, 22 nt, Human
gcuuacaaacaacagaaauuaa

SEQ ID NO: 536107 - RNA, 22 nt, Human
cagucuucuaaccuagcagccu

SEQ ID NO: 536108 - RNA, 22 nt, Human
cucuccuccaacagcccugccg

SEQ ID NO: 536109 - RNA, 22 nt, Human
gcagggagguuugcugaccugg

SEQ ID NO: 536110 - RNA, 22 nt, Human
auucuagaugcuguaaguagca

SEQ ID NO: 536111 - RNA, 22 nt, Human
uugcauuccaguccccacugug

SEQ ID NO: 536112 - RNA, 22 nt, Human
accagagaaaacacagcaggcu

SEQ ID NO: 536113 - RNA, 22 nt, Human
cagcuuuaccaauauuuggaaa

SEQ ID NO: 536114 - RNA, 22 nt, Human
ucccugccugacagcacccacc

SEQ ID NO: 536115 - RNA, 22 nt, Human
uacaaaugaccauagccacuua

SEQ ID NO: 536116 - RNA, 22 nt, Human
cugagccaugagccugcgccca

SEQ ID NO: 536117 - RNA, 22 nt, Human
auucuuuccagacacugauugc

SEQ ID NO: 536118 - RNA, 20 nt, Human
augugaaagaucaguugucu

SEQ ID NO: 536119 - RNA, 22 nt, Human
ggagaugguggaagcuggugca

SEQ ID NO: 536120 - RNA, 22 nt, Human
cccagagccucauucuguuggg

SEQ ID NO: 536121 - RNA, 22 nt, Human
uugaaaggugaacaugaugcac

SEQ ID NO: 536122 - RNA, 22 nt, Human
agguggagacccagagaaggcg

SEQ ID NO: 536123 - RNA, 22 nt, Human
ccuuuucuaggaugcuuuauag

SEQ ID NO: 536124 - RNA, 23 nt, Human
acucacaaagcaggaucauguug

SEQ ID NO: 536125 - RNA, 22 nt, Human
gggcccuggggauguggacgcg

SEQ ID NO: 536126 - RNA, 22 nt, Human
cuaggcuguucaugcucagacc

SEQ ID NO: 536127 - RNA, 22 nt, Human
aguguuaacaugaaugguuucc

SEQ ID NO: 536128 - RNA, 22 nt, Human
gcugucagaaggugaaggguaa

SEQ ID NO: 536129 - RNA, 22 nt, Human
accauuuaauaaguauuuccau

SEQ ID NO: 536130 - RNA, 21 nt, Human
uuaauuuauucaugauagcua

SEQ ID NO: 536131 - RNA, 22 nt, Human
uucugccuuacgauauuuucaa

SEQ ID NO: 536132 - RNA, 22 nt, Human
uuguuuuuaaacaugugacuga

SEQ ID NO: 536133 - RNA, 22 nt, Human
ugaggcagaguaagauacauga

SEQ ID NO: 536134 - RNA, 22 nt, Human
cauuucacgcacacucauuacu

SEQ ID NO: 536135 - RNA, 21 nt, Human
ccuucucuugcuucagcuuca

SEQ ID NO: 536136 - RNA, 21 nt, Human
gauugaaaccauggcagugag

SEQ ID NO: 536137 - RNA, 22 nt, Human
agggccugagcuggcugaccuc

SEQ ID NO: 536138 - RNA, 17 nt, Human
ccaggcuccaucacugu

SEQ ID NO: 536139 - RNA, 22 nt, Human
acuuguuugccuaaaauuuuga

SEQ ID NO: 536140 - RNA, 22 nt, Human
ggugagaggccugagagcugga

SEQ ID NO: 536141 - RNA, 22 nt, Human
ugcaaagaugaaauauuaaagg

SEQ ID NO: 536142 - RNA, 22 nt, Human
gaacacuuggcuuuggauuuaa

SEQ ID NO: 536143 - RNA, 22 nt, Human
gcugccugccugcauuuaaucc

SEQ ID NO: 536144 - RNA, 22 nt, Human
cccagacucaucccugggagcu

SEQ ID NO: 536145 - RNA, 20 nt, Human
gauacacagcacagagggcc

SEQ ID NO: 536146 - RNA, 22 nt, Human
aggagggcuaggaaaaccagga

SEQ ID NO: 536147 - RNA, 22 nt, Human
gaggggcucuugggcaugaagg

SEQ ID NO: 536148 - RNA, 22 nt, Human
cagcagagcuuauguuggguca

SEQ ID NO: 536149 - RNA, 22 nt, Human
cucacuguccaacaggcuuuac

SEQ ID NO: 536150 - RNA, 22 nt, Human
cuauuuguacagcauucgaguu

SEQ ID NO: 536151 - RNA, 16 nt, Human
ccuuuucucaucucua

SEQ ID NO: 536152 - RNA, 22 nt, Human
accugugcacagucagcccugg

SEQ ID NO: 536153 - RNA, 20 nt, Human
guggccuguccuguuguggg

SEQ ID NO: 536154 - RNA, 22 nt, Human
ugggcuucuggaguggggcaga

SEQ ID NO: 536155 - RNA, 22 nt, Human
gaaggagagagacaucgucccu

SEQ ID NO: 536156 - RNA, 22 nt, Human
uuccaagugggggaagcugagu

SEQ ID NO: 536157 - RNA, 22 nt, Human
cgcugauaaacgucacguuccc

SEQ ID NO: 536158 - RNA, 19 nt, Human
ugaguucugugguucucaa

SEQ ID NO: 536159 - RNA, 22 nt, Human
aacaaguuacucuuaaaguaua

SEQ ID NO: 536160 - RNA, 22 nt, Human
cccaggaggcagagguugcagu

SEQ ID NO: 536161 - RNA, 22 nt, Human
guggguggaggcgucgagggca

SEQ ID NO: 536162 - RNA, 22 nt, Human
ugaaacuugaguauauauggau

SEQ ID NO: 536163 - RNA, 22 nt, Human
gccugucugcgucacgcuuauu

SEQ ID NO: 536164 - RNA, 22 nt, Human
ucuccaggaagcccucccugac

SEQ ID NO: 536165 - RNA, 22 nt, Human
ugggacaguuguccuccacucu

SEQ ID NO: 536166 - RNA, 22 nt, Human
ugugugccugagccgugccugg

SEQ ID NO: 536167 - RNA, 22 nt, Human
uuacauaacgguaugaaaaaug

SEQ ID NO: 536168 - RNA, 22 nt, Human
uaauuuaugaugcaaagaaaag

SEQ ID NO: 536169 - RNA, 22 nt, Human
gaagguccagcguggccaaguc

SEQ ID NO: 536170 - RNA, 22 nt, Human
cugcugaggccuucccuguccu

SEQ ID NO: 536171 - RNA, 22 nt, Human
aggcacugaaggaagcuugcgc

SEQ ID NO: 536172 - RNA, 22 nt, Human
gcucuguccagcgugcacagaa

SEQ ID NO: 536173 - RNA, 22 nt, Human
ggugagaggcagugcuguggaa

SEQ ID NO: 536174 - RNA, 22 nt, Human
ugacagaaagaauaugucaauc

SEQ ID NO: 536175 - RNA, 22 nt, Human
caugagauaauuuuucuccagu

SEQ ID NO: 536176 - RNA, 18 nt, Human
uagagggggccugggcau

SEQ ID NO: 536177 - RNA, 22 nt, Human
ucugagaguagagcugccucuu

SEQ ID NO: 536178 - RNA, 22 nt, Human
ccagggcagugggagaaggugc

SEQ ID NO: 536179 - RNA, 22 nt, Human
auucagcauaaucaguagcuug

SEQ ID NO: 536180 - RNA, 22 nt, Human
ggugcaaguuuuuugaggaagu

SEQ ID NO: 536181 - RNA, 22 nt, Human
ugacagaaugugacucucagau

SEQ ID NO: 536182 - RNA, 22 nt, Human
cugaggagagaucacguggugu

SEQ ID NO: 536183 - RNA, 22 nt, Human
gucagaggggacaagacacaga

SEQ ID NO: 536184 - RNA, 22 nt, Human
uaacacuugaagccauuuuugc

SEQ ID NO: 536185 - RNA, 22 nt, Human
cagcugaagagaggugcugagu

SEQ ID NO: 536186 - RNA, 22 nt, Human
ugccauuucucaaauaugacua

SEQ ID NO: 536187 - RNA, 22 nt, Human
ggcaaaaaccauaauuacuuuu

SEQ ID NO: 536188 - RNA, 22 nt, Human
gcugggcugagcuagacuuggc

SEQ ID NO: 536189 - RNA, 22 nt, Human
auuuucauuuugcagggugaga

SEQ ID NO: 536190 - RNA, 22 nt, Human
uguaauggaagugggauugcau

SEQ ID NO: 536191 - RNA, 22 nt, Human
cgagcagaauggagggugccga

SEQ ID NO: 536192 - RNA, 22 nt, Human
caguguuuagcacagugcuugg

SEQ ID NO: 536193 - RNA, 22 nt, Human
acaguggaauggugggccugca

SEQ ID NO: 536194 - RNA, 22 nt, Human
gggcugagggguaucucauggg

SEQ ID NO: 536195 - RNA, 22 nt, Human
agcugaaucuugacuaggaaga

SEQ ID NO: 536196 - RNA, 22 nt, Human
ccagacccugcucuggggcucu

SEQ ID NO: 536197 - RNA, 22 nt, Human
ggcgaggccgggacaggcugga

SEQ ID NO: 536198 - RNA, 22 nt, Human
uuaugaaguuccuguuacagug

SEQ ID NO: 536199 - RNA, 22 nt, Human
uuguccaaggucccacaguuag

SEQ ID NO: 536200 - RNA, 22 nt, Human
acagcugugagggucacuugua

SEQ ID NO: 536201 - RNA, 20 nt, Human
uaggcagagcugugcagccu

SEQ ID NO: 536202 - RNA, 22 nt, Human
gaaggccaguuuugagauaggu

SEQ ID NO: 536203 - RNA, 22 nt, Human
ugaagccaucccucagauggcc

SEQ ID NO: 536204 - RNA, 19 nt, Human
gaguuauugccagggcaug

SEQ ID NO: 536205 - RNA, 22 nt, Human
agacagcauggagcugauaaca

SEQ ID NO: 536206 - RNA, 22 nt, Human
cagacuggccacaucugcacug

SEQ ID NO: 536207 - RNA, 19 nt, Human
ccagaggacuguuaaugaa

SEQ ID NO: 536208 - RNA, 22 nt, Human
uagcuggggcuuucauucuugc

SEQ ID NO: 536209 - RNA, 22 nt, Human
uucaggagcuggcugcgaagga

SEQ ID NO: 536210 - RNA, 22 nt, Human
ggcagggaaacagcugauccca

SEQ ID NO: 536211 - RNA, 22 nt, Human
cagaccugagguugaguaccag

SEQ ID NO: 536212 - RNA, 22 nt, Human
gcagcucugacaaugccuggaa

SEQ ID NO: 536213 - RNA, 22 nt, Human
auauguguauuugguuagccua

SEQ ID NO: 536214 - RNA, 22 nt, Human
gcuggacaggccacauggagga

SEQ ID NO: 536215 - RNA, 17 nt, Human
uccaggcauaucuccua

SEQ ID NO: 536216 - RNA, 19 nt, Human
augagcuggcauuucaggu

SEQ ID NO: 536217 - RNA, 22 nt, Human
cccaggccagaacuugguugcu

SEQ ID NO: 536218 - RNA, 22 nt, Human
uuucacaggggcaaccuccaug

SEQ ID NO: 536219 - RNA, 22 nt, Human
guuauaaaggugauaaugguca

SEQ ID NO: 536220 - RNA, 20 nt, Human
ucauugcacauaauggaagc

SEQ ID NO: 536221 - RNA, 22 nt, Human
ucuaaacagccucuuaccaacu

SEQ ID NO: 536222 - RNA, 22 nt, Human
ugaagccaaucugccaggcaga

SEQ ID NO: 536223 - RNA, 22 nt, Human
gcugauauaaaauuacagagga

SEQ ID NO: 536224 - RNA, 21 nt, Human
gagacagacuuucguccccug

SEQ ID NO: 536225 - RNA, 18 nt, Human
ggcggguguuuuauucac

SEQ ID NO: 536226 - RNA, 22 nt, Human
cucuggagguugagcccagcaa

SEQ ID NO: 536227 - RNA, 22 nt, Human
ugaaacaauuagaauguaauga

SEQ ID NO: 536228 - RNA, 19 nt, Human
gggaccugacuaauuggca

SEQ ID NO: 536229 - RNA, 22 nt, Human
cagagcaguggagaguaggucu

SEQ ID NO: 536230 - RNA, 22 nt, Human
aacuuucugucugagcugcaga

SEQ ID NO: 536231 - RNA, 22 nt, Human
cuggacaggcuggggacugcaa

SEQ ID NO: 536232 - RNA, 22 nt, Human
cagcugccaagaaucuuuucua

SEQ ID NO: 536233 - RNA, 22 nt, Human
auauuccauugguuucccuucu

SEQ ID NO: 536234 - RNA, 22 nt, Human
ugcaggugcugauaccuacucc

SEQ ID NO: 536235 - RNA, 22 nt, Human
auuauuagacuuauaugguagu

SEQ ID NO: 536236 - RNA, 22 nt, Human
ugauuuccuaggucuggagaag

SEQ ID NO: 536237 - RNA, 22 nt, Human
guuuuggcagccguguucacau

SEQ ID NO: 536238 - RNA, 17 nt, Human
ggccuuggggccucagu

SEQ ID NO: 536239 - RNA, 17 nt, Human
ccacagccuggcacuug

SEQ ID NO: 536240 - RNA, 22 nt, Human
cuuagaaauuguuacucauuca

SEQ ID NO: 536241 - RNA, 22 nt, Human
acauuucucaucuaguagagua

SEQ ID NO: 536242 - RNA, 22 nt, Human
aaaugcauaucaaagacuugaa

SEQ ID NO: 536243 - RNA, 22 nt, Human
cuucaagauauuucuagaauca

SEQ ID NO: 536244 - RNA, 21 nt, Human
ugccagcauuaaacagucauu

SEQ ID NO: 536245 - RNA, 22 nt, Human
auagacauuuugcauucaagca

SEQ ID NO: 536246 - RNA, 22 nt, Human
ggcaggcugggagucaucagag

SEQ ID NO: 536247 - RNA, 22 nt, Human
aaaugcaucagcucauaagaga

SEQ ID NO: 536248 - RNA, 22 nt, Human
agaggcugcacuugcucaugau

SEQ ID NO: 536249 - RNA, 22 nt, Human
caaaguauauuggauugaaugg

SEQ ID NO: 536250 - RNA, 23 nt, Human
ugggucagcugccuccaggacaa

SEQ ID NO: 536251 - RNA, 22 nt, Human
agauguguuucuaguuccugca

SEQ ID NO: 536252 - RNA, 22 nt, Human
gugcaugucggggugcauguca

SEQ ID NO: 536253 - RNA, 22 nt, Human
ugcaccauuuugucaggcuacu

SEQ ID NO: 536254 - RNA, 22 nt, Human
ucagagugugacuuggucauga

SEQ ID NO: 536255 - RNA, 22 nt, Human
ucaggccuggagaaaggaauga

SEQ ID NO: 536256 - RNA, 22 nt, Human
ucacacguccuugcuacuccuc

SEQ ID NO: 536257 - RNA, 22 nt, Human
cauagcaacagcaucaagucaa

SEQ ID NO: 536258 - RNA, 22 nt, Human
cuuucugaaagacauuuuaacu

SEQ ID NO: 536259 - RNA, 22 nt, Human
uacaaagauaguguuagaguaa

SEQ ID NO: 536260 - RNA, 20 nt, Human
uccuggccucccuggggcuc

SEQ ID NO: 536261 - RNA, 22 nt, Human
gcugcagccuucuugccauuaa

SEQ ID NO: 536262 - RNA, 22 nt, Human
cucuuuaacucccauucugucc

SEQ ID NO: 536263 - RNA, 20 nt, Human
cagaaauuuguaaaagggau

SEQ ID NO: 536264 - RNA, 22 nt, Human
gagggaggcaucaugaauccag

SEQ ID NO: 536265 - RNA, 17 nt, Human
gcccugccugcugcccu

SEQ ID NO: 536266 - RNA, 22 nt, Human
caggccugucugcacaugaggc

SEQ ID NO: 536267 - RNA, 22 nt, Human
uugcucagcacuggagccagcu

SEQ ID NO: 536268 - RNA, 22 nt, Human
ucacaguuauagucuguagaau

SEQ ID NO: 536269 - RNA, 18 nt, Human
aggcaggugcuggaaguc

SEQ ID NO: 536270 - RNA, 22 nt, Human
cgcaggugccggcagauggggu

SEQ ID NO: 536271 - RNA, 22 nt, Human
aaguucaagagugacauauuag

SEQ ID NO: 536272 - RNA, 22 nt, Human
cugaggcauguuacaggacaua

SEQ ID NO: 536273 - RNA, 22 nt, Human
cagcagcccacgcgugcugucc

SEQ ID NO: 536274 - RNA, 22 nt, Human
caguacuuuucaaccaguauga

SEQ ID NO: 536275 - RNA, 22 nt, Human
gauuuuauauggcauacugugg

SEQ ID NO: 536276 - RNA, 19 nt, Human
uagcagcugccaaaggaga

SEQ ID NO: 536277 - RNA, 22 nt, Human
ugccagugggugugcagagacu

SEQ ID NO: 536278 - RNA, 22 nt, Human
uuuguguguguauaggaaagga

SEQ ID NO: 536279 - RNA, 22 nt, Human
aaaugguaaauuaguaguagcu

SEQ ID NO: 536280 - RNA, 22 nt, Human
ucaguguuucaguuuggaaaug

SEQ ID NO: 536281 - RNA, 22 nt, Human
agccaggccagacucacacccu

SEQ ID NO: 536282 - RNA, 22 nt, Human
aggcaguuuaggcagcgauuua

SEQ ID NO: 536283 - RNA, 21 nt, Human
agagagaaggccauauggucc

SEQ ID NO: 536284 - RNA, 22 nt, Human
uuucuaaggugauccuuucuua

SEQ ID NO: 536285 - RNA, 22 nt, Human
acagauggagcuacuagguaaa

SEQ ID NO: 536286 - RNA, 22 nt, Human
uuucauaaugucacagucaaaa

SEQ ID NO: 536287 - RNA, 20 nt, Human
auacacauucauagaaaaau

SEQ ID NO: 536288 - RNA, 22 nt, Human
ggagguggagguugcaaugagc

SEQ ID NO: 536289 - RNA, 22 nt, Human
acaguggaagcaugaugcuauc

SEQ ID NO: 536290 - RNA, 22 nt, Human
uaggaccccugugguagauggg

SEQ ID NO: 536291 - RNA, 22 nt, Human
cccugcagaccaaugccauaga

SEQ ID NO: 536292 - RNA, 22 nt, Human
ggcucagaaacuaaaggcgcug

SEQ ID NO: 536293 - RNA, 22 nt, Human
uucucuuauucuggauaugcag

SEQ ID NO: 536294 - RNA, 22 nt, Human
aaacaugaguuaaaaguaacug

SEQ ID NO: 536295 - RNA, 22 nt, Human
ggagcugugcagugacuacaga

SEQ ID NO: 536296 - RNA, 22 nt, Human
gggcagugucgaggucuggucc

SEQ ID NO: 536297 - RNA, 22 nt, Human
cuuacauuuaaucaugugucau

SEQ ID NO: 536298 - RNA, 22 nt, Human
ugucucugcuuuccuugcaggg

SEQ ID NO: 536299 - RNA, 22 nt, Human
acugggcuguuuuuugagugga

SEQ ID NO: 536300 - RNA, 22 nt, Human
cugaggugcuauggaggauacg

SEQ ID NO: 536301 - RNA, 22 nt, Human
ugggacagagugagcuuuggcc

SEQ ID NO: 536302 - RNA, 22 nt, Human
agaaacaagguguagguugacc

SEQ ID NO: 536303 - RNA, 19 nt, Human
uuuaaugugugcugcaauc

SEQ ID NO: 536304 - RNA, 22 nt, Human
gcacccaguuugucucaggguu

SEQ ID NO: 536305 - RNA, 22 nt, Human
gcugugugaaaacugggccugg

SEQ ID NO: 536306 - RNA, 22 nt, Human
aaucuauucccuuucuguaaaa

SEQ ID NO: 536307 - RNA, 23 nt, Human
uggccuggagagaaaagaugagu

SEQ ID NO: 536308 - RNA, 18 nt, Human
aagcugcccucaggcagg

SEQ ID NO: 536309 - RNA, 22 nt, Human
gccugcugaagccagagugugu

SEQ ID NO: 536310 - RNA, 22 nt, Human
acaggugguagaguggaaagag

SEQ ID NO: 536311 - RNA, 22 nt, Human
uguucuuacggaacuuaucuuu

SEQ ID NO: 536312 - RNA, 22 nt, Human
aucuuuagagucaucugagugu

SEQ ID NO: 536313 - RNA, 22 nt, Human
ugaacagauggcccagcagagg

SEQ ID NO: 536314 - RNA, 22 nt, Human
accucugcaaugcaaugucaug

SEQ ID NO: 536315 - RNA, 22 nt, Human
ggcugcugguggaaugguaggc

SEQ ID NO: 536316 - RNA, 22 nt, Human
uucucuuaucuggcauuauugg

SEQ ID NO: 536317 - RNA, 22 nt, Human
uuucuuucaauucuccuaaugc

SEQ ID NO: 536318 - RNA, 22 nt, Human
ccaggguuuaaauucugacuau

SEQ ID NO: 536319 - RNA, 22 nt, Human
cuucuuucccaggcauguuuua

SEQ ID NO: 536320 - RNA, 22 nt, Human
auguaacaggugaagcucugag

SEQ ID NO: 536321 - RNA, 22 nt, Human
ugagcccagagaucugagcuau

SEQ ID NO: 536322 - RNA, 22 nt, Human
gaaggaaaacagaucugccuga

SEQ ID NO: 536323 - RNA, 21 nt, Human
aggagggcacaaggccaggaa

SEQ ID NO: 536324 - RNA, 22 nt, Human
aggcacuuuaggaucagguuga

SEQ ID NO: 536325 - RNA, 22 nt, Human
agagaguugaggaagcaacacu

SEQ ID NO: 536326 - RNA, 22 nt, Human
uaucuaagagagucaauauuua

SEQ ID NO: 536327 - RNA, 22 nt, Human
uggcuuccugcacagugucugc

SEQ ID NO: 536328 - RNA, 22 nt, Human
gugcagugacccuggagagcug

SEQ ID NO: 536329 - RNA, 22 nt, Human
aacaguuucaguuacugaugag

SEQ ID NO: 536330 - RNA, 22 nt, Human
aguggcagggcuggcugcugca

SEQ ID NO: 536331 - RNA, 22 nt, Human
cgcaggcucgguucacagagca

SEQ ID NO: 536332 - RNA, 22 nt, Human
caucugaauuugccuuaguuuc

SEQ ID NO: 536333 - RNA, 20 nt, Human
uccugcaguuccuaggaggg

SEQ ID NO: 536334 - RNA, 22 nt, Human
cagagcaucgcgcagagagccu

SEQ ID NO: 536335 - RNA, 22 nt, Human
cugcugaucagggcaaagcaaa

SEQ ID NO: 536336 - RNA, 22 nt, Human
auccaagucagggauaguuuga

SEQ ID NO: 536337 - RNA, 22 nt, Human
auagacaaugguuugccaagaa

SEQ ID NO: 536338 - RNA, 22 nt, Human
gggcuggcucccagguguugaa

SEQ ID NO: 536339 - RNA, 22 nt, Human
cagaccucaguccucaguagga

SEQ ID NO: 536340 - RNA, 22 nt, Human
ugcagggaggccccgcagcccu

SEQ ID NO: 536341 - RNA, 22 nt, Human
aguuacaugacugccggcggug

SEQ ID NO: 536342 - RNA, 22 nt, Human
aaagcauauuaggacugaauua

SEQ ID NO: 536343 - RNA, 22 nt, Human
uuugcauuuugauaagaucacu

SEQ ID NO: 536344 - RNA, 22 nt, Human
uccugcugagcgucugucauuu

SEQ ID NO: 536345 - RNA, 22 nt, Human
uguuucaaguuugcucaaagga

SEQ ID NO: 536346 - RNA, 22 nt, Human
caccugcccagcaccugggauc

SEQ ID NO: 536347 - RNA, 22 nt, Human
caguggccaugguggcaggggu

SEQ ID NO: 536348 - RNA, 22 nt, Human
ccuguucaauauucuuccuugu

SEQ ID NO: 536349 - RNA, 22 nt, Human
gggaaccagccgcuuccgccuc

SEQ ID NO: 536350 - RNA, 22 nt, Human
ggagcugagcagcgauggcgga

SEQ ID NO: 536351 - RNA, 22 nt, Human
uggcugagguaacuaugaauaa

SEQ ID NO: 536352 - RNA, 22 nt, Human
aagggcugcuguagaagcagag

SEQ ID NO: 536353 - RNA, 22 nt, Human
gcugucugucucugucccacca

SEQ ID NO: 536354 - RNA, 22 nt, Human
agacagggucuugaucagagcu

SEQ ID NO: 536355 - RNA, 22 nt, Human
uguucauucugugaccugguuc

SEQ ID NO: 536356 - RNA, 22 nt, Human
ggggccuuggaucugugccccg

SEQ ID NO: 536357 - RNA, 21 nt, Human
uagaaaucagcuggugccucu

SEQ ID NO: 536358 - RNA, 18 nt, Human
gcauuuuaaucugaggca

SEQ ID NO: 536359 - RNA, 22 nt, Human
cuuauucagcacuugcucugua

SEQ ID NO: 536360 - RNA, 22 nt, Human
agcagcuggugagcaagcucag

SEQ ID NO: 536361 - RNA, 22 nt, Human
agcauuuaauuacaguuuaauu

SEQ ID NO: 536362 - RNA, 22 nt, Human
aacacuuuuuccuccugucugg

SEQ ID NO: 536363 - RNA, 22 nt, Human
cagguacauucguagacccauu

SEQ ID NO: 536364 - RNA, 22 nt, Human
uaggaaaacgugauuuucucac

SEQ ID NO: 536365 - RNA, 22 nt, Human
cuuuuucuaaucauaauugucu

SEQ ID NO: 536366 - RNA, 22 nt, Human
cacaccagagguuaccugcaaa

SEQ ID NO: 536367 - RNA, 22 nt, Human
uggccagguguggguucucaga

SEQ ID NO: 536368 - RNA, 22 nt, Human
ugcaggcucaucucaagaguag

SEQ ID NO: 536369 - RNA, 22 nt, Human
ugaucugaaggacaugggaccc

SEQ ID NO: 536370 - RNA, 22 nt, Human
ucauuuguucucauucucuacu

SEQ ID NO: 536371 - RNA, 21 nt, Human
uugauuuuaggaaguuuguca

SEQ ID NO: 536372 - RNA, 22 nt, Human
agaaggaagccaggagggugca

SEQ ID NO: 536373 - RNA, 22 nt, Human
agaaguuaauuccugaaauucu

SEQ ID NO: 536374 - RNA, 22 nt, Human
ugcaauaacccaguaucuguga

SEQ ID NO: 536375 - RNA, 22 nt, Human
cauuuguauagugcuuagacca

SEQ ID NO: 536376 - RNA, 22 nt, Human
uggcaguguauagguggcuccu

SEQ ID NO: 536377 - RNA, 22 nt, Human
uaccaggcagcugcacagaggc

SEQ ID NO: 536378 - RNA, 22 nt, Human
uucuuguacuggagauacauga

SEQ ID NO: 536379 - RNA, 22 nt, Human
uuugaguuuuaccuguauuacu

SEQ ID NO: 536380 - RNA, 22 nt, Human
cugggccaguuaugucucaucu

SEQ ID NO: 536381 - RNA, 22 nt, Human
ugcaaacauccgacugaaagcc

SEQ ID NO: 536382 - RNA, 22 nt, Human
aggcuucccagcugagcucagc

SEQ ID NO: 536383 - RNA, 22 nt, Human
acagaauauuuuauuuagauca

SEQ ID NO: 536384 - RNA, 22 nt, Human
uucuucauucccuuacuuccga

SEQ ID NO: 536385 - RNA, 22 nt, Human
uacacuuuuuacuacagauucu

SEQ ID NO: 536386 - RNA, 22 nt, Human
aagaauguucuuguagucauga

SEQ ID NO: 536387 - RNA, 22 nt, Human
ucaaacuagccugacugguauu

SEQ ID NO: 536388 - RNA, 22 nt, Human
uccucucagugugguuguggga

SEQ ID NO: 536389 - RNA, 22 nt, Human
acuuucuaggucucaguccuuu

SEQ ID NO: 536390 - RNA, 22 nt, Human
gaagaagccucuguggaucuga

SEQ ID NO: 536391 - RNA, 22 nt, Human
agggucagugaugagggagccc

SEQ ID NO: 536392 - RNA, 22 nt, Human
guucacaguguuuucuuugcau

SEQ ID NO: 536393 - RNA, 22 nt, Human
ugggcuucauaauugguccuag

SEQ ID NO: 536394 - RNA, 22 nt, Human
auuuacagaugaugcuauuuga

SEQ ID NO: 536395 - RNA, 23 nt, Human
ggcaccaggccauggagcgggag

SEQ ID NO: 536396 - RNA, 20 nt, Human
ucaguuaggaagaggcacuc

SEQ ID NO: 536397 - RNA, 22 nt, Human
aaauguagaccuauagggaccu

SEQ ID NO: 536398 - RNA, 22 nt, Human
agggccugagaccguggcuuga

SEQ ID NO: 536399 - RNA, 19 nt, Human
ucaaugcaugaaaucagcc

SEQ ID NO: 536400 - RNA, 22 nt, Human
ucacaucuguugauacagcauc

SEQ ID NO: 536401 - RNA, 23 nt, Human
ccuucagaagaaguaacaggggc

SEQ ID NO: 536402 - RNA, 22 nt, Human
acuauucauguuuccuaacuau

SEQ ID NO: 536403 - RNA, 22 nt, Human
agggcugcuuugcuaaauaugg

SEQ ID NO: 536404 - RNA, 22 nt, Human
agugcuguccaguuucacaggu

SEQ ID NO: 536405 - RNA, 22 nt, Human
uuuacucuugcuacacaacugu

SEQ ID NO: 536406 - RNA, 22 nt, Human
cugcugugagugguucuugccu

SEQ ID NO: 536407 - RNA, 22 nt, Human
acagggcagagggcaguuggua

SEQ ID NO: 536408 - RNA, 17 nt, Human
cuggagccuccaacucc

SEQ ID NO: 536409 - RNA, 22 nt, Human
cccaggcacauccacucuguga

SEQ ID NO: 536410 - RNA, 22 nt, Human
aaaauaacuucuacuauuugca

SEQ ID NO: 536411 - RNA, 22 nt, Human
aaggaaccugagggaccccaaa

SEQ ID NO: 536412 - RNA, 22 nt, Human
uauuuucuguggaggaccagau

SEQ ID NO: 536413 - RNA, 18 nt, Human
acacacacaccuguguau

SEQ ID NO: 536414 - RNA, 22 nt, Human
gcagaaggauccgcaggugcaa

SEQ ID NO: 536415 - RNA, 22 nt, Human
uccagcagaaaagagguaggga

SEQ ID NO: 536416 - RNA, 22 nt, Human
auauauuuacucuccuguugca

SEQ ID NO: 536417 - RNA, 22 nt, Human
caaauucagaaaauugguagag

SEQ ID NO: 536418 - RNA, 22 nt, Human
ggaaggcuaauaaugcaagaaa

SEQ ID NO: 536419 - RNA, 22 nt, Human
gaggggaagacuucuggacagu

SEQ ID NO: 536420 - RNA, 23 nt, Human
agccucuuuucuccugcccugca

SEQ ID NO: 536421 - RNA, 22 nt, Human
cuuaauaauaggugaggcuaug

SEQ ID NO: 536422 - RNA, 21 nt, Human
ccuuuacaauuuugcauuccu

SEQ ID NO: 536423 - RNA, 22 nt, Human
gucugagaaucuugcauaucau

SEQ ID NO: 536424 - RNA, 22 nt, Human
aaacugaaacaucaucauguug

SEQ ID NO: 536425 - RNA, 22 nt, Human
uguguauucagcaagcgaaaca

SEQ ID NO: 536426 - RNA, 22 nt, Human
agugagcauucguuuggaaccc

SEQ ID NO: 536427 - RNA, 22 nt, Human
caggcuugcugcuagagcacuu

SEQ ID NO: 536428 - RNA, 20 nt, Human
aagaggugauaacaggugag

SEQ ID NO: 536429 - RNA, 22 nt, Human
cagcuguguagaugcaggguca

SEQ ID NO: 536430 - RNA, 22 nt, Human
cugcagggcccgccugagcccu

SEQ ID NO: 536431 - RNA, 22 nt, Human
uuccaaucaggauaauaauuag

SEQ ID NO: 536432 - RNA, 22 nt, Human
ggcuccuguccccucagcugcu

SEQ ID NO: 536433 - RNA, 22 nt, Human
acuuuuuaguuuccucaaacau

SEQ ID NO: 536434 - RNA, 22 nt, Human
acagcucuguugccagaucugc

SEQ ID NO: 536435 - RNA, 22 nt, Human
aaaagacaggugucugcggccc

SEQ ID NO: 536436 - RNA, 22 nt, Human
aguguuucccaguaggaugaaa

SEQ ID NO: 536437 - RNA, 22 nt, Human
gcugggcaccggagagacccca

SEQ ID NO: 536438 - RNA, 22 nt, Human
gcagauggacuguaugaccuga

SEQ ID NO: 536439 - RNA, 22 nt, Human
ucuccucucuuaccugguacaa

SEQ ID NO: 536440 - RNA, 22 nt, Human
agggccugugcuuccugagaua

SEQ ID NO: 536441 - RNA, 22 nt, Human
gggcuaggcuuggccagcacug

SEQ ID NO: 536442 - RNA, 22 nt, Human
ugcacacacaggagucuccucc

SEQ ID NO: 536443 - RNA, 21 nt, Human
ugcuggccucaagggugacuu

SEQ ID NO: 536444 - RNA, 22 nt, Human
aaauagaaaccaacaaggucag

SEQ ID NO: 536445 - RNA, 22 nt, Human
gcuccuggcuccaggcagccaa

SEQ ID NO: 536446 - RNA, 22 nt, Human
agggaggaguccucaaagucau

SEQ ID NO: 536447 - RNA, 22 nt, Human
gcagacaauuuauuagcagauu

SEQ ID NO: 536448 - RNA, 22 nt, Human
aaagcaguauaguggaagggcu

SEQ ID NO: 536449 - RNA, 23 nt, Human
ugucugucauggaauuucaaggu

SEQ ID NO: 536450 - RNA, 22 nt, Human
gaagagcugcaguuuccugggc

SEQ ID NO: 536451 - RNA, 22 nt, Human
cugccugugccaaugcuccuuu

SEQ ID NO: 536452 - RNA, 22 nt, Human
augaaguuccaguauaugcagu

SEQ ID NO: 536453 - RNA, 21 nt, Human
ucacuagugccuucugucauu

SEQ ID NO: 536454 - RNA, 22 nt, Human
uguucagagacagaaauucuaa

SEQ ID NO: 536455 - RNA, 22 nt, Human
aacaucuuguccuuagauuaaa

SEQ ID NO: 536456 - RNA, 22 nt, Human
acaaaugacucaaacaccacuu

SEQ ID NO: 536457 - RNA, 22 nt, Human
ucacuguauuuggaagggaugg

SEQ ID NO: 536458 - RNA, 22 nt, Human
cuuacauugugugcaugagggg

SEQ ID NO: 536459 - RNA, 22 nt, Human
ccucccuggccagagcagcagc

SEQ ID NO: 536460 - RNA, 22 nt, Human
ugggacagugugccuugcuccu

SEQ ID NO: 536461 - RNA, 22 nt, Human
caacaucuguaucauuaguaca

SEQ ID NO: 536462 - RNA, 22 nt, Human
uuauuugugaaucauuuaucua

SEQ ID NO: 536463 - RNA, 22 nt, Human
gaaaucauuagcaaagauaugu

SEQ ID NO: 536464 - RNA, 22 nt, Human
ucaugaaaauagaucagaaauu

SEQ ID NO: 536465 - RNA, 22 nt, Human
acuuccugcuaugagcuucugu

SEQ ID NO: 536466 - RNA, 22 nt, Human
cagugcagaacacauggaaaau

SEQ ID NO: 536467 - RNA, 22 nt, Human
cacugaaggacaguaggaaggg

SEQ ID NO: 536468 - RNA, 21 nt, Human
aggcccagagucuugggggga

SEQ ID NO: 536469 - RNA, 22 nt, Human
cccuuuaauuccaacacaggaa

SEQ ID NO: 536470 - RNA, 22 nt, Human
gugcagguguuuuggcugccag

SEQ ID NO: 536471 - RNA, 22 nt, Human
caguacuuugcaucauuccacu

SEQ ID NO: 536472 - RNA, 22 nt, Human
cuugaaagauuuggccucugug

SEQ ID NO: 536473 - RNA, 22 nt, Human
ugugggaggucuggaaggcucc

SEQ ID NO: 536474 - RNA, 22 nt, Human
uuccuccacgugacaggagcca

SEQ ID NO: 536475 - RNA, 22 nt, Human
cacauuuauuugaggcuaauug

SEQ ID NO: 536476 - RNA, 22 nt, Human
gcagagcucuguucuuaucucc

SEQ ID NO: 536477 - RNA, 21 nt, Human
aggcucccagaaaugggcauc

SEQ ID NO: 536478 - RNA, 22 nt, Human
guguuuuaucagacaaaguaua

SEQ ID NO: 536479 - RNA, 22 nt, Human
agccugagugcuuaggacuguu

SEQ ID NO: 536480 - RNA, 22 nt, Human
aaagaagagcuggaaggagucu

SEQ ID NO: 536481 - RNA, 22 nt, Human
acuccugggugcugaccagcgu

SEQ ID NO: 536482 - RNA, 20 nt, Human
gggaugagaguccuagcucu

SEQ ID NO: 536483 - RNA, 22 nt, Human
cagccucugagccuuggcagau

SEQ ID NO: 536484 - RNA, 22 nt, Human
uccuccugccuuugcuucuugu

SEQ ID NO: 536485 - RNA, 22 nt, Human
uggaaagaugaagauguuuaag

SEQ ID NO: 536486 - RNA, 22 nt, Human
gcuggcucuucaguggagauag

SEQ ID NO: 536487 - RNA, 22 nt, Human
ucauguaaguauagaaagcagu

SEQ ID NO: 536488 - RNA, 22 nt, Human
agcccugcacaguucgggagga

SEQ ID NO: 536489 - RNA, 22 nt, Human
ccaaaauguuugaaugcaugug

SEQ ID NO: 536490 - RNA, 22 nt, Human
gcaaagcaagauucagauguag

SEQ ID NO: 536491 - RNA, 22 nt, Human
uauacucugagaaacgugucac

SEQ ID NO: 536492 - RNA, 22 nt, Human
ugguccugcccacgcccaucug

SEQ ID NO: 536493 - RNA, 22 nt, Human
aagauuguuuuggaugcuaacu

SEQ ID NO: 536494 - RNA, 22 nt, Human
uucaggauggcggauguugggg

SEQ ID NO: 536495 - RNA, 22 nt, Human
cugccuguuagucuagcaguua

SEQ ID NO: 536496 - RNA, 22 nt, Human
ugcucagcugcucuguauucuu

SEQ ID NO: 536497 - RNA, 22 nt, Human
ucuuugaaaagggagauagaaa

SEQ ID NO: 536498 - RNA, 23 nt, Human
aggcaggcaguucagcuguuguu

SEQ ID NO: 536499 - RNA, 22 nt, Human
agcagccacccagcugcucauu

SEQ ID NO: 536500 - RNA, 22 nt, Human
agcugagcucaggcugauguaa

SEQ ID NO: 536501 - RNA, 22 nt, Human
ccugccugacagagaagguuca

SEQ ID NO: 536502 - RNA, 23 nt, Human
cuuucauugugguuucacagagc

SEQ ID NO: 536503 - RNA, 22 nt, Human
ggugggcaacauuuggccugag

SEQ ID NO: 536504 - RNA, 22 nt, Human
cagggccuuauccugccauuga

SEQ ID NO: 536505 - RNA, 22 nt, Human
cugcuggccuagcccauccucu

SEQ ID NO: 536506 - RNA, 22 nt, Human
uuuuagaaggaaugcuauggug

SEQ ID NO: 536507 - RNA, 22 nt, Human
uugaaacugggaagcagggggu

SEQ ID NO: 536508 - RNA, 22 nt, Human
uccugcagccuugggcuggagc

SEQ ID NO: 536509 - RNA, 22 nt, Human
gcaggugaaugauggacuagga

SEQ ID NO: 536510 - RNA, 22 nt, Human
acuggcugaguuuauguucaca

SEQ ID NO: 536511 - RNA, 21 nt, Human
ccagcccagcugugucccagc

SEQ ID NO: 536512 - RNA, 22 nt, Human
uuaacauuguccuuagcagauu

SEQ ID NO: 536513 - RNA, 22 nt, Human
ggucccaaucuaaucacaugag

SEQ ID NO: 536514 - RNA, 22 nt, Human
guagcccaccuggggagggcga

SEQ ID NO: 536515 - RNA, 22 nt, Human
ccugucugcaugagugagcaua

SEQ ID NO: 536516 - RNA, 22 nt, Human
uuucuaagugaacauucaaguu

SEQ ID NO: 536517 - RNA, 22 nt, Human
ugguuucccauuaucugcagga

SEQ ID NO: 536518 - RNA, 19 nt, Human
uguugccagguaucauguu

SEQ ID NO: 536519 - RNA, 21 nt, Human
uggcucugcucagagcagucc

SEQ ID NO: 536520 - RNA, 22 nt, Human
aggcugggaaaccugaaguugu

SEQ ID NO: 536521 - RNA, 22 nt, Human
ugaguacucggagugcuuugga

SEQ ID NO: 536522 - RNA, 20 nt, Human
aaaaucucccagaaacuuau

SEQ ID NO: 536523 - RNA, 22 nt, Human
auguuuauguugggcuauauuu

SEQ ID NO: 536524 - RNA, 22 nt, Human
uucuucuccuaaggagaguccu

SEQ ID NO: 536525 - RNA, 20 nt, Human
auuccauaguuggcacuuuu

SEQ ID NO: 536526 - RNA, 22 nt, Human
aagucuguuugagugucacacu

SEQ ID NO: 536527 - RNA, 18 nt, Human
uacaugcauaaaugaagc

SEQ ID NO: 536528 - RNA, 22 nt, Human
ugcuagugugugagauguucaa

SEQ ID NO: 536529 - RNA, 22 nt, Human
gggagcuggagcuggaagacuc

SEQ ID NO: 536530 - RNA, 22 nt, Human
uucacauugguucuugauagcu

SEQ ID NO: 536531 - RNA, 22 nt, Human
uugaggaguguuuagggugagg

SEQ ID NO: 536532 - RNA, 22 nt, Human
cagggcucgcucuugcccuucg

SEQ ID NO: 536533 - RNA, 20 nt, Human
uccaguuuuggagacauucu

SEQ ID NO: 536534 - RNA, 22 nt, Human
guuugcaaagaucauuuucucc

SEQ ID NO: 536535 - RNA, 22 nt, Human
uccuucagucuucugagccaua

SEQ ID NO: 536536 - RNA, 22 nt, Human
augauucaggauugaaccauuu

SEQ ID NO: 536537 - RNA, 19 nt, Human
gauuuaaacguggcucuau

SEQ ID NO: 536538 - RNA, 22 nt, Human
aagaauucacugguagagucaa

SEQ ID NO: 536539 - RNA, 22 nt, Human
ggcacugaauuucuuggcaucu

SEQ ID NO: 536540 - RNA, 20 nt, Human
agaagaggauacaaccaggc

SEQ ID NO: 536541 - RNA, 22 nt, Human
guauuccugcaaauagcaguga

SEQ ID NO: 536542 - RNA, 22 nt, Human
gucucagauaacauguauucua

SEQ ID NO: 536543 - RNA, 22 nt, Human
cacagcuuguuuagugacucac

SEQ ID NO: 536544 - RNA, 22 nt, Human
gcugcuggccgcccagcuucuc

SEQ ID NO: 536545 - RNA, 22 nt, Human
gggccaggaguggagauauggg

SEQ ID NO: 536546 - RNA, 22 nt, Human
gcagggacgccagggacagcaa

SEQ ID NO: 536547 - RNA, 22 nt, Human
uggaagagggagcuggguggcc

SEQ ID NO: 536548 - RNA, 22 nt, Human
caugggcuugcucucugagcuc

SEQ ID NO: 536549 - RNA, 22 nt, Human
cauaucaaagagaaggauagga

SEQ ID NO: 536550 - RNA, 22 nt, Human
gucccaggugggcuccaccucu

SEQ ID NO: 536551 - RNA, 22 nt, Human
uaucuucauagauuuuuacacc

SEQ ID NO: 536552 - RNA, 22 nt, Human
gcagguggcagaggugggaucu

SEQ ID NO: 536553 - RNA, 21 nt, Human
agacagaacaacugcucucca

SEQ ID NO: 536554 - RNA, 22 nt, Human
uaguuaggguucugcagagaca

SEQ ID NO: 536555 - RNA, 22 nt, Human
acaaaugacuauuugguacagg

SEQ ID NO: 536556 - RNA, 22 nt, Human
ugcacacaaaugugaacgugcc

SEQ ID NO: 536557 - RNA, 22 nt, Human
gcugcuggggucacaugguaag

SEQ ID NO: 536558 - RNA, 22 nt, Human
aaaguuuucugccuucauuaga

SEQ ID NO: 536559 - RNA, 22 nt, Human
uuaugcaaagaaauagacuaau

SEQ ID NO: 536560 - RNA, 22 nt, Human
cagcaggggaacugugggccag

SEQ ID NO: 536561 - RNA, 22 nt, Human
ugagcaggagauaaacagguag

SEQ ID NO: 536562 - RNA, 22 nt, Human
aaggcuaugaucuuuuucauga

SEQ ID NO: 536563 - RNA, 22 nt, Human
cuuucaaucaaaguuucuagug

SEQ ID NO: 536564 - RNA, 22 nt, Human
auguaucagauaaagcaugugg

SEQ ID NO: 536565 - RNA, 22 nt, Human
uuacaaguuucuggcuucaucc

SEQ ID NO: 536566 - RNA, 22 nt, Human
gcugucacaagcaucuggggca

SEQ ID NO: 536567 - RNA, 21 nt, Human
acaguuuuaaggagcacaugg

SEQ ID NO: 536568 - RNA, 22 nt, Human
aggugcugaacuggugaggucu

SEQ ID NO: 536569 - RNA, 22 nt, Human
uccuccuccucacagucaccug

SEQ ID NO: 536570 - RNA, 20 nt, Human
guggccucucacauucugag

SEQ ID NO: 536571 - RNA, 22 nt, Human
uagaaacuacuagaauaagaga

SEQ ID NO: 536572 - RNA, 22 nt, Human
aagggcucacccaacucacuuc

SEQ ID NO: 536573 - RNA, 22 nt, Human
aggaguguggccagggcucugg

SEQ ID NO: 536574 - RNA, 22 nt, Human
aguggagaauaugcagaaagcc

SEQ ID NO: 536575 - RNA, 22 nt, Human
aagacccacaaggcugaauguu

SEQ ID NO: 536576 - RNA, 22 nt, Human
uuuuggcucuugguaggucaga

SEQ ID NO: 536577 - RNA, 22 nt, Human
agcucuggaauaaugaugugau

SEQ ID NO: 536578 - RNA, 22 nt, Human
aaaugaacucuuccugcauccc

SEQ ID NO: 536579 - RNA, 22 nt, Human
ugagccuggguggucgaggcug

SEQ ID NO: 536580 - RNA, 22 nt, Human
ucuccuccuuuuuucaacauag

SEQ ID NO: 536581 - RNA, 22 nt, Human
acugagagucaagauagcaugg

SEQ ID NO: 536582 - RNA, 22 nt, Human
ucuggcaggacaugcugaccau

SEQ ID NO: 536583 - RNA, 22 nt, Human
aguuuuguaauucucaaaaaua

SEQ ID NO: 536584 - RNA, 22 nt, Human
uggcaugauaggaggugcagaa

SEQ ID NO: 536585 - RNA, 18 nt, Human
gccagagggcccaagguc

SEQ ID NO: 536586 - RNA, 22 nt, Human
uuauuauugugguugcauuauc

SEQ ID NO: 536587 - RNA, 22 nt, Human
gacacagaaggucacauguuca

SEQ ID NO: 536588 - RNA, 22 nt, Human
ggccuguccagccugccuggcu

SEQ ID NO: 536589 - RNA, 22 nt, Human
gcccuggagcuagacuaggaca

SEQ ID NO: 536590 - RNA, 22 nt, Human
acuguucaagcaaaugacauug

SEQ ID NO: 536591 - RNA, 22 nt, Human
ggaaagucuuguguagaugucu

SEQ ID NO: 536592 - RNA, 22 nt, Human
ucaggcaggacaauuauuuagg

SEQ ID NO: 536593 - RNA, 22 nt, Human
ggagcuggccgccuaugugcag

SEQ ID NO: 536594 - RNA, 22 nt, Human
ccagccuggggaggcagcuucu

SEQ ID NO: 536595 - RNA, 22 nt, Human
ugucccaacccugagaagauuc

SEQ ID NO: 536596 - RNA, 23 nt, Human
agcuggguggccugcgugaagcu

SEQ ID NO: 536597 - RNA, 22 nt, Human
gcugccugccuugccuggagga

SEQ ID NO: 536598 - RNA, 20 nt, Human
uaaggcuguuuuguauuccu

SEQ ID NO: 536599 - RNA, 22 nt, Human
augagcaguagguucauggcug

SEQ ID NO: 536600 - RNA, 21 nt, Human
cagacccucuagaggccaccu

SEQ ID NO: 536601 - RNA, 19 nt, Human
gugaggauacugcucagag

SEQ ID NO: 536602 - RNA, 20 nt, Human
agaguaacuggcacauaggg

SEQ ID NO: 536603 - RNA, 22 nt, Human
gaggcucacgacgggacgaacu

SEQ ID NO: 536604 - RNA, 22 nt, Human
agcguggguccaaggcucuggu

SEQ ID NO: 536605 - RNA, 22 nt, Human
agacaaagacagcaucucaggu

SEQ ID NO: 536606 - RNA, 19 nt, Human
ccugucugucuucagcuag

SEQ ID NO: 536607 - RNA, 22 nt, Human
ccugggcaaauuauguuacuca

SEQ ID NO: 536608 - RNA, 23 nt, Human
gccugcuggucaccuaaucugcc

SEQ ID NO: 536609 - RNA, 22 nt, Human
agucagugaaaacuagaauguu

SEQ ID NO: 536610 - RNA, 22 nt, Human
gcugcagugagccaagaucgug

SEQ ID NO: 536611 - RNA, 22 nt, Human
ugggaaaguaauugucauccuu

SEQ ID NO: 536612 - RNA, 22 nt, Human
cugcuuauggagaugaguaaga

SEQ ID NO: 536613 - RNA, 18 nt, Human
cccucuugcacaaagcaa

SEQ ID NO: 536614 - RNA, 22 nt, Human
ccucucucuccugcacacacac

SEQ ID NO: 536615 - RNA, 22 nt, Human
agcacccuccaacuucccugua

SEQ ID NO: 536616 - RNA, 22 nt, Human
gagaagcaauuuccaacugugc

SEQ ID NO: 536617 - RNA, 22 nt, Human
gcagcuuggauuucuguaguuu

SEQ ID NO: 536618 - RNA, 22 nt, Human
uuugucaaguuugcaaauacgu

SEQ ID NO: 536619 - RNA, 22 nt, Human
cccaggcacagauuaucccaau

SEQ ID NO: 536620 - RNA, 16 nt, Human
gggagggaguuggugg

SEQ ID NO: 536621 - RNA, 22 nt, Human
uggggugccgacagggagggca

SEQ ID NO: 536622 - RNA, 22 nt, Human
ucucagagugacaaugagaauu

SEQ ID NO: 536623 - RNA, 22 nt, Human
uaugagaaaauaaauaucuguu

SEQ ID NO: 536624 - RNA, 22 nt, Human
ggcagcaugagccuggugaauu

SEQ ID NO: 536625 - RNA, 22 nt, Human
auacaaauuuauagaugcauuu

SEQ ID NO: 536626 - RNA, 22 nt, Human
cuuaauuucaaacugcuaguga

SEQ ID NO: 536627 - RNA, 22 nt, Human
ucaguguuugguuucagaauug

SEQ ID NO: 536628 - RNA, 22 nt, Human
gaaaugcagauucugauucugu

SEQ ID NO: 536629 - RNA, 22 nt, Human
uuugaaaccuaguuauaugacu

SEQ ID NO: 536630 - RNA, 22 nt, Human
agcaaagucaguggaaccaucc

SEQ ID NO: 536631 - RNA, 22 nt, Human
auuauuauauagggaaaguccc

SEQ ID NO: 536632 - RNA, 21 nt, Human
uuacaaagcuacagauguugc

SEQ ID NO: 536633 - RNA, 22 nt, Human
ggagccugggcauuaguaauuu

SEQ ID NO: 536634 - RNA, 23 nt, Human
ccuggcuggauucucugcauuca

SEQ ID NO: 536635 - RNA, 22 nt, Human
uuaaacagagucugaaauguaa

SEQ ID NO: 536636 - RNA, 22 nt, Human
ggcuccugggagauagagguca

SEQ ID NO: 536637 - RNA, 22 nt, Human
uccuuugacuucuugcagucca

SEQ ID NO: 536638 - RNA, 23 nt, Human
ggggccugcaccggucugcgcgg

SEQ ID NO: 536639 - RNA, 22 nt, Human
auucuucacauaagugcuguac

SEQ ID NO: 536640 - RNA, 22 nt, Human
uguucccaagauaagauuauga

SEQ ID NO: 536641 - RNA, 18 nt, Human
cagcagagacauucaaaa

SEQ ID NO: 536642 - RNA, 22 nt, Human
aagaauuauugcaauacuagau

SEQ ID NO: 536643 - RNA, 22 nt, Human
gaggugaguggaucacgagguc

SEQ ID NO: 536644 - RNA, 22 nt, Human
gugugaaaugguucucuuuguu

SEQ ID NO: 536645 - RNA, 22 nt, Human
uucuucuuuaucucaguauccu

SEQ ID NO: 536646 - RNA, 22 nt, Human
uuguuaaagaugcagauuccau

SEQ ID NO: 536647 - RNA, 22 nt, Human
gcagaugcuuggcacugacagu

SEQ ID NO: 536648 - RNA, 22 nt, Human
ugcccagcacugugccagucac

SEQ ID NO: 536649 - RNA, 16 nt, Human
ucacauacuuccuugc

SEQ ID NO: 536650 - RNA, 22 nt, Human
uugaaacucaucuuagugaugu

SEQ ID NO: 536651 - RNA, 22 nt, Human
auuauuuuaugugcggccugau

SEQ ID NO: 536652 - RNA, 22 nt, Human
gcagagccaugggagguuuuug

SEQ ID NO: 536653 - RNA, 22 nt, Human
cagaccaucuugaagcaaacug

SEQ ID NO: 536654 - RNA, 22 nt, Human
gccaggcucucagugacugccc

SEQ ID NO: 536655 - RNA, 22 nt, Human
uggcagcuccggguaggggcug

SEQ ID NO: 536656 - RNA, 22 nt, Human
gccugggaagacuaagugggag

SEQ ID NO: 536657 - RNA, 22 nt, Human
cucuccagccaggggcuuccug

SEQ ID NO: 536658 - RNA, 22 nt, Human
aaaaggauguuuucaugaaaca

SEQ ID NO: 536659 - RNA, 22 nt, Human
ucuucauuccguagauauuuau

SEQ ID NO: 536660 - RNA, 22 nt, Human
augaggcaggagugcaguggca

SEQ ID NO: 536661 - RNA, 22 nt, Human
caugcuuucuguccaaauguua

SEQ ID NO: 536662 - RNA, 19 nt, Human
aauacaguguuauagaauu

SEQ ID NO: 536663 - RNA, 22 nt, Human
agcaaagcuuccauaaagcagc

SEQ ID NO: 536664 - RNA, 22 nt, Human
agggccuguccgcucccgcccg

SEQ ID NO: 536665 - RNA, 22 nt, Human
ccaggguggaggcuggauggag

SEQ ID NO: 536666 - RNA, 22 nt, Human
agccaccuucuccaaggccuag

SEQ ID NO: 536667 - RNA, 22 nt, Human
ucacagaaucucugauaagucu

SEQ ID NO: 536668 - RNA, 22 nt, Human
ucucagggcgcagugaggcagu

SEQ ID NO: 536669 - RNA, 22 nt, Human
gggcucuguccauuccuucaua

SEQ ID NO: 536670 - RNA, 22 nt, Human
aguuuucugccucuggaugcgu

SEQ ID NO: 536671 - RNA, 22 nt, Human
ugccugucuucaggagugucac

SEQ ID NO: 536672 - RNA, 22 nt, Human
uugcucugauuagguggaaaca

SEQ ID NO: 536673 - RNA, 22 nt, Human
ucagcacugauguuucagaaga

SEQ ID NO: 536674 - RNA, 21 nt, Human
ugccagcauguaggcuaguug

SEQ ID NO: 536675 - RNA, 22 nt, Human
caggcagaguuagugauuuagg

SEQ ID NO: 536676 - RNA, 22 nt, Human
gcaaagcaucaguagaaauguu

SEQ ID NO: 536677 - RNA, 22 nt, Human
gcucaggcuggauugcaguggc

SEQ ID NO: 536678 - RNA, 22 nt, Human
aaggcaguaggaucuuccacag

SEQ ID NO: 536679 - RNA, 22 nt, Human
cacugaaauauuaauaucuuau

SEQ ID NO: 536680 - RNA, 22 nt, Human
cugaaguggacaaauggagugg

SEQ ID NO: 536681 - RNA, 22 nt, Human
aaauaagaggacagauguuugg

SEQ ID NO: 536682 - RNA, 22 nt, Human
aguuggugggugugagcuggac

SEQ ID NO: 536683 - RNA, 22 nt, Human
cugcuguguuucacaccucugg

SEQ ID NO: 536684 - RNA, 22 nt, Human
cuggacagaaaaggccacugga

SEQ ID NO: 536685 - RNA, 22 nt, Human
cagcaucuuucucuucuggagu

SEQ ID NO: 536686 - RNA, 22 nt, Human
ccaggacucaguggggaaaggg

SEQ ID NO: 536687 - RNA, 22 nt, Human
ugcaggcuguaaucugaggcua

SEQ ID NO: 536688 - RNA, 22 nt, Human
gcuggcagguaaagccccgggg

SEQ ID NO: 536689 - RNA, 19 nt, Human
ggcuccuguggcugcagcc

SEQ ID NO: 536690 - RNA, 22 nt, Human
agggaagggcagggucuaugca

SEQ ID NO: 536691 - RNA, 22 nt, Human
cucgggcuugaggcuguuuacc

SEQ ID NO: 536692 - RNA, 22 nt, Human
uccaagcuuuccaugcccucac

SEQ ID NO: 536693 - RNA, 18 nt, Human
gaaaggagagacaguagg

SEQ ID NO: 536694 - RNA, 22 nt, Human
ugggaauggaugcuaagugcua

SEQ ID NO: 536695 - RNA, 22 nt, Human
cuggccugcugggugagguccu

SEQ ID NO: 536696 - RNA, 22 nt, Human
acagcacaggaguugaaugggc

SEQ ID NO: 536697 - RNA, 22 nt, Human
uauguguacaucugguugagca

SEQ ID NO: 536698 - RNA, 22 nt, Human
gacacauagaucuaucucacuc

SEQ ID NO: 536699 - RNA, 23 nt, Human
auuucccauugugucagcagagc

SEQ ID NO: 536700 - RNA, 18 nt, Human
aaugaaauguacaccuuu

SEQ ID NO: 536701 - RNA, 22 nt, Human
uggacuggaaugcugauccucu

SEQ ID NO: 536702 - RNA, 22 nt, Human
gugccugcagcaauccauggca

SEQ ID NO: 536703 - RNA, 22 nt, Human
uugauuucuuacucuuccaagg

SEQ ID NO: 536704 - RNA, 22 nt, Human
ucccugcucagcucaccuggca

SEQ ID NO: 536705 - RNA, 22 nt, Human
cucaggauuuacuaauuucaag

SEQ ID NO: 536706 - RNA, 22 nt, Human
agggcccuaaggaaggcacaca

SEQ ID NO: 536707 - RNA, 22 nt, Human
aaauuauaggugccaccuugga

SEQ ID NO: 536708 - RNA, 22 nt, Human
ggaggccaaggagggcggauca

SEQ ID NO: 536709 - RNA, 22 nt, Human
aaaguuagguguggauuucuca

SEQ ID NO: 536710 - RNA, 22 nt, Human
ggcugagccaugggcacugcag

SEQ ID NO: 536711 - RNA, 22 nt, Human
aggagcagcuucugaaccaugu

SEQ ID NO: 536712 - RNA, 22 nt, Human
ugcccucagcagcagcuccugc

SEQ ID NO: 536713 - RNA, 22 nt, Human
agugaaauccuggucaacaggu

SEQ ID NO: 536714 - RNA, 18 nt, Human
uccagagagggagaagug

SEQ ID NO: 536715 - RNA, 22 nt, Human
ugaggcaggacauggacaacug

SEQ ID NO: 536716 - RNA, 22 nt, Human
guuugcauaucugugaaaugga

SEQ ID NO: 536717 - RNA, 22 nt, Human
cuggugguucaggagaauggcu

SEQ ID NO: 536718 - RNA, 22 nt, Human
ugcuuuauuaagagagaaauuu

SEQ ID NO: 536719 - RNA, 22 nt, Human
uccagccaccaccuugauugcc

SEQ ID NO: 536720 - RNA, 22 nt, Human
gcagagccugacgggauuuuuc

SEQ ID NO: 536721 - RNA, 22 nt, Human
ccucaggggcuuuucguuguug

SEQ ID NO: 536722 - RNA, 22 nt, Human
gagggagggacuagcauucucu

SEQ ID NO: 536723 - RNA, 22 nt, Human
ggugacuggagggacccaggcc

SEQ ID NO: 536724 - RNA, 20 nt, Human
gaagccagaggggaaaggag

SEQ ID NO: 536725 - RNA, 22 nt, Human
ccagcacugcucucagacugag

SEQ ID NO: 536726 - RNA, 22 nt, Human
gggcugcuuuuaagggucucag

SEQ ID NO: 536727 - RNA, 22 nt, Human
caugcacauguggcuauguaau

SEQ ID NO: 536728 - RNA, 22 nt, Human
cccuggagcugcuugcauguug

SEQ ID NO: 536729 - RNA, 22 nt, Human
ccaggaggggucucugucuccc

SEQ ID NO: 536730 - RNA, 20 nt, Human
uuuacauuuugaaacaguga

SEQ ID NO: 536731 - RNA, 19 nt, Human
gcugucugaugcugagguc

SEQ ID NO: 536732 - RNA, 22 nt, Human
ugagagugccuuguaaaccugc

SEQ ID NO: 536733 - RNA, 22 nt, Human
caggguggcccuguggucucau

SEQ ID NO: 536734 - RNA, 22 nt, Human
cugugacaguuucucagaauuu

SEQ ID NO: 536735 - RNA, 22 nt, Human
cauggaaggcaaaagacacaga

SEQ ID NO: 536736 - RNA, 22 nt, Human
acugugcaucuauugccauuua

SEQ ID NO: 536737 - RNA, 18 nt, Human
ggguccuguucuuggaag

SEQ ID NO: 536738 - RNA, 22 nt, Human
aacugaaaguuucaccugaggu

SEQ ID NO: 536739 - RNA, 22 nt, Human
cggcagggcuccaugcauuucu

SEQ ID NO: 536740 - RNA, 22 nt, Human
cgggcagaucacacagggcuug

SEQ ID NO: 536741 - RNA, 22 nt, Human
gaaaggagugaauauuugugac

SEQ ID NO: 536742 - RNA, 22 nt, Human
auggccuggccagagcucugcu

SEQ ID NO: 536743 - RNA, 22 nt, Human
agccaggaauuggacaacacau

SEQ ID NO: 536744 - RNA, 22 nt, Human
ugugcucugcaaucaguucuuu

SEQ ID NO: 536745 - RNA, 22 nt, Human
uguggggaucuucuagcuuuuc

SEQ ID NO: 536746 - RNA, 22 nt, Human
uuccauaaucaccuuauucuuu

SEQ ID NO: 536747 - RNA, 22 nt, Human
gcauuccuacaggcugcuauga

SEQ ID NO: 536748 - RNA, 22 nt, Human
ccagggaggguccuguggcuuc

SEQ ID NO: 536749 - RNA, 17 nt, Human
ugcaggcuguuauagcc

SEQ ID NO: 536750 - RNA, 20 nt, Human
ggaagccagggugcagggga

SEQ ID NO: 536751 - RNA, 22 nt, Human
uauuacauccacuuuuauugca

SEQ ID NO: 536752 - RNA, 22 nt, Human
gcauccagagguagccacugug

SEQ ID NO: 536753 - RNA, 22 nt, Human
cugcccucuagaggaggacuga

SEQ ID NO: 536754 - RNA, 22 nt, Human
uggcccugacugauguggaggg

SEQ ID NO: 536755 - RNA, 22 nt, Human
uucuugcucaaugucuguuuaa

SEQ ID NO: 536756 - RNA, 22 nt, Human
ccugucaggguuugccucagaa

SEQ ID NO: 536757 - RNA, 22 nt, Human
ugaccugggcauuacaggugca

SEQ ID NO: 536758 - RNA, 22 nt, Human
acuuguucauugaguacauaug

SEQ ID NO: 536759 - RNA, 22 nt, Human
aaguggagagcccuggaggucu

SEQ ID NO: 536760 - RNA, 22 nt, Human
acaaagcacgagugccauggac

SEQ ID NO: 536761 - RNA, 22 nt, Human
ucaaauaguugacauuaacuug

SEQ ID NO: 536762 - RNA, 22 nt, Human
agaggagguggugaugcuuuaa

SEQ ID NO: 536763 - RNA, 22 nt, Human
ccugugaggucaucugugguaa

SEQ ID NO: 536764 - RNA, 22 nt, Human
augcuauacauaugacaucaca

SEQ ID NO: 536765 - RNA, 22 nt, Human
agggcuccugaggcccuucugg

SEQ ID NO: 536766 - RNA, 22 nt, Human
uucucuacuugagauuuuaaug

SEQ ID NO: 536767 - RNA, 22 nt, Human
cuggaggcacccuuagagaggc

SEQ ID NO: 536768 - RNA, 20 nt, Human
gcucugggagggaugugaug

SEQ ID NO: 536769 - RNA, 22 nt, Human
cugccuggaccggcagcccucc

SEQ ID NO: 536770 - RNA, 22 nt, Human
ucaagaauagcugcaaacaggg

SEQ ID NO: 536771 - RNA, 22 nt, Human
uguaguaagugcgcaauaaaua

SEQ ID NO: 536772 - RNA, 22 nt, Human
gcugcuggcaucuagggggugg

SEQ ID NO: 536773 - RNA, 22 nt, Human
acacuuuuguuugaagucucca

SEQ ID NO: 536774 - RNA, 22 nt, Human
auuuccuaggguagaugucaca

SEQ ID NO: 536775 - RNA, 22 nt, Human
gagggaguaacguacuacagug

SEQ ID NO: 536776 - RNA, 22 nt, Human
ucccagagaaagucaaggucuu

SEQ ID NO: 536777 - RNA, 22 nt, Human
uguauacauuuaacuagauaga

SEQ ID NO: 536778 - RNA, 21 nt, Human
cagagcuguccaaacccugac

SEQ ID NO: 536779 - RNA, 22 nt, Human
aguaugaaucuuucagaccgua

SEQ ID NO: 536780 - RNA, 19 nt, Human
aucugaaguaggugcagcu

SEQ ID NO: 536781 - RNA, 22 nt, Human
gcuggguggaucggaggcucug

SEQ ID NO: 536782 - RNA, 22 nt, Human
cuuauguauauuuggaacguac

SEQ ID NO: 536783 - RNA, 22 nt, Human
guuccauaucacagcagacgaa

SEQ ID NO: 536784 - RNA, 22 nt, Human
aagagcauauuaauaguggaga

SEQ ID NO: 536785 - RNA, 22 nt, Human
agaggggaaggaugugauguga

SEQ ID NO: 536786 - RNA, 22 nt, Human
ggcuucagaagacuggacaggu

SEQ ID NO: 536787 - RNA, 22 nt, Human
aguguuuaaacugaagugauga

SEQ ID NO: 536788 - RNA, 22 nt, Human
acuuucaagcaagaacacuuug

SEQ ID NO: 536789 - RNA, 22 nt, Human
acauuuaaccaaacuguuuaau

SEQ ID NO: 536790 - RNA, 22 nt, Human
gaggccaggagugcuguaaguu

SEQ ID NO: 536791 - RNA, 20 nt, Human
ugcagggcugccucccagcu

SEQ ID NO: 536792 - RNA, 22 nt, Human
ucagacagauuuugacacuugc

SEQ ID NO: 536793 - RNA, 19 nt, Human
acauuuaaauucagaucuc

SEQ ID NO: 536794 - RNA, 22 nt, Human
cuggcuccuccaaggccuggag

SEQ ID NO: 536795 - RNA, 22 nt, Human
ccuggccucagacagagggugg

SEQ ID NO: 536796 - RNA, 22 nt, Human
gccucugcgccucagccgaccu

SEQ ID NO: 536797 - RNA, 22 nt, Human
auuaaauuaaguggcuaauuua

SEQ ID NO: 536798 - RNA, 22 nt, Human
gcacuagguaaguggguggcaa

SEQ ID NO: 536799 - RNA, 22 nt, Human
ugucuuuuaccuaaugagcugg

SEQ ID NO: 536800 - RNA, 22 nt, Human
ucaggcugcagcugucagcagc

SEQ ID NO: 536801 - RNA, 22 nt, Human
aguucaaaaagguaaaguuuau

SEQ ID NO: 536802 - RNA, 22 nt, Human
ucaguuuauagauauugcugau

SEQ ID NO: 536803 - RNA, 23 nt, Human
acaguuauagcugugaauaacau

SEQ ID NO: 536804 - RNA, 22 nt, Human
ugcuccagcgcugccaccaguu

SEQ ID NO: 536805 - RNA, 22 nt, Human
uaaaggcaugcaggugaaugua

SEQ ID NO: 536806 - RNA, 22 nt, Human
uggccaggaggcugcuucugac

SEQ ID NO: 536807 - RNA, 22 nt, Human
auugcaaaggucccauucaaga

SEQ ID NO: 536808 - RNA, 22 nt, Human
guggcauucucggcaccaucug

SEQ ID NO: 536809 - RNA, 22 nt, Human
guuuuuaucuaauagcaguuau

SEQ ID NO: 536810 - RNA, 22 nt, Human
gagaagaaauagaaucacauuu

SEQ ID NO: 536811 - RNA, 22 nt, Human
cauguaaaacacucagaacagu

SEQ ID NO: 536812 - RNA, 22 nt, Human
gaggaagaugguugaguggucc

SEQ ID NO: 536813 - RNA, 22 nt, Human
ugacagggugauuaugagagcu

SEQ ID NO: 536814 - RNA, 22 nt, Human
aaaugcugcagcuaguguguuu

SEQ ID NO: 536815 - RNA, 22 nt, Human
cacaugcauaaggauaauuacu

SEQ ID NO: 536816 - RNA, 22 nt, Human
cgugaaaugaguugaauuauug

SEQ ID NO: 536817 - RNA, 22 nt, Human
acagcaaaugguuuucugucug

SEQ ID NO: 536818 - RNA, 21 nt, Human
guagggacagagaguugguga

SEQ ID NO: 536819 - RNA, 22 nt, Human
ccuggcuguggcggugcucuca

SEQ ID NO: 536820 - RNA, 22 nt, Human
cugccagcucgccacaaugaca

SEQ ID NO: 536821 - RNA, 22 nt, Human
aagagcuguugucugcuuacug

SEQ ID NO: 536822 - RNA, 22 nt, Human
cagaaggcauagaugaaggccu

SEQ ID NO: 536823 - RNA, 22 nt, Human
uuucacauucuucugaaucuac

SEQ ID NO: 536824 - RNA, 22 nt, Human
aggucccagucugugaugacuc

SEQ ID NO: 536825 - RNA, 22 nt, Human
aaaggccagguuggcugguauu

SEQ ID NO: 536826 - RNA, 20 nt, Human
agaaaucagcauguccucug

SEQ ID NO: 536827 - RNA, 22 nt, Human
gugcaugugcauccauguguac

SEQ ID NO: 536828 - RNA, 22 nt, Human
aguggugucgugggaguggaag

SEQ ID NO: 536829 - RNA, 22 nt, Human
uuugggcucacuaugcugaaga

SEQ ID NO: 536830 - RNA, 22 nt, Human
gcugucuugaugauuggaugcu

SEQ ID NO: 536831 - RNA, 22 nt, Human
uggaagagaaaauccacccuua

SEQ ID NO: 536832 - RNA, 19 nt, Human
aauucuguuucagcagauc

SEQ ID NO: 536833 - RNA, 22 nt, Human
agcucuuuugugagcauuuggc

SEQ ID NO: 536834 - RNA, 22 nt, Human
gucccugggaugcccuucuggg

SEQ ID NO: 536835 - RNA, 18 nt, Human
caaagcucacguuccauc

SEQ ID NO: 536836 - RNA, 22 nt, Human
cauuguaagaggcuuugcagca

SEQ ID NO: 536837 - RNA, 22 nt, Human
cucaggggaccuggcuccgagu

SEQ ID NO: 536838 - RNA, 22 nt, Human
ccuggcugugugaccuuggcaa

SEQ ID NO: 536839 - RNA, 22 nt, Human
auauuuguuuggcagaguucag

SEQ ID NO: 536840 - RNA, 22 nt, Human
ucucaguguuguucugcagaug

SEQ ID NO: 536841 - RNA, 22 nt, Human
ggcugccuucagacuccagcuu

SEQ ID NO: 536842 - RNA, 22 nt, Human
uacaaacuuguuuuaaguaagu

SEQ ID NO: 536843 - RNA, 22 nt, Human
cagaggacaauagaauggaaag

SEQ ID NO: 536844 - RNA, 21 nt, Human
ccugagccuguuuauccagaa

SEQ ID NO: 536845 - RNA, 22 nt, Human
agaaagccucaaucuucaggcc

SEQ ID NO: 536846 - RNA, 22 nt, Human
aaagaugaucuacaaguucauu

SEQ ID NO: 536847 - RNA, 22 nt, Human
gagcagcuccagccgcaugacu

SEQ ID NO: 536848 - RNA, 22 nt, Human
ugcuauaagaauuauauuacuc

SEQ ID NO: 536849 - RNA, 22 nt, Human
gugucucuaucuaugccugaag

SEQ ID NO: 536850 - RNA, 22 nt, Human
agagucaacaucgagccacugg

SEQ ID NO: 536851 - RNA, 22 nt, Human
gguucacacuaagcuuaagugg

SEQ ID NO: 536852 - RNA, 22 nt, Human
guguucuuuauuuagugaugcu

SEQ ID NO: 536853 - RNA, 22 nt, Human
auauucacacuguuuaguuaca

SEQ ID NO: 536854 - RNA, 22 nt, Human
ggcugcuguuucagagacuguu

SEQ ID NO: 536855 - RNA, 22 nt, Human
ugucugguggguugacaggcag

SEQ ID NO: 536856 - RNA, 22 nt, Human
ccugggaagcccauagcagcuu

SEQ ID NO: 536857 - RNA, 22 nt, Human
aguuuguaauaaugaaggaagu

SEQ ID NO: 536858 - RNA, 22 nt, Human
cuggcucccguuguccuugaag

SEQ ID NO: 536859 - RNA, 16 nt, Human
ggggaaggcaagaggg

SEQ ID NO: 536860 - RNA, 22 nt, Human
uacaguaaccuuauuugucauu

SEQ ID NO: 536861 - RNA, 22 nt, Human
uuucacaguuagcaugaggacu

SEQ ID NO: 536862 - RNA, 22 nt, Human
ucugggcugaaaugaaggccuu

SEQ ID NO: 536863 - RNA, 22 nt, Human
ucugggguuggugcuuacacca

SEQ ID NO: 536864 - RNA, 22 nt, Human
gaagcagccacggggagacaga

SEQ ID NO: 536865 - RNA, 22 nt, Human
accagugggaaguggaaaauga

SEQ ID NO: 536866 - RNA, 22 nt, Human
ccacuguaaguuugaaaauaac

SEQ ID NO: 536867 - RNA, 22 nt, Human
ugggucagaaucagagaguugc

SEQ ID NO: 536868 - RNA, 22 nt, Human
ucacuuauaaaaugcaagaucu

SEQ ID NO: 536869 - RNA, 22 nt, Human
cuuccaaauguaaauaaguuuc

SEQ ID NO: 536870 - RNA, 22 nt, Human
caaaugcuggcccugcuacuua

SEQ ID NO: 536871 - RNA, 22 nt, Human
caggccucuuccaugcagcagc

SEQ ID NO: 536872 - RNA, 20 nt, Human
aggaggaagaaagcacacug

SEQ ID NO: 536873 - RNA, 22 nt, Human
aggugcaguggcucaugccugu

SEQ ID NO: 536874 - RNA, 22 nt, Human
accuuaaaugugacauagucua

SEQ ID NO: 536875 - RNA, 22 nt, Human
cacagugauugauuuuuacuuu

SEQ ID NO: 536876 - RNA, 22 nt, Human
cugggcaggauacuucauggga

SEQ ID NO: 536877 - RNA, 20 nt, Human
acaauauguagaugaauagc

SEQ ID NO: 536878 - RNA, 22 nt, Human
ugcagaagaaaacagcugugug

SEQ ID NO: 536879 - RNA, 22 nt, Human
acuguucacccagcacuagcag

SEQ ID NO: 536880 - RNA, 22 nt, Human
cuacugaguccuucagcugcca

SEQ ID NO: 536881 - RNA, 22 nt, Human
cacuauuuucucuucagauggc

SEQ ID NO: 536882 - RNA, 22 nt, Human
uuuaugcagccucaguaucaga

SEQ ID NO: 536883 - RNA, 22 nt, Human
cagaggggcugacacccuuggc

SEQ ID NO: 536884 - RNA, 22 nt, Human
gggaccugccauugcucacagg

SEQ ID NO: 536885 - RNA, 22 nt, Human
gacuauuuugcacaaaacaauu

SEQ ID NO: 536886 - RNA, 22 nt, Human
accaaggaagagauucucaguu

SEQ ID NO: 536887 - RNA, 22 nt, Human
gcucuguaugagggugagagau

SEQ ID NO: 536888 - RNA, 23 nt, Human
cccagagucaucuguagcugugg

SEQ ID NO: 536889 - RNA, 22 nt, Human
ugcucagccgugagcagagccg

SEQ ID NO: 536890 - RNA, 22 nt, Human
gugggaugguagguagguaaua

SEQ ID NO: 536891 - RNA, 22 nt, Human
acagugauaaaauuucacaugu

SEQ ID NO: 536892 - RNA, 18 nt, Human
aaauguacuguccauggc

SEQ ID NO: 536893 - RNA, 22 nt, Human
acuuuuuuauaaggaagaagau

SEQ ID NO: 536894 - RNA, 22 nt, Human
agauuucugucaccuucuaugc

SEQ ID NO: 536895 - RNA, 22 nt, Human
ggcuccaaagggcagugugagg

SEQ ID NO: 536896 - RNA, 22 nt, Human
ugccaggcccugcgggguccca

SEQ ID NO: 536897 - RNA, 22 nt, Human
augaaggcaguuaaacgucauc

SEQ ID NO: 536898 - RNA, 22 nt, Human
cugggcagugcagcuauagaac

SEQ ID NO: 536899 - RNA, 22 nt, Human
ucuggccaggauggcaagacca

SEQ ID NO: 536900 - RNA, 22 nt, Human
agagugauucuaguuagggaau

SEQ ID NO: 536901 - RNA, 22 nt, Human
cuuuuccuauugauucuguuac

SEQ ID NO: 536902 - RNA, 22 nt, Human
agcagguggccuccugucuguc

SEQ ID NO: 536903 - RNA, 22 nt, Human
gugccuuccccgguggucuguu

SEQ ID NO: 536904 - RNA, 22 nt, Human
aauacuuuccuauauaaggugc

SEQ ID NO: 536905 - RNA, 22 nt, Human
gagucugaugucccccaggcca

SEQ ID NO: 536906 - RNA, 22 nt, Human
cuguaaaaugaaccuagucauc

SEQ ID NO: 536907 - RNA, 22 nt, Human
cacugaagccacuggaagagga

SEQ ID NO: 536908 - RNA, 23 nt, Human
gggcagguuuuuauaggcuucag

SEQ ID NO: 536909 - RNA, 21 nt, Human
ccuccaggugauuccgugcuc

SEQ ID NO: 536910 - RNA, 21 nt, Human
gcucccugcucagcuccuggg

SEQ ID NO: 536911 - RNA, 22 nt, Human
ccugggcaauauagugaggccc

SEQ ID NO: 536912 - RNA, 22 nt, Human
caagagcuggguggcaagcuag

SEQ ID NO: 536913 - RNA, 22 nt, Human
acuggcugcgggguggaagaag

SEQ ID NO: 536914 - RNA, 22 nt, Human
ucuucaaauccuacagugucug

SEQ ID NO: 536915 - RNA, 22 nt, Human
ucugggagaagcugaugugaag

SEQ ID NO: 536916 - RNA, 22 nt, Human
gcuggccugcgagggcaggcug

SEQ ID NO: 536917 - RNA, 22 nt, Human
agcaaagcugauuaagagcaca

SEQ ID NO: 536918 - RNA, 22 nt, Human
guacacacuauguauuguacac

SEQ ID NO: 536919 - RNA, 22 nt, Human
ugcaggcugugucauuuaguga

SEQ ID NO: 536920 - RNA, 22 nt, Human
gaaggccauuagagccugugcc

SEQ ID NO: 536921 - RNA, 19 nt, Human
uuuguaaguccuuacugau

SEQ ID NO: 536922 - RNA, 22 nt, Human
cugggcuguucugccccugggu

SEQ ID NO: 536923 - RNA, 22 nt, Human
guuauaaaugacugcaaaaguu

SEQ ID NO: 536924 - RNA, 22 nt, Human
aguucugguuaaccugcaaccu

SEQ ID NO: 536925 - RNA, 22 nt, Human
guuaaagaguuuggcuuucuuc

SEQ ID NO: 536926 - RNA, 22 nt, Human
aaagccuucaaguagauguaag

SEQ ID NO: 536927 - RNA, 22 nt, Human
gccuccugcccagaugagugau

SEQ ID NO: 536928 - RNA, 22 nt, Human
gugcuuaaggcagucugucaaa

SEQ ID NO: 536929 - RNA, 20 nt, Human
gauuucaaagcagaguggcc

SEQ ID NO: 536930 - RNA, 22 nt, Human
uucuuuuuaaaguguguaugca

SEQ ID NO: 536931 - RNA, 22 nt, Human
uggacccugaagcaacagggag

SEQ ID NO: 536932 - RNA, 22 nt, Human
guggauggauuuugaggaaugg

SEQ ID NO: 536933 - RNA, 22 nt, Human
uuauuguuuacuaguuugcaga

SEQ ID NO: 536934 - RNA, 22 nt, Human
guuauguaaucuaacacucagu

SEQ ID NO: 536935 - RNA, 22 nt, Human
aggcuuaacuuaacuuuagagc

SEQ ID NO: 536936 - RNA, 22 nt, Human
ggcagagcuugcagugagccga

SEQ ID NO: 536937 - RNA, 22 nt, Human
gccuaggaguacagaaugguuu

SEQ ID NO: 536938 - RNA, 22 nt, Human
cuauucaauuuugcuauuguag

SEQ ID NO: 536939 - RNA, 22 nt, Human
cacacauugaauucauucuugu

SEQ ID NO: 536940 - RNA, 22 nt, Human
uccaggccaggguaagaggaga

SEQ ID NO: 536941 - RNA, 22 nt, Human
gccugccacgcaugcagaguca

SEQ ID NO: 536942 - RNA, 22 nt, Human
ugaccaaagacuuuagauguuc

SEQ ID NO: 536943 - RNA, 22 nt, Human
agugaucuuuuaaaaagaagug

SEQ ID NO: 536944 - RNA, 22 nt, Human
augaaugaugccaguugaaaug

SEQ ID NO: 536945 - RNA, 22 nt, Human
ucagagcccugcuccuccccaa

SEQ ID NO: 536946 - RNA, 22 nt, Human
ugccuugguucucuacuuggag

SEQ ID NO: 536947 - RNA, 22 nt, Human
cugggcugcaucaaagaggcau

SEQ ID NO: 536948 - RNA, 22 nt, Human
gcugcugggguggagaaacgcu

SEQ ID NO: 536949 - RNA, 22 nt, Human
ugaccaaaaaauucccugugag

SEQ ID NO: 536950 - RNA, 22 nt, Human
cuguaugaguugggaauagaau

SEQ ID NO: 536951 - RNA, 22 nt, Human
aaaaccaggcguuuccuauuau

SEQ ID NO: 536952 - RNA, 18 nt, Human
cagagcagagguggagcg

SEQ ID NO: 536953 - RNA, 20 nt, Human
ucuguaaagacuccagaagc

SEQ ID NO: 536954 - RNA, 22 nt, Human
acacugaauaauugagaguuga

SEQ ID NO: 536955 - RNA, 22 nt, Human
uugcauugggagugaggagacc

SEQ ID NO: 536956 - RNA, 20 nt, Human
cagcaggaaaagugccucag

SEQ ID NO: 536957 - RNA, 22 nt, Human
auuuuguuuccuuuggaguaga

SEQ ID NO: 536958 - RNA, 22 nt, Human
agaagcaguuauuuuuugcaca

SEQ ID NO: 536959 - RNA, 22 nt, Human
uggcugaguaaguugugauaug

SEQ ID NO: 536960 - RNA, 22 nt, Human
uguggcagucucacuggagggc

SEQ ID NO: 536961 - RNA, 22 nt, Human
cuucaguuuaucccaucaucca

SEQ ID NO: 536962 - RNA, 22 nt, Human
auuucuuccauugccucuucaa

SEQ ID NO: 536963 - RNA, 22 nt, Human
uacauguauguguuaauaucug

SEQ ID NO: 536964 - RNA, 22 nt, Human
ggcugccaggagaagcucagug

SEQ ID NO: 536965 - RNA, 22 nt, Human
aagaugguaaggcagcuggcag

SEQ ID NO: 536966 - RNA, 22 nt, Human
gguggcucagugucaggcccug

SEQ ID NO: 536967 - RNA, 22 nt, Human
uagcagaguagugccuccagau

SEQ ID NO: 536968 - RNA, 22 nt, Human
cuuaaaguagaauacaagaccu

SEQ ID NO: 536969 - RNA, 22 nt, Human
ugcugccuaacagaacucuuuc

SEQ ID NO: 536970 - RNA, 22 nt, Human
uucugaaaggcagguuguuugc

SEQ ID NO: 536971 - RNA, 22 nt, Human
acugccaaugguaguuugaugg

SEQ ID NO: 536972 - RNA, 22 nt, Human
ugaaccaggaggcagccagcac

SEQ ID NO: 536973 - RNA, 22 nt, Human
gugguaauuuaauccuacacug

SEQ ID NO: 536974 - RNA, 22 nt, Human
gccuguccuggaugcucugcaa

SEQ ID NO: 536975 - RNA, 22 nt, Human
caguuucuuagugacacaaauc

SEQ ID NO: 536976 - RNA, 22 nt, Human
caaugucagaauuacaguugau

SEQ ID NO: 536977 - RNA, 22 nt, Human
ggcaaaaaccacaauuacuuuu

SEQ ID NO: 536978 - RNA, 21 nt, Human
agcugagcccagaagacuggu

SEQ ID NO: 536979 - RNA, 22 nt, Human
acagaauagagacugccugcuc

SEQ ID NO: 536980 - RNA, 19 nt, Human
aauauuuuagccucuuccu

SEQ ID NO: 536981 - RNA, 22 nt, Human
ucaaaugcucuuugcagagagg

SEQ ID NO: 536982 - RNA, 22 nt, Human
ucaaauaccagcaauuucaugu

SEQ ID NO: 536983 - RNA, 19 nt, Human
cuggggcuuugguacugcc

SEQ ID NO: 536984 - RNA, 22 nt, Human
aagauuucugcuuuuggaggca

SEQ ID NO: 536985 - RNA, 22 nt, Human
ucucugggaaugggccugggua

SEQ ID NO: 536986 - RNA, 22 nt, Human
uuugacaaaauuaugcuaauau

SEQ ID NO: 536987 - RNA, 19 nt, Human
gggcagaauggcaucucag

SEQ ID NO: 536988 - RNA, 22 nt, Human
auugaaagauuuugggcucaug

SEQ ID NO: 536989 - RNA, 20 nt, Human
gcucccugguagaaauguuu

SEQ ID NO: 536990 - RNA, 22 nt, Human
uacuacauuaauaaaacauuca

SEQ ID NO: 536991 - RNA, 22 nt, Human
uuaaugaauaugacaggagagg

SEQ ID NO: 536992 - RNA, 20 nt, Human
acugcuucuuucucugaccu

SEQ ID NO: 536993 - RNA, 22 nt, Human
ugcugcaggaauucucaaggga

SEQ ID NO: 536994 - RNA, 22 nt, Human
agugcagguuaaggaacuggcc

SEQ ID NO: 536995 - RNA, 18 nt, Human
ggagagugacagagucgu

SEQ ID NO: 536996 - RNA, 22 nt, Human
augauacaagcaaaacuaauca

SEQ ID NO: 536997 - RNA, 22 nt, Human
cugugaaaugcuuugcgauggu

SEQ ID NO: 536998 - RNA, 22 nt, Human
uggcagcuugaaugcagucuuu

SEQ ID NO: 536999 - RNA, 22 nt, Human
gcccaggcuggagugcaguagc

SEQ ID NO: 537000 - RNA, 23 nt, Human
aucaagauaauccagaugaccua

SEQ ID NO: 537001 - RNA, 23 nt, Human
uggcauuuuaguuagcuucagug

SEQ ID NO: 537002 - RNA, 22 nt, Human
agaaaucacuuaaugaacguag

SEQ ID NO: 537003 - RNA, 19 nt, Human
cugaggcccauguaccaug

SEQ ID NO: 537004 - RNA, 22 nt, Human
cuggagggugagccucaucucu

SEQ ID NO: 537005 - RNA, 22 nt, Human
ggccugugagcccuugcaugua

SEQ ID NO: 537006 - RNA, 22 nt, Human
ucugcagaaguggcugggccac

SEQ ID NO: 537007 - RNA, 22 nt, Human
gagagcccugcuccuaucccag

SEQ ID NO: 537008 - RNA, 22 nt, Human
gcauccaaauguuucauuucuu

SEQ ID NO: 537009 - RNA, 18 nt, Human
aacaugcauuagaacugc

SEQ ID NO: 537010 - RNA, 22 nt, Human
acuauacaccaaaauauuaagg

SEQ ID NO: 537011 - RNA, 23 nt, Human
caugggagugagaaugccagcuc

SEQ ID NO: 537012 - RNA, 22 nt, Human
gagcuagaguuuguaggguaga

SEQ ID NO: 537013 - RNA, 22 nt, Human
gaugaaaaucuugagaugucga

SEQ ID NO: 537014 - RNA, 17 nt, Human
gaagaaggaaucuagaa

SEQ ID NO: 537015 - RNA, 22 nt, Human
ggaggagacaguaaaaagcacg

SEQ ID NO: 537016 - RNA, 22 nt, Human
gugggcuuuggccucuuucucc

SEQ ID NO: 537017 - RNA, 22 nt, Human
aggcacugacaauucuggacug

SEQ ID NO: 537018 - RNA, 22 nt, Human
cugggccacaagccugugugau

SEQ ID NO: 537019 - RNA, 22 nt, Human
auuugucaacaggcauuuaggu

SEQ ID NO: 537020 - RNA, 22 nt, Human
ucacaggguaucugggauggau

SEQ ID NO: 537021 - RNA, 22 nt, Human
cagcuuugauucuuucugccau

SEQ ID NO: 537022 - RNA, 20 nt, Human
cagcucugggaaagaggcca

SEQ ID NO: 537023 - RNA, 22 nt, Human
gugcugaguagaaugaaugccu

SEQ ID NO: 537024 - RNA, 22 nt, Human
ucuucacagaugcauauacuuc

SEQ ID NO: 537025 - RNA, 20 nt, Human
uggaccugucucuuuaggga

SEQ ID NO: 537026 - RNA, 22 nt, Human
ucaggugguccuaagugccauc

SEQ ID NO: 537027 - RNA, 22 nt, Human
gcuccuggguguggcugccccu

SEQ ID NO: 537028 - RNA, 22 nt, Human
uaagaaacaugauuaauggcag

SEQ ID NO: 537029 - RNA, 22 nt, Human
ggcaggguguggaguugggaca

SEQ ID NO: 537030 - RNA, 22 nt, Human
agccuccuggaguuucugggau

SEQ ID NO: 537031 - RNA, 22 nt, Human
uuucuggaaacggguucaagcu

SEQ ID NO: 537032 - RNA, 22 nt, Human
uuccagaacaauguggacguau

SEQ ID NO: 537033 - RNA, 20 nt, Human
cagcaaaaugaaaauggauu

SEQ ID NO: 537034 - RNA, 22 nt, Human
uccugcaguuacaucccagcca

SEQ ID NO: 537035 - RNA, 22 nt, Human
ccauuguaguaucuguuuuagu

SEQ ID NO: 537036 - RNA, 22 nt, Human
ccuccuggugggcgcuucuggc

SEQ ID NO: 537037 - RNA, 22 nt, Human
auguuucaugacugagcaaaau

SEQ ID NO: 537038 - RNA, 22 nt, Human
acuguucacagauuagucgaug

SEQ ID NO: 537039 - RNA, 22 nt, Human
ucuauaaaacucaagagcaauu

SEQ ID NO: 537040 - RNA, 22 nt, Human
uaagucauagauuaauggccac

SEQ ID NO: 537041 - RNA, 22 nt, Human
ugaugggacugccagcugcuga

SEQ ID NO: 537042 - RNA, 22 nt, Human
uguuucaacuguuaagauaugc

SEQ ID NO: 537043 - RNA, 22 nt, Human
ccuggagauuauuugguccaau

SEQ ID NO: 537044 - RNA, 22 nt, Human
gguuugcacgauauuuccaugg

SEQ ID NO: 537045 - RNA, 22 nt, Human
ucauugcaguugaguuguguua

SEQ ID NO: 537046 - RNA, 22 nt, Human
ucuguaucacccguucccagaa

SEQ ID NO: 537047 - RNA, 22 nt, Human
acagggcagcaacuuugugccu

SEQ ID NO: 537048 - RNA, 22 nt, Human
aagcgccaugguuccugcgcag

SEQ ID NO: 537049 - RNA, 22 nt, Human
cuacaaaaguaauugugguuuu

SEQ ID NO: 537050 - RNA, 23 nt, Human
ugcuccagccucuuugauagugu

SEQ ID NO: 537051 - RNA, 22 nt, Human
ugaggccagucucaucacaggc

SEQ ID NO: 537052 - RNA, 22 nt, Human
auuauuauaaagugcaugaccu

SEQ ID NO: 537053 - RNA, 20 nt, Human
ugcucaggauggagaggugu

SEQ ID NO: 537054 - RNA, 22 nt, Human
aguggagguuauugaguuaagg

SEQ ID NO: 537055 - RNA, 22 nt, Human
auuuucaugacuaccuuaaaua

SEQ ID NO: 537056 - RNA, 22 nt, Human
aauacuugugaauucaaagucu

SEQ ID NO: 537057 - RNA, 22 nt, Human
uccuucagauuccugcuucugg

SEQ ID NO: 537058 - RNA, 22 nt, Human
cagcuguugacugguacaugaa

SEQ ID NO: 537059 - RNA, 21 nt, Human
agcugggccucagccugcagu

SEQ ID NO: 537060 - RNA, 22 nt, Human
gcagcaaucuucacagugucau

SEQ ID NO: 537061 - RNA, 22 nt, Human
agaggccagcagugccuaucug

SEQ ID NO: 537062 - RNA, 22 nt, Human
ggcagccaugucccagggcuuc

SEQ ID NO: 537063 - RNA, 21 nt, Human
ggcacagccugaaaugccuca

SEQ ID NO: 537064 - RNA, 22 nt, Human
ucuuggccagguguggugccuc

SEQ ID NO: 537065 - RNA, 22 nt, Human
agugaggggcagcugagugggc

SEQ ID NO: 537066 - RNA, 22 nt, Human
uuccucaggcuucccuuugucc

SEQ ID NO: 537067 - RNA, 23 nt, Human
guggccuccccggaaugccucgc

SEQ ID NO: 537068 - RNA, 22 nt, Human
agaucagaaauguaauggcagu

SEQ ID NO: 537069 - RNA, 22 nt, Human
gggccacauugaagggugggua

SEQ ID NO: 537070 - RNA, 22 nt, Human
guuucauaauucaaucaaauga

SEQ ID NO: 537071 - RNA, 19 nt, Human
ccagcuggccugggaccuc

SEQ ID NO: 537072 - RNA, 22 nt, Human
uccuuuuuauaguuagagaaac

SEQ ID NO: 537073 - RNA, 19 nt, Human
cugcucaggucagucuguc

SEQ ID NO: 537074 - RNA, 22 nt, Human
agcugcccuggcggagcugcuc

SEQ ID NO: 537075 - RNA, 22 nt, Human
uucacaauagcuggcaucaucu

SEQ ID NO: 537076 - RNA, 22 nt, Human
acagcaggcacacaaggauaga

SEQ ID NO: 537077 - RNA, 22 nt, Human
aagaguuaagcaacagauacca

SEQ ID NO: 537078 - RNA, 21 nt, Human
aguuacauguauagauaaagu

SEQ ID NO: 537079 - RNA, 22 nt, Human
ccuguucaaugcccuggcuuca

SEQ ID NO: 537080 - RNA, 23 nt, Human
ucacagggcacuggcugggguug

SEQ ID NO: 537081 - RNA, 20 nt, Human
agucucuguagugccugaga

SEQ ID NO: 537082 - RNA, 20 nt, Human
uagaaaucuuauaaaagacu

SEQ ID NO: 537083 - RNA, 20 nt, Human
aauuuuaucuccauccuuug

SEQ ID NO: 537084 - RNA, 22 nt, Human
ucaggccuucagaccuggcccg

SEQ ID NO: 537085 - RNA, 23 nt, Human
ucaugcccaggcuccagauguca

SEQ ID NO: 537086 - RNA, 22 nt, Human
cagagugagggccugcaccugc

SEQ ID NO: 537087 - RNA, 22 nt, Human
ggcaggcuguucaccugcuuuu

SEQ ID NO: 537088 - RNA, 22 nt, Human
aaguacaaauuuugaagagcuu

SEQ ID NO: 537089 - RNA, 22 nt, Human
gcucuccacugaccacggggca

SEQ ID NO: 537090 - RNA, 22 nt, Human
uagcagcucacagccucccauu

SEQ ID NO: 537091 - RNA, 22 nt, Human
auguguacaaccaagcacuaaa

SEQ ID NO: 537092 - RNA, 22 nt, Human
uucuaagaggcuaaugaagaau

SEQ ID NO: 537093 - RNA, 21 nt, Human
uaucagaagagaaagaaugau

SEQ ID NO: 537094 - RNA, 22 nt, Human
uucuuaaguuuagcaacuugug

SEQ ID NO: 537095 - RNA, 22 nt, Human
cagcucagcuuccugggugugu

SEQ ID NO: 537096 - RNA, 20 nt, Human
ucucugcuguccacauuugc

SEQ ID NO: 537097 - RNA, 22 nt, Human
agccucuguagaaagcagugug

SEQ ID NO: 537098 - RNA, 22 nt, Human
ucagcaguguaguuuaucauuc

SEQ ID NO: 537099 - RNA, 22 nt, Human
gcaagaccuaucuaguugcugu

SEQ ID NO: 537100 - RNA, 19 nt, Human
ugagagugaggaaggcuuc

SEQ ID NO: 537101 - RNA, 22 nt, Human
ccuuuucuguuuccugucacug

SEQ ID NO: 537102 - RNA, 22 nt, Human
caagaugaaugaugaagugugu

SEQ ID NO: 537103 - RNA, 22 nt, Human
ugguccagaugccuuggcuuua

SEQ ID NO: 537104 - RNA, 22 nt, Human
agugggggcuggcucugucugu

SEQ ID NO: 537105 - RNA, 22 nt, Human
ugggaagggccgauggagccuc

SEQ ID NO: 537106 - RNA, 22 nt, Human
uggaaggaagccaaggaagguu

SEQ ID NO: 537107 - RNA, 22 nt, Human
aaacucuguagcuaaacauaau

SEQ ID NO: 537108 - RNA, 22 nt, Human
accugcagccacuucucuccuu

SEQ ID NO: 537109 - RNA, 22 nt, Human
ucccagcgcggggggaggaucc

SEQ ID NO: 537110 - RNA, 22 nt, Human
ugaaagagugcaagucaaggag

SEQ ID NO: 537111 - RNA, 23 nt, Human
uagggcagcugggagggacaugc

SEQ ID NO: 537112 - RNA, 22 nt, Human
acaggcugcugagccauuugcu

SEQ ID NO: 537113 - RNA, 22 nt, Human
uauaaagaauccagaagagaca

SEQ ID NO: 537114 - RNA, 17 nt, Human
gacaggcucagugacga

SEQ ID NO: 537115 - RNA, 22 nt, Human
augcugugucaggaauuugaua

SEQ ID NO: 537116 - RNA, 22 nt, Human
ugcuucuguuuguuucugucau

SEQ ID NO: 537117 - RNA, 20 nt, Human
aggcucagagcaguaguaca

SEQ ID NO: 537118 - RNA, 22 nt, Human
ggcugugagcaggcagaaugcu

SEQ ID NO: 537119 - RNA, 22 nt, Human
agugaaauagcauuuaugaagc

SEQ ID NO: 537120 - RNA, 22 nt, Human
uuauuucauauaauguuaucaa

SEQ ID NO: 537121 - RNA, 22 nt, Human
cugccaggccucaucccagcca

SEQ ID NO: 537122 - RNA, 22 nt, Human
agccacagcccacaggacucuu

SEQ ID NO: 537123 - RNA, 21 nt, Human
uaguguagcugcagcagcaga

SEQ ID NO: 537124 - RNA, 22 nt, Human
gcuguucucuguaacaugcauu

SEQ ID NO: 537125 - RNA, 22 nt, Human
uucuucaauaaauucccauaag

SEQ ID NO: 537126 - RNA, 22 nt, Human
uaauuucacaguucaacgcaca

SEQ ID NO: 537127 - RNA, 22 nt, Human
ugaaauuaugcauuguuguacc

SEQ ID NO: 537128 - RNA, 22 nt, Human
acagaaagaagguguauuugag

SEQ ID NO: 537129 - RNA, 22 nt, Human
ucccagcagagccagcaagccg

SEQ ID NO: 537130 - RNA, 22 nt, Human
aucacaaucuucaaaucgauuc

SEQ ID NO: 537131 - RNA, 22 nt, Human
ugccugggccucugaggaaggc

SEQ ID NO: 537132 - RNA, 22 nt, Human
gcagggcugagucaugugugcc

SEQ ID NO: 537133 - RNA, 22 nt, Human
uaaaguaauccuucauaaggag

SEQ ID NO: 537134 - RNA, 22 nt, Human
aagcaaaacgugcucuaggagg

SEQ ID NO: 537135 - RNA, 22 nt, Human
cugaaccaucucuguucuguau

SEQ ID NO: 537136 - RNA, 22 nt, Human
gucccuggggaaucagcuggag

SEQ ID NO: 537137 - RNA, 22 nt, Human
augaaucagaaucugcauuuua

SEQ ID NO: 537138 - RNA, 22 nt, Human
aguuuuucugcuggucucacua

SEQ ID NO: 537139 - RNA, 22 nt, Human
uggggcagggaugggaaacuau

SEQ ID NO: 537140 - RNA, 22 nt, Human
gggcaggugccagcucccuguc

SEQ ID NO: 537141 - RNA, 22 nt, Human
gguggcagaggugcaucagccc

SEQ ID NO: 537142 - RNA, 22 nt, Human
cugagcuggucuauggacuugg

SEQ ID NO: 537143 - RNA, 22 nt, Human
ucaggugggucuacaauuaguu

SEQ ID NO: 537144 - RNA, 22 nt, Human
agauuuguaugucuaaauguaa

SEQ ID NO: 537145 - RNA, 22 nt, Human
cacaagucuguggucuccaaca

SEQ ID NO: 537146 - RNA, 22 nt, Human
ggccaccucugcccuacugagu

SEQ ID NO: 537147 - RNA, 22 nt, Human
gaggccugaaaggggaccuaug

SEQ ID NO: 537148 - RNA, 22 nt, Human
auauuaguguagguagcuaaua

SEQ ID NO: 537149 - RNA, 22 nt, Human
ugaaagcagugccaugauuaug

SEQ ID NO: 537150 - RNA, 22 nt, Human
uaugugcagcacuugccauuac

SEQ ID NO: 537151 - RNA, 22 nt, Human
ugggccaggucugcggucauuu

SEQ ID NO: 537152 - RNA, 22 nt, Human
uauuuuguaauuggucauagcu

SEQ ID NO: 537153 - RNA, 22 nt, Human
ugcuucugacugggucaguuga

SEQ ID NO: 537154 - RNA, 22 nt, Human
aaacaauuuccaccucuccuga

SEQ ID NO: 537155 - RNA, 19 nt, Human
auaaggcagugacuuuuuu

SEQ ID NO: 537156 - RNA, 22 nt, Human
cagcauggggaucacuguaggc

SEQ ID NO: 537157 - RNA, 22 nt, Human
acaagguaagaaacauuggcuu

SEQ ID NO: 537158 - RNA, 22 nt, Human
uuugcucugcuguugccaggug

SEQ ID NO: 537159 - RNA, 22 nt, Human
gacagguggggaaacuaaggua

SEQ ID NO: 537160 - RNA, 22 nt, Human
cagagacagaaaauggaucuag

SEQ ID NO: 537161 - RNA, 22 nt, Human
cauacagagaaggauaauaaag

SEQ ID NO: 537162 - RNA, 22 nt, Human
cuccaggguuccccgauccacu

SEQ ID NO: 537163 - RNA, 22 nt, Human
ugauuucuuccuugucauuaga

SEQ ID NO: 537164 - RNA, 22 nt, Human
aggccugagguuccugugcuca

SEQ ID NO: 537165 - RNA, 22 nt, Human
gcuggcuguguuucaucucuga

SEQ ID NO: 537166 - RNA, 22 nt, Human
gcuugcauuuggaauagauuaa

SEQ ID NO: 537167 - RNA, 22 nt, Human
cucugggcaaguaugauagaaa

SEQ ID NO: 537168 - RNA, 22 nt, Human
cugaggugagcuucccugggcu

SEQ ID NO: 537169 - RNA, 22 nt, Human
cagagccaggucuaggagucuc

SEQ ID NO: 537170 - RNA, 22 nt, Human
aaagcagggaugaggcuagagg

SEQ ID NO: 537171 - RNA, 22 nt, Human
aggcuucacgaugggugaggug

SEQ ID NO: 537172 - RNA, 22 nt, Human
guuucauucggcagcucauaag

SEQ ID NO: 537173 - RNA, 22 nt, Human
cacacaauuaugugugcacaau

SEQ ID NO: 537174 - RNA, 22 nt, Human
gccuggagaccugcuccucuac

SEQ ID NO: 537175 - RNA, 22 nt, Human
ucuucuuuaugucauaugccag

SEQ ID NO: 537176 - RNA, 22 nt, Human
cugggccuccagcucugccagc

SEQ ID NO: 537177 - RNA, 22 nt, Human
cccacacaaaucauggggagaa

SEQ ID NO: 537178 - RNA, 22 nt, Human
ccuuucucuuggauaccgauug

SEQ ID NO: 537179 - RNA, 19 nt, Human
uuucuuccaaagacuaugg

SEQ ID NO: 537180 - RNA, 22 nt, Human
agcaggggcaggguuuugugcu

SEQ ID NO: 537181 - RNA, 22 nt, Human
acauucuauuucaucaugucua

SEQ ID NO: 537182 - RNA, 22 nt, Human
auauuugucaucugccuuaguu

SEQ ID NO: 537183 - RNA, 22 nt, Human
agauuccuaaaguaagauauca

SEQ ID NO: 537184 - RNA, 22 nt, Human
gagggcuuccauggggagcccc

SEQ ID NO: 537185 - RNA, 22 nt, Human
guuucuuaaguuacaaaaucuu

SEQ ID NO: 537186 - RNA, 20 nt, Human
accuugaacccgccagccau

SEQ ID NO: 537187 - RNA, 22 nt, Human
cagggcucagaagacagaccuc

SEQ ID NO: 537188 - RNA, 22 nt, Human
gaccauuuguugaaaagauuau

SEQ ID NO: 537189 - RNA, 22 nt, Human
aaaguuggauuucauccucaug

SEQ ID NO: 537190 - RNA, 22 nt, Human
cccaggcagcggggucuccuug

SEQ ID NO: 537191 - RNA, 22 nt, Human
aucaguuuaacugucaagagcc

SEQ ID NO: 537192 - RNA, 22 nt, Human
cucugggcacuguauggguucu

SEQ ID NO: 537193 - RNA, 22 nt, Human
aggaaaaauaaggcagcagggc

SEQ ID NO: 537194 - RNA, 22 nt, Human
ucucccaggcuggagugcagug

SEQ ID NO: 537195 - RNA, 22 nt, Human
agguccuguguccaggggccug

SEQ ID NO: 537196 - RNA, 22 nt, Human
aaguuguauauaccgcuuuaag

SEQ ID NO: 537197 - RNA, 22 nt, Human
gcuccugggcucuaccuugcua

SEQ ID NO: 537198 - RNA, 22 nt, Human
ggccucugaggacagccuuggc

SEQ ID NO: 537199 - RNA, 22 nt, Human
uccagcccgacugggccugccg

SEQ ID NO: 537200 - RNA, 21 nt, Human
cagggcacacagaggauggua

SEQ ID NO: 537201 - RNA, 19 nt, Human
caaaguaccuggcacagug

SEQ ID NO: 537202 - RNA, 22 nt, Human
uugaaagugauggggaagaugg

SEQ ID NO: 537203 - RNA, 22 nt, Human
gcagauggcugagccugcagau

SEQ ID NO: 537204 - RNA, 22 nt, Human
ugcuucugucucuuaugccuug

SEQ ID NO: 537205 - RNA, 22 nt, Human
aggcugagcaaagggccuuacc

SEQ ID NO: 537206 - RNA, 22 nt, Human
uuuauuaugauggacaccuucg

SEQ ID NO: 537207 - RNA, 22 nt, Human
cauuuguuaaccaguguggauu

SEQ ID NO: 537208 - RNA, 22 nt, Human
ugaagccacagagcaucugccu

SEQ ID NO: 537209 - RNA, 22 nt, Human
gcucugggaacugacugccuuc

SEQ ID NO: 537210 - RNA, 22 nt, Human
cacagcuucccaaaguggaccu

SEQ ID NO: 537211 - RNA, 20 nt, Human
cacugggcuggagucagggc

SEQ ID NO: 537212 - RNA, 22 nt, Human
uuucaaguggggacauuugaga

SEQ ID NO: 537213 - RNA, 22 nt, Human
uucuuguaauuuggagaaauga

SEQ ID NO: 537214 - RNA, 22 nt, Human
acagggccauuaucuguucuag

SEQ ID NO: 537215 - RNA, 22 nt, Human
gggaagggagggaccucagucu

SEQ ID NO: 537216 - RNA, 22 nt, Human
acuagcagggauauuauauaag

SEQ ID NO: 537217 - RNA, 22 nt, Human
agcagguuguuuuguggccagg

SEQ ID NO: 537218 - RNA, 23 nt, Human
ggcagcucucaucugaugacuga

SEQ ID NO: 537219 - RNA, 22 nt, Human
guagcuuauuagggauaauagu

SEQ ID NO: 537220 - RNA, 22 nt, Human
acacucugugaggcauguaaug

SEQ ID NO: 537221 - RNA, 19 nt, Human
ucuaaacucuauacuggua

SEQ ID NO: 537222 - RNA, 22 nt, Human
uccaggcuggacaugaggcggg

SEQ ID NO: 537223 - RNA, 22 nt, Human
agagcugugcuuugcaccacgu

SEQ ID NO: 537224 - RNA, 22 nt, Human
ggagugacucacagcugggaca

SEQ ID NO: 537225 - RNA, 22 nt, Human
ugucucaggcccaagccaguaa

SEQ ID NO: 537226 - RNA, 22 nt, Human
cucucugguacauagaguuugg

SEQ ID NO: 537227 - RNA, 22 nt, Human
ugaaggccagggauuugcagcc

SEQ ID NO: 537228 - RNA, 17 nt, Human
uggcuucccugggccac

SEQ ID NO: 537229 - RNA, 22 nt, Human
uccagugguaguaaagaggucu

SEQ ID NO: 537230 - RNA, 22 nt, Human
ugcugagaugaauagggcuguc

SEQ ID NO: 537231 - RNA, 22 nt, Human
aauguguagauguugcauuccu

SEQ ID NO: 537232 - RNA, 22 nt, Human
gaacacaugauuauaaaugcua

SEQ ID NO: 537233 - RNA, 22 nt, Human
ugaaaucauaacaguuuggcuu

SEQ ID NO: 537234 - RNA, 22 nt, Human
agucucagccacacagaccuau

SEQ ID NO: 537235 - RNA, 22 nt, Human
uuguaugcugaucaaaagcuuc

SEQ ID NO: 537236 - RNA, 22 nt, Human
gaauuguacgcuuuacauaggu

SEQ ID NO: 537237 - RNA, 22 nt, Human
auuugucuuuggaccugugaga

SEQ ID NO: 537238 - RNA, 19 nt, Human
ccaggccucuggggccugu

SEQ ID NO: 537239 - RNA, 22 nt, Human
aagggcucccaacucaucuuuu

SEQ ID NO: 537240 - RNA, 22 nt, Human
gcucagagcaucccagugaaug

SEQ ID NO: 537241 - RNA, 22 nt, Human
gagcucuguguagccugagggu

SEQ ID NO: 537242 - RNA, 20 nt, Human
acaguguaauauucacauuc

SEQ ID NO: 537243 - RNA, 22 nt, Human
uguggcagaguaaggacccagu

SEQ ID NO: 537244 - RNA, 22 nt, Human
guacuuccagccaagugagaca

SEQ ID NO: 537245 - RNA, 22 nt, Human
ucaucucagagagguauguuag

SEQ ID NO: 537246 - RNA, 20 nt, Human
acauagcuauagaaagucga

SEQ ID NO: 537247 - RNA, 18 nt, Human
cugccuguugcugagagg

SEQ ID NO: 537248 - RNA, 22 nt, Human
ccuggaggagcgcugaccagcu

SEQ ID NO: 537249 - RNA, 22 nt, Human
cacacagaaccgcucgccacuu

SEQ ID NO: 537250 - RNA, 22 nt, Human
ugaaaaggguagaucccuaagu

SEQ ID NO: 537251 - RNA, 22 nt, Human
cagguuccaguugcagggacuu

SEQ ID NO: 537252 - RNA, 22 nt, Human
acacaguauugugacuauaacu

SEQ ID NO: 537253 - RNA, 22 nt, Human
acacauuuuguuaaacccugug

SEQ ID NO: 537254 - RNA, 22 nt, Human
gugcccugucucuugucuccag

SEQ ID NO: 537255 - RNA, 22 nt, Human
gcucccugaaaagaacaaaguc

SEQ ID NO: 537256 - RNA, 22 nt, Human
gcugggagcaaagccaugcaua

SEQ ID NO: 537257 - RNA, 22 nt, Human
acuugauuuugaaccuuucuac

SEQ ID NO: 537258 - RNA, 22 nt, Human
caguauuuccucuucuuaacuu

SEQ ID NO: 537259 - RNA, 22 nt, Human
uuucuguuaggcaucauuuuaa

SEQ ID NO: 537260 - RNA, 18 nt, Human
ucaaaauauuucugugga

SEQ ID NO: 537261 - RNA, 22 nt, Human
gugaggcagagaugccaaaacu

SEQ ID NO: 537262 - RNA, 22 nt, Human
ucugaaaugaccuuuccccacu

SEQ ID NO: 537263 - RNA, 22 nt, Human
uagcugucaccagaaauggcca

SEQ ID NO: 537264 - RNA, 19 nt, Human
caggaaugagguaauggcu

SEQ ID NO: 537265 - RNA, 22 nt, Human
auacacaugcacacaugugugu

SEQ ID NO: 537266 - RNA, 22 nt, Human
auguguauacuugugcuuacuc

SEQ ID NO: 537267 - RNA, 22 nt, Human
gcagaggggaagcugaggaauu

SEQ ID NO: 537268 - RNA, 22 nt, Human
acaauacuauuuucaguauccu

SEQ ID NO: 537269 - RNA, 22 nt, Human
ugcucugugguccaagauggcu

SEQ ID NO: 537270 - RNA, 22 nt, Human
ccacagccauuccagggaggcu

SEQ ID NO: 537271 - RNA, 22 nt, Human
uggggaggacgggcgccuuccu

SEQ ID NO: 537272 - RNA, 22 nt, Human
cagggcccagucccugcuguca

SEQ ID NO: 537273 - RNA, 22 nt, Human
aacauuucauuggaagcuaugu

SEQ ID NO: 537274 - RNA, 22 nt, Human
cuguacagaccuauuagcccag

SEQ ID NO: 537275 - RNA, 22 nt, Human
aguaggaggcgggagcaugaag

SEQ ID NO: 537276 - RNA, 22 nt, Human
ucugucauugcaauaaaauuuc

SEQ ID NO: 537277 - RNA, 22 nt, Human
gaaagcaaguugacugcagaau

SEQ ID NO: 537278 - RNA, 19 nt, Human
ugcaaucagcuacccaggu

SEQ ID NO: 537279 - RNA, 22 nt, Human
uaagaacaagcuggggguucca

SEQ ID NO: 537280 - RNA, 22 nt, Human
ggaugcaggacggcauggaugu

SEQ ID NO: 537281 - RNA, 22 nt, Human
ggauccuucuuugaccucacag

SEQ ID NO: 537282 - RNA, 22 nt, Human
agagucuuccaggcagccugag

SEQ ID NO: 537283 - RNA, 22 nt, Human
auaaggacuugaauuagacauu

SEQ ID NO: 537284 - RNA, 22 nt, Human
augucccaagauacagcuagag

SEQ ID NO: 537285 - RNA, 22 nt, Human
agcucugcuucuugggaagaug

SEQ ID NO: 537286 - RNA, 22 nt, Human
uauuuguagaauggauuaaggg

SEQ ID NO: 537287 - RNA, 22 nt, Human
cugcucuguauaugagcaggaa

SEQ ID NO: 537288 - RNA, 23 nt, Human
aaccagauaaauggcuccagggc

SEQ ID NO: 537289 - RNA, 22 nt, Human
caggagaaacauaauuuucugg

SEQ ID NO: 537290 - RNA, 22 nt, Human
agugaaaggaaaaacugauauu

SEQ ID NO: 537291 - RNA, 22 nt, Human
uuauuccaguaaucucuguaau

SEQ ID NO: 537292 - RNA, 22 nt, Human
uggcucagauaauucaaggggc

SEQ ID NO: 537293 - RNA, 22 nt, Human
cccugcagaucagugagaacuu

SEQ ID NO: 537294 - RNA, 22 nt, Human
aaaaagauguccugaaguuuag

SEQ ID NO: 537295 - RNA, 20 nt, Human
gaggaaccacugggaggaga

SEQ ID NO: 537296 - RNA, 22 nt, Human
acugaaauacugcucuuggauu

SEQ ID NO: 537297 - RNA, 22 nt, Human
ucugaggccccugggcaggaug

SEQ ID NO: 537298 - RNA, 22 nt, Human
aucuucuggucaaauuuuugca

SEQ ID NO: 537299 - RNA, 22 nt, Human
agacugaauaacaagcaaauaa

SEQ ID NO: 537300 - RNA, 22 nt, Human
ucuucagucaauccagauguuu

SEQ ID NO: 537301 - RNA, 22 nt, Human
ugcuuaaacauacuauuuauau

SEQ ID NO: 537302 - RNA, 20 nt, Human
agcaggaaaagugccagucu

SEQ ID NO: 537303 - RNA, 22 nt, Human
gcuccucuccucggagucgggg

SEQ ID NO: 537304 - RNA, 19 nt, Human
cauuuagaaguacauauua

SEQ ID NO: 537305 - RNA, 22 nt, Human
caggcagaagaaguggaaggac

SEQ ID NO: 537306 - RNA, 22 nt, Human
uugaaggaggcuccuuuuuaaa

SEQ ID NO: 537307 - RNA, 22 nt, Human
ccugagggucaaggagcccuag

SEQ ID NO: 537308 - RNA, 22 nt, Human
ugaagcuuuccuguggucagga

SEQ ID NO: 537309 - RNA, 22 nt, Human
gggcacaggagaaggaucuggc

SEQ ID NO: 537310 - RNA, 22 nt, Human
acaugaagcaagaaagaugcua

SEQ ID NO: 537311 - RNA, 22 nt, Human
uccucacauggugagccacaca

SEQ ID NO: 537312 - RNA, 22 nt, Human
uuuuacacuucgguugugugca

SEQ ID NO: 537313 - RNA, 22 nt, Human
acaguguugaggugcuuguuuc

SEQ ID NO: 537314 - RNA, 22 nt, Human
uuugaauguuuuagguacuuaa

SEQ ID NO: 537315 - RNA, 22 nt, Human
acauuuaaauaccuauguuucu

SEQ ID NO: 537316 - RNA, 22 nt, Human
uuugaaaagaaccaucgccuua

SEQ ID NO: 537317 - RNA, 21 nt, Human
cagcuuugucugucuucgggg

SEQ ID NO: 537318 - RNA, 22 nt, Human
ucccaggguccucuucuggaau

SEQ ID NO: 537319 - RNA, 22 nt, Human
caaagccaggcuuucuaaugua

SEQ ID NO: 537320 - RNA, 22 nt, Human
uggcagggugccaguugcgagu

SEQ ID NO: 537321 - RNA, 22 nt, Human
uaaaucaagaauaucagcuugu

SEQ ID NO: 537322 - RNA, 22 nt, Human
ccagcccuugcugaaggguggc

SEQ ID NO: 537323 - RNA, 22 nt, Human
uuaaaaccaucagcuguaagau

SEQ ID NO: 537324 - RNA, 18 nt, Human
ccuguggcucagcccaca

SEQ ID NO: 537325 - RNA, 22 nt, Human
uccuugagauuaauuaaucacc

SEQ ID NO: 537326 - RNA, 22 nt, Human
gcugagaguguaggauguuuac

SEQ ID NO: 537327 - RNA, 22 nt, Human
acugggcuuaugcuguggagua

SEQ ID NO: 537328 - RNA, 22 nt, Human
uaggcagggauuaggguugauu

SEQ ID NO: 537329 - RNA, 22 nt, Human
uuggcugagagaggaaaagggc

SEQ ID NO: 537330 - RNA, 22 nt, Human
ccagaaaagcaucugguucuuu

SEQ ID NO: 537331 - RNA, 22 nt, Human
agaaacaucauuggaacacaag

SEQ ID NO: 537332 - RNA, 22 nt, Human
guguuuuagugcugcugagcug

SEQ ID NO: 537333 - RNA, 22 nt, Human
aagaaauaagacuucucugucc

SEQ ID NO: 537334 - RNA, 22 nt, Human
agcagccauccuuagagaaaga

SEQ ID NO: 537335 - RNA, 22 nt, Human
aggugucuucagggugagacag

SEQ ID NO: 537336 - RNA, 22 nt, Human
uuuguguuggaagaaaugcuac

SEQ ID NO: 537337 - RNA, 22 nt, Human
aaaccuauauagucuuagaagc

SEQ ID NO: 537338 - RNA, 23 nt, Human
uaggaagacagcaaaagaaugga

SEQ ID NO: 537339 - RNA, 22 nt, Human
ugggaguggggcauagaaggua

SEQ ID NO: 537340 - RNA, 22 nt, Human
gcccagcuuuucacuuccacac

SEQ ID NO: 537341 - RNA, 22 nt, Human
aggaacccggucugucacugug

SEQ ID NO: 537342 - RNA, 22 nt, Human
aucagagauuguaguaugugca

SEQ ID NO: 537343 - RNA, 22 nt, Human
aaagcagcagcacguggaagag

SEQ ID NO: 537344 - RNA, 22 nt, Human
ugaggggagcuagcaugccuug

SEQ ID NO: 537345 - RNA, 22 nt, Human
ucuguucaucaucuggacacau

SEQ ID NO: 537346 - RNA, 22 nt, Human
agugcagugguuaggagccagg

SEQ ID NO: 537347 - RNA, 22 nt, Human
guggccuuuaucuuagguaucc

SEQ ID NO: 537348 - RNA, 18 nt, Human
cugugggcuggugcauga

SEQ ID NO: 537349 - RNA, 22 nt, Human
ggaggccaaagugugggcggcu

SEQ ID NO: 537350 - RNA, 22 nt, Human
acaguuauuuucccagcauuua

SEQ ID NO: 537351 - RNA, 22 nt, Human
aacauuuaggaaggaccuccuc

SEQ ID NO: 537352 - RNA, 22 nt, Human
acaaggcucuaauuucauugaa

SEQ ID NO: 537353 - RNA, 22 nt, Human
caaagcaguauuggauucuuua

SEQ ID NO: 537354 - RNA, 22 nt, Human
aaggcugacguuuguguuuauu

SEQ ID NO: 537355 - RNA, 22 nt, Human
gagccuggggacccuccugagu

SEQ ID NO: 537356 - RNA, 22 nt, Human
gaggugggguuuuguucuugaa

SEQ ID NO: 537357 - RNA, 22 nt, Human
aaacugaagccuuggagugaca

SEQ ID NO: 537358 - RNA, 22 nt, Human
gugcccuucagcuuugcugaaa

SEQ ID NO: 537359 - RNA, 22 nt, Human
gucaaguuuauccgcucauuca

SEQ ID NO: 537360 - RNA, 22 nt, Human
uuaauuuuuauguauagugugu

SEQ ID NO: 537361 - RNA, 22 nt, Human
aaaaguguucaggaagaauaau

SEQ ID NO: 537362 - RNA, 22 nt, Human
ugaagccaccgaaccagaagag

SEQ ID NO: 537363 - RNA, 22 nt, Human
uuacacaaguucuuuaaccuau

SEQ ID NO: 537364 - RNA, 22 nt, Human
gcugucagcgcccaaggagcuc

SEQ ID NO: 537365 - RNA, 17 nt, Human
cagcuuuaugcuacugu

SEQ ID NO: 537366 - RNA, 22 nt, Human
uggucaguugcaucagagaagu

SEQ ID NO: 537367 - RNA, 22 nt, Human
aaguaaaacacacaguccaccg

SEQ ID NO: 537368 - RNA, 22 nt, Human
ugggcuacucugggagccuaac

SEQ ID NO: 537369 - RNA, 22 nt, Human
agcagggcucacauuaguggau

SEQ ID NO: 537370 - RNA, 22 nt, Human
gccauuaaagugcauguuuugc

SEQ ID NO: 537371 - RNA, 22 nt, Human
agggcccuccccgcucagggca

SEQ ID NO: 537372 - RNA, 22 nt, Human
ggcugggcugcggcuguaccug

SEQ ID NO: 537373 - RNA, 22 nt, Human
gcucccaccuccagccugaguu

SEQ ID NO: 537374 - RNA, 22 nt, Human
ggcuggcagaggggagucugug

SEQ ID NO: 537375 - RNA, 22 nt, Human
uuauuccauuauuucacuuagg

SEQ ID NO: 537376 - RNA, 22 nt, Human
ccuacauucucugaguuuuccu

SEQ ID NO: 537377 - RNA, 22 nt, Human
uugcuauuuugagagucauagu

SEQ ID NO: 537378 - RNA, 22 nt, Human
uucugaaaacacacuuugcagc

SEQ ID NO: 537379 - RNA, 22 nt, Human
uccugggccuguacuccauccg

SEQ ID NO: 537380 - RNA, 22 nt, Human
ugcaaacuauugguagagaugg

SEQ ID NO: 537381 - RNA, 22 nt, Human
ugaaagguuaaaaguaguauug

SEQ ID NO: 537382 - RNA, 22 nt, Human
cauugcuuugugcauauuuaaa

SEQ ID NO: 537383 - RNA, 22 nt, Human
uuuuaaugugcucugcaaugau

SEQ ID NO: 537384 - RNA, 22 nt, Human
uggcagagaauaaaucuugacu

SEQ ID NO: 537385 - RNA, 22 nt, Human
ucuuuccuacuuuauugugaac

SEQ ID NO: 537386 - RNA, 22 nt, Human
gggcugagugggccucuuacuu

SEQ ID NO: 537387 - RNA, 22 nt, Human
aucagaauggagcccacauggu

SEQ ID NO: 537388 - RNA, 22 nt, Human
uacacacagaggccaugggauu

SEQ ID NO: 537389 - RNA, 22 nt, Human
ugcaauaacuacuuuaauguug

SEQ ID NO: 537390 - RNA, 22 nt, Human
auuuauguaucuguguagauca

SEQ ID NO: 537391 - RNA, 22 nt, Human
uccacaagaugauaaagagagg

SEQ ID NO: 537392 - RNA, 22 nt, Human
ccuggggcucaagauggcgccg

SEQ ID NO: 537393 - RNA, 22 nt, Human
ggaagcuucauaccuuuauuua

SEQ ID NO: 537394 - RNA, 20 nt, Human
agcuuugguuaagccagugg

SEQ ID NO: 537395 - RNA, 22 nt, Human
gaaaugugcagaauguguuaga

SEQ ID NO: 537396 - RNA, 22 nt, Human
uucuuucuguccauaaugagac

SEQ ID NO: 537397 - RNA, 22 nt, Human
gugccgcuggagcuggaauuga

SEQ ID NO: 537398 - RNA, 22 nt, Human
gccuggagggcucuagagaggc

SEQ ID NO: 537399 - RNA, 22 nt, Human
acuacacagggaugugacuacc

SEQ ID NO: 537400 - RNA, 22 nt, Human
guucacagcuuguguuuucucu

SEQ ID NO: 537401 - RNA, 22 nt, Human
agcuggcagggguucacacugc

SEQ ID NO: 537402 - RNA, 22 nt, Human
aguuucuuuagauagaaaguuc

SEQ ID NO: 537403 - RNA, 22 nt, Human
caagagagaugcagcucacuca

SEQ ID NO: 537404 - RNA, 22 nt, Human
caguuucuuggaugccaauuuc

SEQ ID NO: 537405 - RNA, 22 nt, Human
ugcagcuccucuggcugccuga

SEQ ID NO: 537406 - RNA, 22 nt, Human
ucaguucuaagugcuuuacaug

SEQ ID NO: 537407 - RNA, 22 nt, Human
gggccagagcuuggcagcuggg

SEQ ID NO: 537408 - RNA, 22 nt, Human
uggaaauuacuaacacuuagag

SEQ ID NO: 537409 - RNA, 22 nt, Human
ugcagcccuuccuuccucuggg

SEQ ID NO: 537410 - RNA, 20 nt, Human
aauuuacucacagaaugaau

SEQ ID NO: 537411 - RNA, 22 nt, Human
auaaacacuucuagggcacaca

SEQ ID NO: 537412 - RNA, 22 nt, Human
agcugccacugagggugcacag

SEQ ID NO: 537413 - RNA, 22 nt, Human
acagagucucaaaccuacaaag

SEQ ID NO: 537414 - RNA, 22 nt, Human
cuuuucaaacgcugaugucagu

SEQ ID NO: 537415 - RNA, 22 nt, Human
ucucuguacaguacaugccgug

SEQ ID NO: 537416 - RNA, 22 nt, Human
uuuuugaaggcugaugugauua

SEQ ID NO: 537417 - RNA, 22 nt, Human
cagcagcugauggggaagugau

SEQ ID NO: 537418 - RNA, 22 nt, Human
cuauuuucugucucuauagagu

SEQ ID NO: 537419 - RNA, 22 nt, Human
ugucuuuagccagcagucuucu

SEQ ID NO: 537420 - RNA, 22 nt, Human
cuucauuuccauccaacuggga

SEQ ID NO: 537421 - RNA, 22 nt, Human
uuguaaaugaccuuuucuaauu

SEQ ID NO: 537422 - RNA, 22 nt, Human
uacaguaaagcugcuaugaauu

SEQ ID NO: 537423 - RNA, 22 nt, Human
uccccacucaccacuggccaaa

SEQ ID NO: 537424 - RNA, 22 nt, Human
ugagccugcugucgcuggaccc

SEQ ID NO: 537425 - RNA, 22 nt, Human
ucaggaagaagacggggcagga

SEQ ID NO: 537426 - RNA, 22 nt, Human
aagugaaacauguaucucuuua

SEQ ID NO: 537427 - RNA, 21 nt, Human
cacuauuuauauaugccagcu

SEQ ID NO: 537428 - RNA, 22 nt, Human
accugagggcccaaacuuggua

SEQ ID NO: 537429 - RNA, 22 nt, Human
ggcacagcaccuuuucacauug

SEQ ID NO: 537430 - RNA, 22 nt, Human
gguuccccaggcggcccuugga

SEQ ID NO: 537431 - RNA, 22 nt, Human
cagaguggagauguguguggaa

SEQ ID NO: 537432 - RNA, 22 nt, Human
ggcagugaaugaaacagaggcu

SEQ ID NO: 537433 - RNA, 22 nt, Human
gccaugcuugguaugcugugag

SEQ ID NO: 537434 - RNA, 22 nt, Human
ugcuguuauacuuagcugguua

SEQ ID NO: 537435 - RNA, 22 nt, Human
gauuuuucaguauaaaauauau

SEQ ID NO: 537436 - RNA, 22 nt, Human
gauucccauccucagcagcagc

SEQ ID NO: 537437 - RNA, 22 nt, Human
aacauuucauaacuugacuuuu

SEQ ID NO: 537438 - RNA, 22 nt, Human
uccaggcauguggccaguacuc

SEQ ID NO: 537439 - RNA, 22 nt, Human
ugacauaaaccagugagcaaaa

SEQ ID NO: 537440 - RNA, 22 nt, Human
agaaaugcaguuucaagacaaa

SEQ ID NO: 537441 - RNA, 22 nt, Human
ugaacuucagugcauaauuauc

SEQ ID NO: 537442 - RNA, 22 nt, Human
ccccauucuggccagcccagcu

SEQ ID NO: 537443 - RNA, 22 nt, Human
ugcuggaggaguuuacuguggc

SEQ ID NO: 537444 - RNA, 22 nt, Human
ucagacaucucauaauguauua

SEQ ID NO: 537445 - RNA, 22 nt, Human
uggagcaugagagucuuuagcu

SEQ ID NO: 537446 - RNA, 22 nt, Human
agugguucuugaucuguagagu

SEQ ID NO: 537447 - RNA, 22 nt, Human
aucagacagggaguucuguguc

SEQ ID NO: 537448 - RNA, 22 nt, Human
aucauacauacaugguccucag

SEQ ID NO: 537449 - RNA, 22 nt, Human
uauuccuaagucccaacuacau

SEQ ID NO: 537450 - RNA, 22 nt, Human
agucuccuuggccucaaugccu

SEQ ID NO: 537451 - RNA, 22 nt, Human
ucaaagucauggcuaguaauga

SEQ ID NO: 537452 - RNA, 22 nt, Human
agaagaauacuugauguucaug

SEQ ID NO: 537453 - RNA, 22 nt, Human
guuucauacagauuauucaugg

SEQ ID NO: 537454 - RNA, 22 nt, Human
agccuucaaccuagcuagagca

SEQ ID NO: 537455 - RNA, 22 nt, Human
aaaguauucaaaaauauuuggu

SEQ ID NO: 537456 - RNA, 22 nt, Human
aagggaggaggauuuauuguac

SEQ ID NO: 537457 - RNA, 22 nt, Human
aaaggaagaucuauacacccca

SEQ ID NO: 537458 - RNA, 22 nt, Human
aucuuuuacauuacugcccaga

SEQ ID NO: 537459 - RNA, 22 nt, Human
gccugugcuuaacugacgugag

SEQ ID NO: 537460 - RNA, 22 nt, Human
gcagagguggcaucugggcucu

SEQ ID NO: 537461 - RNA, 22 nt, Human
aagcagccacuggccaguuaua

SEQ ID NO: 537462 - RNA, 22 nt, Human
cuuuuucugauguuccaugauu

SEQ ID NO: 537463 - RNA, 22 nt, Human
ggccugugcaagacagcacccc

SEQ ID NO: 537464 - RNA, 22 nt, Human
ggcaggaggaagaguuagcacc

SEQ ID NO: 537465 - RNA, 19 nt, Human
gcuuuuuguugucaaaggu

SEQ ID NO: 537466 - RNA, 22 nt, Human
ccucuucauccuggaagcugcu

SEQ ID NO: 537467 - RNA, 22 nt, Human
gaacagaagaggcuggugccac

SEQ ID NO: 537468 - RNA, 22 nt, Human
ugcauugcauuugucaugaaga

SEQ ID NO: 537469 - RNA, 22 nt, Human
cccuggagucagguuggccugg

SEQ ID NO: 537470 - RNA, 22 nt, Human
uaacagcaggguuacaggcauu

SEQ ID NO: 537471 - RNA, 20 nt, Human
uguccuaauagacaagcaga

SEQ ID NO: 537472 - RNA, 21 nt, Human
agcugccugcucuggaccugg

SEQ ID NO: 537473 - RNA, 22 nt, Human
ugcuugucaggauaagcucugg

SEQ ID NO: 537474 - RNA, 18 nt, Human
uauguauaacauaguuca

SEQ ID NO: 537475 - RNA, 22 nt, Human
uuaccaaugugcuuuugcuaca

SEQ ID NO: 537476 - RNA, 22 nt, Human
aggcagcagugauaagauagga

SEQ ID NO: 537477 - RNA, 22 nt, Human
gauuucaaccuaacaguaugac

SEQ ID NO: 537478 - RNA, 18 nt, Human
ucagccuguugucugccu

SEQ ID NO: 537479 - RNA, 22 nt, Human
gugggcuucuguuagggaggcu

SEQ ID NO: 537480 - RNA, 22 nt, Human
gcuggcagcuggaaguugggcu

SEQ ID NO: 537481 - RNA, 22 nt, Human
ccagggugugagaaggaaguag

SEQ ID NO: 537482 - RNA, 22 nt, Human
agacagcaugauacaugaugcu

SEQ ID NO: 537483 - RNA, 22 nt, Human
aagaaagugcuuuguaaauuau

SEQ ID NO: 537484 - RNA, 23 nt, Human
cuucacagguucaggggauuaag

SEQ ID NO: 537485 - RNA, 22 nt, Human
uguggcugacuccuggucccca

SEQ ID NO: 537486 - RNA, 22 nt, Human
uuuuauuaguggcuagaugggg

SEQ ID NO: 537487 - RNA, 22 nt, Human
cugagcagcguggggagcuggc

SEQ ID NO: 537488 - RNA, 22 nt, Human
ccuucuucuguguggcccaaga

SEQ ID NO: 537489 - RNA, 22 nt, Human
gcauugucaaaagugguaugac

SEQ ID NO: 537490 - RNA, 22 nt, Human
agcagggcuccugaaagccgcg

SEQ ID NO: 537491 - RNA, 23 nt, Human
ugcagggcaaguuagagacccca

SEQ ID NO: 537492 - RNA, 22 nt, Human
cagcagugaugugugaggguuc

SEQ ID NO: 537493 - RNA, 22 nt, Human
ggcgggaaguucuugcccacuu

SEQ ID NO: 537494 - RNA, 17 nt, Human
agccccucagcgucacc

SEQ ID NO: 537495 - RNA, 21 nt, Human
uggcugccuacaugcugcagg

SEQ ID NO: 537496 - RNA, 22 nt, Human
auuuuagagcuccaaguacagc

SEQ ID NO: 537497 - RNA, 22 nt, Human
ccugggaggcggagguugcagu

SEQ ID NO: 537498 - RNA, 22 nt, Human
gggguagggugauugugaagua

SEQ ID NO: 537499 - RNA, 22 nt, Human
uauccaauucaccauugauggg

SEQ ID NO: 537500 - RNA, 22 nt, Human
aaggcugaauucaaggguaggc

SEQ ID NO: 537501 - RNA, 22 nt, Human
agcuguggcagcacuuuggagu

SEQ ID NO: 537502 - RNA, 22 nt, Human
gacauacagcauggucuaugaa

SEQ ID NO: 537503 - RNA, 22 nt, Human
gcuucaugaaaaucacugguca

SEQ ID NO: 537504 - RNA, 22 nt, Human
uuuuccagauggauacuagaau

SEQ ID NO: 537505 - RNA, 22 nt, Human
ggcuggcaagugucugcucaug

SEQ ID NO: 537506 - RNA, 22 nt, Human
gaucggguggguucugccauca

SEQ ID NO: 537507 - RNA, 22 nt, Human
ugaggccaggaucccaggcucu

SEQ ID NO: 537508 - RNA, 22 nt, Human
aaaaaugaauucuucaguggca

SEQ ID NO: 537509 - RNA, 22 nt, Human
ccaagcaggauauucuguguca

SEQ ID NO: 537510 - RNA, 22 nt, Human
ggccagcagucacagggucaga

SEQ ID NO: 537511 - RNA, 22 nt, Human
ugcacuuugcaggcauggaaac

SEQ ID NO: 537512 - RNA, 22 nt, Human
cucugaggaagucaaguagcca

SEQ ID NO: 537513 - RNA, 22 nt, Human
agucaggagcugcugcauugua

SEQ ID NO: 537514 - RNA, 22 nt, Human
aucuucaacuugaucauuugaa

SEQ ID NO: 537515 - RNA, 22 nt, Human
aaguacaaucuuucuguaaagg

SEQ ID NO: 537516 - RNA, 22 nt, Human
gcauggaauucccuuaugggcc

SEQ ID NO: 537517 - RNA, 22 nt, Human
cagagggcucggcggccgcucc

SEQ ID NO: 537518 - RNA, 22 nt, Human
caucaaauaaagaaauuccuug

SEQ ID NO: 537519 - RNA, 22 nt, Human
gccuuuugaucuauaacugugu

SEQ ID NO: 537520 - RNA, 22 nt, Human
ugaagcaguucucagaaguggg

SEQ ID NO: 537521 - RNA, 22 nt, Human
agggaucaaaaaauguacaugc

SEQ ID NO: 537522 - RNA, 22 nt, Human
aaagccuugggauuugugauca

SEQ ID NO: 537523 - RNA, 22 nt, Human
uccagccaagggagguuacuag

SEQ ID NO: 537524 - RNA, 22 nt, Human
uaagaauaguguuugccuuugg

SEQ ID NO: 537525 - RNA, 22 nt, Human
uucaaaguccugucagguagcc

SEQ ID NO: 537526 - RNA, 21 nt, Human
ucugaacaacauacgaaucuu

SEQ ID NO: 537527 - RNA, 22 nt, Human
uaggcaggcugaauguagauuu

SEQ ID NO: 537528 - RNA, 22 nt, Human
auacauguuguaccauauguuu

SEQ ID NO: 537529 - RNA, 22 nt, Human
caugaauauacauccugauggc

SEQ ID NO: 537530 - RNA, 19 nt, Human
aacaucuuuccaguagagg

SEQ ID NO: 537531 - RNA, 22 nt, Human
agggcugcuauguugauucaga

SEQ ID NO: 537532 - RNA, 22 nt, Human
guuacaauguucuucaguucug

SEQ ID NO: 537533 - RNA, 22 nt, Human
ugaaugauacagaauuauguag

SEQ ID NO: 537534 - RNA, 20 nt, Human
gucugaggagcagugggaaa

SEQ ID NO: 537535 - RNA, 22 nt, Human
aguauaauuagauaucaaaagu

SEQ ID NO: 537536 - RNA, 22 nt, Human
ucugaaagaaagauuuuguuuc

SEQ ID NO: 537537 - RNA, 22 nt, Human
guggccuggaugagcuucgaca

SEQ ID NO: 537538 - RNA, 22 nt, Human
aggugaguccugggcacaggua

SEQ ID NO: 537539 - RNA, 22 nt, Human
ugugggcacuaaugacaugcag

SEQ ID NO: 537540 - RNA, 22 nt, Human
gcacacaggggaguucucagaa

SEQ ID NO: 537541 - RNA, 22 nt, Human
agcuguguguuuccacugagcu

SEQ ID NO: 537542 - RNA, 22 nt, Human
ucugucacuuauuaagauggau

SEQ ID NO: 537543 - RNA, 22 nt, Human
cuugaaucuucugaguauuugc

SEQ ID NO: 537544 - RNA, 22 nt, Human
cugauucucugacucuuggcuu

SEQ ID NO: 537545 - RNA, 22 nt, Human
cagcucugggugacaggagggc

SEQ ID NO: 537546 - RNA, 22 nt, Human
auacagaagccuguauuucugg

SEQ ID NO: 537547 - RNA, 20 nt, Human
gagcagugagccagggaaag

SEQ ID NO: 537548 - RNA, 22 nt, Human
uucaggaucacuaaacccucca

SEQ ID NO: 537549 - RNA, 22 nt, Human
ucucaggguuuccugggggcug

SEQ ID NO: 537550 - RNA, 22 nt, Human
agauguuccagccaaugggaau

SEQ ID NO: 537551 - RNA, 23 nt, Human
ggacacugcuauaaaggaucugc

SEQ ID NO: 537552 - RNA, 22 nt, Human
cugggagauaugaggaucugga

SEQ ID NO: 537553 - RNA, 22 nt, Human
cuggcccagucucagaguguca

SEQ ID NO: 537554 - RNA, 22 nt, Human
ggcuagggagacagagggcaug

SEQ ID NO: 537555 - RNA, 23 nt, Human
uccucaguauauaaaggcagaug

SEQ ID NO: 537556 - RNA, 22 nt, Human
uggccuuggacagagcgcuccu

SEQ ID NO: 537557 - RNA, 22 nt, Human
caauuuuuguacuuauaguacu

SEQ ID NO: 537558 - RNA, 22 nt, Human
auuuaagacugacuucaccagu

SEQ ID NO: 537559 - RNA, 22 nt, Human
aaagccuuggucaucugguucc

SEQ ID NO: 537560 - RNA, 21 nt, Human
agggcagauuagcuguaagag

SEQ ID NO: 537561 - RNA, 22 nt, Human
gcugucaagguagaaaacagag

SEQ ID NO: 537562 - RNA, 22 nt, Human
aaaggccauuacuugcuuuuag

SEQ ID NO: 537563 - RNA, 22 nt, Human
uucccagauuggagggcagggg

SEQ ID NO: 537564 - RNA, 22 nt, Human
cccucaccaggcuccaggcaug

SEQ ID NO: 537565 - RNA, 22 nt, Human
acccagccacagcauugaggga

SEQ ID NO: 537566 - RNA, 22 nt, Human
aagagcagccuccaggggugga

SEQ ID NO: 537567 - RNA, 19 nt, Human
agcaaauauaauaguguuc

SEQ ID NO: 537568 - RNA, 22 nt, Human
ugcugugggcaguacauaagcu

SEQ ID NO: 537569 - RNA, 22 nt, Human
cuggguggaaagugcugagaau

SEQ ID NO: 537570 - RNA, 22 nt, Human
ucaguuaagaggccacggcagu

SEQ ID NO: 537571 - RNA, 22 nt, Human
gcaugugucuccccaguggagg

SEQ ID NO: 537572 - RNA, 22 nt, Human
ucauucauacucuuuucuauua

SEQ ID NO: 537573 - RNA, 22 nt, Human
caagccugucucaccagugcua

SEQ ID NO: 537574 - RNA, 22 nt, Human
uauuuccugcauggugauguaa

SEQ ID NO: 537575 - RNA, 22 nt, Human
aagggcugcauuugauguguca

SEQ ID NO: 537576 - RNA, 22 nt, Human
ugggagaugguucugagacuuu

SEQ ID NO: 537577 - RNA, 22 nt, Human
ggacacaagcuccggggcugca

SEQ ID NO: 537578 - RNA, 21 nt, Human
ggaugccacgaagcaccagga

SEQ ID NO: 537579 - RNA, 22 nt, Human
auacaugucaucauauguuugu

SEQ ID NO: 537580 - RNA, 22 nt, Human
caccugcagggggagucaagag

SEQ ID NO: 537581 - RNA, 22 nt, Human
ggagaggugagagguacaaguu

SEQ ID NO: 537582 - RNA, 22 nt, Human
gggcagguggcagggucucugg

SEQ ID NO: 537583 - RNA, 20 nt, Human
gagccuuccccucaccacug

SEQ ID NO: 537584 - RNA, 22 nt, Human
agcuguggaagacugucagggu

SEQ ID NO: 537585 - RNA, 22 nt, Human
aaagaacaaaugauauaugguu

SEQ ID NO: 537586 - RNA, 22 nt, Human
gcaggagguugagccaggacug

SEQ ID NO: 537587 - RNA, 22 nt, Human
guguuacaaaucaccugugcug

SEQ ID NO: 537588 - RNA, 22 nt, Human
agggcuggcuccguuaccuuga

SEQ ID NO: 537589 - RNA, 22 nt, Human
ugugaaaggggucacagggaaa

SEQ ID NO: 537590 - RNA, 22 nt, Human
gaggcacaguguuuggucagug

SEQ ID NO: 537591 - RNA, 22 nt, Human
uucaacauuacacaggcaauuc

SEQ ID NO: 537592 - RNA, 22 nt, Human
uggaaagggacuuaugaguucc

SEQ ID NO: 537593 - RNA, 22 nt, Human
gggcagguuauuggaguaggga

SEQ ID NO: 537594 - RNA, 22 nt, Human
gaggaggcuggcgccgccugcc

SEQ ID NO: 537595 - RNA, 22 nt, Human
ccuggggaccugccucagcccu

SEQ ID NO: 537596 - RNA, 22 nt, Human
ugcacacaggucuaggacaugg

SEQ ID NO: 537597 - RNA, 22 nt, Human
augauugaccaucugcugggcu

SEQ ID NO: 537598 - RNA, 22 nt, Human
aaugaugggaaggagaaaagca

SEQ ID NO: 537599 - RNA, 22 nt, Human
ugcaugcauaaauguacacaca

SEQ ID NO: 537600 - RNA, 22 nt, Human
acaugauuuuuaaagagauaau

SEQ ID NO: 537601 - RNA, 21 nt, Human
aguguccuugaucuugccuug

SEQ ID NO: 537602 - RNA, 23 nt, Human
ucuugaaaagccuacagcaguuc

SEQ ID NO: 537603 - RNA, 22 nt, Human
acauuaucccuggcacaacugc

SEQ ID NO: 537604 - RNA, 21 nt, Human
ccucugcucgggcaugcguuu

SEQ ID NO: 537605 - RNA, 17 nt, Human
ucagcaaagacaaagga

SEQ ID NO: 537606 - RNA, 22 nt, Human
agccaggccuuuucucaagguu

SEQ ID NO: 537607 - RNA, 22 nt, Human
cucaggaucgcuugcccuaggg

SEQ ID NO: 537608 - RNA, 22 nt, Human
ccucccacuucuugcugagguc

SEQ ID NO: 537609 - RNA, 22 nt, Human
gggaaagagugcuuguccagag

SEQ ID NO: 537610 - RNA, 22 nt, Human
acauaacauaguugacauuuuu

SEQ ID NO: 537611 - RNA, 22 nt, Human
ccugggcucgcgcacuucaccc

SEQ ID NO: 537612 - RNA, 22 nt, Human
uaaagcagccagggucuaagcc

SEQ ID NO: 537613 - RNA, 19 nt, Human
cagaggcaccagguauaga

SEQ ID NO: 537614 - RNA, 22 nt, Human
gcagaucaauugauuguucacu

SEQ ID NO: 537615 - RNA, 22 nt, Human
cacagcauuaacugggacagcu

SEQ ID NO: 537616 - RNA, 22 nt, Human
aagaaaagaaaccugaggcuuu

SEQ ID NO: 537617 - RNA, 22 nt, Human
cagguggggagaguguggagca

SEQ ID NO: 537618 - RNA, 22 nt, Human
uuucuggaaacuguaaagagga

SEQ ID NO: 537619 - RNA, 22 nt, Human
uacauucugguggagaaaguaa

SEQ ID NO: 537620 - RNA, 22 nt, Human
gggggaagaaagaacauggcau

SEQ ID NO: 537621 - RNA, 22 nt, Human
aaauuguaggaucacaugaccu

SEQ ID NO: 537622 - RNA, 22 nt, Human
ggcugaaggaugaaagcugcag

SEQ ID NO: 537623 - RNA, 22 nt, Human
acaaagaaggaauuggucuuua

SEQ ID NO: 537624 - RNA, 22 nt, Human
uauuccuauggccacugcuacu

SEQ ID NO: 537625 - RNA, 22 nt, Human
gcuguccagagcaugggagcaa

SEQ ID NO: 537626 - RNA, 22 nt, Human
gugucccaggagaggagacaau

SEQ ID NO: 537627 - RNA, 22 nt, Human
ugagaaaagguugagaugauaa

SEQ ID NO: 537628 - RNA, 22 nt, Human
uccucuggcucuuucccuagga

SEQ ID NO: 537629 - RNA, 22 nt, Human
ucugcagcuuuuugguggggug

SEQ ID NO: 537630 - RNA, 23 nt, Human
ugcaggggaggcuuaaagcaggu

SEQ ID NO: 537631 - RNA, 22 nt, Human
ugugaaaagcaggcuacuuucu

SEQ ID NO: 537632 - RNA, 18 nt, Human
gcuguucuucgcacuggc

SEQ ID NO: 537633 - RNA, 22 nt, Human
gccacuggacccagaaagggaa

SEQ ID NO: 537634 - RNA, 23 nt, Human
ugcugggcagagcuggugcugag

SEQ ID NO: 537635 - RNA, 22 nt, Human
ggcagguuggaugcuguaguga

SEQ ID NO: 537636 - RNA, 17 nt, Human
ugaagaugcauggcagc

SEQ ID NO: 537637 - RNA, 22 nt, Human
ccuggaagucauuccucguucc

SEQ ID NO: 537638 - RNA, 22 nt, Human
ccaucacaguccccaucgugau

SEQ ID NO: 537639 - RNA, 22 nt, Human
ugcauuauacuuuuagaaauuu

SEQ ID NO: 537640 - RNA, 22 nt, Human
ucauaaaacacaccagguaguu

SEQ ID NO: 537641 - RNA, 22 nt, Human
uaauuuuaugacaguguauuuu

SEQ ID NO: 537642 - RNA, 22 nt, Human
uaacaugcuaggaagagugauu

SEQ ID NO: 537643 - RNA, 22 nt, Human
gggcagguauuuaucuucuauu

SEQ ID NO: 537644 - RNA, 22 nt, Human
aagaacuuccuaauauauuuuc

SEQ ID NO: 537645 - RNA, 23 nt, Human
gccaggcuccggucuguggccac

SEQ ID NO: 537646 - RNA, 22 nt, Human
gacacagacaguuagagguaau

SEQ ID NO: 537647 - RNA, 23 nt, Human
uuucuguuggguauauauccaag

SEQ ID NO: 537648 - RNA, 22 nt, Human
cucugagaagaguucaaguaaa

SEQ ID NO: 537649 - RNA, 22 nt, Human
gcacagccacugagugagaacc

SEQ ID NO: 537650 - RNA, 17 nt, Human
ucaaagaaugcaugcag

SEQ ID NO: 537651 - RNA, 22 nt, Human
agcacagguacggagaugcuac

SEQ ID NO: 537652 - RNA, 22 nt, Human
ucaggcagagggagaagccaag

SEQ ID NO: 537653 - RNA, 22 nt, Human
gcuguucauagaaauggucuca

SEQ ID NO: 537654 - RNA, 22 nt, Human
cauguuuaauugcgauguuuga

SEQ ID NO: 537655 - RNA, 22 nt, Human
gggcaaguccggugcccagagc

SEQ ID NO: 537656 - RNA, 22 nt, Human
cuacauuuugugauuaugaaau

SEQ ID NO: 537657 - RNA, 22 nt, Human
gagcagcuguccccaaagcuuc

SEQ ID NO: 537658 - RNA, 22 nt, Human
ccagagagcuacaaggcauaaa

SEQ ID NO: 537659 - RNA, 22 nt, Human
agccuggaccaggggccucaga

SEQ ID NO: 537660 - RNA, 18 nt, Human
ucugucucuguccuugcu

SEQ ID NO: 537661 - RNA, 22 nt, Human
aggcagagaaaaaccagauaug

SEQ ID NO: 537662 - RNA, 22 nt, Human
agcuguguucugguugauucac

SEQ ID NO: 537663 - RNA, 22 nt, Human
guccuuaaccacuuguguuuau

SEQ ID NO: 537664 - RNA, 22 nt, Human
acuugauuuuuauaauaaaugg

SEQ ID NO: 537665 - RNA, 22 nt, Human
cuacuucuaaguacauggugau

SEQ ID NO: 537666 - RNA, 22 nt, Human
ucaucaaagcgcuuggaguagg

SEQ ID NO: 537667 - RNA, 22 nt, Human
gggcuggaucuccugcaggcag

SEQ ID NO: 537668 - RNA, 22 nt, Human
gaacaauagugguaacaaagcc

SEQ ID NO: 537669 - RNA, 22 nt, Human
ucaggccacuucacaggugauu

SEQ ID NO: 537670 - RNA, 22 nt, Human
gaagagcuguagccugcucuuu

SEQ ID NO: 537671 - RNA, 22 nt, Human
aggcacugaagugguaaaugua

SEQ ID NO: 537672 - RNA, 21 nt, Human
cauuucaguaaggaagccugu

SEQ ID NO: 537673 - RNA, 22 nt, Human
caguauuuuccuuguuaacuua

SEQ ID NO: 537674 - RNA, 22 nt, Human
cugggagcccgcguccuggugg

SEQ ID NO: 537675 - RNA, 22 nt, Human
ucacagaaugucuagcauaauu

SEQ ID NO: 537676 - RNA, 22 nt, Human
ucauucuugaucacuaguuagu

SEQ ID NO: 537677 - RNA, 22 nt, Human
gugaggcuacucagcuguccga

SEQ ID NO: 537678 - RNA, 22 nt, Human
uaaauacagucauuugagccau

SEQ ID NO: 537679 - RNA, 20 nt, Human
ugguccugucccacccacuc

SEQ ID NO: 537680 - RNA, 22 nt, Human
ucuaaacugcuagcugacugag

SEQ ID NO: 537681 - RNA, 22 nt, Human
uuucacagagaaauauaacagg

SEQ ID NO: 537682 - RNA, 22 nt, Human
acuucaaaugugacaaugugaa

SEQ ID NO: 537683 - RNA, 19 nt, Human
ucucacaucagcuccuagc

SEQ ID NO: 537684 - RNA, 22 nt, Human
agcacuuuagaauuuagaguug

SEQ ID NO: 537685 - RNA, 18 nt, Human
uagauggcagucugcaga

SEQ ID NO: 537686 - RNA, 22 nt, Human
ugggcuggagcuuguugcuucc

SEQ ID NO: 537687 - RNA, 22 nt, Human
gagugugggggugcugaggaca

SEQ ID NO: 537688 - RNA, 21 nt, Human
aggagcuguguuagcuggucg

SEQ ID NO: 537689 - RNA, 22 nt, Human
caggaagccacaggacagguag

SEQ ID NO: 537690 - RNA, 22 nt, Human
ucaggcugcuggccagcaggcu

SEQ ID NO: 537691 - RNA, 22 nt, Human
uaaguuuaaauguacaugaagc

SEQ ID NO: 537692 - RNA, 18 nt, Human
gaguguggcacugggccc

SEQ ID NO: 537693 - RNA, 22 nt, Human
agccauugaauuuagugccuuu

SEQ ID NO: 537694 - RNA, 22 nt, Human
auccucagcaucuagcaugaag

SEQ ID NO: 537695 - RNA, 22 nt, Human
ugcuuucacugauguaucauuu

SEQ ID NO: 537696 - RNA, 22 nt, Human
accagaguuuuauuaguucuaa

SEQ ID NO: 537697 - RNA, 22 nt, Human
cagaccugggucccuggccugu

SEQ ID NO: 537698 - RNA, 22 nt, Human
acuaccuuauacaaaauguagg

SEQ ID NO: 537699 - RNA, 22 nt, Human
gggucuggcaugcugagaugga

SEQ ID NO: 537700 - RNA, 22 nt, Human
gagagcuguccggcugagcagc

SEQ ID NO: 537701 - RNA, 22 nt, Human
gggcuugcugauuugggcagga

SEQ ID NO: 537702 - RNA, 22 nt, Human
uaacagcauaugaaauuacugg

SEQ ID NO: 537703 - RNA, 22 nt, Human
guaauugacucagcucuguuca

SEQ ID NO: 537704 - RNA, 22 nt, Human
ucugggcuggcuuuaugcugac

SEQ ID NO: 537705 - RNA, 22 nt, Human
uuguuucauggggauguuuauu

SEQ ID NO: 537706 - RNA, 22 nt, Human
acauuuaaauaugccuuauauu

SEQ ID NO: 537707 - RNA, 22 nt, Human
gagcugccuacauugccaagag

SEQ ID NO: 537708 - RNA, 20 nt, Human
accauaauguuaauuacaaa

SEQ ID NO: 537709 - RNA, 22 nt, Human
cugugaccuccaggaaggggug

SEQ ID NO: 537710 - RNA, 23 nt, Human
uccagggauuaaugaagucaguc

SEQ ID NO: 537711 - RNA, 22 nt, Human
guggcuucacauggcauuuggc

SEQ ID NO: 537712 - RNA, 22 nt, Human
cuauaaaucuacccagcauugg

SEQ ID NO: 537713 - RNA, 22 nt, Human
gcuuccgcgauguccuaggugg

SEQ ID NO: 537714 - RNA, 22 nt, Human
auuucacaucuaucucagauuu

SEQ ID NO: 537715 - RNA, 22 nt, Human
gguaugaauucacuacuuccaa

SEQ ID NO: 537716 - RNA, 22 nt, Human
uagaaaucagguuuuuagaaag

SEQ ID NO: 537717 - RNA, 22 nt, Human
uagcaggguccaaugugaggca

SEQ ID NO: 537718 - RNA, 22 nt, Human
aucuauuucugcuaauaacaau

SEQ ID NO: 537719 - RNA, 22 nt, Human
cuucagugcauguuuauaauca

SEQ ID NO: 537720 - RNA, 22 nt, Human
uuaauacaagcauaugcacaca

SEQ ID NO: 537721 - RNA, 22 nt, Human
acagcugugaagcaagcacucu

SEQ ID NO: 537722 - RNA, 22 nt, Human
ucugucuuugagaucucagccu

SEQ ID NO: 537723 - RNA, 22 nt, Human
uucaaugagcccaagaacguga

SEQ ID NO: 537724 - RNA, 20 nt, Human
auacaaagagauugauguau

SEQ ID NO: 537725 - RNA, 21 nt, Human
agugaaaugaaguguaugcuc

SEQ ID NO: 537726 - RNA, 22 nt, Human
uuggccuuguuaaggaggcccu

SEQ ID NO: 537727 - RNA, 22 nt, Human
uuaugcuaaaugaaucaaguca

SEQ ID NO: 537728 - RNA, 22 nt, Human
cugcccugagggccuguguguu

SEQ ID NO: 537729 - RNA, 22 nt, Human
ggcuccugggaugggacugagc

SEQ ID NO: 537730 - RNA, 22 nt, Human
gaagcagcgaaguggaagggac

SEQ ID NO: 537731 - RNA, 22 nt, Human
uggcagggaguugcaggauuuc

SEQ ID NO: 537732 - RNA, 22 nt, Human
ucccagccugacagugcaucaa

SEQ ID NO: 537733 - RNA, 23 nt, Human
guaaaauacgcagugcaguguga

SEQ ID NO: 537734 - RNA, 22 nt, Human
uucuuucugucaugguguacug

SEQ ID NO: 537735 - RNA, 22 nt, Human
cagggcagggauguugcggcag

SEQ ID NO: 537736 - RNA, 22 nt, Human
ucagcucuaaguuuuaugcaaa

SEQ ID NO: 537737 - RNA, 22 nt, Human
ccagugggugcugggcucugcc

SEQ ID NO: 537738 - RNA, 22 nt, Human
uguuuuuuuauauaccugaagu

SEQ ID NO: 537739 - RNA, 22 nt, Human
auucaaagagcugccagaacug

SEQ ID NO: 537740 - RNA, 22 nt, Human
aaauuauuaaacagugggaugc

SEQ ID NO: 537741 - RNA, 22 nt, Human
guguaugagccuccagcugggc

SEQ ID NO: 537742 - RNA, 22 nt, Human
agauuauuuccagacuaaugaa

SEQ ID NO: 537743 - RNA, 22 nt, Human
uucacauucucacaagaggaaa

SEQ ID NO: 537744 - RNA, 22 nt, Human
cgaggcagggaagcugcaaaag

SEQ ID NO: 537745 - RNA, 19 nt, Human
gcucugugaugcugagggg

SEQ ID NO: 537746 - RNA, 22 nt, Human
uuaauuaauuaguuaagcaugu

SEQ ID NO: 537747 - RNA, 22 nt, Human
ucucugagcgcauuccuccggc

SEQ ID NO: 537748 - RNA, 22 nt, Human
aucaggaucugggagccugaaa

SEQ ID NO: 537749 - RNA, 22 nt, Human
caaaggaggugauaggcccucu

SEQ ID NO: 537750 - RNA, 22 nt, Human
gcucagaggaugcuccuuuaug

SEQ ID NO: 537751 - RNA, 22 nt, Human
cacaguguggcaaauuucaacu

SEQ ID NO: 537752 - RNA, 22 nt, Human
aacaucuuugauaaacuuagug

SEQ ID NO: 537753 - RNA, 22 nt, Human
ccugcuggcguggcuggcgccc

SEQ ID NO: 537754 - RNA, 18 nt, Human
uguuuauuuuucucuuac

SEQ ID NO: 537755 - RNA, 22 nt, Human
uuaucguacgcuucagaaauuu

SEQ ID NO: 537756 - RNA, 22 nt, Human
ggggccagcuucgcgugcucuu

SEQ ID NO: 537757 - RNA, 22 nt, Human
ucugccuguucaagucuucuag

SEQ ID NO: 537758 - RNA, 22 nt, Human
uaaauuauguuccauguccuuu

SEQ ID NO: 537759 - RNA, 22 nt, Human
agagccagcauuugggcccugc

SEQ ID NO: 537760 - RNA, 22 nt, Human
ccagagucuaugaguccucauu

SEQ ID NO: 537761 - RNA, 22 nt, Human
auauaucugcaguacugaagaa

SEQ ID NO: 537762 - RNA, 22 nt, Human
cucuggaauguuuacaugcccu

SEQ ID NO: 537763 - RNA, 22 nt, Human
agcaaaucagcugcucaggaaa

SEQ ID NO: 537764 - RNA, 22 nt, Human
cuccugagcucugaggaagcuu

SEQ ID NO: 537765 - RNA, 22 nt, Human
augaaauguaaguagagaguuu

SEQ ID NO: 537766 - RNA, 22 nt, Human
agcugcucuugggugacuucaa

SEQ ID NO: 537767 - RNA, 22 nt, Human
cagggccucucaucccacgggc

SEQ ID NO: 537768 - RNA, 20 nt, Human
agaagcugauacugauggaa

SEQ ID NO: 537769 - RNA, 22 nt, Human
augggcagagcuggugggaggc

SEQ ID NO: 537770 - RNA, 22 nt, Human
augggcugaggugggauagaag

SEQ ID NO: 537771 - RNA, 22 nt, Human
cacauggaagagauacagugag

SEQ ID NO: 537772 - RNA, 22 nt, Human
aggcagcccacaggacacagga

SEQ ID NO: 537773 - RNA, 22 nt, Human
gcuggccuucugcagaguucug

SEQ ID NO: 537774 - RNA, 22 nt, Human
uagccaggucacacuguguguu

SEQ ID NO: 537775 - RNA, 22 nt, Human
acauacuugaagcaagugauca

SEQ ID NO: 537776 - RNA, 22 nt, Human
agucagcagccuggccaggaga

SEQ ID NO: 537777 - RNA, 22 nt, Human
uuacaguuguagaaagugguug

SEQ ID NO: 537778 - RNA, 22 nt, Human
ucugcuggccuuagcaggucua

SEQ ID NO: 537779 - RNA, 20 nt, Human
ucaggcaguggggaaaggca

SEQ ID NO: 537780 - RNA, 21 nt, Human
gccugccugcgugacccucuu

SEQ ID NO: 537781 - RNA, 22 nt, Human
ucuggcucuaacuaggcaucag

SEQ ID NO: 537782 - RNA, 22 nt, Human
cuggcagcucuacucagagccu

SEQ ID NO: 537783 - RNA, 22 nt, Human
uuuaguauccuaucucauuuaa

SEQ ID NO: 537784 - RNA, 20 nt, Human
caucaucacaugagccaauu

SEQ ID NO: 537785 - RNA, 22 nt, Human
ucagacagaggagcucgugcag

SEQ ID NO: 537786 - RNA, 22 nt, Human
aguuaauaauggaaagacacau

SEQ ID NO: 537787 - RNA, 22 nt, Human
ucugucugacaggguaugaacu

SEQ ID NO: 537788 - RNA, 22 nt, Human
uucagugucaauuuuuaaauau

SEQ ID NO: 537789 - RNA, 22 nt, Human
agcugcucauucccagcacaug

SEQ ID NO: 537790 - RNA, 22 nt, Human
agcagugaugcaugacagccua

SEQ ID NO: 537791 - RNA, 22 nt, Human
uuuguguggauggaaggcagua

SEQ ID NO: 537792 - RNA, 22 nt, Human
cagcuucuggcguggagccuga

SEQ ID NO: 537793 - RNA, 22 nt, Human
augcccuguggcaguacauauu

SEQ ID NO: 537794 - RNA, 22 nt, Human
uuccuguaguugugcaauguac

SEQ ID NO: 537795 - RNA, 22 nt, Human
ucagcuuuccugcagcuaaggg

SEQ ID NO: 537796 - RNA, 22 nt, Human
ucaauuauuugauaugaaaggg

SEQ ID NO: 537797 - RNA, 22 nt, Human
ucugaaauggcagcgggaauga

SEQ ID NO: 537798 - RNA, 22 nt, Human
uaaagguagcaugaaacugcaa

SEQ ID NO: 537799 - RNA, 22 nt, Human
uauucauaguaaacaaaagugg

SEQ ID NO: 537800 - RNA, 22 nt, Human
ugccugaagaaaacuugcagca

SEQ ID NO: 537801 - RNA, 20 nt, Human
ggagcuggcauccagccucu

SEQ ID NO: 537802 - RNA, 22 nt, Human
ugagccagaggaggcugugugg

SEQ ID NO: 537803 - RNA, 22 nt, Human
ggcagaguggagugcggccucc

SEQ ID NO: 537804 - RNA, 22 nt, Human
cuugcugggguaagucugugcu

SEQ ID NO: 537805 - RNA, 22 nt, Human
guuucauuuacaucuguaggua

SEQ ID NO: 537806 - RNA, 22 nt, Human
gacuucuauuaauaccucuacu

SEQ ID NO: 537807 - RNA, 22 nt, Human
cagugagguggauggauggccu

SEQ ID NO: 537808 - RNA, 22 nt, Human
uggccuggugcucaggcaguag

SEQ ID NO: 537809 - RNA, 22 nt, Human
auugcaccuuggguuuugaaag

SEQ ID NO: 537810 - RNA, 22 nt, Human
agucaguuaaccucacagcauc

SEQ ID NO: 537811 - RNA, 22 nt, Human
gggaagagugucgguugaagug

SEQ ID NO: 537812 - RNA, 22 nt, Human
caggccuggcugcagcucgccu

SEQ ID NO: 537813 - RNA, 22 nt, Human
gcccacaccauuuauucuuugu

SEQ ID NO: 537814 - RNA, 19 nt, Human
gauauugcuugaguaacug

SEQ ID NO: 537815 - RNA, 22 nt, Human
uuacaaguauuuaagaugcugu

SEQ ID NO: 537816 - RNA, 22 nt, Human
uguuuauugcugcaauugugcc

SEQ ID NO: 537817 - RNA, 22 nt, Human
cugucacacugauaucaggcuu

SEQ ID NO: 537818 - RNA, 22 nt, Human
uaacacugauuuguucucaggg

SEQ ID NO: 537819 - RNA, 22 nt, Human
uuacuaaguuuuaugcaacuua

SEQ ID NO: 537820 - RNA, 22 nt, Human
ugcuggcccaugaagacgcagu

SEQ ID NO: 537821 - RNA, 22 nt, Human
uugauaaaaugaugaaaucacu

SEQ ID NO: 537822 - RNA, 22 nt, Human
acacagggcaaugcuuugaccu

SEQ ID NO: 537823 - RNA, 22 nt, Human
uugguucauugcaggcgccggg

SEQ ID NO: 537824 - RNA, 22 nt, Human
gggagcugagggaccucugugg

SEQ ID NO: 537825 - RNA, 23 nt, Human
ccaggcucuuucaccugcuauuc

SEQ ID NO: 537826 - RNA, 22 nt, Human
uuauuuaauuuucucacucaga

SEQ ID NO: 537827 - RNA, 22 nt, Human
uguaacaucacagugauguuug

SEQ ID NO: 537828 - RNA, 19 nt, Human
ucaaaacacaaaugguuga

SEQ ID NO: 537829 - RNA, 20 nt, Human
ccucaguguccuggacuggg

SEQ ID NO: 537830 - RNA, 22 nt, Human
caggcagcagccacucugguau

SEQ ID NO: 537831 - RNA, 22 nt, Human
gguggcagucuuaagagaucuu

SEQ ID NO: 537832 - RNA, 22 nt, Human
guugugcagucagacugccugg

SEQ ID NO: 537833 - RNA, 21 nt, Human
auggagucaggggaaugggcc

SEQ ID NO: 537834 - RNA, 22 nt, Human
agagggagcccagucauagcug

SEQ ID NO: 537835 - RNA, 22 nt, Human
ugcccuggcucuccacuaguuu

SEQ ID NO: 537836 - RNA, 21 nt, Human
gcugugcaggugccccugcuc

SEQ ID NO: 537837 - RNA, 22 nt, Human
aaccauuugccauuaucuuaag

SEQ ID NO: 537838 - RNA, 22 nt, Human
augaauacgcggucauacacau

SEQ ID NO: 537839 - RNA, 22 nt, Human
agagccugucugccuuucuacc

SEQ ID NO: 537840 - RNA, 22 nt, Human
cuuacauaugcaagacaaaggg

SEQ ID NO: 537841 - RNA, 22 nt, Human
aggcugcuuccuuacguggcug

SEQ ID NO: 537842 - RNA, 22 nt, Human
agcaauauaaauguuggguaga

SEQ ID NO: 537843 - RNA, 22 nt, Human
aaauuauugggucccaccccag

SEQ ID NO: 537844 - RNA, 22 nt, Human
aggcccugcccagugccacaag

SEQ ID NO: 537845 - RNA, 22 nt, Human
cacugaaggaaggacuacugca

SEQ ID NO: 537846 - RNA, 22 nt, Human
cccaggcagccccagaagcuug

SEQ ID NO: 537847 - RNA, 22 nt, Human
gacuuugagggauacaaacauu

SEQ ID NO: 537848 - RNA, 22 nt, Human
aucugccucuucuucauugcga

SEQ ID NO: 537849 - RNA, 22 nt, Human
aacacaaaaauucucaggggca

SEQ ID NO: 537850 - RNA, 20 nt, Human
agccaggcucaagcuccccc

SEQ ID NO: 537851 - RNA, 22 nt, Human
auaaagucauuucaaaaguuga

SEQ ID NO: 537852 - RNA, 22 nt, Human
ccaggcugcuuagccuuaucuu

SEQ ID NO: 537853 - RNA, 17 nt, Human
gccuggcccagccuggc

SEQ ID NO: 537854 - RNA, 22 nt, Human
gaacugaguuuucugccuggac

SEQ ID NO: 537855 - RNA, 22 nt, Human
cugggcugcuguccacuagggu

SEQ ID NO: 537856 - RNA, 22 nt, Human
ucucaccauggugcuugcuuau

SEQ ID NO: 537857 - RNA, 22 nt, Human
agcaaauauuuuguugaagugc

SEQ ID NO: 537858 - RNA, 22 nt, Human
uuugaacaggaguaucuauagu

SEQ ID NO: 537859 - RNA, 22 nt, Human
agucaacaguuuuugauguaaa

SEQ ID NO: 537860 - RNA, 22 nt, Human
uaaauuuuuguuaacagccucu

SEQ ID NO: 537861 - RNA, 18 nt, Human
uucaccagugugaugggu

SEQ ID NO: 537862 - RNA, 22 nt, Human
uuuuccuauaugcaaagaaugc

SEQ ID NO: 537863 - RNA, 22 nt, Human
cgguccuguacuugaugagaua

SEQ ID NO: 537864 - RNA, 22 nt, Human
uucuuuucccaauauuuugcug

SEQ ID NO: 537865 - RNA, 22 nt, Human
ccaggugugccagcagggacug

SEQ ID NO: 537866 - RNA, 22 nt, Human
gcucaaagaauauucagaauga

SEQ ID NO: 537867 - RNA, 22 nt, Human
gggcucuucucaggagcuaucu

SEQ ID NO: 537868 - RNA, 22 nt, Human
uuggcagggccaggcucucucu

SEQ ID NO: 537869 - RNA, 22 nt, Human
uucagagaagcaaaggcagauu

SEQ ID NO: 537870 - RNA, 22 nt, Human
agggcugacaaauggcagugac

SEQ ID NO: 537871 - RNA, 22 nt, Human
ucugauuuauauaugcagauac

SEQ ID NO: 537872 - RNA, 22 nt, Human
uuuccugugacuaaucuggaca

SEQ ID NO: 537873 - RNA, 17 nt, Human
cauuuguugaucaguug

SEQ ID NO: 537874 - RNA, 22 nt, Human
cauuucugauuacagaauacua

SEQ ID NO: 537875 - RNA, 22 nt, Human
gagagaagaaagccaugguccu

SEQ ID NO: 537876 - RNA, 22 nt, Human
uuauuucuacuauuuugccuga

SEQ ID NO: 537877 - RNA, 22 nt, Human
agagaggcugggcguagggcuu

SEQ ID NO: 537878 - RNA, 22 nt, Human
ucaagucuugaugagacaaacc

SEQ ID NO: 537879 - RNA, 22 nt, Human
ugaagccauaggacagaggaua

SEQ ID NO: 537880 - RNA, 20 nt, Human
gacaacacagcuucaggucc

SEQ ID NO: 537881 - RNA, 22 nt, Human
gugcuuuccauccucccugcug

SEQ ID NO: 537882 - RNA, 22 nt, Human
cagaaggcaaacaaaaggauuu

SEQ ID NO: 537883 - RNA, 22 nt, Human
aaacuucuugcugcauuuucug

SEQ ID NO: 537884 - RNA, 22 nt, Human
agagccuguuuugugggagaug

SEQ ID NO: 537885 - RNA, 20 nt, Human
cuuagaaauuuuuacccugg

SEQ ID NO: 537886 - RNA, 22 nt, Human
aggaagagcuggaccagaggac

SEQ ID NO: 537887 - RNA, 22 nt, Human
agggggugcuacuuccagaguu

SEQ ID NO: 537888 - RNA, 22 nt, Human
ucccuggcagcuaagggugguc

SEQ ID NO: 537889 - RNA, 17 nt, Human
gauuuccugaaguucuu

SEQ ID NO: 537890 - RNA, 22 nt, Human
acaaucacacaugcaauuauac

SEQ ID NO: 537891 - RNA, 22 nt, Human
gcuggcccagggucaccuagga

SEQ ID NO: 537892 - RNA, 22 nt, Human
cagcugccccauaaaucacagu

SEQ ID NO: 537893 - RNA, 22 nt, Human
ugcuucugcaacuugaauguac

SEQ ID NO: 537894 - RNA, 20 nt, Human
uugaaauuggaugguagcua

SEQ ID NO: 537895 - RNA, 22 nt, Human
cucuggccagagccugcgggaa

SEQ ID NO: 537896 - RNA, 22 nt, Human
uuggcagucagucuuggugcuu

SEQ ID NO: 537897 - RNA, 22 nt, Human
acagaauucucucugcagaggc

SEQ ID NO: 537898 - RNA, 22 nt, Human
agauuucagaugcucggcaguu

SEQ ID NO: 537899 - RNA, 22 nt, Human
cagcccucagguccucagcagc

SEQ ID NO: 537900 - RNA, 22 nt, Human
aguugaagguuggcugauccau

SEQ ID NO: 537901 - RNA, 22 nt, Human
uggcaggaaaaacauuggagau

SEQ ID NO: 537902 - RNA, 22 nt, Human
cagaaguaaugaugucauuccu

SEQ ID NO: 537903 - RNA, 22 nt, Human
caaauacuacgauucuugcagu

SEQ ID NO: 537904 - RNA, 22 nt, Human
ggggcugguggugguuucucca

SEQ ID NO: 537905 - RNA, 22 nt, Human
auacacacugcuauccuuuuuu

SEQ ID NO: 537906 - RNA, 22 nt, Human
uggagccagagcgcagccuggg

SEQ ID NO: 537907 - RNA, 22 nt, Human
aucugcccaucuguccugcuuc

SEQ ID NO: 537908 - RNA, 22 nt, Human
gcucaggaaggcucaaccagga

SEQ ID NO: 537909 - RNA, 22 nt, Human
ucccaagagacagaaugguauc

SEQ ID NO: 537910 - RNA, 19 nt, Human
caguuacagcagcuaagac

SEQ ID NO: 537911 - RNA, 22 nt, Human
uggcaaagcuagacauucccuc

SEQ ID NO: 537912 - RNA, 22 nt, Human
agccaggcuaaaugagccauga

SEQ ID NO: 537913 - RNA, 22 nt, Human
acauugaucagccucccaugca

SEQ ID NO: 537914 - RNA, 22 nt, Human
gaggcacaccagggagucuugu

SEQ ID NO: 537915 - RNA, 22 nt, Human
uggaggcauaggccugggcccu

SEQ ID NO: 537916 - RNA, 22 nt, Human
agaagcugccuacaugaccagc

SEQ ID NO: 537917 - RNA, 22 nt, Human
uugcagggaccugcagaaagcu

SEQ ID NO: 537918 - RNA, 22 nt, Human
uaagcagaaaaagugggaguua

SEQ ID NO: 537919 - RNA, 22 nt, Human
agauuaugcuggcugcuacaag

SEQ ID NO: 537920 - RNA, 21 nt, Human
gggcaggucucugaugucaac

SEQ ID NO: 537921 - RNA, 22 nt, Human
acacuuaagcaugaaguauaaa

SEQ ID NO: 537922 - RNA, 22 nt, Human
agggccugagcucuccuccagu

SEQ ID NO: 537923 - RNA, 22 nt, Human
ugaggcagcaauuguauuguau

SEQ ID NO: 537924 - RNA, 22 nt, Human
ugccuuuuccagcuuccaggag

SEQ ID NO: 537925 - RNA, 23 nt, Human
uggaagcaaucacuguagugaau

SEQ ID NO: 537926 - RNA, 20 nt, Human
agagcugggaagcucccuau

SEQ ID NO: 537927 - RNA, 22 nt, Human
ucagcuuguuuaugauaagcag

SEQ ID NO: 537928 - RNA, 22 nt, Human
cuucugggcagaaguuuugaga

SEQ ID NO: 537929 - RNA, 22 nt, Human
ccugagguggcugcagcacugc

SEQ ID NO: 537930 - RNA, 22 nt, Human
cugagagcagggacuugagcca

SEQ ID NO: 537931 - RNA, 23 nt, Human
ugagaagccaggggagcgugagg

SEQ ID NO: 537932 - RNA, 22 nt, Human
ccugacucuggccaggccagcu

SEQ ID NO: 537933 - RNA, 22 nt, Human
gcaggcucacucuguuuggcuc

SEQ ID NO: 537934 - RNA, 22 nt, Human
aaaauccucuaauucuagaaua

SEQ ID NO: 537935 - RNA, 22 nt, Human
aaaugcauugguuucuacuugu

SEQ ID NO: 537936 - RNA, 20 nt, Human
uagggcucauuaugaucucc

SEQ ID NO: 537937 - RNA, 22 nt, Human
ugcagggcaucuuugaagugug

SEQ ID NO: 537938 - RNA, 18 nt, Human
caauguuuuagaucucua

SEQ ID NO: 537939 - RNA, 22 nt, Human
cuucucccuggcuucugcacac

SEQ ID NO: 537940 - RNA, 22 nt, Human
uaacaacuugcuuuuaucuuag

SEQ ID NO: 537941 - RNA, 22 nt, Human
ggccgggcaggucucagccagc

SEQ ID NO: 537942 - RNA, 20 nt, Human
aagcagaagcugcucucagc

SEQ ID NO: 537943 - RNA, 22 nt, Human
aucuaagauguauugagcacuu

SEQ ID NO: 537944 - RNA, 22 nt, Human
accuuggaaaguuuaauugagg

SEQ ID NO: 537945 - RNA, 22 nt, Human
auggaagacagauaaggcagaa

SEQ ID NO: 537946 - RNA, 22 nt, Human
guuagggaagcgcuguguucuu

SEQ ID NO: 537947 - RNA, 22 nt, Human
uagaaacaaaaucugaugacuc

SEQ ID NO: 537948 - RNA, 22 nt, Human
cagguggcaugacugccuacaa

SEQ ID NO: 537949 - RNA, 21 nt, Human
ccuuuagauuucuaugcaguu

SEQ ID NO: 537950 - RNA, 22 nt, Human
uggaaaaacugagacuuagaca

SEQ ID NO: 537951 - RNA, 19 nt, Human
gguguccuagagauaagag

SEQ ID NO: 537952 - RNA, 18 nt, Human
ucaaagucuggcuccacu

SEQ ID NO: 537953 - RNA, 22 nt, Human
agggcagcagcuccuccuagcu

SEQ ID NO: 537954 - RNA, 22 nt, Human
cucuuuucaaaccuguuuaugg

SEQ ID NO: 537955 - RNA, 22 nt, Human
cuccagggaaaggggcguccgc

SEQ ID NO: 537956 - RNA, 22 nt, Human
aaaaaccauugucuucagucuc

SEQ ID NO: 537957 - RNA, 22 nt, Human
uucacaauaggagcaugcaaau

SEQ ID NO: 537958 - RNA, 22 nt, Human
gagaugguagccucagaagagu

SEQ ID NO: 537959 - RNA, 22 nt, Human
ggagaagaggagcuggaagccu

SEQ ID NO: 537960 - RNA, 22 nt, Human
uauaacaguuuaggugguguca

SEQ ID NO: 537961 - RNA, 22 nt, Human
ugguaaauauguccauucucuu

SEQ ID NO: 537962 - RNA, 18 nt, Human
gcagaucauuagauaauu

SEQ ID NO: 537963 - RNA, 22 nt, Human
uuggguaggagaaagaacagau

SEQ ID NO: 537964 - RNA, 22 nt, Human
agaauucuguucuucgggugug

SEQ ID NO: 537965 - RNA, 22 nt, Human
cugucauuuaagacauucugga

SEQ ID NO: 537966 - RNA, 22 nt, Human
acagcuuuucugauagauccug

SEQ ID NO: 537967 - RNA, 22 nt, Human
aggaggcaggaagucuauggga

SEQ ID NO: 537968 - RNA, 22 nt, Human
auccuucaaaaggaauagcagg

SEQ ID NO: 537969 - RNA, 22 nt, Human
auaugcacgcauacacacauaa

SEQ ID NO: 537970 - RNA, 23 nt, Human
aaauucaguccuucaacucugag

SEQ ID NO: 537971 - RNA, 22 nt, Human
aaugucugccugaacuuuauau

SEQ ID NO: 537972 - RNA, 22 nt, Human
gaacaucaaggucugugucuag

SEQ ID NO: 537973 - RNA, 22 nt, Human
agggccaccagagcagggcagu

SEQ ID NO: 537974 - RNA, 22 nt, Human
gaaauucugugucccagagugc

SEQ ID NO: 537975 - RNA, 22 nt, Human
gagcugcagcggcugacgcaac

SEQ ID NO: 537976 - RNA, 22 nt, Human
acagaagacagaguguucaucu

SEQ ID NO: 537977 - RNA, 22 nt, Human
cugaagcaaaugaaacagcucu

SEQ ID NO: 537978 - RNA, 22 nt, Human
uucacagagaguaugcagagaa

SEQ ID NO: 537979 - RNA, 22 nt, Human
cagggcucaggcucugggauuc

SEQ ID NO: 537980 - RNA, 22 nt, Human
cugggggcaauggucagagugu

SEQ ID NO: 537981 - RNA, 18 nt, Human
acaaaugugucacaggaa

SEQ ID NO: 537982 - RNA, 22 nt, Human
ccuaggccuuacuuuccugugc

SEQ ID NO: 537983 - RNA, 22 nt, Human
uagcuauuuggaaaauuccaau

SEQ ID NO: 537984 - RNA, 22 nt, Human
uacauaauugucuuuguccuca

SEQ ID NO: 537985 - RNA, 22 nt, Human
agccagcugccuuucacaucug

SEQ ID NO: 537986 - RNA, 22 nt, Human
gagcugaaauaugaagccaauu

SEQ ID NO: 537987 - RNA, 22 nt, Human
guucauaauuugaaggaauagg

SEQ ID NO: 537988 - RNA, 18 nt, Human
ugggaaaguuuauagaau

SEQ ID NO: 537989 - RNA, 22 nt, Human
aguucuuuugugaacauaugcu

SEQ ID NO: 537990 - RNA, 22 nt, Human
uuauucagucugucuagggagu

SEQ ID NO: 537991 - RNA, 22 nt, Human
acuguggcucaucaggcuggug

SEQ ID NO: 537992 - RNA, 22 nt, Human
gcugcugggauccugggucuca

SEQ ID NO: 537993 - RNA, 22 nt, Human
aaaggaguuacucauaaagcuu

SEQ ID NO: 537994 - RNA, 22 nt, Human
acuguucauuuggauuucucug

SEQ ID NO: 537995 - RNA, 23 nt, Human
aagcuucuagggugggcaagaug

SEQ ID NO: 537996 - RNA, 20 nt, Human
agugcccuccgacauuguuu

SEQ ID NO: 537997 - RNA, 22 nt, Human
agggcgaggagacggaggcaca

SEQ ID NO: 537998 - RNA, 22 nt, Human
uucccagaccuguaggaucaga

SEQ ID NO: 537999 - RNA, 21 nt, Human
ccuaaacaagacugacacaca

SEQ ID NO: 538000 - RNA, 22 nt, Human
ccugucugcaagggguggaucc

SEQ ID NO: 538001 - RNA, 22 nt, Human
uuuuuacacuuagcauugagcg

SEQ ID NO: 538002 - RNA, 19 nt, Human
ugcuucuggaaccaugauc

SEQ ID NO: 538003 - RNA, 22 nt, Human
ucuccugugcacccucccugug

SEQ ID NO: 538004 - RNA, 22 nt, Human
guacaaggcauuuaucuguuca

SEQ ID NO: 538005 - RNA, 22 nt, Human
acuucaaauuuucagaagaaau

SEQ ID NO: 538006 - RNA, 22 nt, Human
ugucagugguaagguugggagu

SEQ ID NO: 538007 - RNA, 22 nt, Human
uccaaagaagucacaaacgaag

SEQ ID NO: 538008 - RNA, 22 nt, Human
uuuagaaugugacuguauuuga

SEQ ID NO: 538009 - RNA, 22 nt, Human
auggcugugaaggucacacccu

SEQ ID NO: 538010 - RNA, 22 nt, Human
caaagaugccaaaaggaagaca

SEQ ID NO: 538011 - RNA, 22 nt, Human
uaugacaagaaauacagaggua

SEQ ID NO: 538012 - RNA, 22 nt, Human
cagaggaaaugggaaggagaua

SEQ ID NO: 538013 - RNA, 22 nt, Human
uuugggcaguagauguaucacu

SEQ ID NO: 538014 - RNA, 22 nt, Human
cggagcugccugccaagccugc

SEQ ID NO: 538015 - RNA, 23 nt, Human
ucagagaggcccccugcagagau

SEQ ID NO: 538016 - RNA, 22 nt, Human
uguaugcaccauuguauuaccu

SEQ ID NO: 538017 - RNA, 22 nt, Human
gcccacacaccagcucaggagg

SEQ ID NO: 538018 - RNA, 23 nt, Human
acagccaguucaccucuccuugg

SEQ ID NO: 538019 - RNA, 22 nt, Human
gggaggaaagagaaguggucca

SEQ ID NO: 538020 - RNA, 22 nt, Human
cggcacagccgggcaaggcugg

SEQ ID NO: 538021 - RNA, 22 nt, Human
cagcuuuguggccuugaccucg

SEQ ID NO: 538022 - RNA, 22 nt, Human
gccuucugauaucucuuggcau

SEQ ID NO: 538023 - RNA, 22 nt, Human
accugggaguaugcagugguga

SEQ ID NO: 538024 - RNA, 22 nt, Human
gcauuccugagaaugcagagug

SEQ ID NO: 538025 - RNA, 22 nt, Human
augcuguguuuuaaauggaaau

SEQ ID NO: 538026 - RNA, 22 nt, Human
aggccagcaccagagucaagaa

SEQ ID NO: 538027 - RNA, 22 nt, Human
uaccacaggccaaauuugaggu

SEQ ID NO: 538028 - RNA, 22 nt, Human
gcaguaaaaaaggauaugugca

SEQ ID NO: 538029 - RNA, 22 nt, Human
ugaaggagcugauguaaggggu

SEQ ID NO: 538030 - RNA, 22 nt, Human
ugaggcagaaauuccuguuuuc

SEQ ID NO: 538031 - RNA, 22 nt, Human
ucaguuuugauuccugguucuc

SEQ ID NO: 538032 - RNA, 19 nt, Human
gaagaagcuugagaaguag

SEQ ID NO: 538033 - RNA, 22 nt, Human
aacagacaacuccuguggcuca

SEQ ID NO: 538034 - RNA, 22 nt, Human
ucaguuuuucuauacuuuguag

SEQ ID NO: 538035 - RNA, 22 nt, Human
aaggucauuguugcauguucuc

SEQ ID NO: 538036 - RNA, 22 nt, Human
gcagccuccgcacugcgagucc

SEQ ID NO: 538037 - RNA, 22 nt, Human
ccagaagacaagaauguucuua

SEQ ID NO: 538038 - RNA, 22 nt, Human
ucuggccuuaucuguccaagcc

SEQ ID NO: 538039 - RNA, 22 nt, Human
agaauaaaucaaauguccugag

SEQ ID NO: 538040 - RNA, 22 nt, Human
caucacugacgcugagauucca

SEQ ID NO: 538041 - RNA, 23 nt, Human
augaaaguucuuaaaaugucaug

SEQ ID NO: 538042 - RNA, 22 nt, Human
uccagggcugacuugggagagg

SEQ ID NO: 538043 - RNA, 22 nt, Human
aaagcagccgguucccuggucu

SEQ ID NO: 538044 - RNA, 22 nt, Human
acagaaguguugaaguuuucau

SEQ ID NO: 538045 - RNA, 22 nt, Human
guccucugaaagaugaaccaug

SEQ ID NO: 538046 - RNA, 22 nt, Human
uaaaggcucacuggcuuggggu

SEQ ID NO: 538047 - RNA, 22 nt, Human
ccagaggcauguucaaagcaau

SEQ ID NO: 538048 - RNA, 22 nt, Human
gcugagcccucaucccuaguuu

SEQ ID NO: 538049 - RNA, 22 nt, Human
caggagcaugcugaugccagaa

SEQ ID NO: 538050 - RNA, 22 nt, Human
uuagaaaucugcugccaugcaa

SEQ ID NO: 538051 - RNA, 22 nt, Human
ugcccaaguccuccaccgaggu

SEQ ID NO: 538052 - RNA, 22 nt, Human
uuuccucuuccgagggggaggc

SEQ ID NO: 538053 - RNA, 22 nt, Human
acuuaguauuuuucagcuuuga

SEQ ID NO: 538054 - RNA, 22 nt, Human
aaauauaauuucugccucaaua

SEQ ID NO: 538055 - RNA, 22 nt, Human
uaaacagagagugcaguuauag

SEQ ID NO: 538056 - RNA, 22 nt, Human
uuuucuguauuauugugcuuca

SEQ ID NO: 538057 - RNA, 22 nt, Human
uggcucaggagggaucuuugcu

SEQ ID NO: 538058 - RNA, 22 nt, Human
gagcugaggcucaggcuggcgu

SEQ ID NO: 538059 - RNA, 22 nt, Human
cuuguagaauugaaauggucuc

SEQ ID NO: 538060 - RNA, 22 nt, Human
aaguuacaguuauuauuuaaaa

SEQ ID NO: 538061 - RNA, 22 nt, Human
uccuucaaagcuccuagugagc

SEQ ID NO: 538062 - RNA, 22 nt, Human
ugcuuuauugcaucaguguggg

SEQ ID NO: 538063 - RNA, 22 nt, Human
caaguuauuucauuggaacaau

SEQ ID NO: 538064 - RNA, 22 nt, Human
uguuuacagggugauuuuaccu

SEQ ID NO: 538065 - RNA, 19 nt, Human
uagucuuuauucuuaauuu

SEQ ID NO: 538066 - RNA, 22 nt, Human
uacacagaagccagaaggccug

SEQ ID NO: 538067 - RNA, 22 nt, Human
ucacauuuuaguaccaugauuu

SEQ ID NO: 538068 - RNA, 22 nt, Human
ugaagcaggguggccagauugu

SEQ ID NO: 538069 - RNA, 22 nt, Human
aagauuucugcuccugagagaa

SEQ ID NO: 538070 - RNA, 22 nt, Human
cucugcccgugccuuucccagu

SEQ ID NO: 538071 - RNA, 22 nt, Human
uuucaguggguuuauuucaugu

SEQ ID NO: 538072 - RNA, 22 nt, Human
gagaugcugccugauuuauuca

SEQ ID NO: 538073 - RNA, 22 nt, Human
aggagccagcguuccucaggau

SEQ ID NO: 538074 - RNA, 22 nt, Human
cgggaaaguuccacagauggau

SEQ ID NO: 538075 - RNA, 22 nt, Human
cuccagggaugagacagaguag

SEQ ID NO: 538076 - RNA, 20 nt, Human
ugcagaagaacguucugguu

SEQ ID NO: 538077 - RNA, 22 nt, Human
ccucugagccugugugcggcac

SEQ ID NO: 538078 - RNA, 23 nt, Human
gccugggacugguagugugaccu

SEQ ID NO: 538079 - RNA, 22 nt, Human
cugcagugaaaucaggaagcaa

SEQ ID NO: 538080 - RNA, 22 nt, Human
uggcugagggggcucugcucag

SEQ ID NO: 538081 - RNA, 22 nt, Human
agcaggugcguuacuucacucu

SEQ ID NO: 538082 - RNA, 22 nt, Human
ggcccugugguuuugcaaaguc

SEQ ID NO: 538083 - RNA, 22 nt, Human
gcuaccugagcaagagcuucaa

SEQ ID NO: 538084 - RNA, 22 nt, Human
augaggcagucuggccugaggg

SEQ ID NO: 538085 - RNA, 22 nt, Human
uggaggcaucagagugcuuggc

SEQ ID NO: 538086 - RNA, 22 nt, Human
gaggcagcuuggggcugugggu

SEQ ID NO: 538087 - RNA, 22 nt, Human
ugugaaaggagccauagacagu

SEQ ID NO: 538088 - RNA, 22 nt, Human
uccuucaagaugccacagcuuu

SEQ ID NO: 538089 - RNA, 22 nt, Human
uuauuaaugaguacaaguuauu

SEQ ID NO: 538090 - RNA, 22 nt, Human
acacauuucucuuuuuguaagu

SEQ ID NO: 538091 - RNA, 22 nt, Human
cucacugugccuuuucccaaac

SEQ ID NO: 538092 - RNA, 22 nt, Human
cauacauuuugcauauuuacca

SEQ ID NO: 538093 - RNA, 22 nt, Human
ugcugggcaucguaggagguac

SEQ ID NO: 538094 - RNA, 22 nt, Human
cagucaggcugcgcuucucuga

SEQ ID NO: 538095 - RNA, 22 nt, Human
uugcucugacuggagugcagug

SEQ ID NO: 538096 - RNA, 22 nt, Human
ugggcagagaucuggaucaaac

SEQ ID NO: 538097 - RNA, 22 nt, Human
acagagucugacagguaggcgc

SEQ ID NO: 538098 - RNA, 22 nt, Human
gaggcucaacccacagggguug

SEQ ID NO: 538099 - RNA, 22 nt, Human
ucugggugaugaaaugcacugu

SEQ ID NO: 538100 - RNA, 22 nt, Human
ucugagaguccaucuccaagcc

SEQ ID NO: 538101 - RNA, 22 nt, Human
uuuaauuuuccugguaggccug

SEQ ID NO: 538102 - RNA, 22 nt, Human
gugaaaucugaggcccaugaug

SEQ ID NO: 538103 - RNA, 22 nt, Human
guagggacccacagucuauauu

SEQ ID NO: 538104 - RNA, 22 nt, Human
guggagcaggacuagcugagaa

SEQ ID NO: 538105 - RNA, 22 nt, Human
aggggccuggcacugagcuggc

SEQ ID NO: 538106 - RNA, 22 nt, Human
aggaaagguucagugauugaaa

SEQ ID NO: 538107 - RNA, 22 nt, Human
uuuccuaacacaaugcaugaga

SEQ ID NO: 538108 - RNA, 22 nt, Human
caggguccaucuuucaucacug

SEQ ID NO: 538109 - RNA, 22 nt, Human
ucaagcagagucaaaaguacca

SEQ ID NO: 538110 - RNA, 22 nt, Human
cagagugaaaacugagcucaaa

SEQ ID NO: 538111 - RNA, 20 nt, Human
ucuggcucuuugcuccuccc

SEQ ID NO: 538112 - RNA, 22 nt, Human
cuggagcugucuucacaggccu

SEQ ID NO: 538113 - RNA, 22 nt, Human
gucugcccuuggccugggacuu

SEQ ID NO: 538114 - RNA, 20 nt, Human
gcaugaggaaucauugcagc

SEQ ID NO: 538115 - RNA, 22 nt, Human
acaaaugucuacauugagaaua

SEQ ID NO: 538116 - RNA, 22 nt, Human
ucucuuaaaggucuucagcuga

SEQ ID NO: 538117 - RNA, 22 nt, Human
uaaaggcucguauuguugugug

SEQ ID NO: 538118 - RNA, 22 nt, Human
cugacacacugagcauuugaua

SEQ ID NO: 538119 - RNA, 22 nt, Human
agcaggugaucgcgugugcucc

SEQ ID NO: 538120 - RNA, 20 nt, Human
cacaggaaagcuacucaguu

SEQ ID NO: 538121 - RNA, 22 nt, Human
aacuucagggacagaaaagagc

SEQ ID NO: 538122 - RNA, 22 nt, Human
cacacaugaaucccuaguaccu

SEQ ID NO: 538123 - RNA, 22 nt, Human
ccaaggcacacucugcaagguu

SEQ ID NO: 538124 - RNA, 22 nt, Human
ugggggugugccagggaccucc

SEQ ID NO: 538125 - RNA, 22 nt, Human
cuggaagguucuuugugugccu

SEQ ID NO: 538126 - RNA, 22 nt, Human
uuguggcagaccaugagucuaa

SEQ ID NO: 538127 - RNA, 22 nt, Human
caaggccaagucucugugaaga

SEQ ID NO: 538128 - RNA, 22 nt, Human
caguuuuaugucgaauguauac

SEQ ID NO: 538129 - RNA, 22 nt, Human
acauuguagacuuuucauaugu

SEQ ID NO: 538130 - RNA, 22 nt, Human
uggcucagcgguggcagcagac

SEQ ID NO: 538131 - RNA, 22 nt, Human
ucaaauaccagcuuuuccagaa

SEQ ID NO: 538132 - RNA, 22 nt, Human
uggcuucuuagaccaguggccu

SEQ ID NO: 538133 - RNA, 22 nt, Human
auggaaagcuaagccauuuacc

SEQ ID NO: 538134 - RNA, 22 nt, Human
aaguuugugguuauacuugauu

SEQ ID NO: 538135 - RNA, 22 nt, Human
augggaagguuuugagagcggg

SEQ ID NO: 538136 - RNA, 22 nt, Human
cagggaguuuuuguuccucuag

SEQ ID NO: 538137 - RNA, 22 nt, Human
ugaaaucaauaauuggugauug

SEQ ID NO: 538138 - RNA, 22 nt, Human
agguauauauucugguccuuau

SEQ ID NO: 538139 - RNA, 22 nt, Human
ggguaccaagcugcuugggggc

SEQ ID NO: 538140 - RNA, 22 nt, Human
ccugggucacucaggcaggcgg

SEQ ID NO: 538141 - RNA, 22 nt, Human
accucuggccuucaggcaucau

SEQ ID NO: 538142 - RNA, 22 nt, Human
ucacaagacagaaaacauuuag

SEQ ID NO: 538143 - RNA, 22 nt, Human
aacaugaaaagcccagagaggu

SEQ ID NO: 538144 - RNA, 22 nt, Human
cugcccugcuuguuuccagugg

SEQ ID NO: 538145 - RNA, 22 nt, Human
caauuucagucucagagaguuc

SEQ ID NO: 538146 - RNA, 22 nt, Human
gcugagaguccaggaaaacauc

SEQ ID NO: 538147 - RNA, 22 nt, Human
auaauguagguauguguauuua

SEQ ID NO: 538148 - RNA, 22 nt, Human
uccugagaaggcacagcuugca

SEQ ID NO: 538149 - RNA, 22 nt, Human
aaaggaagugccacucuucuuc

SEQ ID NO: 538150 - RNA, 22 nt, Human
acaaguggguccuacauaaagc

SEQ ID NO: 538151 - RNA, 23 nt, Human
ucuguucaaggcuuucuccuuga

SEQ ID NO: 538152 - RNA, 22 nt, Human
guuaaauucgaugauggauaaa

SEQ ID NO: 538153 - RNA, 22 nt, Human
cuggcucaguucuugguuuuca

SEQ ID NO: 538154 - RNA, 22 nt, Human
aguaaugugccugaaauacuug

SEQ ID NO: 538155 - RNA, 22 nt, Human
uggcucaggccuacgacgccuu

SEQ ID NO: 538156 - RNA, 22 nt, Human
agggucaggagacacuggcaac

SEQ ID NO: 538157 - RNA, 22 nt, Human
cagagacccuucucaguggcca

SEQ ID NO: 538158 - RNA, 22 nt, Human
ucaaagcaugguuuugaaagac

SEQ ID NO: 538159 - RNA, 22 nt, Human
ucugccuuuucacugccacuaa

SEQ ID NO: 538160 - RNA, 22 nt, Human
uauuguacauuuccaaauugcu

SEQ ID NO: 538161 - RNA, 22 nt, Human
aucuguagucacugcacagcuc

SEQ ID NO: 538162 - RNA, 22 nt, Human
uauguucaucuggugcaucagu

SEQ ID NO: 538163 - RNA, 22 nt, Human
guccucugauuucuagguauau

SEQ ID NO: 538164 - RNA, 22 nt, Human
ugcagguggacacgggagacgg

SEQ ID NO: 538165 - RNA, 22 nt, Human
cuuucaaagaguaggagguuuu

SEQ ID NO: 538166 - RNA, 22 nt, Human
uggcccuguguccugcugccag

SEQ ID NO: 538167 - RNA, 22 nt, Human
agagccccugguggagugagaa

SEQ ID NO: 538168 - RNA, 22 nt, Human
gcagggacgcagcacucuccgu

SEQ ID NO: 538169 - RNA, 22 nt, Human
ucuuuccuaggugauaugcaau

SEQ ID NO: 538170 - RNA, 22 nt, Human
ggagcacccugcucagccaagc

SEQ ID NO: 538171 - RNA, 22 nt, Human
ggcuccagaggccuuaccugca

SEQ ID NO: 538172 - RNA, 22 nt, Human
gcugcagcagcugcaggguugu

SEQ ID NO: 538173 - RNA, 22 nt, Human
guugaguggguuaggaugcuga

SEQ ID NO: 538174 - RNA, 22 nt, Human
ugcuucuggaguaacaggguga

SEQ ID NO: 538175 - RNA, 22 nt, Human
gccugcagccagggaguucucu

SEQ ID NO: 538176 - RNA, 22 nt, Human
ucccucugguccucgguggaga

SEQ ID NO: 538177 - RNA, 22 nt, Human
aagggcagcugacagaugcuua

SEQ ID NO: 538178 - RNA, 22 nt, Human
acacacaugcaugcuugccauu

SEQ ID NO: 538179 - RNA, 22 nt, Human
uauagacuagcagcagaauuua

SEQ ID NO: 538180 - RNA, 22 nt, Human
gacaggggucccucugggcugu

SEQ ID NO: 538181 - RNA, 19 nt, Human
cacauuuugagucugagau

SEQ ID NO: 538182 - RNA, 22 nt, Human
cauaaacucucuguaccaauau

SEQ ID NO: 538183 - RNA, 22 nt, Human
cgcaccacugaauuccagccug

SEQ ID NO: 538184 - RNA, 22 nt, Human
aacagugagaagguggacagga

SEQ ID NO: 538185 - RNA, 22 nt, Human
gcagggcacaaggacgcacagg

SEQ ID NO: 538186 - RNA, 22 nt, Human
uggccugguaccacauagauuu

SEQ ID NO: 538187 - RNA, 22 nt, Human
gguggcagugcuugcgggucua

SEQ ID NO: 538188 - RNA, 22 nt, Human
ucucaggguuuguacaagugua

SEQ ID NO: 538189 - RNA, 22 nt, Human
uaauuucuagggacuaaggugc

SEQ ID NO: 538190 - RNA, 22 nt, Human
cauacauaugcauguguguaua

SEQ ID NO: 538191 - RNA, 21 nt, Human
ucagguggcagaguguuuaug

SEQ ID NO: 538192 - RNA, 22 nt, Human
ugcccacauggugccauggcca

SEQ ID NO: 538193 - RNA, 22 nt, Human
gcuccacuugcagcuaggcuug

SEQ ID NO: 538194 - RNA, 22 nt, Human
uuucuguaauuaaaagggcagg

SEQ ID NO: 538195 - RNA, 22 nt, Human
cacuguccaauagauacauaau

SEQ ID NO: 538196 - RNA, 22 nt, Human
uucacauuggugauauguuucu

SEQ ID NO: 538197 - RNA, 22 nt, Human
ucuacauuuuaacaagaugccc

SEQ ID NO: 538198 - RNA, 22 nt, Human
cagagcuggagggaacccuggc

SEQ ID NO: 538199 - RNA, 22 nt, Human
cauauuuuaguugcugaacagc

SEQ ID NO: 538200 - RNA, 22 nt, Human
uauuuugacuauuaaaccaaca

SEQ ID NO: 538201 - RNA, 22 nt, Human
uggaguucauccaugacagcuu

SEQ ID NO: 538202 - RNA, 22 nt, Human
ccaugccccaauacaggacacc

SEQ ID NO: 538203 - RNA, 23 nt, Human
gugaagguuucugcauuuauugg

SEQ ID NO: 538204 - RNA, 22 nt, Human
cagcaugguggagcugcucuuu

SEQ ID NO: 538205 - RNA, 22 nt, Human
caagagcucaccggagagcauu

SEQ ID NO: 538206 - RNA, 22 nt, Human
aaggcacugagccagccgucuc

SEQ ID NO: 538207 - RNA, 22 nt, Human
gagcuuggacaccuuggcaggu

SEQ ID NO: 538208 - RNA, 22 nt, Human
ggagaagggacagacucagcuu

SEQ ID NO: 538209 - RNA, 22 nt, Human
ucagaaauagucuuuaaaauga

SEQ ID NO: 538210 - RNA, 22 nt, Human
acaaggcuuauaguugcuuuuu

SEQ ID NO: 538211 - RNA, 22 nt, Human
cuggccacaacuagcccaggac

SEQ ID NO: 538212 - RNA, 22 nt, Human
agggagaagguccaugccuguc

SEQ ID NO: 538213 - RNA, 22 nt, Human
aggggccucgcaggaccgcucc

SEQ ID NO: 538214 - RNA, 23 nt, Human
cucugagacccagguggacacgg

SEQ ID NO: 538215 - RNA, 22 nt, Human
cagggagccuccaaagcuuuca

SEQ ID NO: 538216 - RNA, 22 nt, Human
aacaaaguacuuuucagugcuu

SEQ ID NO: 538217 - RNA, 22 nt, Human
gacauaaaauucaauaauuugu

SEQ ID NO: 538218 - RNA, 22 nt, Human
caggauggucuucauuuggcuc

SEQ ID NO: 538219 - RNA, 22 nt, Human
uaaguggaagguuauaugcuaa

SEQ ID NO: 538220 - RNA, 22 nt, Human
uggcuuccuggacagaugcggu

SEQ ID NO: 538221 - RNA, 19 nt, Human
gccugagccagccaugcaa

SEQ ID NO: 538222 - RNA, 22 nt, Human
cugugagcuggguggccaggac

SEQ ID NO: 538223 - RNA, 22 nt, Human
acaguggagaaggcaugaggcu

SEQ ID NO: 538224 - RNA, 22 nt, Human
ucccagagacaucauuucuccg

SEQ ID NO: 538225 - RNA, 22 nt, Human
cugcucugcagcuuggacuccc

SEQ ID NO: 538226 - RNA, 22 nt, Human
gcagaggaucaggcucuggaaa

SEQ ID NO: 538227 - RNA, 22 nt, Human
ugguccuucguggugcaguucu

SEQ ID NO: 538228 - RNA, 22 nt, Human
cccagaguuggucaggggaccc

SEQ ID NO: 538229 - RNA, 22 nt, Human
ucuugauuuuguuaaaauuaga

SEQ ID NO: 538230 - RNA, 22 nt, Human
uguacagauaucaggagugagg

SEQ ID NO: 538231 - RNA, 22 nt, Human
ggaaacaugccugcuggacagu

SEQ ID NO: 538232 - RNA, 22 nt, Human
ugcugcuguugacggcugucca

SEQ ID NO: 538233 - RNA, 20 nt, Human
accuuucaaaugauucagca

SEQ ID NO: 538234 - RNA, 22 nt, Human
gacaucaauauucugcagggau

SEQ ID NO: 538235 - RNA, 22 nt, Human
aauaucuucuaaggauagaacu

SEQ ID NO: 538236 - RNA, 22 nt, Human
auuacaauaagguuuauuugua

SEQ ID NO: 538237 - RNA, 22 nt, Human
acacaguucaggaucaaauagc

SEQ ID NO: 538238 - RNA, 22 nt, Human
uccauuuuagaagaaaauccac

SEQ ID NO: 538239 - RNA, 22 nt, Human
aaagcaaugcccguucauuauc

SEQ ID NO: 538240 - RNA, 22 nt, Human
aaaauccugcugacucgagaug

SEQ ID NO: 538241 - RNA, 22 nt, Human
aaauuccagaaacucaguauau

SEQ ID NO: 538242 - RNA, 22 nt, Human
uucuuuucuuuaggcauugugu

SEQ ID NO: 538243 - RNA, 22 nt, Human
aggaagaacagauaauggacgc

SEQ ID NO: 538244 - RNA, 22 nt, Human
cucuggagaacgcuauggaucu

SEQ ID NO: 538245 - RNA, 22 nt, Human
ccacagggcacaagggagguug

SEQ ID NO: 538246 - RNA, 22 nt, Human
gagggguguggagccaucaguu

SEQ ID NO: 538247 - RNA, 22 nt, Human
augcaaauuaacauauaguaga

SEQ ID NO: 538248 - RNA, 22 nt, Human
uacagaggguaauugaucaagg

SEQ ID NO: 538249 - RNA, 22 nt, Human
uaagagaacuggauagauagga

SEQ ID NO: 538250 - RNA, 22 nt, Human
uucagcuugaaucuggcuuuga

SEQ ID NO: 538251 - RNA, 22 nt, Human
cugguggagggacaggcuuagc

SEQ ID NO: 538252 - RNA, 22 nt, Human
caggaacccaaugggccaggcc

SEQ ID NO: 538253 - RNA, 22 nt, Human
cugcuggggucagagcacuggg

SEQ ID NO: 538254 - RNA, 22 nt, Human
aagagagaguuccuaggcaaaa

SEQ ID NO: 538255 - RNA, 22 nt, Human
cagagacauccauguuaguugg

SEQ ID NO: 538256 - RNA, 22 nt, Human
uccuggcccuguggccugcagu

SEQ ID NO: 538257 - RNA, 22 nt, Human
uggcagaggagaauuaagauua

SEQ ID NO: 538258 - RNA, 22 nt, Human
cagggcuguuagcugcugcucu

SEQ ID NO: 538259 - RNA, 22 nt, Human
gaacagcccuguuaagucuguu

SEQ ID NO: 538260 - RNA, 22 nt, Human
ggcucaggccuguaauccuagc

SEQ ID NO: 538261 - RNA, 22 nt, Human
cuagggcacuaggacucaugug

SEQ ID NO: 538262 - RNA, 22 nt, Human
ggaggcaggaaagacagguuca

SEQ ID NO: 538263 - RNA, 22 nt, Human
uucaguauguguaaacuacuuu

SEQ ID NO: 538264 - RNA, 22 nt, Human
cugggcacacucugcuccagcu

SEQ ID NO: 538265 - RNA, 22 nt, Human
ugccucgugucugagucuguuc

SEQ ID NO: 538266 - RNA, 22 nt, Human
agaggcaacauggggaacagau

SEQ ID NO: 538267 - RNA, 22 nt, Human
ugugaaaucacaggcuauuuag

SEQ ID NO: 538268 - RNA, 22 nt, Human
cagcagaguuuggcuucuaaug

SEQ ID NO: 538269 - RNA, 22 nt, Human
auucauaacggcaaaugucacc

SEQ ID NO: 538270 - RNA, 22 nt, Human
gcucugagucucagcuaccaca

SEQ ID NO: 538271 - RNA, 22 nt, Human
cugaacucaugauaugcuuuug

SEQ ID NO: 538272 - RNA, 22 nt, Human
agaucauauuguaacuuuauug

SEQ ID NO: 538273 - RNA, 22 nt, Human
cuaaaaacucuacgaugcacag

SEQ ID NO: 538274 - RNA, 22 nt, Human
caggcucagaugcccugcgcug

SEQ ID NO: 538275 - RNA, 22 nt, Human
uaagcaggggucaaguguacaa

SEQ ID NO: 538276 - RNA, 22 nt, Human
ggaaugcacuagacugugaaac

SEQ ID NO: 538277 - RNA, 22 nt, Human
cagcuucucagaaagcugaggu

SEQ ID NO: 538278 - RNA, 22 nt, Human
aggagggcaggcuggcugccua

SEQ ID NO: 538279 - RNA, 22 nt, Human
gcugugugcucacguaguggaa

SEQ ID NO: 538280 - RNA, 20 nt, Human
agaggcuuccuugggaggag

SEQ ID NO: 538281 - RNA, 22 nt, Human
cccuggccuccaggcaguccug

SEQ ID NO: 538282 - RNA, 22 nt, Human
aauauuucuguagcuauguucu

SEQ ID NO: 538283 - RNA, 22 nt, Human
ucaaaggcgguccaggaauaaa

SEQ ID NO: 538284 - RNA, 21 nt, Human
ugguggagugugcugagcaug

SEQ ID NO: 538285 - RNA, 22 nt, Human
uggccaggcagguagaacggcc

SEQ ID NO: 538286 - RNA, 22 nt, Human
ugcacagcugccuccucucugc

SEQ ID NO: 538287 - RNA, 22 nt, Human
aaggcaggaugggaaaagauuu

SEQ ID NO: 538288 - RNA, 22 nt, Human
gcuggcuuccuucugcagcuag

SEQ ID NO: 538289 - RNA, 22 nt, Human
aucuuuagucaggcguggguau

SEQ ID NO: 538290 - RNA, 22 nt, Human
agcccugcgugccaggggacug

SEQ ID NO: 538291 - RNA, 22 nt, Human
acucugccaucccaggugcugu

SEQ ID NO: 538292 - RNA, 22 nt, Human
ggggugggcgugcagggacacc

SEQ ID NO: 538293 - RNA, 22 nt, Human
aaggugucggguuagcucagcc

SEQ ID NO: 538294 - RNA, 22 nt, Human
ccucaguguuaggauaagagaa

SEQ ID NO: 538295 - RNA, 22 nt, Human
cuuguucaguccugacuuccug

SEQ ID NO: 538296 - RNA, 22 nt, Human
ugcaggagaaaguacggagcgu

SEQ ID NO: 538297 - RNA, 22 nt, Human
ucugcaggacugaggccuguuu

SEQ ID NO: 538298 - RNA, 22 nt, Human
ucggagcgucacuggcuggagg

SEQ ID NO: 538299 - RNA, 22 nt, Human
agugaccaacaaugcugagaag

SEQ ID NO: 538300 - RNA, 22 nt, Human
ugggugcuucgucagcucugag

SEQ ID NO: 538301 - RNA, 22 nt, Human
caaggccaugagcagcgagugu

SEQ ID NO: 538302 - RNA, 22 nt, Human
ggccagaggugguacauagcuu

SEQ ID NO: 538303 - RNA, 22 nt, Human
uuuccaauaaagugucauuguu

SEQ ID NO: 538304 - RNA, 22 nt, Human
agggucagagaucggccaugug

SEQ ID NO: 538305 - RNA, 22 nt, Human
aagcuucuuuacaggagagauu

SEQ ID NO: 538306 - RNA, 20 nt, Human
gggcagccucgggagugggu

SEQ ID NO: 538307 - RNA, 22 nt, Human
uaaggccaaacuauuauaguuc

SEQ ID NO: 538308 - RNA, 22 nt, Human
cugagcccaggcgggagcugag

SEQ ID NO: 538309 - RNA, 22 nt, Human
uccuggauucugcccugaaggc

SEQ ID NO: 538310 - RNA, 22 nt, Human
ugcccugccaagacucaguggu

SEQ ID NO: 538311 - RNA, 22 nt, Human
ugaggaaguugaucucaucagu

SEQ ID NO: 538312 - RNA, 22 nt, Human
ccagcuccaggacugggagcug

SEQ ID NO: 538313 - RNA, 22 nt, Human
ggccacuccgcugcuacuggaa

SEQ ID NO: 538314 - RNA, 22 nt, Human
guuuacaugcagaaaaucaaug

SEQ ID NO: 538315 - RNA, 22 nt, Human
auguuuuaaauauguguguaaa

SEQ ID NO: 538316 - RNA, 22 nt, Human
guuauuaaaguauuugauguua

SEQ ID NO: 538317 - RNA, 22 nt, Human
cgggcacacacuugacagguuc

SEQ ID NO: 538318 - RNA, 22 nt, Human
cucugaacucuugggcagcaug

SEQ ID NO: 538319 - RNA, 22 nt, Human
aauacauaauaaguuuugucug

SEQ ID NO: 538320 - RNA, 22 nt, Human
uacuuuggauccuuacaauagc

SEQ ID NO: 538321 - RNA, 22 nt, Human
uucaggauuguguuuuuccuga

SEQ ID NO: 538322 - RNA, 22 nt, Human
ugaacuuucacaagaauaugcu

SEQ ID NO: 538323 - RNA, 22 nt, Human
uguccuguccuuccuggaaguc

SEQ ID NO: 538324 - RNA, 22 nt, Human
agggcugccauuucuggcccaa

SEQ ID NO: 538325 - RNA, 22 nt, Human
acugucaaaagagauuauauua

SEQ ID NO: 538326 - RNA, 22 nt, Human
uuacuuuagaaauagucaucaa

SEQ ID NO: 538327 - RNA, 22 nt, Human
ugaggcaggaguuaaugugcuc

SEQ ID NO: 538328 - RNA, 22 nt, Human
ugcagggcaguggagguugagu

SEQ ID NO: 538329 - RNA, 22 nt, Human
ccucugaggucauggacuuggc

SEQ ID NO: 538330 - RNA, 22 nt, Human
ugcuuccaguuccucaccacau

SEQ ID NO: 538331 - RNA, 22 nt, Human
gccaggcuggccagcaccuucu

SEQ ID NO: 538332 - RNA, 22 nt, Human
ggaggccauaguuugggaguca

SEQ ID NO: 538333 - RNA, 22 nt, Human
uuugagaagauguaauguuaag

SEQ ID NO: 538334 - RNA, 22 nt, Human
uucuccaaguagaagcuaaguu

SEQ ID NO: 538335 - RNA, 21 nt, Human
ucacauuucucauggguaaau

SEQ ID NO: 538336 - RNA, 22 nt, Human
agcagcagggacaaaggaacag

SEQ ID NO: 538337 - RNA, 22 nt, Human
gguuggggcgagcuggaggccc

SEQ ID NO: 538338 - RNA, 19 nt, Human
agcagagcccugaagaucc

SEQ ID NO: 538339 - RNA, 22 nt, Human
ugcuccugcugcaugcaucucc

SEQ ID NO: 538340 - RNA, 22 nt, Human
uggcccugacacgugguacugg

SEQ ID NO: 538341 - RNA, 17 nt, Human
gccugcaggcccgcaga

SEQ ID NO: 538342 - RNA, 22 nt, Human
gcagauggcucagacacugggg

SEQ ID NO: 538343 - RNA, 22 nt, Human
aaucuguucuacucuauucaga

SEQ ID NO: 538344 - RNA, 22 nt, Human
ugugaggaacccggaauguggg

SEQ ID NO: 538345 - RNA, 22 nt, Human
uucuugaaggggauauaaauag

SEQ ID NO: 538346 - RNA, 22 nt, Human
gcuggccacauugugccguccu

SEQ ID NO: 538347 - RNA, 22 nt, Human
uggcagcaauuagcuagagcug

SEQ ID NO: 538348 - RNA, 22 nt, Human
aucaggaagaagaauguguugg

SEQ ID NO: 538349 - RNA, 22 nt, Human
ucaggcacugcuuucugauaug

SEQ ID NO: 538350 - RNA, 21 nt, Human
ugcauaaagaaauacaaauac

SEQ ID NO: 538351 - RNA, 22 nt, Human
aucaaauaaagguaccuagcuu

SEQ ID NO: 538352 - RNA, 20 nt, Human
accaauguuagcuuaguacu

SEQ ID NO: 538353 - RNA, 22 nt, Human
agggcaugugggagaggagccu

SEQ ID NO: 538354 - RNA, 16 nt, Human
cagagaggacagaggc

SEQ ID NO: 538355 - RNA, 22 nt, Human
uuccaguuugcaguugacacua

SEQ ID NO: 538356 - RNA, 22 nt, Human
uaugaagcuuugaaaagcuuac

SEQ ID NO: 538357 - RNA, 22 nt, Human
uuuucauuuacauuagggaaga

SEQ ID NO: 538358 - RNA, 22 nt, Human
acucuucacacaugcugcccuc

SEQ ID NO: 538359 - RNA, 20 nt, Human
ugaagcagccuugauucugu

SEQ ID NO: 538360 - RNA, 19 nt, Human
cuguccuuggcugcacugu

SEQ ID NO: 538361 - RNA, 20 nt, Human
aaguuuucuccaaauacagu

SEQ ID NO: 538362 - RNA, 22 nt, Human
gcagaggcucuuuaaugcuuag

SEQ ID NO: 538363 - RNA, 22 nt, Human
ucuuccucucuaauugaucaga

SEQ ID NO: 538364 - RNA, 22 nt, Human
uuacauaaaaguucacguaggc

SEQ ID NO: 538365 - RNA, 23 nt, Human
aggcuuccuaucuuagagcuggg

SEQ ID NO: 538366 - RNA, 22 nt, Human
cugcuuuggcagaagucagcua

SEQ ID NO: 538367 - RNA, 22 nt, Human
gcaggggaguggcaggcccgga

SEQ ID NO: 538368 - RNA, 22 nt, Human
gaaaauguuagcuucauaguca

SEQ ID NO: 538369 - RNA, 22 nt, Human
aaaguuacacaucuaguaagug

SEQ ID NO: 538370 - RNA, 22 nt, Human
gaguccuucuggcuggcaggau

SEQ ID NO: 538371 - RNA, 22 nt, Human
ugggccuggacaaggccacuag

SEQ ID NO: 538372 - RNA, 22 nt, Human
aggcuguguggaugagucuuac

SEQ ID NO: 538373 - RNA, 17 nt, Human
gccaguugucuuggcau

SEQ ID NO: 538374 - RNA, 20 nt, Human
uccagggcuagggagcucau

SEQ ID NO: 538375 - RNA, 22 nt, Human
agucucuuuugcgaagaguguu

SEQ ID NO: 538376 - RNA, 22 nt, Human
ccaggcucuguuccccgaggag

SEQ ID NO: 538377 - RNA, 21 nt, Human
ucagaacaauuccaugccucc

SEQ ID NO: 538378 - RNA, 22 nt, Human
ugcaauauguugcauuguaugg

SEQ ID NO: 538379 - RNA, 22 nt, Human
acaaaugccauauauaaauucu

SEQ ID NO: 538380 - RNA, 22 nt, Human
acaggugguaaaauggacuguc

SEQ ID NO: 538381 - RNA, 22 nt, Human
ggcuggcaagucagugcugaug

SEQ ID NO: 538382 - RNA, 22 nt, Human
cucccuggaggugagcuggcac

SEQ ID NO: 538383 - RNA, 22 nt, Human
cuaccggguucucagccaggca

SEQ ID NO: 538384 - RNA, 22 nt, Human
ugggcucugaagucagucugcu

SEQ ID NO: 538385 - RNA, 22 nt, Human
agugaaaugauaguguaaauac

SEQ ID NO: 538386 - RNA, 22 nt, Human
cuuuccaacucuagugaaauuu

SEQ ID NO: 538387 - RNA, 22 nt, Human
aaguggacuaauacaaggacua

SEQ ID NO: 538388 - RNA, 22 nt, Human
agagugaaaagcuagagcagua

SEQ ID NO: 538389 - RNA, 22 nt, Human
gcugggagccguaccugucacg

SEQ ID NO: 538390 - RNA, 22 nt, Human
ugaggcagugcugggaagccug

SEQ ID NO: 538391 - RNA, 22 nt, Human
aggaagagcauucacaugguag

SEQ ID NO: 538392 - RNA, 22 nt, Human
caugcagugaugcacugcauca

SEQ ID NO: 538393 - RNA, 22 nt, Human
aaacauuuuucuucaucauccu

SEQ ID NO: 538394 - RNA, 22 nt, Human
uuuuuaaugcagucugagacau

SEQ ID NO: 538395 - RNA, 22 nt, Human
aauuucaccugcacuacaucgc

SEQ ID NO: 538396 - RNA, 22 nt, Human
uaaaaccauaaggcuggaagga

SEQ ID NO: 538397 - RNA, 22 nt, Human
gaggagaaauuauccuuggugu

SEQ ID NO: 538398 - RNA, 22 nt, Human
auacuuuggggguuaguguaga

SEQ ID NO: 538399 - RNA, 22 nt, Human
cccucaguuuuccagugugggc

SEQ ID NO: 538400 - RNA, 22 nt, Human
ccugagugccaugagagcaccc

SEQ ID NO: 538401 - RNA, 22 nt, Human
accaggcaugauguggagcaca

SEQ ID NO: 538402 - RNA, 22 nt, Human
ggcuuuaugcacagcagauggu

SEQ ID NO: 538403 - RNA, 22 nt, Human
gggagccacagugaggugcaug

SEQ ID NO: 538404 - RNA, 22 nt, Human
aguuuguaaccuaagauucagg

SEQ ID NO: 538405 - RNA, 22 nt, Human
cuucugcaggagucaacucugg

SEQ ID NO: 538406 - RNA, 22 nt, Human
gggccccuuguaucucuggcuc

SEQ ID NO: 538407 - RNA, 22 nt, Human
ugugcaguuucuauguugucca

SEQ ID NO: 538408 - RNA, 21 nt, Human
gucagcugugugugaggaccc

SEQ ID NO: 538409 - RNA, 22 nt, Human
acaaauguggacauggauaaug

SEQ ID NO: 538410 - RNA, 20 nt, Human
uucaaaguguaugauaugca

SEQ ID NO: 538411 - RNA, 22 nt, Human
agccaucauuucugucacuggc

SEQ ID NO: 538412 - RNA, 22 nt, Human
caccaggcugaaccagagggga

SEQ ID NO: 538413 - RNA, 22 nt, Human
uccuuggcuuucuggagcuucu

SEQ ID NO: 538414 - RNA, 22 nt, Human
acauuucuuuucaucucuauau

SEQ ID NO: 538415 - RNA, 22 nt, Human
agcagcuggggccugugacgau

SEQ ID NO: 538416 - RNA, 22 nt, Human
guggccugccagcagauggcgc

SEQ ID NO: 538417 - RNA, 22 nt, Human
agcugggcgcaguggcugguga

SEQ ID NO: 538418 - RNA, 22 nt, Human
agagcugggacuuggacucaau

SEQ ID NO: 538419 - RNA, 22 nt, Human
acagggucauuuuaugaucugu

SEQ ID NO: 538420 - RNA, 22 nt, Human
cuucagcugcaguuauguuuag

SEQ ID NO: 538421 - RNA, 22 nt, Human
guggccaggacauugccaggca

SEQ ID NO: 538422 - RNA, 22 nt, Human
acacaggggaaaguggagcuga

SEQ ID NO: 538423 - RNA, 22 nt, Human
cuucuguagccaguaacauaua

SEQ ID NO: 538424 - RNA, 22 nt, Human
ugacaccacaacuagccauuga

SEQ ID NO: 538425 - RNA, 22 nt, Human
acagagcugggugcccccugga

SEQ ID NO: 538426 - RNA, 22 nt, Human
gcuguggccuggcgcagagcug

SEQ ID NO: 538427 - RNA, 22 nt, Human
gaucuuuacuacugccuucucu

SEQ ID NO: 538428 - RNA, 22 nt, Human
gguccagggaacuuugaaggau

SEQ ID NO: 538429 - RNA, 20 nt, Human
cugagcccccagccugcagg

SEQ ID NO: 538430 - RNA, 19 nt, Human
ccagcagguucauuucagg

SEQ ID NO: 538431 - RNA, 22 nt, Human
uagaaacauauaggauggcagg

SEQ ID NO: 538432 - RNA, 22 nt, Human
cuuggccagacagggagcucca

SEQ ID NO: 538433 - RNA, 22 nt, Human
augccagacauuaacgacuaug

SEQ ID NO: 538434 - RNA, 22 nt, Human
gcugccugaucauacaccaggg

SEQ ID NO: 538435 - RNA, 22 nt, Human
gcagggcugcugaaacuuguuu

SEQ ID NO: 538436 - RNA, 22 nt, Human
gcucuggagauggagccuugag

SEQ ID NO: 538437 - RNA, 22 nt, Human
ucacagcuuucagauuguuccc

SEQ ID NO: 538438 - RNA, 22 nt, Human
aucuguggcgcaaacaaaggcu

SEQ ID NO: 538439 - RNA, 22 nt, Human
cacagacccagaagggaugaag

SEQ ID NO: 538440 - RNA, 22 nt, Human
caggcagcugcuggguucagcc

SEQ ID NO: 538441 - RNA, 22 nt, Human
cagcuggaggagcagcuuccag

SEQ ID NO: 538442 - RNA, 22 nt, Human
aacacuuuccugccuuucugau

SEQ ID NO: 538443 - RNA, 22 nt, Human
ucagguggcuucggggaguggc

SEQ ID NO: 538444 - RNA, 22 nt, Human
ucagggaaacagguuuucccuu

SEQ ID NO: 538445 - RNA, 22 nt, Human
aaugauuggcacuagauacaca

SEQ ID NO: 538446 - RNA, 22 nt, Human
caucuucagguucauggucaua

SEQ ID NO: 538447 - RNA, 23 nt, Human
agucuucauuguauuuccagacc

SEQ ID NO: 538448 - RNA, 22 nt, Human
ucucauucauacccuacaugcu

SEQ ID NO: 538449 - RNA, 22 nt, Human
ggguggaguagaaagaugaauu

SEQ ID NO: 538450 - RNA, 22 nt, Human
gagguggcuggcucagagccag

SEQ ID NO: 538451 - RNA, 21 nt, Human
ccaggcagagcugugaguucu

SEQ ID NO: 538452 - RNA, 22 nt, Human
uauucuuacucucgacugcauu

SEQ ID NO: 538453 - RNA, 22 nt, Human
uaacagaaauaguaggugaggg

SEQ ID NO: 538454 - RNA, 22 nt, Human
ucacugaauuucaagcuagugg

SEQ ID NO: 538455 - RNA, 19 nt, Human
cugggccugcaugguuguu

SEQ ID NO: 538456 - RNA, 22 nt, Human
gcagggacaucuucagaucacu

SEQ ID NO: 538457 - RNA, 22 nt, Human
aaauuuuaaggcuggaacuuaa

SEQ ID NO: 538458 - RNA, 23 nt, Human
gcugucugucaucucugcgggag

SEQ ID NO: 538459 - RNA, 23 nt, Human
agucucagcuggaaacauguguc

SEQ ID NO: 538460 - RNA, 22 nt, Human
gggcuggcucugucuagaaagg

SEQ ID NO: 538461 - RNA, 22 nt, Human
aaguguuaaaagauuaaaugcu

SEQ ID NO: 538462 - RNA, 22 nt, Human
uccugucugcucacagagcugg

SEQ ID NO: 538463 - RNA, 22 nt, Human
aggucaagaguaaauuugggua

SEQ ID NO: 538464 - RNA, 22 nt, Human
aggcaguuguagagagggcucu

SEQ ID NO: 538465 - RNA, 22 nt, Human
gucauugcaguggcaaaucaca

SEQ ID NO: 538466 - RNA, 22 nt, Human
aggggagccagggcugcgaguu

SEQ ID NO: 538467 - RNA, 20 nt, Human
agcccaggccugugugaguc

SEQ ID NO: 538468 - RNA, 22 nt, Human
ugggcucucaaagugcggcuug

SEQ ID NO: 538469 - RNA, 22 nt, Human
ccagagucaggagcucauguga

SEQ ID NO: 538470 - RNA, 22 nt, Human
ugacacaggcagcucccagcac

SEQ ID NO: 538471 - RNA, 23 nt, Human
uacauuguggauggaguccuggg

SEQ ID NO: 538472 - RNA, 21 nt, Human
gcacagggacagaucaucaca

SEQ ID NO: 538473 - RNA, 22 nt, Human
gcagagugaagcaguauggaaa

SEQ ID NO: 538474 - RNA, 22 nt, Human
ugcuuucaugaagucuauagag

SEQ ID NO: 538475 - RNA, 22 nt, Human
uucuguauguacauauguguau

SEQ ID NO: 538476 - RNA, 22 nt, Human
aauguuuggacuggaagguccc

SEQ ID NO: 538477 - RNA, 20 nt, Human
cagaaagaagguagauuuuu

SEQ ID NO: 538478 - RNA, 22 nt, Human
gcagaggauagcauaugaaccu

SEQ ID NO: 538479 - RNA, 22 nt, Human
uuacaaacugucauauaguauu

SEQ ID NO: 538480 - RNA, 22 nt, Human
auuguaaaguacuguguacaau

SEQ ID NO: 538481 - RNA, 22 nt, Human
agaaaucagaacccugaaguuc

SEQ ID NO: 538482 - RNA, 22 nt, Human
uggccucucuaccaggcagccu

SEQ ID NO: 538483 - RNA, 22 nt, Human
aaucuuuaaggacucagucucu

SEQ ID NO: 538484 - RNA, 22 nt, Human
agagccagguguagucucggag

SEQ ID NO: 538485 - RNA, 22 nt, Human
gucaggaugggcagccaaacua

SEQ ID NO: 538486 - RNA, 22 nt, Human
agcacagggcccagccuaggcc

SEQ ID NO: 538487 - RNA, 22 nt, Human
ucacaugcucaccuaagccaca

SEQ ID NO: 538488 - RNA, 22 nt, Human
ugcaagagacagacaugacuca

SEQ ID NO: 538489 - RNA, 22 nt, Human
uguaaacagccccauggagagc

SEQ ID NO: 538490 - RNA, 22 nt, Human
agcaguuaugugucucuugacu

SEQ ID NO: 538491 - RNA, 22 nt, Human
gccuaauaacuagcuguguaac

SEQ ID NO: 538492 - RNA, 22 nt, Human
uccucccugcacucagugaagu

SEQ ID NO: 538493 - RNA, 22 nt, Human
uccucaggucaaagcaggagaa

SEQ ID NO: 538494 - RNA, 20 nt, Human
cagagacccaggcuucagcu

SEQ ID NO: 538495 - RNA, 22 nt, Human
aaaauugucgaacaguaguaac

SEQ ID NO: 538496 - RNA, 22 nt, Human
ucuccaagcagggcugcaaggc

SEQ ID NO: 538497 - RNA, 22 nt, Human
ugcaucaaccuaauaucagcuc

SEQ ID NO: 538498 - RNA, 22 nt, Human
aaggccaggagacuuggaguca

SEQ ID NO: 538499 - RNA, 22 nt, Human
aggccuguuucuuguccagcuc

SEQ ID NO: 538500 - RNA, 22 nt, Human
agcaggagaacacuguggcucu

SEQ ID NO: 538501 - RNA, 20 nt, Human
ugcuugucaugcacucaggc

SEQ ID NO: 538502 - RNA, 22 nt, Human
cccuggaggucagaggccuggg

SEQ ID NO: 538503 - RNA, 22 nt, Human
cccagcuccgagcuccgagccg

SEQ ID NO: 538504 - RNA, 18 nt, Human
ccauuucaugauuauuac

SEQ ID NO: 538505 - RNA, 22 nt, Human
uucaauuugugcuaaggcaccg

SEQ ID NO: 538506 - RNA, 22 nt, Human
gccuggagagcacugugcgcuu

SEQ ID NO: 538507 - RNA, 22 nt, Human
ucagaagcaaacaucacucuag

SEQ ID NO: 538508 - RNA, 22 nt, Human
uauguagaagcugcucaaagaa

SEQ ID NO: 538509 - RNA, 22 nt, Human
aaaugcacagaggccagagagg

SEQ ID NO: 538510 - RNA, 22 nt, Human
uacagaaaaacuggcauugaag

SEQ ID NO: 538511 - RNA, 22 nt, Human
caguccuggggaccaggcugag

SEQ ID NO: 538512 - RNA, 22 nt, Human
gagaaacaggaauugagucgcu

SEQ ID NO: 538513 - RNA, 22 nt, Human
cucuggaguggguggccgggag

SEQ ID NO: 538514 - RNA, 22 nt, Human
agccuggcacugaggcagggcg

SEQ ID NO: 538515 - RNA, 22 nt, Human
gggcucagggacacaugugugu

SEQ ID NO: 538516 - RNA, 22 nt, Human
cauggcagugauucagccuuug

SEQ ID NO: 538517 - RNA, 19 nt, Human
cucuuacagaauagacaca

SEQ ID NO: 538518 - RNA, 23 nt, Human
ccucccaccuauuucacuuucuu

SEQ ID NO: 538519 - RNA, 22 nt, Human
ugcauuugucuugucucaugaa

SEQ ID NO: 538520 - RNA, 19 nt, Human
ugggcuuccccagggcaga

SEQ ID NO: 538521 - RNA, 22 nt, Human
agccacagucugaugccugaga

SEQ ID NO: 538522 - RNA, 22 nt, Human
uaaauaugcauguauccuuauc

SEQ ID NO: 538523 - RNA, 22 nt, Human
ucuccucaccaccagcagcaga

SEQ ID NO: 538524 - RNA, 22 nt, Human
caggaagagaacauggaggcug

SEQ ID NO: 538525 - RNA, 22 nt, Human
cauucucaauaguagaugagua

SEQ ID NO: 538526 - RNA, 22 nt, Human
agaaauguuacaguuguuauuu

SEQ ID NO: 538527 - RNA, 22 nt, Human
gggcacagucugcagcccccca

SEQ ID NO: 538528 - RNA, 22 nt, Human
caucuuaaaaugugucauaacu

SEQ ID NO: 538529 - RNA, 22 nt, Human
aaugccaguguguugauuccag

SEQ ID NO: 538530 - RNA, 22 nt, Human
ggcaguggguggaucucaggga

SEQ ID NO: 538531 - RNA, 22 nt, Human
caccugagugucaguauucuca

SEQ ID NO: 538532 - RNA, 22 nt, Human
aggcccagagcaggaaaggguu

SEQ ID NO: 538533 - RNA, 22 nt, Human
ccagauggugccugucagaagg

SEQ ID NO: 538534 - RNA, 22 nt, Human
aauuagggagccaucauaaggu

SEQ ID NO: 538535 - RNA, 22 nt, Human
aaauguguuccuuugcuacaga

SEQ ID NO: 538536 - RNA, 22 nt, Human
ggugaggaauuggggacugacc

SEQ ID NO: 538537 - RNA, 22 nt, Human
ggcaggugaccuggccucccag

SEQ ID NO: 538538 - RNA, 16 nt, Human
aggcagagauuuaccc

SEQ ID NO: 538539 - RNA, 22 nt, Human
aaacuuuuuuagguucauaggc

SEQ ID NO: 538540 - RNA, 22 nt, Human
acagaaauuagcagugaguuua

SEQ ID NO: 538541 - RNA, 22 nt, Human
acuguucaaguuuuaugcugga

SEQ ID NO: 538542 - RNA, 22 nt, Human
uaaagugucugccucagcucag

SEQ ID NO: 538543 - RNA, 22 nt, Human
uaugagaaaggagaaugacuuu

SEQ ID NO: 538544 - RNA, 22 nt, Human
uuuauucugugcuacaugaaga

SEQ ID NO: 538545 - RNA, 22 nt, Human
uuuucuaaaauauccaggacag

SEQ ID NO: 538546 - RNA, 22 nt, Human
cuguuuuaauggagacugaugu

SEQ ID NO: 538547 - RNA, 22 nt, Human
ucuguaaucagaguagcagaua

SEQ ID NO: 538548 - RNA, 22 nt, Human
ccaggcuccgcauagaccccac

SEQ ID NO: 538549 - RNA, 22 nt, Human
caauacuauucggaccaucucu

SEQ ID NO: 538550 - RNA, 20 nt, Human
ggcagcucacuacuuucugu

SEQ ID NO: 538551 - RNA, 22 nt, Human
uuucagaaaacuuaucaucagu

SEQ ID NO: 538552 - RNA, 22 nt, Human
ccugaggcccuggcugugcuga

SEQ ID NO: 538553 - RNA, 22 nt, Human
gcccaugcacuuucugugaugg

SEQ ID NO: 538554 - RNA, 22 nt, Human
aauuagggaggacaaagguaca

SEQ ID NO: 538555 - RNA, 22 nt, Human
caggaagauuagaccaagagcu

SEQ ID NO: 538556 - RNA, 22 nt, Human
ugauacagucagcucacaauug

SEQ ID NO: 538557 - RNA, 22 nt, Human
cuauuuguacagcauuaguaau

SEQ ID NO: 538558 - RNA, 22 nt, Human
gcuggagcugcagccugggccu

SEQ ID NO: 538559 - RNA, 22 nt, Human
aaaucagacacagugaaaguua

SEQ ID NO: 538560 - RNA, 22 nt, Human
uuuuauguaauccuuacugucg

SEQ ID NO: 538561 - RNA, 22 nt, Human
uagggcucagcucuagcuccug

SEQ ID NO: 538562 - RNA, 22 nt, Human
cugugggccuagucuggccuag

SEQ ID NO: 538563 - RNA, 22 nt, Human
cuggcaggcggcagagcccagg

SEQ ID NO: 538564 - RNA, 22 nt, Human
ugcugggggugucucaccaggc

SEQ ID NO: 538565 - RNA, 22 nt, Human
cagaacagacuuaacagggcug

SEQ ID NO: 538566 - RNA, 22 nt, Human
ggccugaggcaauagucagaca

SEQ ID NO: 538567 - RNA, 22 nt, Human
gaaaggaaauauucuaagcacu

SEQ ID NO: 538568 - RNA, 22 nt, Human
uuggaacauccaggacagauau

SEQ ID NO: 538569 - RNA, 22 nt, Human
agaggcacaaacuggaaaggac

SEQ ID NO: 538570 - RNA, 22 nt, Human
gccugagacagugugguccaau

SEQ ID NO: 538571 - RNA, 22 nt, Human
gccauuaaugugaaggaaggaa

SEQ ID NO: 538572 - RNA, 22 nt, Human
uuagauaauguagagauaugag

SEQ ID NO: 538573 - RNA, 22 nt, Human
caggcugagcucuggccugggc

SEQ ID NO: 538574 - RNA, 22 nt, Human
ccuugcugaccaucaccuuuga

SEQ ID NO: 538575 - RNA, 22 nt, Human
aaaugucuaucuggcauauucc

SEQ ID NO: 538576 - RNA, 22 nt, Human
ccagugacuggcuuucuggugu

SEQ ID NO: 538577 - RNA, 22 nt, Human
ugucaaagccugaaucacauag

SEQ ID NO: 538578 - RNA, 22 nt, Human
ucaguuuugaaaacauugaaug

SEQ ID NO: 538579 - RNA, 22 nt, Human
ugaaacacuuucaauuacauau

SEQ ID NO: 538580 - RNA, 22 nt, Human
ccagagcugcauccagcagguu

SEQ ID NO: 538581 - RNA, 22 nt, Human
uuguaauuugcaaauguauugu

SEQ ID NO: 538582 - RNA, 22 nt, Human
agagucugccuuuuucuccugc

SEQ ID NO: 538583 - RNA, 22 nt, Human
ugcagggcuacaggacuacaac

SEQ ID NO: 538584 - RNA, 18 nt, Human
gcuuuuuagugcaucuuc

SEQ ID NO: 538585 - RNA, 22 nt, Human
auuucucacugagcagauaaaa

SEQ ID NO: 538586 - RNA, 22 nt, Human
ccagcuggaacggcagcccagc

SEQ ID NO: 538587 - RNA, 22 nt, Human
ccugcaggcugcaggccaguuc

SEQ ID NO: 538588 - RNA, 22 nt, Human
agccagggugggugaaugcuau

SEQ ID NO: 538589 - RNA, 22 nt, Human
uggcuuccgccgcgggccucgg

SEQ ID NO: 538590 - RNA, 22 nt, Human
ucugaggcuaagagacagaggc

SEQ ID NO: 538591 - RNA, 22 nt, Human
uaggaaaagcacaggauguucu

SEQ ID NO: 538592 - RNA, 22 nt, Human
ucagauauucaauuaaguuaaa

SEQ ID NO: 538593 - RNA, 22 nt, Human
uguguuccugccuggcucuggu

SEQ ID NO: 538594 - RNA, 20 nt, Human
acagaaagagagaaugucag

SEQ ID NO: 538595 - RNA, 22 nt, Human
aggcucagccugggccuagagc

SEQ ID NO: 538596 - RNA, 22 nt, Human
uacccaggaggaaacugaggcu

SEQ ID NO: 538597 - RNA, 21 nt, Human
ccugcagcaccagaaggagau

SEQ ID NO: 538598 - RNA, 22 nt, Human
uaucuuuaacuugcaguauuua

SEQ ID NO: 538599 - RNA, 22 nt, Human
cauauucuguuggucacauaga

SEQ ID NO: 538600 - RNA, 22 nt, Human
aacuccaggcagggaggccacu

SEQ ID NO: 538601 - RNA, 22 nt, Human
aaggcugagacagcacaggucc

SEQ ID NO: 538602 - RNA, 22 nt, Human
cugccuggggaaugugaggauu

SEQ ID NO: 538603 - RNA, 23 nt, Human
ucuuuccucagcacacaccaaga

SEQ ID NO: 538604 - RNA, 22 nt, Human
ggcuuccuaauacucccuacac

SEQ ID NO: 538605 - RNA, 19 nt, Human
aggaaaggaucaaaauagc

SEQ ID NO: 538606 - RNA, 22 nt, Human
gauuucuuugcaagcuguguuc

SEQ ID NO: 538607 - RNA, 19 nt, Human
ggcugcugguuacagaggc

SEQ ID NO: 538608 - RNA, 22 nt, Human
gagcugcaugcggaaaccuguu

SEQ ID NO: 538609 - RNA, 22 nt, Human
cuguacagaguucugaguguac

SEQ ID NO: 538610 - RNA, 22 nt, Human
ucuguuccauguuuuguuccau

SEQ ID NO: 538611 - RNA, 22 nt, Human
uccagcucuaacaugcugggcc

SEQ ID NO: 538612 - RNA, 20 nt, Human
gucucagaauggauuugcau

SEQ ID NO: 538613 - RNA, 22 nt, Human
ggcacacauagaucugcacugg

SEQ ID NO: 538614 - RNA, 22 nt, Human
cuguaaaacugcuuaaguaugc

SEQ ID NO: 538615 - RNA, 22 nt, Human
cauuagggccaccauaacaaaa

SEQ ID NO: 538616 - RNA, 22 nt, Human
ucacaccuguaaucccaggccu

SEQ ID NO: 538617 - RNA, 22 nt, Human
ucuggccaacaaaaacuaaguc

SEQ ID NO: 538618 - RNA, 22 nt, Human
ugaagcaggaaccagcagcauu

SEQ ID NO: 538619 - RNA, 22 nt, Human
uucuguaucucuguguuucuug

SEQ ID NO: 538620 - RNA, 22 nt, Human
gagcugagaucgugccauugca

SEQ ID NO: 538621 - RNA, 22 nt, Human
gucccauaaguagugcaacuug

SEQ ID NO: 538622 - RNA, 22 nt, Human
uauucacaguugauuuacaguu

SEQ ID NO: 538623 - RNA, 22 nt, Human
acagucucuccacacugcaggg

SEQ ID NO: 538624 - RNA, 22 nt, Human
acauuuuacaguugucuggcua

SEQ ID NO: 538625 - RNA, 22 nt, Human
aauguucugauguaggguuuag

SEQ ID NO: 538626 - RNA, 22 nt, Human
cuuaauuuuuguaguagaugga

SEQ ID NO: 538627 - RNA, 22 nt, Human
caaaugcagauucaggaguucu

SEQ ID NO: 538628 - RNA, 22 nt, Human
aauacaagauuuauaguuguuu

SEQ ID NO: 538629 - RNA, 21 nt, Human
gccuggcagguggaagggcuc

SEQ ID NO: 538630 - RNA, 22 nt, Human
ucucauguauugcccuggugug

SEQ ID NO: 538631 - RNA, 22 nt, Human
gcagagcagagccugcauuggc

SEQ ID NO: 538632 - RNA, 22 nt, Human
uuuaacagaugugaaauuuuca

SEQ ID NO: 538633 - RNA, 22 nt, Human
gaggcagagugcaccccaggag

SEQ ID NO: 538634 - RNA, 19 nt, Human
caggccagugucagggggc

SEQ ID NO: 538635 - RNA, 20 nt, Human
ucccaaggaugccugggugu

SEQ ID NO: 538636 - RNA, 22 nt, Human
uagugcaacagggaaagagugu

SEQ ID NO: 538637 - RNA, 22 nt, Human
agagcugggugaagugccauca

SEQ ID NO: 538638 - RNA, 22 nt, Human
ggcugagcucaggggcagcagg

SEQ ID NO: 538639 - RNA, 22 nt, Human
agaggcuguuacacucccagau

SEQ ID NO: 538640 - RNA, 22 nt, Human
ugguccugaggcuuguuuccac

SEQ ID NO: 538641 - RNA, 22 nt, Human
aggacagagggaccagagccca

SEQ ID NO: 538642 - RNA, 22 nt, Human
uuccagaauagauggagcucua

SEQ ID NO: 538643 - RNA, 22 nt, Human
cugggaggcacuauucaggagg

SEQ ID NO: 538644 - RNA, 22 nt, Human
aaggagugcaugacucagagua

SEQ ID NO: 538645 - RNA, 22 nt, Human
cccagcaggucggugcugccug

SEQ ID NO: 538646 - RNA, 22 nt, Human
aaugucuuuuaaauguugaggu

SEQ ID NO: 538647 - RNA, 18 nt, Human
cagggccccagaauuauc

SEQ ID NO: 538648 - RNA, 23 nt, Human
gcugagguacauuuacaggaaga

SEQ ID NO: 538649 - RNA, 22 nt, Human
gggcaugagagggcagcuggca

SEQ ID NO: 538650 - RNA, 22 nt, Human
gccucuccgagccacugccucu

SEQ ID NO: 538651 - RNA, 22 nt, Human
ucauuaaaaugcagauucugac

SEQ ID NO: 538652 - RNA, 22 nt, Human
aggcugugggaguugagagucu

SEQ ID NO: 538653 - RNA, 22 nt, Human
cccaggcagccugcagggaagg

SEQ ID NO: 538654 - RNA, 22 nt, Human
acaguggaaagaaacgaauuag

SEQ ID NO: 538655 - RNA, 22 nt, Human
gaggcagcaugguaccuuggag

SEQ ID NO: 538656 - RNA, 22 nt, Human
gagaauuagggcguaauucaga

SEQ ID NO: 538657 - RNA, 22 nt, Human
gugagcagaacagguggcuucu

SEQ ID NO: 538658 - RNA, 22 nt, Human
gaugaagccugacuucucggug

SEQ ID NO: 538659 - RNA, 22 nt, Human
ccuuuacaguaugguuguauca

SEQ ID NO: 538660 - RNA, 22 nt, Human
agggaccucauguaaguggauu

SEQ ID NO: 538661 - RNA, 22 nt, Human
ugcauaaacuucucugguguga

SEQ ID NO: 538662 - RNA, 22 nt, Human
gcauagcuuugaugcugccuua

SEQ ID NO: 538663 - RNA, 22 nt, Human
acaaccuucuggagauaucugu

SEQ ID NO: 538664 - RNA, 22 nt, Human
gaggggcagaaugugaucaggg

SEQ ID NO: 538665 - RNA, 22 nt, Human
aucaaagagugagauuuuuacu

SEQ ID NO: 538666 - RNA, 22 nt, Human
cuggggaccgagcaagcucugg

SEQ ID NO: 538667 - RNA, 22 nt, Human
gcaucuuucuguccauucagca

SEQ ID NO: 538668 - RNA, 22 nt, Human
gcugugggacagguccagccag

SEQ ID NO: 538669 - RNA, 22 nt, Human
aaauuacagaucaccaaugcau

SEQ ID NO: 538670 - RNA, 22 nt, Human
uauuccaaaaucccaaacugcc

SEQ ID NO: 538671 - RNA, 22 nt, Human
augugucaauuuucaaaugcuu

SEQ ID NO: 538672 - RNA, 21 nt, Human
uucuucaggccaaugcucauu

SEQ ID NO: 538673 - RNA, 22 nt, Human
aagcuggcaauuaucaaaacug

SEQ ID NO: 538674 - RNA, 22 nt, Human
acugccugagcuauuggaaaag

SEQ ID NO: 538675 - RNA, 22 nt, Human
uaacaguauauuuaccaaaccu

SEQ ID NO: 538676 - RNA, 22 nt, Human
gggccaguucuccgccucuuuu

SEQ ID NO: 538677 - RNA, 22 nt, Human
auucacaguucauuagcuguaa

SEQ ID NO: 538678 - RNA, 15 nt, Human
cacacagacagcuug

SEQ ID NO: 538679 - RNA, 22 nt, Human
aaaagaggagugguuuaugaca

SEQ ID NO: 538680 - RNA, 22 nt, Human
uuuuucuuaaauguggguuggc

SEQ ID NO: 538681 - RNA, 22 nt, Human
ugucauuuugucucacugcuau

SEQ ID NO: 538682 - RNA, 22 nt, Human
gagagugucgggggccccagga

SEQ ID NO: 538683 - RNA, 22 nt, Human
acagucuuucaguaauaauacu

SEQ ID NO: 538684 - RNA, 22 nt, Human
aggcugugacagggucauggag

SEQ ID NO: 538685 - RNA, 22 nt, Human
ucauuuguuuagguagcaccau

SEQ ID NO: 538686 - RNA, 22 nt, Human
caagcuggaguuccucagagug

SEQ ID NO: 538687 - RNA, 22 nt, Human
aggugacaucccggcagcagag

SEQ ID NO: 538688 - RNA, 22 nt, Human
gcccucagaggacagcugacuu

SEQ ID NO: 538689 - RNA, 22 nt, Human
ugugaaauauuuauauacucaa

SEQ ID NO: 538690 - RNA, 22 nt, Human
agucccagcucugccacuuacu

SEQ ID NO: 538691 - RNA, 22 nt, Human
ggguggcacaggugcagagggu

SEQ ID NO: 538692 - RNA, 18 nt, Human
agcaaagcaagagaucac

SEQ ID NO: 538693 - RNA, 22 nt, Human
aagcagaauuuaauagaaaggu

SEQ ID NO: 538694 - RNA, 23 nt, Human
ucuuuagaagaacaucagaaaug

SEQ ID NO: 538695 - RNA, 22 nt, Human
cagcagaguauggcacucaacu

SEQ ID NO: 538696 - RNA, 22 nt, Human
guuacaaaggucauaaaagugu

SEQ ID NO: 538697 - RNA, 18 nt, Human
ucuggaacaacuucaugu

SEQ ID NO: 538698 - RNA, 22 nt, Human
uuuacagaucuguugauuuguu

SEQ ID NO: 538699 - RNA, 22 nt, Human
ggagauuuauagcacacuucag

SEQ ID NO: 538700 - RNA, 20 nt, Human
ucugugugccaucaccuaac

SEQ ID NO: 538701 - RNA, 23 nt, Human
cagugccauuugucuugccuaug

SEQ ID NO: 538702 - RNA, 22 nt, Human
caggggcucugagauugucuaa

SEQ ID NO: 538703 - RNA, 22 nt, Human
caauucuuuguagaagcucucc

SEQ ID NO: 538704 - RNA, 22 nt, Human
uguugauuaguguuuagacuua

SEQ ID NO: 538705 - RNA, 22 nt, Human
aucaggauguuuggcugucaua

SEQ ID NO: 538706 - RNA, 22 nt, Human
agcucccagaguccucugccca

SEQ ID NO: 538707 - RNA, 22 nt, Human
aacuuuacacugcuuuacauga

SEQ ID NO: 538708 - RNA, 22 nt, Human
gccaggcauguccucugcagaa

SEQ ID NO: 538709 - RNA, 23 nt, Human
cauuucugggagauuuauaaaau

SEQ ID NO: 538710 - RNA, 22 nt, Human
aaaaaugugaccacaggguguu

SEQ ID NO: 538711 - RNA, 22 nt, Human
ugggccuucucaaugcacugga

SEQ ID NO: 538712 - RNA, 22 nt, Human
aggugccaauuuucagugaaca

SEQ ID NO: 538713 - RNA, 22 nt, Human
ugcaagaggcaucuuuuaaaaa

SEQ ID NO: 538714 - RNA, 22 nt, Human
uggacaggugagugacucaggg

SEQ ID NO: 538715 - RNA, 22 nt, Human
ucugccucgcuaacagcagcca

SEQ ID NO: 538716 - RNA, 22 nt, Human
ugaaacaagauccacagacuug

SEQ ID NO: 538717 - RNA, 22 nt, Human
caaaugcuaacuucuuuccaaa

SEQ ID NO: 538718 - RNA, 22 nt, Human
gagccuggagcuggaacgaagc

SEQ ID NO: 538719 - RNA, 22 nt, Human
cuguucauggaaaaauaguugg

SEQ ID NO: 538720 - RNA, 20 nt, Human
agugucuggugcagggccuc

SEQ ID NO: 538721 - RNA, 22 nt, Human
aguauuacccucagaacuugau

SEQ ID NO: 538722 - RNA, 22 nt, Human
gcaagaaaagagccuucagugg

SEQ ID NO: 538723 - RNA, 20 nt, Human
auguaaaagacagggaguag

SEQ ID NO: 538724 - RNA, 22 nt, Human
ugcuuugacagggaugacauga

SEQ ID NO: 538725 - RNA, 22 nt, Human
uccugggaguggccauguaaug

SEQ ID NO: 538726 - RNA, 22 nt, Human
cucaggauccaucuccugcccu

SEQ ID NO: 538727 - RNA, 22 nt, Human
aaucuuagaguguuuuugaagc

SEQ ID NO: 538728 - RNA, 22 nt, Human
cccuaggaauucuauggccaag

SEQ ID NO: 538729 - RNA, 22 nt, Human
uaaagauugcucaaaacuguga

SEQ ID NO: 538730 - RNA, 22 nt, Human
ucauacaacuaagaguuucaga

SEQ ID NO: 538731 - RNA, 21 nt, Human
agcugcuccagggagcucagg

SEQ ID NO: 538732 - RNA, 22 nt, Human
ugcaaagaagcaacauccuugu

SEQ ID NO: 538733 - RNA, 22 nt, Human
uucagcagugcagacacccagu

SEQ ID NO: 538734 - RNA, 22 nt, Human
aauuagagaagcuucuuccauu

SEQ ID NO: 538735 - RNA, 22 nt, Human
agccaguguuaagugacugguu

SEQ ID NO: 538736 - RNA, 22 nt, Human
uccucagacacccugcuggcuu

SEQ ID NO: 538737 - RNA, 21 nt, Human
uuuuaacaaggauuucccuag

SEQ ID NO: 538738 - RNA, 21 nt, Human
agagcugggacuugccugaga

SEQ ID NO: 538739 - RNA, 22 nt, Human
aguaugaauugcuuugccugua

SEQ ID NO: 538740 - RNA, 22 nt, Human
aaguuugagaagcuuauagaua

SEQ ID NO: 538741 - RNA, 22 nt, Human
auuuauuaagcaucugcuaugu

SEQ ID NO: 538742 - RNA, 22 nt, Human
caacauauuuuccaagagugaa

SEQ ID NO: 538743 - RNA, 22 nt, Human
gugugcagucugcuaggcaggg

SEQ ID NO: 538744 - RNA, 22 nt, Human
gagggucccgagcccugucaga

SEQ ID NO: 538745 - RNA, 17 nt, Human
ugaggcucggugaggag

SEQ ID NO: 538746 - RNA, 22 nt, Human
ccucagagccuccagaaggaau

SEQ ID NO: 538747 - RNA, 22 nt, Human
caggugcuguccugcacauguc

SEQ ID NO: 538748 - RNA, 22 nt, Human
gggcguggauggucagugcagg

SEQ ID NO: 538749 - RNA, 22 nt, Human
cugagcagcacagggcgccagg

SEQ ID NO: 538750 - RNA, 22 nt, Human
uuucaagcauaacugggaagag

SEQ ID NO: 538751 - RNA, 22 nt, Human
ggcauccaaauaccaagaugua

SEQ ID NO: 538752 - RNA, 22 nt, Human
aaucucaugagcuucuuguccc

SEQ ID NO: 538753 - RNA, 22 nt, Human
cauucauuuacuuucaacagcu

SEQ ID NO: 538754 - RNA, 22 nt, Human
ugaggggcggccugcagaggcc

SEQ ID NO: 538755 - RNA, 22 nt, Human
aggcucugcagaccccagcugu

SEQ ID NO: 538756 - RNA, 22 nt, Human
uguaccuuuuucugugcaugcu

SEQ ID NO: 538757 - RNA, 20 nt, Human
caaauucuguugaauacacc

SEQ ID NO: 538758 - RNA, 22 nt, Human
cagcagagacgguaagcagaac

SEQ ID NO: 538759 - RNA, 23 nt, Human
ggugggagauuauccagaauuau

SEQ ID NO: 538760 - RNA, 22 nt, Human
aaaggagaaaacauacaggacu

SEQ ID NO: 538761 - RNA, 22 nt, Human
gcagggccagugcagagaggaa

SEQ ID NO: 538762 - RNA, 22 nt, Human
caguuuauaugucagagcugua

SEQ ID NO: 538763 - RNA, 22 nt, Human
ccugcuuaacauugccaugaca

SEQ ID NO: 538764 - RNA, 22 nt, Human
aggagagggguaggauuaauuu

SEQ ID NO: 538765 - RNA, 22 nt, Human
caagaugaucccugaaggcagc

SEQ ID NO: 538766 - RNA, 22 nt, Human
ccaaggcaacguuggugucagg

SEQ ID NO: 538767 - RNA, 22 nt, Human
accugagccuagggagguugag

SEQ ID NO: 538768 - RNA, 22 nt, Human
uguaaacaaaugcauucuugcu

SEQ ID NO: 538769 - RNA, 18 nt, Human
uggcaggaaaugcacuuu

SEQ ID NO: 538770 - RNA, 22 nt, Human
gaagggugugugugagggacac

SEQ ID NO: 538771 - RNA, 22 nt, Human
ggcucagggaaugaggaagaau

SEQ ID NO: 538772 - RNA, 22 nt, Human
gaaggccauuuuuagguagaau

SEQ ID NO: 538773 - RNA, 22 nt, Human
cuuauucuacuccacaagcucu

SEQ ID NO: 538774 - RNA, 22 nt, Human
aggaggaacucagaaagaaggu

SEQ ID NO: 538775 - RNA, 22 nt, Human
aauuccugucuuaacaguucug

SEQ ID NO: 538776 - RNA, 22 nt, Human
caggagcugggucuggaagcag

SEQ ID NO: 538777 - RNA, 22 nt, Human
aguguacauguacacauuagua

SEQ ID NO: 538778 - RNA, 20 nt, Human
gggguuggcuggcacaggga

SEQ ID NO: 538779 - RNA, 22 nt, Human
gagugggcaccgugggcacacu

SEQ ID NO: 538780 - RNA, 22 nt, Human
ugucuuccucuuggcuugagcu

SEQ ID NO: 538781 - RNA, 22 nt, Human
auuuaucaccaguuagcugacu

SEQ ID NO: 538782 - RNA, 22 nt, Human
ccucacuuuccuuucuccuggg

SEQ ID NO: 538783 - RNA, 22 nt, Human
gauuuuauagucaggaaaaaga

SEQ ID NO: 538784 - RNA, 22 nt, Human
cuugagagccacuccuggggcc

SEQ ID NO: 538785 - RNA, 22 nt, Human
aucagcuagauaagucaagcaa

SEQ ID NO: 538786 - RNA, 22 nt, Human
uucaacauaugaauuuugggug

SEQ ID NO: 538787 - RNA, 22 nt, Human
gcucccacaaccuucuugcucc

SEQ ID NO: 538788 - RNA, 22 nt, Human
gccuggaguggacuuggccccu

SEQ ID NO: 538789 - RNA, 22 nt, Human
aacuauucuguggacucuuaua

SEQ ID NO: 538790 - RNA, 22 nt, Human
cacaguacccagcacuacugag

SEQ ID NO: 538791 - RNA, 22 nt, Human
caggagcaaggagcagugggau

SEQ ID NO: 538792 - RNA, 22 nt, Human
aauaagacucugcuagaaauuc

SEQ ID NO: 538793 - RNA, 22 nt, Human
ucauuuguugaacuuuagugcg

SEQ ID NO: 538794 - RNA, 22 nt, Human
cacagcuucuccccgcugcggc

SEQ ID NO: 538795 - RNA, 22 nt, Human
auuucuguaacuuaugaaaguu

SEQ ID NO: 538796 - RNA, 22 nt, Human
cuggcuuucucugugguguuca

SEQ ID NO: 538797 - RNA, 20 nt, Human
gccagcugcccuuccacccu

SEQ ID NO: 538798 - RNA, 22 nt, Human
gggcuggcuaagacuuuucugu

SEQ ID NO: 538799 - RNA, 22 nt, Human
gcagcuuuguaaaguaugaagc

SEQ ID NO: 538800 - RNA, 22 nt, Human
ugaguucuaguggcugcagauu

SEQ ID NO: 538801 - RNA, 22 nt, Human
aaaaauguuaucuacuguccga

SEQ ID NO: 538802 - RNA, 22 nt, Human
aaaaugaauaaguuaacccagg

SEQ ID NO: 538803 - RNA, 22 nt, Human
uccuggauuuaacccuggcucu

SEQ ID NO: 538804 - RNA, 22 nt, Human
agacaacaccaaaugcuagugu

SEQ ID NO: 538805 - RNA, 22 nt, Human
uaacaacucaguuuguuccuug

SEQ ID NO: 538806 - RNA, 22 nt, Human
agaggcagcagucauacuacag

SEQ ID NO: 538807 - RNA, 22 nt, Human
accagaaaggaauaauagaauu

SEQ ID NO: 538808 - RNA, 22 nt, Human
cacauuuaggagguggggaagc

SEQ ID NO: 538809 - RNA, 22 nt, Human
cuggugggaagauggaaaacau

SEQ ID NO: 538810 - RNA, 22 nt, Human
cugcuuugaaaauaaacuuguc

SEQ ID NO: 538811 - RNA, 22 nt, Human
gacccuccacucacugcugugu

SEQ ID NO: 538812 - RNA, 22 nt, Human
auuugugggacuauaaugcagg

SEQ ID NO: 538813 - RNA, 22 nt, Human
ccugggcugaagucaagugugg

SEQ ID NO: 538814 - RNA, 22 nt, Human
cgcagguguucaguaaauguau

SEQ ID NO: 538815 - RNA, 22 nt, Human
agaaaugacacacaugagacau

SEQ ID NO: 538816 - RNA, 19 nt, Human
accuuacagaaacaggcau

SEQ ID NO: 538817 - RNA, 22 nt, Human
cuguggagcuuguggcaguggg

SEQ ID NO: 538818 - RNA, 22 nt, Human
cuggacagaucccuuguagcuu

SEQ ID NO: 538819 - RNA, 17 nt, Human
caucuuuaaaauccuga

SEQ ID NO: 538820 - RNA, 22 nt, Human
ggccugagaaccauggggccaa

SEQ ID NO: 538821 - RNA, 22 nt, Human
uacauuguacuuacaaauagug

SEQ ID NO: 538822 - RNA, 23 nt, Human
uuuaugcagcauguagaacaugg

SEQ ID NO: 538823 - RNA, 22 nt, Human
uacagugaaugaauggcugugc

SEQ ID NO: 538824 - RNA, 22 nt, Human
ccuccugggacucauuagcacc

SEQ ID NO: 538825 - RNA, 19 nt, Human
aauuagggagucgguuaag

SEQ ID NO: 538826 - RNA, 22 nt, Human
auugucugaauccaaagcucug

SEQ ID NO: 538827 - RNA, 19 nt, Human
cacagcucugcucagggaa

SEQ ID NO: 538828 - RNA, 22 nt, Human
ggguacuuaauauuuacggggu

SEQ ID NO: 538829 - RNA, 22 nt, Human
ccauaaggagccagacauucca

SEQ ID NO: 538830 - RNA, 22 nt, Human
aacauauaaacucuuaaguuca

SEQ ID NO: 538831 - RNA, 22 nt, Human
caguggauuagccagagcugga

SEQ ID NO: 538832 - RNA, 22 nt, Human
cucugcugucucagaugggcca

SEQ ID NO: 538833 - RNA, 22 nt, Human
agcacuuugugcauuucugaag

SEQ ID NO: 538834 - RNA, 22 nt, Human
cuugucagccaauuguggauuu

SEQ ID NO: 538835 - RNA, 22 nt, Human
aacagugucaggauuacagaua

SEQ ID NO: 538836 - RNA, 22 nt, Human
gccugcuggauguggccaggcc

SEQ ID NO: 538837 - RNA, 22 nt, Human
caggaugagguagaggcagaua

SEQ ID NO: 538838 - RNA, 22 nt, Human
gucauuuuugacuuugaaguga

SEQ ID NO: 538839 - RNA, 22 nt, Human
ucccagagcucugacaccagcu

SEQ ID NO: 538840 - RNA, 22 nt, Human
auggcucauuuaucuugcagcc

SEQ ID NO: 538841 - RNA, 22 nt, Human
agauuguagaaacuguagcauu

SEQ ID NO: 538842 - RNA, 22 nt, Human
ucagcugccccaguggccccag

SEQ ID NO: 538843 - RNA, 22 nt, Human
guccuggcuuaguucgcuguaa

SEQ ID NO: 538844 - RNA, 22 nt, Human
gaaaggccauuucugaggguuu

SEQ ID NO: 538845 - RNA, 22 nt, Human
auaaggcaucucucaguuagca

SEQ ID NO: 538846 - RNA, 22 nt, Human
gcuguucacaucuggaccauuu

SEQ ID NO: 538847 - RNA, 22 nt, Human
aaagcagagcagggcacuuaug

SEQ ID NO: 538848 - RNA, 22 nt, Human
aagugauuucugccugcauguu

SEQ ID NO: 538849 - RNA, 22 nt, Human
cagagagcaugggaggcccgag

SEQ ID NO: 538850 - RNA, 21 nt, Human
agcucuggagcagcaaucaag

SEQ ID NO: 538851 - RNA, 22 nt, Human
ugaagagaagaaaauuaucuuu

SEQ ID NO: 538852 - RNA, 22 nt, Human
auauagauuccaugguuccuuu

SEQ ID NO: 538853 - RNA, 22 nt, Human
guaggaaagggagugaagggaa

SEQ ID NO: 538854 - RNA, 22 nt, Human
ggcucugucaccuaugagcuga

SEQ ID NO: 538855 - RNA, 21 nt, Human
uagcacuucgcuguaauuggg

SEQ ID NO: 538856 - RNA, 22 nt, Human
aaggcacuacgcugcuggggcg

SEQ ID NO: 538857 - RNA, 22 nt, Human
ccaggcucagcgcgcacgucug

SEQ ID NO: 538858 - RNA, 22 nt, Human
uaauaggagccaggucacauag

SEQ ID NO: 538859 - RNA, 22 nt, Human
gugggcugcccuugaggucagc

SEQ ID NO: 538860 - RNA, 22 nt, Human
auacuguacgucccagauagga

SEQ ID NO: 538861 - RNA, 22 nt, Human
ugcuaacuauuccuaaagauca

SEQ ID NO: 538862 - RNA, 22 nt, Human
gaaaggagaggguuaaggagcu

SEQ ID NO: 538863 - RNA, 22 nt, Human
uuuuaucuaccuaugcucauuu

SEQ ID NO: 538864 - RNA, 22 nt, Human
uauccaaaggaacaaucacagc

SEQ ID NO: 538865 - RNA, 17 nt, Human
uuccaguuuaguauugu

SEQ ID NO: 538866 - RNA, 19 nt, Human
cucagcuguagcucaugug

SEQ ID NO: 538867 - RNA, 22 nt, Human
uuaguuagucccugguaccuuu

SEQ ID NO: 538868 - RNA, 22 nt, Human
ugcaguggaggccgugagacag

SEQ ID NO: 538869 - RNA, 20 nt, Human
gugugaagcccucaggagga

SEQ ID NO: 538870 - RNA, 22 nt, Human
uagaaacagauguuuuugaaga

SEQ ID NO: 538871 - RNA, 22 nt, Human
acuucacaacuguacauggcag

SEQ ID NO: 538872 - RNA, 22 nt, Human
caaacugaacacgaaagucuuu

SEQ ID NO: 538873 - RNA, 21 nt, Human
cagaggggcuagccuggcugc

SEQ ID NO: 538874 - RNA, 22 nt, Human
uuucaacaggaugauaauaggc

SEQ ID NO: 538875 - RNA, 22 nt, Human
cacccagggcugugccugccca

SEQ ID NO: 538876 - RNA, 20 nt, Human
uccugcagucgcuagcgccc

SEQ ID NO: 538877 - RNA, 22 nt, Human
ugucccagggaaggcccagcac

SEQ ID NO: 538878 - RNA, 22 nt, Human
agaaucaaagagaaauacuuug

SEQ ID NO: 538879 - RNA, 22 nt, Human
accuugugagguuacauaaugu

SEQ ID NO: 538880 - RNA, 21 nt, Human
uaauauagguucacaacuagu

SEQ ID NO: 538881 - RNA, 22 nt, Human
caggcaggucagugaagaagga

SEQ ID NO: 538882 - RNA, 22 nt, Human
caguccugugucccuugguggg

SEQ ID NO: 538883 - RNA, 18 nt, Human
uggagccagcucuaggau

SEQ ID NO: 538884 - RNA, 23 nt, Human
aucaaaguggaaaucaauuaucu

SEQ ID NO: 538885 - RNA, 22 nt, Human
aggcacugaaagguggccagag

SEQ ID NO: 538886 - RNA, 22 nt, Human
uggugagaugcagcaacagaca

SEQ ID NO: 538887 - RNA, 22 nt, Human
gagcacagaaucuucccaugca

SEQ ID NO: 538888 - RNA, 22 nt, Human
cugggcagcuguaucagggagu

SEQ ID NO: 538889 - RNA, 22 nt, Human
augagacuaccuguaauguggc

SEQ ID NO: 538890 - RNA, 22 nt, Human
uaagacacauucauaucugucu

SEQ ID NO: 538891 - RNA, 22 nt, Human
gcaggccugacuguagggggca

SEQ ID NO: 538892 - RNA, 22 nt, Human
cuucuggaggacacuggcccca

SEQ ID NO: 538893 - RNA, 22 nt, Human
ggcucuggagcacagacgucug

SEQ ID NO: 538894 - RNA, 22 nt, Human
gcuccaagguauccaccagggu

SEQ ID NO: 538895 - RNA, 22 nt, Human
caggccuugggacccagacugg

SEQ ID NO: 538896 - RNA, 22 nt, Human
cacauuuaugggcugggaggca

SEQ ID NO: 538897 - RNA, 22 nt, Human
uucacagcuccuuuuacucaac

SEQ ID NO: 538898 - RNA, 22 nt, Human
agggguggccugccuuacuccc

SEQ ID NO: 538899 - RNA, 23 nt, Human
cagugcagggcaacucagacucc

SEQ ID NO: 538900 - RNA, 22 nt, Human
cuggguggcagagccugcagug

SEQ ID NO: 538901 - RNA, 17 nt, Human
gccuuccuuccuccaca

SEQ ID NO: 538902 - RNA, 22 nt, Human
agguacagaugaaagucuaguu

SEQ ID NO: 538903 - RNA, 22 nt, Human
agcugggucuugggccaggaga

SEQ ID NO: 538904 - RNA, 22 nt, Human
uuucuuagcgaugcuugauaaa

SEQ ID NO: 538905 - RNA, 22 nt, Human
ccagggugaccagcuggccuag

SEQ ID NO: 538906 - RNA, 20 nt, Human
uggcccuguuuucuccaggc

SEQ ID NO: 538907 - RNA, 22 nt, Human
uucagaauguacugauagaaca

SEQ ID NO: 538908 - RNA, 22 nt, Human
aauucuugguccuaguguauaa

SEQ ID NO: 538909 - RNA, 19 nt, Human
ugcagggcugcgccugggg

SEQ ID NO: 538910 - RNA, 23 nt, Human
gcccugcuccuggcugggaggga

SEQ ID NO: 538911 - RNA, 22 nt, Human
agagucagcuuaugacacaguc

SEQ ID NO: 538912 - RNA, 22 nt, Human
gcucagggaacuuuuugcaggc

SEQ ID NO: 538913 - RNA, 22 nt, Human
ucugaaaucuaaugcucugugg

SEQ ID NO: 538914 - RNA, 20 nt, Human
cagagaccugucuucacaga

SEQ ID NO: 538915 - RNA, 23 nt, Human
auuuuacaggucaguuccuugaa

SEQ ID NO: 538916 - RNA, 22 nt, Human
uccuguggaagacaguguuggg

SEQ ID NO: 538917 - RNA, 22 nt, Human
cagacaggcuagccagacucac

SEQ ID NO: 538918 - RNA, 22 nt, Human
gucagcuagaggaugugacauu

SEQ ID NO: 538919 - RNA, 22 nt, Human
acugcuuuuagaaaucuauaga

SEQ ID NO: 538920 - RNA, 22 nt, Human
uucucuuuuagaggcuccauga

SEQ ID NO: 538921 - RNA, 22 nt, Human
gacacuaaaguauaggguaucu

SEQ ID NO: 538922 - RNA, 22 nt, Human
ugggugagugggaaaagcccag

SEQ ID NO: 538923 - RNA, 22 nt, Human
cagggccaugaggcacaggguc

SEQ ID NO: 538924 - RNA, 22 nt, Human
cccagggucccugcucucugug

SEQ ID NO: 538925 - RNA, 20 nt, Human
cugcaucaugguuaagaaca

SEQ ID NO: 538926 - RNA, 22 nt, Human
gccaggcugaggcucuggaaga

SEQ ID NO: 538927 - RNA, 22 nt, Human
gcccaggagguggaggugcagu

SEQ ID NO: 538928 - RNA, 22 nt, Human
guguuuccaguucagaaagcaa

SEQ ID NO: 538929 - RNA, 22 nt, Human
cccacuguugccucaaauauca

SEQ ID NO: 538930 - RNA, 22 nt, Human
aagagcagaaguccuuggaucc

SEQ ID NO: 538931 - RNA, 22 nt, Human
aauauuuuugaggcccuguuau

SEQ ID NO: 538932 - RNA, 22 nt, Human
aacauucaccucuaccuccuuc

SEQ ID NO: 538933 - RNA, 22 nt, Human
ucacagaaggaccuuguuucau

SEQ ID NO: 538934 - RNA, 22 nt, Human
ugccaggcucaggaugucccug

SEQ ID NO: 538935 - RNA, 22 nt, Human
aauauguuccacuuaaagcugg

SEQ ID NO: 538936 - RNA, 22 nt, Human
cugucucucuaggacacugggg

SEQ ID NO: 538937 - RNA, 22 nt, Human
gcccagaagugacucagcacug

SEQ ID NO: 538938 - RNA, 22 nt, Human
augagguaauacuuucaguccu

SEQ ID NO: 538939 - RNA, 22 nt, Human
auagauacauuagguaacuugu

SEQ ID NO: 538940 - RNA, 22 nt, Human
agacaggagagggaacugccgg

SEQ ID NO: 538941 - RNA, 22 nt, Human
gagccauacaaccuauaaagug

SEQ ID NO: 538942 - RNA, 19 nt, Human
agaaaaacugguacugcug

SEQ ID NO: 538943 - RNA, 22 nt, Human
ccucagcugcuucccuggagcc

SEQ ID NO: 538944 - RNA, 22 nt, Human
guguugacucuuggacuucaag

SEQ ID NO: 538945 - RNA, 22 nt, Human
ggcuccugggagaaguuuuauu

SEQ ID NO: 538946 - RNA, 22 nt, Human
ggcaggcauggggucugccauu

SEQ ID NO: 538947 - RNA, 22 nt, Human
agggaggucuuugaggggcuua

SEQ ID NO: 538948 - RNA, 22 nt, Human
aggugcuggagucugggcagga

SEQ ID NO: 538949 - RNA, 22 nt, Human
gcucagagggaacaaggggcug

SEQ ID NO: 538950 - RNA, 22 nt, Human
uuucuaaggugagguagaaaau

SEQ ID NO: 538951 - RNA, 23 nt, Human
cucaacccuaguaagggaguagg

SEQ ID NO: 538952 - RNA, 22 nt, Human
uucuggagaucugccuauggga

SEQ ID NO: 538953 - RNA, 22 nt, Human
gucaugccagcggagcucggga

SEQ ID NO: 538954 - RNA, 22 nt, Human
cuucacagaugcugagagggcu

SEQ ID NO: 538955 - RNA, 22 nt, Human
uguaacagcucuccaugugggg

SEQ ID NO: 538956 - RNA, 22 nt, Human
aauuagggaaaauuuacuugua

SEQ ID NO: 538957 - RNA, 22 nt, Human
ugaacacauuuucuucaguaga

SEQ ID NO: 538958 - RNA, 22 nt, Human
cucucugugguggcugucccau

SEQ ID NO: 538959 - RNA, 22 nt, Human
ggaaggggccuugagcaaacug

SEQ ID NO: 538960 - RNA, 22 nt, Human
uuagggacagcucuguagguga

SEQ ID NO: 538961 - RNA, 22 nt, Human
gugcaggggccuccccuugcug

SEQ ID NO: 538962 - RNA, 22 nt, Human
ugguaaagaaggcuagaucuga

SEQ ID NO: 538963 - RNA, 22 nt, Human
cuguaugaggaucagacuggac

SEQ ID NO: 538964 - RNA, 22 nt, Human
gggcuacauugugagagaaguu

SEQ ID NO: 538965 - RNA, 21 nt, Human
cucugcccagggccuccugcc

SEQ ID NO: 538966 - RNA, 22 nt, Human
uagcugccuaugugauaagaga

SEQ ID NO: 538967 - RNA, 22 nt, Human
gauggguggucucagacuugcc

SEQ ID NO: 538968 - RNA, 22 nt, Human
uagaaaauagggccuguggagc

SEQ ID NO: 538969 - RNA, 22 nt, Human
aggcagcauuucugcuuaucca

SEQ ID NO: 538970 - RNA, 22 nt, Human
acagaaagaugauuugaaaugg

SEQ ID NO: 538971 - RNA, 22 nt, Human
ugaugguugauuauaaaucagu

SEQ ID NO: 538972 - RNA, 21 nt, Human
auauuucagauuuccguaauc

SEQ ID NO: 538973 - RNA, 22 nt, Human
ugccuguccugaggaugagggu

SEQ ID NO: 538974 - RNA, 22 nt, Human
agaaaguuaucacaaaauugag

SEQ ID NO: 538975 - RNA, 22 nt, Human
uggagcagagaugguggccuuc

SEQ ID NO: 538976 - RNA, 22 nt, Human
gcagccaccucccauggcgggg

SEQ ID NO: 538977 - RNA, 18 nt, Human
agcaggcguugccuggga

SEQ ID NO: 538978 - RNA, 22 nt, Human
gggagggaggugcugguucacg

SEQ ID NO: 538979 - RNA, 22 nt, Human
uuuggaaaaagacagcuuauga

SEQ ID NO: 538980 - RNA, 22 nt, Human
uuugcauuucucguaaggaaac

SEQ ID NO: 538981 - RNA, 22 nt, Human
cauuuucucaaugaacccucuu

SEQ ID NO: 538982 - RNA, 22 nt, Human
cugcagaguggagccucggcug

SEQ ID NO: 538983 - RNA, 22 nt, Human
gggaguggagagcaauggauga

SEQ ID NO: 538984 - RNA, 22 nt, Human
gccaggcaggccacgcuguguu

SEQ ID NO: 538985 - RNA, 22 nt, Human
guggcugcagagggcacagcau

SEQ ID NO: 538986 - RNA, 22 nt, Human
uuugaaguccaucuggcccagu

SEQ ID NO: 538987 - RNA, 21 nt, Human
gagaugcuuuuuauucaaccc

SEQ ID NO: 538988 - RNA, 22 nt, Human
aucuuucaguuucauaccaauu

SEQ ID NO: 538989 - RNA, 22 nt, Human
uuagcuuuggauugcauuuagu

SEQ ID NO: 538990 - RNA, 22 nt, Human
acagggcagguggcuacugguc

SEQ ID NO: 538991 - RNA, 22 nt, Human
aaucaacuguuuccacagggag

SEQ ID NO: 538992 - RNA, 22 nt, Human
acugugaaucacuacuaguaga

SEQ ID NO: 538993 - RNA, 22 nt, Human
uuuugagauggagucuugcucu

SEQ ID NO: 538994 - RNA, 17 nt, Human
agcagggagucaaggga

SEQ ID NO: 538995 - RNA, 22 nt, Human
agggcuacugccugccuucagg

SEQ ID NO: 538996 - RNA, 22 nt, Human
cugggcucaccuguggcuggca

SEQ ID NO: 538997 - RNA, 22 nt, Human
cugcagcuauauuuucccacag

SEQ ID NO: 538998 - RNA, 22 nt, Human
uaggaacccgcagcaguccgag

SEQ ID NO: 538999 - RNA, 22 nt, Human
gugcccugagcuuaugcauucu

SEQ ID NO: 539000 - RNA, 18 nt, Human
gggcauggaugcagcauc

SEQ ID NO: 539001 - RNA, 22 nt, Human
cccuuuaacacacagaggcugc

SEQ ID NO: 539002 - RNA, 22 nt, Human
gugaagauaaggaugcugcagu

SEQ ID NO: 539003 - RNA, 22 nt, Human
ucacauuuauacuccauuugca

SEQ ID NO: 539004 - RNA, 22 nt, Human
auuauaggcuugagccaccgug

SEQ ID NO: 539005 - RNA, 22 nt, Human
caccaggcugcccaggacaggg

SEQ ID NO: 539006 - RNA, 22 nt, Human
aguauaauuuacauuugguauu

SEQ ID NO: 539007 - RNA, 21 nt, Human
ggacuuacauagguaaggggu

SEQ ID NO: 539008 - RNA, 22 nt, Human
uagucuuuuuaauaaauaaugc

SEQ ID NO: 539009 - RNA, 22 nt, Human
ucuuucagccacuuaccugucu

SEQ ID NO: 539010 - RNA, 22 nt, Human
gaaaucaaacccuuuucugaua

SEQ ID NO: 539011 - RNA, 22 nt, Human
uuacagauacauuucuuuuguu

SEQ ID NO: 539012 - RNA, 22 nt, Human
ucagagaacacagaggugaugu

SEQ ID NO: 539013 - RNA, 22 nt, Human
ugaaugauguauaauauugaga

SEQ ID NO: 539014 - RNA, 22 nt, Human
acaaaguuaacaguuggauagu

SEQ ID NO: 539015 - RNA, 22 nt, Human
gcuucuggagucuucagaggaa

SEQ ID NO: 539016 - RNA, 22 nt, Human
acaucuuuguuucuuaguguau

SEQ ID NO: 539017 - RNA, 17 nt, Human
cagacagauauccuggg

SEQ ID NO: 539018 - RNA, 22 nt, Human
auguguaaaaagugcuuaauau

SEQ ID NO: 539019 - RNA, 16 nt, Human
gcagguggaucaccug

SEQ ID NO: 539020 - RNA, 22 nt, Human
ccaggaggcagaaguugcagug

SEQ ID NO: 539021 - RNA, 22 nt, Human
caguucugguuugcagauauau

SEQ ID NO: 539022 - RNA, 22 nt, Human
agccuccuguagcccucaccca

SEQ ID NO: 539023 - RNA, 22 nt, Human
cugccaggacugacgucuucag

SEQ ID NO: 539024 - RNA, 22 nt, Human
ugcacacauuaaggauacacag

SEQ ID NO: 539025 - RNA, 22 nt, Human
aggggagcuaacaccagagccc

SEQ ID NO: 539026 - RNA, 22 nt, Human
cugucugucaaguucaucucca

SEQ ID NO: 539027 - RNA, 22 nt, Human
gccuggagacaaggacaaaggg

SEQ ID NO: 539028 - RNA, 22 nt, Human
agagagcauggcacagaggggu

SEQ ID NO: 539029 - RNA, 22 nt, Human
acuuuacauuugaucucucuaa

SEQ ID NO: 539030 - RNA, 22 nt, Human
ccaguggguaggccauggugag

SEQ ID NO: 539031 - RNA, 22 nt, Human
gccuggcacucacugaagaggc

SEQ ID NO: 539032 - RNA, 22 nt, Human
uucaggcccaacgcacagcuuc

SEQ ID NO: 539033 - RNA, 22 nt, Human
cuuagaaauaaugguuucaguu

SEQ ID NO: 539034 - RNA, 22 nt, Human
aucaguuuugggggacauacug

SEQ ID NO: 539035 - RNA, 22 nt, Human
guuucuggagugacuauaacug

SEQ ID NO: 539036 - RNA, 22 nt, Human
augugcaaauccaaugugaaug

SEQ ID NO: 539037 - RNA, 17 nt, Human
ucaggauguagcaguag

SEQ ID NO: 539038 - RNA, 22 nt, Human
cccaggagguggagcuugcagu

SEQ ID NO: 539039 - RNA, 20 nt, Human
aaaguguaagcauauaauua

SEQ ID NO: 539040 - RNA, 22 nt, Human
gcauuuguguucuuccuagagc

SEQ ID NO: 539041 - RNA, 22 nt, Human
guuggccugaauggucaagagg

SEQ ID NO: 539042 - RNA, 22 nt, Human
ugcaaagucgcaaaauucuucu

SEQ ID NO: 539043 - RNA, 22 nt, Human
aggcugaggcaagaggaucacu

SEQ ID NO: 539044 - RNA, 21 nt, Human
acaugucuggucauuuuuagc

SEQ ID NO: 539045 - RNA, 22 nt, Human
cccuggagaaggggacgcggag

SEQ ID NO: 539046 - RNA, 22 nt, Human
uaagauaauccauuauaauguu

SEQ ID NO: 539047 - RNA, 22 nt, Human
acucaugauaugccuauaagau

SEQ ID NO: 539048 - RNA, 22 nt, Human
uaaggccaauuacauauguuca

SEQ ID NO: 539049 - RNA, 22 nt, Human
cuccacucaccagaugccagga

SEQ ID NO: 539050 - RNA, 22 nt, Human
uacagaauguuaugaagcauag

SEQ ID NO: 539051 - RNA, 22 nt, Human
ugcugggcuugaaagcugcuaa

SEQ ID NO: 539052 - RNA, 22 nt, Human
uaacagcacuggcaggcacugu

SEQ ID NO: 539053 - RNA, 22 nt, Human
agcagacaacccagaugaccca

SEQ ID NO: 539054 - RNA, 22 nt, Human
uucacuuauagggauguuauug

SEQ ID NO: 539055 - RNA, 22 nt, Human
ggaagcuuaaugccuaauuucc

SEQ ID NO: 539056 - RNA, 22 nt, Human
guuuacauguuuuucucuuaca

SEQ ID NO: 539057 - RNA, 22 nt, Human
uccuucagcugcuaggaaauga

SEQ ID NO: 539058 - RNA, 22 nt, Human
cuucuggguugcaggucuuggc

SEQ ID NO: 539059 - RNA, 22 nt, Human
uuuuuccuaagcaguggagcug

SEQ ID NO: 539060 - RNA, 22 nt, Human
cugguucagugaaaggcauggg

SEQ ID NO: 539061 - RNA, 22 nt, Human
uugcuuccaguccaagucuguu

SEQ ID NO: 539062 - RNA, 22 nt, Human
ugaaggccagcucuuuaucagc

SEQ ID NO: 539063 - RNA, 22 nt, Human
ucaacacaacagagaaaugcug

SEQ ID NO: 539064 - RNA, 22 nt, Human
aagcagaggccacagagugggc

SEQ ID NO: 539065 - RNA, 22 nt, Human
uucuuugugcauccaauuuucu

SEQ ID NO: 539066 - RNA, 20 nt, Human
agcaggaaugaugcuuucau

SEQ ID NO: 539067 - RNA, 22 nt, Human
uucuucuuaauguccugggaac

SEQ ID NO: 539068 - RNA, 22 nt, Human
agugcaaauuauuuaccugauu

SEQ ID NO: 539069 - RNA, 22 nt, Human
uagaaagaucuguaggcaagag

SEQ ID NO: 539070 - RNA, 22 nt, Human
agagcuggggcauaaaugccac

SEQ ID NO: 539071 - RNA, 22 nt, Human
gccugcagaacugugaggcaau

SEQ ID NO: 539072 - RNA, 22 nt, Human
aaagucaugcaguugaacuuuu

SEQ ID NO: 539073 - RNA, 22 nt, Human
ugugcccauuacacagaggcau

SEQ ID NO: 539074 - RNA, 22 nt, Human
cuucuuuacuuucuagaaauaa

SEQ ID NO: 539075 - RNA, 22 nt, Human
gcuuuuuugggaugccugccuu

SEQ ID NO: 539076 - RNA, 18 nt, Human
gcagcugacacuggaguu

SEQ ID NO: 539077 - RNA, 22 nt, Human
gugcccuggaugacuuuggucu

SEQ ID NO: 539078 - RNA, 22 nt, Human
auguagcagaagauguuuuccu

SEQ ID NO: 539079 - RNA, 22 nt, Human
auuuuauccccacuggauuaca

SEQ ID NO: 539080 - RNA, 22 nt, Human
cugaagcaugcguuuguaaacu

SEQ ID NO: 539081 - RNA, 22 nt, Human
guccagaaggaggucaaguugg

SEQ ID NO: 539082 - RNA, 22 nt, Human
agugaaauaaagcugccuaugg

SEQ ID NO: 539083 - RNA, 21 nt, Human
cucuggaggcaagggagagug

SEQ ID NO: 539084 - RNA, 22 nt, Human
cagcaguggccaucuguguggu

SEQ ID NO: 539085 - RNA, 22 nt, Human
auaugcaagcacauagaauacu

SEQ ID NO: 539086 - RNA, 19 nt, Human
acacugaauguagaauugg

SEQ ID NO: 539087 - RNA, 22 nt, Human
acaggcuggugguccuggccau

SEQ ID NO: 539088 - RNA, 23 nt, Human
uugauacagaagaaucaguuugu

SEQ ID NO: 539089 - RNA, 22 nt, Human
uuugugaauagguuggcuucca

SEQ ID NO: 539090 - RNA, 22 nt, Human
guccuucauggaguuacagccu

SEQ ID NO: 539091 - RNA, 22 nt, Human
cucaggccuugaagucuuuucu

SEQ ID NO: 539092 - RNA, 22 nt, Human
cagcuuggcuuccgcuuuacug

SEQ ID NO: 539093 - RNA, 22 nt, Human
ugaagcagaggggucuugagcu

SEQ ID NO: 539094 - RNA, 22 nt, Human
aucugccuggcuccaggugagc

SEQ ID NO: 539095 - RNA, 22 nt, Human
uacacauccauguuuugacuuu

SEQ ID NO: 539096 - RNA, 17 nt, Human
cugaggggagugcugug

SEQ ID NO: 539097 - RNA, 22 nt, Human
aaagauuauggaacacacauga

SEQ ID NO: 539098 - RNA, 23 nt, Human
uaguuauuuucucuguaauuugc

SEQ ID NO: 539099 - RNA, 22 nt, Human
agagcugcaauuucauguggug

SEQ ID NO: 539100 - RNA, 22 nt, Human
auauuuguaguggguaagaagu

SEQ ID NO: 539101 - RNA, 22 nt, Human
uuuauuguguugaaacugaauu

SEQ ID NO: 539102 - RNA, 22 nt, Human
acuauuuacucaaaugagguug

SEQ ID NO: 539103 - RNA, 22 nt, Human
uggaggugggagggacuguccu

SEQ ID NO: 539104 - RNA, 22 nt, Human
aacaucuucagagaagcuaagu

SEQ ID NO: 539105 - RNA, 22 nt, Human
guccucagucaguuuggugggg

SEQ ID NO: 539106 - RNA, 22 nt, Human
ucauauaagagcuuuagaguca

SEQ ID NO: 539107 - RNA, 22 nt, Human
ucaugccacuuacaaaauaaug

SEQ ID NO: 539108 - RNA, 22 nt, Human
gacccagccugguuuuuauagg

SEQ ID NO: 539109 - RNA, 22 nt, Human
uauggcuucuuuugcaacuacu

SEQ ID NO: 539110 - RNA, 22 nt, Human
ccaggggaaacagggagcacuc

SEQ ID NO: 539111 - RNA, 22 nt, Human
caggagguuguaagagcaggcc

SEQ ID NO: 539112 - RNA, 23 nt, Human
cuugcagggcuggaggcuuagaa

SEQ ID NO: 539113 - RNA, 23 nt, Human
auggagcugguacuagcuaccuc

SEQ ID NO: 539114 - RNA, 21 nt, Human
cagugagguccccagccuagg

SEQ ID NO: 539115 - RNA, 22 nt, Human
aauauuugcaucauuagcuauu

SEQ ID NO: 539116 - RNA, 22 nt, Human
uguaagauauucagcuuauuga

SEQ ID NO: 539117 - RNA, 22 nt, Human
ggaggggagucucccaaagccg

SEQ ID NO: 539118 - RNA, 21 nt, Human
auuuuguacauagaauuuguc

SEQ ID NO: 539119 - RNA, 22 nt, Human
aaugaaauguagcuuauccaua

SEQ ID NO: 539120 - RNA, 22 nt, Human
ugugcuucaucacuucucaguu

SEQ ID NO: 539121 - RNA, 22 nt, Human
acagaacugggggcacagauag

SEQ ID NO: 539122 - RNA, 23 nt, Human
caggacaugggaggaaguauggc

SEQ ID NO: 539123 - RNA, 19 nt, Human
ggcaggcuggauagagagg

SEQ ID NO: 539124 - RNA, 22 nt, Human
uaagaaacccaggaauuucuua

SEQ ID NO: 539125 - RNA, 22 nt, Human
cagguagguauggugcagucuu

SEQ ID NO: 539126 - RNA, 22 nt, Human
ggcagucuuaucagcauuggac

SEQ ID NO: 539127 - RNA, 22 nt, Human
accaaaggcagagcugaacacu

SEQ ID NO: 539128 - RNA, 18 nt, Human
ggacaucaucaggugcuu

SEQ ID NO: 539129 - RNA, 22 nt, Human
gccugccuuuuggaggcacauu

SEQ ID NO: 539130 - RNA, 22 nt, Human
gugucccaaucuacuuuucccu

SEQ ID NO: 539131 - RNA, 22 nt, Human
guauuccuucagaagacguuua

SEQ ID NO: 539132 - RNA, 22 nt, Human
uggagcagggcaucacugugcg

SEQ ID NO: 539133 - RNA, 22 nt, Human
aaagagcccuuccaugacucuu

SEQ ID NO: 539134 - RNA, 22 nt, Human
uaaaucacuccuaauaaucagu

SEQ ID NO: 539135 - RNA, 22 nt, Human
uggaagcacugaagagacaacc

SEQ ID NO: 539136 - RNA, 22 nt, Human
ccuggcugguggcagcgacaag

SEQ ID NO: 539137 - RNA, 22 nt, Human
uucauuugugugccugaugcaa

SEQ ID NO: 539138 - RNA, 22 nt, Human
gccuggcccagggcuccgcagg

SEQ ID NO: 539139 - RNA, 22 nt, Human
gcugagcacaccuaggguagag

SEQ ID NO: 539140 - RNA, 22 nt, Human
cucagaguccccacaucugggu

SEQ ID NO: 539141 - RNA, 22 nt, Human
uuugugcagauguauauuugug

SEQ ID NO: 539142 - RNA, 21 nt, Human
ugaggcaggggugcuuuuguc

SEQ ID NO: 539143 - RNA, 18 nt, Human
ucauuuguuuugcaugaa

SEQ ID NO: 539144 - RNA, 22 nt, Human
caaaagucuuccuauucucuua

SEQ ID NO: 539145 - RNA, 22 nt, Human
ugcacacauguauguauaugug

SEQ ID NO: 539146 - RNA, 22 nt, Human
gggaaauugugugagaucuuug

SEQ ID NO: 539147 - RNA, 20 nt, Human
uuucagagugucuuuccauu

SEQ ID NO: 539148 - RNA, 22 nt, Human
ucugagagguuaagcaauuuga

SEQ ID NO: 539149 - RNA, 22 nt, Human
uggcuggacagugggcagugga

SEQ ID NO: 539150 - RNA, 22 nt, Human
cagggcucuuccggagcaggga

SEQ ID NO: 539151 - RNA, 22 nt, Human
cucuccagaauaugccgccgug

SEQ ID NO: 539152 - RNA, 22 nt, Human
ugcacagcuggcucuccuuuuc

SEQ ID NO: 539153 - RNA, 22 nt, Human
cagggccucauccucagagauu

SEQ ID NO: 539154 - RNA, 22 nt, Human
ccuggcucugccguaaccacca

SEQ ID NO: 539155 - RNA, 22 nt, Human
uggauaaacucacuguaaguug

SEQ ID NO: 539156 - RNA, 22 nt, Human
agauacauugaguuuccuccug

SEQ ID NO: 539157 - RNA, 22 nt, Human
guuucuaagcacaugugagugu

SEQ ID NO: 539158 - RNA, 22 nt, Human
ucugagagcuguagaagccuau

SEQ ID NO: 539159 - RNA, 22 nt, Human
gagcuuuaagggauaaaaugau

SEQ ID NO: 539160 - RNA, 22 nt, Human
gggcaguuuauucuagaugguu

SEQ ID NO: 539161 - RNA, 22 nt, Human
gggcucauucaucugggcuugg

SEQ ID NO: 539162 - RNA, 20 nt, Human
uggcaucucucaauuguagg

SEQ ID NO: 539163 - RNA, 22 nt, Human
aagcugccaaugguaagcugcu

SEQ ID NO: 539164 - RNA, 22 nt, Human
ugugaaggcagcagcucugucc

SEQ ID NO: 539165 - RNA, 22 nt, Human
guuuccaaccccaccaaagugc

SEQ ID NO: 539166 - RNA, 22 nt, Human
aagcugccuugcugaggagaaa

SEQ ID NO: 539167 - RNA, 22 nt, Human
cacagauagaccuuaugagauu

SEQ ID NO: 539168 - RNA, 22 nt, Human
auguuccuuccagagagcagaa

SEQ ID NO: 539169 - RNA, 21 nt, Human
ucacagacuggucagugaggc

SEQ ID NO: 539170 - RNA, 22 nt, Human
uugaaauccaauuaucauaugu

SEQ ID NO: 539171 - RNA, 18 nt, Human
aggcuucccaggcaggcc

SEQ ID NO: 539172 - RNA, 22 nt, Human
aggcagagcuaggaagaauugu

SEQ ID NO: 539173 - RNA, 22 nt, Human
gcagggccagguacaagaagca

SEQ ID NO: 539174 - RNA, 22 nt, Human
ggucagguuuuuaggagugacc

SEQ ID NO: 539175 - RNA, 22 nt, Human
ggggcagaguagcuggggugug

SEQ ID NO: 539176 - RNA, 22 nt, Human
agucuaauguuuguaaaaucau

SEQ ID NO: 539177 - RNA, 22 nt, Human
gagucaguaauggauaugucau

SEQ ID NO: 539178 - RNA, 20 nt, Human
gagggugggacuuccuaggc

SEQ ID NO: 539179 - RNA, 22 nt, Human
uggcaaaggcgcucacaugccu

SEQ ID NO: 539180 - RNA, 22 nt, Human
uagaaucccagccagcuggaag

SEQ ID NO: 539181 - RNA, 22 nt, Human
uaaaguguaugccaucucucau

SEQ ID NO: 539182 - RNA, 22 nt, Human
uggaagaaggcagagaggcauu

SEQ ID NO: 539183 - RNA, 22 nt, Human
ucccagagugagccaggggcag

SEQ ID NO: 539184 - RNA, 22 nt, Human
auguaacuucugugaaucugac

SEQ ID NO: 539185 - RNA, 22 nt, Human
uccugccuaccuugcggaggug

SEQ ID NO: 539186 - RNA, 22 nt, Human
aaugucugccagaacugaucau

SEQ ID NO: 539187 - RNA, 22 nt, Human
ucagagucaacuguugccuguu

SEQ ID NO: 539188 - RNA, 22 nt, Human
agcaggcaggaggcuacuaagg

SEQ ID NO: 539189 - RNA, 22 nt, Human
uucagcuaaugggaauaagagu

SEQ ID NO: 539190 - RNA, 22 nt, Human
agcaggcuuacuuucugauuag

SEQ ID NO: 539191 - RNA, 22 nt, Human
auauguguaaaugcauuuguuu

SEQ ID NO: 539192 - RNA, 22 nt, Human
uauauuaccugccugaucuaua

SEQ ID NO: 539193 - RNA, 22 nt, Human
uuuuaaugggcgacuauuaugg

SEQ ID NO: 539194 - RNA, 22 nt, Human
ugcaaagaacuaagcagccuua

SEQ ID NO: 539195 - RNA, 22 nt, Human
aucuacagcugucugcacagua

SEQ ID NO: 539196 - RNA, 22 nt, Human
cauuuguuuagaagucuuuaua

SEQ ID NO: 539197 - RNA, 22 nt, Human
acauauauguaaaguacuuugu

SEQ ID NO: 539198 - RNA, 22 nt, Human
ccugucucuuucaaucugagag

SEQ ID NO: 539199 - RNA, 22 nt, Human
uuuguuuucuguaggccuuucc

SEQ ID NO: 539200 - RNA, 22 nt, Human
aggcugcguuagccucacuccc

SEQ ID NO: 539201 - RNA, 22 nt, Human
uuauguaccugaauuaguaaag

SEQ ID NO: 539202 - RNA, 19 nt, Human
ucaaaggcuuuuaggagac

SEQ ID NO: 539203 - RNA, 22 nt, Human
gcauccaaaccauucaucagcc

SEQ ID NO: 539204 - RNA, 22 nt, Human
cacuggugacuucugagcugga

SEQ ID NO: 539205 - RNA, 22 nt, Human
acauuugaaauaaacucaagug

SEQ ID NO: 539206 - RNA, 22 nt, Human
agauggagaccuuggaugaacu

SEQ ID NO: 539207 - RNA, 22 nt, Human
ggcugaaacagauuucaagaca

SEQ ID NO: 539208 - RNA, 22 nt, Human
agcagaaacagccagucuggac

SEQ ID NO: 539209 - RNA, 22 nt, Human
cuggaaggcucugcugccuguc

SEQ ID NO: 539210 - RNA, 22 nt, Human
uccugcagagacagaggccuca

SEQ ID NO: 539211 - RNA, 22 nt, Human
aaaagacaucuauuucaggcag

SEQ ID NO: 539212 - RNA, 20 nt, Human
ccagagcugauggcugcccg

SEQ ID NO: 539213 - RNA, 22 nt, Human
acaaagugaauugcaucgaguu

SEQ ID NO: 539214 - RNA, 22 nt, Human
aagcuccccgaaacccaccucu

SEQ ID NO: 539215 - RNA, 22 nt, Human
uguguuuuacaaauucucuuaa

SEQ ID NO: 539216 - RNA, 22 nt, Human
cuggacagaaaccaguccuggg

SEQ ID NO: 539217 - RNA, 22 nt, Human
gauuuauugucccuguccugcu

SEQ ID NO: 539218 - RNA, 22 nt, Human
uggaagccaggcccgcuccuaa

SEQ ID NO: 539219 - RNA, 22 nt, Human
ccuuuuucaauauagaauugca

SEQ ID NO: 539220 - RNA, 19 nt, Human
ggcucuggcggcuguagcc

SEQ ID NO: 539221 - RNA, 22 nt, Human
ucagaucacaaaaguuucuauu

SEQ ID NO: 539222 - RNA, 22 nt, Human
aacaucuacagugagauguuag

SEQ ID NO: 539223 - RNA, 22 nt, Human
agucugcaggcugugauuuuuu

SEQ ID NO: 539224 - RNA, 22 nt, Human
ugcaggugucuccagggcaggu

SEQ ID NO: 539225 - RNA, 22 nt, Human
cagacuuucuggaagcuaaaaa

SEQ ID NO: 539226 - RNA, 22 nt, Human
auuuuuucagauugaguguuaa

SEQ ID NO: 539227 - RNA, 22 nt, Human
ucucagaggugcccuggcaucu

SEQ ID NO: 539228 - RNA, 20 nt, Human
gaggcucugggcauggcgcc

SEQ ID NO: 539229 - RNA, 22 nt, Human
uuccuguauucuaaagggaaag

SEQ ID NO: 539230 - RNA, 22 nt, Human
cagucucugccacuucuaagcu

SEQ ID NO: 539231 - RNA, 22 nt, Human
ucagacuugacuuuguaaguuu

SEQ ID NO: 539232 - RNA, 22 nt, Human
gagugguaggcaguguuaggaa

SEQ ID NO: 539233 - RNA, 22 nt, Human
ucaguggaacugucugggugag

SEQ ID NO: 539234 - RNA, 22 nt, Human
gagaauauauugaaguaguucc

SEQ ID NO: 539235 - RNA, 22 nt, Human
gaauauuuucaguacagauggu

SEQ ID NO: 539236 - RNA, 22 nt, Human
cugcuggaaguuugcuguggau

SEQ ID NO: 539237 - RNA, 22 nt, Human
cauuacaaccccaaauuacaaa

SEQ ID NO: 539238 - RNA, 22 nt, Human
ucuauaaauuaugcagucucag

SEQ ID NO: 539239 - RNA, 22 nt, Human
uuuccuaggagauugaucacau

SEQ ID NO: 539240 - RNA, 22 nt, Human
uugucugaaagaucauuacauu

SEQ ID NO: 539241 - RNA, 22 nt, Human
uaaaggcagccuaggaaguguu

SEQ ID NO: 539242 - RNA, 22 nt, Human
uauaguaaaauuuucauuuaug

SEQ ID NO: 539243 - RNA, 21 nt, Human
ggccaguggccuugacuuucc

SEQ ID NO: 539244 - RNA, 23 nt, Human
ggcuggcccggggcugcuccuga

SEQ ID NO: 539245 - RNA, 22 nt, Human
gacauguauuaguacauauggu

SEQ ID NO: 539246 - RNA, 22 nt, Human
accaggagccauagagucaggc

SEQ ID NO: 539247 - RNA, 22 nt, Human
uacagaaggaaguuuagcuaaa

SEQ ID NO: 539248 - RNA, 22 nt, Human
uuuauucacucauucagccagu

SEQ ID NO: 539249 - RNA, 22 nt, Human
gucccagggaugcagacaugag

SEQ ID NO: 539250 - RNA, 22 nt, Human
gaaaauuauugaaaauggcucu

SEQ ID NO: 539251 - RNA, 22 nt, Human
uauuuaauaaaacuauggcaug

SEQ ID NO: 539252 - RNA, 22 nt, Human
acacauuaucucauuaaauacu

SEQ ID NO: 539253 - RNA, 23 nt, Human
cuggcuccgaagacuccaggauc

SEQ ID NO: 539254 - RNA, 22 nt, Human
ucagaggaaaggucagauggcu

SEQ ID NO: 539255 - RNA, 22 nt, Human
ucaaaauuuuauuucucaagga

SEQ ID NO: 539256 - RNA, 22 nt, Human
ucucagugauggcccauuugga

SEQ ID NO: 539257 - RNA, 22 nt, Human
uggcucagaagaaaagguaaac

SEQ ID NO: 539258 - RNA, 22 nt, Human
cuagaaaugcucaagagaaagu

SEQ ID NO: 539259 - RNA, 19 nt, Human
ggcauccacgaaugcagag

SEQ ID NO: 539260 - RNA, 22 nt, Human
cagcucuuuuucacacaacaug

SEQ ID NO: 539261 - RNA, 22 nt, Human
aaauucuuucauggcuaauaag

SEQ ID NO: 539262 - RNA, 22 nt, Human
uagaaaacuaauacaugcuuga

SEQ ID NO: 539263 - RNA, 22 nt, Human
ucaagagagugcugcuuggggu

SEQ ID NO: 539264 - RNA, 22 nt, Human
uaaagcaggcaucucucuccuc

SEQ ID NO: 539265 - RNA, 22 nt, Human
uucauuccugagcccauauuua

SEQ ID NO: 539266 - RNA, 23 nt, Human
uuuauacaagaaaccgcuggccu

SEQ ID NO: 539267 - RNA, 22 nt, Human
ccaagcuacuuaggagucugag

SEQ ID NO: 539268 - RNA, 22 nt, Human
uuucuucucaucccugaaauca

SEQ ID NO: 539269 - RNA, 22 nt, Human
cugagcucuaaugucagccuug

SEQ ID NO: 539270 - RNA, 22 nt, Human
uggcugcugagaaggcagcugu

SEQ ID NO: 539271 - RNA, 22 nt, Human
auuuccaguacccagaacagag

SEQ ID NO: 539272 - RNA, 23 nt, Human
uguaugaauaugccacaguuuaa

SEQ ID NO: 539273 - RNA, 22 nt, Human
agcugccauccuguucagcacc

SEQ ID NO: 539274 - RNA, 22 nt, Human
aauguauuccucaugcaagagu

SEQ ID NO: 539275 - RNA, 22 nt, Human
aacaggagaguaaauauaugau

SEQ ID NO: 539276 - RNA, 22 nt, Human
aaacauuugcaacucgguuugg

SEQ ID NO: 539277 - RNA, 19 nt, Human
cuucuaagucauuuggaau

SEQ ID NO: 539278 - RNA, 21 nt, Human
guuuuaagggagaaaaccuag

SEQ ID NO: 539279 - RNA, 19 nt, Human
gucaccauuuccaaaugcc

SEQ ID NO: 539280 - RNA, 22 nt, Human
gaagauuucuuuaugaaagaug

SEQ ID NO: 539281 - RNA, 22 nt, Human
gagcaggugccuguagcucucu

SEQ ID NO: 539282 - RNA, 22 nt, Human
auguaacaaaugguauacaugu

SEQ ID NO: 539283 - RNA, 22 nt, Human
uguucccuccuccccacugggu

SEQ ID NO: 539284 - RNA, 22 nt, Human
cuccuuccccuacucagcaucc

SEQ ID NO: 539285 - RNA, 22 nt, Human
gccagcagccacagaagucacu

SEQ ID NO: 539286 - RNA, 22 nt, Human
gaguuauagauggacuauuauu

SEQ ID NO: 539287 - RNA, 22 nt, Human
uggcacugaccccaggccugug

SEQ ID NO: 539288 - RNA, 22 nt, Human
agggggcaucagguccuggcuc

SEQ ID NO: 539289 - RNA, 22 nt, Human
uaaagguaugucuuaaucaaac

SEQ ID NO: 539290 - RNA, 22 nt, Human
ugccugucucugacugccauua

SEQ ID NO: 539291 - RNA, 22 nt, Human
cccagcagccagaaugaggagc

SEQ ID NO: 539292 - RNA, 22 nt, Human
agucccagcuucccccaugcag

SEQ ID NO: 539293 - RNA, 22 nt, Human
caggaagcugugaaggagacgg

SEQ ID NO: 539294 - RNA, 22 nt, Human
ucugucacccaggcuggagugc

SEQ ID NO: 539295 - RNA, 22 nt, Human
ccugugugucugucacugcaca

SEQ ID NO: 539296 - RNA, 22 nt, Human
augauggugggagaugacccag

SEQ ID NO: 539297 - RNA, 22 nt, Human
agggcugccugacuccagagcc

SEQ ID NO: 539298 - RNA, 22 nt, Human
gagagugagauccuccugggga

SEQ ID NO: 539299 - RNA, 22 nt, Human
caagaauauauauggaguggag

SEQ ID NO: 539300 - RNA, 22 nt, Human
gucaggauuauuuuauuaaaag

SEQ ID NO: 539301 - RNA, 22 nt, Human
ucuaguucuagaucccugagga

SEQ ID NO: 539302 - RNA, 22 nt, Human
ucucagagggaaaggccaauuu

SEQ ID NO: 539303 - RNA, 22 nt, Human
acauuucuauagugcaucuguu

SEQ ID NO: 539304 - RNA, 22 nt, Human
uccugccucuuuucuuauucca

SEQ ID NO: 539305 - RNA, 22 nt, Human
gaaugcaaauauauggaucagu

SEQ ID NO: 539306 - RNA, 22 nt, Human
aguuuaugaaacacagauuuga

SEQ ID NO: 539307 - RNA, 22 nt, Human
uuugacaugugcuuauaacuuu

SEQ ID NO: 539308 - RNA, 22 nt, Human
ucuuccaagguugcacacuauc

SEQ ID NO: 539309 - RNA, 22 nt, Human
uauuugucagcuguugaguuca

SEQ ID NO: 539310 - RNA, 22 nt, Human
cugcacagagcagggcagacac

SEQ ID NO: 539311 - RNA, 22 nt, Human
uuuagcauguuccuuucauaga

SEQ ID NO: 539312 - RNA, 22 nt, Human
uuugaguugcuuauuuaauagg

SEQ ID NO: 539313 - RNA, 22 nt, Human
ucuuagcacagcuauauaaguu

SEQ ID NO: 539314 - RNA, 22 nt, Human
aggagugggggcgagaaguuaa

SEQ ID NO: 539315 - RNA, 22 nt, Human
cuuucauuugauaagaaugcca

SEQ ID NO: 539316 - RNA, 22 nt, Human
ggcugguguugagugccuguag

SEQ ID NO: 539317 - RNA, 19 nt, Human
gagcugccuuuugaagacc

SEQ ID NO: 539318 - RNA, 22 nt, Human
aagaccauugcuguauuuguag

SEQ ID NO: 539319 - RNA, 23 nt, Human
cuggucagaggcugcuggaaggg

SEQ ID NO: 539320 - RNA, 22 nt, Human
cuagucacucagcacugacaaa

SEQ ID NO: 539321 - RNA, 23 nt, Human
gggcuccagucucugcucaguug

SEQ ID NO: 539322 - RNA, 22 nt, Human
auacauaguucugugaaaagua

SEQ ID NO: 539323 - RNA, 22 nt, Human
ugcccaggcuggagugcagagg

SEQ ID NO: 539324 - RNA, 21 nt, Human
gcaggcuggucaaaccucagu

SEQ ID NO: 539325 - RNA, 22 nt, Human
ccaaagucuggagcagcagagc

SEQ ID NO: 539326 - RNA, 22 nt, Human
ugggccuucuaaucuggucccu

SEQ ID NO: 539327 - RNA, 22 nt, Human
aguguggguuuuauggagcccu

SEQ ID NO: 539328 - RNA, 22 nt, Human
uguuuaauucaccaucauguuc

SEQ ID NO: 539329 - RNA, 22 nt, Human
gguccuggaaauugacggaaag

SEQ ID NO: 539330 - RNA, 17 nt, Human
ggagagugggaauggcc

SEQ ID NO: 539331 - RNA, 22 nt, Human
ucuucccauuaguaaugaagug

SEQ ID NO: 539332 - RNA, 22 nt, Human
ugugauuauauuguaguacauu

SEQ ID NO: 539333 - RNA, 22 nt, Human
aacuguaauuuuuacauaguaa

SEQ ID NO: 539334 - RNA, 22 nt, Human
agcacacaggacuugauucaug

SEQ ID NO: 539335 - RNA, 22 nt, Human
uuugucuucauccuucgagcug

SEQ ID NO: 539336 - RNA, 22 nt, Human
uuuaaaaaacuagucugagucu

SEQ ID NO: 539337 - RNA, 22 nt, Human
uaccaaguguauuaugcuuugu

SEQ ID NO: 539338 - RNA, 22 nt, Human
acugccuggcagagguuugcaa

SEQ ID NO: 539339 - RNA, 23 nt, Human
acagcugcaccuggccgccuggc

SEQ ID NO: 539340 - RNA, 22 nt, Human
aagaauauuuccugcacuuggg

SEQ ID NO: 539341 - RNA, 22 nt, Human
uaagcaaaagucgagugugagc

SEQ ID NO: 539342 - RNA, 22 nt, Human
gaggccuggguuggaggugcau

SEQ ID NO: 539343 - RNA, 21 nt, Human
ugcccuggggcucuucccuca

SEQ ID NO: 539344 - RNA, 22 nt, Human
augcacagacccaaaggccauc

SEQ ID NO: 539345 - RNA, 22 nt, Human
aggucccaggcauagcuggucu

SEQ ID NO: 539346 - RNA, 22 nt, Human
gggccaggucggugaaugguca

SEQ ID NO: 539347 - RNA, 22 nt, Human
caguucaggccggcugacucag

SEQ ID NO: 539348 - RNA, 22 nt, Human
acauacauaugacaacuuuccu

SEQ ID NO: 539349 - RNA, 22 nt, Human
ucagcuuucucuucuaucgaua

SEQ ID NO: 539350 - RNA, 23 nt, Human
uuucuucucgaagagggagcuua

SEQ ID NO: 539351 - RNA, 22 nt, Human
cugggaagccacaggguguggg

SEQ ID NO: 539352 - RNA, 22 nt, Human
caggcacugugcuagauccuug

SEQ ID NO: 539353 - RNA, 22 nt, Human
aaggcccugucuccaaauacag

SEQ ID NO: 539354 - RNA, 18 nt, Human
ccugagcccugcuuacuu

SEQ ID NO: 539355 - RNA, 22 nt, Human
cagguggcuucucccuaggcca

SEQ ID NO: 539356 - RNA, 22 nt, Human
agauauuuaaaucagacaaaga

SEQ ID NO: 539357 - RNA, 23 nt, Human
uuauugcaagguaaaauugcuga

SEQ ID NO: 539358 - RNA, 22 nt, Human
auuauaaagaacaugugugugg

SEQ ID NO: 539359 - RNA, 18 nt, Human
ugaauagggguuugcaga

SEQ ID NO: 539360 - RNA, 22 nt, Human
acccaggagguggaggcugcag

SEQ ID NO: 539361 - RNA, 22 nt, Human
uaaaaugccagaccaguucacg

SEQ ID NO: 539362 - RNA, 22 nt, Human
aacuuuaaaaaauaugucuguu

SEQ ID NO: 539363 - RNA, 22 nt, Human
uuuacagucaccaaacuuugcu

SEQ ID NO: 539364 - RNA, 22 nt, Human
cuuaaauuuucaucuacaagaa

SEQ ID NO: 539365 - RNA, 22 nt, Human
acagagcaguaagaacacagcu

SEQ ID NO: 539366 - RNA, 22 nt, Human
augaaggauggcuggcugcccu

SEQ ID NO: 539367 - RNA, 19 nt, Human
uuucaaagggcauaagccu

SEQ ID NO: 539368 - RNA, 21 nt, Human
gagugcaggucugaugccauc

SEQ ID NO: 539369 - RNA, 22 nt, Human
guuauucaauggcuuauaagga

SEQ ID NO: 539370 - RNA, 22 nt, Human
gcucucuggaggccauggacag

SEQ ID NO: 539371 - RNA, 22 nt, Human
aacacuuucuuccuugcucagg

SEQ ID NO: 539372 - RNA, 20 nt, Human
ugaagaggaagaggacggcc

SEQ ID NO: 539373 - RNA, 22 nt, Human
caguuaaaggcccaauaucugg

SEQ ID NO: 539374 - RNA, 22 nt, Human
uggccucuuacgacauagccuu

SEQ ID NO: 539375 - RNA, 19 nt, Human
ugucucugaaagaugagcu

SEQ ID NO: 539376 - RNA, 22 nt, Human
ccucucccacguggcagaggcu

SEQ ID NO: 539377 - RNA, 22 nt, Human
ugucucugugacuccuuccgcc

SEQ ID NO: 539378 - RNA, 22 nt, Human
guccagaagcucaaguugaacu

SEQ ID NO: 539379 - RNA, 22 nt, Human
gaauacaaacuuaaggcuuuac

SEQ ID NO: 539380 - RNA, 22 nt, Human
cucugagagcggucuguggcuu

SEQ ID NO: 539381 - RNA, 22 nt, Human
ucuggcuccacuuucuucauuu

SEQ ID NO: 539382 - RNA, 22 nt, Human
uccauuuucaucucauguauaa

SEQ ID NO: 539383 - RNA, 22 nt, Human
agugcugaacauagaauggaca

SEQ ID NO: 539384 - RNA, 22 nt, Human
aaugggaagucacuacuguuac

SEQ ID NO: 539385 - RNA, 22 nt, Human
gcaguggcuaagcucgcaugca

SEQ ID NO: 539386 - RNA, 22 nt, Human
auucuuaauugccaugcuguau

SEQ ID NO: 539387 - RNA, 22 nt, Human
ccuggcaggccccuccuggauu

SEQ ID NO: 539388 - RNA, 22 nt, Human
uggagauggguuaauggagaga

SEQ ID NO: 539389 - RNA, 22 nt, Human
acaucucaugaaugauaaauca

SEQ ID NO: 539390 - RNA, 22 nt, Human
aaggcagggaaaguggauuagg

SEQ ID NO: 539391 - RNA, 22 nt, Human
ggcagggugccuggcuccuguu

SEQ ID NO: 539392 - RNA, 23 nt, Human
ugcugguguuuuugggaccaggg

SEQ ID NO: 539393 - RNA, 22 nt, Human
gcuggagcugaguucccugggc

SEQ ID NO: 539394 - RNA, 22 nt, Human
uucaggaucaaguugccaguag

SEQ ID NO: 539395 - RNA, 22 nt, Human
uccugagauguggagcuccaug

SEQ ID NO: 539396 - RNA, 22 nt, Human
ccacuguauuuuggaagcagau

SEQ ID NO: 539397 - RNA, 22 nt, Human
uugugcaauuuaaaaucuuccu

SEQ ID NO: 539398 - RNA, 18 nt, Human
gugagcagagagcaucac

SEQ ID NO: 539399 - RNA, 22 nt, Human
cugcagaggucuugcugauggu

SEQ ID NO: 539400 - RNA, 22 nt, Human
augccaggccccacgcugggca

SEQ ID NO: 539401 - RNA, 22 nt, Human
aucauaagacccagccaguauu

SEQ ID NO: 539402 - RNA, 22 nt, Human
gcuggucagggagggcacccau

SEQ ID NO: 539403 - RNA, 22 nt, Human
aaggcauauauucuaaacagga

SEQ ID NO: 539404 - RNA, 22 nt, Human
gugaggggaguaaagccauguu

SEQ ID NO: 539405 - RNA, 22 nt, Human
uggggcuggcacagucucuauu

SEQ ID NO: 539406 - RNA, 22 nt, Human
uugcccugcguuaccaucucuu

SEQ ID NO: 539407 - RNA, 20 nt, Human
uggcuccugcgguggaacca

SEQ ID NO: 539408 - RNA, 22 nt, Human
augcaaggacauguaaugaugu

SEQ ID NO: 539409 - RNA, 22 nt, Human
cucagaguggggcucccugagg

SEQ ID NO: 539410 - RNA, 22 nt, Human
uucuagauaucuaguguauaac

SEQ ID NO: 539411 - RNA, 22 nt, Human
aaggggaaaaaguguuaggagu

SEQ ID NO: 539412 - RNA, 22 nt, Human
acucagaggcagcugcucaccc

SEQ ID NO: 539413 - RNA, 22 nt, Human
uugggggcagagggagcaucug

SEQ ID NO: 539414 - RNA, 22 nt, Human
ugaaggcuguuggauggggaag

SEQ ID NO: 539415 - RNA, 20 nt, Human
aagcccauuaccaugcuugg

SEQ ID NO: 539416 - RNA, 20 nt, Human
uuucaaaggcaccuaugaag

SEQ ID NO: 539417 - RNA, 22 nt, Human
agaagcuuccuacauuguucuu

SEQ ID NO: 539418 - RNA, 22 nt, Human
ucaaaggcugcuugucuucugg

SEQ ID NO: 539419 - RNA, 22 nt, Human
uggagccuccucacacuguggc

SEQ ID NO: 539420 - RNA, 20 nt, Human
gucaggauuaguaaacucug

SEQ ID NO: 539421 - RNA, 22 nt, Human
gcccugugcgacucuagagguu

SEQ ID NO: 539422 - RNA, 21 nt, Human
uccugccuuaguccagagcag

SEQ ID NO: 539423 - RNA, 22 nt, Human
agaaauguuuauggcugccuau

SEQ ID NO: 539424 - RNA, 22 nt, Human
cagggagggacaauugucaccu

SEQ ID NO: 539425 - RNA, 22 nt, Human
agggacuugaugucagggagau

SEQ ID NO: 539426 - RNA, 22 nt, Human
cggcuggugucgggcacagcaa

SEQ ID NO: 539427 - RNA, 22 nt, Human
agcagggcuggauuuggcaaga

SEQ ID NO: 539428 - RNA, 22 nt, Human
gcagcccaaaaaagagguagau

SEQ ID NO: 539429 - RNA, 22 nt, Human
uucacauuauaaucaguucugc

SEQ ID NO: 539430 - RNA, 22 nt, Human
cugccuuugcccuugacacugu

SEQ ID NO: 539431 - RNA, 22 nt, Human
gaagagcuccaaaaacagugag

SEQ ID NO: 539432 - RNA, 22 nt, Human
uaugcauacaaugagauauucc

SEQ ID NO: 539433 - RNA, 22 nt, Human
aaauaugacuagaaugccaggu

SEQ ID NO: 539434 - RNA, 22 nt, Human
uuacacaugaagguccaauguu

SEQ ID NO: 539435 - RNA, 22 nt, Human
ucaguuuucauuucaugagcag

SEQ ID NO: 539436 - RNA, 22 nt, Human
cuugaauugggggaagaucacu

SEQ ID NO: 539437 - RNA, 22 nt, Human
ucuuuauuuuaugcuugugcaa

SEQ ID NO: 539438 - RNA, 22 nt, Human
gugucacaagagcccaggaaac

SEQ ID NO: 539439 - RNA, 22 nt, Human
uaggccagaggagcagcuuugg

SEQ ID NO: 539440 - RNA, 22 nt, Human
aggagagagcugagcuuugcug

SEQ ID NO: 539441 - RNA, 22 nt, Human
ccuggcagacugugagggcagg

SEQ ID NO: 539442 - RNA, 22 nt, Human
augcuucagugcuaccuucaaa

SEQ ID NO: 539443 - RNA, 22 nt, Human
cagaggcauuacugaaaaggug

SEQ ID NO: 539444 - RNA, 22 nt, Human
gagaaagggaacuuacagagug

SEQ ID NO: 539445 - RNA, 23 nt, Human
acagagguccaaacaguauaagc

SEQ ID NO: 539446 - RNA, 22 nt, Human
cugggccuggcguuccaggcug

SEQ ID NO: 539447 - RNA, 22 nt, Human
ucacagcagaauuuaggaggca

SEQ ID NO: 539448 - RNA, 22 nt, Human
gcugagggcuguaacagcagag

SEQ ID NO: 539449 - RNA, 22 nt, Human
ucacuguugaccuggaaguggg

SEQ ID NO: 539450 - RNA, 22 nt, Human
ggcugcagcagagggacucacg

SEQ ID NO: 539451 - RNA, 22 nt, Human
uugaaucauuacaauagauaag

SEQ ID NO: 539452 - RNA, 22 nt, Human
auggcagcaaaugucuggcugg

SEQ ID NO: 539453 - RNA, 22 nt, Human
ucgcuugaacccaggaagugga

SEQ ID NO: 539454 - RNA, 22 nt, Human
cagggcucaucugugugaccag

SEQ ID NO: 539455 - RNA, 22 nt, Human
gaagucugcugcucaggaguuu

SEQ ID NO: 539456 - RNA, 22 nt, Human
aggccuccuggcuccaggccuu

SEQ ID NO: 539457 - RNA, 22 nt, Human
aaaaguaauugaugcaaucgua

SEQ ID NO: 539458 - RNA, 22 nt, Human
aaauguuuaaguguaggagcaa

SEQ ID NO: 539459 - RNA, 22 nt, Human
ucauccaguaccauggaaggca

SEQ ID NO: 539460 - RNA, 22 nt, Human
uucaaacuaguuaaaagucaga

SEQ ID NO: 539461 - RNA, 22 nt, Human
uccuuuucccugaagguauuua

SEQ ID NO: 539462 - RNA, 22 nt, Human
ucucuuaauaaguaaauacuga

SEQ ID NO: 539463 - RNA, 22 nt, Human
gggcagcauucugugggcaggu

SEQ ID NO: 539464 - RNA, 22 nt, Human
uucauuuucuuucacgcugcug

SEQ ID NO: 539465 - RNA, 22 nt, Human
aauacagugaaagugagcaagg

SEQ ID NO: 539466 - RNA, 22 nt, Human
aucuuucagggccauuuguauu

SEQ ID NO: 539467 - RNA, 22 nt, Human
cuguggggagcugaucagauca

SEQ ID NO: 539468 - RNA, 22 nt, Human
ugagagcuguccaccuguggga

SEQ ID NO: 539469 - RNA, 22 nt, Human
uguacagucaugcuuucuguuc

SEQ ID NO: 539470 - RNA, 22 nt, Human
guucuggaagcuuuugagcaac

SEQ ID NO: 539471 - RNA, 20 nt, Human
ucauuacagugcuaagaugu

SEQ ID NO: 539472 - RNA, 22 nt, Human
ggugcagaggagccagcugggg

SEQ ID NO: 539473 - RNA, 17 nt, Human
caaggccagcaucuuca

SEQ ID NO: 539474 - RNA, 22 nt, Human
caugucuggguauaugcauaug

SEQ ID NO: 539475 - RNA, 22 nt, Human
uuguaugaccacaaucugacgu

SEQ ID NO: 539476 - RNA, 22 nt, Human
gaauacaagccugccaccugga

SEQ ID NO: 539477 - RNA, 22 nt, Human
cagggcaggacagauacauuac

SEQ ID NO: 539478 - RNA, 22 nt, Human
aaacuugaggcaaugaaggugu

SEQ ID NO: 539479 - RNA, 22 nt, Human
cuccucuuuacccgcauggucu

SEQ ID NO: 539480 - RNA, 22 nt, Human
uuuagcauuacuaaaaugaaaa

SEQ ID NO: 539481 - RNA, 22 nt, Human
ugccagcuccgaggagcugcag

SEQ ID NO: 539482 - RNA, 22 nt, Human
acaguauagggcuuauauugua

SEQ ID NO: 539483 - RNA, 22 nt, Human
uucucucauucaaauuaaagug

SEQ ID NO: 539484 - RNA, 22 nt, Human
acagagcaauucuuggguguuu

SEQ ID NO: 539485 - RNA, 22 nt, Human
agcugccaggccccugagaacc

SEQ ID NO: 539486 - RNA, 22 nt, Human
aauuucagaacccaaauuagcg

SEQ ID NO: 539487 - RNA, 22 nt, Human
ugccuguguaugugcaugcaca

SEQ ID NO: 539488 - RNA, 18 nt, Human
uggagcagguaggcauga

SEQ ID NO: 539489 - RNA, 22 nt, Human
aggagaaguaaggcuagaugau

SEQ ID NO: 539490 - RNA, 20 nt, Human
caccaggcgcucugagaaca

SEQ ID NO: 539491 - RNA, 22 nt, Human
cugcuguguggauucaauggcu

SEQ ID NO: 539492 - RNA, 22 nt, Human
uugaaaguagcagcugcauaug

SEQ ID NO: 539493 - RNA, 22 nt, Human
ugagccuggcggaagcagcgug

SEQ ID NO: 539494 - RNA, 22 nt, Human
uuauccaacaugacuuaugucc

SEQ ID NO: 539495 - RNA, 22 nt, Human
aaguuacauuuuggucuaauug

SEQ ID NO: 539496 - RNA, 22 nt, Human
ucaggaagugccuaggcuggcc

SEQ ID NO: 539497 - RNA, 22 nt, Human
acuguucauuuguccuguaucu

SEQ ID NO: 539498 - RNA, 22 nt, Human
agauaugacuagaagcucauuu

SEQ ID NO: 539499 - RNA, 22 nt, Human
cuguuuucaaagagagagaaug

SEQ ID NO: 539500 - RNA, 22 nt, Human
cagaaguaagauuacugugagu

SEQ ID NO: 539501 - RNA, 22 nt, Human
acacacuguaaggacuaucacu

SEQ ID NO: 539502 - RNA, 22 nt, Human
aucagaaauugcccagcuguuu

SEQ ID NO: 539503 - RNA, 22 nt, Human
uaagcaaaguuuauaaggcucu

SEQ ID NO: 539504 - RNA, 22 nt, Human
agggcucugagugggaaagagg

SEQ ID NO: 539505 - RNA, 22 nt, Human
ugggacagguuggagagaagca

SEQ ID NO: 539506 - RNA, 22 nt, Human
ggcaagagggcagauggagugc

SEQ ID NO: 539507 - RNA, 22 nt, Human
ggcaggugggaacccuccccac

SEQ ID NO: 539508 - RNA, 21 nt, Human
ugauuuaugcccaagucccug

SEQ ID NO: 539509 - RNA, 22 nt, Human
agcugaggcauggacaggcugc

SEQ ID NO: 539510 - RNA, 22 nt, Human
acauuugaaauucugaacagau

SEQ ID NO: 539511 - RNA, 22 nt, Human
ucaggcagaauuaucaaaagau

SEQ ID NO: 539512 - RNA, 22 nt, Human
ugaaaagucuuauauugucuga

SEQ ID NO: 539513 - RNA, 22 nt, Human
auggaaauacagccagagcaga

SEQ ID NO: 539514 - RNA, 22 nt, Human
uguacaguaggaacuuguuauu

SEQ ID NO: 539515 - RNA, 22 nt, Human
gcugcucucucccuaaguuggg

SEQ ID NO: 539516 - RNA, 22 nt, Human
gucucaguuuuccaaacuguca

SEQ ID NO: 539517 - RNA, 22 nt, Human
gccucuggggcagcugagucau

SEQ ID NO: 539518 - RNA, 22 nt, Human
ccugccaggcuuugggcuucug

SEQ ID NO: 539519 - RNA, 22 nt, Human
uaagaccaguaugcauuuucac

SEQ ID NO: 539520 - RNA, 22 nt, Human
uauaauccauucauugauuucu

SEQ ID NO: 539521 - RNA, 22 nt, Human
ugauuacauugguaauguuuau

SEQ ID NO: 539522 - RNA, 22 nt, Human
auuuuccagccuuucuagaacu

SEQ ID NO: 539523 - RNA, 21 nt, Human
accauuaacacccagguuucu

SEQ ID NO: 539524 - RNA, 22 nt, Human
uuugaaagacagaauauuuuug

SEQ ID NO: 539525 - RNA, 22 nt, Human
cuccucuggaaauuccucugcc

SEQ ID NO: 539526 - RNA, 22 nt, Human
cagggccagccgcagcauccac

SEQ ID NO: 539527 - RNA, 22 nt, Human
auagaauaugacuuuuagaucc

SEQ ID NO: 539528 - RNA, 22 nt, Human
ucacguuuuacugagugagaua

SEQ ID NO: 539529 - RNA, 22 nt, Human
aaaucaguuagugguaggauug

SEQ ID NO: 539530 - RNA, 22 nt, Human
cagcuacaaauacuuuuguaug

SEQ ID NO: 539531 - RNA, 22 nt, Human
gggcucuggauggagccugcag

SEQ ID NO: 539532 - RNA, 22 nt, Human
auuucuucaggucagaaauaga

SEQ ID NO: 539533 - RNA, 22 nt, Human
agccccaguaagggagggccug

SEQ ID NO: 539534 - RNA, 22 nt, Human
cacccacauggaaauucacagu

SEQ ID NO: 539535 - RNA, 22 nt, Human
gcugagggcauguguggcgacu

SEQ ID NO: 539536 - RNA, 22 nt, Human
cagcuccugccugggcagcugu

SEQ ID NO: 539537 - RNA, 22 nt, Human
ugggagagaauucuggugacug

SEQ ID NO: 539538 - RNA, 22 nt, Human
uuucuaaggcuaggucuuaagg

SEQ ID NO: 539539 - RNA, 22 nt, Human
augaaacuaaacuacauaaguu

SEQ ID NO: 539540 - RNA, 22 nt, Human
gccuggaaucaugcagggguua

SEQ ID NO: 539541 - RNA, 22 nt, Human
ucuugauuacaaauaacaucau

SEQ ID NO: 539542 - RNA, 20 nt, Human
uuccagagaucugcauuuua

SEQ ID NO: 539543 - RNA, 22 nt, Human
ucugaggccuugggacagaagu

SEQ ID NO: 539544 - RNA, 22 nt, Human
ccugcucugguuuagucagucu

SEQ ID NO: 539545 - RNA, 22 nt, Human
aacuuaaacccacucauguaga

SEQ ID NO: 539546 - RNA, 22 nt, Human
uuauguuuuauggcuauaucau

SEQ ID NO: 539547 - RNA, 22 nt, Human
agccuguccagaggacagggcu

SEQ ID NO: 539548 - RNA, 22 nt, Human
ccugcugggccugagcaaugag

SEQ ID NO: 539549 - RNA, 22 nt, Human
guggggcucccaucuccuggcu

SEQ ID NO: 539550 - RNA, 16 nt, Human
gagaagagcccggcag

SEQ ID NO: 539551 - RNA, 22 nt, Human
ggcucugggucuguggggagcg

SEQ ID NO: 539552 - RNA, 22 nt, Human
ucagcugaguucuagagcacuc

SEQ ID NO: 539553 - RNA, 22 nt, Human
gucuccagggcugcuggcgccu

SEQ ID NO: 539554 - RNA, 22 nt, Human
aaaagagaguugccagucugua

SEQ ID NO: 539555 - RNA, 20 nt, Human
uauaaauucagagcuuuggu

SEQ ID NO: 539556 - RNA, 22 nt, Human
uucacccuggaccagaaauugg

SEQ ID NO: 539557 - RNA, 22 nt, Human
ucugaggccuucagcaugaauc

SEQ ID NO: 539558 - RNA, 22 nt, Human
ugaaauaucauuuucaucuccc

SEQ ID NO: 539559 - RNA, 22 nt, Human
cacugaaggcugcagcucagcc

SEQ ID NO: 539560 - RNA, 22 nt, Human
caagggcagaggcagggccccg

SEQ ID NO: 539561 - RNA, 22 nt, Human
acuguggaugccaaaggggagg

SEQ ID NO: 539562 - RNA, 22 nt, Human
acagccuggacuggcucucugc

SEQ ID NO: 539563 - RNA, 22 nt, Human
ucucccacgguacaggauaaac

SEQ ID NO: 539564 - RNA, 22 nt, Human
cagagcugcagauugaaggcau

SEQ ID NO: 539565 - RNA, 22 nt, Human
ucauaaauugauuaugugcuuu

SEQ ID NO: 539566 - RNA, 21 nt, Human
auggagggaccagggaagcag

SEQ ID NO: 539567 - RNA, 20 nt, Human
uuacagaaaugauguuauuu

SEQ ID NO: 539568 - RNA, 22 nt, Human
guagcagaaucagugcuacaga

SEQ ID NO: 539569 - RNA, 22 nt, Human
ugcuccaggcugcugaagaucu

SEQ ID NO: 539570 - RNA, 22 nt, Human
caagauaucaaugacauaguau

SEQ ID NO: 539571 - RNA, 18 nt, Human
ggcugccuguuccugaag

SEQ ID NO: 539572 - RNA, 22 nt, Human
uagugcacacgcauguagcagu

SEQ ID NO: 539573 - RNA, 22 nt, Human
ucacagacaauuguuuuggugu

SEQ ID NO: 539574 - RNA, 22 nt, Human
ucugaaauguucucuuguuuug

SEQ ID NO: 539575 - RNA, 22 nt, Human
cuagagaaaggcaguggagcaa

SEQ ID NO: 539576 - RNA, 19 nt, Human
agguuacaggugucacaga

SEQ ID NO: 539577 - RNA, 22 nt, Human
uggcucugagacacaggcucuc

SEQ ID NO: 539578 - RNA, 22 nt, Human
uccugguggugccagcugcagg

SEQ ID NO: 539579 - RNA, 22 nt, Human
cccaggaaugggaaggaggaau

SEQ ID NO: 539580 - RNA, 22 nt, Human
gguuucaacuaaaucaagaagg

SEQ ID NO: 539581 - RNA, 22 nt, Human
cuucacaggcaagucuguuuuu

SEQ ID NO: 539582 - RNA, 22 nt, Human
ugcaggaauagcuacagagcug

SEQ ID NO: 539583 - RNA, 22 nt, Human
guauuuucaugauuucagacca

SEQ ID NO: 539584 - RNA, 22 nt, Human
aaaugcacaaagauuuugcacu

SEQ ID NO: 539585 - RNA, 22 nt, Human
ugcugucaagaaaacaagcaau

SEQ ID NO: 539586 - RNA, 19 nt, Human
cucugcccuacagaaagcu

SEQ ID NO: 539587 - RNA, 22 nt, Human
ugcaagaaaugugaagcuacaa

SEQ ID NO: 539588 - RNA, 20 nt, Human
ugcagcugcaggaggguggg

SEQ ID NO: 539589 - RNA, 22 nt, Human
augggcagacagggagcucacg

SEQ ID NO: 539590 - RNA, 22 nt, Human
cuguacagaagcuagagcaaau

SEQ ID NO: 539591 - RNA, 22 nt, Human
guacacacuguuugaucauuuc

SEQ ID NO: 539592 - RNA, 22 nt, Human
uggcuggcaaggcuggagucag

SEQ ID NO: 539593 - RNA, 22 nt, Human
ccacccagcagaggaggcaaga

SEQ ID NO: 539594 - RNA, 23 nt, Human
uggcugagcccacuaucuuggcc
